United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 6

SEQ ID NO: 205258 - DNA, 16 bp, Homo sapiens
aaaatgattgtaaaat

SEQ ID NO: 205259 - DNA, 20 bp, Homo sapiens
aaaatgattgtaaaatagct

SEQ ID NO: 205260 - DNA, 22 bp, Homo sapiens
aaaatgcattgaaagaattaga

SEQ ID NO: 205261 - DNA, 23 bp, Homo sapiens
aaaatgcatttaaactcatttga

SEQ ID NO: 205262 - DNA, 15 bp, Homo sapiens
aaaatgccaatctct

SEQ ID NO: 205263 - DNA, 12 bp, Homo sapiens
aaaatggaaaga

SEQ ID NO: 205264 - DNA, 14 bp, Homo sapiens
aaaatggaacatta

SEQ ID NO: 205265 - DNA, 23 bp, Homo sapiens
aaaatggacttttgttcatggga

SEQ ID NO: 205266 - DNA, 24 bp, Homo sapiens
aaaatgtaaaaaccctgctaaatg

SEQ ID NO: 205267 - DNA, 11 bp, Homo sapiens
aaaatgtaaat

SEQ ID NO: 205268 - DNA, 12 bp, Homo sapiens
aaaatgtgaagt

SEQ ID NO: 205269 - DNA, 18 bp, Homo sapiens
aaaatgtgccgtctttgg

SEQ ID NO: 205270 - DNA, 18 bp, Homo sapiens
aaaatgtgtctgcaacat

SEQ ID NO: 205271 - DNA, 20 bp, Homo sapiens
aaaatgtgtctgcaacatgg

SEQ ID NO: 205272 - DNA, 20 bp, Homo sapiens
ctagtgcagctgattttaac

SEQ ID NO: 205273 - DNA, 22 bp, Homo sapiens
ctagtgcagctgattttaacaa

SEQ ID NO: 205274 - DNA, 23 bp, Homo sapiens
ctagtgcagctgattttaacaat

SEQ ID NO: 205275 - DNA, 17 bp, Homo sapiens
ctagtgccatatatttt

SEQ ID NO: 205276 - DNA, 13 bp, Homo sapiens
ctagtgctgaagc

SEQ ID NO: 205277 - DNA, 14 bp, Homo sapiens
ctagtgctgaagct

SEQ ID NO: 205278 - DNA, 20 bp, Homo sapiens
ctagtgctgaagcttattaa

SEQ ID NO: 205279 - DNA, 20 bp, Homo sapiens
ctagtggaaagattgtgtct

SEQ ID NO: 205280 - DNA, 21 bp, Homo sapiens
ctagtggaaagattgtgtctg

SEQ ID NO: 205281 - DNA, 13 bp, Homo sapiens
ctagtggagagaa

SEQ ID NO: 205282 - DNA, 18 bp, Homo sapiens
ctagtgggagcccagcac

SEQ ID NO: 205283 - DNA, 18 bp, Homo sapiens
ctagtggggaggggcctg

SEQ ID NO: 205284 - DNA, 13 bp, Homo sapiens
ctagtggtctgat

SEQ ID NO: 205285 - DNA, 12 bp, Homo sapiens
ctagtggtggct

SEQ ID NO: 205286 - DNA, 17 bp, Homo sapiens
ctagtgtttctgcagag

SEQ ID NO: 205287 - DNA, 17 bp, Homo sapiens
aaaattcaaaaagtgtt

SEQ ID NO: 205288 - DNA, 13 bp, Homo sapiens
aaaattcaacaaa

SEQ ID NO: 205289 - DNA, 12 bp, Homo sapiens
aaaattcatagc

SEQ ID NO: 205290 - DNA, 20 bp, Homo sapiens
aaaattccagaaaggatatt

SEQ ID NO: 205291 - DNA, 12 bp, Homo sapiens
aaaattgatgtg

SEQ ID NO: 205292 - DNA, 21 bp, Homo sapiens
aaaattgtatagagatatgca

SEQ ID NO: 205293 - DNA, 13 bp, Homo sapiens
aaaattgtgatca

SEQ ID NO: 205294 - DNA, 19 bp, Homo sapiens
aaaattgtgtccacataat

SEQ ID NO: 205295 - DNA, 20 bp, Homo sapiens
aaaattgttaatttttccta

SEQ ID NO: 205296 - DNA, 15 bp, Homo sapiens
aaaatttaagcattg

SEQ ID NO: 205297 - DNA, 20 bp, Homo sapiens
aaaatttacctttaaaataa

SEQ ID NO: 205298 - DNA, 19 bp, Homo sapiens
aaaatttagaaatataatt

SEQ ID NO: 205299 - DNA, 14 bp, Homo sapiens
aaaatttgaaccaa

SEQ ID NO: 205300 - DNA, 22 bp, Homo sapiens
aaaatttgaaccaaaacattcc

SEQ ID NO: 205301 - DNA, 20 bp, Homo sapiens
aaaatttgatggtgaatatt

SEQ ID NO: 205302 - DNA, 21 bp, Homo sapiens
aaaattttataaaattaagca

SEQ ID NO: 205303 - DNA, 21 bp, Homo sapiens
aaacaaaaaaatttaaaaaga

SEQ ID NO: 205304 - DNA, 13 bp, Homo sapiens
aaacaaaaaacaa

SEQ ID NO: 205305 - DNA, 23 bp, Homo sapiens
aaacaaaaattcacaagctgcct

SEQ ID NO: 205306 - DNA, 13 bp, Homo sapiens
aaacaaaacttaa

SEQ ID NO: 205307 - DNA, 14 bp, Homo sapiens
aaacaaacaacctg

SEQ ID NO: 205308 - DNA, 19 bp, Homo sapiens
aaacaaactctactaattt

SEQ ID NO: 205309 - DNA, 19 bp, Homo sapiens
aaacaaaggatttgaaaac

SEQ ID NO: 205310 - DNA, 16 bp, Homo sapiens
aaacaaataatcacat

SEQ ID NO: 205311 - DNA, 14 bp, Homo sapiens
aaacaaatatgcaa

SEQ ID NO: 205312 - DNA, 12 bp, Homo sapiens
aaacaaatctca

SEQ ID NO: 205313 - DNA, 13 bp, Homo sapiens
aaacaacagcaac

SEQ ID NO: 205314 - DNA, 22 bp, Homo sapiens
aaacaaccattttttgttctgt

SEQ ID NO: 205315 - DNA, 22 bp, Homo sapiens
aaacaacctgccacaatgtgat

SEQ ID NO: 205316 - DNA, 17 bp, Homo sapiens
aaacaacgtgtatagtg

SEQ ID NO: 205317 - DNA, 18 bp, Homo sapiens
aaacaacgtgtatagtgc

SEQ ID NO: 205318 - DNA, 15 bp, Homo sapiens
aaacaagaaagtttc

SEQ ID NO: 205319 - DNA, 17 bp, Homo sapiens
aaacaagaaagtttccc

SEQ ID NO: 205320 - DNA, 21 bp, Homo sapiens
aaacaagtctcattagctctc

SEQ ID NO: 205321 - DNA, 17 bp, Homo sapiens
aaacaagtttagaaagc

SEQ ID NO: 205322 - DNA, 21 bp, Homo sapiens
aaacaataaacgaaacacaga

SEQ ID NO: 205323 - DNA, 16 bp, Homo sapiens
aaacaatatgctttac

SEQ ID NO: 205324 - DNA, 17 bp, Homo sapiens
aaacaatatttattgta

SEQ ID NO: 205325 - DNA, 18 bp, Homo sapiens
aaacaatcccaatctttc

SEQ ID NO: 205326 - DNA, 17 bp, Homo sapiens
aaacaatgcaaaacctt

SEQ ID NO: 205327 - DNA, 15 bp, Homo sapiens
aaacaatttaaattg

SEQ ID NO: 205328 - DNA, 20 bp, Homo sapiens
aaacaatttaaattgttata

SEQ ID NO: 205329 - DNA, 15 bp, Homo sapiens
aaacaatttgcataa

SEQ ID NO: 205330 - DNA, 16 bp, Homo sapiens
aaacacacagactctg

SEQ ID NO: 205331 - DNA, 16 bp, Homo sapiens
aaacacaccaggctgt

SEQ ID NO: 205332 - DNA, 18 bp, Homo sapiens
aaacacaccaggctgtgg

SEQ ID NO: 205333 - DNA, 17 bp, Homo sapiens
aaacacacttttgcaca

SEQ ID NO: 205334 - DNA, 23 bp, Homo sapiens
aaacacatacaaaagaattaaac

SEQ ID NO: 205335 - DNA, 16 bp, Homo sapiens
aaacacatcttcccta

SEQ ID NO: 205336 - DNA, 23 bp, Homo sapiens
aaacacattgcctaactactagt

SEQ ID NO: 205337 - DNA, 15 bp, Homo sapiens
aaacaccaagagtac

SEQ ID NO: 205338 - DNA, 13 bp, Homo sapiens
aaacacctcccca

SEQ ID NO: 205339 - DNA, 17 bp, Homo sapiens
aaacacctccccagccc

SEQ ID NO: 205340 - DNA, 14 bp, Homo sapiens
aaacacctgacaca

SEQ ID NO: 205341 - DNA, 23 bp, Homo sapiens
aaacactagtaccttcagatcct

SEQ ID NO: 205342 - DNA, 24 bp, Homo sapiens
aaacactcagttgttcaataataa

SEQ ID NO: 205343 - DNA, 16 bp, Homo sapiens
aaacactcgtgtgcat

SEQ ID NO: 205344 - DNA, 17 bp, Homo sapiens
aaacactcgtgtgcatg

SEQ ID NO: 205345 - DNA, 14 bp, Homo sapiens
aaacactgtaatct

SEQ ID NO: 205346 - DNA, 21 bp, Homo sapiens
aaacactgtaatcttaaaagt

SEQ ID NO: 205347 - DNA, 16 bp, Homo sapiens
aaacactgtattgtaa

SEQ ID NO: 205348 - DNA, 14 bp, Homo sapiens
aaacactttcaaaa

SEQ ID NO: 205349 - DNA, 15 bp, Homo sapiens
aaacactttcctgga

SEQ ID NO: 205350 - DNA, 13 bp, Homo sapiens
aaacagaaaaaaa

SEQ ID NO: 205351 - DNA, 15 bp, Homo sapiens
aaacagaaaaaaaac

SEQ ID NO: 205352 - DNA, 22 bp, Homo sapiens
aaacagaaacgagatttgccaa

SEQ ID NO: 205353 - DNA, 13 bp, Homo sapiens
aaacagaacattt

SEQ ID NO: 205354 - DNA, 22 bp, Homo sapiens
aaacagaaggtaataggaagaa

SEQ ID NO: 205355 - DNA, 14 bp, Homo sapiens
aaacagaggatgct

SEQ ID NO: 205356 - DNA, 20 bp, Homo sapiens
aaacagagtccaatttaagg

SEQ ID NO: 205357 - DNA, 12 bp, Homo sapiens
aaacagatataa

SEQ ID NO: 205358 - DNA, 15 bp, Homo sapiens
aaacagcatcaaaat

SEQ ID NO: 205359 - DNA, 19 bp, Homo sapiens
aaacagcatcaaaatacaa

SEQ ID NO: 205360 - DNA, 14 bp, Homo sapiens
aaacagccatgtcc

SEQ ID NO: 205361 - DNA, 22 bp, Homo sapiens
aaacagccgtcagccaaatgta

SEQ ID NO: 205362 - DNA, 14 bp, Homo sapiens
aaacagctcaggct

SEQ ID NO: 205363 - DNA, 16 bp, Homo sapiens
aaacagctgtctctaa

SEQ ID NO: 205364 - DNA, 20 bp, Homo sapiens
aaacagcttcatgcctttgt

SEQ ID NO: 205365 - DNA, 22 bp, Homo sapiens
aaacagcttcatgcctttgtaa

SEQ ID NO: 205366 - DNA, 17 bp, Homo sapiens
aaacagtgaatcttatg

SEQ ID NO: 205367 - DNA, 20 bp, Homo sapiens
aaacagtgtggatgtaaatt

SEQ ID NO: 205368 - DNA, 22 bp, Homo sapiens
aaacagtgtggcttaaacattt

SEQ ID NO: 205369 - DNA, 13 bp, Homo sapiens
aaacagtgtttat

SEQ ID NO: 205370 - DNA, 14 bp, Homo sapiens
aaacagttaacttt

SEQ ID NO: 205371 - DNA, 18 bp, Homo sapiens
aaacagttaactttcaga

SEQ ID NO: 205372 - DNA, 14 bp, Homo sapiens
aaacataagacgac

SEQ ID NO: 205373 - DNA, 18 bp, Homo sapiens
aaacataagacgacttat

SEQ ID NO: 205374 - DNA, 16 bp, Homo sapiens
aaacataagagagcct

SEQ ID NO: 205375 - DNA, 14 bp, Homo sapiens
aaacataatatctt

SEQ ID NO: 205376 - DNA, 19 bp, Homo sapiens
aaacatcaaataaatttct

SEQ ID NO: 205377 - DNA, 12 bp, Homo sapiens
aaacatgaaaac

SEQ ID NO: 205378 - DNA, 16 bp, Homo sapiens
aaacatgaatttaatg

SEQ ID NO: 205379 - DNA, 24 bp, Homo sapiens
aaacatgctaaatagttctatcag

SEQ ID NO: 205380 - DNA, 17 bp, Homo sapiens
aaacatggcctttgctt

SEQ ID NO: 205381 - DNA, 18 bp, Homo sapiens
aaacatgtacaaaatcga

SEQ ID NO: 205382 - DNA, 13 bp, Homo sapiens
aaacatgtgcaac

SEQ ID NO: 205383 - DNA, 21 bp, Homo sapiens
aaacatgtgcaactcttgtat

SEQ ID NO: 205384 - DNA, 23 bp, Homo sapiens
aaacatgtgcaactcttgtattg

SEQ ID NO: 205385 - DNA, 15 bp, Homo sapiens
aaacattaaaagaag

SEQ ID NO: 205386 - DNA, 15 bp, Homo sapiens
aaacattaaacactg

SEQ ID NO: 205387 - DNA, 18 bp, Homo sapiens
aaacattaaacactgtaa

SEQ ID NO: 205388 - DNA, 15 bp, Homo sapiens
aaacattagaagaaa

SEQ ID NO: 205389 - DNA, 16 bp, Homo sapiens
aaacattagaagaaaa

SEQ ID NO: 205390 - DNA, 20 bp, Homo sapiens
aaacattagaagaaaacata

SEQ ID NO: 205391 - DNA, 23 bp, Homo sapiens
aaacattcacacagggctctttg

SEQ ID NO: 205392 - DNA, 14 bp, Homo sapiens
aaacattccagatg

SEQ ID NO: 205393 - DNA, 15 bp, Homo sapiens
aaacattcctccagc

SEQ ID NO: 205394 - DNA, 19 bp, Homo sapiens
aaacattcctccagcctcc

SEQ ID NO: 205395 - DNA, 13 bp, Homo sapiens
aaacattcttatt

SEQ ID NO: 205396 - DNA, 15 bp, Homo sapiens
aaacatttgacacat

SEQ ID NO: 205397 - DNA, 22 bp, Homo sapiens
aaacatttgacacataaaagta

SEQ ID NO: 205398 - DNA, 11 bp, Homo sapiens
aaaccaaaaca

SEQ ID NO: 205399 - DNA, 16 bp, Homo sapiens
aaaccacacttcttga

SEQ ID NO: 205400 - DNA, 23 bp, Homo sapiens
aaaccaccagtgcccaaagtctg

SEQ ID NO: 205401 - DNA, 14 bp, Homo sapiens
aaaccaccctgagg

SEQ ID NO: 205402 - DNA, 17 bp, Homo sapiens
ctatggactgcacaaaa

SEQ ID NO: 205403 - DNA, 22 bp, Homo sapiens
ctatggagcaaaacaaagctga

SEQ ID NO: 205404 - DNA, 22 bp, Homo sapiens
ctatggattcacttctatttat

SEQ ID NO: 205405 - DNA, 17 bp, Homo sapiens
ctatggctgagttctgg

SEQ ID NO: 205406 - DNA, 21 bp, Homo sapiens
ctatggctgtatttttagaga

SEQ ID NO: 205407 - DNA, 18 bp, Homo sapiens
ctatgggaagctctgtgt

SEQ ID NO: 205408 - DNA, 19 bp, Homo sapiens
ctatgggaagctctgtgtg

SEQ ID NO: 205409 - DNA, 13 bp, Homo sapiens
ctatgggagcccc

SEQ ID NO: 205410 - DNA, 16 bp, Homo sapiens
ctatgggagccccagg

SEQ ID NO: 205411 - DNA, 19 bp, Homo sapiens
ctatgggagccccagggtc

SEQ ID NO: 205412 - DNA, 22 bp, Homo sapiens
ctatgggtatcaaacagctcag

SEQ ID NO: 205413 - DNA, 12 bp, Homo sapiens
ctatggtaaaga

SEQ ID NO: 205414 - DNA, 16 bp, Homo sapiens
ctatgtaaattattgt

SEQ ID NO: 205415 - DNA, 17 bp, Homo sapiens
ctatgtaaattattgta

SEQ ID NO: 205416 - DNA, 19 bp, Homo sapiens
ctatgtaatgcttatgtgt

SEQ ID NO: 205417 - DNA, 17 bp, Homo sapiens
ctatgtatgtaaaatat

SEQ ID NO: 205418 - DNA, 21 bp, Homo sapiens
ctatgtatgtgccaattttgt

SEQ ID NO: 205419 - DNA, 14 bp, Homo sapiens
ctatgtcatttcta

SEQ ID NO: 205420 - DNA, 23 bp, Homo sapiens
ctatgtcctaaggacacactaat

SEQ ID NO: 205421 - DNA, 17 bp, Homo sapiens
ctatgtgagcacaaagg

SEQ ID NO: 205422 - DNA, 13 bp, Homo sapiens
ctatgtgctgggt

SEQ ID NO: 205423 - DNA, 16 bp, Homo sapiens
ctatgtgctgggtgcc

SEQ ID NO: 205424 - DNA, 15 bp, Homo sapiens
ctatgtggcagctgg

SEQ ID NO: 205425 - DNA, 18 bp, Homo sapiens
aaacctccatcctgccag

SEQ ID NO: 205426 - DNA, 15 bp, Homo sapiens
aaacctctatatgtt

SEQ ID NO: 205427 - DNA, 20 bp, Homo sapiens
aaacctcttctgtatttttt

SEQ ID NO: 205428 - DNA, 16 bp, Homo sapiens
aaacctgaaaaaaagt

SEQ ID NO: 205429 - DNA, 14 bp, Homo sapiens
aaacctgatgttaa

SEQ ID NO: 205430 - DNA, 19 bp, Homo sapiens
aaacctgatgttaaaattc

SEQ ID NO: 205431 - DNA, 12 bp, Homo sapiens
aaacctgcattt

SEQ ID NO: 205432 - DNA, 17 bp, Homo sapiens
aaacctgccctgcctga

SEQ ID NO: 205433 - DNA, 14 bp, Homo sapiens
aaacctgtgccagg

SEQ ID NO: 205434 - DNA, 22 bp, Homo sapiens
aaacctgtgtctctgagagtag

SEQ ID NO: 205435 - DNA, 17 bp, Homo sapiens
aaacctgttatgccaaa

SEQ ID NO: 205436 - DNA, 18 bp, Homo sapiens
aaaccttattgtacctct

SEQ ID NO: 205437 - DNA, 15 bp, Homo sapiens
aaaccttgtgactca

SEQ ID NO: 205438 - DNA, 12 bp, Homo sapiens
aaaccttgtttc

SEQ ID NO: 205439 - DNA, 18 bp, Homo sapiens
aaaccttgtttctttctg

SEQ ID NO: 205440 - DNA, 17 bp, Homo sapiens
aaaccttgtttgtttta

SEQ ID NO: 205441 - DNA, 20 bp, Homo sapiens
aaaccttttggaaaatctgc

SEQ ID NO: 205442 - DNA, 16 bp, Homo sapiens
aaacgaaaataaagta

SEQ ID NO: 205443 - DNA, 14 bp, Homo sapiens
aaacgaaacattta

SEQ ID NO: 205444 - DNA, 13 bp, Homo sapiens
aaacgaatataag

SEQ ID NO: 205445 - DNA, 16 bp, Homo sapiens
aaacgcattaagaggt

SEQ ID NO: 205446 - DNA, 17 bp, Homo sapiens
aaacgtaatttgttata

SEQ ID NO: 205447 - DNA, 16 bp, Homo sapiens
aaacgtgccccccagt

SEQ ID NO: 205448 - DNA, 14 bp, Homo sapiens
aaacgtttcagtaa

SEQ ID NO: 205449 - DNA, 21 bp, Homo sapiens
aaacgttttattgtgttttta

SEQ ID NO: 205450 - DNA, 21 bp, Homo sapiens
aaactaaggaaccctggaaac

SEQ ID NO: 205451 - DNA, 16 bp, Homo sapiens
aaactaatattttatg

SEQ ID NO: 205452 - DNA, 22 bp, Homo sapiens
aaactacacatccctaatgtgt

SEQ ID NO: 205453 - DNA, 20 bp, Homo sapiens
aaactaccagtgggcatgta

SEQ ID NO: 205454 - DNA, 23 bp, Homo sapiens
aaactaccagtgggcatgtatta

SEQ ID NO: 205455 - DNA, 14 bp, Homo sapiens
aaactactgtacat

SEQ ID NO: 205456 - DNA, 13 bp, Homo sapiens
aaactactttctt

SEQ ID NO: 205457 - DNA, 21 bp, Homo sapiens
aaactagacttgaggaaacca

SEQ ID NO: 205458 - DNA, 16 bp, Homo sapiens
aaactagattgactat

SEQ ID NO: 205459 - DNA, 17 bp, Homo sapiens
aaactaggaaatttttt

SEQ ID NO: 205460 - DNA, 17 bp, Homo sapiens
aaactaggcatttgtaa

SEQ ID NO: 205461 - DNA, 20 bp, Homo sapiens
aaactaggcatttgtaaata

SEQ ID NO: 205462 - DNA, 19 bp, Homo sapiens
aaactagggttttggcctg

SEQ ID NO: 205463 - DNA, 16 bp, Homo sapiens
aaactagtaaagacat

SEQ ID NO: 205464 - DNA, 14 bp, Homo sapiens
aaactataggtaat

SEQ ID NO: 205465 - DNA, 23 bp, Homo sapiens
aaactatccaattaaaattaagg

SEQ ID NO: 205466 - DNA, 21 bp, Homo sapiens
aaactatcggttcaagttgat

SEQ ID NO: 205467 - DNA, 21 bp, Homo sapiens
aaactatggttcccaataaaa

SEQ ID NO: 205468 - DNA, 23 bp, Homo sapiens
aaactatggttcccaataaaagt

SEQ ID NO: 205469 - DNA, 17 bp, Homo sapiens
aaactattcagaggaaa

SEQ ID NO: 205470 - DNA, 20 bp, Homo sapiens
aaactattggaaagtactcc

SEQ ID NO: 205471 - DNA, 21 bp, Homo sapiens
aaactatttaaaattggcacc

SEQ ID NO: 205472 - DNA, 13 bp, Homo sapiens
aaactcaaaactt

SEQ ID NO: 205473 - DNA, 18 bp, Homo sapiens
aaactcaaaacttaacat

SEQ ID NO: 205474 - DNA, 19 bp, Homo sapiens
aaactcaaaacttaacata

SEQ ID NO: 205475 - DNA, 15 bp, Homo sapiens
aaactcaaacttttc

SEQ ID NO: 205476 - DNA, 15 bp, Homo sapiens
aaactcaccatttca

SEQ ID NO: 205477 - DNA, 16 bp, Homo sapiens
aaactcacctgctggc

SEQ ID NO: 205478 - DNA, 20 bp, Homo sapiens
aaactcacctgctggcccct

SEQ ID NO: 205479 - DNA, 22 bp, Homo sapiens
aaactcacctgctggcccctca

SEQ ID NO: 205480 - DNA, 13 bp, Homo sapiens
aaactcagatgtc

SEQ ID NO: 205481 - DNA, 17 bp, Homo sapiens
aaactcagatgtccaaa

SEQ ID NO: 205482 - DNA, 17 bp, Homo sapiens
aaactccacagggactg

SEQ ID NO: 205483 - DNA, 11 bp, Homo sapiens
aaactcctgcc

SEQ ID NO: 205484 - DNA, 18 bp, Homo sapiens
aaactcgtctgatgtttt

SEQ ID NO: 205485 - DNA, 18 bp, Homo sapiens
aaactctaagtgtaaaaa

SEQ ID NO: 205486 - DNA, 15 bp, Homo sapiens
aaactctactaattt

SEQ ID NO: 205487 - DNA, 12 bp, Homo sapiens
aaactcttcaag

SEQ ID NO: 205488 - DNA, 18 bp, Homo sapiens
aaactcttcaaggccaag

SEQ ID NO: 205489 - DNA, 14 bp, Homo sapiens
aaactctttaactt

SEQ ID NO: 205490 - DNA, 23 bp, Homo sapiens
aaactgaaagtgttttactcttt

SEQ ID NO: 205491 - DNA, 20 bp, Homo sapiens
aaactgactttttcccccca

SEQ ID NO: 205492 - DNA, 12 bp, Homo sapiens
aaactgcaatag

SEQ ID NO: 205493 - DNA, 16 bp, Homo sapiens
aaactgcaatagagac

SEQ ID NO: 205494 - DNA, 17 bp, Homo sapiens
aaactgcctgaaagcaa

SEQ ID NO: 205495 - DNA, 21 bp, Homo sapiens
aaactgcttttttttttccag

SEQ ID NO: 205496 - DNA, 22 bp, Homo sapiens
aaactgcttttttttttccagc

SEQ ID NO: 205497 - DNA, 19 bp, Homo sapiens
aaactggaacggtgaaggt

SEQ ID NO: 205498 - DNA, 21 bp, Homo sapiens
aaactggcatctgacacaaaa

SEQ ID NO: 205499 - DNA, 16 bp, Homo sapiens
aaactggggcctccct

SEQ ID NO: 205500 - DNA, 18 bp, Homo sapiens
aaactgtagaaatgatga

SEQ ID NO: 205501 - DNA, 12 bp, Homo sapiens
aaactgtccctt

SEQ ID NO: 205502 - DNA, 10 bp, Homo sapiens
aaactgtgac

SEQ ID NO: 205503 - DNA, 14 bp, Homo sapiens
aaactgtgacattc

SEQ ID NO: 205504 - DNA, 17 bp, Homo sapiens
aaactgtgagataaata

SEQ ID NO: 205505 - DNA, 16 bp, Homo sapiens
aaactgtgtctgtccc

SEQ ID NO: 205506 - DNA, 14 bp, Homo sapiens
aaactgttctctat

SEQ ID NO: 205507 - DNA, 16 bp, Homo sapiens
aaactgtttatggtat

SEQ ID NO: 205508 - DNA, 14 bp, Homo sapiens
aaactgttttcatg

SEQ ID NO: 205509 - DNA, 21 bp, Homo sapiens
aaacttactgtcagagaatat

SEQ ID NO: 205510 - DNA, 22 bp, Homo sapiens
aaacttagaataaaattgtaaa

SEQ ID NO: 205511 - DNA, 15 bp, Homo sapiens
aaacttagtttgtga

SEQ ID NO: 205512 - DNA, 10 bp, Homo sapiens
aaacttattt

SEQ ID NO: 205513 - DNA, 12 bp, Homo sapiens
aaacttatttga

SEQ ID NO: 205514 - DNA, 12 bp, Homo sapiens
aaacttcaaagc

SEQ ID NO: 205515 - DNA, 11 bp, Homo sapiens
aaacttcagca

SEQ ID NO: 205516 - DNA, 12 bp, Homo sapiens
aaacttcagcaa

SEQ ID NO: 205517 - DNA, 16 bp, Homo sapiens
aaacttccaagacctg

SEQ ID NO: 205518 - DNA, 18 bp, Homo sapiens
aaacttccattctttctt

SEQ ID NO: 205519 - DNA, 21 bp, Homo sapiens
aaacttgagttggagtactat

SEQ ID NO: 205520 - DNA, 18 bp, Homo sapiens
aaacttgctttatgcctt

SEQ ID NO: 205521 - DNA, 13 bp, Homo sapiens
aaacttgtcagaa

SEQ ID NO: 205522 - DNA, 20 bp, Homo sapiens
aaactttacccaaaaactaa

SEQ ID NO: 205523 - DNA, 15 bp, Homo sapiens
aaactttattttata

SEQ ID NO: 205524 - DNA, 16 bp, Homo sapiens
aaactttgtcacttct

SEQ ID NO: 205525 - DNA, 20 bp, Homo sapiens
aaactttgttatatatatca

SEQ ID NO: 205526 - DNA, 17 bp, Homo sapiens
aaacttttataaattaa

SEQ ID NO: 205527 - DNA, 18 bp, Homo sapiens
aaacttttataaattaaa

SEQ ID NO: 205528 - DNA, 19 bp, Homo sapiens
aaacttttataaattaaat

SEQ ID NO: 205529 - DNA, 20 bp, Homo sapiens
aaacttttattgtaaatgag

SEQ ID NO: 205530 - DNA, 15 bp, Homo sapiens
aaactttttcaatgg

SEQ ID NO: 205531 - DNA, 19 bp, Homo sapiens
aaagaaaaaaaaggcagta

SEQ ID NO: 205532 - DNA, 13 bp, Homo sapiens
aaagaaaaaaaat

SEQ ID NO: 205533 - DNA, 12 bp, Homo sapiens
ggctctttcaga

SEQ ID NO: 205534 - DNA, 13 bp, Homo sapiens
ggctctttcagag

SEQ ID NO: 205535 - DNA, 14 bp, Homo sapiens
ggctctttccttgc

SEQ ID NO: 205536 - DNA, 17 bp, Homo sapiens
ggctctttccttgctca

SEQ ID NO: 205537 - DNA, 19 bp, Homo sapiens
ggctgaaaagtgctttgct

SEQ ID NO: 205538 - DNA, 20 bp, Homo sapiens
ggctgaaagaggccaatgcc

SEQ ID NO: 205539 - DNA, 14 bp, Homo sapiens
ggctgaaattatgt

SEQ ID NO: 205540 - DNA, 22 bp, Homo sapiens
ggctgaaattatgtcaaatgga

SEQ ID NO: 205541 - DNA, 17 bp, Homo sapiens
ggctgacacctaccatg

SEQ ID NO: 205542 - DNA, 19 bp, Homo sapiens
ggctgacacctaccatgct

SEQ ID NO: 205543 - DNA, 20 bp, Homo sapiens
ggctgacacctaccatgctg

SEQ ID NO: 205544 - DNA, 21 bp, Homo sapiens
ggctgacacctaccatgctgc

SEQ ID NO: 205545 - DNA, 22 bp, Homo sapiens
ggctgacacctaccatgctgct

SEQ ID NO: 205546 - DNA, 24 bp, Homo sapiens
ggctgacacgtccaccccagtgca

SEQ ID NO: 205547 - DNA, 14 bp, Homo sapiens
ggctgacagagcag

SEQ ID NO: 205548 - DNA, 18 bp, Homo sapiens
ggctgacagagcaggtct

SEQ ID NO: 205549 - DNA, 20 bp, Homo sapiens
ggctgacagagcaggtctgc

SEQ ID NO: 205550 - DNA, 14 bp, Homo sapiens
ggctgactggggct

SEQ ID NO: 205551 - DNA, 22 bp, Homo sapiens
ggctgactgggggcctctgcct

SEQ ID NO: 205552 - DNA, 17 bp, Homo sapiens
ggctgagactgcagagg

SEQ ID NO: 205553 - DNA, 21 bp, Homo sapiens
ggctgagactgcagaggagcc

SEQ ID NO: 205554 - DNA, 14 bp, Homo sapiens
ggctgagagcccca

SEQ ID NO: 205555 - DNA, 13 bp, Homo sapiens
ggctgagccccta

SEQ ID NO: 205556 - DNA, 16 bp, Homo sapiens
ggctgagcccctaccc

SEQ ID NO: 205557 - DNA, 18 bp, Homo sapiens
ggctgagcccctcctctc

SEQ ID NO: 205558 - DNA, 21 bp, Homo sapiens
ggctgaggaagcacagcagca

SEQ ID NO: 205559 - DNA, 19 bp, Homo sapiens
ggctgaggacggggcagag

SEQ ID NO: 205560 - DNA, 14 bp, Homo sapiens
ggctgaggcctgga

SEQ ID NO: 205561 - DNA, 19 bp, Homo sapiens
ggctgaggggcaacgaaga

SEQ ID NO: 205562 - DNA, 21 bp, Homo sapiens
ggctgagttctggtcaaagaa

SEQ ID NO: 205563 - DNA, 16 bp, Homo sapiens
ggctgcaagctgcagg

SEQ ID NO: 205564 - DNA, 16 bp, Homo sapiens
ctatgtggcagctggg

SEQ ID NO: 205565 - DNA, 22 bp, Homo sapiens
ctatgtttctcagactggtctc

SEQ ID NO: 205566 - DNA, 19 bp, Homo sapiens
ctattaagaaaatcacatt

SEQ ID NO: 205567 - DNA, 16 bp, Homo sapiens
ctattaagcagtaaaa

SEQ ID NO: 205568 - DNA, 19 bp, Homo sapiens
ctattaatcacctctctgt

SEQ ID NO: 205569 - DNA, 12 bp, Homo sapiens
ctattacaaata

SEQ ID NO: 205570 - DNA, 14 bp, Homo sapiens
ctattactctgaca

SEQ ID NO: 205571 - DNA, 18 bp, Homo sapiens
ctattagactttagaaat

SEQ ID NO: 205572 - DNA, 20 bp, Homo sapiens
ctattagactttagaaataa

SEQ ID NO: 205573 - DNA, 23 bp, Homo sapiens
ctattaggctataagaagtagca

SEQ ID NO: 205574 - DNA, 14 bp, Homo sapiens
ctattatattaaaa

SEQ ID NO: 205575 - DNA, 13 bp, Homo sapiens
ctattcaaaataa

SEQ ID NO: 205576 - DNA, 23 bp, Homo sapiens
ctattcaaggtggccaaattatt

SEQ ID NO: 205577 - DNA, 14 bp, Homo sapiens
ctattcacacacac

SEQ ID NO: 205578 - DNA, 19 bp, Homo sapiens
ctattcagaataaatgggt

SEQ ID NO: 205579 - DNA, 23 bp, Homo sapiens
ctattcagaatcaaaccttttta

SEQ ID NO: 205580 - DNA, 13 bp, Homo sapiens
ctattcagacaag

SEQ ID NO: 205581 - DNA, 14 bp, Homo sapiens
ctattcagacaagc

SEQ ID NO: 205582 - DNA, 12 bp, Homo sapiens
ctattcccaggc

SEQ ID NO: 205583 - DNA, 14 bp, Homo sapiens
ctattcccaggcag

SEQ ID NO: 205584 - DNA, 16 bp, Homo sapiens
ctattcccaggcaggg

SEQ ID NO: 205585 - DNA, 14 bp, Homo sapiens
ctattccctggaga

SEQ ID NO: 205586 - DNA, 23 bp, Homo sapiens
ctattccctttgacttcagctgc

SEQ ID NO: 205587 - DNA, 18 bp, Homo sapiens
ctattcttaagcactttg

SEQ ID NO: 205588 - DNA, 19 bp, Homo sapiens
ctattgatgtacagtctgt

SEQ ID NO: 205589 - DNA, 16 bp, Homo sapiens
ctattgcagatatttg

SEQ ID NO: 205590 - DNA, 19 bp, Homo sapiens
ctattgccaggaatgtttc

SEQ ID NO: 205591 - DNA, 21 bp, Homo sapiens
ctattgccaggaatgtttcag

SEQ ID NO: 205592 - DNA, 15 bp, Homo sapiens
ctattgctgtaaata

SEQ ID NO: 205593 - DNA, 19 bp, Homo sapiens
ctattggacagacacagag

SEQ ID NO: 205594 - DNA, 15 bp, Homo sapiens
ctattgggttcatta

SEQ ID NO: 205595 - DNA, 24 bp, Homo sapiens
ctattggtaatataataatgtcct

SEQ ID NO: 205596 - DNA, 16 bp, Homo sapiens
ctattgtagcatttct

SEQ ID NO: 205597 - DNA, 18 bp, Homo sapiens
ctattgttagtctcttga

SEQ ID NO: 205598 - DNA, 16 bp, Homo sapiens
ctattgttgtgggctt

SEQ ID NO: 205599 - DNA, 16 bp, Homo sapiens
ctattgtttagatatt

SEQ ID NO: 205600 - DNA, 14 bp, Homo sapiens
ctatttaaaattgg

SEQ ID NO: 205601 - DNA, 15 bp, Homo sapiens
ctatttaaaattggc

SEQ ID NO: 205602 - DNA, 15 bp, Homo sapiens
ctatttaacttgagg

SEQ ID NO: 205603 - DNA, 10 bp, Homo sapiens
ctatttaagc

SEQ ID NO: 205604 - DNA, 21 bp, Homo sapiens
ctatttaagttatcaacttta

SEQ ID NO: 205605 - DNA, 14 bp, Homo sapiens
ctatttagagatat

SEQ ID NO: 205606 - DNA, 23 bp, Homo sapiens
ctatttagcatgacaagccccag

SEQ ID NO: 205607 - DNA, 16 bp, Homo sapiens
ctatttatctgtctga

SEQ ID NO: 205608 - DNA, 19 bp, Homo sapiens
ctatttattccctgttaaa

SEQ ID NO: 205609 - DNA, 15 bp, Homo sapiens
ctatttatttactga

SEQ ID NO: 205610 - DNA, 22 bp, Homo sapiens
ctatttccccaggggaaaatga

SEQ ID NO: 205611 - DNA, 23 bp, Homo sapiens
ctatttccccaggggaaaatgaa

SEQ ID NO: 205612 - DNA, 14 bp, Homo sapiens
ctatttcctttgcg

SEQ ID NO: 205613 - DNA, 16 bp, Homo sapiens
ctatttctctccccac

SEQ ID NO: 205614 - DNA, 15 bp, Homo sapiens
ctatttctttaatct

SEQ ID NO: 205615 - DNA, 14 bp, Homo sapiens
ctatttgactgctt

SEQ ID NO: 205616 - DNA, 17 bp, Homo sapiens
ctatttgtctttcagga

SEQ ID NO: 205617 - DNA, 20 bp, Homo sapiens
ctatttgtgtgtatgctgat

SEQ ID NO: 205618 - DNA, 20 bp, Homo sapiens
ctatttgttcagagaggcct

SEQ ID NO: 205619 - DNA, 16 bp, Homo sapiens
ctatttgttttcatgg

SEQ ID NO: 205620 - DNA, 14 bp, Homo sapiens
ctattttactttgt

SEQ ID NO: 205621 - DNA, 19 bp, Homo sapiens
ctattttactttgtacttg

SEQ ID NO: 205622 - DNA, 21 bp, Homo sapiens
ctattttctcagaatctattc

SEQ ID NO: 205623 - DNA, 15 bp, Homo sapiens
ctatttttatttata

SEQ ID NO: 205624 - DNA, 12 bp, Homo sapiens
ctcaaaagcatt

SEQ ID NO: 205625 - DNA, 21 bp, Homo sapiens
ctcaaaatgatatgtttgagt

SEQ ID NO: 205626 - DNA, 13 bp, Homo sapiens
ctcaaaatgtgcc

SEQ ID NO: 205627 - DNA, 14 bp, Homo sapiens
ctcaaacacagaga

SEQ ID NO: 205628 - DNA, 18 bp, Homo sapiens
ctcaaacctccaaaagcc

SEQ ID NO: 205629 - DNA, 13 bp, Homo sapiens
ctcaaactcctga

SEQ ID NO: 205630 - DNA, 16 bp, Homo sapiens
ctcaaagatgtactga

SEQ ID NO: 205631 - DNA, 18 bp, Homo sapiens
ctcaaagatgtactgaga

SEQ ID NO: 205632 - DNA, 23 bp, Homo sapiens
ctcaaagatgtactgagaggagg

SEQ ID NO: 205633 - DNA, 12 bp, Homo sapiens
ctcaaaggactg

SEQ ID NO: 205634 - DNA, 13 bp, Homo sapiens
ctcaaatctattc

SEQ ID NO: 205635 - DNA, 23 bp, Homo sapiens
ctcaaattaatctttctttacct

SEQ ID NO: 205636 - DNA, 12 bp, Homo sapiens
ctcaaatttgga

SEQ ID NO: 205637 - DNA, 20 bp, Homo sapiens
ctcaacaaaagtgctttgga

SEQ ID NO: 205638 - DNA, 15 bp, Homo sapiens
ctcaacaaagcacag

SEQ ID NO: 205639 - DNA, 18 bp, Homo sapiens
ctcaacccccctcccaga

SEQ ID NO: 205640 - DNA, 22 bp, Homo sapiens
ctcaacccccctcccagacagg

SEQ ID NO: 205641 - DNA, 19 bp, Homo sapiens
ctcaaccctccctcagccc

SEQ ID NO: 205642 - DNA, 21 bp, Homo sapiens
ctcaaccctccctcagcccct

SEQ ID NO: 205643 - DNA, 13 bp, Homo sapiens
ctcaacctcacca

SEQ ID NO: 205644 - DNA, 12 bp, Homo sapiens
ctcaacctctca

SEQ ID NO: 205645 - DNA, 18 bp, Homo sapiens
ctcaacctgtaaattatt

SEQ ID NO: 205646 - DNA, 21 bp, Homo sapiens
ctcaacctgtaaattatttta

SEQ ID NO: 205647 - DNA, 13 bp, Homo sapiens
ctcaacctgtgat

SEQ ID NO: 205648 - DNA, 20 bp, Homo sapiens
ctcaactaaagaatagtgcc

SEQ ID NO: 205649 - DNA, 23 bp, Homo sapiens
ctcaactaaagaatagtgcctca

SEQ ID NO: 205650 - DNA, 17 bp, Homo sapiens
ctcaactcacctaatgt

SEQ ID NO: 205651 - DNA, 23 bp, Homo sapiens
ctcaagacccttttgggtttctg

SEQ ID NO: 205652 - DNA, 20 bp, Homo sapiens
ctcaagattatattataata

SEQ ID NO: 205653 - DNA, 19 bp, Homo sapiens
ctcaagcaaggaagcagag

SEQ ID NO: 205654 - DNA, 20 bp, Homo sapiens
ctcaagcaaggaagcagagc

SEQ ID NO: 205655 - DNA, 21 bp, Homo sapiens
ctcaagcaaggaagcagagca

SEQ ID NO: 205656 - DNA, 18 bp, Homo sapiens
ctcaagcaatcctcctga

SEQ ID NO: 205657 - DNA, 21 bp, Homo sapiens
ctcaagcaatcctcctgagtg

SEQ ID NO: 205658 - DNA, 23 bp, Homo sapiens
ctcaagcagtctacccacctcag

SEQ ID NO: 205659 - DNA, 23 bp, Homo sapiens
ctcaagccaggagaccctgtctt

SEQ ID NO: 205660 - DNA, 18 bp, Homo sapiens
ctcaagccatcttcccgc

SEQ ID NO: 205661 - DNA, 18 bp, Homo sapiens
ctcaaggacttgaaagca

SEQ ID NO: 205662 - DNA, 19 bp, Homo sapiens
ctcaaggacttgaaagcat

SEQ ID NO: 205663 - DNA, 16 bp, Homo sapiens
ggctgtggaggcctga

SEQ ID NO: 205664 - DNA, 21 bp, Homo sapiens
ggctgtggaggcctgatgctg

SEQ ID NO: 205665 - DNA, 22 bp, Homo sapiens
ggctgtggaggcctgatgctgc

SEQ ID NO: 205666 - DNA, 13 bp, Homo sapiens
ggctgtggcccct

SEQ ID NO: 205667 - DNA, 22 bp, Homo sapiens
ggctgtggccgtctcctccctc

SEQ ID NO: 205668 - DNA, 22 bp, Homo sapiens
ggctgtgggcctcaaggacttg

SEQ ID NO: 205669 - DNA, 16 bp, Homo sapiens
ggctgtgttgactgct

SEQ ID NO: 205670 - DNA, 22 bp, Homo sapiens
ggctgttccagactcaggttcc

SEQ ID NO: 205671 - DNA, 18 bp, Homo sapiens
ggctgtttcgtgtagtgg

SEQ ID NO: 205672 - DNA, 22 bp, Homo sapiens
ggctgttttaacggcctgcatc

SEQ ID NO: 205673 - DNA, 19 bp, Homo sapiens
ggctgttttagtgccaggc

SEQ ID NO: 205674 - DNA, 16 bp, Homo sapiens
ggctgtttttgggtgc

SEQ ID NO: 205675 - DNA, 21 bp, Homo sapiens
ggcttaaaaatacttaataaa

SEQ ID NO: 205676 - DNA, 19 bp, Homo sapiens
ggcttaagagagagagcct

SEQ ID NO: 205677 - DNA, 22 bp, Homo sapiens
ggcttactacatgtgggagctt

SEQ ID NO: 205678 - DNA, 20 bp, Homo sapiens
ggcttagcgttctgtttcac

SEQ ID NO: 205679 - DNA, 16 bp, Homo sapiens
ggcttaggtgccaggc

SEQ ID NO: 205680 - DNA, 17 bp, Homo sapiens
ggcttaggtgccaggct

SEQ ID NO: 205681 - DNA, 22 bp, Homo sapiens
ggcttcaaccttgagacagctt

SEQ ID NO: 205682 - DNA, 21 bp, Homo sapiens
ggcttcaccagtctgtctact

SEQ ID NO: 205683 - DNA, 14 bp, Homo sapiens
ggcttcagcccctg

SEQ ID NO: 205684 - DNA, 14 bp, Homo sapiens
ggcttccaggctct

SEQ ID NO: 205685 - DNA, 15 bp, Homo sapiens
ggcttccatggtggt

SEQ ID NO: 205686 - DNA, 18 bp, Homo sapiens
ggcttccatttgtgtgtg

SEQ ID NO: 205687 - DNA, 11 bp, Homo sapiens
ggcttcccagg

SEQ ID NO: 205688 - DNA, 18 bp, Homo sapiens
ggcttcccgctcagccct

SEQ ID NO: 205689 - DNA, 16 bp, Homo sapiens
ggcttccctctgctcc

SEQ ID NO: 205690 - DNA, 15 bp, Homo sapiens
ggcttccgctgtcac

SEQ ID NO: 205691 - DNA, 21 bp, Homo sapiens
ggcttcctccgtccacccagg

SEQ ID NO: 205692 - DNA, 22 bp, Homo sapiens
ggcttcctccgtccacccaggc

SEQ ID NO: 205693 - DNA, 13 bp, Homo sapiens
ggcttcctgtcca

SEQ ID NO: 205694 - DNA, 14 bp, Homo sapiens
ggcttcctgtccac

SEQ ID NO: 205695 - DNA, 17 bp, Homo sapiens
ggcttcctgtccactct

SEQ ID NO: 205696 - DNA, 15 bp, Homo sapiens
ggcttcggcctgctt

SEQ ID NO: 205697 - DNA, 20 bp, Homo sapiens
ggcttctccctggactctgt

SEQ ID NO: 205698 - DNA, 12 bp, Homo sapiens
ggcttctcctga

SEQ ID NO: 205699 - DNA, 17 bp, Homo sapiens
ggcttctgggacctgtg

SEQ ID NO: 205700 - DNA, 14 bp, Homo sapiens
ggcttgctccaggg

SEQ ID NO: 205701 - DNA, 21 bp, Homo sapiens
ctcacagtgttgcccaggctg

SEQ ID NO: 205702 - DNA, 17 bp, Homo sapiens
ctcacatctcccttcca

SEQ ID NO: 205703 - DNA, 13 bp, Homo sapiens
ctcacatgcccgc

SEQ ID NO: 205704 - DNA, 22 bp, Homo sapiens
ctcacatgcccgctgtcccagg

SEQ ID NO: 205705 - DNA, 15 bp, Homo sapiens
ctcacatgctggaca

SEQ ID NO: 205706 - DNA, 22 bp, Homo sapiens
ctcacatgctggacaggtctgg

SEQ ID NO: 205707 - DNA, 23 bp, Homo sapiens
ctcacatgctggacaggtctggg

SEQ ID NO: 205708 - DNA, 15 bp, Homo sapiens
ctcacattccctctc

SEQ ID NO: 205709 - DNA, 23 bp, Homo sapiens
ctcacattccctctcatccaggt

SEQ ID NO: 205710 - DNA, 13 bp, Homo sapiens
ctcaccaaaatat

SEQ ID NO: 205711 - DNA, 20 bp, Homo sapiens
ctcaccaataacttcagaga

SEQ ID NO: 205712 - DNA, 20 bp, Homo sapiens
ctcaccagaattgtgcaaat

SEQ ID NO: 205713 - DNA, 23 bp, Homo sapiens
ctcaccagctcagccccggccac

SEQ ID NO: 205714 - DNA, 21 bp, Homo sapiens
ctcaccatttaatcatttcca

SEQ ID NO: 205715 - DNA, 12 bp, Homo sapiens
ctcacccagaag

SEQ ID NO: 205716 - DNA, 15 bp, Homo sapiens
ctcacccagaaggaa

SEQ ID NO: 205717 - DNA, 22 bp, Homo sapiens
ctcacccattgtctcattgcca

SEQ ID NO: 205718 - DNA, 21 bp, Homo sapiens
ctcaccccatcccacaccctg

SEQ ID NO: 205719 - DNA, 17 bp, Homo sapiens
ctcacccccaaggggca

SEQ ID NO: 205720 - DNA, 21 bp, Homo sapiens
ctcacccccaaggggcagtct

SEQ ID NO: 205721 - DNA, 15 bp, Homo sapiens
ctcaccccctttgct

SEQ ID NO: 205722 - DNA, 13 bp, Homo sapiens
ctcacccctgcag

SEQ ID NO: 205723 - DNA, 16 bp, Homo sapiens
ctcacccctgggcagg

SEQ ID NO: 205724 - DNA, 17 bp, Homo sapiens
ctcacccctgggcaggc

SEQ ID NO: 205725 - DNA, 20 bp, Homo sapiens
ctcacccgctgcccagccct

SEQ ID NO: 205726 - DNA, 13 bp, Homo sapiens
ctcaccctgcttg

SEQ ID NO: 205727 - DNA, 14 bp, Homo sapiens
ctcaccctgcttgg

SEQ ID NO: 205728 - DNA, 21 bp, Homo sapiens
ctcacctcaggaccccagagg

SEQ ID NO: 205729 - DNA, 18 bp, Homo sapiens
ctcacctctaggcctcag

SEQ ID NO: 205730 - DNA, 15 bp, Homo sapiens
ctcacctctggactg

SEQ ID NO: 205731 - DNA, 16 bp, Homo sapiens
ctcacctgctggcccc

SEQ ID NO: 205732 - DNA, 18 bp, Homo sapiens
ctcacctgctggcccctc

SEQ ID NO: 205733 - DNA, 19 bp, Homo sapiens
ctcacctgctggcccctca

SEQ ID NO: 205734 - DNA, 19 bp, Homo sapiens
ctcacctgggcacctgggg

SEQ ID NO: 205735 - DNA, 14 bp, Homo sapiens
ctcacctgggcctt

SEQ ID NO: 205736 - DNA, 16 bp, Homo sapiens
ctcacctgggcctttc

SEQ ID NO: 205737 - DNA, 22 bp, Homo sapiens
ctcacctgggcctttcctgtgc

SEQ ID NO: 205738 - DNA, 24 bp, Homo sapiens
ctcacctgggcctttcctgtgcca

SEQ ID NO: 205739 - DNA, 19 bp, Homo sapiens
ctcaccttccctagttctt

SEQ ID NO: 205740 - DNA, 14 bp, Homo sapiens
ctcaccttctgttt

SEQ ID NO: 205741 - DNA, 15 bp, Homo sapiens
ctcaccttctgtttt

SEQ ID NO: 205742 - DNA, 22 bp, Homo sapiens
ctcaccttgaacaccacgcttg

SEQ ID NO: 205743 - DNA, 18 bp, Homo sapiens
ctcaccttgcaacacaca

SEQ ID NO: 205744 - DNA, 20 bp, Homo sapiens
ctcaccttgcaacacacaga

SEQ ID NO: 205745 - DNA, 20 bp, Homo sapiens
ctcacctttcccacagtctc

SEQ ID NO: 205746 - DNA, 19 bp, Homo sapiens
ctcacgactcttcctgcaa

SEQ ID NO: 205747 - DNA, 18 bp, Homo sapiens
ctcacgctcccccgcagt

SEQ ID NO: 205748 - DNA, 21 bp, Homo sapiens
ctcacgctcccccgcagtccc

SEQ ID NO: 205749 - DNA, 14 bp, Homo sapiens
ctcacggggcctcc

SEQ ID NO: 205750 - DNA, 16 bp, Homo sapiens
ctcacggggttggctg

SEQ ID NO: 205751 - DNA, 20 bp, Homo sapiens
ctcacggggttggctgttcc

SEQ ID NO: 205752 - DNA, 14 bp, Homo sapiens
ctcacgtctgtgag

SEQ ID NO: 205753 - DNA, 21 bp, Homo sapiens
ctcacgtctgtgagtctgtcc

SEQ ID NO: 205754 - DNA, 20 bp, Homo sapiens
ctcactacaacctccacctt

SEQ ID NO: 205755 - DNA, 14 bp, Homo sapiens
ctcactatgtttct

SEQ ID NO: 205756 - DNA, 13 bp, Homo sapiens
ctcactccagccc

SEQ ID NO: 205757 - DNA, 14 bp, Homo sapiens
ctcactccagccca

SEQ ID NO: 205758 - DNA, 12 bp, Homo sapiens
ctcactcccttt

SEQ ID NO: 205759 - DNA, 15 bp, Homo sapiens
ctcactcctacctgg

SEQ ID NO: 205760 - DNA, 17 bp, Homo sapiens
ctcactcctacctggta

SEQ ID NO: 205761 - DNA, 19 bp, Homo sapiens
ctcactcctacctggtaat

SEQ ID NO: 205762 - DNA, 23 bp, Homo sapiens
ctcactcctaggagagccaacct

SEQ ID NO: 205763 - DNA, 15 bp, Homo sapiens
ctcactctgccaggg

SEQ ID NO: 205764 - DNA, 18 bp, Homo sapiens
ctcactcttatgaaatgg

SEQ ID NO: 205765 - DNA, 16 bp, Homo sapiens
ctcactgcagcctcga

SEQ ID NO: 205766 - DNA, 16 bp, Homo sapiens
ctcactgcagcctctg

SEQ ID NO: 205767 - DNA, 12 bp, Homo sapiens
ctcactgcccgc

SEQ ID NO: 205768 - DNA, 13 bp, Homo sapiens
ctcactgccctcc

SEQ ID NO: 205769 - DNA, 13 bp, Homo sapiens
ctcactgcttctg

SEQ ID NO: 205770 - DNA, 12 bp, Homo sapiens
ctcactggctgg

SEQ ID NO: 205771 - DNA, 13 bp, Homo sapiens
ctcactggctggg

SEQ ID NO: 205772 - DNA, 15 bp, Homo sapiens
ctcactggctggggc

SEQ ID NO: 205773 - DNA, 15 bp, Homo sapiens
ctcactggtgcattt

SEQ ID NO: 205774 - DNA, 18 bp, Homo sapiens
ctcactggtgcatttaaa

SEQ ID NO: 205775 - DNA, 15 bp, Homo sapiens
ctcactgttgaattt

SEQ ID NO: 205776 - DNA, 14 bp, Homo sapiens
ctcacttataccaa

SEQ ID NO: 205777 - DNA, 18 bp, Homo sapiens
ctcacttccatacagctc

SEQ ID NO: 205778 - DNA, 14 bp, Homo sapiens
ctcacttttctcca

SEQ ID NO: 205779 - DNA, 21 bp, Homo sapiens
ctcagaaagtcaccaggactt

SEQ ID NO: 205780 - DNA, 17 bp, Homo sapiens
ctcagaaatttttattt

SEQ ID NO: 205781 - DNA, 21 bp, Homo sapiens
ctcagaaatttttatttttct

SEQ ID NO: 205782 - DNA, 21 bp, Homo sapiens
ctcagaacaccccgctctggc

SEQ ID NO: 205783 - DNA, 14 bp, Homo sapiens
ctcagaacagctga

SEQ ID NO: 205784 - DNA, 15 bp, Homo sapiens
ctcagaatgctctac

SEQ ID NO: 205785 - DNA, 22 bp, Homo sapiens
ctcagacaggaaagggaaggcc

SEQ ID NO: 205786 - DNA, 23 bp, Homo sapiens
ctcagacccttgaagatgtagct

SEQ ID NO: 205787 - DNA, 17 bp, Homo sapiens
ctcagacgagacaccct

SEQ ID NO: 205788 - DNA, 21 bp, Homo sapiens
ctcagacgagacaccctaact

SEQ ID NO: 205789 - DNA, 16 bp, Homo sapiens
ctcagagcatgtgtca

SEQ ID NO: 205790 - DNA, 15 bp, Homo sapiens
ctcagagccctgccc

SEQ ID NO: 205791 - DNA, 18 bp, Homo sapiens
ctcagagccctgccctgc

SEQ ID NO: 205792 - DNA, 19 bp, Homo sapiens
ctcagagccctgccctgca

SEQ ID NO: 205793 - DNA, 16 bp, Homo sapiens
gggaccattgacctca

SEQ ID NO: 205794 - DNA, 17 bp, Homo sapiens
gggaccattgacctcag

SEQ ID NO: 205795 - DNA, 20 bp, Homo sapiens
gggaccattgacctcagctg

SEQ ID NO: 205796 - DNA, 22 bp, Homo sapiens
gggaccattgacctcagctgca

SEQ ID NO: 205797 - DNA, 14 bp, Homo sapiens
gggacccagctact

SEQ ID NO: 205798 - DNA, 24 bp, Homo sapiens
gggacccagctactctgtccaggc

SEQ ID NO: 205799 - DNA, 22 bp, Homo sapiens
gggaccccccccccccccgccc

SEQ ID NO: 205800 - DNA, 14 bp, Homo sapiens
gggacccctcccaa

SEQ ID NO: 205801 - DNA, 19 bp, Homo sapiens
gggacccctcccaacctca

SEQ ID NO: 205802 - DNA, 22 bp, Homo sapiens
gggacccctcccaacctcaatg

SEQ ID NO: 205803 - DNA, 15 bp, Homo sapiens
gggaccctgccgagg

SEQ ID NO: 205804 - DNA, 13 bp, Homo sapiens
gggacgaagaaag

SEQ ID NO: 205805 - DNA, 23 bp, Homo sapiens
gggacgtcctgccacctggggca

SEQ ID NO: 205806 - DNA, 17 bp, Homo sapiens
gggactaaatgccctgc

SEQ ID NO: 205807 - DNA, 16 bp, Homo sapiens
gggactcagccctgag

SEQ ID NO: 205808 - DNA, 17 bp, Homo sapiens
gggactcagccctgagg

SEQ ID NO: 205809 - DNA, 21 bp, Homo sapiens
gggactgatgtcatcttgagc

SEQ ID NO: 205810 - DNA, 15 bp, Homo sapiens
gggactgcctctgcc

SEQ ID NO: 205811 - DNA, 16 bp, Homo sapiens
gggactgcctctgcca

SEQ ID NO: 205812 - DNA, 14 bp, Homo sapiens
gggactggagtcag

SEQ ID NO: 205813 - DNA, 15 bp, Homo sapiens
gggactggcccaccc

SEQ ID NO: 205814 - DNA, 19 bp, Homo sapiens
gggactggcccacccctct

SEQ ID NO: 205815 - DNA, 13 bp, Homo sapiens
gggactgtatttc

SEQ ID NO: 205816 - DNA, 23 bp, Homo sapiens
gggactgtcttcaaccctgccct

SEQ ID NO: 205817 - DNA, 15 bp, Homo sapiens
gggactgtgcctttg

SEQ ID NO: 205818 - DNA, 19 bp, Homo sapiens
gggacttccttgctctccc

SEQ ID NO: 205819 - DNA, 20 bp, Homo sapiens
gggacttccttgctctccct

SEQ ID NO: 205820 - DNA, 24 bp, Homo sapiens
gggacttgtaggaatctgccttcc

SEQ ID NO: 205821 - DNA, 15 bp, Homo sapiens
gggagaaaaagaaac

SEQ ID NO: 205822 - DNA, 19 bp, Homo sapiens
gggagaaaaagaaacacaa

SEQ ID NO: 205823 - DNA, 19 bp, Homo sapiens
gggagaaactgaaagtgtt

SEQ ID NO: 205824 - DNA, 17 bp, Homo sapiens
gggagaacacatttcta

SEQ ID NO: 205825 - DNA, 16 bp, Homo sapiens
gggagaacatggccaa

SEQ ID NO: 205826 - DNA, 21 bp, Homo sapiens
gggagaaccaaaaagaggcta

SEQ ID NO: 205827 - DNA, 15 bp, Homo sapiens
gggagaatcatgtga

SEQ ID NO: 205828 - DNA, 21 bp, Homo sapiens
gggagacacctcagagccccg

SEQ ID NO: 205829 - DNA, 12 bp, Homo sapiens
gggagaccctgg

SEQ ID NO: 205830 - DNA, 13 bp, Homo sapiens
gggagactgagct

SEQ ID NO: 205831 - DNA, 12 bp, Homo sapiens
gggagagcaggc

SEQ ID NO: 205832 - DNA, 13 bp, Homo sapiens
gggagagcaggct

SEQ ID NO: 205833 - DNA, 14 bp, Homo sapiens
gggagagcaggctg

SEQ ID NO: 205834 - DNA, 16 bp, Homo sapiens
gggagagcaggctggc

SEQ ID NO: 205835 - DNA, 15 bp, Homo sapiens
gggagagcccctggg

SEQ ID NO: 205836 - DNA, 17 bp, Homo sapiens
gggagagcgccacccgc

SEQ ID NO: 205837 - DNA, 22 bp, Homo sapiens
gggagagcgccacccgcccgcc

SEQ ID NO: 205838 - DNA, 14 bp, Homo sapiens
gggagaggaagcca

SEQ ID NO: 205839 - DNA, 12 bp, Homo sapiens
ctcagctctggc

SEQ ID NO: 205840 - DNA, 14 bp, Homo sapiens
ctcagctctggctc

SEQ ID NO: 205841 - DNA, 15 bp, Homo sapiens
ctcagctctggctca

SEQ ID NO: 205842 - DNA, 13 bp, Homo sapiens
ctcagctctggga

SEQ ID NO: 205843 - DNA, 15 bp, Homo sapiens
ctcagctctgggaga

SEQ ID NO: 205844 - DNA, 22 bp, Homo sapiens
ctcagctctgggagaggatttt

SEQ ID NO: 205845 - DNA, 23 bp, Homo sapiens
ctcagctgacacataatttgaat

SEQ ID NO: 205846 - DNA, 20 bp, Homo sapiens
ctcagctgagaaggccagcc

SEQ ID NO: 205847 - DNA, 14 bp, Homo sapiens
ctcagctgcacatt

SEQ ID NO: 205848 - DNA, 22 bp, Homo sapiens
ctcagctgcacattcctggccc

SEQ ID NO: 205849 - DNA, 14 bp, Homo sapiens
ctcagctgccaagc

SEQ ID NO: 205850 - DNA, 14 bp, Homo sapiens
ctcagctgcctcac

SEQ ID NO: 205851 - DNA, 12 bp, Homo sapiens
ctcagctggccg

SEQ ID NO: 205852 - DNA, 21 bp, Homo sapiens
ctcagctggccgggttggagg

SEQ ID NO: 205853 - DNA, 19 bp, Homo sapiens
ctcagctggcggaacctgg

SEQ ID NO: 205854 - DNA, 19 bp, Homo sapiens
ctcaggaccaaagaacact

SEQ ID NO: 205855 - DNA, 15 bp, Homo sapiens
ctcaggacccaggcc

SEQ ID NO: 205856 - DNA, 16 bp, Homo sapiens
ctcaggacccaggccc

SEQ ID NO: 205857 - DNA, 19 bp, Homo sapiens
ctcaggacccaggccctcc

SEQ ID NO: 205858 - DNA, 23 bp, Homo sapiens
ctcaggacccaggccctccatgg

SEQ ID NO: 205859 - DNA, 13 bp, Homo sapiens
ctcaggaccccag

SEQ ID NO: 205860 - DNA, 15 bp, Homo sapiens
ctcaggaccccagag

SEQ ID NO: 205861 - DNA, 22 bp, Homo sapiens
ctcaggaccccagagggaccag

SEQ ID NO: 205862 - DNA, 21 bp, Homo sapiens
ctcaggaccctccccacccac

SEQ ID NO: 205863 - DNA, 21 bp, Homo sapiens
ctcaggaggcagtggcttgga

SEQ ID NO: 205864 - DNA, 20 bp, Homo sapiens
ctcaggatttaaaaactgga

SEQ ID NO: 205865 - DNA, 21 bp, Homo sapiens
ctcaggcataggcctgggtgc

SEQ ID NO: 205866 - DNA, 13 bp, Homo sapiens
ctcaggccacctg

SEQ ID NO: 205867 - DNA, 18 bp, Homo sapiens
ctcaggccacctgccccc

SEQ ID NO: 205868 - DNA, 22 bp, Homo sapiens
ctcaggccacctgcccccttct

SEQ ID NO: 205869 - DNA, 10 bp, Homo sapiens
ctcaggccca

SEQ ID NO: 205870 - DNA, 17 bp, Homo sapiens
ctcaggcccacattgcc

SEQ ID NO: 205871 - DNA, 13 bp, Homo sapiens
ctcaggccgggct

SEQ ID NO: 205872 - DNA, 11 bp, Homo sapiens
ctcaggcctca

SEQ ID NO: 205873 - DNA, 13 bp, Homo sapiens
ctcaggcctcacc

SEQ ID NO: 205874 - DNA, 21 bp, Homo sapiens
ctcaggcctcacctggcttcc

SEQ ID NO: 205875 - DNA, 23 bp, Homo sapiens
ctcaggcctcacctggcttccca

SEQ ID NO: 205876 - DNA, 13 bp, Homo sapiens
ctcaggcctgcca

SEQ ID NO: 205877 - DNA, 14 bp, Homo sapiens
ctcaggcctgccaa

SEQ ID NO: 205878 - DNA, 22 bp, Homo sapiens
ctcaggcctgccaatgccacag

SEQ ID NO: 205879 - DNA, 23 bp, Homo sapiens
ctcaggcctgccaatgccacagc

SEQ ID NO: 205880 - DNA, 14 bp, Homo sapiens
ctcaggcgcagccc

SEQ ID NO: 205881 - DNA, 15 bp, Homo sapiens
ctcaggcgcagccct

SEQ ID NO: 205882 - DNA, 13 bp, Homo sapiens
ctcaggctgctgg

SEQ ID NO: 205883 - DNA, 16 bp, Homo sapiens
ctcaggctgctggagg

SEQ ID NO: 205884 - DNA, 20 bp, Homo sapiens
ctcaggctgtttttgggtgc

SEQ ID NO: 205885 - DNA, 16 bp, Homo sapiens
ctcagggatcttctcc

SEQ ID NO: 205886 - DNA, 18 bp, Homo sapiens
ctcagggatcttctccct

SEQ ID NO: 205887 - DNA, 19 bp, Homo sapiens
ctcagggatcttctccctc

SEQ ID NO: 205888 - DNA, 16 bp, Homo sapiens
ctcagggatgtgggaa

SEQ ID NO: 205889 - DNA, 22 bp, Homo sapiens
ctcagggatgtgggaatctccc

SEQ ID NO: 205890 - DNA, 18 bp, Homo sapiens
ctcagggattctgggctt

SEQ ID NO: 205891 - DNA, 21 bp, Homo sapiens
ctcagggcccacctcctccag

SEQ ID NO: 205892 - DNA, 16 bp, Homo sapiens
ctcagggctgacacgt

SEQ ID NO: 205893 - DNA, 13 bp, Homo sapiens
ctcaggggcagct

SEQ ID NO: 205894 - DNA, 18 bp, Homo sapiens
ctcagggtggggggtgac

SEQ ID NO: 205895 - DNA, 18 bp, Homo sapiens
ctcaggtccctgcagggc

SEQ ID NO: 205896 - DNA, 13 bp, Homo sapiens
ctcaggtgccact

SEQ ID NO: 205897 - DNA, 18 bp, Homo sapiens
ctcaggtgccactccctg

SEQ ID NO: 205898 - DNA, 22 bp, Homo sapiens
ctcaggtgccactccctgagct

SEQ ID NO: 205899 - DNA, 15 bp, Homo sapiens
ctcaggtgttgccaa

SEQ ID NO: 205900 - DNA, 16 bp, Homo sapiens
ctcaggttccagaaca

SEQ ID NO: 205901 - DNA, 22 bp, Homo sapiens
ctcagtattgagacactgtcaa

SEQ ID NO: 205902 - DNA, 17 bp, Homo sapiens
ctcagtccacctgagct

SEQ ID NO: 205903 - DNA, 18 bp, Homo sapiens
ctcagtccacctgagctg

SEQ ID NO: 205904 - DNA, 16 bp, Homo sapiens
ctcagtcccccaccac

SEQ ID NO: 205905 - DNA, 24 bp, Homo sapiens
ctcagtccctccctcctggctcac

SEQ ID NO: 205906 - DNA, 12 bp, Homo sapiens
ctcagtcctcaa

SEQ ID NO: 205907 - DNA, 22 bp, Homo sapiens
ctcagtgccacttgacattcct

SEQ ID NO: 205908 - DNA, 12 bp, Homo sapiens
ctcagtgcctcc

SEQ ID NO: 205909 - DNA, 15 bp, Homo sapiens
ctcagtgcctcctgg

SEQ ID NO: 205910 - DNA, 13 bp, Homo sapiens
ctcagtgctctcc

SEQ ID NO: 205911 - DNA, 15 bp, Homo sapiens
ctcagtgtattttaa

SEQ ID NO: 205912 - DNA, 14 bp, Homo sapiens
ctcagtgtcattta

SEQ ID NO: 205913 - DNA, 22 bp, Homo sapiens
ctcagtgtcatttatgaaaaga

SEQ ID NO: 205914 - DNA, 19 bp, Homo sapiens
ctcagtgtcctcatctata

SEQ ID NO: 205915 - DNA, 18 bp, Homo sapiens
ctcagtgtgaagcctgtc

SEQ ID NO: 205916 - DNA, 13 bp, Homo sapiens
ctcagttaaaatg

SEQ ID NO: 205917 - DNA, 15 bp, Homo sapiens
ctcagttcccttggc

SEQ ID NO: 205918 - DNA, 19 bp, Homo sapiens
ctcagttcccttggcctca

SEQ ID NO: 205919 - DNA, 20 bp, Homo sapiens
ctcagttcccttggcctcag

SEQ ID NO: 205920 - DNA, 22 bp, Homo sapiens
ctcagttctctcccttcctctc

SEQ ID NO: 205921 - DNA, 14 bp, Homo sapiens
ctcagtttctgttg

SEQ ID NO: 205922 - DNA, 20 bp, Homo sapiens
ctcagtttctgttgtttctt

SEQ ID NO: 205923 - DNA, 17 bp, Homo sapiens
gggcaacgaagaaaaaa

SEQ ID NO: 205924 - DNA, 23 bp, Homo sapiens
gggcaacgaagaaaaaaaataac

SEQ ID NO: 205925 - DNA, 16 bp, Homo sapiens
gggcaagcctgagtgg

SEQ ID NO: 205926 - DNA, 17 bp, Homo sapiens
gggcacaagacccctgc

SEQ ID NO: 205927 - DNA, 20 bp, Homo sapiens
gggcacaagacccctgctcc

SEQ ID NO: 205928 - DNA, 11 bp, Homo sapiens
gggcacaccac

SEQ ID NO: 205929 - DNA, 18 bp, Homo sapiens
gggcacaccactgccctg

SEQ ID NO: 205930 - DNA, 19 bp, Homo sapiens
gggcacaccactgccctgc

SEQ ID NO: 205931 - DNA, 22 bp, Homo sapiens
gggcacaccactgccctgcctg

SEQ ID NO: 205932 - DNA, 19 bp, Homo sapiens
gggcacactacagagcagc

SEQ ID NO: 205933 - DNA, 13 bp, Homo sapiens
gggcacagccaga

SEQ ID NO: 205934 - DNA, 22 bp, Homo sapiens
gggcacagctgctgtgccagga

SEQ ID NO: 205935 - DNA, 12 bp, Homo sapiens
gggcacaggctg

SEQ ID NO: 205936 - DNA, 23 bp, Homo sapiens
gggcacaggtgtctgccccctct

SEQ ID NO: 205937 - DNA, 12 bp, Homo sapiens
gggcacccagcc

SEQ ID NO: 205938 - DNA, 14 bp, Homo sapiens
gggcaccctcccac

SEQ ID NO: 205939 - DNA, 13 bp, Homo sapiens
gggcacctcagaa

SEQ ID NO: 205940 - DNA, 18 bp, Homo sapiens
gggcacggctccgagggc

SEQ ID NO: 205941 - DNA, 17 bp, Homo sapiens
gggcactctctgccagc

SEQ ID NO: 205942 - DNA, 16 bp, Homo sapiens
gggcactggaaaacat

SEQ ID NO: 205943 - DNA, 18 bp, Homo sapiens
gggcactggctgctctgt

SEQ ID NO: 205944 - DNA, 19 bp, Homo sapiens
gggcactggctgctctgtc

SEQ ID NO: 205945 - DNA, 22 bp, Homo sapiens
gggcactgggccggcagcctgg

SEQ ID NO: 205946 - DNA, 16 bp, Homo sapiens
gggcactggtggcccg

SEQ ID NO: 205947 - DNA, 22 bp, Homo sapiens
gggcacttttgaactcacgagc

SEQ ID NO: 205948 - DNA, 21 bp, Homo sapiens
gggcagaaatgtgctgcaaag

SEQ ID NO: 205949 - DNA, 22 bp, Homo sapiens
gggcagaaatgtgctgcaaaga

SEQ ID NO: 205950 - DNA, 23 bp, Homo sapiens
gggcagaaggaggaagggactgg

SEQ ID NO: 205951 - DNA, 14 bp, Homo sapiens
gggcagagccatgg

SEQ ID NO: 205952 - DNA, 18 bp, Homo sapiens
gggcagagccatgggcct

SEQ ID NO: 205953 - DNA, 19 bp, Homo sapiens
gggcagagccatgggcctg

SEQ ID NO: 205954 - DNA, 20 bp, Homo sapiens
gggcagagccatgggcctgg

SEQ ID NO: 205955 - DNA, 13 bp, Homo sapiens
gggcagagcctgt

SEQ ID NO: 205956 - DNA, 23 bp, Homo sapiens
gggcagagggaatgttccctgca

SEQ ID NO: 205957 - DNA, 16 bp, Homo sapiens
gggcagaggggagagg

SEQ ID NO: 205958 - DNA, 15 bp, Homo sapiens
gggcagaggggcagc

SEQ ID NO: 205959 - DNA, 11 bp, Homo sapiens
gggcagcagcc

SEQ ID NO: 205960 - DNA, 16 bp, Homo sapiens
gggcagccaggctgcc

SEQ ID NO: 205961 - DNA, 15 bp, Homo sapiens
gggcagcccagagag

SEQ ID NO: 205962 - DNA, 11 bp, Homo sapiens
gggcagcccct

SEQ ID NO: 205963 - DNA, 12 bp, Homo sapiens
gggcagcccctc

SEQ ID NO: 205964 - DNA, 16 bp, Homo sapiens
gggcagcccctcccca

SEQ ID NO: 205965 - DNA, 13 bp, Homo sapiens
gggcagcccctgc

SEQ ID NO: 205966 - DNA, 18 bp, Homo sapiens
gggcagccgctaggagag

SEQ ID NO: 205967 - DNA, 19 bp, Homo sapiens
gggcagccgctaggagaga

SEQ ID NO: 205968 - DNA, 23 bp, Homo sapiens
gggcagccgctaggagagactga

SEQ ID NO: 205969 - DNA, 15 bp, Homo sapiens
gggcagcctggctcc

SEQ ID NO: 205970 - DNA, 16 bp, Homo sapiens
gggcagcctgtgggag

SEQ ID NO: 205971 - DNA, 17 bp, Homo sapiens
gggcagcctgtgggaga

SEQ ID NO: 205972 - DNA, 18 bp, Homo sapiens
gggcagcctgtgggagaa

SEQ ID NO: 205973 - DNA, 20 bp, Homo sapiens
gggcagcctgtgggagaagg

SEQ ID NO: 205974 - DNA, 12 bp, Homo sapiens
gggcagctgagg

SEQ ID NO: 205975 - DNA, 12 bp, Homo sapiens
gggcagctgcca

SEQ ID NO: 205976 - DNA, 18 bp, Homo sapiens
gggcagctgccagagaag

SEQ ID NO: 205977 - DNA, 20 bp, Homo sapiens
ctcatttctttcaagacagc

SEQ ID NO: 205978 - DNA, 15 bp, Homo sapiens
ctcatttgcatccta

SEQ ID NO: 205979 - DNA, 10 bp, Homo sapiens
ctcattttgt

SEQ ID NO: 205980 - DNA, 11 bp, Homo sapiens
ctccaaagctt

SEQ ID NO: 205981 - DNA, 18 bp, Homo sapiens
ctccaaaggggctgctgg

SEQ ID NO: 205982 - DNA, 19 bp, Homo sapiens
ctccaaaggggctgctggg

SEQ ID NO: 205983 - DNA, 20 bp, Homo sapiens
ctccaaaggggctgctgggg

SEQ ID NO: 205984 - DNA, 22 bp, Homo sapiens
ctccaaaggggctgctggggca

SEQ ID NO: 205985 - DNA, 20 bp, Homo sapiens
ctccaacgttaaaagacagt

SEQ ID NO: 205986 - DNA, 22 bp, Homo sapiens
ctccaagaagccctccttgcca

SEQ ID NO: 205987 - DNA, 14 bp, Homo sapiens
ctccaagcctgcct

SEQ ID NO: 205988 - DNA, 17 bp, Homo sapiens
ctccaagcctgcctccc

SEQ ID NO: 205989 - DNA, 18 bp, Homo sapiens
ctccaagctccatctcca

SEQ ID NO: 205990 - DNA, 11 bp, Homo sapiens
ctccaaggcaa

SEQ ID NO: 205991 - DNA, 15 bp, Homo sapiens
ctccaaggcaaatgt

SEQ ID NO: 205992 - DNA, 17 bp, Homo sapiens
ctccaaggcaaatgtcc

SEQ ID NO: 205993 - DNA, 21 bp, Homo sapiens
ctccaaggcaaatgtccaagc

SEQ ID NO: 205994 - DNA, 22 bp, Homo sapiens
ctccaaggcaaatgtccaagca

SEQ ID NO: 205995 - DNA, 13 bp, Homo sapiens
ctccaaggtcctc

SEQ ID NO: 205996 - DNA, 17 bp, Homo sapiens
ctccaaggtcctcttag

SEQ ID NO: 205997 - DNA, 14 bp, Homo sapiens
ctccaatcctttcc

SEQ ID NO: 205998 - DNA, 17 bp, Homo sapiens
ctccacaccagtggcct

SEQ ID NO: 205999 - DNA, 13 bp, Homo sapiens
ctccacacctcca

SEQ ID NO: 206000 - DNA, 15 bp, Homo sapiens
ctccacacctccacc

SEQ ID NO: 206001 - DNA, 15 bp, Homo sapiens
ctccacagtgctgct

SEQ ID NO: 206002 - DNA, 19 bp, Homo sapiens
ctccacatcccagcagccc

SEQ ID NO: 206003 - DNA, 20 bp, Homo sapiens
ctccacccaaaccccttccc

SEQ ID NO: 206004 - DNA, 23 bp, Homo sapiens
ctccacccaaaccccttcccacg

SEQ ID NO: 206005 - DNA, 14 bp, Homo sapiens
ctccacccaccagt

SEQ ID NO: 206006 - DNA, 23 bp, Homo sapiens
ctccacccccgccacggccaccc

SEQ ID NO: 206007 - DNA, 12 bp, Homo sapiens
ctccacccctca

SEQ ID NO: 206008 - DNA, 14 bp, Homo sapiens
ctccacccctcaag

SEQ ID NO: 206009 - DNA, 20 bp, Homo sapiens
ctccacccgtcctggggtgg

SEQ ID NO: 206010 - DNA, 14 bp, Homo sapiens
ctccaccctcccct

SEQ ID NO: 206011 - DNA, 12 bp, Homo sapiens
ctccacccttgg

SEQ ID NO: 206012 - DNA, 17 bp, Homo sapiens
ctccacccttggcctgt

SEQ ID NO: 206013 - DNA, 18 bp, Homo sapiens
ctccaccgagccagcttg

SEQ ID NO: 206014 - DNA, 19 bp, Homo sapiens
ctccaccgagccagcttgg

SEQ ID NO: 206015 - DNA, 15 bp, Homo sapiens
ctccaccggtgcctc

SEQ ID NO: 206016 - DNA, 19 bp, Homo sapiens
ctccacctcctctcttgga

SEQ ID NO: 206017 - DNA, 22 bp, Homo sapiens
ctccacctcctctcttggactc

SEQ ID NO: 206018 - DNA, 20 bp, Homo sapiens
ctccacctgcttgtgttggg

SEQ ID NO: 206019 - DNA, 13 bp, Homo sapiens
ctccacctgggag

SEQ ID NO: 206020 - DNA, 14 bp, Homo sapiens
ctccaccttccagg

SEQ ID NO: 206021 - DNA, 20 bp, Homo sapiens
ctccaccttgttacacatta

SEQ ID NO: 206022 - DNA, 15 bp, Homo sapiens
ctccacgccctgggg

SEQ ID NO: 206023 - DNA, 13 bp, Homo sapiens
ctccacgggggcc

SEQ ID NO: 206024 - DNA, 16 bp, Homo sapiens
ctccacgttcacccct

SEQ ID NO: 206025 - DNA, 13 bp, Homo sapiens
ctccactcactcc

SEQ ID NO: 206026 - DNA, 15 bp, Homo sapiens
ctccactcactccag

SEQ ID NO: 206027 - DNA, 17 bp, Homo sapiens
ctccactcactccagcc

SEQ ID NO: 206028 - DNA, 15 bp, Homo sapiens
ctccactcactgcat

SEQ ID NO: 206029 - DNA, 18 bp, Homo sapiens
ctccactcagggctggcc

SEQ ID NO: 206030 - DNA, 12 bp, Homo sapiens
ctccactccatg

SEQ ID NO: 206031 - DNA, 17 bp, Homo sapiens
ctccactcccccacctg

SEQ ID NO: 206032 - DNA, 21 bp, Homo sapiens
ctccactcccccacctgacaa

SEQ ID NO: 206033 - DNA, 14 bp, Homo sapiens
ctccactcccctca

SEQ ID NO: 206034 - DNA, 14 bp, Homo sapiens
ctccactcctccca

SEQ ID NO: 206035 - DNA, 19 bp, Homo sapiens
ctccactctagttctagat

SEQ ID NO: 206036 - DNA, 17 bp, Homo sapiens
ctccactgacctggaag

SEQ ID NO: 206037 - DNA, 20 bp, Homo sapiens
ctccactgacctggaagagc

SEQ ID NO: 206038 - DNA, 16 bp, Homo sapiens
ctccactgcctctgga

SEQ ID NO: 206039 - DNA, 16 bp, Homo sapiens
ctccactgccttcgat

SEQ ID NO: 206040 - DNA, 21 bp, Homo sapiens
ctccacttctggtcccctgtg

SEQ ID NO: 206041 - DNA, 24 bp, Homo sapiens
ctccacttctggtcccctgtggtg

SEQ ID NO: 206042 - DNA, 15 bp, Homo sapiens
ctccagaagcctctg

SEQ ID NO: 206043 - DNA, 16 bp, Homo sapiens
ctccagaagcctctgg

SEQ ID NO: 206044 - DNA, 15 bp, Homo sapiens
ctccagaatctgctg

SEQ ID NO: 206045 - DNA, 19 bp, Homo sapiens
ctccagaatctgctgttgc

SEQ ID NO: 206046 - DNA, 14 bp, Homo sapiens
ctccagaatgtaag

SEQ ID NO: 206047 - DNA, 16 bp, Homo sapiens
ctccagaatgtaagaa

SEQ ID NO: 206048 - DNA, 18 bp, Homo sapiens
ctccagaatttcccaaag

SEQ ID NO: 206049 - DNA, 12 bp, Homo sapiens
ctccagaccccc

SEQ ID NO: 206050 - DNA, 18 bp, Homo sapiens
ctccagacccccacccct

SEQ ID NO: 206051 - DNA, 21 bp, Homo sapiens
ctccagacccccaccccttcc

SEQ ID NO: 206052 - DNA, 22 bp, Homo sapiens
ctccagacccccaccccttccc

SEQ ID NO: 206053 - DNA, 16 bp, Homo sapiens
ctccagacccccagca

SEQ ID NO: 206054 - DNA, 22 bp, Homo sapiens
gggccatggctttcatcctgtg

SEQ ID NO: 206055 - DNA, 19 bp, Homo sapiens
gggcccaagacagatgccc

SEQ ID NO: 206056 - DNA, 20 bp, Homo sapiens
gggcccagaactgcccccac

SEQ ID NO: 206057 - DNA, 23 bp, Homo sapiens
gggcccagaactgcccccactgt

SEQ ID NO: 206058 - DNA, 13 bp, Homo sapiens
gggcccagagaga

SEQ ID NO: 206059 - DNA, 22 bp, Homo sapiens
gggcccagagagaggcgtcctg

SEQ ID NO: 206060 - DNA, 11 bp, Homo sapiens
gggcccagagg

SEQ ID NO: 206061 - DNA, 12 bp, Homo sapiens
gggcccagagga

SEQ ID NO: 206062 - DNA, 22 bp, Homo sapiens
gggcccagaggggcggggccag

SEQ ID NO: 206063 - DNA, 13 bp, Homo sapiens
gggcccagatctg

SEQ ID NO: 206064 - DNA, 12 bp, Homo sapiens
gggcccagctgg

SEQ ID NO: 206065 - DNA, 15 bp, Homo sapiens
gggcccagctgggct

SEQ ID NO: 206066 - DNA, 13 bp, Homo sapiens
gggcccaggaggg

SEQ ID NO: 206067 - DNA, 18 bp, Homo sapiens
gggcccaggcagcacctg

SEQ ID NO: 206068 - DNA, 19 bp, Homo sapiens
gggcccaggcagcacctgg

SEQ ID NO: 206069 - DNA, 21 bp, Homo sapiens
gggcccaggcagcacctggag

SEQ ID NO: 206070 - DNA, 20 bp, Homo sapiens
gggcccaggccctagaccct

SEQ ID NO: 206071 - DNA, 14 bp, Homo sapiens
gggcccaggcctgg

SEQ ID NO: 206072 - DNA, 20 bp, Homo sapiens
gggcccaggctcccctgccc

SEQ ID NO: 206073 - DNA, 23 bp, Homo sapiens
gggcccatctgccgcctggggct

SEQ ID NO: 206074 - DNA, 14 bp, Homo sapiens
gggcccatggcccc

SEQ ID NO: 206075 - DNA, 16 bp, Homo sapiens
gggcccatggccccag

SEQ ID NO: 206076 - DNA, 19 bp, Homo sapiens
gggccccaaagcccagccc

SEQ ID NO: 206077 - DNA, 19 bp, Homo sapiens
gggccccagatctgcctgg

SEQ ID NO: 206078 - DNA, 11 bp, Homo sapiens
gggccccagcc

SEQ ID NO: 206079 - DNA, 13 bp, Homo sapiens
gggccccatgctc

SEQ ID NO: 206080 - DNA, 19 bp, Homo sapiens
gggccccatgctctgcccc

SEQ ID NO: 206081 - DNA, 20 bp, Homo sapiens
gggccccatgctctgcccca

SEQ ID NO: 206082 - DNA, 17 bp, Homo sapiens
gggccccattctccctc

SEQ ID NO: 206083 - DNA, 18 bp, Homo sapiens
gggccccggggctggcaa

SEQ ID NO: 206084 - DNA, 19 bp, Homo sapiens
gggccccggggctggcaag

SEQ ID NO: 206085 - DNA, 21 bp, Homo sapiens
gggccccggggctggcaagca

SEQ ID NO: 206086 - DNA, 17 bp, Homo sapiens
gggcccctcaccctgcc

SEQ ID NO: 206087 - DNA, 19 bp, Homo sapiens
gggcccctcaccctgcctt

SEQ ID NO: 206088 - DNA, 10 bp, Homo sapiens
gggcccctcc

SEQ ID NO: 206089 - DNA, 18 bp, Homo sapiens
gggcccctccctacctca

SEQ ID NO: 206090 - DNA, 20 bp, Homo sapiens
gggcccctccctacctcaac

SEQ ID NO: 206091 - DNA, 13 bp, Homo sapiens
gggcccctccctc

SEQ ID NO: 206092 - DNA, 15 bp, Homo sapiens
gggcccctccctctg

SEQ ID NO: 206093 - DNA, 17 bp, Homo sapiens
gggcccctccctctgcc

SEQ ID NO: 206094 - DNA, 18 bp, Homo sapiens
gggcccctccctctgccc

SEQ ID NO: 206095 - DNA, 20 bp, Homo sapiens
gggcccctccctctgcccca

SEQ ID NO: 206096 - DNA, 20 bp, Homo sapiens
gggcccctcctctgtgctcc

SEQ ID NO: 206097 - DNA, 17 bp, Homo sapiens
gggcccctctgcccagc

SEQ ID NO: 206098 - DNA, 13 bp, Homo sapiens
gggcccctggcac

SEQ ID NO: 206099 - DNA, 20 bp, Homo sapiens
gggcccctggcacgtcctcc

SEQ ID NO: 206100 - DNA, 16 bp, Homo sapiens
gggcccgagcgcgtgc

SEQ ID NO: 206101 - DNA, 19 bp, Homo sapiens
gggcccgctgcgtgccatc

SEQ ID NO: 206102 - DNA, 13 bp, Homo sapiens
gggcccgggcagg

SEQ ID NO: 206103 - DNA, 17 bp, Homo sapiens
gggcccgggcaggccag

SEQ ID NO: 206104 - DNA, 16 bp, Homo sapiens
gggccctgcaggaggc

SEQ ID NO: 206105 - DNA, 20 bp, Homo sapiens
gggccctgcaggaggcctgg

SEQ ID NO: 206106 - DNA, 12 bp, Homo sapiens
gggccctggggt

SEQ ID NO: 206107 - DNA, 21 bp, Homo sapiens
gggccctggggtctctgagca

SEQ ID NO: 206108 - DNA, 22 bp, Homo sapiens
gggccctggggtctctgagcag

SEQ ID NO: 206109 - DNA, 23 bp, Homo sapiens
gggccctggggtctctgagcagt

SEQ ID NO: 206110 - DNA, 20 bp, Homo sapiens
gggcccttggggcctggctt

SEQ ID NO: 206111 - DNA, 13 bp, Homo sapiens
gggccgcagggcg

SEQ ID NO: 206112 - DNA, 14 bp, Homo sapiens
gggccgcagggcgc

SEQ ID NO: 206113 - DNA, 15 bp, Homo sapiens
gggccgcagggcgct

SEQ ID NO: 206114 - DNA, 16 bp, Homo sapiens
gggccgcagggcgctc

SEQ ID NO: 206115 - DNA, 11 bp, Homo sapiens
gggccgcctcc

SEQ ID NO: 206116 - DNA, 24 bp, Homo sapiens
ctccagtacgtcccgctgctgtgc

SEQ ID NO: 206117 - DNA, 15 bp, Homo sapiens
ctccagtcaggaggc

SEQ ID NO: 206118 - DNA, 18 bp, Homo sapiens
ctccagtccccctatcct

SEQ ID NO: 206119 - DNA, 22 bp, Homo sapiens
ctccagtccccctatccttggc

SEQ ID NO: 206120 - DNA, 14 bp, Homo sapiens
ctccagtcctgctc

SEQ ID NO: 206121 - DNA, 13 bp, Homo sapiens
ctccagtctgttc

SEQ ID NO: 206122 - DNA, 14 bp, Homo sapiens
ctccagtctgttct

SEQ ID NO: 206123 - DNA, 15 bp, Homo sapiens
ctccagtctgttctc

SEQ ID NO: 206124 - DNA, 13 bp, Homo sapiens
ctccagtgcttgg

SEQ ID NO: 206125 - DNA, 17 bp, Homo sapiens
ctccagtgcttggctgc

SEQ ID NO: 206126 - DNA, 12 bp, Homo sapiens
ctccagtgttgc

SEQ ID NO: 206127 - DNA, 18 bp, Homo sapiens
ctccagtttgcccaccac

SEQ ID NO: 206128 - DNA, 19 bp, Homo sapiens
ctccagtttgcccaccaca

SEQ ID NO: 206129 - DNA, 12 bp, Homo sapiens
ctccatacagcc

SEQ ID NO: 206130 - DNA, 14 bp, Homo sapiens
ctccatactcagga

SEQ ID NO: 206131 - DNA, 19 bp, Homo sapiens
ctccatatcagctctctgc

SEQ ID NO: 206132 - DNA, 20 bp, Homo sapiens
ctccatatcagctctctgca

SEQ ID NO: 206133 - DNA, 21 bp, Homo sapiens
ctccatcatatgcctgacccc

SEQ ID NO: 206134 - DNA, 13 bp, Homo sapiens
ctccatcccctcc

SEQ ID NO: 206135 - DNA, 14 bp, Homo sapiens
ctccatcccctccc

SEQ ID NO: 206136 - DNA, 17 bp, Homo sapiens
ctccatcctgccaggag

SEQ ID NO: 206137 - DNA, 14 bp, Homo sapiens
ctccatctggggat

SEQ ID NO: 206138 - DNA, 23 bp, Homo sapiens
ctccatcttggtagttctgtgcc

SEQ ID NO: 206139 - DNA, 16 bp, Homo sapiens
ctccatctttctacag

SEQ ID NO: 206140 - DNA, 19 bp, Homo sapiens
ctccatgaagaagctggga

SEQ ID NO: 206141 - DNA, 15 bp, Homo sapiens
ctccatgaccaggcc

SEQ ID NO: 206142 - DNA, 16 bp, Homo sapiens
ctccatgaccaggcca

SEQ ID NO: 206143 - DNA, 21 bp, Homo sapiens
ctccatgaccaggccaccatc

SEQ ID NO: 206144 - DNA, 22 bp, Homo sapiens
ctccatgaccaggccaccatct

SEQ ID NO: 206145 - DNA, 18 bp, Homo sapiens
ctccatgattccaagggc

SEQ ID NO: 206146 - DNA, 18 bp, Homo sapiens
ctccatgcagatctagcc

SEQ ID NO: 206147 - DNA, 21 bp, Homo sapiens
ctccatgcagatctagccagg

SEQ ID NO: 206148 - DNA, 22 bp, Homo sapiens
ctccatgcctatttactggaaa

SEQ ID NO: 206149 - DNA, 14 bp, Homo sapiens
ctccatgctcctca

SEQ ID NO: 206150 - DNA, 19 bp, Homo sapiens
ctccatggccctgccatgc

SEQ ID NO: 206151 - DNA, 12 bp, Homo sapiens
ctccatggtgcc

SEQ ID NO: 206152 - DNA, 17 bp, Homo sapiens
ctccatggtgcctctgg

SEQ ID NO: 206153 - DNA, 16 bp, Homo sapiens
ctccatgtggccccag

SEQ ID NO: 206154 - DNA, 21 bp, Homo sapiens
ctccatgtggccccaggtgcc

SEQ ID NO: 206155 - DNA, 22 bp, Homo sapiens
ctccattaggatttgccccttc

SEQ ID NO: 206156 - DNA, 20 bp, Homo sapiens
ctccattcccatcactgctg

SEQ ID NO: 206157 - DNA, 22 bp, Homo sapiens
ctccattcccatcactgctgtc

SEQ ID NO: 206158 - DNA, 16 bp, Homo sapiens
ctccatttttcccagg

SEQ ID NO: 206159 - DNA, 17 bp, Homo sapiens
ctcccaaagagctgcct

SEQ ID NO: 206160 - DNA, 21 bp, Homo sapiens
ctcccaaagccatatcaccag

SEQ ID NO: 206161 - DNA, 15 bp, Homo sapiens
ctcccaaagtgctgg

SEQ ID NO: 206162 - DNA, 19 bp, Homo sapiens
ctcccaaagtgctgggatt

SEQ ID NO: 206163 - DNA, 18 bp, Homo sapiens
ctcccaaataaactcctt

SEQ ID NO: 206164 - DNA, 23 bp, Homo sapiens
ctcccaaataaactccttaacca

SEQ ID NO: 206165 - DNA, 18 bp, Homo sapiens
ctcccaaatatgcccctc

SEQ ID NO: 206166 - DNA, 23 bp, Homo sapiens
ctcccaacctcaatgccctgcca

SEQ ID NO: 206167 - DNA, 24 bp, Homo sapiens
ctcccaacctcaatgccctgccat

SEQ ID NO: 206168 - DNA, 15 bp, Homo sapiens
ctcccaactctggcc

SEQ ID NO: 206169 - DNA, 23 bp, Homo sapiens
ctcccaagctcagagcagcctct

SEQ ID NO: 206170 - DNA, 18 bp, Homo sapiens
ctcccaaggtcctctcag

SEQ ID NO: 206171 - DNA, 17 bp, Homo sapiens
ctcccaataaagctgga

SEQ ID NO: 206172 - DNA, 13 bp, Homo sapiens
ctcccaatcagct

SEQ ID NO: 206173 - DNA, 15 bp, Homo sapiens
ctcccaatcagcttt

SEQ ID NO: 206174 - DNA, 17 bp, Homo sapiens
ctcccaatcagcttttg

SEQ ID NO: 206175 - DNA, 23 bp, Homo sapiens
ctcccaatcagcttttgttctag

SEQ ID NO: 206176 - DNA, 15 bp, Homo sapiens
ctcccacaggccctt

SEQ ID NO: 206177 - DNA, 20 bp, Homo sapiens
ctcccacaggcccttcctct

SEQ ID NO: 206178 - DNA, 21 bp, Homo sapiens
ctcccacaggcccttcctctc

SEQ ID NO: 206179 - DNA, 18 bp, Homo sapiens
ctcccacatcccactgga

SEQ ID NO: 206180 - DNA, 14 bp, Homo sapiens
ctcccacatccccc

SEQ ID NO: 206181 - DNA, 14 bp, Homo sapiens
ctcccaccagagac

SEQ ID NO: 206182 - DNA, 22 bp, Homo sapiens
ctcccacccccatctctccctc

SEQ ID NO: 206183 - DNA, 22 bp, Homo sapiens
ctcccacccccttctctgctcc

SEQ ID NO: 206184 - DNA, 23 bp, Homo sapiens
ccggctgggtcggccctgcccaa

SEQ ID NO: 206185 - DNA, 13 bp, Homo sapiens
ccggctgtggagc

SEQ ID NO: 206186 - DNA, 17 bp, Homo sapiens
ccggctttgcagggaga

SEQ ID NO: 206187 - DNA, 15 bp, Homo sapiens
ccgggaccacagctg

SEQ ID NO: 206188 - DNA, 23 bp, Homo sapiens
ccgggaccacagctgctggccag

SEQ ID NO: 206189 - DNA, 24 bp, Homo sapiens
ccgggaccacagctgctggccagg

SEQ ID NO: 206190 - DNA, 12 bp, Homo sapiens
ccgggagagggg

SEQ ID NO: 206191 - DNA, 17 bp, Homo sapiens
ccgggagatccgccctg

SEQ ID NO: 206192 - DNA, 20 bp, Homo sapiens
ccgggagcctgcgtggcctg

SEQ ID NO: 206193 - DNA, 22 bp, Homo sapiens
ccgggagcctgcgtggcctggg

SEQ ID NO: 206194 - DNA, 17 bp, Homo sapiens
ccgggcacagctgtggt

SEQ ID NO: 206195 - DNA, 14 bp, Homo sapiens
ccgggcaggccagc

SEQ ID NO: 206196 - DNA, 20 bp, Homo sapiens
ccgggcagggctcccacaga

SEQ ID NO: 206197 - DNA, 14 bp, Homo sapiens
ccgggcaggggagc

SEQ ID NO: 206198 - DNA, 22 bp, Homo sapiens
ccgggcaggggagccagggtag

SEQ ID NO: 206199 - DNA, 21 bp, Homo sapiens
ccgggccacgccccagcccga

SEQ ID NO: 206200 - DNA, 13 bp, Homo sapiens
ccgggcccagagg

SEQ ID NO: 206201 - DNA, 16 bp, Homo sapiens
ccgggcccctggcacg

SEQ ID NO: 206202 - DNA, 17 bp, Homo sapiens
ccgggcccttcagtccc

SEQ ID NO: 206203 - DNA, 23 bp, Homo sapiens
ccgggccgaatcccctccctgtc

SEQ ID NO: 206204 - DNA, 12 bp, Homo sapiens
ccgggcctggac

SEQ ID NO: 206205 - DNA, 15 bp, Homo sapiens
ccgggcctgggcctc

SEQ ID NO: 206206 - DNA, 15 bp, Homo sapiens
ccgggctctggccac

SEQ ID NO: 206207 - DNA, 12 bp, Homo sapiens
ccgggctgctgc

SEQ ID NO: 206208 - DNA, 18 bp, Homo sapiens
ccgggctgggagctctgc

SEQ ID NO: 206209 - DNA, 19 bp, Homo sapiens
ccgggctgggagctctgca

SEQ ID NO: 206210 - DNA, 17 bp, Homo sapiens
ccggggactcgcagcac

SEQ ID NO: 206211 - DNA, 16 bp, Homo sapiens
ccggggaggagccttg

SEQ ID NO: 206212 - DNA, 16 bp, Homo sapiens
ccggggcactggctgc

SEQ ID NO: 206213 - DNA, 18 bp, Homo sapiens
ccggggcagagctcagag

SEQ ID NO: 206214 - DNA, 20 bp, Homo sapiens
ccggggcagagctcagagga

SEQ ID NO: 206215 - DNA, 18 bp, Homo sapiens
ccggggcagctgccagag

SEQ ID NO: 206216 - DNA, 14 bp, Homo sapiens
ccggggcagggcag

SEQ ID NO: 206217 - DNA, 19 bp, Homo sapiens
ccggggcatggacagggcc

SEQ ID NO: 206218 - DNA, 22 bp, Homo sapiens
ccggggcatggacagggccagg

SEQ ID NO: 206219 - DNA, 19 bp, Homo sapiens
ccggggccatggaagctgg

SEQ ID NO: 206220 - DNA, 13 bp, Homo sapiens
ccggggcccctca

SEQ ID NO: 206221 - DNA, 17 bp, Homo sapiens
ccggggcctgcctagca

SEQ ID NO: 206222 - DNA, 16 bp, Homo sapiens
ccggggctggcaagca

SEQ ID NO: 206223 - DNA, 20 bp, Homo sapiens
ccgggggtgggggcctgctg

SEQ ID NO: 206224 - DNA, 21 bp, Homo sapiens
ccgggggtgggggcctgctgt

SEQ ID NO: 206225 - DNA, 15 bp, Homo sapiens
ccggggtctgtgctg

SEQ ID NO: 206226 - DNA, 17 bp, Homo sapiens
ccggggtctgtgctgtg

SEQ ID NO: 206227 - DNA, 23 bp, Homo sapiens
ccggggtctgtgctgtgcctgct

SEQ ID NO: 206228 - DNA, 18 bp, Homo sapiens
ccggggtggggtgcctga

SEQ ID NO: 206229 - DNA, 19 bp, Homo sapiens
ccggggtggggtgcctgag

SEQ ID NO: 206230 - DNA, 20 bp, Homo sapiens
ccggggtggggtgcctgagc

SEQ ID NO: 206231 - DNA, 16 bp, Homo sapiens
ccggggtggtggacag

SEQ ID NO: 206232 - DNA, 17 bp, Homo sapiens
ccgggtcaccctgtgac

SEQ ID NO: 206233 - DNA, 14 bp, Homo sapiens
ccgggtgagatgga

SEQ ID NO: 206234 - DNA, 14 bp, Homo sapiens
ccgggtgccattcc

SEQ ID NO: 206235 - DNA, 16 bp, Homo sapiens
ccgggtgcctgtgacc

SEQ ID NO: 206236 - DNA, 21 bp, Homo sapiens
ccgggtgcgtgaccggcccgc

SEQ ID NO: 206237 - DNA, 22 bp, Homo sapiens
ccgggtgcgtgaccggcccgcc

SEQ ID NO: 206238 - DNA, 13 bp, Homo sapiens
ccgggtgggcctg

SEQ ID NO: 206239 - DNA, 16 bp, Homo sapiens
ccgggtgggcctggcc

SEQ ID NO: 206240 - DNA, 18 bp, Homo sapiens
ccgggtgggcctggcctg

SEQ ID NO: 206241 - DNA, 22 bp, Homo sapiens
ccgggttcacgccattctcctg

SEQ ID NO: 206242 - DNA, 20 bp, Homo sapiens
ccgggttctagtctcctttg

SEQ ID NO: 206243 - DNA, 17 bp, Homo sapiens
ccgggttggaggcctca

SEQ ID NO: 206244 - DNA, 19 bp, Homo sapiens
ccgggttggaggcctcacc

SEQ ID NO: 206245 - DNA, 21 bp, Homo sapiens
ccgggtttggcgggccaagga

SEQ ID NO: 206246 - DNA, 17 bp, Homo sapiens
ccggtggtttgccatgt

SEQ ID NO: 206247 - DNA, 20 bp, Homo sapiens
ccggttcagacccctgcctg

SEQ ID NO: 206248 - DNA, 14 bp, Homo sapiens
ccggttgcttctgg

SEQ ID NO: 206249 - DNA, 17 bp, Homo sapiens
ccggttgcttctgggaa

SEQ ID NO: 206250 - DNA, 23 bp, Homo sapiens
ccgtaaagtgagcatgctttctg

SEQ ID NO: 206251 - DNA, 22 bp, Homo sapiens
ccgtacctcttcccatgactgc

SEQ ID NO: 206252 - DNA, 12 bp, Homo sapiens
ccgtactctcac

SEQ ID NO: 206253 - DNA, 22 bp, Homo sapiens
ccgtagccactctctgcccact

SEQ ID NO: 206254 - DNA, 21 bp, Homo sapiens
ccgtaggcagcctctctgcta

SEQ ID NO: 206255 - DNA, 22 bp, Homo sapiens
ccgtattggttgggggctcctg

SEQ ID NO: 206256 - DNA, 17 bp, Homo sapiens
ccgtcagccaaatgtaa

SEQ ID NO: 206257 - DNA, 21 bp, Homo sapiens
ccgtcatggcttaatgtttat

SEQ ID NO: 206258 - DNA, 14 bp, Homo sapiens
ccgtccacccaggc

SEQ ID NO: 206259 - DNA, 15 bp, Homo sapiens
ccgtccacccaggct

SEQ ID NO: 206260 - DNA, 21 bp, Homo sapiens
ccgtccacccaggctgcactg

SEQ ID NO: 206261 - DNA, 24 bp, Homo sapiens
ccgtccacccaggctgcactgcag

SEQ ID NO: 206262 - DNA, 22 bp, Homo sapiens
ccgtccagccgccattgccacc

SEQ ID NO: 206263 - DNA, 16 bp, Homo sapiens
ccgtccatggcaccag

SEQ ID NO: 206264 - DNA, 23 bp, Homo sapiens
ccgtccatggcaccagccccctg

SEQ ID NO: 206265 - DNA, 12 bp, Homo sapiens
ccgtccccaggg

SEQ ID NO: 206266 - DNA, 17 bp, Homo sapiens
ccgtcccgcgttcaaga

SEQ ID NO: 206267 - DNA, 13 bp, Homo sapiens
ccgtcccggcccc

SEQ ID NO: 206268 - DNA, 18 bp, Homo sapiens
ccgtcctggcagggcagg

SEQ ID NO: 206269 - DNA, 17 bp, Homo sapiens
ccgtcggactgccccca

SEQ ID NO: 206270 - DNA, 16 bp, Homo sapiens
ccgtctcatgaggggc

SEQ ID NO: 206271 - DNA, 13 bp, Homo sapiens
ccgtctcctccct

SEQ ID NO: 206272 - DNA, 14 bp, Homo sapiens
ccgtctgactccag

SEQ ID NO: 206273 - DNA, 14 bp, Homo sapiens
cctcagatggcaca

SEQ ID NO: 206274 - DNA, 15 bp, Homo sapiens
cctcagatgtgttga

SEQ ID NO: 206275 - DNA, 15 bp, Homo sapiens
cctcagccagctgcc

SEQ ID NO: 206276 - DNA, 13 bp, Homo sapiens
cctcagccccagg

SEQ ID NO: 206277 - DNA, 17 bp, Homo sapiens
cctcagccccagggccc

SEQ ID NO: 206278 - DNA, 18 bp, Homo sapiens
cctcagccccagggccct

SEQ ID NO: 206279 - DNA, 22 bp, Homo sapiens
cctcagccccagggccctgctc

SEQ ID NO: 206280 - DNA, 13 bp, Homo sapiens
cctcagcccctct

SEQ ID NO: 206281 - DNA, 16 bp, Homo sapiens
cctcagcccctcttgc

SEQ ID NO: 206282 - DNA, 19 bp, Homo sapiens
cctcagcccctcttgcccc

SEQ ID NO: 206283 - DNA, 20 bp, Homo sapiens
cctcagcccctcttgccccc

SEQ ID NO: 206284 - DNA, 11 bp, Homo sapiens
cctcagccctt

SEQ ID NO: 206285 - DNA, 12 bp, Homo sapiens
cctcagcctccg

SEQ ID NO: 206286 - DNA, 14 bp, Homo sapiens
cctcagcgctccct

SEQ ID NO: 206287 - DNA, 17 bp, Homo sapiens
cctcagcgctccctgtc

SEQ ID NO: 206288 - DNA, 19 bp, Homo sapiens
cctcagcgctccctgtcgc

SEQ ID NO: 206289 - DNA, 22 bp, Homo sapiens
cctcagcgctccctgtcgcctg

SEQ ID NO: 206290 - DNA, 17 bp, Homo sapiens
cctcagcgctgcccaca

SEQ ID NO: 206291 - DNA, 16 bp, Homo sapiens
cctcagctatcagtgt

SEQ ID NO: 206292 - DNA, 12 bp, Homo sapiens
cctcagctctgg

SEQ ID NO: 206293 - DNA, 13 bp, Homo sapiens
cctcagctctggg

SEQ ID NO: 206294 - DNA, 16 bp, Homo sapiens
cctcagctctgggaga

SEQ ID NO: 206295 - DNA, 18 bp, Homo sapiens
cctcagctctgggagagg

SEQ ID NO: 206296 - DNA, 11 bp, Homo sapiens
cctcagctgca

SEQ ID NO: 206297 - DNA, 18 bp, Homo sapiens
cctcagctgcacattcct

SEQ ID NO: 206298 - DNA, 19 bp, Homo sapiens
cctcagctgcacattcctg

SEQ ID NO: 206299 - DNA, 15 bp, Homo sapiens
cctcagctgccaagc

SEQ ID NO: 206300 - DNA, 16 bp, Homo sapiens
cctcagctgccaagca

SEQ ID NO: 206301 - DNA, 15 bp, Homo sapiens
cctcagctgcctcac

SEQ ID NO: 206302 - DNA, 17 bp, Homo sapiens
cctcagctgcctcactt

SEQ ID NO: 206303 - DNA, 19 bp, Homo sapiens
cctcagctgcctcacttcc

SEQ ID NO: 206304 - DNA, 12 bp, Homo sapiens
cctcaggagagc

SEQ ID NO: 206305 - DNA, 13 bp, Homo sapiens
cctcaggaggcag

SEQ ID NO: 206306 - DNA, 22 bp, Homo sapiens
cctcaggcagaggatgttctgg

SEQ ID NO: 206307 - DNA, 22 bp, Homo sapiens
cctcaggcataggcctgggtgc

SEQ ID NO: 206308 - DNA, 18 bp, Homo sapiens
cctcaggctgctggagga

SEQ ID NO: 206309 - DNA, 14 bp, Homo sapiens
cctcagggctctac

SEQ ID NO: 206310 - DNA, 19 bp, Homo sapiens
cctcaggtagtactgggaa

SEQ ID NO: 206311 - DNA, 15 bp, Homo sapiens
cctcagtcagttccc

SEQ ID NO: 206312 - DNA, 15 bp, Homo sapiens
cctcagtgccacttg

SEQ ID NO: 206313 - DNA, 16 bp, Homo sapiens
cctcagtggactttcc

SEQ ID NO: 206314 - DNA, 20 bp, Homo sapiens
cctcagtggactttccaccc

SEQ ID NO: 206315 - DNA, 11 bp, Homo sapiens
cctcagtgtca

SEQ ID NO: 206316 - DNA, 13 bp, Homo sapiens
cctcagtgtgaag

SEQ ID NO: 206317 - DNA, 14 bp, Homo sapiens
cctcagtgtgaagc

SEQ ID NO: 206318 - DNA, 15 bp, Homo sapiens
cctcagttcccttgg

SEQ ID NO: 206319 - DNA, 16 bp, Homo sapiens
cctcagttcccttggc

SEQ ID NO: 206320 - DNA, 19 bp, Homo sapiens
cctcagttcccttggcctc

SEQ ID NO: 206321 - DNA, 22 bp, Homo sapiens
cctcagttcccttggcctcaga

SEQ ID NO: 206322 - DNA, 15 bp, Homo sapiens
cctcagttggaatca

SEQ ID NO: 206323 - DNA, 21 bp, Homo sapiens
cctcagttgtttctaagagca

SEQ ID NO: 206324 - DNA, 21 bp, Homo sapiens
cctcagtttctgttgtttctt

SEQ ID NO: 206325 - DNA, 19 bp, Homo sapiens
cctcatcaggatgaaccca

SEQ ID NO: 206326 - DNA, 12 bp, Homo sapiens
cctcatccatgc

SEQ ID NO: 206327 - DNA, 13 bp, Homo sapiens
cctcatcctgctt

SEQ ID NO: 206328 - DNA, 21 bp, Homo sapiens
cctcatctataaaatgaggga

SEQ ID NO: 206329 - DNA, 19 bp, Homo sapiens
cctcatctccagtatcctg

SEQ ID NO: 206330 - DNA, 15 bp, Homo sapiens
cctcatgaatgtaaa

SEQ ID NO: 206331 - DNA, 16 bp, Homo sapiens
cctcatgaatgtaaat

SEQ ID NO: 206332 - DNA, 17 bp, Homo sapiens
cctcatgaatgtaaatt

SEQ ID NO: 206333 - DNA, 14 bp, Homo sapiens
cctcatgcctggcc

SEQ ID NO: 206334 - DNA, 13 bp, Homo sapiens
cctcatgctctct

SEQ ID NO: 206335 - DNA, 14 bp, Homo sapiens
cctcatgctctcta

SEQ ID NO: 206336 - DNA, 17 bp, Homo sapiens
cctcatggactccagga

SEQ ID NO: 206337 - DNA, 15 bp, Homo sapiens
cctcatgggagtcag

SEQ ID NO: 206338 - DNA, 19 bp, Homo sapiens
cctcatggtgggttcaggg

SEQ ID NO: 206339 - DNA, 16 bp, Homo sapiens
cctcatgtcatttctc

SEQ ID NO: 206340 - DNA, 21 bp, Homo sapiens
cctcattccaccttcccatgc

SEQ ID NO: 206341 - DNA, 12 bp, Homo sapiens
cctcatttgcat

SEQ ID NO: 206342 - DNA, 16 bp, Homo sapiens
cctccaaactcctgcc

SEQ ID NO: 206343 - DNA, 19 bp, Homo sapiens
cctccaaactcctgcctgt

SEQ ID NO: 206344 - DNA, 20 bp, Homo sapiens
cctccaaactcctgcctgtg

SEQ ID NO: 206345 - DNA, 19 bp, Homo sapiens
cctccaaagtcttgatagc

SEQ ID NO: 206346 - DNA, 16 bp, Homo sapiens
cctccaaatgctgtcg

SEQ ID NO: 206347 - DNA, 13 bp, Homo sapiens
cctccaagaaact

SEQ ID NO: 206348 - DNA, 14 bp, Homo sapiens
cctccaagaaactt

SEQ ID NO: 206349 - DNA, 21 bp, Homo sapiens
cctccaagctccatctccact

SEQ ID NO: 206350 - DNA, 15 bp, Homo sapiens
cctccaaggactcta

SEQ ID NO: 206351 - DNA, 23 bp, Homo sapiens
cctccacaccagtggcctcgtgg

SEQ ID NO: 206352 - DNA, 16 bp, Homo sapiens
cctccacagtgctgct

SEQ ID NO: 206353 - DNA, 17 bp, Homo sapiens
cctccacatcccagcag

SEQ ID NO: 206354 - DNA, 20 bp, Homo sapiens
cctccacccccaagaaacct

SEQ ID NO: 206355 - DNA, 18 bp, Homo sapiens
cctccacccccgccacgg

SEQ ID NO: 206356 - DNA, 13 bp, Homo sapiens
cctccacccgtcc

SEQ ID NO: 206357 - DNA, 21 bp, Homo sapiens
cctccaccgagccagcttggt

SEQ ID NO: 206358 - DNA, 17 bp, Homo sapiens
cctccacctgggagatg

SEQ ID NO: 206359 - DNA, 18 bp, Homo sapiens
cctccacgttcacccctc

SEQ ID NO: 206360 - DNA, 16 bp, Homo sapiens
cctccactcactccag

SEQ ID NO: 206361 - DNA, 21 bp, Homo sapiens
cctccactcactccagcccaa

SEQ ID NO: 206362 - DNA, 14 bp, Homo sapiens
cctccactcctccc

SEQ ID NO: 206363 - DNA, 19 bp, Homo sapiens
cctccactctagttctaga

SEQ ID NO: 206364 - DNA, 13 bp, Homo sapiens
cctccactgccct

SEQ ID NO: 206365 - DNA, 18 bp, Homo sapiens
cctccactgtgtccagag

SEQ ID NO: 206366 - DNA, 13 bp, Homo sapiens
cctccagaagcct

SEQ ID NO: 206367 - DNA, 18 bp, Homo sapiens
cctccagaagcctctggc

SEQ ID NO: 206368 - DNA, 19 bp, Homo sapiens
cctccagaagcctctggct

SEQ ID NO: 206369 - DNA, 15 bp, Homo sapiens
cctccagaccaccag

SEQ ID NO: 206370 - DNA, 16 bp, Homo sapiens
cctccagaccaccagc

SEQ ID NO: 206371 - DNA, 17 bp, Homo sapiens
cctccagacccctaccc

SEQ ID NO: 206372 - DNA, 17 bp, Homo sapiens
cctccagaccctgcctg

SEQ ID NO: 206373 - DNA, 18 bp, Homo sapiens
cctccagaccctgcctga

SEQ ID NO: 206374 - DNA, 22 bp, Homo sapiens
cctccagactcgagagggctga

SEQ ID NO: 206375 - DNA, 19 bp, Homo sapiens
cctccagagccagcctggg

SEQ ID NO: 206376 - DNA, 23 bp, Homo sapiens
cctccagagccagcctgggactc

SEQ ID NO: 206377 - DNA, 12 bp, Homo sapiens
cctccagcacag

SEQ ID NO: 206378 - DNA, 14 bp, Homo sapiens
cctccagcacagac

SEQ ID NO: 206379 - DNA, 16 bp, Homo sapiens
cctccagcacagactg

SEQ ID NO: 206380 - DNA, 18 bp, Homo sapiens
cctccagcctcccctccc

SEQ ID NO: 206381 - DNA, 12 bp, Homo sapiens
cctccagcctct

SEQ ID NO: 206382 - DNA, 13 bp, Homo sapiens
cctccagcctctc

SEQ ID NO: 206383 - DNA, 16 bp, Homo sapiens
cctccagcctctcccg

SEQ ID NO: 206384 - DNA, 17 bp, Homo sapiens
cctccagcctctcccgg

SEQ ID NO: 206385 - DNA, 22 bp, Homo sapiens
cctccagcgagtaccccagcca

SEQ ID NO: 206386 - DNA, 22 bp, Homo sapiens
cctccagctctttcctccttcc

SEQ ID NO: 206387 - DNA, 19 bp, Homo sapiens
gcccaccctgggcctcccg

SEQ ID NO: 206388 - DNA, 21 bp, Homo sapiens
gcccaccctgggcctcccgtc

SEQ ID NO: 206389 - DNA, 19 bp, Homo sapiens
gcccaccgaccccctttct

SEQ ID NO: 206390 - DNA, 15 bp, Homo sapiens
gcccacctaccttca

SEQ ID NO: 206391 - DNA, 13 bp, Homo sapiens
gcccacctcgtcc

SEQ ID NO: 206392 - DNA, 14 bp, Homo sapiens
gcccacctcgtccc

SEQ ID NO: 206393 - DNA, 13 bp, Homo sapiens
gcccacctctgct

SEQ ID NO: 206394 - DNA, 18 bp, Homo sapiens
gcccacctctgctgccca

SEQ ID NO: 206395 - DNA, 22 bp, Homo sapiens
gcccacctctgctgcccacggc

SEQ ID NO: 206396 - DNA, 10 bp, Homo sapiens
gcccacctga

SEQ ID NO: 206397 - DNA, 15 bp, Homo sapiens
gcccacctgcatcag

SEQ ID NO: 206398 - DNA, 22 bp, Homo sapiens
gcccacctgcatcagcctctgg

SEQ ID NO: 206399 - DNA, 15 bp, Homo sapiens
gcccacctgcccagt

SEQ ID NO: 206400 - DNA, 14 bp, Homo sapiens
gcccacctgcccat

SEQ ID NO: 206401 - DNA, 17 bp, Homo sapiens
gcccacctgggccctag

SEQ ID NO: 206402 - DNA, 18 bp, Homo sapiens
gcccacctgggccctagg

SEQ ID NO: 206403 - DNA, 16 bp, Homo sapiens
gcccacctgggctggg

SEQ ID NO: 206404 - DNA, 13 bp, Homo sapiens
gcccacgcagagc

SEQ ID NO: 206405 - DNA, 18 bp, Homo sapiens
gcccacgcagagccccgg

SEQ ID NO: 206406 - DNA, 22 bp, Homo sapiens
gcccacgcagagccccggagca

SEQ ID NO: 206407 - DNA, 21 bp, Homo sapiens
gcccacgcccgactagcaggc

SEQ ID NO: 206408 - DNA, 21 bp, Homo sapiens
gcccacgccctccctctccca

SEQ ID NO: 206409 - DNA, 13 bp, Homo sapiens
gcccacggccacc

SEQ ID NO: 206410 - DNA, 18 bp, Homo sapiens
gcccacggccacccaccc

SEQ ID NO: 206411 - DNA, 20 bp, Homo sapiens
gcccacggctaagaggctgc

SEQ ID NO: 206412 - DNA, 13 bp, Homo sapiens
gcccactgtcctg

SEQ ID NO: 206413 - DNA, 14 bp, Homo sapiens
gcccactgtcctgg

SEQ ID NO: 206414 - DNA, 17 bp, Homo sapiens
gcccactgtcctgggcg

SEQ ID NO: 206415 - DNA, 22 bp, Homo sapiens
gcccagaacgggcctccccggg

SEQ ID NO: 206416 - DNA, 17 bp, Homo sapiens
gcccagaactgccccca

SEQ ID NO: 206417 - DNA, 16 bp, Homo sapiens
gcccagacccctctgg

SEQ ID NO: 206418 - DNA, 19 bp, Homo sapiens
gcccagacctcccctcttc

SEQ ID NO: 206419 - DNA, 14 bp, Homo sapiens
gcccagactacagg

SEQ ID NO: 206420 - DNA, 13 bp, Homo sapiens
gcccagagagctg

SEQ ID NO: 206421 - DNA, 16 bp, Homo sapiens
gcccagagctggaaca

SEQ ID NO: 206422 - DNA, 18 bp, Homo sapiens
gcccagaggagccaagtc

SEQ ID NO: 206423 - DNA, 22 bp, Homo sapiens
gcccagaggagctgggagccgg

SEQ ID NO: 206424 - DNA, 16 bp, Homo sapiens
gcccagcagcggccca

SEQ ID NO: 206425 - DNA, 17 bp, Homo sapiens
gcccagcagcggcccag

SEQ ID NO: 206426 - DNA, 17 bp, Homo sapiens
gcccagcagcttggctg

SEQ ID NO: 206427 - DNA, 19 bp, Homo sapiens
gcccagcagcttggctgag

SEQ ID NO: 206428 - DNA, 20 bp, Homo sapiens
gcccagccaaaccctgtctg

SEQ ID NO: 206429 - DNA, 17 bp, Homo sapiens
gcccagccatgggccct

SEQ ID NO: 206430 - DNA, 19 bp, Homo sapiens
gcccagccatgggccctct

SEQ ID NO: 206431 - DNA, 16 bp, Homo sapiens
gcccagcccagctgct

SEQ ID NO: 206432 - DNA, 10 bp, Homo sapiens
gcccagccct

SEQ ID NO: 206433 - DNA, 11 bp, Homo sapiens
gcccagccctc

SEQ ID NO: 206434 - DNA, 18 bp, Homo sapiens
gcccagccctcccagctg

SEQ ID NO: 206435 - DNA, 20 bp, Homo sapiens
gcccagccctcccagctggt

SEQ ID NO: 206436 - DNA, 16 bp, Homo sapiens
gcccagccggggtggg

SEQ ID NO: 206437 - DNA, 19 bp, Homo sapiens
gcccagccggggtggggtg

SEQ ID NO: 206438 - DNA, 23 bp, Homo sapiens
gcccagccggggtggggtgcctg

SEQ ID NO: 206439 - DNA, 15 bp, Homo sapiens
gcccagcctaggccc

SEQ ID NO: 206440 - DNA, 22 bp, Homo sapiens
gcccagcctctccccgctctgg

SEQ ID NO: 206441 - DNA, 13 bp, Homo sapiens
gcccagcctggag

SEQ ID NO: 206442 - DNA, 13 bp, Homo sapiens
gcccagcctggcc

SEQ ID NO: 206443 - DNA, 17 bp, Homo sapiens
gcccagcctggccccaa

SEQ ID NO: 206444 - DNA, 12 bp, Homo sapiens
gcccagcctgtc

SEQ ID NO: 206445 - DNA, 16 bp, Homo sapiens
gcccagcctgtcctgg

SEQ ID NO: 206446 - DNA, 16 bp, Homo sapiens
gcccagcggcccctcc

SEQ ID NO: 206447 - DNA, 19 bp, Homo sapiens
gcccagcggcccctcccac

SEQ ID NO: 206448 - DNA, 23 bp, Homo sapiens
gcccagcggcccctcccacacac

SEQ ID NO: 206449 - DNA, 23 bp, Homo sapiens
gcccagctacattcctcagctgc

SEQ ID NO: 206450 - DNA, 16 bp, Homo sapiens
gcccagctccactcag

SEQ ID NO: 206451 - DNA, 19 bp, Homo sapiens
gcccagctccactcagggc

SEQ ID NO: 206452 - DNA, 13 bp, Homo sapiens
gcccagctgctct

SEQ ID NO: 206453 - DNA, 21 bp, Homo sapiens
gcccagctgggctctgccacc

SEQ ID NO: 206454 - DNA, 14 bp, Homo sapiens
gcccagctggggcc

SEQ ID NO: 206455 - DNA, 17 bp, Homo sapiens
gcccagctggggcccct

SEQ ID NO: 206456 - DNA, 21 bp, Homo sapiens
gcccagctggggcccctcggc

SEQ ID NO: 206457 - DNA, 22 bp, Homo sapiens
gcccagctggggcccctcggct

SEQ ID NO: 206458 - DNA, 24 bp, Homo sapiens
gcccagctggggcccctcggctac

SEQ ID NO: 206459 - DNA, 14 bp, Homo sapiens
gcccagctgtagcc

SEQ ID NO: 206460 - DNA, 14 bp, Homo sapiens
gcccagcttcctgg

SEQ ID NO: 206461 - DNA, 17 bp, Homo sapiens
gcccagcttcctggtgt

SEQ ID NO: 206462 - DNA, 15 bp, Homo sapiens
gcccagcttgggccc

SEQ ID NO: 206463 - DNA, 16 bp, Homo sapiens
gcccagcttgggccca

SEQ ID NO: 206464 - DNA, 19 bp, Homo sapiens
gcccagcttgggcccagct

SEQ ID NO: 206465 - DNA, 22 bp, Homo sapiens
gcccagcttgggcccagctggg

SEQ ID NO: 206466 - DNA, 23 bp, Homo sapiens
gcccaggagcggcgatgcactcg

SEQ ID NO: 206467 - DNA, 21 bp, Homo sapiens
gcccaggagctgagtcacctc

SEQ ID NO: 206468 - DNA, 16 bp, Homo sapiens
gcccaggaggacctgg

SEQ ID NO: 206469 - DNA, 19 bp, Homo sapiens
gcccaggattgtacgtggg

SEQ ID NO: 206470 - DNA, 21 bp, Homo sapiens
gcccaggattgtacgtgggag

SEQ ID NO: 206471 - DNA, 14 bp, Homo sapiens
gcccaggccggcca

SEQ ID NO: 206472 - DNA, 16 bp, Homo sapiens
gcccaggccggccagc

SEQ ID NO: 206473 - DNA, 20 bp, Homo sapiens
gcccaggccggccagcctca

SEQ ID NO: 206474 - DNA, 14 bp, Homo sapiens
gcccaggcctggag

SEQ ID NO: 206475 - DNA, 15 bp, Homo sapiens
gcccaggcctggagc

SEQ ID NO: 206476 - DNA, 19 bp, Homo sapiens
gcccaggcctggcctcggg

SEQ ID NO: 206477 - DNA, 21 bp, Homo sapiens
gcccaggcctggcctcggggc

SEQ ID NO: 206478 - DNA, 12 bp, Homo sapiens
gcccaggctccc

SEQ ID NO: 206479 - DNA, 20 bp, Homo sapiens
gcccaggctcccctgcccgc

SEQ ID NO: 206480 - DNA, 18 bp, Homo sapiens
gcccaggctctgctgact

SEQ ID NO: 206481 - DNA, 15 bp, Homo sapiens
gcccaggctggagtg

SEQ ID NO: 206482 - DNA, 23 bp, Homo sapiens
gcccaggggctgtggccgtctcc

SEQ ID NO: 206483 - DNA, 17 bp, Homo sapiens
gcccagggtcctgtgcc

SEQ ID NO: 206484 - DNA, 21 bp, Homo sapiens
gcccagggtcctgtgcctgga

SEQ ID NO: 206485 - DNA, 17 bp, Homo sapiens
gcccagggttcccccag

SEQ ID NO: 206486 - DNA, 17 bp, Homo sapiens
gaggctgggccaagcca

SEQ ID NO: 206487 - DNA, 21 bp, Homo sapiens
gaggctgggccaagccaggga

SEQ ID NO: 206488 - DNA, 13 bp, Homo sapiens
gaggctgtctggg

SEQ ID NO: 206489 - DNA, 17 bp, Homo sapiens
gaggctgtctggggcct

SEQ ID NO: 206490 - DNA, 13 bp, Homo sapiens
gaggcttccaggc

SEQ ID NO: 206491 - DNA, 20 bp, Homo sapiens
gaggcttccaggctcttcct

SEQ ID NO: 206492 - DNA, 21 bp, Homo sapiens
gaggcttccaggctcttcctg

SEQ ID NO: 206493 - DNA, 17 bp, Homo sapiens
gaggcttgtcagagctg

SEQ ID NO: 206494 - DNA, 19 bp, Homo sapiens
gaggcttgtcagagctggg

SEQ ID NO: 206495 - DNA, 19 bp, Homo sapiens
gaggctttaagctccagct

SEQ ID NO: 206496 - DNA, 16 bp, Homo sapiens
gaggcttttcccacca

SEQ ID NO: 206497 - DNA, 18 bp, Homo sapiens
gagggaagcccacccgcc

SEQ ID NO: 206498 - DNA, 22 bp, Homo sapiens
gagggaagcccacccgccccag

SEQ ID NO: 206499 - DNA, 23 bp, Homo sapiens
gagggaagcccacccgccccaga

SEQ ID NO: 206500 - DNA, 14 bp, Homo sapiens
gagggaatgtgaaa

SEQ ID NO: 206501 - DNA, 21 bp, Homo sapiens
gagggacaaatttaaaacaaa

SEQ ID NO: 206502 - DNA, 21 bp, Homo sapiens
gagggacaagggattctggga

SEQ ID NO: 206503 - DNA, 18 bp, Homo sapiens
gagggaccttggagagct

SEQ ID NO: 206504 - DNA, 19 bp, Homo sapiens
gagggaccttggagagctc

SEQ ID NO: 206505 - DNA, 15 bp, Homo sapiens
gagggacgaagaaag

SEQ ID NO: 206506 - DNA, 16 bp, Homo sapiens
gagggacgaagaaagg

SEQ ID NO: 206507 - DNA, 17 bp, Homo sapiens
gagggactgtatttctg

SEQ ID NO: 206508 - DNA, 12 bp, Homo sapiens
gagggagaagga

SEQ ID NO: 206509 - DNA, 22 bp, Homo sapiens
gagggagaaggagaggctctga

SEQ ID NO: 206510 - DNA, 14 bp, Homo sapiens
gagggagcaagcct

SEQ ID NO: 206511 - DNA, 19 bp, Homo sapiens
gagggagccggtttgggag

SEQ ID NO: 206512 - DNA, 20 bp, Homo sapiens
gagggagccggtttgggaga

SEQ ID NO: 206513 - DNA, 17 bp, Homo sapiens
gagggaggggaggtggc

SEQ ID NO: 206514 - DNA, 12 bp, Homo sapiens
gagggagtcagt

SEQ ID NO: 206515 - DNA, 21 bp, Homo sapiens
gagggatgccataccttgaga

SEQ ID NO: 206516 - DNA, 18 bp, Homo sapiens
gagggatgggatttcatg

SEQ ID NO: 206517 - DNA, 19 bp, Homo sapiens
gagggattgaacacaggca

SEQ ID NO: 206518 - DNA, 18 bp, Homo sapiens
gagggcactctctgccag

SEQ ID NO: 206519 - DNA, 13 bp, Homo sapiens
gagggcagagcca

SEQ ID NO: 206520 - DNA, 22 bp, Homo sapiens
gagggcagcactgggaagctgg

SEQ ID NO: 206521 - DNA, 15 bp, Homo sapiens
gagggcagtacctgg

SEQ ID NO: 206522 - DNA, 15 bp, Homo sapiens
gataataactagatc

SEQ ID NO: 206523 - DNA, 17 bp, Homo sapiens
gataataactagatctc

SEQ ID NO: 206524 - DNA, 18 bp, Homo sapiens
gataataactagatctcc

SEQ ID NO: 206525 - DNA, 21 bp, Homo sapiens
gataatcaattattacattta

SEQ ID NO: 206526 - DNA, 18 bp, Homo sapiens
gataatcttagctgccaa

SEQ ID NO: 206527 - DNA, 23 bp, Homo sapiens
gataatgaaatagttattttaat

SEQ ID NO: 206528 - DNA, 17 bp, Homo sapiens
gataatgcttttactaa

SEQ ID NO: 206529 - DNA, 18 bp, Homo sapiens
gataatggataatcttcg

SEQ ID NO: 206530 - DNA, 21 bp, Homo sapiens
gataatgttgtggtttgttgc

SEQ ID NO: 206531 - DNA, 18 bp, Homo sapiens
gataattaaatgaaatac

SEQ ID NO: 206532 - DNA, 16 bp, Homo sapiens
gataatttattttgta

SEQ ID NO: 206533 - DNA, 13 bp, Homo sapiens
gataatttgcata

SEQ ID NO: 206534 - DNA, 19 bp, Homo sapiens
gatacaccgggcctggaga

SEQ ID NO: 206535 - DNA, 22 bp, Homo sapiens
gatacactgtatctaaaaaata

SEQ ID NO: 206536 - DNA, 21 bp, Homo sapiens
gatacagatccgcatgtgtct

SEQ ID NO: 206537 - DNA, 18 bp, Homo sapiens
gatacagtccctaaagaa

SEQ ID NO: 206538 - DNA, 12 bp, Homo sapiens
gatacatgtgcc

SEQ ID NO: 206539 - DNA, 14 bp, Homo sapiens
gatacatttatctt

SEQ ID NO: 206540 - DNA, 21 bp, Homo sapiens
gatacatttatcttctgtttt

SEQ ID NO: 206541 - DNA, 22 bp, Homo sapiens
gatactaatagagtacttaata

SEQ ID NO: 206542 - DNA, 14 bp, Homo sapiens
gatactggaagttt

SEQ ID NO: 206543 - DNA, 16 bp, Homo sapiens
gatactggaagttttg

SEQ ID NO: 206544 - DNA, 20 bp, Homo sapiens
gatactggaagttttgcatt

SEQ ID NO: 206545 - DNA, 13 bp, Homo sapiens
gatactgggtaca

SEQ ID NO: 206546 - DNA, 19 bp, Homo sapiens
gatacttagtggtatgtct

SEQ ID NO: 206547 - DNA, 20 bp, Homo sapiens
gatacttagtggtatgtctc

SEQ ID NO: 206548 - DNA, 22 bp, Homo sapiens
gatacttagtggtatgtctctt

SEQ ID NO: 206549 - DNA, 20 bp, Homo sapiens
gatagaaataaatagctata

SEQ ID NO: 206550 - DNA, 14 bp, Homo sapiens
gatagaagatgttt

SEQ ID NO: 206551 - DNA, 16 bp, Homo sapiens
gatagaagatgtttgc

SEQ ID NO: 206552 - DNA, 17 bp, Homo sapiens
gatagaagatgtttgct

SEQ ID NO: 206553 - DNA, 20 bp, Homo sapiens
gatagagattcccctggacc

SEQ ID NO: 206554 - DNA, 15 bp, Homo sapiens
gatagagcctttgat

SEQ ID NO: 206555 - DNA, 15 bp, Homo sapiens
gatagagctgggtgg

SEQ ID NO: 206556 - DNA, 14 bp, Homo sapiens
gatagatgccctgc

SEQ ID NO: 206557 - DNA, 15 bp, Homo sapiens
gatagatttggaata

SEQ ID NO: 206558 - DNA, 22 bp, Homo sapiens
gatagcatatattcatacctgt

SEQ ID NO: 206559 - DNA, 17 bp, Homo sapiens
gatagcatttttgattt

SEQ ID NO: 206560 - DNA, 22 bp, Homo sapiens
gatagcatttttgatttatgca

SEQ ID NO: 206561 - DNA, 14 bp, Homo sapiens
gatagcctttgtag

SEQ ID NO: 206562 - DNA, 14 bp, Homo sapiens
gatagcgttggaat

SEQ ID NO: 206563 - DNA, 22 bp, Homo sapiens
gatagcgttggaattaaaacaa

SEQ ID NO: 206564 - DNA, 20 bp, Homo sapiens
gatagctaacattttaaata

SEQ ID NO: 206565 - DNA, 22 bp, Homo sapiens
gatagctaacattttaaataaa

SEQ ID NO: 206566 - DNA, 15 bp, Homo sapiens
gatagctattaagat

SEQ ID NO: 206567 - DNA, 14 bp, Homo sapiens
gatagctggggctt

SEQ ID NO: 206568 - DNA, 15 bp, Homo sapiens
gataggagacttgta

SEQ ID NO: 206569 - DNA, 15 bp, Homo sapiens
gataggcaaggatga

SEQ ID NO: 206570 - DNA, 22 bp, Homo sapiens
gataggcaaggatgaaagacaa

SEQ ID NO: 206571 - DNA, 21 bp, Homo sapiens
gataggcccaaggtcccctcc

SEQ ID NO: 206572 - DNA, 12 bp, Homo sapiens
gataggctctgc

SEQ ID NO: 206573 - DNA, 13 bp, Homo sapiens
gataggctctgca

SEQ ID NO: 206574 - DNA, 13 bp, Homo sapiens
gatagtagtaaaa

SEQ ID NO: 206575 - DNA, 14 bp, Homo sapiens
gatagtagtaaaat

SEQ ID NO: 206576 - DNA, 21 bp, Homo sapiens
gatagtagtaaaattagaaaa

SEQ ID NO: 206577 - DNA, 13 bp, Homo sapiens
gatagtcacctgc

SEQ ID NO: 206578 - DNA, 14 bp, Homo sapiens
gatagtcacctgct

SEQ ID NO: 206579 - DNA, 16 bp, Homo sapiens
gatagtcacctgctgg

SEQ ID NO: 206580 - DNA, 19 bp, Homo sapiens
gatagtgccaggtggctca

SEQ ID NO: 206581 - DNA, 16 bp, Homo sapiens
gatagttggttctttt

SEQ ID NO: 206582 - DNA, 14 bp, Homo sapiens
gatatacagatgaa

SEQ ID NO: 206583 - DNA, 19 bp, Homo sapiens
gatatacagatgaaaattt

SEQ ID NO: 206584 - DNA, 15 bp, Homo sapiens
gatatccattctttc

SEQ ID NO: 206585 - DNA, 17 bp, Homo sapiens
gatatccctatgctgcc

SEQ ID NO: 206586 - DNA, 22 bp, Homo sapiens
gatatccctatgtcccagcccc

SEQ ID NO: 206587 - DNA, 13 bp, Homo sapiens
gatatctcaatgt

SEQ ID NO: 206588 - DNA, 22 bp, Homo sapiens
gatatgagaaatataaaaataa

SEQ ID NO: 206589 - DNA, 18 bp, Homo sapiens
gatatgcagttttcctta

SEQ ID NO: 206590 - DNA, 23 bp, Homo sapiens
gatatgcatgtagcatataaatg

SEQ ID NO: 206591 - DNA, 12 bp, Homo sapiens
gatatggagccc

SEQ ID NO: 206592 - DNA, 21 bp, Homo sapiens
gatatggagccctgtaatttt

SEQ ID NO: 206593 - DNA, 15 bp, Homo sapiens
gatatgtctttaaaa

SEQ ID NO: 206594 - DNA, 13 bp, Homo sapiens
gatatgtgtaata

SEQ ID NO: 206595 - DNA, 19 bp, Homo sapiens
gatattaaattttttaaaa

SEQ ID NO: 206596 - DNA, 16 bp, Homo sapiens
gatattatgtggcttt

SEQ ID NO: 206597 - DNA, 23 bp, Homo sapiens
gatattattcaccatgtaaaaca

SEQ ID NO: 206598 - DNA, 15 bp, Homo sapiens
gatattcattaatag

SEQ ID NO: 206599 - DNA, 18 bp, Homo sapiens
gatattccatgaatgtat

SEQ ID NO: 206600 - DNA, 18 bp, Homo sapiens
gatattctccctgacctt

SEQ ID NO: 206601 - DNA, 14 bp, Homo sapiens
gatattctttacaa

SEQ ID NO: 206602 - DNA, 20 bp, Homo sapiens
gatattggttctatttattt

SEQ ID NO: 206603 - DNA, 16 bp, Homo sapiens
gatattgtgaagtaca

SEQ ID NO: 206604 - DNA, 17 bp, Homo sapiens
gatattgtgaagtacat

SEQ ID NO: 206605 - DNA, 16 bp, Homo sapiens
gatattgttttctgta

SEQ ID NO: 206606 - DNA, 20 bp, Homo sapiens
gatatttaagaaaatacaat

SEQ ID NO: 206607 - DNA, 23 bp, Homo sapiens
gatatttaagaaaatacaataaa

SEQ ID NO: 206608 - DNA, 23 bp, Homo sapiens
gatatttatatttttattttatt

SEQ ID NO: 206609 - DNA, 13 bp, Homo sapiens
gatatttcttgct

SEQ ID NO: 206610 - DNA, 21 bp, Homo sapiens
gatattttcaacgcagccctg

SEQ ID NO: 206611 - DNA, 22 bp, Homo sapiens
gatattttcaacgcagccctgc

SEQ ID NO: 206612 - DNA, 23 bp, Homo sapiens
gatattttcaacgcagccctgct

SEQ ID NO: 206613 - DNA, 18 bp, Homo sapiens
gatattttcacatcttaa

SEQ ID NO: 206614 - DNA, 13 bp, Homo sapiens
gatatttttaaaa

SEQ ID NO: 206615 - DNA, 21 bp, Homo sapiens
gatcaaaacctgtgccaggct

SEQ ID NO: 206616 - DNA, 14 bp, Homo sapiens
gatcaaagacacac

SEQ ID NO: 206617 - DNA, 16 bp, Homo sapiens
gatcaaagcaccttga

SEQ ID NO: 206618 - DNA, 18 bp, Homo sapiens
gatcaaagctaggaaagg

SEQ ID NO: 206619 - DNA, 22 bp, Homo sapiens
gatcaaagctaggaaaggcaga

SEQ ID NO: 206620 - DNA, 23 bp, Homo sapiens
gatcaaagctaggaaaggcagaa

SEQ ID NO: 206621 - DNA, 20 bp, Homo sapiens
gatcaagcttgtgtacttga

SEQ ID NO: 206622 - DNA, 23 bp, Homo sapiens
gatcaatggcgcagtgcctctgg

SEQ ID NO: 206623 - DNA, 20 bp, Homo sapiens
gatcacagatgtgcccagag

SEQ ID NO: 206624 - DNA, 13 bp, Homo sapiens
gatcacagcctcc

SEQ ID NO: 206625 - DNA, 17 bp, Homo sapiens
gatcacagcctccaggg

SEQ ID NO: 206626 - DNA, 18 bp, Homo sapiens
gatcaccagcccggcctg

SEQ ID NO: 206627 - DNA, 22 bp, Homo sapiens
gatcaccagcccggcctgctcc

SEQ ID NO: 206628 - DNA, 18 bp, Homo sapiens
gatcacttaagcccagga

SEQ ID NO: 206629 - DNA, 16 bp, Homo sapiens
gatcacttgagcccag

SEQ ID NO: 206630 - DNA, 22 bp, Homo sapiens
gatcagaactgggaaaacagtg

SEQ ID NO: 206631 - DNA, 16 bp, Homo sapiens
gatcagaccataatgt

SEQ ID NO: 206632 - DNA, 12 bp, Homo sapiens
gatcagagagca

SEQ ID NO: 206633 - DNA, 13 bp, Homo sapiens
gatcagagagcaa

SEQ ID NO: 206634 - DNA, 24 bp, Homo sapiens
gatcagcattcaaaatagttctat

SEQ ID NO: 206635 - DNA, 11 bp, Homo sapiens
gatcaggtcat

SEQ ID NO: 206636 - DNA, 21 bp, Homo sapiens
gatcagtctttgtcaatgctc

SEQ ID NO: 206637 - DNA, 20 bp, Homo sapiens
gatcatatgaattagccaaa

SEQ ID NO: 206638 - DNA, 14 bp, Homo sapiens
gatcatgaaaagtg

SEQ ID NO: 206639 - DNA, 19 bp, Homo sapiens
gatcatgcaggaactgaaa

SEQ ID NO: 206640 - DNA, 12 bp, Homo sapiens
gatcatgcattg

SEQ ID NO: 206641 - DNA, 14 bp, Homo sapiens
gatcatggctcact

SEQ ID NO: 206642 - DNA, 20 bp, Homo sapiens
gatcatggctcactgcagcc

SEQ ID NO: 206643 - DNA, 21 bp, Homo sapiens
gatcatggctcactgcagcct

SEQ ID NO: 206644 - DNA, 19 bp, Homo sapiens
gatcattacatggctgtgg

SEQ ID NO: 206645 - DNA, 22 bp, Homo sapiens
gatcattacatggctgtggttc

SEQ ID NO: 206646 - DNA, 22 bp, Homo sapiens
gatcatttattttaagcactct

SEQ ID NO: 206647 - DNA, 21 bp, Homo sapiens
gatcatttgcagctgctggtt

SEQ ID NO: 206648 - DNA, 21 bp, Homo sapiens
gatcatttgcccttaaggaca

SEQ ID NO: 206649 - DNA, 14 bp, Homo sapiens
gatcattttccccc

SEQ ID NO: 206650 - DNA, 19 bp, Homo sapiens
gatcattttccccccactc

SEQ ID NO: 206651 - DNA, 17 bp, Homo sapiens
gatgcatgagctccctc

SEQ ID NO: 206652 - DNA, 21 bp, Homo sapiens
gatgccaaggaggtcccagga

SEQ ID NO: 206653 - DNA, 16 bp, Homo sapiens
gatgccatctgtgtcc

SEQ ID NO: 206654 - DNA, 15 bp, Homo sapiens
gatgcccactgagga

SEQ ID NO: 206655 - DNA, 16 bp, Homo sapiens
gatgccccagagctgt

SEQ ID NO: 206656 - DNA, 23 bp, Homo sapiens
gatgccctataacccctgcctgg

SEQ ID NO: 206657 - DNA, 14 bp, Homo sapiens
gatgccctgggggc

SEQ ID NO: 206658 - DNA, 20 bp, Homo sapiens
gatgcctcccggctttgcag

SEQ ID NO: 206659 - DNA, 18 bp, Homo sapiens
gatgcctccctgaccctg

SEQ ID NO: 206660 - DNA, 19 bp, Homo sapiens
gatgcctccctgaccctgc

SEQ ID NO: 206661 - DNA, 14 bp, Homo sapiens
gatgcctgaacttg

SEQ ID NO: 206662 - DNA, 15 bp, Homo sapiens
gatgcctgacacagg

SEQ ID NO: 206663 - DNA, 14 bp, Homo sapiens
gatgcctttgctgt

SEQ ID NO: 206664 - DNA, 16 bp, Homo sapiens
gatgcggtggctcacg

SEQ ID NO: 206665 - DNA, 18 bp, Homo sapiens
gatgcgttgttacaggaa

SEQ ID NO: 206666 - DNA, 13 bp, Homo sapiens
gatgctaataaac

SEQ ID NO: 206667 - DNA, 16 bp, Homo sapiens
gatgctaataaactgt

SEQ ID NO: 206668 - DNA, 20 bp, Homo sapiens
gatgctagaaaaatgttctt

SEQ ID NO: 206669 - DNA, 23 bp, Homo sapiens
gatgctccctcccctgccctggt

SEQ ID NO: 206670 - DNA, 20 bp, Homo sapiens
gatgctgaaacaggagagaa

SEQ ID NO: 206671 - DNA, 19 bp, Homo sapiens
gatgctgaaagagaaaaga

SEQ ID NO: 206672 - DNA, 19 bp, Homo sapiens
gatgctgaaataaactagg

SEQ ID NO: 206673 - DNA, 10 bp, Homo sapiens
gatgctgaag

SEQ ID NO: 206674 - DNA, 17 bp, Homo sapiens
gatgctgactgtactcc

SEQ ID NO: 206675 - DNA, 14 bp, Homo sapiens
gatgctgaggaggg

SEQ ID NO: 206676 - DNA, 23 bp, Homo sapiens
gatgctgccagggcgccatcgcc

SEQ ID NO: 206677 - DNA, 19 bp, Homo sapiens
gatgctgccccgttccctg

SEQ ID NO: 206678 - DNA, 23 bp, Homo sapiens
gatgctgccccgttccctgtcag

SEQ ID NO: 206679 - DNA, 14 bp, Homo sapiens
gatgctgctcccgc

SEQ ID NO: 206680 - DNA, 15 bp, Homo sapiens
gatgctgggaccctc

SEQ ID NO: 206681 - DNA, 16 bp, Homo sapiens
gatgctgtgcctccca

SEQ ID NO: 206682 - DNA, 19 bp, Homo sapiens
gatgcttaataaacgcagc

SEQ ID NO: 206683 - DNA, 20 bp, Homo sapiens
gatgcttctgctcacattcc

SEQ ID NO: 206684 - DNA, 14 bp, Homo sapiens
gatggaaaaaaaaa

SEQ ID NO: 206685 - DNA, 22 bp, Homo sapiens
gatggaaaaaaaaaacaaaaaa

SEQ ID NO: 206686 - DNA, 17 bp, Homo sapiens
gatggaaaaggaagact

SEQ ID NO: 206687 - DNA, 23 bp, Homo sapiens
gatggaaaggattgtaggtgcaa

SEQ ID NO: 206688 - DNA, 14 bp, Homo sapiens
gatggaacacacac

SEQ ID NO: 206689 - DNA, 23 bp, Homo sapiens
gatggacagttcacaccctgcaa

SEQ ID NO: 206690 - DNA, 20 bp, Homo sapiens
gatggaccgggtgggcctgg

SEQ ID NO: 206691 - DNA, 14 bp, Homo sapiens
gatggactctgaaa

SEQ ID NO: 206692 - DNA, 17 bp, Homo sapiens
gatggagaatgccagcc

SEQ ID NO: 206693 - DNA, 20 bp, Homo sapiens
gatggagccagctctgcatt

SEQ ID NO: 206694 - DNA, 23 bp, Homo sapiens
gatggagcccccagatagagctg

SEQ ID NO: 206695 - DNA, 23 bp, Homo sapiens
gatggaggaaaaccaagccgtgg

SEQ ID NO: 206696 - DNA, 11 bp, Homo sapiens
gatggaggagg

SEQ ID NO: 206697 - DNA, 21 bp, Homo sapiens
gatggaggggtggtcctgact

SEQ ID NO: 206698 - DNA, 22 bp, Homo sapiens
gatggaggggtggtcctgactc

SEQ ID NO: 206699 - DNA, 19 bp, Homo sapiens
gatggaggttctctcggag

SEQ ID NO: 206700 - DNA, 18 bp, Homo sapiens
gatggagtccagggaaga

SEQ ID NO: 206701 - DNA, 20 bp, Homo sapiens
gatggatctgctccatgcag

SEQ ID NO: 206702 - DNA, 19 bp, Homo sapiens
gatggatttgacacactca

SEQ ID NO: 206703 - DNA, 19 bp, Homo sapiens
gatggatttgcctgtgcca

SEQ ID NO: 206704 - DNA, 18 bp, Homo sapiens
gatggcacctgtggccag

SEQ ID NO: 206705 - DNA, 17 bp, Homo sapiens
gatggcattactctgca

SEQ ID NO: 206706 - DNA, 14 bp, Homo sapiens
gatggccaagagca

SEQ ID NO: 206707 - DNA, 15 bp, Homo sapiens
gatggccaagagcat

SEQ ID NO: 206708 - DNA, 22 bp, Homo sapiens
gatggccaagggggtggacgca

SEQ ID NO: 206709 - DNA, 22 bp, Homo sapiens
gatggccatgctcaacccccct

SEQ ID NO: 206710 - DNA, 18 bp, Homo sapiens
gatggccgggctgctgct

SEQ ID NO: 206711 - DNA, 15 bp, Homo sapiens
gatggcgcacccggc

SEQ ID NO: 206712 - DNA, 13 bp, Homo sapiens
gatggcgcgggag

SEQ ID NO: 206713 - DNA, 16 bp, Homo sapiens
gatggcgcgggaggca

SEQ ID NO: 206714 - DNA, 20 bp, Homo sapiens
gatggcgcgggaggcaccag

SEQ ID NO: 206715 - DNA, 14 bp, Homo sapiens
gatggcgctaggca

SEQ ID NO: 206716 - DNA, 17 bp, Homo sapiens
gatggcgtgtcccctgc

SEQ ID NO: 206717 - DNA, 19 bp, Homo sapiens
gatggcgtgtcccctgcct

SEQ ID NO: 206718 - DNA, 19 bp, Homo sapiens
gatggctgtgcctctgcct

SEQ ID NO: 206719 - DNA, 17 bp, Homo sapiens
gatgggactgggagggc

SEQ ID NO: 206720 - DNA, 14 bp, Homo sapiens
gatgggagtaagag

SEQ ID NO: 206721 - DNA, 16 bp, Homo sapiens
gatgggagtctccctc

SEQ ID NO: 206722 - DNA, 14 bp, Homo sapiens
gatgggagtgggca

SEQ ID NO: 206723 - DNA, 14 bp, Homo sapiens
gatgggcacaggct

SEQ ID NO: 206724 - DNA, 21 bp, Homo sapiens
gatgggcatggggtgggcctc

SEQ ID NO: 206725 - DNA, 16 bp, Homo sapiens
gatgggcattgggctg

SEQ ID NO: 206726 - DNA, 21 bp, Homo sapiens
gatgggcattgggctgacacc

SEQ ID NO: 206727 - DNA, 21 bp, Homo sapiens
gatgggctgtttcgtgtagtg

SEQ ID NO: 206728 - DNA, 20 bp, Homo sapiens
gatggggagatcggggccag

SEQ ID NO: 206729 - DNA, 17 bp, Homo sapiens
gatggggagcagctggg

SEQ ID NO: 206730 - DNA, 14 bp, Homo sapiens
gatggggccacagc

SEQ ID NO: 206731 - DNA, 17 bp, Homo sapiens
gatggggttgggctctg

SEQ ID NO: 206732 - DNA, 15 bp, Homo sapiens
gatgggtattaaact

SEQ ID NO: 206733 - DNA, 15 bp, Homo sapiens
gatgggtcctgctgc

SEQ ID NO: 206734 - DNA, 16 bp, Homo sapiens
gatgggtcctgctgct

SEQ ID NO: 206735 - DNA, 10 bp, Homo sapiens
gatgggtggg

SEQ ID NO: 206736 - DNA, 14 bp, Homo sapiens
gatggtcagctccc

SEQ ID NO: 206737 - DNA, 20 bp, Homo sapiens
gatggtcccaggaagcaggg

SEQ ID NO: 206738 - DNA, 17 bp, Homo sapiens
gatggtgacttttgaag

SEQ ID NO: 206739 - DNA, 20 bp, Homo sapiens
gatggtgacttttgaagaac

SEQ ID NO: 206740 - DNA, 15 bp, Homo sapiens
gatggtgagctggga

SEQ ID NO: 206741 - DNA, 16 bp, Homo sapiens
gatggtgagctgggaa

SEQ ID NO: 206742 - DNA, 15 bp, Homo sapiens
gatggtgccccctgg

SEQ ID NO: 206743 - DNA, 17 bp, Homo sapiens
gatggtgccccctgggg

SEQ ID NO: 206744 - DNA, 18 bp, Homo sapiens
gatggttactgaggacca

SEQ ID NO: 206745 - DNA, 14 bp, Homo sapiens
gatgtaaaacagaa

SEQ ID NO: 206746 - DNA, 20 bp, Homo sapiens
gatgtaaaatcttgtcatgt

SEQ ID NO: 206747 - DNA, 16 bp, Homo sapiens
gatgtaaccaagctgt

SEQ ID NO: 206748 - DNA, 18 bp, Homo sapiens
gatgtaatgacagagagt

SEQ ID NO: 206749 - DNA, 23 bp, Homo sapiens
gatgtaatgacagagagttctgg

SEQ ID NO: 206750 - DNA, 17 bp, Homo sapiens
gatgtacagtctgtcat

SEQ ID NO: 206751 - DNA, 13 bp, Homo sapiens
gatgtagcattgt

SEQ ID NO: 206752 - DNA, 14 bp, Homo sapiens
gatgtagcattgtt

SEQ ID NO: 206753 - DNA, 15 bp, Homo sapiens
gatgtatatgtttat

SEQ ID NO: 206754 - DNA, 20 bp, Homo sapiens
gatgtatgaaggcttttggt

SEQ ID NO: 206755 - DNA, 22 bp, Homo sapiens
gatgtatgaaggcttttggtct

SEQ ID NO: 206756 - DNA, 15 bp, Homo sapiens
gatgtattcagagcc

SEQ ID NO: 206757 - DNA, 20 bp, Homo sapiens
gatgtattttcaataaagaa

SEQ ID NO: 206758 - DNA, 20 bp, Homo sapiens
gatgtcaaatatctcagagg

SEQ ID NO: 206759 - DNA, 14 bp, Homo sapiens
gatgtcagccttgc

SEQ ID NO: 206760 - DNA, 15 bp, Homo sapiens
gatgtcagccttgca

SEQ ID NO: 206761 - DNA, 16 bp, Homo sapiens
gatgtccaacaaggaa

SEQ ID NO: 206762 - DNA, 21 bp, Homo sapiens
gatgtccctttcttggccagt

SEQ ID NO: 206763 - DNA, 16 bp, Homo sapiens
gatgtctctaaagcac

SEQ ID NO: 206764 - DNA, 21 bp, Homo sapiens
gatgtctgcaaaggagggcct

SEQ ID NO: 206765 - DNA, 15 bp, Homo sapiens
gatgtcttctgcctg

SEQ ID NO: 206766 - DNA, 18 bp, Homo sapiens
gatgtcttctgcctgtta

SEQ ID NO: 206767 - DNA, 20 bp, Homo sapiens
gatgtcttctgcctgttata

SEQ ID NO: 206768 - DNA, 18 bp, Homo sapiens
gatgtcttgagagcgctg

SEQ ID NO: 206769 - DNA, 21 bp, Homo sapiens
gatgtgaagataatttgcata

SEQ ID NO: 206770 - DNA, 18 bp, Homo sapiens
gatgtgacccaccagtgc

SEQ ID NO: 206771 - DNA, 20 bp, Homo sapiens
gatgtgacccaccagtgcct

SEQ ID NO: 206772 - DNA, 21 bp, Homo sapiens
gatgtgacccaccagtgcctt

SEQ ID NO: 206773 - DNA, 20 bp, Homo sapiens
gatgtgatggaacacacaca

SEQ ID NO: 206774 - DNA, 20 bp, Homo sapiens
gaagtggtgttccatgactt

SEQ ID NO: 206775 - DNA, 14 bp, Homo sapiens
gaagtgtaacagct

SEQ ID NO: 206776 - DNA, 17 bp, Homo sapiens
gaagtgtaacagctgag

SEQ ID NO: 206777 - DNA, 22 bp, Homo sapiens
gaagtgtctaatgcattaactt

SEQ ID NO: 206778 - DNA, 19 bp, Homo sapiens
gaagtgttcaagaaataaa

SEQ ID NO: 206779 - DNA, 18 bp, Homo sapiens
gaagttaacagtctcatt

SEQ ID NO: 206780 - DNA, 17 bp, Homo sapiens
gaagttgcagtgagctg

SEQ ID NO: 206781 - DNA, 22 bp, Homo sapiens
gaagttggagtgagtgtggctc

SEQ ID NO: 206782 - DNA, 22 bp, Homo sapiens
gaagttggtcttactttgtgca

SEQ ID NO: 206783 - DNA, 17 bp, Homo sapiens
gaagttgtaaacacagt

SEQ ID NO: 206784 - DNA, 20 bp, Homo sapiens
gaagttgtgccttttatagc

SEQ ID NO: 206785 - DNA, 17 bp, Homo sapiens
gaagtttacattgtaaa

SEQ ID NO: 206786 - DNA, 15 bp, Homo sapiens
gaagtttcatttatg

SEQ ID NO: 206787 - DNA, 21 bp, Homo sapiens
gaataaaaaacatttgtacat

SEQ ID NO: 206788 - DNA, 13 bp, Homo sapiens
gaataaaattgta

SEQ ID NO: 206789 - DNA, 22 bp, Homo sapiens
gaataaaattgtaaaattgtat

SEQ ID NO: 206790 - DNA, 19 bp, Homo sapiens
gaataaacactttttctgg

SEQ ID NO: 206791 - DNA, 12 bp, Homo sapiens
gaataaagccac

SEQ ID NO: 206792 - DNA, 18 bp, Homo sapiens
gaataaataaagaagaaa

SEQ ID NO: 206793 - DNA, 22 bp, Homo sapiens
gaataaataaagaagaaaataa

SEQ ID NO: 206794 - DNA, 15 bp, Homo sapiens
gaataaattgctcct

SEQ ID NO: 206795 - DNA, 16 bp, Homo sapiens
gaataacactgcagcc

SEQ ID NO: 206796 - DNA, 23 bp, Homo sapiens
gaataaccacttaaaaaatgtcc

SEQ ID NO: 206797 - DNA, 21 bp, Homo sapiens
gaataactctgtggcattatt

SEQ ID NO: 206798 - DNA, 13 bp, Homo sapiens
gaataacttgaag

SEQ ID NO: 206799 - DNA, 23 bp, Homo sapiens
gaataagctctagttcttaacaa

SEQ ID NO: 206800 - DNA, 13 bp, Homo sapiens
gaataatgtagtg

SEQ ID NO: 206801 - DNA, 13 bp, Homo sapiens
gaataattattta

SEQ ID NO: 206802 - DNA, 18 bp, Homo sapiens
gaataattatttatttaa

SEQ ID NO: 206803 - DNA, 14 bp, Homo sapiens
gaataattgtgtac

SEQ ID NO: 206804 - DNA, 17 bp, Homo sapiens
gaataattgtgtacaaa

SEQ ID NO: 206805 - DNA, 19 bp, Homo sapiens
gaataattgtgtacaaagt

SEQ ID NO: 206806 - DNA, 17 bp, Homo sapiens
gaatacaattaaaggtc

SEQ ID NO: 206807 - DNA, 14 bp, Homo sapiens
gaatacagaaaatg

SEQ ID NO: 206808 - DNA, 19 bp, Homo sapiens
gaataccattaaaactgct

SEQ ID NO: 206809 - DNA, 21 bp, Homo sapiens
gaataccattaaaactgcttt

SEQ ID NO: 206810 - DNA, 19 bp, Homo sapiens
gaatactcttggtcacctc

SEQ ID NO: 206811 - DNA, 14 bp, Homo sapiens
gaatagcagtttca

SEQ ID NO: 206812 - DNA, 16 bp, Homo sapiens
gaataggtaggagacc

SEQ ID NO: 206813 - DNA, 16 bp, Homo sapiens
gaatagtctctgggtt

SEQ ID NO: 206814 - DNA, 16 bp, Homo sapiens
gaatagtgcctcagcg

SEQ ID NO: 206815 - DNA, 19 bp, Homo sapiens
gaatagtgcctcagcgctg

SEQ ID NO: 206816 - DNA, 22 bp, Homo sapiens
gaatagtgcctcagcgctgccc

SEQ ID NO: 206817 - DNA, 16 bp, Homo sapiens
gaatataaatgtacta

SEQ ID NO: 206818 - DNA, 21 bp, Homo sapiens
gaatataagcttaaaataagt

SEQ ID NO: 206819 - DNA, 12 bp, Homo sapiens
gaatataattat

SEQ ID NO: 206820 - DNA, 16 bp, Homo sapiens
gaatatatttaagcaa

SEQ ID NO: 206821 - DNA, 20 bp, Homo sapiens
gaatatgacctaaatccatt

SEQ ID NO: 206822 - DNA, 17 bp, Homo sapiens
gaatatgacggaagaac

SEQ ID NO: 206823 - DNA, 15 bp, Homo sapiens
gaatatggaacatat

SEQ ID NO: 206824 - DNA, 16 bp, Homo sapiens
gaatattacattgcat

SEQ ID NO: 206825 - DNA, 12 bp, Homo sapiens
gaatattcagga

SEQ ID NO: 206826 - DNA, 17 bp, Homo sapiens
gaatattgcccaaataa

SEQ ID NO: 206827 - DNA, 18 bp, Homo sapiens
gaatatttattacctctg

SEQ ID NO: 206828 - DNA, 19 bp, Homo sapiens
gaatatttccatatggatt

SEQ ID NO: 206829 - DNA, 14 bp, Homo sapiens
gaatcaaggagcct

SEQ ID NO: 206830 - DNA, 20 bp, Homo sapiens
gaatcaatctggcttctgca

SEQ ID NO: 206831 - DNA, 20 bp, Homo sapiens
gaatcacctaattaatttca

SEQ ID NO: 206832 - DNA, 14 bp, Homo sapiens
gaatcatgttggat

SEQ ID NO: 206833 - DNA, 17 bp, Homo sapiens
gaatcattatttattaa

SEQ ID NO: 206834 - DNA, 18 bp, Homo sapiens
gaatcattgagaaataaa

SEQ ID NO: 206835 - DNA, 24 bp, Homo sapiens
gaatccacccatcctaccaatgca

SEQ ID NO: 206836 - DNA, 19 bp, Homo sapiens
gaatccagctccctagact

SEQ ID NO: 206837 - DNA, 12 bp, Homo sapiens
gaatcccagctc

SEQ ID NO: 206838 - DNA, 13 bp, Homo sapiens
gaatcccagctcc

SEQ ID NO: 206839 - DNA, 22 bp, Homo sapiens
gaatcccatggatgtttcttct

SEQ ID NO: 206840 - DNA, 20 bp, Homo sapiens
gaatcccctaaacaaaaaga

SEQ ID NO: 206841 - DNA, 18 bp, Homo sapiens
gaatcccctcgcttcata

SEQ ID NO: 206842 - DNA, 18 bp, Homo sapiens
gaatcctcagttggaatc

SEQ ID NO: 206843 - DNA, 13 bp, Homo sapiens
gaatcctggctct

SEQ ID NO: 206844 - DNA, 17 bp, Homo sapiens
gaatcctggctctgatt

SEQ ID NO: 206845 - DNA, 19 bp, Homo sapiens
gaatcgaggaaccagagcc

SEQ ID NO: 206846 - DNA, 21 bp, Homo sapiens
gaatcgatgggggatgcttca

SEQ ID NO: 206847 - DNA, 20 bp, Homo sapiens
gaatctaacttgatcttgtt

SEQ ID NO: 206848 - DNA, 13 bp, Homo sapiens
gaatctacagaac

SEQ ID NO: 206849 - DNA, 12 bp, Homo sapiens
gaatctcagcac

SEQ ID NO: 206850 - DNA, 21 bp, Homo sapiens
gaatctcccagacttgtttcc

SEQ ID NO: 206851 - DNA, 12 bp, Homo sapiens
gaatctcccctc

SEQ ID NO: 206852 - DNA, 14 bp, Homo sapiens
gaatctcccctcct

SEQ ID NO: 206853 - DNA, 16 bp, Homo sapiens
gaatctctcaaaatgt

SEQ ID NO: 206854 - DNA, 20 bp, Homo sapiens
gaatctgatcccataaagaa

SEQ ID NO: 206855 - DNA, 12 bp, Homo sapiens
gaatctgccttc

SEQ ID NO: 206856 - DNA, 20 bp, Homo sapiens
gaatctgccttccagcccag

SEQ ID NO: 206857 - DNA, 15 bp, Homo sapiens
gaatctgctgttgcc

SEQ ID NO: 206858 - DNA, 15 bp, Homo sapiens
gaatctggcattcta

SEQ ID NO: 206859 - DNA, 15 bp, Homo sapiens
gaatcttttactgtg

SEQ ID NO: 206860 - DNA, 22 bp, Homo sapiens
gaatcttttactgtggaggtgg

SEQ ID NO: 206861 - DNA, 15 bp, Homo sapiens
gaatgaaaaaacagt

SEQ ID NO: 206862 - DNA, 22 bp, Homo sapiens
gaatgaaaaatttaagcattgt

SEQ ID NO: 206863 - DNA, 24 bp, Homo sapiens
gaatgaaatataaactgtgagata

SEQ ID NO: 206864 - DNA, 14 bp, Homo sapiens
gaatgaatgtcagt

SEQ ID NO: 206865 - DNA, 16 bp, Homo sapiens
gaatgacaacagaagc

SEQ ID NO: 206866 - DNA, 16 bp, Homo sapiens
gaatgaccagcatgat

SEQ ID NO: 206867 - DNA, 16 bp, Homo sapiens
gaatgagagagtgtgg

SEQ ID NO: 206868 - DNA, 21 bp, Homo sapiens
gaatgagctgggccctgggtg

SEQ ID NO: 206869 - DNA, 15 bp, Homo sapiens
gaatgaggaacaatc

SEQ ID NO: 206870 - DNA, 16 bp, Homo sapiens
gaatgaggaacaatca

SEQ ID NO: 206871 - DNA, 15 bp, Homo sapiens
gaatgagggaaacaa

SEQ ID NO: 206872 - DNA, 22 bp, Homo sapiens
gaatgatatctttgacctcaat

SEQ ID NO: 206873 - DNA, 20 bp, Homo sapiens
gaatgatttaaatagaactt

SEQ ID NO: 206874 - DNA, 14 bp, Homo sapiens
gaatgatttttaga

SEQ ID NO: 206875 - DNA, 16 bp, Homo sapiens
gaatgatttttagatg

SEQ ID NO: 206876 - DNA, 15 bp, Homo sapiens
gaatgcaagagaagg

SEQ ID NO: 206877 - DNA, 16 bp, Homo sapiens
gaatgcaagagaagga

SEQ ID NO: 206878 - DNA, 19 bp, Homo sapiens
gaatgcagattcctgggcc

SEQ ID NO: 206879 - DNA, 20 bp, Homo sapiens
gaatgcagattcctgggcct

SEQ ID NO: 206880 - DNA, 16 bp, Homo sapiens
gaatgcagtgggtggg

SEQ ID NO: 206881 - DNA, 19 bp, Homo sapiens
gaatgcattcactcagcat

SEQ ID NO: 206882 - DNA, 13 bp, Homo sapiens
gaatgccagccca

SEQ ID NO: 206883 - DNA, 14 bp, Homo sapiens
gaatgccagcccaa

SEQ ID NO: 206884 - DNA, 14 bp, Homo sapiens
gaatgccgtggatt

SEQ ID NO: 206885 - DNA, 12 bp, Homo sapiens
gaatgcctgtgc

SEQ ID NO: 206886 - DNA, 13 bp, Homo sapiens
gaatgcctgtgcc

SEQ ID NO: 206887 - DNA, 20 bp, Homo sapiens
gaatgcgctcttcaccagga

SEQ ID NO: 206888 - DNA, 22 bp, Homo sapiens
gaatgcgctcttcaccaggaag

SEQ ID NO: 206889 - DNA, 15 bp, Homo sapiens
gaatgcgctttattg

SEQ ID NO: 206890 - DNA, 18 bp, Homo sapiens
gaatgctcaatgtgctgt

SEQ ID NO: 206891 - DNA, 20 bp, Homo sapiens
gaatgctcccccatcctccc

SEQ ID NO: 206892 - DNA, 23 bp, Homo sapiens
gaatgctcccccatcctcccctt

SEQ ID NO: 206893 - DNA, 17 bp, Homo sapiens
gaatgctctgtgccaga

SEQ ID NO: 206894 - DNA, 17 bp, Homo sapiens
gaatgctggttttccta

SEQ ID NO: 206895 - DNA, 18 bp, Homo sapiens
gaatgctggttttcctaa

SEQ ID NO: 206896 - DNA, 22 bp, Homo sapiens
gaatgctggttttcctaaatgc

SEQ ID NO: 206897 - DNA, 14 bp, Homo sapiens
gaatgctgtgttaa

SEQ ID NO: 206898 - DNA, 19 bp, Homo sapiens
gaatggagtccagacctgg

SEQ ID NO: 206899 - DNA, 18 bp, Homo sapiens
gcctccgtttatgggcct

SEQ ID NO: 206900 - DNA, 19 bp, Homo sapiens
gcctccgtttatgggcctt

SEQ ID NO: 206901 - DNA, 22 bp, Homo sapiens
gcctccgtttatgggccttgct

SEQ ID NO: 206902 - DNA, 14 bp, Homo sapiens
gcctcctccagact

SEQ ID NO: 206903 - DNA, 15 bp, Homo sapiens
gcctcctccagactc

SEQ ID NO: 206904 - DNA, 14 bp, Homo sapiens
gcctcctcccatcc

SEQ ID NO: 206905 - DNA, 22 bp, Homo sapiens
gcctcctctaacaggggctggt

SEQ ID NO: 206906 - DNA, 13 bp, Homo sapiens
gcctcctctctcc

SEQ ID NO: 206907 - DNA, 14 bp, Homo sapiens
gcctcctctctccc

SEQ ID NO: 206908 - DNA, 19 bp, Homo sapiens
gcctcctctctccctgcct

SEQ ID NO: 206909 - DNA, 21 bp, Homo sapiens
gcctcctctctccctgcctca

SEQ ID NO: 206910 - DNA, 20 bp, Homo sapiens
gcctcctcttcaccccggca

SEQ ID NO: 206911 - DNA, 19 bp, Homo sapiens
gcctcctgagcctgtgggt

SEQ ID NO: 206912 - DNA, 15 bp, Homo sapiens
gcctcctgccccctg

SEQ ID NO: 206913 - DNA, 24 bp, Homo sapiens
gcctcctgccccctgccagtgaag

SEQ ID NO: 206914 - DNA, 23 bp, Homo sapiens
gcctcctgcctgcccctctcccg

SEQ ID NO: 206915 - DNA, 16 bp, Homo sapiens
gcctcctgctgagtgg

SEQ ID NO: 206916 - DNA, 20 bp, Homo sapiens
gcctcctgctgagtggtcca

SEQ ID NO: 206917 - DNA, 22 bp, Homo sapiens
gcctcctgctgagtggtccaca

SEQ ID NO: 206918 - DNA, 13 bp, Homo sapiens
gcctcctgtgtaa

SEQ ID NO: 206919 - DNA, 16 bp, Homo sapiens
gcctccttccacctcc

SEQ ID NO: 206920 - DNA, 18 bp, Homo sapiens
gcctccttccacctccct

SEQ ID NO: 206921 - DNA, 16 bp, Homo sapiens
gcctcgaactcctggg

SEQ ID NO: 206922 - DNA, 19 bp, Homo sapiens
gcctcgaactcctgggctc

SEQ ID NO: 206923 - DNA, 18 bp, Homo sapiens
gcctcgaatatcttaatt

SEQ ID NO: 206924 - DNA, 22 bp, Homo sapiens
gcctcgaggcaccggcgctgca

SEQ ID NO: 206925 - DNA, 15 bp, Homo sapiens
gcctcgcccctccag

SEQ ID NO: 206926 - DNA, 13 bp, Homo sapiens
gcctcgggacctc

SEQ ID NO: 206927 - DNA, 19 bp, Homo sapiens
gcctcgggccgcctcctcc

SEQ ID NO: 206928 - DNA, 21 bp, Homo sapiens
gcctcgggccgcctcctccag

SEQ ID NO: 206929 - DNA, 18 bp, Homo sapiens
gcctcggggcagggcagg

SEQ ID NO: 206930 - DNA, 18 bp, Homo sapiens
gcctctaagagtgcccgt

SEQ ID NO: 206931 - DNA, 15 bp, Homo sapiens
gcctctaaggccaag

SEQ ID NO: 206932 - DNA, 16 bp, Homo sapiens
gcctctaaggccaagg

SEQ ID NO: 206933 - DNA, 20 bp, Homo sapiens
gcctctaaggccaaggcctc

SEQ ID NO: 206934 - DNA, 23 bp, Homo sapiens
gcctctaaggccaaggcctcagg

SEQ ID NO: 206935 - DNA, 24 bp, Homo sapiens
gcctctactttgtcccctcacctc

SEQ ID NO: 206936 - DNA, 17 bp, Homo sapiens
gcctctcatcccccatt

SEQ ID NO: 206937 - DNA, 12 bp, Homo sapiens
gcctctcccacc

SEQ ID NO: 206938 - DNA, 18 bp, Homo sapiens
gcctctccccgctctgga

SEQ ID NO: 206939 - DNA, 16 bp, Homo sapiens
gcctctcccggctgcc

SEQ ID NO: 206940 - DNA, 17 bp, Homo sapiens
gcctctcccggctgcct

SEQ ID NO: 206941 - DNA, 12 bp, Homo sapiens
gcctctccctta

SEQ ID NO: 206942 - DNA, 19 bp, Homo sapiens
gcctctcggtggccagcag

SEQ ID NO: 206943 - DNA, 17 bp, Homo sapiens
gcctctgaactgctgct

SEQ ID NO: 206944 - DNA, 18 bp, Homo sapiens
gcctctgaagttggacag

SEQ ID NO: 206945 - DNA, 20 bp, Homo sapiens
gcctctgacagcagcctgtg

SEQ ID NO: 206946 - DNA, 23 bp, Homo sapiens
gcctctgacagcagcctgtgagg

SEQ ID NO: 206947 - DNA, 12 bp, Homo sapiens
gcctctgagcca

SEQ ID NO: 206948 - DNA, 14 bp, Homo sapiens
gcctctgagccagg

SEQ ID NO: 206949 - DNA, 19 bp, Homo sapiens
gcctctgagccaggagcct

SEQ ID NO: 206950 - DNA, 13 bp, Homo sapiens
gcctctgccaggc

SEQ ID NO: 206951 - DNA, 18 bp, Homo sapiens
gcctctgccaggcctgta

SEQ ID NO: 206952 - DNA, 15 bp, Homo sapiens
gcctctgcccgcaga

SEQ ID NO: 206953 - DNA, 10 bp, Homo sapiens
gcctctgcct

SEQ ID NO: 206954 - DNA, 21 bp, Homo sapiens
gatgtgcatttttgtgaaatg

SEQ ID NO: 206955 - DNA, 13 bp, Homo sapiens
gatgtgcccagag

SEQ ID NO: 206956 - DNA, 17 bp, Homo sapiens
gatgtgcccagagtagc

SEQ ID NO: 206957 - DNA, 20 bp, Homo sapiens
gatgtgcccagagtagccca

SEQ ID NO: 206958 - DNA, 24 bp, Homo sapiens
gatgtgcgtgctgtctgtcctatg

SEQ ID NO: 206959 - DNA, 13 bp, Homo sapiens
gatgtggatgaaa

SEQ ID NO: 206960 - DNA, 19 bp, Homo sapiens
gatgtggcaaagtgctgta

SEQ ID NO: 206961 - DNA, 20 bp, Homo sapiens
gatgtgtggctcattctttt

SEQ ID NO: 206962 - DNA, 14 bp, Homo sapiens
gatgtgttgtgata

SEQ ID NO: 206963 - DNA, 17 bp, Homo sapiens
gatgttctggacctccc

SEQ ID NO: 206964 - DNA, 20 bp, Homo sapiens
gatgttgaagaatacagtta

SEQ ID NO: 206965 - DNA, 20 bp, Homo sapiens
gatgtttagtagctgataaa

SEQ ID NO: 206966 - DNA, 19 bp, Homo sapiens
gatgtttccagctgccaag

SEQ ID NO: 206967 - DNA, 13 bp, Homo sapiens
gatgtttgtggcc

SEQ ID NO: 206968 - DNA, 13 bp, Homo sapiens
gattaaacacctg

SEQ ID NO: 206969 - DNA, 15 bp, Homo sapiens
gattaaacacctgac

SEQ ID NO: 206970 - DNA, 16 bp, Homo sapiens
gattaaacacctgaca

SEQ ID NO: 206971 - DNA, 15 bp, Homo sapiens
gattaaactgagtga

SEQ ID NO: 206972 - DNA, 16 bp, Homo sapiens
gattaaactgtatgtc

SEQ ID NO: 206973 - DNA, 15 bp, Homo sapiens
gattaaacttcacct

SEQ ID NO: 206974 - DNA, 15 bp, Homo sapiens
gattaaatatttaat

SEQ ID NO: 206975 - DNA, 19 bp, Homo sapiens
gattaaatatttaatgatg

SEQ ID NO: 206976 - DNA, 19 bp, Homo sapiens
gattaaatggcacctgtat

SEQ ID NO: 206977 - DNA, 20 bp, Homo sapiens
gattaaatttaatatactgc

SEQ ID NO: 206978 - DNA, 18 bp, Homo sapiens
gattaagttataccagca

SEQ ID NO: 206979 - DNA, 20 bp, Homo sapiens
gattaatctctaaaattcta

SEQ ID NO: 206980 - DNA, 19 bp, Homo sapiens
gattaatgttttgtacaat

SEQ ID NO: 206981 - DNA, 23 bp, Homo sapiens
gattaatttgtgtagattgtgta

SEQ ID NO: 206982 - DNA, 21 bp, Homo sapiens
gattacaaatagaagcttctt

SEQ ID NO: 206983 - DNA, 18 bp, Homo sapiens
gattacagggatgagcca

SEQ ID NO: 206984 - DNA, 14 bp, Homo sapiens
gattacatgcatgt

SEQ ID NO: 206985 - DNA, 17 bp, Homo sapiens
gattactgtcaataaac

SEQ ID NO: 206986 - DNA, 18 bp, Homo sapiens
gattagaagccaagacag

SEQ ID NO: 206987 - DNA, 16 bp, Homo sapiens
gattagacaatgtgga

SEQ ID NO: 206988 - DNA, 19 bp, Homo sapiens
gattagcaagttacagtga

SEQ ID NO: 206989 - DNA, 14 bp, Homo sapiens
gattagcatgaaag

SEQ ID NO: 206990 - DNA, 17 bp, Homo sapiens
gattagtagtaaatgct

SEQ ID NO: 206991 - DNA, 16 bp, Homo sapiens
gattatattataataa

SEQ ID NO: 206992 - DNA, 10 bp, Homo sapiens
gattatcagg

SEQ ID NO: 206993 - DNA, 16 bp, Homo sapiens
gattatgggtcacagg

SEQ ID NO: 206994 - DNA, 17 bp, Homo sapiens
gattatggttttgtgat

SEQ ID NO: 206995 - DNA, 18 bp, Homo sapiens
gattattatttgtacttt

SEQ ID NO: 206996 - DNA, 15 bp, Homo sapiens
gattattcatttaaa

SEQ ID NO: 206997 - DNA, 20 bp, Homo sapiens
gattattcatttaaaatgat

SEQ ID NO: 206998 - DNA, 13 bp, Homo sapiens
gattattgaatgt

SEQ ID NO: 206999 - DNA, 21 bp, Homo sapiens
gattatttgttatttgtacag

SEQ ID NO: 207000 - DNA, 15 bp, Homo sapiens
gattattttttatga

SEQ ID NO: 207001 - DNA, 15 bp, Homo sapiens
gattcaaatgcatga

SEQ ID NO: 207002 - DNA, 17 bp, Homo sapiens
gattcaattttctttaa

SEQ ID NO: 207003 - DNA, 18 bp, Homo sapiens
gattcacctgtaaaactt

SEQ ID NO: 207004 - DNA, 17 bp, Homo sapiens
gattcactgtcttttga

SEQ ID NO: 207005 - DNA, 18 bp, Homo sapiens
gattcagattgttatcta

SEQ ID NO: 207006 - DNA, 18 bp, Homo sapiens
gattcatatttacttctt

SEQ ID NO: 207007 - DNA, 19 bp, Homo sapiens
gattcatatttacttctta

SEQ ID NO: 207008 - DNA, 22 bp, Homo sapiens
gattcatctaccctgctgacct

SEQ ID NO: 207009 - DNA, 10 bp, Homo sapiens
gattccaaat

SEQ ID NO: 207010 - DNA, 17 bp, Homo sapiens
gattccaagggcccaga

SEQ ID NO: 207011 - DNA, 16 bp, Homo sapiens
gattccccggagctgg

SEQ ID NO: 207012 - DNA, 18 bp, Homo sapiens
gattccccggagctggga

SEQ ID NO: 207013 - DNA, 23 bp, Homo sapiens
gattcccctggaccacacctccg

SEQ ID NO: 207014 - DNA, 17 bp, Homo sapiens
gattcccggctggactt

SEQ ID NO: 207015 - DNA, 21 bp, Homo sapiens
gattcctcacatctttaactt

SEQ ID NO: 207016 - DNA, 23 bp, Homo sapiens
gattcctctgtattgtgctgatt

SEQ ID NO: 207017 - DNA, 20 bp, Homo sapiens
gattcctcttgcctctctca

SEQ ID NO: 207018 - DNA, 12 bp, Homo sapiens
gattcctgggcc

SEQ ID NO: 207019 - DNA, 13 bp, Homo sapiens
gattcctgggcct

SEQ ID NO: 207020 - DNA, 15 bp, Homo sapiens
gattcctgggcctgt

SEQ ID NO: 207021 - DNA, 13 bp, Homo sapiens
gattccttcctgt

SEQ ID NO: 207022 - DNA, 22 bp, Homo sapiens
gattccttctaagtgtacttca

SEQ ID NO: 207023 - DNA, 19 bp, Homo sapiens
gattcgtctgcgattttat

SEQ ID NO: 207024 - DNA, 14 bp, Homo sapiens
gattctaaaacatt

SEQ ID NO: 207025 - DNA, 22 bp, Homo sapiens
gattctaaacagatgtccctga

SEQ ID NO: 207026 - DNA, 17 bp, Homo sapiens
gattctaaaggggacag

SEQ ID NO: 207027 - DNA, 18 bp, Homo sapiens
gattctaaaggggacaga

SEQ ID NO: 207028 - DNA, 18 bp, Homo sapiens
gattctactcttgtcatt

SEQ ID NO: 207029 - DNA, 14 bp, Homo sapiens
gattctatatttca

SEQ ID NO: 207030 - DNA, 21 bp, Homo sapiens
gattctatgcctgtatttcca

SEQ ID NO: 207031 - DNA, 12 bp, Homo sapiens
gattctcctctc

SEQ ID NO: 207032 - DNA, 13 bp, Homo sapiens
gattctcctctcc

SEQ ID NO: 207033 - DNA, 13 bp, Homo sapiens
gattctctattgg

SEQ ID NO: 207034 - DNA, 19 bp, Homo sapiens
gattctggatggccgggct

SEQ ID NO: 207035 - DNA, 16 bp, Homo sapiens
gattcttcaaaagcat

SEQ ID NO: 207036 - DNA, 19 bp, Homo sapiens
gattctttaatagaagttt

SEQ ID NO: 207037 - DNA, 23 bp, Homo sapiens
gattctttcaatccacagtattg

SEQ ID NO: 207038 - DNA, 15 bp, Homo sapiens
gattctttccccaga

SEQ ID NO: 207039 - DNA, 15 bp, Homo sapiens
gattgaacacaggca

SEQ ID NO: 207040 - DNA, 18 bp, Homo sapiens
gattgaacacaggcaaag

SEQ ID NO: 207041 - DNA, 12 bp, Homo sapiens
gattgacatttt

SEQ ID NO: 207042 - DNA, 21 bp, Homo sapiens
gattgacattttgtagctagt

SEQ ID NO: 207043 - DNA, 22 bp, Homo sapiens
gattgatcggagcctcctctct

SEQ ID NO: 207044 - DNA, 16 bp, Homo sapiens
gattgcaaggaaggaa

SEQ ID NO: 207045 - DNA, 15 bp, Homo sapiens
gattgcacgtggcct

SEQ ID NO: 207046 - DNA, 20 bp, Homo sapiens
gattgccatttcttcccaag

SEQ ID NO: 207047 - DNA, 22 bp, Homo sapiens
gattgccatttcttcccaaggc

SEQ ID NO: 207048 - DNA, 23 bp, Homo sapiens
gattgccccagagccccactccc

SEQ ID NO: 207049 - DNA, 24 bp, Homo sapiens
gattgcggtgtgagatggtgcccc

SEQ ID NO: 207050 - DNA, 15 bp, Homo sapiens
gattgctacacacac

SEQ ID NO: 207051 - DNA, 16 bp, Homo sapiens
gattgctacacacaca

SEQ ID NO: 207052 - DNA, 19 bp, Homo sapiens
gattgctctggaagcctgc

SEQ ID NO: 207053 - DNA, 20 bp, Homo sapiens
gattgctctggaagcctgct

SEQ ID NO: 207054 - DNA, 16 bp, Homo sapiens
gattgcttctgtagta

SEQ ID NO: 207055 - DNA, 21 bp, Homo sapiens
gattgcttttattacattagt

SEQ ID NO: 207056 - DNA, 22 bp, Homo sapiens
gattgcttttattacattagtt

SEQ ID NO: 207057 - DNA, 20 bp, Homo sapiens
gattggaaagacaggaagac

SEQ ID NO: 207058 - DNA, 20 bp, Homo sapiens
gattggattattcatttaaa

SEQ ID NO: 207059 - DNA, 19 bp, Homo sapiens
gattggcagcttcaaaaca

SEQ ID NO: 207060 - DNA, 22 bp, Homo sapiens
gattggcagcttcaaaacagaa

SEQ ID NO: 207061 - DNA, 22 bp, Homo sapiens
gattgggggggcttggggtaga

SEQ ID NO: 207062 - DNA, 16 bp, Homo sapiens
gattggtaccagagcc

SEQ ID NO: 207063 - DNA, 20 bp, Homo sapiens
gattgtaaaatagcttgtat

SEQ ID NO: 207064 - DNA, 14 bp, Homo sapiens
gattgtaacatatt

SEQ ID NO: 207065 - DNA, 19 bp, Homo sapiens
gattgtacgtgggagaggc

SEQ ID NO: 207066 - DNA, 23 bp, Homo sapiens
gattgtacgtgggagaggcagaa

SEQ ID NO: 207067 - DNA, 22 bp, Homo sapiens
gattgtcattcttacaaaacat

SEQ ID NO: 207068 - DNA, 17 bp, Homo sapiens
gattgtccacaaatgtc

SEQ ID NO: 207069 - DNA, 19 bp, Homo sapiens
gattgtccacaaatgtcct

SEQ ID NO: 207070 - DNA, 21 bp, Homo sapiens
gattgttaagtctaaatattt

SEQ ID NO: 207071 - DNA, 21 bp, Homo sapiens
gattgttcatatcaagaaatt

SEQ ID NO: 207072 - DNA, 19 bp, Homo sapiens
gattgtttctggtgactgc

SEQ ID NO: 207073 - DNA, 20 bp, Homo sapiens
gatttaaaaatgccaaaact

SEQ ID NO: 207074 - DNA, 17 bp, Homo sapiens
gatttaaatagaacttg

SEQ ID NO: 207075 - DNA, 15 bp, Homo sapiens
gatttaaattttcac

SEQ ID NO: 207076 - DNA, 19 bp, Homo sapiens
gatttaaattttcacctgt

SEQ ID NO: 207077 - DNA, 17 bp, Homo sapiens
gatttaacagtcattta

SEQ ID NO: 207078 - DNA, 16 bp, Homo sapiens
gatttaagcacaaact

SEQ ID NO: 207079 - DNA, 22 bp, Homo sapiens
gatttaagggatggaaaaggaa

SEQ ID NO: 207080 - DNA, 21 bp, Homo sapiens
gatttagaaaaaagtttacaa

SEQ ID NO: 207081 - DNA, 19 bp, Homo sapiens
gatttagcacccttctgct

SEQ ID NO: 207082 - DNA, 17 bp, Homo sapiens
gatttatagtttgtaca

SEQ ID NO: 207083 - DNA, 14 bp, Homo sapiens
gcaactagccaagg

SEQ ID NO: 207084 - DNA, 16 bp, Homo sapiens
gcaactagccaaggct

SEQ ID NO: 207085 - DNA, 16 bp, Homo sapiens
gcaactagtggagaga

SEQ ID NO: 207086 - DNA, 20 bp, Homo sapiens
gcaactcatgaacaaaatga

SEQ ID NO: 207087 - DNA, 13 bp, Homo sapiens
gcaactccatgcc

SEQ ID NO: 207088 - DNA, 14 bp, Homo sapiens
gcaactccatgcct

SEQ ID NO: 207089 - DNA, 16 bp, Homo sapiens
gcaactccatgcctat

SEQ ID NO: 207090 - DNA, 17 bp, Homo sapiens
gcaactgaatacttgaa

SEQ ID NO: 207091 - DNA, 15 bp, Homo sapiens
gcaactgtgcagcac

SEQ ID NO: 207092 - DNA, 19 bp, Homo sapiens
gcaacttcagtcctgggag

SEQ ID NO: 207093 - DNA, 19 bp, Homo sapiens
gcaacttctgtcccttgtt

SEQ ID NO: 207094 - DNA, 20 bp, Homo sapiens
cccatgcctgtccagcctgg

SEQ ID NO: 207095 - DNA, 20 bp, Homo sapiens
cccatgctctgccccaagcc

SEQ ID NO: 207096 - DNA, 16 bp, Homo sapiens
cccatgctgccttcag

SEQ ID NO: 207097 - DNA, 14 bp, Homo sapiens
cccatggcccagca

SEQ ID NO: 207098 - DNA, 21 bp, Homo sapiens
cccatggcccagcagcttggc

SEQ ID NO: 207099 - DNA, 14 bp, Homo sapiens
cccatggccccagc

SEQ ID NO: 207100 - DNA, 20 bp, Homo sapiens
cccatggccttccctcccca

SEQ ID NO: 207101 - DNA, 16 bp, Homo sapiens
cccatgggcttggact

SEQ ID NO: 207102 - DNA, 17 bp, Homo sapiens
cccatggtagactgtga

SEQ ID NO: 207103 - DNA, 15 bp, Homo sapiens
cccatggtccctagc

SEQ ID NO: 207104 - DNA, 14 bp, Homo sapiens
cccatggtgcagtg

SEQ ID NO: 207105 - DNA, 17 bp, Homo sapiens
cccatgtggctgaagac

SEQ ID NO: 207106 - DNA, 17 bp, Homo sapiens
cccatgttgggaaaaac

SEQ ID NO: 207107 - DNA, 18 bp, Homo sapiens
cccatgttgggaaaaact

SEQ ID NO: 207108 - DNA, 23 bp, Homo sapiens
cccatgtttaaactttgtgcctt

SEQ ID NO: 207109 - DNA, 21 bp, Homo sapiens
cccattcccccatgtggctga

SEQ ID NO: 207110 - DNA, 18 bp, Homo sapiens
cccattctagatcctgca

SEQ ID NO: 207111 - DNA, 19 bp, Homo sapiens
cccattctataaattcaac

SEQ ID NO: 207112 - DNA, 23 bp, Homo sapiens
cccatttattattttaatattta

SEQ ID NO: 207113 - DNA, 18 bp, Homo sapiens
cccatttcacacctgaaa

SEQ ID NO: 207114 - DNA, 20 bp, Homo sapiens
cccatttcctcttccttctc

SEQ ID NO: 207115 - DNA, 19 bp, Homo sapiens
cccatttctatttatttac

SEQ ID NO: 207116 - DNA, 14 bp, Homo sapiens
cccatttctctaca

SEQ ID NO: 207117 - DNA, 20 bp, Homo sapiens
cccatttttatatcgatctc

SEQ ID NO: 207118 - DNA, 16 bp, Homo sapiens
ccccaaaaccacagcc

SEQ ID NO: 207119 - DNA, 23 bp, Homo sapiens
ccccaaaaccacagccctgtcag

SEQ ID NO: 207120 - DNA, 14 bp, Homo sapiens
ccccaaaccctgct

SEQ ID NO: 207121 - DNA, 15 bp, Homo sapiens
ccccaaacttcttgt

SEQ ID NO: 207122 - DNA, 13 bp, Homo sapiens
ccccaaagcccag

SEQ ID NO: 207123 - DNA, 18 bp, Homo sapiens
ccccaaagcccagcccgg

SEQ ID NO: 207124 - DNA, 23 bp, Homo sapiens
ccccaaaggaagctttctctgct

SEQ ID NO: 207125 - DNA, 21 bp, Homo sapiens
ccccaaatctactgagccacg

SEQ ID NO: 207126 - DNA, 19 bp, Homo sapiens
ccccaaattgccttcagcc

SEQ ID NO: 207127 - DNA, 12 bp, Homo sapiens
ccccaaccactc

SEQ ID NO: 207128 - DNA, 21 bp, Homo sapiens
ccccaaccccgcggtgctctg

SEQ ID NO: 207129 - DNA, 17 bp, Homo sapiens
ccccaaccctgcccctg

SEQ ID NO: 207130 - DNA, 23 bp, Homo sapiens
ccccaaccgtgcaacgtgtaact

SEQ ID NO: 207131 - DNA, 20 bp, Homo sapiens
ccccaacgtcccctccgccg

SEQ ID NO: 207132 - DNA, 23 bp, Homo sapiens
ccccaactccaggggcacctatg

SEQ ID NO: 207133 - DNA, 14 bp, Homo sapiens
ccccaactccatgg

SEQ ID NO: 207134 - DNA, 17 bp, Homo sapiens
ccccaactccttcctct

SEQ ID NO: 207135 - DNA, 19 bp, Homo sapiens
ccccaactctccccagtgc

SEQ ID NO: 207136 - DNA, 20 bp, Homo sapiens
ccccaagaaacctccatcct

SEQ ID NO: 207137 - DNA, 14 bp, Homo sapiens
ccccaagaaggctg

SEQ ID NO: 207138 - DNA, 18 bp, Homo sapiens
ccccaagaaggctggggc

SEQ ID NO: 207139 - DNA, 17 bp, Homo sapiens
ccccaagaggctagccc

SEQ ID NO: 207140 - DNA, 14 bp, Homo sapiens
ccccaagcagccag

SEQ ID NO: 207141 - DNA, 16 bp, Homo sapiens
ccccaagcagccagcc

SEQ ID NO: 207142 - DNA, 18 bp, Homo sapiens
ccccaagcagccagccag

SEQ ID NO: 207143 - DNA, 11 bp, Homo sapiens
ccccaagctgg

SEQ ID NO: 207144 - DNA, 22 bp, Homo sapiens
ccccaaggggcagtctggaggg

SEQ ID NO: 207145 - DNA, 22 bp, Homo sapiens
ccccaagtccacctgcctatcc

SEQ ID NO: 207146 - DNA, 20 bp, Homo sapiens
ccccaatcgggtccagagac

SEQ ID NO: 207147 - DNA, 15 bp, Homo sapiens
ccccacacaggcctg

SEQ ID NO: 207148 - DNA, 18 bp, Homo sapiens
ccccacacaggcctggcc

SEQ ID NO: 207149 - DNA, 19 bp, Homo sapiens
ccccacaccccagcccacc

SEQ ID NO: 207150 - DNA, 23 bp, Homo sapiens
ccccacaccccagcccaccctgc

SEQ ID NO: 207151 - DNA, 20 bp, Homo sapiens
ccccacacgccggggctggc

SEQ ID NO: 207152 - DNA, 23 bp, Homo sapiens
ccccacacttgttccagctcttt

SEQ ID NO: 207153 - DNA, 18 bp, Homo sapiens
ccccaccagcagcacaat

SEQ ID NO: 207154 - DNA, 16 bp, Homo sapiens
ccccacccaagcttgg

SEQ ID NO: 207155 - DNA, 18 bp, Homo sapiens
ccccacccaagcttggca

SEQ ID NO: 207156 - DNA, 18 bp, Homo sapiens
ccccacccacccctcctg

SEQ ID NO: 207157 - DNA, 23 bp, Homo sapiens
ccccacccacctccacccagccc

SEQ ID NO: 207158 - DNA, 23 bp, Homo sapiens
ccccacccattttcccccgtcct

SEQ ID NO: 207159 - DNA, 16 bp, Homo sapiens
ccccaccccacacttg

SEQ ID NO: 207160 - DNA, 19 bp, Homo sapiens
ccccacccctaagtgccca

SEQ ID NO: 207161 - DNA, 17 bp, Homo sapiens
ccccaccccttccccac

SEQ ID NO: 207162 - DNA, 13 bp, Homo sapiens
ccccaccctccat

SEQ ID NO: 207163 - DNA, 17 bp, Homo sapiens
ccccaccctccatgctc

SEQ ID NO: 207164 - DNA, 13 bp, Homo sapiens
ccccacctcctgc

SEQ ID NO: 207165 - DNA, 14 bp, Homo sapiens
ccccacctctccaa

SEQ ID NO: 207166 - DNA, 23 bp, Homo sapiens
ccccacctgacaatggcagctag

SEQ ID NO: 207167 - DNA, 17 bp, Homo sapiens
ccccacctgccactagg

SEQ ID NO: 207168 - DNA, 13 bp, Homo sapiens
ccccacctgcctg

SEQ ID NO: 207169 - DNA, 14 bp, Homo sapiens
ccccacctgcctga

SEQ ID NO: 207170 - DNA, 15 bp, Homo sapiens
ccccaccttccctcc

SEQ ID NO: 207171 - DNA, 19 bp, Homo sapiens
ccccacgagtcacctgcaa

SEQ ID NO: 207172 - DNA, 20 bp, Homo sapiens
ccccacgagtcacctgcaag

SEQ ID NO: 207173 - DNA, 15 bp, Homo sapiens
ccccacggccgtccc

SEQ ID NO: 207174 - DNA, 18 bp, Homo sapiens
ccccacggccgtccctga

SEQ ID NO: 207175 - DNA, 19 bp, Homo sapiens
ccccacgtgacagtgcctg

SEQ ID NO: 207176 - DNA, 20 bp, Homo sapiens
ccccacgtggactctgtgct

SEQ ID NO: 207177 - DNA, 21 bp, Homo sapiens
ccccacgtggcacctcctcac

SEQ ID NO: 207178 - DNA, 12 bp, Homo sapiens
ccccactctccc

SEQ ID NO: 207179 - DNA, 17 bp, Homo sapiens
ccccactctgctcccag

SEQ ID NO: 207180 - DNA, 12 bp, Homo sapiens
ccccactgcctg

SEQ ID NO: 207181 - DNA, 17 bp, Homo sapiens
ccccactgcctgcccac

SEQ ID NO: 207182 - DNA, 13 bp, Homo sapiens
ccccactgggaga

SEQ ID NO: 207183 - DNA, 17 bp, Homo sapiens
ccccactgggagagctg

SEQ ID NO: 207184 - DNA, 19 bp, Homo sapiens
ccccacttatgctgctgtg

SEQ ID NO: 207185 - DNA, 14 bp, Homo sapiens
ccccacttcacccc

SEQ ID NO: 207186 - DNA, 16 bp, Homo sapiens
ccccagaaagcctcct

SEQ ID NO: 207187 - DNA, 22 bp, Homo sapiens
ccccagaaatgccgctgtgtcc

SEQ ID NO: 207188 - DNA, 14 bp, Homo sapiens
ccccagaccccgcc

SEQ ID NO: 207189 - DNA, 18 bp, Homo sapiens
ccccagaccgatccttcc

SEQ ID NO: 207190 - DNA, 15 bp, Homo sapiens
ccccagacctgagct

SEQ ID NO: 207191 - DNA, 21 bp, Homo sapiens
ccccagagactgcccaccctg

SEQ ID NO: 207192 - DNA, 22 bp, Homo sapiens
ccccagagagagctctgcacgt

SEQ ID NO: 207193 - DNA, 17 bp, Homo sapiens
ccccagagccagggctg

SEQ ID NO: 207194 - DNA, 18 bp, Homo sapiens
ccccagagccagggctgt

SEQ ID NO: 207195 - DNA, 19 bp, Homo sapiens
ccccagagccccactcccg

SEQ ID NO: 207196 - DNA, 12 bp, Homo sapiens
ccccagagctgt

SEQ ID NO: 207197 - DNA, 15 bp, Homo sapiens
ccccagaggctccca

SEQ ID NO: 207198 - DNA, 17 bp, Homo sapiens
ccccagaggctcccaat

SEQ ID NO: 207199 - DNA, 21 bp, Homo sapiens
ccccagagggaccagctgggg

SEQ ID NO: 207200 - DNA, 18 bp, Homo sapiens
ccccagataccagcccct

SEQ ID NO: 207201 - DNA, 16 bp, Homo sapiens
ccccagatagagctgg

SEQ ID NO: 207202 - DNA, 17 bp, Homo sapiens
ccccagatagagctggg

SEQ ID NO: 207203 - DNA, 18 bp, Homo sapiens
ccccagatagagctgggt

SEQ ID NO: 207204 - DNA, 19 bp, Homo sapiens
ccccagatctgcctgggcc

SEQ ID NO: 207205 - DNA, 20 bp, Homo sapiens
ccccagatctgcctgggcct

SEQ ID NO: 207206 - DNA, 14 bp, Homo sapiens
ccccagcattccag

SEQ ID NO: 207207 - DNA, 12 bp, Homo sapiens
ccccagccaagt

SEQ ID NO: 207208 - DNA, 13 bp, Homo sapiens
ccccagccactcc

SEQ ID NO: 207209 - DNA, 14 bp, Homo sapiens
ccccagccagccct

SEQ ID NO: 207210 - DNA, 21 bp, Homo sapiens
ccccagccagcccttcccagg

SEQ ID NO: 207211 - DNA, 12 bp, Homo sapiens
ccccagcccaat

SEQ ID NO: 207212 - DNA, 12 bp, Homo sapiens
ccccagcccacc

SEQ ID NO: 207213 - DNA, 23 bp, Homo sapiens
gcacacagcttttagtacccacc

SEQ ID NO: 207214 - DNA, 19 bp, Homo sapiens
gcacaccactgccctgcct

SEQ ID NO: 207215 - DNA, 18 bp, Homo sapiens
gcacaccagaagtgccat

SEQ ID NO: 207216 - DNA, 17 bp, Homo sapiens
gcacaccagttactgtt

SEQ ID NO: 207217 - DNA, 19 bp, Homo sapiens
gcacaccctcactctgcca

SEQ ID NO: 207218 - DNA, 17 bp, Homo sapiens
gcacactgacataatgt

SEQ ID NO: 207219 - DNA, 22 bp, Homo sapiens
gcacactgagtttgaacacaga

SEQ ID NO: 207220 - DNA, 16 bp, Homo sapiens
gcacactgctaaattt

SEQ ID NO: 207221 - DNA, 14 bp, Homo sapiens
gcacacttcccctt

SEQ ID NO: 207222 - DNA, 18 bp, Homo sapiens
gcacagaaagggcagctt

SEQ ID NO: 207223 - DNA, 15 bp, Homo sapiens
gcacagaacaagcca

SEQ ID NO: 207224 - DNA, 10 bp, Homo sapiens
gcacagactg

SEQ ID NO: 207225 - DNA, 22 bp, Homo sapiens
gcacagactgttccctccaagg

SEQ ID NO: 207226 - DNA, 19 bp, Homo sapiens
gcacagagagggggccacc

SEQ ID NO: 207227 - DNA, 22 bp, Homo sapiens
gcacagagcgtccttccccctg

SEQ ID NO: 207228 - DNA, 20 bp, Homo sapiens
gcacagagtcgatgctcaat

SEQ ID NO: 207229 - DNA, 20 bp, Homo sapiens
gcacagatgccatggcctgt

SEQ ID NO: 207230 - DNA, 13 bp, Homo sapiens
gcacagatggatt

SEQ ID NO: 207231 - DNA, 15 bp, Homo sapiens
gcacagatggatttg

SEQ ID NO: 207232 - DNA, 20 bp, Homo sapiens
ccccagcttttcttgccagc

SEQ ID NO: 207233 - DNA, 14 bp, Homo sapiens
ccccaggcaggctg

SEQ ID NO: 207234 - DNA, 15 bp, Homo sapiens
ccccaggccaggtcc

SEQ ID NO: 207235 - DNA, 14 bp, Homo sapiens
ccccaggcctccag

SEQ ID NO: 207236 - DNA, 18 bp, Homo sapiens
ccccaggcctccagcctc

SEQ ID NO: 207237 - DNA, 18 bp, Homo sapiens
ccccaggctcccctggtc

SEQ ID NO: 207238 - DNA, 19 bp, Homo sapiens
ccccaggctcccctggtct

SEQ ID NO: 207239 - DNA, 14 bp, Homo sapiens
ccccaggctgcgcc

SEQ ID NO: 207240 - DNA, 19 bp, Homo sapiens
ccccaggctgcgcctgccc

SEQ ID NO: 207241 - DNA, 23 bp, Homo sapiens
ccccagggcagggtgggcagcct

SEQ ID NO: 207242 - DNA, 11 bp, Homo sapiens
ccccagggccc

SEQ ID NO: 207243 - DNA, 16 bp, Homo sapiens
ccccagggccctgctc

SEQ ID NO: 207244 - DNA, 13 bp, Homo sapiens
ccccagggcctgg

SEQ ID NO: 207245 - DNA, 14 bp, Homo sapiens
ccccagggcctggg

SEQ ID NO: 207246 - DNA, 20 bp, Homo sapiens
ccccaggggcacacttcccc

SEQ ID NO: 207247 - DNA, 19 bp, Homo sapiens
ccccaggggtcccagccac

SEQ ID NO: 207248 - DNA, 19 bp, Homo sapiens
ccccagggtcttccctacc

SEQ ID NO: 207249 - DNA, 19 bp, Homo sapiens
ccccagggtgagcagggcc

SEQ ID NO: 207250 - DNA, 20 bp, Homo sapiens
ccccagggtgagcagggccc

SEQ ID NO: 207251 - DNA, 15 bp, Homo sapiens
ccccagggtgcaggc

SEQ ID NO: 207252 - DNA, 16 bp, Homo sapiens
ccccagggtgcaggcg

SEQ ID NO: 207253 - DNA, 19 bp, Homo sapiens
ccccaggtgccaccaataa

SEQ ID NO: 207254 - DNA, 20 bp, Homo sapiens
ccccaggtgccaccaataaa

SEQ ID NO: 207255 - DNA, 14 bp, Homo sapiens
ccccaggtgctgga

SEQ ID NO: 207256 - DNA, 18 bp, Homo sapiens
ccccagtaagccactgcc

SEQ ID NO: 207257 - DNA, 18 bp, Homo sapiens
ccccagtacctccaagca

SEQ ID NO: 207258 - DNA, 22 bp, Homo sapiens
ccccataattttttttttcctt

SEQ ID NO: 207259 - DNA, 22 bp, Homo sapiens
ccccatagaaaacaatctgccc

SEQ ID NO: 207260 - DNA, 16 bp, Homo sapiens
ccccatatataaatta

SEQ ID NO: 207261 - DNA, 17 bp, Homo sapiens
ccccatatttgtgttca

SEQ ID NO: 207262 - DNA, 14 bp, Homo sapiens
ccccatccagcatg

SEQ ID NO: 207263 - DNA, 17 bp, Homo sapiens
ccccatccagccagggg

SEQ ID NO: 207264 - DNA, 12 bp, Homo sapiens
ccccatccctcg

SEQ ID NO: 207265 - DNA, 15 bp, Homo sapiens
ccccatcctccagct

SEQ ID NO: 207266 - DNA, 17 bp, Homo sapiens
ccccatcctccagcttc

SEQ ID NO: 207267 - DNA, 19 bp, Homo sapiens
ccccatcctccccttccct

SEQ ID NO: 207268 - DNA, 17 bp, Homo sapiens
ccccatccttcccgcag

SEQ ID NO: 207269 - DNA, 21 bp, Homo sapiens
ccccatccttcccgcagcacc

SEQ ID NO: 207270 - DNA, 14 bp, Homo sapiens
ccccatctccccag

SEQ ID NO: 207271 - DNA, 20 bp, Homo sapiens
ccccatctccccaggcctcc

SEQ ID NO: 207272 - DNA, 16 bp, Homo sapiens
ccccatctctccctcc

SEQ ID NO: 207273 - DNA, 11 bp, Homo sapiens
ccccatctgct

SEQ ID NO: 207274 - DNA, 12 bp, Homo sapiens
ccccatctgctg

SEQ ID NO: 207275 - DNA, 13 bp, Homo sapiens
ccccatctgctga

SEQ ID NO: 207276 - DNA, 13 bp, Homo sapiens
ccccatgccaaag

SEQ ID NO: 207277 - DNA, 17 bp, Homo sapiens
ccccatgcctgtccagc

SEQ ID NO: 207278 - DNA, 21 bp, Homo sapiens
ccccatgcctgtccagcctgg

SEQ ID NO: 207279 - DNA, 17 bp, Homo sapiens
ccccatgctctgcccca

SEQ ID NO: 207280 - DNA, 21 bp, Homo sapiens
ccccatgctctgccccaagcc

SEQ ID NO: 207281 - DNA, 22 bp, Homo sapiens
ccccatgctctgccccaagccc

SEQ ID NO: 207282 - DNA, 19 bp, Homo sapiens
ccccatgctgccttcaggg

SEQ ID NO: 207283 - DNA, 22 bp, Homo sapiens
ccccatgggcttggacttcctg

SEQ ID NO: 207284 - DNA, 13 bp, Homo sapiens
ccccatgtgcctg

SEQ ID NO: 207285 - DNA, 23 bp, Homo sapiens
ccccatgtgcctgcaccaggaga

SEQ ID NO: 207286 - DNA, 22 bp, Homo sapiens
ccccatgtgggtgaccaggtcc

SEQ ID NO: 207287 - DNA, 23 bp, Homo sapiens
ccccatgtgggtgaccaggtcct

SEQ ID NO: 207288 - DNA, 16 bp, Homo sapiens
ccccattcagaactct

SEQ ID NO: 207289 - DNA, 20 bp, Homo sapiens
ccccattcagaactctcaga

SEQ ID NO: 207290 - DNA, 20 bp, Homo sapiens
ccccatttcctcttccttct

SEQ ID NO: 207291 - DNA, 21 bp, Homo sapiens
ccccatttcctcttccttctc

SEQ ID NO: 207292 - DNA, 23 bp, Homo sapiens
ccccatttcctcttccttctcta

SEQ ID NO: 207293 - DNA, 17 bp, Homo sapiens
ccccatttctatttatt

SEQ ID NO: 207294 - DNA, 14 bp, Homo sapiens
cccccaaaccctgc

SEQ ID NO: 207295 - DNA, 22 bp, Homo sapiens
cccccaaagcaatgtgagtccc

SEQ ID NO: 207296 - DNA, 21 bp, Homo sapiens
cccccaaatctactgagccac

SEQ ID NO: 207297 - DNA, 18 bp, Homo sapiens
cccccaaatcttcctctg

SEQ ID NO: 207298 - DNA, 21 bp, Homo sapiens
cccccaagaaacctccatcct

SEQ ID NO: 207299 - DNA, 22 bp, Homo sapiens
cccccaagaaacctccatcctg

SEQ ID NO: 207300 - DNA, 18 bp, Homo sapiens
cccccaaggttttggagt

SEQ ID NO: 207301 - DNA, 11 bp, Homo sapiens
cccccacccac

SEQ ID NO: 207302 - DNA, 12 bp, Homo sapiens
cccccacccacc

SEQ ID NO: 207303 - DNA, 15 bp, Homo sapiens
cccccaccccttccc

SEQ ID NO: 207304 - DNA, 17 bp, Homo sapiens
cccccaccccttcccca

SEQ ID NO: 207305 - DNA, 14 bp, Homo sapiens
cccccacctcccgg

SEQ ID NO: 207306 - DNA, 13 bp, Homo sapiens
cccccacctgaca

SEQ ID NO: 207307 - DNA, 15 bp, Homo sapiens
cccccacggccgtcc

SEQ ID NO: 207308 - DNA, 21 bp, Homo sapiens
cccccacgtggactctgtgct

SEQ ID NO: 207309 - DNA, 18 bp, Homo sapiens
cccccagagagagctctg

SEQ ID NO: 207310 - DNA, 19 bp, Homo sapiens
cccccagagccagggctgt

SEQ ID NO: 207311 - DNA, 23 bp, Homo sapiens
cccccagagccagggctgtcctt

SEQ ID NO: 207312 - DNA, 16 bp, Homo sapiens
cccccagatagagctg

SEQ ID NO: 207313 - DNA, 16 bp, Homo sapiens
cccccagcaaccctcc

SEQ ID NO: 207314 - DNA, 17 bp, Homo sapiens
cccccagcccaataaag

SEQ ID NO: 207315 - DNA, 13 bp, Homo sapiens
cccccagccctgt

SEQ ID NO: 207316 - DNA, 18 bp, Homo sapiens
cccccagcctcccccagg

SEQ ID NO: 207317 - DNA, 21 bp, Homo sapiens
cccccagcctcccccaggctg

SEQ ID NO: 207318 - DNA, 22 bp, Homo sapiens
cccccagcctcccccaggctgc

SEQ ID NO: 207319 - DNA, 11 bp, Homo sapiens
cccccagctgt

SEQ ID NO: 207320 - DNA, 11 bp, Homo sapiens
cccccaggagg

SEQ ID NO: 207321 - DNA, 16 bp, Homo sapiens
cccccaggaggagaga

SEQ ID NO: 207322 - DNA, 14 bp, Homo sapiens
cccccaggctgcgc

SEQ ID NO: 207323 - DNA, 19 bp, Homo sapiens
cccccaggctgcgcctgcc

SEQ ID NO: 207324 - DNA, 22 bp, Homo sapiens
cccccaggggcccaggctcccc

SEQ ID NO: 207325 - DNA, 22 bp, Homo sapiens
cccccaggtgctggaggcagac

SEQ ID NO: 207326 - DNA, 14 bp, Homo sapiens
cccccagtacctcc

SEQ ID NO: 207327 - DNA, 15 bp, Homo sapiens
cccccagtacctcca

SEQ ID NO: 207328 - DNA, 22 bp, Homo sapiens
cccccatccccatcctccagct

SEQ ID NO: 207329 - DNA, 22 bp, Homo sapiens
cccccatgtttaaactttgtgc

SEQ ID NO: 207330 - DNA, 12 bp, Homo sapiens
ccccccactctc

SEQ ID NO: 207331 - DNA, 12 bp, Homo sapiens
ccccccagctca

SEQ ID NO: 207332 - DNA, 13 bp, Homo sapiens
cccccctccaggc

SEQ ID NO: 207333 - DNA, 12 bp, Homo sapiens
cccccctcctcc

SEQ ID NO: 207334 - DNA, 13 bp, Homo sapiens
cccccctcctcca

SEQ ID NO: 207335 - DNA, 11 bp, Homo sapiens
cccccctgaga

SEQ ID NO: 207336 - DNA, 12 bp, Homo sapiens
cccccctgagtg

SEQ ID NO: 207337 - DNA, 21 bp, Homo sapiens
cccccgagctgggggccatga

SEQ ID NO: 207338 - DNA, 15 bp, Homo sapiens
cccccgccacggcca

SEQ ID NO: 207339 - DNA, 18 bp, Homo sapiens
cccccgccctcgctccgg

SEQ ID NO: 207340 - DNA, 18 bp, Homo sapiens
cccccgcgggttctagac

SEQ ID NO: 207341 - DNA, 13 bp, Homo sapiens
cccccgctctgcc

SEQ ID NO: 207342 - DNA, 20 bp, Homo sapiens
cccccgctctgccatcagcc

SEQ ID NO: 207343 - DNA, 20 bp, Homo sapiens
gcacctcctaccctcccacc

SEQ ID NO: 207344 - DNA, 21 bp, Homo sapiens
gcacctcctaccctcccacca

SEQ ID NO: 207345 - DNA, 17 bp, Homo sapiens
gcacctcctctctgctg

SEQ ID NO: 207346 - DNA, 18 bp, Homo sapiens
gcacctcctctctgctgg

SEQ ID NO: 207347 - DNA, 13 bp, Homo sapiens
gcacctcctgaga

SEQ ID NO: 207348 - DNA, 21 bp, Homo sapiens
gcacctctcatcagcccaggt

SEQ ID NO: 207349 - DNA, 16 bp, Homo sapiens
gcacctgaaccccatg

SEQ ID NO: 207350 - DNA, 19 bp, Homo sapiens
gcacctgaaccccatgggc

SEQ ID NO: 207351 - DNA, 24 bp, Homo sapiens
gcacctgaaccccatgggcttgga

SEQ ID NO: 207352 - DNA, 13 bp, Homo sapiens
gcacctgaggccc

SEQ ID NO: 207353 - DNA, 21 bp, Homo sapiens
gcacctgaggcccagcagagc

SEQ ID NO: 207354 - DNA, 15 bp, Homo sapiens
gcacctgccagggcc

SEQ ID NO: 207355 - DNA, 18 bp, Homo sapiens
gcacctgcgcctggctct

SEQ ID NO: 207356 - DNA, 16 bp, Homo sapiens
gcacctggagcccaca

SEQ ID NO: 207357 - DNA, 12 bp, Homo sapiens
gcacctggcctg

SEQ ID NO: 207358 - DNA, 14 bp, Homo sapiens
gcacctggcctgct

SEQ ID NO: 207359 - DNA, 15 bp, Homo sapiens
gcacctggcctgctg

SEQ ID NO: 207360 - DNA, 16 bp, Homo sapiens
gcacctggcctgctgg

SEQ ID NO: 207361 - DNA, 17 bp, Homo sapiens
gcacctggcctgctggg

SEQ ID NO: 207362 - DNA, 18 bp, Homo sapiens
gcacctggcctgctggga

SEQ ID NO: 207363 - DNA, 22 bp, Homo sapiens
gcacctgggctgaggaggcagt

SEQ ID NO: 207364 - DNA, 15 bp, Homo sapiens
gcacctggggagtgg

SEQ ID NO: 207365 - DNA, 21 bp, Homo sapiens
gcacctgggtgctctggctgg

SEQ ID NO: 207366 - DNA, 19 bp, Homo sapiens
gcacctgtagtcccagcta

SEQ ID NO: 207367 - DNA, 15 bp, Homo sapiens
gcacctgtggccaga

SEQ ID NO: 207368 - DNA, 19 bp, Homo sapiens
gcaccttaccaactttctg

SEQ ID NO: 207369 - DNA, 21 bp, Homo sapiens
gcaccttaccaactttctgta

SEQ ID NO: 207370 - DNA, 22 bp, Homo sapiens
ccccctttcagatgtcttctgc

SEQ ID NO: 207371 - DNA, 12 bp, Homo sapiens
ccccgacactgc

SEQ ID NO: 207372 - DNA, 18 bp, Homo sapiens
ccccgacactgctgcacc

SEQ ID NO: 207373 - DNA, 14 bp, Homo sapiens
ccccgacgccacag

SEQ ID NO: 207374 - DNA, 14 bp, Homo sapiens
ccccgagccctact

SEQ ID NO: 207375 - DNA, 19 bp, Homo sapiens
ccccgagccgagctctcct

SEQ ID NO: 207376 - DNA, 18 bp, Homo sapiens
ccccgcagcccgcctgcc

SEQ ID NO: 207377 - DNA, 17 bp, Homo sapiens
ccccgccccacattccg

SEQ ID NO: 207378 - DNA, 20 bp, Homo sapiens
ccccgccccacattccgaca

SEQ ID NO: 207379 - DNA, 12 bp, Homo sapiens
ccccgcccccac

SEQ ID NO: 207380 - DNA, 13 bp, Homo sapiens
ccccgcccccacc

SEQ ID NO: 207381 - DNA, 14 bp, Homo sapiens
ccccgcccccaccc

SEQ ID NO: 207382 - DNA, 15 bp, Homo sapiens
ccccgccccccagag

SEQ ID NO: 207383 - DNA, 19 bp, Homo sapiens
ccccgccccccagagccag

SEQ ID NO: 207384 - DNA, 13 bp, Homo sapiens
ccccgccctctgc

SEQ ID NO: 207385 - DNA, 15 bp, Homo sapiens
ccccgcctccactct

SEQ ID NO: 207386 - DNA, 16 bp, Homo sapiens
ccccgcgcgtgccccc

SEQ ID NO: 207387 - DNA, 22 bp, Homo sapiens
ccccgcgcgtgcccccagcgtg

SEQ ID NO: 207388 - DNA, 18 bp, Homo sapiens
ccccgcggtgctctggcg

SEQ ID NO: 207389 - DNA, 23 bp, Homo sapiens
ccccgctctgccatcagcccctg

SEQ ID NO: 207390 - DNA, 16 bp, Homo sapiens
ccccggaggaagcttg

SEQ ID NO: 207391 - DNA, 20 bp, Homo sapiens
ccccggaggcgcccacctgc

SEQ ID NO: 207392 - DNA, 12 bp, Homo sapiens
ccccggccactc

SEQ ID NO: 207393 - DNA, 13 bp, Homo sapiens
ccccggccctacc

SEQ ID NO: 207394 - DNA, 22 bp, Homo sapiens
ccccggcctccaggctggggcc

SEQ ID NO: 207395 - DNA, 16 bp, Homo sapiens
ccccgggaaaggccgg

SEQ ID NO: 207396 - DNA, 17 bp, Homo sapiens
ccccgggaaaggccggt

SEQ ID NO: 207397 - DNA, 15 bp, Homo sapiens
ccccgggctctctgc

SEQ ID NO: 207398 - DNA, 16 bp, Homo sapiens
ccccgggctctggcca

SEQ ID NO: 207399 - DNA, 21 bp, Homo sapiens
ccccgggctctggccaccctg

SEQ ID NO: 207400 - DNA, 12 bp, Homo sapiens
ccccggggctgg

SEQ ID NO: 207401 - DNA, 13 bp, Homo sapiens
ccccggggctggc

SEQ ID NO: 207402 - DNA, 14 bp, Homo sapiens
ccccggggctggca

SEQ ID NO: 207403 - DNA, 21 bp, Homo sapiens
ccccggggtattagcacctct

SEQ ID NO: 207404 - DNA, 18 bp, Homo sapiens
ccccggtgtgcggtgcat

SEQ ID NO: 207405 - DNA, 14 bp, Homo sapiens
ccccgtcccacctc

SEQ ID NO: 207406 - DNA, 17 bp, Homo sapiens
ccccgtccctttccctg

SEQ ID NO: 207407 - DNA, 17 bp, Homo sapiens
ccccgtcggactgcccc

SEQ ID NO: 207408 - DNA, 19 bp, Homo sapiens
ccccgtcggactgccccca

SEQ ID NO: 207409 - DNA, 12 bp, Homo sapiens
ccccgtctgccc

SEQ ID NO: 207410 - DNA, 13 bp, Homo sapiens
ccccgtctgcccc

SEQ ID NO: 207411 - DNA, 23 bp, Homo sapiens
ccccgtctgccccttgaccccac

SEQ ID NO: 207412 - DNA, 19 bp, Homo sapiens
ccccgtgtattcaggaccc

SEQ ID NO: 207413 - DNA, 17 bp, Homo sapiens
ccccgtgtgccccaaga

SEQ ID NO: 207414 - DNA, 16 bp, Homo sapiens
ccccgttacagctccc

SEQ ID NO: 207415 - DNA, 14 bp, Homo sapiens
cccctaactttctt

SEQ ID NO: 207416 - DNA, 18 bp, Homo sapiens
cccctaactttcttgctt

SEQ ID NO: 207417 - DNA, 18 bp, Homo sapiens
cccctaagctccaggtgc

SEQ ID NO: 207418 - DNA, 23 bp, Homo sapiens
cccctaagctccaggtgccctgt

SEQ ID NO: 207419 - DNA, 21 bp, Homo sapiens
cccctaagtggattggctttg

SEQ ID NO: 207420 - DNA, 20 bp, Homo sapiens
cccctaccccacaccaggcc

SEQ ID NO: 207421 - DNA, 22 bp, Homo sapiens
cccctaccccacaccaggccgt

SEQ ID NO: 207422 - DNA, 20 bp, Homo sapiens
cccctacccccttgtctgct

SEQ ID NO: 207423 - DNA, 17 bp, Homo sapiens
cccctagtatctggctg

SEQ ID NO: 207424 - DNA, 12 bp, Homo sapiens
cccctatcctct

SEQ ID NO: 207425 - DNA, 16 bp, Homo sapiens
cccctatcctgcaccc

SEQ ID NO: 207426 - DNA, 19 bp, Homo sapiens
cccctcacccgctgcccag

SEQ ID NO: 207427 - DNA, 23 bp, Homo sapiens
cccctcacccgctgcccagccct

SEQ ID NO: 207428 - DNA, 14 bp, Homo sapiens
cccctcacctcagg

SEQ ID NO: 207429 - DNA, 18 bp, Homo sapiens
cccctcacctgggccttt

SEQ ID NO: 207430 - DNA, 20 bp, Homo sapiens
cccctcacctgggcctttcc

SEQ ID NO: 207431 - DNA, 14 bp, Homo sapiens
cccctcaccttgca

SEQ ID NO: 207432 - DNA, 15 bp, Homo sapiens
cccctcagcgctccc

SEQ ID NO: 207433 - DNA, 20 bp, Homo sapiens
cccctcagcgctccctgtcg

SEQ ID NO: 207434 - DNA, 23 bp, Homo sapiens
cccctccaatcccaccaaccctc

SEQ ID NO: 207435 - DNA, 23 bp, Homo sapiens
cccctccagaccctgcctgagcc

SEQ ID NO: 207436 - DNA, 12 bp, Homo sapiens
cccctccagtgt

SEQ ID NO: 207437 - DNA, 12 bp, Homo sapiens
cccctccatctg

SEQ ID NO: 207438 - DNA, 11 bp, Homo sapiens
cccctcccacc

SEQ ID NO: 207439 - DNA, 12 bp, Homo sapiens
cccctcccacca

SEQ ID NO: 207440 - DNA, 13 bp, Homo sapiens
cccctcccacctc

SEQ ID NO: 207441 - DNA, 15 bp, Homo sapiens
cccctcccagacagg

SEQ ID NO: 207442 - DNA, 11 bp, Homo sapiens
cccctcccagc

SEQ ID NO: 207443 - DNA, 14 bp, Homo sapiens
cccctccccaactc

SEQ ID NO: 207444 - DNA, 14 bp, Homo sapiens
cccctccccagcca

SEQ ID NO: 207445 - DNA, 15 bp, Homo sapiens
cccctccccagccag

SEQ ID NO: 207446 - DNA, 18 bp, Homo sapiens
cccctccccagccagccc

SEQ ID NO: 207447 - DNA, 15 bp, Homo sapiens
cccctcccccaaccc

SEQ ID NO: 207448 - DNA, 16 bp, Homo sapiens
cccctcccccaacccc

SEQ ID NO: 207449 - DNA, 15 bp, Homo sapiens
cccctcccccgcaga

SEQ ID NO: 207450 - DNA, 16 bp, Homo sapiens
cccctcccccgcagac

SEQ ID NO: 207451 - DNA, 18 bp, Homo sapiens
cccctcccccgcagacag

SEQ ID NO: 207452 - DNA, 19 bp, Homo sapiens
cccctcccctaatgcctgc

SEQ ID NO: 207453 - DNA, 13 bp, Homo sapiens
cccctcccctgaa

SEQ ID NO: 207454 - DNA, 20 bp, Homo sapiens
cccctcccctgcccctgccc

SEQ ID NO: 207455 - DNA, 12 bp, Homo sapiens
cccctccctacc

SEQ ID NO: 207456 - DNA, 14 bp, Homo sapiens
cccctccctacctc

SEQ ID NO: 207457 - DNA, 16 bp, Homo sapiens
cccctccctctgcccc

SEQ ID NO: 207458 - DNA, 14 bp, Homo sapiens
cccctccctctgct

SEQ ID NO: 207459 - DNA, 18 bp, Homo sapiens
cccctccctctgctctca

SEQ ID NO: 207460 - DNA, 16 bp, Homo sapiens
cccctccctggcctgt

SEQ ID NO: 207461 - DNA, 15 bp, Homo sapiens
cccctccctggctcc

SEQ ID NO: 207462 - DNA, 12 bp, Homo sapiens
cccctccctggg

SEQ ID NO: 207463 - DNA, 13 bp, Homo sapiens
cccctccctgtca

SEQ ID NO: 207464 - DNA, 12 bp, Homo sapiens
cccctcccttgc

SEQ ID NO: 207465 - DNA, 19 bp, Homo sapiens
cccctcctcgggcgcctgc

SEQ ID NO: 207466 - DNA, 23 bp, Homo sapiens
cccctcctcttcccttagcctct

SEQ ID NO: 207467 - DNA, 14 bp, Homo sapiens
cccctcctgggccc

SEQ ID NO: 207468 - DNA, 20 bp, Homo sapiens
cccctccttctcccctccag

SEQ ID NO: 207469 - DNA, 22 bp, Homo sapiens
cccctccttctcccctccagac

SEQ ID NO: 207470 - DNA, 13 bp, Homo sapiens
cccctcgctgctg

SEQ ID NO: 207471 - DNA, 18 bp, Homo sapiens
cccctcgctgctgctact

SEQ ID NO: 207472 - DNA, 14 bp, Homo sapiens
cccctcggctaccc

SEQ ID NO: 207473 - DNA, 19 bp, Homo sapiens
cccctctaatgctcacgct

SEQ ID NO: 207474 - DNA, 20 bp, Homo sapiens
gcagacaggccatgtgagcc

SEQ ID NO: 207475 - DNA, 18 bp, Homo sapiens
gcagaccccttggccagc

SEQ ID NO: 207476 - DNA, 18 bp, Homo sapiens
gcagacgcagcagctggg

SEQ ID NO: 207477 - DNA, 21 bp, Homo sapiens
gcagacgcagcagctgggacc

SEQ ID NO: 207478 - DNA, 17 bp, Homo sapiens
gcagactcagtttgtca

SEQ ID NO: 207479 - DNA, 21 bp, Homo sapiens
gcagactcctcagatctgaac

SEQ ID NO: 207480 - DNA, 23 bp, Homo sapiens
gcagactcgttctcgtgacccag

SEQ ID NO: 207481 - DNA, 13 bp, Homo sapiens
gcagactggtggg

SEQ ID NO: 207482 - DNA, 13 bp, Homo sapiens
gcagagacactaa

SEQ ID NO: 207483 - DNA, 15 bp, Homo sapiens
gcagagacagagagg

SEQ ID NO: 207484 - DNA, 14 bp, Homo sapiens
gcagagacggcagc

SEQ ID NO: 207485 - DNA, 18 bp, Homo sapiens
gcagagattgggggggct

SEQ ID NO: 207486 - DNA, 20 bp, Homo sapiens
gcagagattgggggggcttg

SEQ ID NO: 207487 - DNA, 21 bp, Homo sapiens
gcagagattgggggggcttgg

SEQ ID NO: 207488 - DNA, 18 bp, Homo sapiens
gcagagcaaatgagggag

SEQ ID NO: 207489 - DNA, 14 bp, Homo sapiens
gcagagcagcacaa

SEQ ID NO: 207490 - DNA, 18 bp, Homo sapiens
gcagagccagtcttcctc

SEQ ID NO: 207491 - DNA, 18 bp, Homo sapiens
gcagagccatgggcctgg

SEQ ID NO: 207492 - DNA, 20 bp, Homo sapiens
gcagagccatgggcctgggc

SEQ ID NO: 207493 - DNA, 15 bp, Homo sapiens
gcagagccccggagc

SEQ ID NO: 207494 - DNA, 15 bp, Homo sapiens
gcagagcccgcccac

SEQ ID NO: 207495 - DNA, 19 bp, Homo sapiens
gcagagccgttcctgggac

SEQ ID NO: 207496 - DNA, 14 bp, Homo sapiens
gcagagcctgtccc

SEQ ID NO: 207497 - DNA, 13 bp, Homo sapiens
gcagagctgagtc

SEQ ID NO: 207498 - DNA, 13 bp, Homo sapiens
gcagaggaccaca

SEQ ID NO: 207499 - DNA, 14 bp, Homo sapiens
gcagaggaccacag

SEQ ID NO: 207500 - DNA, 21 bp, Homo sapiens
gcagaggaccacagtgggtgg

SEQ ID NO: 207501 - DNA, 19 bp, Homo sapiens
gcagaggagccacctgggc

SEQ ID NO: 207502 - DNA, 21 bp, Homo sapiens
gcagaggagccacctgggctg

SEQ ID NO: 207503 - DNA, 23 bp, Homo sapiens
gcagaggatgttctggacctccc

SEQ ID NO: 207504 - DNA, 11 bp, Homo sapiens
gcagaggcagc

SEQ ID NO: 207505 - DNA, 13 bp, Homo sapiens
gcagaggcagggc

SEQ ID NO: 207506 - DNA, 15 bp, Homo sapiens
gcagaggcagggccc

SEQ ID NO: 207507 - DNA, 17 bp, Homo sapiens
gcagaggcagggccctg

SEQ ID NO: 207508 - DNA, 18 bp, Homo sapiens
gcagaggcagggccctgg

SEQ ID NO: 207509 - DNA, 12 bp, Homo sapiens
cccctgcctgtg

SEQ ID NO: 207510 - DNA, 14 bp, Homo sapiens
cccctgcctttgtt

SEQ ID NO: 207511 - DNA, 17 bp, Homo sapiens
cccctgcgcaggccctc

SEQ ID NO: 207512 - DNA, 13 bp, Homo sapiens
cccctgctaagtg

SEQ ID NO: 207513 - DNA, 16 bp, Homo sapiens
cccctgctcccagcct

SEQ ID NO: 207514 - DNA, 21 bp, Homo sapiens
cccctgctcccattcctccct

SEQ ID NO: 207515 - DNA, 13 bp, Homo sapiens
cccctgctgacct

SEQ ID NO: 207516 - DNA, 13 bp, Homo sapiens
cccctgctgcctc

SEQ ID NO: 207517 - DNA, 14 bp, Homo sapiens
cccctgctgcctcc

SEQ ID NO: 207518 - DNA, 20 bp, Homo sapiens
cccctgctgcctccccaacc

SEQ ID NO: 207519 - DNA, 23 bp, Homo sapiens
cccctgctgctcctcggccagag

SEQ ID NO: 207520 - DNA, 13 bp, Homo sapiens
cccctggcccagc

SEQ ID NO: 207521 - DNA, 15 bp, Homo sapiens
cccctggcccagcgg

SEQ ID NO: 207522 - DNA, 22 bp, Homo sapiens
cccctggcccagcggcccctcc

SEQ ID NO: 207523 - DNA, 21 bp, Homo sapiens
cccctggcccatctcagcctc

SEQ ID NO: 207524 - DNA, 20 bp, Homo sapiens
cccctggcttttcactgctg

SEQ ID NO: 207525 - DNA, 22 bp, Homo sapiens
cccctggcttttcactgctggc

SEQ ID NO: 207526 - DNA, 11 bp, Homo sapiens
cccctggggcc

SEQ ID NO: 207527 - DNA, 12 bp, Homo sapiens
cccctggggcct

SEQ ID NO: 207528 - DNA, 23 bp, Homo sapiens
cccctggggcctagactctgtaa

SEQ ID NO: 207529 - DNA, 19 bp, Homo sapiens
cccctggggcttctcctga

SEQ ID NO: 207530 - DNA, 19 bp, Homo sapiens
cccctggggggcacagcca

SEQ ID NO: 207531 - DNA, 21 bp, Homo sapiens
cccctggggtacttctgtgtt

SEQ ID NO: 207532 - DNA, 23 bp, Homo sapiens
cccctggtactcccccagccctc

SEQ ID NO: 207533 - DNA, 16 bp, Homo sapiens
cccctgtacccagctc

SEQ ID NO: 207534 - DNA, 14 bp, Homo sapiens
cccctgtactccag

SEQ ID NO: 207535 - DNA, 20 bp, Homo sapiens
cccctgtagactagtgccgt

SEQ ID NO: 207536 - DNA, 12 bp, Homo sapiens
cccctgtcccac

SEQ ID NO: 207537 - DNA, 17 bp, Homo sapiens
cccctgtcccaccaact

SEQ ID NO: 207538 - DNA, 15 bp, Homo sapiens
cccctgtcccattct

SEQ ID NO: 207539 - DNA, 19 bp, Homo sapiens
cccctgtcccattctagat

SEQ ID NO: 207540 - DNA, 16 bp, Homo sapiens
cccctgtgactcctcc

SEQ ID NO: 207541 - DNA, 17 bp, Homo sapiens
cccctgtgactcctccc

SEQ ID NO: 207542 - DNA, 17 bp, Homo sapiens
cccctgtgcccacccag

SEQ ID NO: 207543 - DNA, 17 bp, Homo sapiens
cccctgtgtgggagggc

SEQ ID NO: 207544 - DNA, 18 bp, Homo sapiens
cccctgtgtgggagggcg

SEQ ID NO: 207545 - DNA, 18 bp, Homo sapiens
ccccttcacaccataact

SEQ ID NO: 207546 - DNA, 16 bp, Homo sapiens
ccccttcaccccttca

SEQ ID NO: 207547 - DNA, 21 bp, Homo sapiens
ccccttcagccgagcccagac

SEQ ID NO: 207548 - DNA, 13 bp, Homo sapiens
ccccttcccaccc

SEQ ID NO: 207549 - DNA, 14 bp, Homo sapiens
ccccttcccacccc

SEQ ID NO: 207550 - DNA, 13 bp, Homo sapiens
ccccttccccact

SEQ ID NO: 207551 - DNA, 23 bp, Homo sapiens
ccccttccccactgcctgcccac

SEQ ID NO: 207552 - DNA, 12 bp, Homo sapiens
ccccttccccct

SEQ ID NO: 207553 - DNA, 16 bp, Homo sapiens
ccccttcccctgctga

SEQ ID NO: 207554 - DNA, 18 bp, Homo sapiens
ccccttccctgcaaacat

SEQ ID NO: 207555 - DNA, 19 bp, Homo sapiens
ccccttctacactctcctg

SEQ ID NO: 207556 - DNA, 20 bp, Homo sapiens
ccccttctacactctcctgg

SEQ ID NO: 207557 - DNA, 21 bp, Homo sapiens
ccccttctacactctcctggg

SEQ ID NO: 207558 - DNA, 13 bp, Homo sapiens
ccccttctcccac

SEQ ID NO: 207559 - DNA, 12 bp, Homo sapiens
ccccttctcccc

SEQ ID NO: 207560 - DNA, 15 bp, Homo sapiens
ccccttcttgggccc

SEQ ID NO: 207561 - DNA, 22 bp, Homo sapiens
ccccttgaagaggggaggggcc

SEQ ID NO: 207562 - DNA, 18 bp, Homo sapiens
ccccttgaatctgcaggg

SEQ ID NO: 207563 - DNA, 20 bp, Homo sapiens
ccccttgattcccataacat

SEQ ID NO: 207564 - DNA, 14 bp, Homo sapiens
ccccttgcttctca

SEQ ID NO: 207565 - DNA, 20 bp, Homo sapiens
ccccttgggatgggcacagg

SEQ ID NO: 207566 - DNA, 16 bp, Homo sapiens
ccccttgggcatccac

SEQ ID NO: 207567 - DNA, 17 bp, Homo sapiens
cccctttccaattccaa

SEQ ID NO: 207568 - DNA, 20 bp, Homo sapiens
cccctttcccatcacccctt

SEQ ID NO: 207569 - DNA, 22 bp, Homo sapiens
cccctttctaaggatagccttt

SEQ ID NO: 207570 - DNA, 16 bp, Homo sapiens
ccccttttgcctggct

SEQ ID NO: 207571 - DNA, 18 bp, Homo sapiens
ccccttttgcctggctgt

SEQ ID NO: 207572 - DNA, 20 bp, Homo sapiens
ccccttttgcctggctgtgg

SEQ ID NO: 207573 - DNA, 20 bp, Homo sapiens
ccccttttgtgggtttctct

SEQ ID NO: 207574 - DNA, 19 bp, Homo sapiens
cccctttttactccccttg

SEQ ID NO: 207575 - DNA, 22 bp, Homo sapiens
cccgacactgctgcaccagagt

SEQ ID NO: 207576 - DNA, 14 bp, Homo sapiens
cccgaccccatctc

SEQ ID NO: 207577 - DNA, 23 bp, Homo sapiens
cccgacgccacagcccagccacg

SEQ ID NO: 207578 - DNA, 23 bp, Homo sapiens
cccgagctactctcttgccagca

SEQ ID NO: 207579 - DNA, 11 bp, Homo sapiens
cccgagctggg

SEQ ID NO: 207580 - DNA, 22 bp, Homo sapiens
cccgagctgggggccatgagct

SEQ ID NO: 207581 - DNA, 23 bp, Homo sapiens
cccgagctgggggccatgagctc

SEQ ID NO: 207582 - DNA, 23 bp, Homo sapiens
cccgaggcagcaacaggaccagg

SEQ ID NO: 207583 - DNA, 16 bp, Homo sapiens
cccgatattctccctg

SEQ ID NO: 207584 - DNA, 20 bp, Homo sapiens
cccgatccccgacagtggct

SEQ ID NO: 207585 - DNA, 22 bp, Homo sapiens
cccgcaatgtgcccccagacgc

SEQ ID NO: 207586 - DNA, 13 bp, Homo sapiens
cccgcacagcagc

SEQ ID NO: 207587 - DNA, 14 bp, Homo sapiens
cccgcacagcagcc

SEQ ID NO: 207588 - DNA, 15 bp, Homo sapiens
cccgcacagcagcct

SEQ ID NO: 207589 - DNA, 16 bp, Homo sapiens
cccgcacagcagcctg

SEQ ID NO: 207590 - DNA, 16 bp, Homo sapiens
cccgcacccccaccct

SEQ ID NO: 207591 - DNA, 16 bp, Homo sapiens
cccgcagcaccagcct

SEQ ID NO: 207592 - DNA, 17 bp, Homo sapiens
cccgcagcaccagcctg

SEQ ID NO: 207593 - DNA, 18 bp, Homo sapiens
cccgcagcaccagcctga

SEQ ID NO: 207594 - DNA, 22 bp, Homo sapiens
cccgcagcaccagcctgagcca

SEQ ID NO: 207595 - DNA, 17 bp, Homo sapiens
cccgcagcccgcctgcc

SEQ ID NO: 207596 - DNA, 23 bp, Homo sapiens
cccgcaggttatgtcagcagctc

SEQ ID NO: 207597 - DNA, 19 bp, Homo sapiens
cccgcatgcagcagcttgc

SEQ ID NO: 207598 - DNA, 19 bp, Homo sapiens
cccgcatgctgcctgcctc

SEQ ID NO: 207599 - DNA, 20 bp, Homo sapiens
cccgccacctgtgtgttctt

SEQ ID NO: 207600 - DNA, 15 bp, Homo sapiens
cccgccacggccacc

SEQ ID NO: 207601 - DNA, 17 bp, Homo sapiens
cccgccacggccaccct

SEQ ID NO: 207602 - DNA, 13 bp, Homo sapiens
cccgccagccagt

SEQ ID NO: 207603 - DNA, 16 bp, Homo sapiens
cccgccagcctcagtg

SEQ ID NO: 207604 - DNA, 23 bp, Homo sapiens
ccctacctgattggtgcaaccct

SEQ ID NO: 207605 - DNA, 16 bp, Homo sapiens
ccctactaacatccca

SEQ ID NO: 207606 - DNA, 17 bp, Homo sapiens
ccctactaacatcccaa

SEQ ID NO: 207607 - DNA, 19 bp, Homo sapiens
ccctactagagacctctca

SEQ ID NO: 207608 - DNA, 22 bp, Homo sapiens
ccctagaaagccatattccagc

SEQ ID NO: 207609 - DNA, 15 bp, Homo sapiens
ccctagactctgtaa

SEQ ID NO: 207610 - DNA, 23 bp, Homo sapiens
ccctagactctgtaaccacctct

SEQ ID NO: 207611 - DNA, 13 bp, Homo sapiens
ccctagactgcat

SEQ ID NO: 207612 - DNA, 21 bp, Homo sapiens
ccctaggactcaggcctgcca

SEQ ID NO: 207613 - DNA, 22 bp, Homo sapiens
ccctaggactcaggcctgccaa

SEQ ID NO: 207614 - DNA, 23 bp, Homo sapiens
ccctaggactcaggcctgccaat

SEQ ID NO: 207615 - DNA, 19 bp, Homo sapiens
ccctaggcatactctccag

SEQ ID NO: 207616 - DNA, 20 bp, Homo sapiens
ccctaggcatactctccagg

SEQ ID NO: 207617 - DNA, 24 bp, Homo sapiens
ccctaggtgggtcaactccaaggc

SEQ ID NO: 207618 - DNA, 18 bp, Homo sapiens
ccctagtgggagcccagc

SEQ ID NO: 207619 - DNA, 18 bp, Homo sapiens
ccctataacccctgcctg

SEQ ID NO: 207620 - DNA, 18 bp, Homo sapiens
ccctataatgctggagcg

SEQ ID NO: 207621 - DNA, 14 bp, Homo sapiens
ccctatcctctgag

SEQ ID NO: 207622 - DNA, 14 bp, Homo sapiens
ccctatcctgcacc

SEQ ID NO: 207623 - DNA, 15 bp, Homo sapiens
ccctatcctgcaccc

SEQ ID NO: 207624 - DNA, 23 bp, Homo sapiens
ccctatctaaccctcccatggca

SEQ ID NO: 207625 - DNA, 16 bp, Homo sapiens
ccctcaaaccctgtgg

SEQ ID NO: 207626 - DNA, 21 bp, Homo sapiens
ccctcaacaagggagagacct

SEQ ID NO: 207627 - DNA, 16 bp, Homo sapiens
ccctcaccctgcctta

SEQ ID NO: 207628 - DNA, 15 bp, Homo sapiens
ccctcacctcaggac

SEQ ID NO: 207629 - DNA, 14 bp, Homo sapiens
ccctcacctccacc

SEQ ID NO: 207630 - DNA, 17 bp, Homo sapiens
ccctcacctgggcacct

SEQ ID NO: 207631 - DNA, 23 bp, Homo sapiens
ccctcacctgggcacctggggag

SEQ ID NO: 207632 - DNA, 21 bp, Homo sapiens
ccctcactctgccagggcagt

SEQ ID NO: 207633 - DNA, 20 bp, Homo sapiens
ccctcagagccctgccctgc

SEQ ID NO: 207634 - DNA, 18 bp, Homo sapiens
ccctcagatgaaaataaa

SEQ ID NO: 207635 - DNA, 13 bp, Homo sapiens
ccctcagcccctc

SEQ ID NO: 207636 - DNA, 21 bp, Homo sapiens
ccctcagcccctcttgccccc

SEQ ID NO: 207637 - DNA, 23 bp, Homo sapiens
ccctcagcccctcttgcccccca

SEQ ID NO: 207638 - DNA, 19 bp, Homo sapiens
ccctcagcccttgccccca

SEQ ID NO: 207639 - DNA, 20 bp, Homo sapiens
ccctcagctatcagtgttct

SEQ ID NO: 207640 - DNA, 18 bp, Homo sapiens
ccctcaggcataggcctg

SEQ ID NO: 207641 - DNA, 19 bp, Homo sapiens
ccctcaggcataggcctgg

SEQ ID NO: 207642 - DNA, 22 bp, Homo sapiens
ccctcaggcataggcctgggtg

SEQ ID NO: 207643 - DNA, 15 bp, Homo sapiens
ccctcagtgtgaagc

SEQ ID NO: 207644 - DNA, 15 bp, Homo sapiens
ccctcatggctctgg

SEQ ID NO: 207645 - DNA, 16 bp, Homo sapiens
ccctcatttctgccag

SEQ ID NO: 207646 - DNA, 17 bp, Homo sapiens
ccctccaaaagcactta

SEQ ID NO: 207647 - DNA, 12 bp, Homo sapiens
ccctccacacca

SEQ ID NO: 207648 - DNA, 13 bp, Homo sapiens
ccctccacaccag

SEQ ID NO: 207649 - DNA, 15 bp, Homo sapiens
ccctccacctgcttg

SEQ ID NO: 207650 - DNA, 20 bp, Homo sapiens
gcagctccgcctggcaccca

SEQ ID NO: 207651 - DNA, 14 bp, Homo sapiens
gcagctcctctcct

SEQ ID NO: 207652 - DNA, 19 bp, Homo sapiens
gcagctcttctgggcagag

SEQ ID NO: 207653 - DNA, 23 bp, Homo sapiens
gcagctcttctgggcagagcctg

SEQ ID NO: 207654 - DNA, 20 bp, Homo sapiens
gcagctgagaaaatgagtga

SEQ ID NO: 207655 - DNA, 17 bp, Homo sapiens
gcagctgagatgtggac

SEQ ID NO: 207656 - DNA, 12 bp, Homo sapiens
gcagctgaggcc

SEQ ID NO: 207657 - DNA, 15 bp, Homo sapiens
gcagctgattttaac

SEQ ID NO: 207658 - DNA, 18 bp, Homo sapiens
gcagctgcaccagcaggt

SEQ ID NO: 207659 - DNA, 14 bp, Homo sapiens
gcagctgcgggtct

SEQ ID NO: 207660 - DNA, 11 bp, Homo sapiens
gcagctgctct

SEQ ID NO: 207661 - DNA, 21 bp, Homo sapiens
gcagctggcaggagagagcct

SEQ ID NO: 207662 - DNA, 16 bp, Homo sapiens
gcagctgggacccctc

SEQ ID NO: 207663 - DNA, 19 bp, Homo sapiens
gcagctgggacccctccca

SEQ ID NO: 207664 - DNA, 14 bp, Homo sapiens
gcagctgggatttg

SEQ ID NO: 207665 - DNA, 20 bp, Homo sapiens
gcagctgggatttgaaccag

SEQ ID NO: 207666 - DNA, 14 bp, Homo sapiens
gcagctgggcactg

SEQ ID NO: 207667 - DNA, 22 bp, Homo sapiens
gcagctgggcactgggccggca

SEQ ID NO: 207668 - DNA, 14 bp, Homo sapiens
gcagctgggcccca

SEQ ID NO: 207669 - DNA, 18 bp, Homo sapiens
gcagctgggccccaccta

SEQ ID NO: 207670 - DNA, 22 bp, Homo sapiens
gcagctgggccccatgctctgc

SEQ ID NO: 207671 - DNA, 16 bp, Homo sapiens
gcagctggggagcagc

SEQ ID NO: 207672 - DNA, 18 bp, Homo sapiens
gcagctgtagctcccgag

SEQ ID NO: 207673 - DNA, 14 bp, Homo sapiens
gcagctgtgctgca

SEQ ID NO: 207674 - DNA, 16 bp, Homo sapiens
gcagctgtgctgcacc

SEQ ID NO: 207675 - DNA, 17 bp, Homo sapiens
gcagctgttagagtcca

SEQ ID NO: 207676 - DNA, 13 bp, Homo sapiens
gcagcttgacgcg

SEQ ID NO: 207677 - DNA, 15 bp, Homo sapiens
gcagcttggctgagc

SEQ ID NO: 207678 - DNA, 22 bp, Homo sapiens
gcagcttggctgagccccctct

SEQ ID NO: 207679 - DNA, 22 bp, Homo sapiens
gcagcttgggagagcccctggg

SEQ ID NO: 207680 - DNA, 23 bp, Homo sapiens
gcaggaacgagcactggccagag

SEQ ID NO: 207681 - DNA, 16 bp, Homo sapiens
gcaggaactgaaaacc

SEQ ID NO: 207682 - DNA, 18 bp, Homo sapiens
gcaggaagagatgctcta

SEQ ID NO: 207683 - DNA, 18 bp, Homo sapiens
gcaggaagcaaggccagc

SEQ ID NO: 207684 - DNA, 13 bp, Homo sapiens
gcaggaaggagag

SEQ ID NO: 207685 - DNA, 15 bp, Homo sapiens
gcaggaaggagagcc

SEQ ID NO: 207686 - DNA, 15 bp, Homo sapiens
gcaggaaggcctggg

SEQ ID NO: 207687 - DNA, 17 bp, Homo sapiens
gcaggaagtcaggagcc

SEQ ID NO: 207688 - DNA, 19 bp, Homo sapiens
gcaggaagtcaggagccag

SEQ ID NO: 207689 - DNA, 20 bp, Homo sapiens
gcaggaagtcaggagccagc

SEQ ID NO: 207690 - DNA, 15 bp, Homo sapiens
gcaggaagtccctga

SEQ ID NO: 207691 - DNA, 19 bp, Homo sapiens
gcaggaatcaaggagcctc

SEQ ID NO: 207692 - DNA, 10 bp, Homo sapiens
gcaggaatgg

SEQ ID NO: 207693 - DNA, 19 bp, Homo sapiens
gcaggaattggtggcagat

SEQ ID NO: 207694 - DNA, 11 bp, Homo sapiens
gcaggacctca

SEQ ID NO: 207695 - DNA, 23 bp, Homo sapiens
gcaggacctcagagtccaggccc

SEQ ID NO: 207696 - DNA, 18 bp, Homo sapiens
gcaggactgaggacaggc

SEQ ID NO: 207697 - DNA, 20 bp, Homo sapiens
gcaggactgaggacaggccc

SEQ ID NO: 207698 - DNA, 11 bp, Homo sapiens
gcaggagagag

SEQ ID NO: 207699 - DNA, 12 bp, Homo sapiens
gcaggagagaga

SEQ ID NO: 207700 - DNA, 16 bp, Homo sapiens
gcaggagagagagaga

SEQ ID NO: 207701 - DNA, 23 bp, Homo sapiens
gcaggagagagagagagaaagaa

SEQ ID NO: 207702 - DNA, 14 bp, Homo sapiens
gcaggagcagctgt

SEQ ID NO: 207703 - DNA, 14 bp, Homo sapiens
gcaggagctcagat

SEQ ID NO: 207704 - DNA, 18 bp, Homo sapiens
gcaggagctcagatgaag

SEQ ID NO: 207705 - DNA, 16 bp, Homo sapiens
gcaggaggccattcca

SEQ ID NO: 207706 - DNA, 14 bp, Homo sapiens
gcaggaggcccctg

SEQ ID NO: 207707 - DNA, 19 bp, Homo sapiens
gcaggaggcccctggccca

SEQ ID NO: 207708 - DNA, 13 bp, Homo sapiens
gcaggaggcctgg

SEQ ID NO: 207709 - DNA, 19 bp, Homo sapiens
gcaggaggcctgggagggc

SEQ ID NO: 207710 - DNA, 18 bp, Homo sapiens
gcaggagggccctacctg

SEQ ID NO: 207711 - DNA, 22 bp, Homo sapiens
gcaggagggccctacctgattg

SEQ ID NO: 207712 - DNA, 16 bp, Homo sapiens
gcaggagggtggcact

SEQ ID NO: 207713 - DNA, 16 bp, Homo sapiens
gcaggaggtgggtgag

SEQ ID NO: 207714 - DNA, 17 bp, Homo sapiens
gcaggagtctctgccac

SEQ ID NO: 207715 - DNA, 12 bp, Homo sapiens
gcaggagtggaa

SEQ ID NO: 207716 - DNA, 17 bp, Homo sapiens
gcaggagtgggctctga

SEQ ID NO: 207717 - DNA, 22 bp, Homo sapiens
gcaggatagttgctccgcctct

SEQ ID NO: 207718 - DNA, 19 bp, Homo sapiens
gcaggatccgctgccacca

SEQ ID NO: 207719 - DNA, 16 bp, Homo sapiens
gcaggcacctgggctt

SEQ ID NO: 207720 - DNA, 23 bp, Homo sapiens
gcaggcagagctcagcacagcct

SEQ ID NO: 207721 - DNA, 20 bp, Homo sapiens
gcaggccagcttcgtgctgg

SEQ ID NO: 207722 - DNA, 23 bp, Homo sapiens
gcaggccagcttcgtgctggagg

SEQ ID NO: 207723 - DNA, 12 bp, Homo sapiens
gcaggcccagct

SEQ ID NO: 207724 - DNA, 17 bp, Homo sapiens
gcaggcccagctggggc

SEQ ID NO: 207725 - DNA, 22 bp, Homo sapiens
gcaggccccagccaagtgcctt

SEQ ID NO: 207726 - DNA, 23 bp, Homo sapiens
gcaggccccagccaagtgccttc

SEQ ID NO: 207727 - DNA, 22 bp, Homo sapiens
gcaggccctccgcgggggacag

SEQ ID NO: 207728 - DNA, 12 bp, Homo sapiens
gcaggccctgca

SEQ ID NO: 207729 - DNA, 13 bp, Homo sapiens
gcaggccctgcag

SEQ ID NO: 207730 - DNA, 18 bp, Homo sapiens
gcaggccctggtggagag

SEQ ID NO: 207731 - DNA, 18 bp, Homo sapiens
gcaggcctgggacccagc

SEQ ID NO: 207732 - DNA, 17 bp, Homo sapiens
gcaggcggtatccagag

SEQ ID NO: 207733 - DNA, 19 bp, Homo sapiens
gcaggcggtatccagaggt

SEQ ID NO: 207734 - DNA, 15 bp, Homo sapiens
gcatatgcatgccag

SEQ ID NO: 207735 - DNA, 16 bp, Homo sapiens
gcatatgcatgccagg

SEQ ID NO: 207736 - DNA, 21 bp, Homo sapiens
gcatattagcatcatgtcttt

SEQ ID NO: 207737 - DNA, 12 bp, Homo sapiens
gcatcaaacatg

SEQ ID NO: 207738 - DNA, 14 bp, Homo sapiens
gcatcaaacatgaa

SEQ ID NO: 207739 - DNA, 18 bp, Homo sapiens
gcatcaaacatgaaaaca

SEQ ID NO: 207740 - DNA, 12 bp, Homo sapiens
gcatcaaataat

SEQ ID NO: 207741 - DNA, 19 bp, Homo sapiens
gcatcaaataatacatctt

SEQ ID NO: 207742 - DNA, 21 bp, Homo sapiens
gcatcaagatgtgacatgttt

SEQ ID NO: 207743 - DNA, 16 bp, Homo sapiens
gcatcaccaccacacc

SEQ ID NO: 207744 - DNA, 17 bp, Homo sapiens
gcatcaccaccacaccc

SEQ ID NO: 207745 - DNA, 13 bp, Homo sapiens
gcatcagcaagac

SEQ ID NO: 207746 - DNA, 16 bp, Homo sapiens
gcatcagcctctggcc

SEQ ID NO: 207747 - DNA, 18 bp, Homo sapiens
gcatcagctttccctggc

SEQ ID NO: 207748 - DNA, 23 bp, Homo sapiens
gcatcagctttccctggctcagg

SEQ ID NO: 207749 - DNA, 24 bp, Homo sapiens
gcatcagctttccctggctcaggg

SEQ ID NO: 207750 - DNA, 13 bp, Homo sapiens
gcatcaggcactg

SEQ ID NO: 207751 - DNA, 14 bp, Homo sapiens
gcatcatctgtaga

SEQ ID NO: 207752 - DNA, 17 bp, Homo sapiens
gcatcattttcacctcc

SEQ ID NO: 207753 - DNA, 16 bp, Homo sapiens
gcatccacaggattcc

SEQ ID NO: 207754 - DNA, 16 bp, Homo sapiens
gcatccacccagtgct

SEQ ID NO: 207755 - DNA, 17 bp, Homo sapiens
gcatccacccagtgctg

SEQ ID NO: 207756 - DNA, 23 bp, Homo sapiens
gcatccactaatattcagtcctg

SEQ ID NO: 207757 - DNA, 12 bp, Homo sapiens
gcatccagcctg

SEQ ID NO: 207758 - DNA, 14 bp, Homo sapiens
gcatccagcctgtg

SEQ ID NO: 207759 - DNA, 16 bp, Homo sapiens
gcatccagcctgtgtg

SEQ ID NO: 207760 - DNA, 17 bp, Homo sapiens
gcatccagtatcttgaa

SEQ ID NO: 207761 - DNA, 18 bp, Homo sapiens
gcatccagtatcttgaag

SEQ ID NO: 207762 - DNA, 16 bp, Homo sapiens
gcatcccagtggcctc

SEQ ID NO: 207763 - DNA, 20 bp, Homo sapiens
gcatcccagtggcctcaacc

SEQ ID NO: 207764 - DNA, 12 bp, Homo sapiens
gcatcccccaaa

SEQ ID NO: 207765 - DNA, 20 bp, Homo sapiens
gcatcccccaaagttcacaa

SEQ ID NO: 207766 - DNA, 18 bp, Homo sapiens
gcatcccttggcccctct

SEQ ID NO: 207767 - DNA, 13 bp, Homo sapiens
gcatccgcctctg

SEQ ID NO: 207768 - DNA, 23 bp, Homo sapiens
gcatccgcctctgagccaggagc

SEQ ID NO: 207769 - DNA, 18 bp, Homo sapiens
gcatcctcagccccaggg

SEQ ID NO: 207770 - DNA, 15 bp, Homo sapiens
gcatcctcagttcct

SEQ ID NO: 207771 - DNA, 22 bp, Homo sapiens
gcatcctccagggggcctgcag

SEQ ID NO: 207772 - DNA, 17 bp, Homo sapiens
gcatccttcccagcaga

SEQ ID NO: 207773 - DNA, 21 bp, Homo sapiens
gcatcgcaggagtctctgcca

SEQ ID NO: 207774 - DNA, 18 bp, Homo sapiens
gcatcgtgacccttcagg

SEQ ID NO: 207775 - DNA, 19 bp, Homo sapiens
gcatcgtgacccttcaggg

SEQ ID NO: 207776 - DNA, 12 bp, Homo sapiens
gcatctcagccc

SEQ ID NO: 207777 - DNA, 14 bp, Homo sapiens
gcatctcagcccac

SEQ ID NO: 207778 - DNA, 15 bp, Homo sapiens
gcatctcctgtgcat

SEQ ID NO: 207779 - DNA, 19 bp, Homo sapiens
gcatctctccccatatata

SEQ ID NO: 207780 - DNA, 21 bp, Homo sapiens
gcatctctccccatatataaa

SEQ ID NO: 207781 - DNA, 13 bp, Homo sapiens
gcatctctggagt

SEQ ID NO: 207782 - DNA, 19 bp, Homo sapiens
gcatctctgggctgagcct

SEQ ID NO: 207783 - DNA, 17 bp, Homo sapiens
gcatctgacacaaaaaa

SEQ ID NO: 207784 - DNA, 19 bp, Homo sapiens
gcatctgacacaaaaaaag

SEQ ID NO: 207785 - DNA, 12 bp, Homo sapiens
gcatctgctctg

SEQ ID NO: 207786 - DNA, 14 bp, Homo sapiens
gcatctgctctgag

SEQ ID NO: 207787 - DNA, 15 bp, Homo sapiens
gcatctgctctgaga

SEQ ID NO: 207788 - DNA, 21 bp, Homo sapiens
gcatctggctaaggcatcatt

SEQ ID NO: 207789 - DNA, 14 bp, Homo sapiens
gcatctgtcccact

SEQ ID NO: 207790 - DNA, 18 bp, Homo sapiens
gcatctgtcccactggga

SEQ ID NO: 207791 - DNA, 20 bp, Homo sapiens
gcatctgtcccactgggaca

SEQ ID NO: 207792 - DNA, 15 bp, Homo sapiens
ccctctgctgtcctg

SEQ ID NO: 207793 - DNA, 21 bp, Homo sapiens
ccctctgctgtcctgcagtag

SEQ ID NO: 207794 - DNA, 21 bp, Homo sapiens
ccctctgtagctccctcctcc

SEQ ID NO: 207795 - DNA, 22 bp, Homo sapiens
ccctctgtcatcactccctgga

SEQ ID NO: 207796 - DNA, 13 bp, Homo sapiens
ccctctgtccaca

SEQ ID NO: 207797 - DNA, 19 bp, Homo sapiens
ccctctgtttcccctcaga

SEQ ID NO: 207798 - DNA, 22 bp, Homo sapiens
ccctcttcaggggtcacctcct

SEQ ID NO: 207799 - DNA, 12 bp, Homo sapiens
ccctcttcccag

SEQ ID NO: 207800 - DNA, 13 bp, Homo sapiens
ccctcttccccct

SEQ ID NO: 207801 - DNA, 15 bp, Homo sapiens
ccctcttcccccttc

SEQ ID NO: 207802 - DNA, 20 bp, Homo sapiens
ccctcttcccccttcccctg

SEQ ID NO: 207803 - DNA, 22 bp, Homo sapiens
ccctcttccctgtcttccccac

SEQ ID NO: 207804 - DNA, 12 bp, Homo sapiens
ccctcttccttg

SEQ ID NO: 207805 - DNA, 20 bp, Homo sapiens
ccctcttctcaagtgcctta

SEQ ID NO: 207806 - DNA, 23 bp, Homo sapiens
ccctcttctcagctccactctga

SEQ ID NO: 207807 - DNA, 23 bp, Homo sapiens
ccctcttgaggtggtgccttctc

SEQ ID NO: 207808 - DNA, 21 bp, Homo sapiens
ccctcttgtccctttccctac

SEQ ID NO: 207809 - DNA, 14 bp, Homo sapiens
ccctctttctctct

SEQ ID NO: 207810 - DNA, 15 bp, Homo sapiens
ccctcttttggcctt

SEQ ID NO: 207811 - DNA, 22 bp, Homo sapiens
ccctgaaaatgtttttctgcca

SEQ ID NO: 207812 - DNA, 15 bp, Homo sapiens
ccctgaaacattgca

SEQ ID NO: 207813 - DNA, 23 bp, Homo sapiens
ccctgaaacattgcatgtattta

SEQ ID NO: 207814 - DNA, 21 bp, Homo sapiens
ccctgaaactgagtctgtgga

SEQ ID NO: 207815 - DNA, 12 bp, Homo sapiens
ccctgaccctgc

SEQ ID NO: 207816 - DNA, 22 bp, Homo sapiens
ccctgaccttagcgttctggac

SEQ ID NO: 207817 - DNA, 13 bp, Homo sapiens
ccctgacttccca

SEQ ID NO: 207818 - DNA, 15 bp, Homo sapiens
ccctgacttgcttta

SEQ ID NO: 207819 - DNA, 20 bp, Homo sapiens
ccctgagaagcctcatggga

SEQ ID NO: 207820 - DNA, 15 bp, Homo sapiens
ccctgagagcatgtg

SEQ ID NO: 207821 - DNA, 20 bp, Homo sapiens
ccctgagcctgccccagctg

SEQ ID NO: 207822 - DNA, 18 bp, Homo sapiens
ccctgagctttccgggga

SEQ ID NO: 207823 - DNA, 23 bp, Homo sapiens
ccctgaggacaggggcatctctg

SEQ ID NO: 207824 - DNA, 19 bp, Homo sapiens
ccctgagggtttccacctt

SEQ ID NO: 207825 - DNA, 15 bp, Homo sapiens
ccctgaggtcatgca

SEQ ID NO: 207826 - DNA, 18 bp, Homo sapiens
ccctgaggtgaaagggag

SEQ ID NO: 207827 - DNA, 18 bp, Homo sapiens
ccctgagtgggctgggcc

SEQ ID NO: 207828 - DNA, 23 bp, Homo sapiens
ccctgagtgggctgggccctctg

SEQ ID NO: 207829 - DNA, 14 bp, Homo sapiens
ccctgcaaggccca

SEQ ID NO: 207830 - DNA, 15 bp, Homo sapiens
ccctgcaaggcccac

SEQ ID NO: 207831 - DNA, 16 bp, Homo sapiens
ccctgcaaggcccaca

SEQ ID NO: 207832 - DNA, 12 bp, Homo sapiens
ccctgcacccac

SEQ ID NO: 207833 - DNA, 17 bp, Homo sapiens
ccctgcacccacccctg

SEQ ID NO: 207834 - DNA, 13 bp, Homo sapiens
ccctgcaccctgg

SEQ ID NO: 207835 - DNA, 18 bp, Homo sapiens
ccctgcaccctggaaagg

SEQ ID NO: 207836 - DNA, 20 bp, Homo sapiens
ccctgcaggaggcctgggag

SEQ ID NO: 207837 - DNA, 23 bp, Homo sapiens
ccctgcaggaggcctgggagggc

SEQ ID NO: 207838 - DNA, 17 bp, Homo sapiens
ccctgcatcccttggcc

SEQ ID NO: 207839 - DNA, 21 bp, Homo sapiens
ccctgccaagcctggagcccc

SEQ ID NO: 207840 - DNA, 23 bp, Homo sapiens
ccctgccaagcctggagcccctg

SEQ ID NO: 207841 - DNA, 18 bp, Homo sapiens
ccctgccacactcagtcc

SEQ ID NO: 207842 - DNA, 20 bp, Homo sapiens
ccctgccacactcagtcccc

SEQ ID NO: 207843 - DNA, 14 bp, Homo sapiens
ccctgccacctcct

SEQ ID NO: 207844 - DNA, 18 bp, Homo sapiens
ccctgccacctcctgcct

SEQ ID NO: 207845 - DNA, 20 bp, Homo sapiens
ccctgccacctcctgcctca

SEQ ID NO: 207846 - DNA, 16 bp, Homo sapiens
ccctgccacctgtctg

SEQ ID NO: 207847 - DNA, 13 bp, Homo sapiens
ccctgccaggctg

SEQ ID NO: 207848 - DNA, 16 bp, Homo sapiens
ccctgcccaagggcct

SEQ ID NO: 207849 - DNA, 13 bp, Homo sapiens
ccctgcccaggca

SEQ ID NO: 207850 - DNA, 22 bp, Homo sapiens
ccctgcccaggcagtctttgct

SEQ ID NO: 207851 - DNA, 12 bp, Homo sapiens
ccctgccccaga

SEQ ID NO: 207852 - DNA, 16 bp, Homo sapiens
ccctgcccccatctcc

SEQ ID NO: 207853 - DNA, 20 bp, Homo sapiens
ccctgcccccatctccccag

SEQ ID NO: 207854 - DNA, 17 bp, Homo sapiens
ccctgccccgcccccca

SEQ ID NO: 207855 - DNA, 15 bp, Homo sapiens
ccctgccccgtcacc

SEQ ID NO: 207856 - DNA, 17 bp, Homo sapiens
ccctgcccctcccttca

SEQ ID NO: 207857 - DNA, 14 bp, Homo sapiens
ccctgcccctcctg

SEQ ID NO: 207858 - DNA, 13 bp, Homo sapiens
ccctgcccctgcc

SEQ ID NO: 207859 - DNA, 17 bp, Homo sapiens
ccctgcccctgccccgt

SEQ ID NO: 207860 - DNA, 18 bp, Homo sapiens
ccctgcccctgccccgtc

SEQ ID NO: 207861 - DNA, 17 bp, Homo sapiens
ccctgcccctgcccctg

SEQ ID NO: 207862 - DNA, 19 bp, Homo sapiens
ccctgcccctgcccgagag

SEQ ID NO: 207863 - DNA, 19 bp, Homo sapiens
ccctgcccgaccccatctc

SEQ ID NO: 207864 - DNA, 22 bp, Homo sapiens
ccctgtccccctcccctcccag

SEQ ID NO: 207865 - DNA, 14 bp, Homo sapiens
ccctgtcccctgag

SEQ ID NO: 207866 - DNA, 23 bp, Homo sapiens
ccctgtcctgatggtcagctccc

SEQ ID NO: 207867 - DNA, 14 bp, Homo sapiens
ccctgtctaaaaaa

SEQ ID NO: 207868 - DNA, 16 bp, Homo sapiens
ccctgtctaggcacat

SEQ ID NO: 207869 - DNA, 20 bp, Homo sapiens
ccctgtctccagggccccca

SEQ ID NO: 207870 - DNA, 14 bp, Homo sapiens
ccctgtctctacta

SEQ ID NO: 207871 - DNA, 14 bp, Homo sapiens
ccctgtctggaaga

SEQ ID NO: 207872 - DNA, 15 bp, Homo sapiens
ccctgtgacccgttc

SEQ ID NO: 207873 - DNA, 18 bp, Homo sapiens
ccctgtgactatggctct

SEQ ID NO: 207874 - DNA, 14 bp, Homo sapiens
ccctgtgactcctc

SEQ ID NO: 207875 - DNA, 15 bp, Homo sapiens
ccctgtgactcctcc

SEQ ID NO: 207876 - DNA, 21 bp, Homo sapiens
ccctgtgagcaaaaatgccag

SEQ ID NO: 207877 - DNA, 13 bp, Homo sapiens
ccctgtgatgcct

SEQ ID NO: 207878 - DNA, 20 bp, Homo sapiens
ccctgtgcccacccagggcc

SEQ ID NO: 207879 - DNA, 22 bp, Homo sapiens
ccctgtgcctaacaccagcgtt

SEQ ID NO: 207880 - DNA, 14 bp, Homo sapiens
ccctgtggaaggga

SEQ ID NO: 207881 - DNA, 18 bp, Homo sapiens
ccctgtggaagggactag

SEQ ID NO: 207882 - DNA, 17 bp, Homo sapiens
ccctgtggagcccgcac

SEQ ID NO: 207883 - DNA, 14 bp, Homo sapiens
ccctgtgggagtcc

SEQ ID NO: 207884 - DNA, 16 bp, Homo sapiens
ccctgtgggagtccac

SEQ ID NO: 207885 - DNA, 17 bp, Homo sapiens
ccctgtgggagtccact

SEQ ID NO: 207886 - DNA, 20 bp, Homo sapiens
ccctgtgggagtccactttc

SEQ ID NO: 207887 - DNA, 18 bp, Homo sapiens
ccctgtggggcctgatgg

SEQ ID NO: 207888 - DNA, 17 bp, Homo sapiens
ccctgtggtaccctggc

SEQ ID NO: 207889 - DNA, 20 bp, Homo sapiens
ccctgtggtaccctggcaga

SEQ ID NO: 207890 - DNA, 20 bp, Homo sapiens
ccctgtgtgtcgttcccttg

SEQ ID NO: 207891 - DNA, 23 bp, Homo sapiens
ccctgtgttggggggcaaggtgg

SEQ ID NO: 207892 - DNA, 17 bp, Homo sapiens
ccctgtgttgtctctag

SEQ ID NO: 207893 - DNA, 16 bp, Homo sapiens
ccctgttatctgctag

SEQ ID NO: 207894 - DNA, 15 bp, Homo sapiens
ccctgttcaaagtac

SEQ ID NO: 207895 - DNA, 13 bp, Homo sapiens
ccctgttcactct

SEQ ID NO: 207896 - DNA, 14 bp, Homo sapiens
ccctgttcactcta

SEQ ID NO: 207897 - DNA, 13 bp, Homo sapiens
ccctgtttgccta

SEQ ID NO: 207898 - DNA, 14 bp, Homo sapiens
cccttagccccgag

SEQ ID NO: 207899 - DNA, 17 bp, Homo sapiens
cccttagcctctcccac

SEQ ID NO: 207900 - DNA, 21 bp, Homo sapiens
cccttatttattattgtagct

SEQ ID NO: 207901 - DNA, 23 bp, Homo sapiens
cccttcaaggaagtgataacact

SEQ ID NO: 207902 - DNA, 15 bp, Homo sapiens
cccttcaccccttca

SEQ ID NO: 207903 - DNA, 12 bp, Homo sapiens
cccttcacgctg

SEQ ID NO: 207904 - DNA, 23 bp, Homo sapiens
cccttcagccgagcccagacctc

SEQ ID NO: 207905 - DNA, 13 bp, Homo sapiens
cccttcagggcca

SEQ ID NO: 207906 - DNA, 11 bp, Homo sapiens
cccttcatttg

SEQ ID NO: 207907 - DNA, 18 bp, Homo sapiens
cccttccacctcctagag

SEQ ID NO: 207908 - DNA, 16 bp, Homo sapiens
cccttccactgcctct

SEQ ID NO: 207909 - DNA, 14 bp, Homo sapiens
cccttccaggccat

SEQ ID NO: 207910 - DNA, 21 bp, Homo sapiens
cccttccaggggtcaccttga

SEQ ID NO: 207911 - DNA, 13 bp, Homo sapiens
cccttccagtggg

SEQ ID NO: 207912 - DNA, 13 bp, Homo sapiens
cccttcccacccc

SEQ ID NO: 207913 - DNA, 12 bp, Homo sapiens
cccttcccaggc

SEQ ID NO: 207914 - DNA, 13 bp, Homo sapiens
cccttcccaggcc

SEQ ID NO: 207915 - DNA, 12 bp, Homo sapiens
cccttccccact

SEQ ID NO: 207916 - DNA, 16 bp, Homo sapiens
cccttccccactcccg

SEQ ID NO: 207917 - DNA, 22 bp, Homo sapiens
cccttccccatttcctcttcct

SEQ ID NO: 207918 - DNA, 12 bp, Homo sapiens
cccttcccctcc

SEQ ID NO: 207919 - DNA, 19 bp, Homo sapiens
cccttcccctccctggctc

SEQ ID NO: 207920 - DNA, 17 bp, Homo sapiens
cccttcccctgcgccct

SEQ ID NO: 207921 - DNA, 18 bp, Homo sapiens
cccttcccctgcgccctc

SEQ ID NO: 207922 - DNA, 22 bp, Homo sapiens
cccttcccctgcgccctccctc

SEQ ID NO: 207923 - DNA, 14 bp, Homo sapiens
cccttcccctgctg

SEQ ID NO: 207924 - DNA, 16 bp, Homo sapiens
cccttcccctgctgac

SEQ ID NO: 207925 - DNA, 19 bp, Homo sapiens
cccttcccctgctgacctt

SEQ ID NO: 207926 - DNA, 12 bp, Homo sapiens
cccttccctgct

SEQ ID NO: 207927 - DNA, 13 bp, Homo sapiens
cccttccctggcc

SEQ ID NO: 207928 - DNA, 16 bp, Homo sapiens
cccttccctggccccg

SEQ ID NO: 207929 - DNA, 15 bp, Homo sapiens
cccttccggtgcgtg

SEQ ID NO: 207930 - DNA, 16 bp, Homo sapiens
cccttccggtgcgtgt

SEQ ID NO: 207931 - DNA, 13 bp, Homo sapiens
cccttcctctcca

SEQ ID NO: 207932 - DNA, 17 bp, Homo sapiens
cccttcctctccactgc

SEQ ID NO: 207933 - DNA, 18 bp, Homo sapiens
cccttcctggactggccc

SEQ ID NO: 207934 - DNA, 17 bp, Homo sapiens
gccaaagtgcagccctt

SEQ ID NO: 207935 - DNA, 12 bp, Homo sapiens
gccaaatatgca

SEQ ID NO: 207936 - DNA, 14 bp, Homo sapiens
gccaaatatgcact

SEQ ID NO: 207937 - DNA, 16 bp, Homo sapiens
gccaaatcctgggcat

SEQ ID NO: 207938 - DNA, 22 bp, Homo sapiens
gccaaatcctgggcatccccag

SEQ ID NO: 207939 - DNA, 21 bp, Homo sapiens
gccaaatgcagggaggggagg

SEQ ID NO: 207940 - DNA, 20 bp, Homo sapiens
gccaaatgctatactgtgtc

SEQ ID NO: 207941 - DNA, 15 bp, Homo sapiens
gccaaattatttgtg

SEQ ID NO: 207942 - DNA, 14 bp, Homo sapiens
gccaaattttggcc

SEQ ID NO: 207943 - DNA, 17 bp, Homo sapiens
gccaacagaagcttcca

SEQ ID NO: 207944 - DNA, 19 bp, Homo sapiens
gccaacagacactacatta

SEQ ID NO: 207945 - DNA, 15 bp, Homo sapiens
gccaaccagcttgtc

SEQ ID NO: 207946 - DNA, 22 bp, Homo sapiens
gccaacctcggcttgtgggctg

SEQ ID NO: 207947 - DNA, 23 bp, Homo sapiens
gccaactcactcttatgaaatgg

SEQ ID NO: 207948 - DNA, 20 bp, Homo sapiens
gccaactccatgaccaggcc

SEQ ID NO: 207949 - DNA, 13 bp, Homo sapiens
gccaacttgtaaa

SEQ ID NO: 207950 - DNA, 17 bp, Homo sapiens
gccaacttgtaaataca

SEQ ID NO: 207951 - DNA, 20 bp, Homo sapiens
gccaacttgtaaatacacca

SEQ ID NO: 207952 - DNA, 16 bp, Homo sapiens
gccaactttccagact

SEQ ID NO: 207953 - DNA, 19 bp, Homo sapiens
gccaacttttagtgggtga

SEQ ID NO: 207954 - DNA, 15 bp, Homo sapiens
gccaagaactctggg

SEQ ID NO: 207955 - DNA, 15 bp, Homo sapiens
gccaagaattagatt

SEQ ID NO: 207956 - DNA, 14 bp, Homo sapiens
gccaagaattctta

SEQ ID NO: 207957 - DNA, 18 bp, Homo sapiens
gccaagaattcttaaata

SEQ ID NO: 207958 - DNA, 22 bp, Homo sapiens
gccaagacttggcaacagaagc

SEQ ID NO: 207959 - DNA, 23 bp, Homo sapiens
gccaagacttggcaacagaagca

SEQ ID NO: 207960 - DNA, 22 bp, Homo sapiens
gccaagcaaaccaatggtgatc

SEQ ID NO: 207961 - DNA, 14 bp, Homo sapiens
gccaagcctgcagc

SEQ ID NO: 207962 - DNA, 19 bp, Homo sapiens
gccaaggaggtcccaggaa

SEQ ID NO: 207963 - DNA, 21 bp, Homo sapiens
gccaaggaggtcccaggaagt

SEQ ID NO: 207964 - DNA, 14 bp, Homo sapiens
gccaaggaggtggg

SEQ ID NO: 207965 - DNA, 20 bp, Homo sapiens
gccaaggccagagtggcctg

SEQ ID NO: 207966 - DNA, 19 bp, Homo sapiens
gccaaggccgcccacctgc

SEQ ID NO: 207967 - DNA, 19 bp, Homo sapiens
gccaaggcctatgccacct

SEQ ID NO: 207968 - DNA, 15 bp, Homo sapiens
gccaaggcctcagga

SEQ ID NO: 207969 - DNA, 15 bp, Homo sapiens
gccaaggctctcccc

SEQ ID NO: 207970 - DNA, 15 bp, Homo sapiens
gccaaggggccagct

SEQ ID NO: 207971 - DNA, 13 bp, Homo sapiens
gccaagtcctgcc

SEQ ID NO: 207972 - DNA, 14 bp, Homo sapiens
gccaagtgccttcc

SEQ ID NO: 207973 - DNA, 17 bp, Homo sapiens
gccaatgaacagctcct

SEQ ID NO: 207974 - DNA, 18 bp, Homo sapiens
gccaatgaacagctcctc

SEQ ID NO: 207975 - DNA, 21 bp, Homo sapiens
gccaatgaagcaaacacacag

SEQ ID NO: 207976 - DNA, 22 bp, Homo sapiens
gccaatgaggtctgaaatggag

SEQ ID NO: 207977 - DNA, 15 bp, Homo sapiens
gccaatgccacagcc

SEQ ID NO: 207978 - DNA, 18 bp, Homo sapiens
gccaatgccacagccaag

SEQ ID NO: 207979 - DNA, 18 bp, Homo sapiens
gccaatgccccactggca

SEQ ID NO: 207980 - DNA, 16 bp, Homo sapiens
gccaatggagactgtc

SEQ ID NO: 207981 - DNA, 11 bp, Homo sapiens
gccaattttgt

SEQ ID NO: 207982 - DNA, 19 bp, Homo sapiens
gccacaacctgaaagacaa

SEQ ID NO: 207983 - DNA, 14 bp, Homo sapiens
gccacaagaaattt

SEQ ID NO: 207984 - DNA, 17 bp, Homo sapiens
gccacaaggctggccag

SEQ ID NO: 207985 - DNA, 15 bp, Homo sapiens
gccacaatcctcccc

SEQ ID NO: 207986 - DNA, 16 bp, Homo sapiens
gccacaatcctcccca

SEQ ID NO: 207987 - DNA, 14 bp, Homo sapiens
gccacaatgtgata

SEQ ID NO: 207988 - DNA, 18 bp, Homo sapiens
gccacacgctcactccag

SEQ ID NO: 207989 - DNA, 18 bp, Homo sapiens
gccacactattaccatga

SEQ ID NO: 207990 - DNA, 19 bp, Homo sapiens
gccacactcagtcccccac

SEQ ID NO: 207991 - DNA, 20 bp, Homo sapiens
gccacagcagcctctgaagt

SEQ ID NO: 207992 - DNA, 15 bp, Homo sapiens
gccacagcaggactg

SEQ ID NO: 207993 - DNA, 14 bp, Homo sapiens
gccacagccaagcc

SEQ ID NO: 207994 - DNA, 19 bp, Homo sapiens
gccacagccacctccaccc

SEQ ID NO: 207995 - DNA, 19 bp, Homo sapiens
ccgccggcaggggcccctc

SEQ ID NO: 207996 - DNA, 14 bp, Homo sapiens
ccgccgtgccggcg

SEQ ID NO: 207997 - DNA, 15 bp, Homo sapiens
ccgccgtgcctgcat

SEQ ID NO: 207998 - DNA, 12 bp, Homo sapiens
ccgcctcagcct

SEQ ID NO: 207999 - DNA, 13 bp, Homo sapiens
ccgcctcagcctc

SEQ ID NO: 208000 - DNA, 23 bp, Homo sapiens
ccgcctccactctagttctagat

SEQ ID NO: 208001 - DNA, 21 bp, Homo sapiens
ccgcctccctcccctgccctc

SEQ ID NO: 208002 - DNA, 16 bp, Homo sapiens
ccgcctcctccagact

SEQ ID NO: 208003 - DNA, 17 bp, Homo sapiens
ccgcctcgggccgcctc

SEQ ID NO: 208004 - DNA, 18 bp, Homo sapiens
ccgcctcgggccgcctcc

SEQ ID NO: 208005 - DNA, 12 bp, Homo sapiens
ccgcctctgagc

SEQ ID NO: 208006 - DNA, 13 bp, Homo sapiens
ccgcctctgagcc

SEQ ID NO: 208007 - DNA, 13 bp, Homo sapiens
ccgcctggcaggt

SEQ ID NO: 208008 - DNA, 11 bp, Homo sapiens
ccgcctgtcct

SEQ ID NO: 208009 - DNA, 12 bp, Homo sapiens
ccgcctgtcctt

SEQ ID NO: 208010 - DNA, 15 bp, Homo sapiens
ccgcctgtccttggt

SEQ ID NO: 208011 - DNA, 22 bp, Homo sapiens
ccgccttaatctggaaggcccc

SEQ ID NO: 208012 - DNA, 12 bp, Homo sapiens
ccgccttccctc

SEQ ID NO: 208013 - DNA, 22 bp, Homo sapiens
ccgccttccctcactcttcctc

SEQ ID NO: 208014 - DNA, 23 bp, Homo sapiens
ccgccttgagtgacatgcggctg

SEQ ID NO: 208015 - DNA, 18 bp, Homo sapiens
ccgcgatgccctgggggc

SEQ ID NO: 208016 - DNA, 18 bp, Homo sapiens
ccgcgcgtgcccccagcg

SEQ ID NO: 208017 - DNA, 14 bp, Homo sapiens
ccgcgctctgcccc

SEQ ID NO: 208018 - DNA, 19 bp, Homo sapiens
ccgcgctctgcccctccgt

SEQ ID NO: 208019 - DNA, 20 bp, Homo sapiens
ccgcgctctgcccctccgtc

SEQ ID NO: 208020 - DNA, 18 bp, Homo sapiens
ccgcgggcggccaggcaa

SEQ ID NO: 208021 - DNA, 20 bp, Homo sapiens
ccgcggggaccctgccgagg

SEQ ID NO: 208022 - DNA, 14 bp, Homo sapiens
ccgcgggttctaga

SEQ ID NO: 208023 - DNA, 20 bp, Homo sapiens
ccgcggtaggtaagggccgc

SEQ ID NO: 208024 - DNA, 14 bp, Homo sapiens
ccgcggtgctctgg

SEQ ID NO: 208025 - DNA, 15 bp, Homo sapiens
ccgcggtgctctggc

SEQ ID NO: 208026 - DNA, 17 bp, Homo sapiens
ccgcggtgctctggcgg

SEQ ID NO: 208027 - DNA, 15 bp, Homo sapiens
ccgcgtccaaccccg

SEQ ID NO: 208028 - DNA, 19 bp, Homo sapiens
ccgcgtgcgaccagaggtg

SEQ ID NO: 208029 - DNA, 15 bp, Homo sapiens
ccgctcaacctctca

SEQ ID NO: 208030 - DNA, 16 bp, Homo sapiens
ccgctcaacctctcag

SEQ ID NO: 208031 - DNA, 15 bp, Homo sapiens
ccgctcagccctccc

SEQ ID NO: 208032 - DNA, 19 bp, Homo sapiens
ccgctcagccctccctgcc

SEQ ID NO: 208033 - DNA, 21 bp, Homo sapiens
ccgctcagccctccctgcccc

SEQ ID NO: 208034 - DNA, 12 bp, Homo sapiens
ccgctccccagc

SEQ ID NO: 208035 - DNA, 19 bp, Homo sapiens
ccgctcctcccctcttgag

SEQ ID NO: 208036 - DNA, 15 bp, Homo sapiens
ccgctctctcatgtg

SEQ ID NO: 208037 - DNA, 18 bp, Homo sapiens
ccgctctgaggcaacccc

SEQ ID NO: 208038 - DNA, 19 bp, Homo sapiens
ccgctctggatcctgcact

SEQ ID NO: 208039 - DNA, 13 bp, Homo sapiens
ccgctctggcagt

SEQ ID NO: 208040 - DNA, 21 bp, Homo sapiens
ccgctgccaccacgtctgcca

SEQ ID NO: 208041 - DNA, 22 bp, Homo sapiens
ccgctgccaccacgtctgccag

SEQ ID NO: 208042 - DNA, 24 bp, Homo sapiens
ccgctgccaccacgtctgccaggc

SEQ ID NO: 208043 - DNA, 19 bp, Homo sapiens
ccgctgcccagccctccca

SEQ ID NO: 208044 - DNA, 21 bp, Homo sapiens
ccgctgcccagccctcccagc

SEQ ID NO: 208045 - DNA, 11 bp, Homo sapiens
ccgctgctgct

SEQ ID NO: 208046 - DNA, 14 bp, Homo sapiens
ccgctgctgctgct

SEQ ID NO: 208047 - DNA, 14 bp, Homo sapiens
ccgctgctgtgctc

SEQ ID NO: 208048 - DNA, 15 bp, Homo sapiens
ccgctgctgtgctct

SEQ ID NO: 208049 - DNA, 15 bp, Homo sapiens
ccgctgcttccaggt

SEQ ID NO: 208050 - DNA, 15 bp, Homo sapiens
ccgctggctgggggc

SEQ ID NO: 208051 - DNA, 18 bp, Homo sapiens
ccgctggctgggggcctc

SEQ ID NO: 208052 - DNA, 22 bp, Homo sapiens
ccgctggctgggggcctcactc

SEQ ID NO: 208053 - DNA, 18 bp, Homo sapiens
ccgctgggagaaaagcca

SEQ ID NO: 208054 - DNA, 21 bp, Homo sapiens
ccgctgggagaaaagccagat

SEQ ID NO: 208055 - DNA, 22 bp, Homo sapiens
ccgctgggagaaaagccagatg

SEQ ID NO: 208056 - DNA, 23 bp, Homo sapiens
ccgctgggagagccaaggcctat

SEQ ID NO: 208057 - DNA, 19 bp, Homo sapiens
ccgctgggctgagccccta

SEQ ID NO: 208058 - DNA, 15 bp, Homo sapiens
ccgctgtcacccagc

SEQ ID NO: 208059 - DNA, 14 bp, Homo sapiens
ccgctgtcccaggg

SEQ ID NO: 208060 - DNA, 17 bp, Homo sapiens
ccgcttcacccctgcac

SEQ ID NO: 208061 - DNA, 15 bp, Homo sapiens
ccgcttccctaccca

SEQ ID NO: 208062 - DNA, 20 bp, Homo sapiens
ccgcttccctacccacaggg

SEQ ID NO: 208063 - DNA, 13 bp, Homo sapiens
ccgcttcctgttt

SEQ ID NO: 208064 - DNA, 15 bp, Homo sapiens
ccgcttctgcctgca

SEQ ID NO: 208065 - DNA, 15 bp, Homo sapiens
ccggaagctcctggt

SEQ ID NO: 208066 - DNA, 20 bp, Homo sapiens
ccggaatcctgtcctcagct

SEQ ID NO: 208067 - DNA, 16 bp, Homo sapiens
ccggaatgaccagcat

SEQ ID NO: 208068 - DNA, 14 bp, Homo sapiens
ccggagatgtagca

SEQ ID NO: 208069 - DNA, 17 bp, Homo sapiens
ccggagatgtagcaaaa

SEQ ID NO: 208070 - DNA, 18 bp, Homo sapiens
ccggagatgtagcaaaac

SEQ ID NO: 208071 - DNA, 17 bp, Homo sapiens
ccggagattggacggcc

SEQ ID NO: 208072 - DNA, 14 bp, Homo sapiens
ccggagcacagccc

SEQ ID NO: 208073 - DNA, 16 bp, Homo sapiens
ccggagcacagccctg

SEQ ID NO: 208074 - DNA, 15 bp, Homo sapiens
ccggagcggctgagg

SEQ ID NO: 208075 - DNA, 16 bp, Homo sapiens
ccggagcggctgagga

SEQ ID NO: 208076 - DNA, 17 bp, Homo sapiens
ccggagcggctgaggac

SEQ ID NO: 208077 - DNA, 17 bp, Homo sapiens
caccctcacacacacag

SEQ ID NO: 208078 - DNA, 23 bp, Homo sapiens
caccctcacacacacagctgggc

SEQ ID NO: 208079 - DNA, 15 bp, Homo sapiens
caccctcactctgcc

SEQ ID NO: 208080 - DNA, 16 bp, Homo sapiens
caccctcactctgcca

SEQ ID NO: 208081 - DNA, 21 bp, Homo sapiens
caccctcactctgccagggca

SEQ ID NO: 208082 - DNA, 12 bp, Homo sapiens
caccctcagctg

SEQ ID NO: 208083 - DNA, 22 bp, Homo sapiens
caccctcagctggcggaacctg

SEQ ID NO: 208084 - DNA, 14 bp, Homo sapiens
caccctccatgctc

SEQ ID NO: 208085 - DNA, 18 bp, Homo sapiens
caccctccatgctcctca

SEQ ID NO: 208086 - DNA, 17 bp, Homo sapiens
caccctccccattagta

SEQ ID NO: 208087 - DNA, 17 bp, Homo sapiens
caccctcccctctcctg

SEQ ID NO: 208088 - DNA, 18 bp, Homo sapiens
caccctcccctctcctga

SEQ ID NO: 208089 - DNA, 19 bp, Homo sapiens
caccctccggccagcgagt

SEQ ID NO: 208090 - DNA, 18 bp, Homo sapiens
caccctcgtggacacctg

SEQ ID NO: 208091 - DNA, 19 bp, Homo sapiens
caccctcgtggacacctgc

SEQ ID NO: 208092 - DNA, 21 bp, Homo sapiens
caccctcgtggacacctgccc

SEQ ID NO: 208093 - DNA, 23 bp, Homo sapiens
caccctcgtggacacctgccctg

SEQ ID NO: 208094 - DNA, 17 bp, Homo sapiens
caccctctgcagggcag

SEQ ID NO: 208095 - DNA, 18 bp, Homo sapiens
caccctctgcagggcagc

SEQ ID NO: 208096 - DNA, 16 bp, Homo sapiens
caccctctggtccttc

SEQ ID NO: 208097 - DNA, 10 bp, Homo sapiens
caccctgagg

SEQ ID NO: 208098 - DNA, 17 bp, Homo sapiens
caccctgatttcttgct

SEQ ID NO: 208099 - DNA, 13 bp, Homo sapiens
caccctgcaaggc

SEQ ID NO: 208100 - DNA, 17 bp, Homo sapiens
caccctgcaaggcccac

SEQ ID NO: 208101 - DNA, 18 bp, Homo sapiens
caccctgccttatcttgc

SEQ ID NO: 208102 - DNA, 19 bp, Homo sapiens
caccctgcttggggcctgg

SEQ ID NO: 208103 - DNA, 21 bp, Homo sapiens
caccctgcttggggcctggcg

SEQ ID NO: 208104 - DNA, 17 bp, Homo sapiens
caccctggaaaggggag

SEQ ID NO: 208105 - DNA, 19 bp, Homo sapiens
caccctggcccgcccctcg

SEQ ID NO: 208106 - DNA, 13 bp, Homo sapiens
caccctggggcct

SEQ ID NO: 208107 - DNA, 19 bp, Homo sapiens
caccctggggcctggacct

SEQ ID NO: 208108 - DNA, 21 bp, Homo sapiens
caccctggggcctggacctgc

SEQ ID NO: 208109 - DNA, 22 bp, Homo sapiens
caccctggggcctggacctgcc

SEQ ID NO: 208110 - DNA, 14 bp, Homo sapiens
caccctgggtgcca

SEQ ID NO: 208111 - DNA, 17 bp, Homo sapiens
caccctgggtgccattc

SEQ ID NO: 208112 - DNA, 18 bp, Homo sapiens
caccctgggtgccattcc

SEQ ID NO: 208113 - DNA, 17 bp, Homo sapiens
caccctgtcaagttaac

SEQ ID NO: 208114 - DNA, 23 bp, Homo sapiens
cacccttcacgctggcttccagc

SEQ ID NO: 208115 - DNA, 14 bp, Homo sapiens
cacccttcagaccc

SEQ ID NO: 208116 - DNA, 11 bp, Homo sapiens
cacccttcccc

SEQ ID NO: 208117 - DNA, 13 bp, Homo sapiens
cacccttcccctc

SEQ ID NO: 208118 - DNA, 22 bp, Homo sapiens
cacccttcccctccttctccct

SEQ ID NO: 208119 - DNA, 14 bp, Homo sapiens
cacccttggacttg

SEQ ID NO: 208120 - DNA, 16 bp, Homo sapiens
cacccttggacttgag

SEQ ID NO: 208121 - DNA, 23 bp, Homo sapiens
cacccttggcctgtctcatcccc

SEQ ID NO: 208122 - DNA, 22 bp, Homo sapiens
caccctttgctgtgaggctgtc

SEQ ID NO: 208123 - DNA, 17 bp, Homo sapiens
caccgaccccctttcta

SEQ ID NO: 208124 - DNA, 11 bp, Homo sapiens
caccgagccag

SEQ ID NO: 208125 - DNA, 14 bp, Homo sapiens
caccgagccagctt

SEQ ID NO: 208126 - DNA, 16 bp, Homo sapiens
caccgagccagcttgg

SEQ ID NO: 208127 - DNA, 17 bp, Homo sapiens
caccgatggagccccca

SEQ ID NO: 208128 - DNA, 20 bp, Homo sapiens
caccgcagcctgtcagccaa

SEQ ID NO: 208129 - DNA, 15 bp, Homo sapiens
caccgcatatgcatg

SEQ ID NO: 208130 - DNA, 19 bp, Homo sapiens
caccgcatatgcatgccag

SEQ ID NO: 208131 - DNA, 15 bp, Homo sapiens
caccgcccaaccccc

SEQ ID NO: 208132 - DNA, 12 bp, Homo sapiens
caccgcccaccc

SEQ ID NO: 208133 - DNA, 19 bp, Homo sapiens
caccgccctcctcgctgtg

SEQ ID NO: 208134 - DNA, 22 bp, Homo sapiens
caccgccctcctcgctgtgcca

SEQ ID NO: 208135 - DNA, 23 bp, Homo sapiens
caccgccctcctcgctgtgccac

SEQ ID NO: 208136 - DNA, 14 bp, Homo sapiens
caccgctcaccctc

SEQ ID NO: 208137 - DNA, 13 bp, Homo sapiens
caccgctccccag

SEQ ID NO: 208138 - DNA, 17 bp, Homo sapiens
caccgctccccagccca

SEQ ID NO: 208139 - DNA, 17 bp, Homo sapiens
caccgctgccagcacag

SEQ ID NO: 208140 - DNA, 14 bp, Homo sapiens
caccggcgctgcag

SEQ ID NO: 208141 - DNA, 13 bp, Homo sapiens
caccgggcctgga

SEQ ID NO: 208142 - DNA, 15 bp, Homo sapiens
caccggggcactggc

SEQ ID NO: 208143 - DNA, 18 bp, Homo sapiens
caccggggcactggctgc

SEQ ID NO: 208144 - DNA, 19 bp, Homo sapiens
caccgtaaagtgagcatgc

SEQ ID NO: 208145 - DNA, 23 bp, Homo sapiens
caccgtcatggcttaatgtttat

SEQ ID NO: 208146 - DNA, 12 bp, Homo sapiens
caccgtggtcag

SEQ ID NO: 208147 - DNA, 23 bp, Homo sapiens
caccgtggtgtgaggcccccgga

SEQ ID NO: 208148 - DNA, 22 bp, Homo sapiens
cacctaaaaccagttttgctgc

SEQ ID NO: 208149 - DNA, 14 bp, Homo sapiens
cacctaaagcagcc

SEQ ID NO: 208150 - DNA, 17 bp, Homo sapiens
cacctaaagcagccagc

SEQ ID NO: 208151 - DNA, 12 bp, Homo sapiens
cacctaagtgac

SEQ ID NO: 208152 - DNA, 20 bp, Homo sapiens
cacctaatgtttatgagcca

SEQ ID NO: 208153 - DNA, 13 bp, Homo sapiens
cacctaccatgct

SEQ ID NO: 208154 - DNA, 15 bp, Homo sapiens
cacctaccatgctgc

SEQ ID NO: 208155 - DNA, 13 bp, Homo sapiens
caccttaaattaa

SEQ ID NO: 208156 - DNA, 22 bp, Homo sapiens
caccttaaattaaacaatttat

SEQ ID NO: 208157 - DNA, 18 bp, Homo sapiens
caccttaactgtgctcag

SEQ ID NO: 208158 - DNA, 18 bp, Homo sapiens
caccttaccaactttctg

SEQ ID NO: 208159 - DNA, 19 bp, Homo sapiens
caccttaccaactttctgt

SEQ ID NO: 208160 - DNA, 18 bp, Homo sapiens
caccttaccctactggct

SEQ ID NO: 208161 - DNA, 20 bp, Homo sapiens
caccttcctcacttccatac

SEQ ID NO: 208162 - DNA, 14 bp, Homo sapiens
caccttcctgactg

SEQ ID NO: 208163 - DNA, 13 bp, Homo sapiens
caccttcctgggc

SEQ ID NO: 208164 - DNA, 19 bp, Homo sapiens
caccttcctgggcagccca

SEQ ID NO: 208165 - DNA, 19 bp, Homo sapiens
caccttctgtccccagccc

SEQ ID NO: 208166 - DNA, 21 bp, Homo sapiens
caccttctgtccccagccctg

SEQ ID NO: 208167 - DNA, 13 bp, Homo sapiens
caccttcttggct

SEQ ID NO: 208168 - DNA, 15 bp, Homo sapiens
caccttcttggcttc

SEQ ID NO: 208169 - DNA, 23 bp, Homo sapiens
caccttgatcccaatccttatcc

SEQ ID NO: 208170 - DNA, 17 bp, Homo sapiens
caccttgcaacacacag

SEQ ID NO: 208171 - DNA, 18 bp, Homo sapiens
caccttgcaacacacaga

SEQ ID NO: 208172 - DNA, 21 bp, Homo sapiens
caccttgcaacacacagacac

SEQ ID NO: 208173 - DNA, 18 bp, Homo sapiens
caccttgccgagagaggc

SEQ ID NO: 208174 - DNA, 15 bp, Homo sapiens
caccttgctgcagtg

SEQ ID NO: 208175 - DNA, 20 bp, Homo sapiens
caccttgctgcagtgtccag

SEQ ID NO: 208176 - DNA, 20 bp, Homo sapiens
caccttggcgcgcagcccgg

SEQ ID NO: 208177 - DNA, 20 bp, Homo sapiens
caccttgggcacgggagagc

SEQ ID NO: 208178 - DNA, 21 bp, Homo sapiens
caccttgtacagaaccagcac

SEQ ID NO: 208179 - DNA, 23 bp, Homo sapiens
caccttgtacagaaccagcactc

SEQ ID NO: 208180 - DNA, 14 bp, Homo sapiens
cacctttgaagaag

SEQ ID NO: 208181 - DNA, 20 bp, Homo sapiens
caccttttctaaaaagtcaa

SEQ ID NO: 208182 - DNA, 18 bp, Homo sapiens
cacgacaaaaacaagact

SEQ ID NO: 208183 - DNA, 12 bp, Homo sapiens
cacgactcttcc

SEQ ID NO: 208184 - DNA, 21 bp, Homo sapiens
cacgagatcttccttccgctc

SEQ ID NO: 208185 - DNA, 23 bp, Homo sapiens
cacgagcaaagtgaagacactgg

SEQ ID NO: 208186 - DNA, 20 bp, Homo sapiens
cacgaggccttcagaaaaga

SEQ ID NO: 208187 - DNA, 21 bp, Homo sapiens
cacgaggtggtagctctgagc

SEQ ID NO: 208188 - DNA, 14 bp, Homo sapiens
cacgagtcacctgc

SEQ ID NO: 208189 - DNA, 18 bp, Homo sapiens
cacgagtcacctgcaagc

SEQ ID NO: 208190 - DNA, 17 bp, Homo sapiens
cacgcaagggcatcagg

SEQ ID NO: 208191 - DNA, 12 bp, Homo sapiens
cacgcacacaca

SEQ ID NO: 208192 - DNA, 13 bp, Homo sapiens
cacgcacctgtag

SEQ ID NO: 208193 - DNA, 12 bp, Homo sapiens
cacgcacgcaca

SEQ ID NO: 208194 - DNA, 14 bp, Homo sapiens
cacgcacgcacaca

SEQ ID NO: 208195 - DNA, 13 bp, Homo sapiens
cacgcagacacac

SEQ ID NO: 208196 - DNA, 14 bp, Homo sapiens
cacgcagacacaca

SEQ ID NO: 208197 - DNA, 20 bp, Homo sapiens
cacgccaagtggaagccact

SEQ ID NO: 208198 - DNA, 21 bp, Homo sapiens
cacgccattctcctgcctcag

SEQ ID NO: 208199 - DNA, 14 bp, Homo sapiens
cacgccccagcccg

SEQ ID NO: 208200 - DNA, 18 bp, Homo sapiens
cacgccctccctctccca

SEQ ID NO: 208201 - DNA, 22 bp, Homo sapiens
cacgcctgtaatcccagcactt

SEQ ID NO: 208202 - DNA, 15 bp, Homo sapiens
cacgctctggtgcag

SEQ ID NO: 208203 - DNA, 12 bp, Homo sapiens
cacgctgcccag

SEQ ID NO: 208204 - DNA, 19 bp, Homo sapiens
cacgctgggacacagaccg

SEQ ID NO: 208205 - DNA, 23 bp, Homo sapiens
cacgctgtctccagacccccacc

SEQ ID NO: 208206 - DNA, 16 bp, Homo sapiens
cacgctgtgggcaggt

SEQ ID NO: 208207 - DNA, 18 bp, Homo sapiens
cacgctgtgggcaggtgg

SEQ ID NO: 208208 - DNA, 19 bp, Homo sapiens
cacgcttgacaggacagca

SEQ ID NO: 208209 - DNA, 14 bp, Homo sapiens
cacgctttctagct

SEQ ID NO: 208210 - DNA, 15 bp, Homo sapiens
cacgctttgctgcta

SEQ ID NO: 208211 - DNA, 15 bp, Homo sapiens
cacggaaacagaact

SEQ ID NO: 208212 - DNA, 19 bp, Homo sapiens
cacggacaggaagcacagc

SEQ ID NO: 208213 - DNA, 23 bp, Homo sapiens
cacggacgctggctccccaaagg

SEQ ID NO: 208214 - DNA, 17 bp, Homo sapiens
cacggacgtttccatca

SEQ ID NO: 208215 - DNA, 21 bp, Homo sapiens
cacggaggctcgtgcatgtaa

SEQ ID NO: 208216 - DNA, 14 bp, Homo sapiens
atatgtattgtaaa

SEQ ID NO: 208217 - DNA, 20 bp, Homo sapiens
atatgtcttactactttaaa

SEQ ID NO: 208218 - DNA, 11 bp, Homo sapiens
atatgtcttgc

SEQ ID NO: 208219 - DNA, 15 bp, Homo sapiens
atatgtcttgcaaag

SEQ ID NO: 208220 - DNA, 16 bp, Homo sapiens
atatgtcttgcaaagc

SEQ ID NO: 208221 - DNA, 14 bp, Homo sapiens
atatgtgagcatga

SEQ ID NO: 208222 - DNA, 19 bp, Homo sapiens
atatgtgagtgaaagtact

SEQ ID NO: 208223 - DNA, 22 bp, Homo sapiens
atatgtggcattcctttcttta

SEQ ID NO: 208224 - DNA, 20 bp, Homo sapiens
atatgtgtaaatgttatgac

SEQ ID NO: 208225 - DNA, 15 bp, Homo sapiens
atatgtgtaatatca

SEQ ID NO: 208226 - DNA, 20 bp, Homo sapiens
atatgtgtgtgtatgtttgc

SEQ ID NO: 208227 - DNA, 20 bp, Homo sapiens
atatgttaacctcagtgtca

SEQ ID NO: 208228 - DNA, 23 bp, Homo sapiens
atatgttaagcagctaaattttc

SEQ ID NO: 208229 - DNA, 13 bp, Homo sapiens
atatgttgctcag

SEQ ID NO: 208230 - DNA, 12 bp, Homo sapiens
atatgttgctga

SEQ ID NO: 208231 - DNA, 16 bp, Homo sapiens
atatgttgctgaaaca

SEQ ID NO: 208232 - DNA, 15 bp, Homo sapiens
catgtgggggaaggc

SEQ ID NO: 208233 - DNA, 23 bp, Homo sapiens
catgtgggggaaggccttgctgt

SEQ ID NO: 208234 - DNA, 17 bp, Homo sapiens
catgtgggtgagccagt

SEQ ID NO: 208235 - DNA, 17 bp, Homo sapiens
catgtgggttgtgatat

SEQ ID NO: 208236 - DNA, 20 bp, Homo sapiens
catgtggtttatagagggcc

SEQ ID NO: 208237 - DNA, 17 bp, Homo sapiens
catgtgtataaaaataa

SEQ ID NO: 208238 - DNA, 14 bp, Homo sapiens
catgtgtatgagaa

SEQ ID NO: 208239 - DNA, 14 bp, Homo sapiens
catgtgtcagagtg

SEQ ID NO: 208240 - DNA, 12 bp, Homo sapiens
catgtgtctgta

SEQ ID NO: 208241 - DNA, 24 bp, Homo sapiens
catgtgtctgtattcatacagcac

SEQ ID NO: 208242 - DNA, 14 bp, Homo sapiens
catgtgtgcctgtg

SEQ ID NO: 208243 - DNA, 14 bp, Homo sapiens
catgtgtgctgaac

SEQ ID NO: 208244 - DNA, 23 bp, Homo sapiens
catgtgtgtatcaccctcagctg

SEQ ID NO: 208245 - DNA, 21 bp, Homo sapiens
catgtgtgtgcaagtgtgtgc

SEQ ID NO: 208246 - DNA, 17 bp, Homo sapiens
catgtgttgcaaattat

SEQ ID NO: 208247 - DNA, 23 bp, Homo sapiens
catgtgttgcaaattattctagt

SEQ ID NO: 208248 - DNA, 19 bp, Homo sapiens
catgtgtttggttctgggg

SEQ ID NO: 208249 - DNA, 13 bp, Homo sapiens
catgtgttttgct

SEQ ID NO: 208250 - DNA, 21 bp, Homo sapiens
catgtgttttgcttttatcca

SEQ ID NO: 208251 - DNA, 22 bp, Homo sapiens
catgttaaagaggcgtcttgta

SEQ ID NO: 208252 - DNA, 16 bp, Homo sapiens
catgttaatcctagct

SEQ ID NO: 208253 - DNA, 18 bp, Homo sapiens
catgttaattgatagaat

SEQ ID NO: 208254 - DNA, 12 bp, Homo sapiens
catgttaccatc

SEQ ID NO: 208255 - DNA, 14 bp, Homo sapiens
catgttattttatt

SEQ ID NO: 208256 - DNA, 16 bp, Homo sapiens
catgttcccttctcct

SEQ ID NO: 208257 - DNA, 15 bp, Homo sapiens
catgttctatgtgtt

SEQ ID NO: 208258 - DNA, 22 bp, Homo sapiens
catgttctgagctataacattt

SEQ ID NO: 208259 - DNA, 20 bp, Homo sapiens
catgttcttgttttgttata

SEQ ID NO: 208260 - DNA, 23 bp, Homo sapiens
catgttgtagatacaatcagctg

SEQ ID NO: 208261 - DNA, 15 bp, Homo sapiens
catgtttaatgttat

SEQ ID NO: 208262 - DNA, 17 bp, Homo sapiens
catgtttcatgttttgt

SEQ ID NO: 208263 - DNA, 19 bp, Homo sapiens
catgtttccatcatttctg

SEQ ID NO: 208264 - DNA, 23 bp, Homo sapiens
catgtttccctactaacatccca

SEQ ID NO: 208265 - DNA, 21 bp, Homo sapiens
catgttttaaaagtttgtcct

SEQ ID NO: 208266 - DNA, 15 bp, Homo sapiens
catgttttgctaatg

SEQ ID NO: 208267 - DNA, 17 bp, Homo sapiens
catgttttgtgactata

SEQ ID NO: 208268 - DNA, 13 bp, Homo sapiens
cattaaaactgct

SEQ ID NO: 208269 - DNA, 14 bp, Homo sapiens
cattaaaactgctt

SEQ ID NO: 208270 - DNA, 18 bp, Homo sapiens
cattaaaagttttatgta

SEQ ID NO: 208271 - DNA, 21 bp, Homo sapiens
cattaaaatagattatcccac

SEQ ID NO: 208272 - DNA, 16 bp, Homo sapiens
cattaaaatggaagtg

SEQ ID NO: 208273 - DNA, 19 bp, Homo sapiens
cattaaaatggaagtggat

SEQ ID NO: 208274 - DNA, 16 bp, Homo sapiens
cattaaacactgtaat

SEQ ID NO: 208275 - DNA, 18 bp, Homo sapiens
cattaaacatgaatttaa

SEQ ID NO: 208276 - DNA, 19 bp, Homo sapiens
cattaaacatgaatttaat

SEQ ID NO: 208277 - DNA, 13 bp, Homo sapiens
cattaaagaaaaa

SEQ ID NO: 208278 - DNA, 14 bp, Homo sapiens
cattaaagaaaaac

SEQ ID NO: 208279 - DNA, 22 bp, Homo sapiens
cattaaagaaaaaccacagata

SEQ ID NO: 208280 - DNA, 14 bp, Homo sapiens
cattaaatgctttg

SEQ ID NO: 208281 - DNA, 12 bp, Homo sapiens
cattaaatgttt

SEQ ID NO: 208282 - DNA, 17 bp, Homo sapiens
cattaacaggtctttga

SEQ ID NO: 208283 - DNA, 22 bp, Homo sapiens
cattaacagttttccatgaaaa

SEQ ID NO: 208284 - DNA, 23 bp, Homo sapiens
cattaacagttttccatgaaaac

SEQ ID NO: 208285 - DNA, 15 bp, Homo sapiens
cattaaccaaagaaa

SEQ ID NO: 208286 - DNA, 18 bp, Homo sapiens
cattaactaatctattgg

SEQ ID NO: 208287 - DNA, 15 bp, Homo sapiens
cattaagtggctttt

SEQ ID NO: 208288 - DNA, 21 bp, Homo sapiens
cattaataggaaagatttaat

SEQ ID NO: 208289 - DNA, 18 bp, Homo sapiens
cattaatcaatcatctgt

SEQ ID NO: 208290 - DNA, 13 bp, Homo sapiens
cattaatgttaat

SEQ ID NO: 208291 - DNA, 23 bp, Homo sapiens
cattaatgttaattcagcactga

SEQ ID NO: 208292 - DNA, 15 bp, Homo sapiens
cattacagagaggag

SEQ ID NO: 208293 - DNA, 20 bp, Homo sapiens
cattacagagaggagaaaca

SEQ ID NO: 208294 - DNA, 17 bp, Homo sapiens
cattacatggctgtggt

SEQ ID NO: 208295 - DNA, 22 bp, Homo sapiens
cattacattccttgataatgtt

SEQ ID NO: 208296 - DNA, 14 bp, Homo sapiens
cattactctgcact

SEQ ID NO: 208297 - DNA, 12 bp, Homo sapiens
cattactgcctt

SEQ ID NO: 208298 - DNA, 13 bp, Homo sapiens
cattactgccttc

SEQ ID NO: 208299 - DNA, 23 bp, Homo sapiens
cattacttgattaagattttaca

SEQ ID NO: 208300 - DNA, 23 bp, Homo sapiens
cattactttaatactcacctcct

SEQ ID NO: 208301 - DNA, 18 bp, Homo sapiens
cattagaagaaaacatat

SEQ ID NO: 208302 - DNA, 16 bp, Homo sapiens
cattagactgaattta

SEQ ID NO: 208303 - DNA, 17 bp, Homo sapiens
cattagattatcaaaaa

SEQ ID NO: 208304 - DNA, 18 bp, Homo sapiens
cattagcagtttgctttg

SEQ ID NO: 208305 - DNA, 22 bp, Homo sapiens
cattaggaacagagtatatatg

SEQ ID NO: 208306 - DNA, 17 bp, Homo sapiens
cattagggggaactcta

SEQ ID NO: 208307 - DNA, 21 bp, Homo sapiens
cattagggtgggcgtgctgcg

SEQ ID NO: 208308 - DNA, 19 bp, Homo sapiens
cattagttaagatgtctga

SEQ ID NO: 208309 - DNA, 20 bp, Homo sapiens
cattataaaatctttccatc

SEQ ID NO: 208310 - DNA, 13 bp, Homo sapiens
cattataaacgtg

SEQ ID NO: 208311 - DNA, 19 bp, Homo sapiens
cattatagcacgaagctat

SEQ ID NO: 208312 - DNA, 13 bp, Homo sapiens
cattatagcatgt

SEQ ID NO: 208313 - DNA, 17 bp, Homo sapiens
cattatagcatgtaata

SEQ ID NO: 208314 - DNA, 20 bp, Homo sapiens
cattatcgccttttgacagc

SEQ ID NO: 208315 - DNA, 21 bp, Homo sapiens
cattatcgggagcagtgtctt

SEQ ID NO: 208316 - DNA, 17 bp, Homo sapiens
cattatctctttctctc

SEQ ID NO: 208317 - DNA, 13 bp, Homo sapiens
cattatctgctgt

SEQ ID NO: 208318 - DNA, 14 bp, Homo sapiens
cattatgattcttt

SEQ ID NO: 208319 - DNA, 15 bp, Homo sapiens
cattatgtagaaata

SEQ ID NO: 208320 - DNA, 14 bp, Homo sapiens
cattattcctccag

SEQ ID NO: 208321 - DNA, 13 bp, Homo sapiens
cattattcctggt

SEQ ID NO: 208322 - DNA, 14 bp, Homo sapiens
cattattggaatta

SEQ ID NO: 208323 - DNA, 22 bp, Homo sapiens
cattattggaattaacctggtg

SEQ ID NO: 208324 - DNA, 23 bp, Homo sapiens
cattattggaattaacctggtgc

SEQ ID NO: 208325 - DNA, 17 bp, Homo sapiens
cattatttattaaattt

SEQ ID NO: 208326 - DNA, 22 bp, Homo sapiens
cattatttattcagcttcattt

SEQ ID NO: 208327 - DNA, 14 bp, Homo sapiens
cattatttgagttt

SEQ ID NO: 208328 - DNA, 21 bp, Homo sapiens
cattattttgtggttctattt

SEQ ID NO: 208329 - DNA, 23 bp, Homo sapiens
cattattttgtggttctatttta

SEQ ID NO: 208330 - DNA, 23 bp, Homo sapiens
cattcaaaaacatggccacatcc

SEQ ID NO: 208331 - DNA, 18 bp, Homo sapiens
cattcaaaagcacaaacc

SEQ ID NO: 208332 - DNA, 22 bp, Homo sapiens
cattcaaaagcacaaaccctgg

SEQ ID NO: 208333 - DNA, 24 bp, Homo sapiens
atattctgataatgtattgcagtg

SEQ ID NO: 208334 - DNA, 22 bp, Homo sapiens
atattcttgtccacattctact

SEQ ID NO: 208335 - DNA, 13 bp, Homo sapiens
atattctttacaa

SEQ ID NO: 208336 - DNA, 14 bp, Homo sapiens
atattctttacaaa

SEQ ID NO: 208337 - DNA, 16 bp, Homo sapiens
atattctttccatgca

SEQ ID NO: 208338 - DNA, 14 bp, Homo sapiens
atattgaccatgtg

SEQ ID NO: 208339 - DNA, 18 bp, Homo sapiens
atattgaccatgtgatta

SEQ ID NO: 208340 - DNA, 16 bp, Homo sapiens
atattgagacaaaaat

SEQ ID NO: 208341 - DNA, 20 bp, Homo sapiens
atattgagacaaaaattatc

SEQ ID NO: 208342 - DNA, 22 bp, Homo sapiens
atattgagatcagcattcaaaa

SEQ ID NO: 208343 - DNA, 22 bp, Homo sapiens
atattgcttggactacctataa

SEQ ID NO: 208344 - DNA, 14 bp, Homo sapiens
atattggaaacata

SEQ ID NO: 208345 - DNA, 15 bp, Homo sapiens
atattggtattcact

SEQ ID NO: 208346 - DNA, 13 bp, Homo sapiens
atattggtgtgaa

SEQ ID NO: 208347 - DNA, 17 bp, Homo sapiens
atattggttctatttat

SEQ ID NO: 208348 - DNA, 16 bp, Homo sapiens
atattgtattatgcta

SEQ ID NO: 208349 - DNA, 17 bp, Homo sapiens
atattgtgttgtgaatg

SEQ ID NO: 208350 - DNA, 18 bp, Homo sapiens
atattgtgttgtgaatgt

SEQ ID NO: 208351 - DNA, 15 bp, Homo sapiens
atattgttataaata

SEQ ID NO: 208352 - DNA, 19 bp, Homo sapiens
atattgtttttatatatta

SEQ ID NO: 208353 - DNA, 15 bp, Homo sapiens
atatttaaaagacaa

SEQ ID NO: 208354 - DNA, 13 bp, Homo sapiens
atatttaaagtct

SEQ ID NO: 208355 - DNA, 21 bp, Homo sapiens
atatttaacttctagttgctc

SEQ ID NO: 208356 - DNA, 16 bp, Homo sapiens
atatttaagaaaatac

SEQ ID NO: 208357 - DNA, 13 bp, Homo sapiens
atatttaatgata

SEQ ID NO: 208358 - DNA, 14 bp, Homo sapiens
atatttaatgatgt

SEQ ID NO: 208359 - DNA, 23 bp, Homo sapiens
atatttactaagccacaagaaat

SEQ ID NO: 208360 - DNA, 19 bp, Homo sapiens
atatttaggccagggtctc

SEQ ID NO: 208361 - DNA, 11 bp, Homo sapiens
atatttataac

SEQ ID NO: 208362 - DNA, 17 bp, Homo sapiens
atctgtgcgtgaaacac

SEQ ID NO: 208363 - DNA, 16 bp, Homo sapiens
atctgtggaaatgaca

SEQ ID NO: 208364 - DNA, 22 bp, Homo sapiens
atctgtggattcagcttctgtt

SEQ ID NO: 208365 - DNA, 13 bp, Homo sapiens
atctgtgtcctgg

SEQ ID NO: 208366 - DNA, 15 bp, Homo sapiens
atctgtgtgaaaatg

SEQ ID NO: 208367 - DNA, 17 bp, Homo sapiens
atctgttagatgctact

SEQ ID NO: 208368 - DNA, 12 bp, Homo sapiens
ccacaccccagc

SEQ ID NO: 208369 - DNA, 15 bp, Homo sapiens
ccacaccccagccca

SEQ ID NO: 208370 - DNA, 17 bp, Homo sapiens
ccacaccccgtctgccc

SEQ ID NO: 208371 - DNA, 19 bp, Homo sapiens
ccacaccccgtctgcccct

SEQ ID NO: 208372 - DNA, 18 bp, Homo sapiens
ccacacgccggggctggc

SEQ ID NO: 208373 - DNA, 19 bp, Homo sapiens
ccacacgctcactccaggt

SEQ ID NO: 208374 - DNA, 21 bp, Homo sapiens
ccacacgctgcccaggctctg

SEQ ID NO: 208375 - DNA, 23 bp, Homo sapiens
ccacacgctgcccaggctctgct

SEQ ID NO: 208376 - DNA, 17 bp, Homo sapiens
ccacacggactcccggg

SEQ ID NO: 208377 - DNA, 17 bp, Homo sapiens
ccacacgtttgccaaat

SEQ ID NO: 208378 - DNA, 20 bp, Homo sapiens
ccacactattaccatgagaa

SEQ ID NO: 208379 - DNA, 21 bp, Homo sapiens
ccacacttcaggctcttctcc

SEQ ID NO: 208380 - DNA, 16 bp, Homo sapiens
ccacacttcctgtcca

SEQ ID NO: 208381 - DNA, 20 bp, Homo sapiens
ccacacttcctgtccagaga

SEQ ID NO: 208382 - DNA, 21 bp, Homo sapiens
ccacacttcctgtccagagag

SEQ ID NO: 208383 - DNA, 12 bp, Homo sapiens
ccacacttcttg

SEQ ID NO: 208384 - DNA, 19 bp, Homo sapiens
ccacacttgagaggatgaa

SEQ ID NO: 208385 - DNA, 21 bp, Homo sapiens
ccacacttgttccagctcttt

SEQ ID NO: 208386 - DNA, 15 bp, Homo sapiens
ccacagacaaggtag

SEQ ID NO: 208387 - DNA, 15 bp, Homo sapiens
ccacagacagatccc

SEQ ID NO: 208388 - DNA, 17 bp, Homo sapiens
ccacagacagatcccat

SEQ ID NO: 208389 - DNA, 19 bp, Homo sapiens
ccacagaggccaggcatgg

SEQ ID NO: 208390 - DNA, 20 bp, Homo sapiens
ccacagcagcctctgaagtt

SEQ ID NO: 208391 - DNA, 12 bp, Homo sapiens
ccacagcaggtg

SEQ ID NO: 208392 - DNA, 19 bp, Homo sapiens
ccacagccaagcccaccct

SEQ ID NO: 208393 - DNA, 12 bp, Homo sapiens
ccacagccacct

SEQ ID NO: 208394 - DNA, 15 bp, Homo sapiens
ccacagccacctcca

SEQ ID NO: 208395 - DNA, 19 bp, Homo sapiens
ccacagcccgcatgcagca

SEQ ID NO: 208396 - DNA, 15 bp, Homo sapiens
ccacagccctgtcag

SEQ ID NO: 208397 - DNA, 21 bp, Homo sapiens
ccacagccctgtcagtgcagc

SEQ ID NO: 208398 - DNA, 23 bp, Homo sapiens
ccacagccctgtcagtgcagccc

SEQ ID NO: 208399 - DNA, 12 bp, Homo sapiens
ccacagctgctg

SEQ ID NO: 208400 - DNA, 23 bp, Homo sapiens
ccacagctgctggccagggtaga

SEQ ID NO: 208401 - DNA, 22 bp, Homo sapiens
ccacaggaataatagttcagga

SEQ ID NO: 208402 - DNA, 21 bp, Homo sapiens
ccacaggaggcaagcaagctc

SEQ ID NO: 208403 - DNA, 23 bp, Homo sapiens
ccacaggaggtgtgatagagcct

SEQ ID NO: 208404 - DNA, 12 bp, Homo sapiens
ccacaggattcc

SEQ ID NO: 208405 - DNA, 18 bp, Homo sapiens
ccacaggattccagttgc

SEQ ID NO: 208406 - DNA, 13 bp, Homo sapiens
ccacaggccacac

SEQ ID NO: 208407 - DNA, 14 bp, Homo sapiens
ccacaggccactgc

SEQ ID NO: 208408 - DNA, 15 bp, Homo sapiens
ccacaggcccttcct

SEQ ID NO: 208409 - DNA, 16 bp, Homo sapiens
ccacaggcccttcctc

SEQ ID NO: 208410 - DNA, 17 bp, Homo sapiens
ccacaggcccttcctct

SEQ ID NO: 208411 - DNA, 18 bp, Homo sapiens
ccacaggcccttcctctc

SEQ ID NO: 208412 - DNA, 23 bp, Homo sapiens
ccacaggggctatcccttctcag

SEQ ID NO: 208413 - DNA, 21 bp, Homo sapiens
ccacagggtgggatgagcctc

SEQ ID NO: 208414 - DNA, 16 bp, Homo sapiens
ccacaggtgtccccag

SEQ ID NO: 208415 - DNA, 19 bp, Homo sapiens
ccacaggtgtccccagccc

SEQ ID NO: 208416 - DNA, 16 bp, Homo sapiens
ccacagtcaaagaagg

SEQ ID NO: 208417 - DNA, 12 bp, Homo sapiens
ccacagtgctca

SEQ ID NO: 208418 - DNA, 14 bp, Homo sapiens
ccacagtgctcagt

SEQ ID NO: 208419 - DNA, 16 bp, Homo sapiens
ccacagtgctcagttg

SEQ ID NO: 208420 - DNA, 17 bp, Homo sapiens
ccacagtgctcagttgt

SEQ ID NO: 208421 - DNA, 22 bp, Homo sapiens
ccacagtgctcagttgtacttt

SEQ ID NO: 208422 - DNA, 18 bp, Homo sapiens
ccacagtgctgcttctct

SEQ ID NO: 208423 - DNA, 21 bp, Homo sapiens
ccacagtggggcccatggccc

SEQ ID NO: 208424 - DNA, 14 bp, Homo sapiens
ccacagtgggtggc

SEQ ID NO: 208425 - DNA, 22 bp, Homo sapiens
ccacagtgggtggcacctcctg

SEQ ID NO: 208426 - DNA, 23 bp, Homo sapiens
ccacagtgggtggcacctcctga

SEQ ID NO: 208427 - DNA, 23 bp, Homo sapiens
ccacagttgtcagttgtgaagag

SEQ ID NO: 208428 - DNA, 24 bp, Homo sapiens
ccacataatacattccatcacagc

SEQ ID NO: 208429 - DNA, 23 bp, Homo sapiens
ccacatacgtgagggggagctga

SEQ ID NO: 208430 - DNA, 22 bp, Homo sapiens
ccacatagtgatggttcccctg

SEQ ID NO: 208431 - DNA, 23 bp, Homo sapiens
ccacatagtgatggttcccctgt

SEQ ID NO: 208432 - DNA, 23 bp, Homo sapiens
ccacatccaacatttcctcaggc

SEQ ID NO: 208433 - DNA, 12 bp, Homo sapiens
ccacatcccagc

SEQ ID NO: 208434 - DNA, 19 bp, Homo sapiens
ccacatcccagcagcccaa

SEQ ID NO: 208435 - DNA, 13 bp, Homo sapiens
ccacatcccaggc

SEQ ID NO: 208436 - DNA, 21 bp, Homo sapiens
ccacatccccgctggctgggg

SEQ ID NO: 208437 - DNA, 19 bp, Homo sapiens
ccacatcctccgtccagcc

SEQ ID NO: 208438 - DNA, 19 bp, Homo sapiens
ccacatcttgtcttttccc

SEQ ID NO: 208439 - DNA, 23 bp, Homo sapiens
ccacatgagtcccagtgggaggc

SEQ ID NO: 208440 - DNA, 23 bp, Homo sapiens
ccacatggtccatttcatgtgat

SEQ ID NO: 208441 - DNA, 13 bp, Homo sapiens
ccacattctactt

SEQ ID NO: 208442 - DNA, 13 bp, Homo sapiens
ccacattctgctg

SEQ ID NO: 208443 - DNA, 14 bp, Homo sapiens
ccacattctgctgc

SEQ ID NO: 208444 - DNA, 22 bp, Homo sapiens
ccacattctgctgcccccagac

SEQ ID NO: 208445 - DNA, 23 bp, Homo sapiens
ccacatttctggccatttaacta

SEQ ID NO: 208446 - DNA, 15 bp, Homo sapiens
ccaccaaactgcaca

SEQ ID NO: 208447 - DNA, 21 bp, Homo sapiens
ccaccaaactgcacacacagc

SEQ ID NO: 208448 - DNA, 16 bp, Homo sapiens
ccaccaaatgcctctg

SEQ ID NO: 208449 - DNA, 19 bp, Homo sapiens
ccaccaaatgcctctgcct

SEQ ID NO: 208450 - DNA, 15 bp, Homo sapiens
ccaccaaccctcaga

SEQ ID NO: 208451 - DNA, 15 bp, Homo sapiens
ccaccaactctgcac

SEQ ID NO: 208452 - DNA, 19 bp, Homo sapiens
ccaccaactctgcactcca

SEQ ID NO: 208453 - DNA, 20 bp, Homo sapiens
ccaccaactctgcactccat

SEQ ID NO: 208454 - DNA, 22 bp, Homo sapiens
ccaccaagctgctctccttcac

SEQ ID NO: 208455 - DNA, 15 bp, Homo sapiens
ccaccaataaaaatc

SEQ ID NO: 208456 - DNA, 16 bp, Homo sapiens
ccaccacacacaccct

SEQ ID NO: 208457 - DNA, 19 bp, Homo sapiens
ccaccacacacacccttcc

SEQ ID NO: 208458 - DNA, 22 bp, Homo sapiens
ccaccacacacacccttcccca

SEQ ID NO: 208459 - DNA, 14 bp, Homo sapiens
ccaccacacccctg

SEQ ID NO: 208460 - DNA, 15 bp, Homo sapiens
ccaccacacccctgc

SEQ ID NO: 208461 - DNA, 16 bp, Homo sapiens
ccaccaccactgtccc

SEQ ID NO: 208462 - DNA, 15 bp, Homo sapiens
ccaccaccttgccaa

SEQ ID NO: 208463 - DNA, 18 bp, Homo sapiens
ccaccacgtctgccaggc

SEQ ID NO: 208464 - DNA, 20 bp, Homo sapiens
ccaccacgtctgccaggccc

SEQ ID NO: 208465 - DNA, 21 bp, Homo sapiens
ccaccacgtctgccaggccca

SEQ ID NO: 208466 - DNA, 15 bp, Homo sapiens
ccaccagatgagaag

SEQ ID NO: 208467 - DNA, 16 bp, Homo sapiens
ccaccagatgagaagt

SEQ ID NO: 208468 - DNA, 12 bp, Homo sapiens
ccaccagcagca

SEQ ID NO: 208469 - DNA, 16 bp, Homo sapiens
ccaccagcagcacaat

SEQ ID NO: 208470 - DNA, 23 bp, Homo sapiens
ccaccagcagcacaattctgtcc

SEQ ID NO: 208471 - DNA, 16 bp, Homo sapiens
ccaccagccccagcaa

SEQ ID NO: 208472 - DNA, 13 bp, Homo sapiens
ccaccagccgccc

SEQ ID NO: 208473 - DNA, 19 bp, Homo sapiens
ccaccagccgccccagccc

SEQ ID NO: 208474 - DNA, 18 bp, Homo sapiens
ccaccaggaacctcttca

SEQ ID NO: 208475 - DNA, 21 bp, Homo sapiens
ccaccagggctcagctccttg

SEQ ID NO: 208476 - DNA, 15 bp, Homo sapiens
ccaccatcctgcagc

SEQ ID NO: 208477 - DNA, 17 bp, Homo sapiens
ccaccatggccagccaa

SEQ ID NO: 208478 - DNA, 22 bp, Homo sapiens
ccaccatggctaaggcaccagc

SEQ ID NO: 208479 - DNA, 15 bp, Homo sapiens
ccaccattcctttaa

SEQ ID NO: 208480 - DNA, 16 bp, Homo sapiens
ccacccaagcttggca

SEQ ID NO: 208481 - DNA, 21 bp, Homo sapiens
ccacccacaccccgtctgccc

SEQ ID NO: 208482 - DNA, 23 bp, Homo sapiens
ccacccacaccccgtctgcccct

SEQ ID NO: 208483 - DNA, 16 bp, Homo sapiens
ccacccaccaaatgcc

SEQ ID NO: 208484 - DNA, 23 bp, Homo sapiens
ccacccaccaaatgcctctgcct

SEQ ID NO: 208485 - DNA, 13 bp, Homo sapiens
ccacccaccccaa

SEQ ID NO: 208486 - DNA, 18 bp, Homo sapiens
ccacccacctccacccag

SEQ ID NO: 208487 - DNA, 17 bp, Homo sapiens
ccacccactagccctct

SEQ ID NO: 208488 - DNA, 11 bp, Homo sapiens
ccacccagccc

SEQ ID NO: 208489 - DNA, 14 bp, Homo sapiens
ccacccagcccctg

SEQ ID NO: 208490 - DNA, 14 bp, Homo sapiens
ccacccaggctgca

SEQ ID NO: 208491 - DNA, 14 bp, Homo sapiens
ccacccagggcccg

SEQ ID NO: 208492 - DNA, 17 bp, Homo sapiens
ccacccagggcccggca

SEQ ID NO: 208493 - DNA, 21 bp, Homo sapiens
ccacccagggctccctcctgg

SEQ ID NO: 208494 - DNA, 17 bp, Homo sapiens
ccacccagtgctgccat

SEQ ID NO: 208495 - DNA, 20 bp, Homo sapiens
ccacccagtgctgccatgcc

SEQ ID NO: 208496 - DNA, 22 bp, Homo sapiens
ccacccagtgctgccatgccac

SEQ ID NO: 208497 - DNA, 15 bp, Homo sapiens
ccacccatcttcctg

SEQ ID NO: 208498 - DNA, 18 bp, Homo sapiens
ccacccatcttcctgctg

SEQ ID NO: 208499 - DNA, 21 bp, Homo sapiens
ccacccatcttcctgctgctg

SEQ ID NO: 208500 - DNA, 21 bp, Homo sapiens
ccaccccaaaccccagcccca

SEQ ID NO: 208501 - DNA, 18 bp, Homo sapiens
atctgttagatgctacta

SEQ ID NO: 208502 - DNA, 19 bp, Homo sapiens
atctgttagatgctactaa

SEQ ID NO: 208503 - DNA, 22 bp, Homo sapiens
atctgttatcctgctagctgta

SEQ ID NO: 208504 - DNA, 15 bp, Homo sapiens
atctgtttgcttcta

SEQ ID NO: 208505 - DNA, 18 bp, Homo sapiens
atctgttttaaatttaaa

SEQ ID NO: 208506 - DNA, 21 bp, Homo sapiens
atcttaaagaaacagctttca

SEQ ID NO: 208507 - DNA, 22 bp, Homo sapiens
atcttaaagaaacagctttcaa

SEQ ID NO: 208508 - DNA, 15 bp, Homo sapiens
atcttaaatctgtga

SEQ ID NO: 208509 - DNA, 20 bp, Homo sapiens
atcttaatctttattttatt

SEQ ID NO: 208510 - DNA, 15 bp, Homo sapiens
atcttaccagatgct

SEQ ID NO: 208511 - DNA, 23 bp, Homo sapiens
atcttaccagatgctactggact

SEQ ID NO: 208512 - DNA, 15 bp, Homo sapiens
atcttacctttatga

SEQ ID NO: 208513 - DNA, 16 bp, Homo sapiens
atcttacgctatttct

SEQ ID NO: 208514 - DNA, 15 bp, Homo sapiens
atcttagctgccaag

SEQ ID NO: 208515 - DNA, 20 bp, Homo sapiens
atcttatcatggtctcagtc

SEQ ID NO: 208516 - DNA, 18 bp, Homo sapiens
atcttatggtggaagagg

SEQ ID NO: 208517 - DNA, 21 bp, Homo sapiens
atcttatgttgatcgatgtta

SEQ ID NO: 208518 - DNA, 16 bp, Homo sapiens
atcttcaaactttcac

SEQ ID NO: 208519 - DNA, 19 bp, Homo sapiens
atcttcaaagcttgaagat

SEQ ID NO: 208520 - DNA, 15 bp, Homo sapiens
atcttcaatggcttt

SEQ ID NO: 208521 - DNA, 22 bp, Homo sapiens
atcttcactgcaattttgtgta

SEQ ID NO: 208522 - DNA, 13 bp, Homo sapiens
atcttcacttcta

SEQ ID NO: 208523 - DNA, 20 bp, Homo sapiens
atcttcagctggtggatggt

SEQ ID NO: 208524 - DNA, 22 bp, Homo sapiens
atcttcagttttatctttaatc

SEQ ID NO: 208525 - DNA, 12 bp, Homo sapiens
atcttcatataa

SEQ ID NO: 208526 - DNA, 17 bp, Homo sapiens
atcttccatatgctctt

SEQ ID NO: 208527 - DNA, 20 bp, Homo sapiens
atcttcccgcctcagcctct

SEQ ID NO: 208528 - DNA, 13 bp, Homo sapiens
atcttcctctgga

SEQ ID NO: 208529 - DNA, 15 bp, Homo sapiens
atcttcctctggagc

SEQ ID NO: 208530 - DNA, 14 bp, Homo sapiens
atcttcctgctgct

SEQ ID NO: 208531 - DNA, 16 bp, Homo sapiens
atcttcctgctgctgt

SEQ ID NO: 208532 - DNA, 11 bp, Homo sapiens
atcttccttcc

SEQ ID NO: 208533 - DNA, 17 bp, Homo sapiens
atcttctctttgacaat

SEQ ID NO: 208534 - DNA, 13 bp, Homo sapiens
atcttctggtgca

SEQ ID NO: 208535 - DNA, 17 bp, Homo sapiens
atcttctgtttttctca

SEQ ID NO: 208536 - DNA, 15 bp, Homo sapiens
atcttgaagggccca

SEQ ID NO: 208537 - DNA, 21 bp, Homo sapiens
atcttgaatatgggcggaagt

SEQ ID NO: 208538 - DNA, 17 bp, Homo sapiens
atcttgaattgtaagga

SEQ ID NO: 208539 - DNA, 14 bp, Homo sapiens
atcttgagcaaggc

SEQ ID NO: 208540 - DNA, 13 bp, Homo sapiens
atcttgcaaagcg

SEQ ID NO: 208541 - DNA, 12 bp, Homo sapiens
atcttgctgtga

SEQ ID NO: 208542 - DNA, 12 bp, Homo sapiens
atcttggaaatc

SEQ ID NO: 208543 - DNA, 19 bp, Homo sapiens
atcttggactgacatttag

SEQ ID NO: 208544 - DNA, 21 bp, Homo sapiens
atcttggactgacatttagcg

SEQ ID NO: 208545 - DNA, 16 bp, Homo sapiens
atcttggagacaatta

SEQ ID NO: 208546 - DNA, 21 bp, Homo sapiens
atcttggagacaattacaaga

SEQ ID NO: 208547 - DNA, 22 bp, Homo sapiens
atcttggtactactagatgtct

SEQ ID NO: 208548 - DNA, 22 bp, Homo sapiens
atcttggtagttctgtgcctcc

SEQ ID NO: 208549 - DNA, 23 bp, Homo sapiens
atcttggtagttctgtgcctccc

SEQ ID NO: 208550 - DNA, 20 bp, Homo sapiens
atcttggtcagatttgaact

SEQ ID NO: 208551 - DNA, 11 bp, Homo sapiens
atcttgtcatg

SEQ ID NO: 208552 - DNA, 18 bp, Homo sapiens
atcttgtgctagaatact

SEQ ID NO: 208553 - DNA, 19 bp, Homo sapiens
atcttgtgctagaatactt

SEQ ID NO: 208554 - DNA, 12 bp, Homo sapiens
atctttaaagac

SEQ ID NO: 208555 - DNA, 17 bp, Homo sapiens
atctttaaataaatgtg

SEQ ID NO: 208556 - DNA, 19 bp, Homo sapiens
atctttaaatgatgtacag

SEQ ID NO: 208557 - DNA, 14 bp, Homo sapiens
atctttaataagta

SEQ ID NO: 208558 - DNA, 14 bp, Homo sapiens
atctttatacttaa

SEQ ID NO: 208559 - DNA, 23 bp, Homo sapiens
atctttattaaatattcagaaaa

SEQ ID NO: 208560 - DNA, 18 bp, Homo sapiens
atctttattttattattc

SEQ ID NO: 208561 - DNA, 19 bp, Homo sapiens
atctttattttattattca

SEQ ID NO: 208562 - DNA, 20 bp, Homo sapiens
atctttattttattattcag

SEQ ID NO: 208563 - DNA, 21 bp, Homo sapiens
atctttcagttattaaatgat

SEQ ID NO: 208564 - DNA, 16 bp, Homo sapiens
atctttcatagttctg

SEQ ID NO: 208565 - DNA, 18 bp, Homo sapiens
atctttcatagttctgtt

SEQ ID NO: 208566 - DNA, 19 bp, Homo sapiens
atctttcatagttctgtta

SEQ ID NO: 208567 - DNA, 16 bp, Homo sapiens
atctttccatctcatt

SEQ ID NO: 208568 - DNA, 19 bp, Homo sapiens
atctttccatctcattaca

SEQ ID NO: 208569 - DNA, 11 bp, Homo sapiens
atctttcctcc

SEQ ID NO: 208570 - DNA, 20 bp, Homo sapiens
atctttcgttggttgtttct

SEQ ID NO: 208571 - DNA, 23 bp, Homo sapiens
atctttctatataaaatgtattc

SEQ ID NO: 208572 - DNA, 17 bp, Homo sapiens
atctttgagaatattat

SEQ ID NO: 208573 - DNA, 20 bp, Homo sapiens
atctttgagaatattataaa

SEQ ID NO: 208574 - DNA, 15 bp, Homo sapiens
atctttgctcccagt

SEQ ID NO: 208575 - DNA, 14 bp, Homo sapiens
atcttttaatatgc

SEQ ID NO: 208576 - DNA, 19 bp, Homo sapiens
atcttttagagtaaactat

SEQ ID NO: 208577 - DNA, 20 bp, Homo sapiens
atcttttaggggaagtgaca

SEQ ID NO: 208578 - DNA, 13 bp, Homo sapiens
atcttttgagaac

SEQ ID NO: 208579 - DNA, 17 bp, Homo sapiens
atcttttgtgcctagat

SEQ ID NO: 208580 - DNA, 18 bp, Homo sapiens
atctttttaggccacctc

SEQ ID NO: 208581 - DNA, 15 bp, Homo sapiens
atctttttcctccct

SEQ ID NO: 208582 - DNA, 14 bp, Homo sapiens
atctttttctccac

SEQ ID NO: 208583 - DNA, 17 bp, Homo sapiens
atgaaaaaaatgatcta

SEQ ID NO: 208584 - DNA, 17 bp, Homo sapiens
atgaaaaatttaagcat

SEQ ID NO: 208585 - DNA, 20 bp, Homo sapiens
atgaaaacgttttattgtgt

SEQ ID NO: 208586 - DNA, 17 bp, Homo sapiens
atgaaaagagaattact

SEQ ID NO: 208587 - DNA, 14 bp, Homo sapiens
atgaaaataaaata

SEQ ID NO: 208588 - DNA, 20 bp, Homo sapiens
atgaaaataaaataaacgaa

SEQ ID NO: 208589 - DNA, 20 bp, Homo sapiens
atgaaaatcctaccaacctc

SEQ ID NO: 208590 - DNA, 20 bp, Homo sapiens
atgaaaatccttttaaccat

SEQ ID NO: 208591 - DNA, 13 bp, Homo sapiens
atgaaaatgtcag

SEQ ID NO: 208592 - DNA, 15 bp, Homo sapiens
atgaaaatgtcagaa

SEQ ID NO: 208593 - DNA, 16 bp, Homo sapiens
atgaaacaaataatca

SEQ ID NO: 208594 - DNA, 20 bp, Homo sapiens
atgaaactcctgattttgta

SEQ ID NO: 208595 - DNA, 12 bp, Homo sapiens
atgaaagacaaa

SEQ ID NO: 208596 - DNA, 22 bp, Homo sapiens
atgaaagacaaagaaggaaaag

SEQ ID NO: 208597 - DNA, 14 bp, Homo sapiens
atgaaagagaattt

SEQ ID NO: 208598 - DNA, 20 bp, Homo sapiens
atgaaagcagggaatttcta

SEQ ID NO: 208599 - DNA, 23 bp, Homo sapiens
atgaaagctgattactgtcaata

SEQ ID NO: 208600 - DNA, 21 bp, Homo sapiens
atgaaagggaaagtcagcttt

SEQ ID NO: 208601 - DNA, 20 bp, Homo sapiens
atgaaaggtaatctgaaaca

SEQ ID NO: 208602 - DNA, 20 bp, Homo sapiens
atgaaagtcttgtgactagt

SEQ ID NO: 208603 - DNA, 23 bp, Homo sapiens
atgaaataaaaaaaaaaggatga

SEQ ID NO: 208604 - DNA, 14 bp, Homo sapiens
atgaaatatttttg

SEQ ID NO: 208605 - DNA, 13 bp, Homo sapiens
atgaaatctattt

SEQ ID NO: 208606 - DNA, 14 bp, Homo sapiens
atgaaatctatttt

SEQ ID NO: 208607 - DNA, 21 bp, Homo sapiens
atgaaatgccctcctaaatgt

SEQ ID NO: 208608 - DNA, 22 bp, Homo sapiens
atgaaatgccctcctaaatgtc

SEQ ID NO: 208609 - DNA, 11 bp, Homo sapiens
atgaaattgcc

SEQ ID NO: 208610 - DNA, 12 bp, Homo sapiens
atgaaattgcca

SEQ ID NO: 208611 - DNA, 19 bp, Homo sapiens
atgaaattttctagacttt

SEQ ID NO: 208612 - DNA, 22 bp, Homo sapiens
atgaaattttctagactttctg

SEQ ID NO: 208613 - DNA, 13 bp, Homo sapiens
atgaacagctcct

SEQ ID NO: 208614 - DNA, 22 bp, Homo sapiens
atgaactcagctattaagaaaa

SEQ ID NO: 208615 - DNA, 22 bp, Homo sapiens
atgaactcaggtttccggctac

SEQ ID NO: 208616 - DNA, 18 bp, Homo sapiens
atgaactgcatgtataaa

SEQ ID NO: 208617 - DNA, 22 bp, Homo sapiens
atgaactgtctagatggatgaa

SEQ ID NO: 208618 - DNA, 13 bp, Homo sapiens
atgaacttaacat

SEQ ID NO: 208619 - DNA, 20 bp, Homo sapiens
atgaacttaacatgctgtgt

SEQ ID NO: 208620 - DNA, 15 bp, Homo sapiens
atgaacttgaggaca

SEQ ID NO: 208621 - DNA, 17 bp, Homo sapiens
ctggtgggcaccaagag

SEQ ID NO: 208622 - DNA, 22 bp, Homo sapiens
ctggtgggcaccaagagccaat

SEQ ID NO: 208623 - DNA, 16 bp, Homo sapiens
ctggtggggctgagcc

SEQ ID NO: 208624 - DNA, 20 bp, Homo sapiens
ctggtgtcactctgcctcta

SEQ ID NO: 208625 - DNA, 20 bp, Homo sapiens
ctggtgtccccttcccctgc

SEQ ID NO: 208626 - DNA, 13 bp, Homo sapiens
ctggttagcagag

SEQ ID NO: 208627 - DNA, 15 bp, Homo sapiens
ctggttagctcagcc

SEQ ID NO: 208628 - DNA, 22 bp, Homo sapiens
ctggttagctcagccccagccc

SEQ ID NO: 208629 - DNA, 23 bp, Homo sapiens
ctggttagctcagccccagccca

SEQ ID NO: 208630 - DNA, 17 bp, Homo sapiens
ctggttatagttgatat

SEQ ID NO: 208631 - DNA, 19 bp, Homo sapiens
ctggttatcctgtgctaca

SEQ ID NO: 208632 - DNA, 20 bp, Homo sapiens
ctggttatcctgtgctacag

SEQ ID NO: 208633 - DNA, 17 bp, Homo sapiens
ctggttcccccaggacc

SEQ ID NO: 208634 - DNA, 22 bp, Homo sapiens
ctggttcccccaggaccctgag

SEQ ID NO: 208635 - DNA, 18 bp, Homo sapiens
ctggttccctctttcctg

SEQ ID NO: 208636 - DNA, 19 bp, Homo sapiens
ctggttccttcctatgccc

SEQ ID NO: 208637 - DNA, 18 bp, Homo sapiens
ctggttctccatccccat

SEQ ID NO: 208638 - DNA, 22 bp, Homo sapiens
ctggttctgtacatgtggaaaa

SEQ ID NO: 208639 - DNA, 16 bp, Homo sapiens
ctggttcttgccttcc

SEQ ID NO: 208640 - DNA, 21 bp, Homo sapiens
ctggttgctgggcctcattct

SEQ ID NO: 208641 - DNA, 12 bp, Homo sapiens
ctggttgtattt

SEQ ID NO: 208642 - DNA, 13 bp, Homo sapiens
ctggttgtcattt

SEQ ID NO: 208643 - DNA, 16 bp, Homo sapiens
ctggttgttgccaggt

SEQ ID NO: 208644 - DNA, 17 bp, Homo sapiens
ctggttgttgccaggtt

SEQ ID NO: 208645 - DNA, 13 bp, Homo sapiens
ctggtttcactgg

SEQ ID NO: 208646 - DNA, 18 bp, Homo sapiens
ctggtttcactggcccaa

SEQ ID NO: 208647 - DNA, 18 bp, Homo sapiens
ctggtttgaatcctggct

SEQ ID NO: 208648 - DNA, 17 bp, Homo sapiens
ctggtttggggcgaggc

SEQ ID NO: 208649 - DNA, 17 bp, Homo sapiens
ctggttttaccccagct

SEQ ID NO: 208650 - DNA, 18 bp, Homo sapiens
ctggttttcctaaatgca

SEQ ID NO: 208651 - DNA, 16 bp, Homo sapiens
ctggtttttctgttcc

SEQ ID NO: 208652 - DNA, 15 bp, Homo sapiens
ctgtaaaaaagaaaa

SEQ ID NO: 208653 - DNA, 20 bp, Homo sapiens
ctgtaaaatacatggtatct

SEQ ID NO: 208654 - DNA, 23 bp, Homo sapiens
ctgtaaaatactattggacagac

SEQ ID NO: 208655 - DNA, 15 bp, Homo sapiens
ctgtaaacactcagc

SEQ ID NO: 208656 - DNA, 15 bp, Homo sapiens
ctgtaaaccacttgt

SEQ ID NO: 208657 - DNA, 17 bp, Homo sapiens
ctgtaaacccctgggta

SEQ ID NO: 208658 - DNA, 18 bp, Homo sapiens
ctgtaaacccctgggtaa

SEQ ID NO: 208659 - DNA, 19 bp, Homo sapiens
ctgtaaagttgaggggaga

SEQ ID NO: 208660 - DNA, 16 bp, Homo sapiens
ctgtaaatacaaaata

SEQ ID NO: 208661 - DNA, 17 bp, Homo sapiens
ctgtaaatacaaaataa

SEQ ID NO: 208662 - DNA, 21 bp, Homo sapiens
ctgtaaatacaaaataaaatt

SEQ ID NO: 208663 - DNA, 22 bp, Homo sapiens
ctgtaaatacaaaataaaatta

SEQ ID NO: 208664 - DNA, 16 bp, Homo sapiens
ctgtaaatacatgtgt

SEQ ID NO: 208665 - DNA, 16 bp, Homo sapiens
ctgtaaatatcccaga

SEQ ID NO: 208666 - DNA, 17 bp, Homo sapiens
ctgtaaattattttaaa

SEQ ID NO: 208667 - DNA, 20 bp, Homo sapiens
ctgtaaattattttaaatta

SEQ ID NO: 208668 - DNA, 21 bp, Homo sapiens
ctgtaaccacctctctgtctt

SEQ ID NO: 208669 - DNA, 19 bp, Homo sapiens
ctgtaacccttgaatttct

SEQ ID NO: 208670 - DNA, 20 bp, Homo sapiens
ctgtaacgggtcgtgctcat

SEQ ID NO: 208671 - DNA, 14 bp, Homo sapiens
ctgtaactgctgag

SEQ ID NO: 208672 - DNA, 19 bp, Homo sapiens
ctgtaagatgttgttttag

SEQ ID NO: 208673 - DNA, 22 bp, Homo sapiens
ctgtaagcacctgggctgagga

SEQ ID NO: 208674 - DNA, 17 bp, Homo sapiens
ctgtaagctctttgaaa

SEQ ID NO: 208675 - DNA, 16 bp, Homo sapiens
ctgtaaggaaatgtta

SEQ ID NO: 208676 - DNA, 17 bp, Homo sapiens
ctgtaatagcctcacct

SEQ ID NO: 208677 - DNA, 18 bp, Homo sapiens
ctgtaatagcctcacctt

SEQ ID NO: 208678 - DNA, 19 bp, Homo sapiens
ctgtaatagcctcaccttc

SEQ ID NO: 208679 - DNA, 17 bp, Homo sapiens
ctgtaatatctttaaat

SEQ ID NO: 208680 - DNA, 20 bp, Homo sapiens
ctgtaatcacactctcttct

SEQ ID NO: 208681 - DNA, 15 bp, Homo sapiens
ctgtaatcccagcac

SEQ ID NO: 208682 - DNA, 15 bp, Homo sapiens
ctgtaatctttttct

SEQ ID NO: 208683 - DNA, 22 bp, Homo sapiens
ctgtaatggaactgaccccctc

SEQ ID NO: 208684 - DNA, 13 bp, Homo sapiens
ctgtaatttaatt

SEQ ID NO: 208685 - DNA, 15 bp, Homo sapiens
ctgtaattttgtagt

SEQ ID NO: 208686 - DNA, 14 bp, Homo sapiens
ctgtacaagtgctc

SEQ ID NO: 208687 - DNA, 13 bp, Homo sapiens
ctgtacacaccct

SEQ ID NO: 208688 - DNA, 17 bp, Homo sapiens
ctgtacacaccctccag

SEQ ID NO: 208689 - DNA, 19 bp, Homo sapiens
ctgtacactgaatatttat

SEQ ID NO: 208690 - DNA, 15 bp, Homo sapiens
ctgtacactgacttg

SEQ ID NO: 208691 - DNA, 17 bp, Homo sapiens
ctgtacactgacttgag

SEQ ID NO: 208692 - DNA, 15 bp, Homo sapiens
ctgtaccaagcccct

SEQ ID NO: 208693 - DNA, 12 bp, Homo sapiens
ctgtacccagcc

SEQ ID NO: 208694 - DNA, 15 bp, Homo sapiens
ctgtacccagctcct

SEQ ID NO: 208695 - DNA, 22 bp, Homo sapiens
ctgtaccctgcttcccaaactc

SEQ ID NO: 208696 - DNA, 12 bp, Homo sapiens
ctgtacctctct

SEQ ID NO: 208697 - DNA, 16 bp, Homo sapiens
ctgtacctctctctgc

SEQ ID NO: 208698 - DNA, 20 bp, Homo sapiens
ctgtacctctctctgctcct

SEQ ID NO: 208699 - DNA, 21 bp, Homo sapiens
ctgtacctctctctgctcctc

SEQ ID NO: 208700 - DNA, 23 bp, Homo sapiens
ctgtacctctctctgctcctcac

SEQ ID NO: 208701 - DNA, 19 bp, Homo sapiens
ctgtacctgtaggaaacag

SEQ ID NO: 208702 - DNA, 18 bp, Homo sapiens
ctgtacgtctggtgttct

SEQ ID NO: 208703 - DNA, 13 bp, Homo sapiens
ctgtactcagagc

SEQ ID NO: 208704 - DNA, 15 bp, Homo sapiens
ctgtactcagagcag

SEQ ID NO: 208705 - DNA, 18 bp, Homo sapiens
ctgtactcagagcagagc

SEQ ID NO: 208706 - DNA, 19 bp, Homo sapiens
ctgtactcagagcagagca

SEQ ID NO: 208707 - DNA, 19 bp, Homo sapiens
ctgtactcctcccaggcgc

SEQ ID NO: 208708 - DNA, 20 bp, Homo sapiens
ctgtactccttggatttgca

SEQ ID NO: 208709 - DNA, 16 bp, Homo sapiens
ctgtactgacttgagg

SEQ ID NO: 208710 - DNA, 12 bp, Homo sapiens
ctgtactgagtt

SEQ ID NO: 208711 - DNA, 20 bp, Homo sapiens
ctgtactgagttctcatcca

SEQ ID NO: 208712 - DNA, 20 bp, Homo sapiens
ctgtacttcaagttaaagtg

SEQ ID NO: 208713 - DNA, 18 bp, Homo sapiens
ctgtagaatgctgtagaa

SEQ ID NO: 208714 - DNA, 12 bp, Homo sapiens
ctgtagagactt

SEQ ID NO: 208715 - DNA, 18 bp, Homo sapiens
ctgtagagacttccgtca

SEQ ID NO: 208716 - DNA, 18 bp, Homo sapiens
ctgtagagccttctgatg

SEQ ID NO: 208717 - DNA, 14 bp, Homo sapiens
ctgtagaggagcct

SEQ ID NO: 208718 - DNA, 21 bp, Homo sapiens
ctgtagattgcttctgtagta

SEQ ID NO: 208719 - DNA, 14 bp, Homo sapiens
ctgtagccactggc

SEQ ID NO: 208720 - DNA, 15 bp, Homo sapiens
ctgtagccagcacct

SEQ ID NO: 208721 - DNA, 12 bp, Homo sapiens
ctgtagccatgg

SEQ ID NO: 208722 - DNA, 14 bp, Homo sapiens
ctgtagccatggct

SEQ ID NO: 208723 - DNA, 16 bp, Homo sapiens
ctgtagccatggctca

SEQ ID NO: 208724 - DNA, 19 bp, Homo sapiens
ctgtagctccctcctccca

SEQ ID NO: 208725 - DNA, 20 bp, Homo sapiens
ctgtaggaaacagaaaagag

SEQ ID NO: 208726 - DNA, 23 bp, Homo sapiens
ctgtaggaaacagaaaagagaag

SEQ ID NO: 208727 - DNA, 14 bp, Homo sapiens
ctgtaggagagact

SEQ ID NO: 208728 - DNA, 22 bp, Homo sapiens
ctgtaggagagactggccagag

SEQ ID NO: 208729 - DNA, 22 bp, Homo sapiens
ctgtaggagtaaagataaaagg

SEQ ID NO: 208730 - DNA, 21 bp, Homo sapiens
ctgtaggcgcccctggggtgg

SEQ ID NO: 208731 - DNA, 17 bp, Homo sapiens
ctgtagggctggaccta

SEQ ID NO: 208732 - DNA, 19 bp, Homo sapiens
ctgtaggtatagaagatct

SEQ ID NO: 208733 - DNA, 17 bp, Homo sapiens
ctgtagtaattgttaca

SEQ ID NO: 208734 - DNA, 21 bp, Homo sapiens
ctgtagtactccttaagaaca

SEQ ID NO: 208735 - DNA, 19 bp, Homo sapiens
ctgtagtagccctttctgt

SEQ ID NO: 208736 - DNA, 14 bp, Homo sapiens
ctgtagtcccagct

SEQ ID NO: 208737 - DNA, 15 bp, Homo sapiens
ctgtagtcccagcta

SEQ ID NO: 208738 - DNA, 13 bp, Homo sapiens
ctgtagtgagaaa

SEQ ID NO: 208739 - DNA, 22 bp, Homo sapiens
ctgtagtgcccctcccatggcc

SEQ ID NO: 208740 - DNA, 17 bp, Homo sapiens
ctgtagttaggaaataa

SEQ ID NO: 208741 - DNA, 18 bp, Homo sapiens
ctgtagttaggaaataaa

SEQ ID NO: 208742 - DNA, 20 bp, Homo sapiens
ctgtataagacactttgcca

SEQ ID NO: 208743 - DNA, 16 bp, Homo sapiens
ctgtatacaaacaggt

SEQ ID NO: 208744 - DNA, 15 bp, Homo sapiens
ctgtatatacatttc

SEQ ID NO: 208745 - DNA, 16 bp, Homo sapiens
ctgtatatgttgtaat

SEQ ID NO: 208746 - DNA, 17 bp, Homo sapiens
ctgtatatgttgtaata

SEQ ID NO: 208747 - DNA, 23 bp, Homo sapiens
ctgtatatttgaaactgctaatt

SEQ ID NO: 208748 - DNA, 15 bp, Homo sapiens
ctgtatcaaatctgt

SEQ ID NO: 208749 - DNA, 16 bp, Homo sapiens
ctgtatcaagcccctg

SEQ ID NO: 208750 - DNA, 14 bp, Homo sapiens
ctgtatcatttctt

SEQ ID NO: 208751 - DNA, 21 bp, Homo sapiens
catgactgcacccagctccag

SEQ ID NO: 208752 - DNA, 23 bp, Homo sapiens
catgactgcacccagctccaggg

SEQ ID NO: 208753 - DNA, 20 bp, Homo sapiens
catgactgccccttgcttct

SEQ ID NO: 208754 - DNA, 21 bp, Homo sapiens
catgactggctgtctgcctgt

SEQ ID NO: 208755 - DNA, 15 bp, Homo sapiens
catgactgggcctcc

SEQ ID NO: 208756 - DNA, 21 bp, Homo sapiens
catgactgggcctcccttggg

SEQ ID NO: 208757 - DNA, 22 bp, Homo sapiens
catgactgtgaccaccttctgt

SEQ ID NO: 208758 - DNA, 15 bp, Homo sapiens
catgagaactaaata

SEQ ID NO: 208759 - DNA, 16 bp, Homo sapiens
catgagaagagggcct

SEQ ID NO: 208760 - DNA, 22 bp, Homo sapiens
catgagaagagggcctgtggga

SEQ ID NO: 208761 - DNA, 20 bp, Homo sapiens
catgagaataagagaaagaa

SEQ ID NO: 208762 - DNA, 20 bp, Homo sapiens
catgagaatgtcatttgcta

SEQ ID NO: 208763 - DNA, 19 bp, Homo sapiens
catgagacacatctcctcc

SEQ ID NO: 208764 - DNA, 17 bp, Homo sapiens
catgagaccactgttat

SEQ ID NO: 208765 - DNA, 22 bp, Homo sapiens
catgagattggtcattaaatac

SEQ ID NO: 208766 - DNA, 16 bp, Homo sapiens
catgagcaccccaagg

SEQ ID NO: 208767 - DNA, 19 bp, Homo sapiens
catgagcctgcccgctgca

SEQ ID NO: 208768 - DNA, 14 bp, Homo sapiens
catgagctctgtgt

SEQ ID NO: 208769 - DNA, 20 bp, Homo sapiens
catgaggaacaaggcaaggc

SEQ ID NO: 208770 - DNA, 21 bp, Homo sapiens
catgaggaacaaggcaaggct

SEQ ID NO: 208771 - DNA, 14 bp, Homo sapiens
catgagggctgaga

SEQ ID NO: 208772 - DNA, 17 bp, Homo sapiens
catgagtcccagtggga

SEQ ID NO: 208773 - DNA, 18 bp, Homo sapiens
catgagtcccagtgggag

SEQ ID NO: 208774 - DNA, 19 bp, Homo sapiens
catgagtcccagtgggagg

SEQ ID NO: 208775 - DNA, 16 bp, Homo sapiens
catgagtttgccctgg

SEQ ID NO: 208776 - DNA, 19 bp, Homo sapiens
catgagttttttctcttgg

SEQ ID NO: 208777 - DNA, 13 bp, Homo sapiens
catgatattgtat

SEQ ID NO: 208778 - DNA, 14 bp, Homo sapiens
catgatattgtatg

SEQ ID NO: 208779 - DNA, 14 bp, Homo sapiens
catgatattttcag

SEQ ID NO: 208780 - DNA, 15 bp, Homo sapiens
catgatattttcaga

SEQ ID NO: 208781 - DNA, 21 bp, Homo sapiens
catgatccctgtgttgtctct

SEQ ID NO: 208782 - DNA, 18 bp, Homo sapiens
catgatgtccttgttatt

SEQ ID NO: 208783 - DNA, 21 bp, Homo sapiens
catgatgtcgttcattttctg

SEQ ID NO: 208784 - DNA, 18 bp, Homo sapiens
catgatgtctgcaaagga

SEQ ID NO: 208785 - DNA, 20 bp, Homo sapiens
catgatgtggagtggggcag

SEQ ID NO: 208786 - DNA, 23 bp, Homo sapiens
catgattccaagggcccagaggg

SEQ ID NO: 208787 - DNA, 16 bp, Homo sapiens
catgattccttcctgt

SEQ ID NO: 208788 - DNA, 20 bp, Homo sapiens
catgatttagggaagcaggg

SEQ ID NO: 208789 - DNA, 21 bp, Homo sapiens
catgatttagggaagcaggga

SEQ ID NO: 208790 - DNA, 18 bp, Homo sapiens
catgatttcaatgattgt

SEQ ID NO: 208791 - DNA, 17 bp, Homo sapiens
catgcaaaccaggagca

SEQ ID NO: 208792 - DNA, 16 bp, Homo sapiens
catgcaactccatgcc

SEQ ID NO: 208793 - DNA, 18 bp, Homo sapiens
catgcaactccatgccta

SEQ ID NO: 208794 - DNA, 23 bp, Homo sapiens
catgcaagggatgaattgtaaaa

SEQ ID NO: 208795 - DNA, 16 bp, Homo sapiens
catgcaatgacatctt

SEQ ID NO: 208796 - DNA, 17 bp, Homo sapiens
catgcacaactctccaa

SEQ ID NO: 208797 - DNA, 21 bp, Homo sapiens
catgcacacaaacacctccta

SEQ ID NO: 208798 - DNA, 18 bp, Homo sapiens
catgcacagaacaagcca

SEQ ID NO: 208799 - DNA, 20 bp, Homo sapiens
catgcagatctagccaggcc

SEQ ID NO: 208800 - DNA, 17 bp, Homo sapiens
catgcagcaacacccaa

SEQ ID NO: 208801 - DNA, 16 bp, Homo sapiens
catgcagcagcttgct

SEQ ID NO: 208802 - DNA, 17 bp, Homo sapiens
catgcagcagcttgctg

SEQ ID NO: 208803 - DNA, 23 bp, Homo sapiens
catgcagttcattattttgtggt

SEQ ID NO: 208804 - DNA, 13 bp, Homo sapiens
catgcatggcctc

SEQ ID NO: 208805 - DNA, 14 bp, Homo sapiens
catgcatggcctcc

SEQ ID NO: 208806 - DNA, 17 bp, Homo sapiens
catgcatggcctcccag

SEQ ID NO: 208807 - DNA, 22 bp, Homo sapiens
catgcatgttttatgtgcactc

SEQ ID NO: 208808 - DNA, 15 bp, Homo sapiens
catgcattgtaatca

SEQ ID NO: 208809 - DNA, 17 bp, Homo sapiens
catgcatttgaggtcaa

SEQ ID NO: 208810 - DNA, 17 bp, Homo sapiens
catgccaactcgggagc

SEQ ID NO: 208811 - DNA, 20 bp, Homo sapiens
catgccaatagttgctgtcc

SEQ ID NO: 208812 - DNA, 13 bp, Homo sapiens
catgccaccctca

SEQ ID NO: 208813 - DNA, 18 bp, Homo sapiens
catgccaccctcacacac

SEQ ID NO: 208814 - DNA, 21 bp, Homo sapiens
catgccacgccccgtgtctgg

SEQ ID NO: 208815 - DNA, 13 bp, Homo sapiens
catgccactgcca

SEQ ID NO: 208816 - DNA, 19 bp, Homo sapiens
catgccataagcaggagtt

SEQ ID NO: 208817 - DNA, 14 bp, Homo sapiens
catgcccacctgcc

SEQ ID NO: 208818 - DNA, 16 bp, Homo sapiens
catgcccacctgccca

SEQ ID NO: 208819 - DNA, 21 bp, Homo sapiens
catgcccacctgcccatcaca

SEQ ID NO: 208820 - DNA, 19 bp, Homo sapiens
catgccccacccacccctc

SEQ ID NO: 208821 - DNA, 20 bp, Homo sapiens
catgccccacccacccctcc

SEQ ID NO: 208822 - DNA, 15 bp, Homo sapiens
catgccccctttcag

SEQ ID NO: 208823 - DNA, 18 bp, Homo sapiens
catgccgagtgccccaga

SEQ ID NO: 208824 - DNA, 22 bp, Homo sapiens
catgccgagtgccccagaaatg

SEQ ID NO: 208825 - DNA, 19 bp, Homo sapiens
catgccgcgggcggccagg

SEQ ID NO: 208826 - DNA, 16 bp, Homo sapiens
catgcctcatgccaca

SEQ ID NO: 208827 - DNA, 13 bp, Homo sapiens
catgcctgagggt

SEQ ID NO: 208828 - DNA, 20 bp, Homo sapiens
catgcctgagggtggagact

SEQ ID NO: 208829 - DNA, 17 bp, Homo sapiens
catgcctggcccccctc

SEQ ID NO: 208830 - DNA, 21 bp, Homo sapiens
catgcctggcccccctccagg

SEQ ID NO: 208831 - DNA, 16 bp, Homo sapiens
catgcctgtccagcct

SEQ ID NO: 208832 - DNA, 21 bp, Homo sapiens
catgcctgtccagcctgggca

SEQ ID NO: 208833 - DNA, 13 bp, Homo sapiens
catgcctttgtaa

SEQ ID NO: 208834 - DNA, 22 bp, Homo sapiens
catgccttttgggtttgcctta

SEQ ID NO: 208835 - DNA, 19 bp, Homo sapiens
catgcgaatgagctgggcc

SEQ ID NO: 208836 - DNA, 17 bp, Homo sapiens
catgcggcccagccatg

SEQ ID NO: 208837 - DNA, 18 bp, Homo sapiens
catgcggccggcctgggg

SEQ ID NO: 208838 - DNA, 20 bp, Homo sapiens
catgcgggctgggcagctgt

SEQ ID NO: 208839 - DNA, 21 bp, Homo sapiens
catgcgtccactttcccttcc

SEQ ID NO: 208840 - DNA, 23 bp, Homo sapiens
catgcgtccactttcccttcccc

SEQ ID NO: 208841 - DNA, 22 bp, Homo sapiens
catgcgtgggtggggagggagg

SEQ ID NO: 208842 - DNA, 22 bp, Homo sapiens
catgctacctgatcccactcct

SEQ ID NO: 208843 - DNA, 13 bp, Homo sapiens
catgctcaacccc

SEQ ID NO: 208844 - DNA, 14 bp, Homo sapiens
catgctcaaccccc

SEQ ID NO: 208845 - DNA, 17 bp, Homo sapiens
catgctcaacccccctc

SEQ ID NO: 208846 - DNA, 13 bp, Homo sapiens
catgctcacctct

SEQ ID NO: 208847 - DNA, 15 bp, Homo sapiens
catgctcagtattga

SEQ ID NO: 208848 - DNA, 15 bp, Homo sapiens
catgctcccagcatt

SEQ ID NO: 208849 - DNA, 16 bp, Homo sapiens
catgctcccagcattt

SEQ ID NO: 208850 - DNA, 17 bp, Homo sapiens
catgctcccagcatttg

SEQ ID NO: 208851 - DNA, 18 bp, Homo sapiens
catgctcccagcatttgt

SEQ ID NO: 208852 - DNA, 18 bp, Homo sapiens
catgctcctcacctgtct

SEQ ID NO: 208853 - DNA, 15 bp, Homo sapiens
catgctcctcactgc

SEQ ID NO: 208854 - DNA, 17 bp, Homo sapiens
catgctcctcactgccc

SEQ ID NO: 208855 - DNA, 20 bp, Homo sapiens
catgctctccaaaccacttt

SEQ ID NO: 208856 - DNA, 16 bp, Homo sapiens
catgctctgccccaag

SEQ ID NO: 208857 - DNA, 15 bp, Homo sapiens
catgctgatttacca

SEQ ID NO: 208858 - DNA, 20 bp, Homo sapiens
catgctgcctgcctccggcc

SEQ ID NO: 208859 - DNA, 16 bp, Homo sapiens
catgctgctatgaaga

SEQ ID NO: 208860 - DNA, 12 bp, Homo sapiens
catgctgcttta

SEQ ID NO: 208861 - DNA, 18 bp, Homo sapiens
catgctgctttaattgtg

SEQ ID NO: 208862 - DNA, 21 bp, Homo sapiens
catgctgctttaattgtgaat

SEQ ID NO: 208863 - DNA, 18 bp, Homo sapiens
catgctggacaggtctgg

SEQ ID NO: 208864 - DNA, 21 bp, Homo sapiens
ctgtctaggtcagtacccacc

SEQ ID NO: 208865 - DNA, 21 bp, Homo sapiens
ctgtctaggtctcctcagggt

SEQ ID NO: 208866 - DNA, 17 bp, Homo sapiens
ctgtctcaaaccctggc

SEQ ID NO: 208867 - DNA, 22 bp, Homo sapiens
ctgtctcaagagggcactggtg

SEQ ID NO: 208868 - DNA, 14 bp, Homo sapiens
ctgtctcagattgg

SEQ ID NO: 208869 - DNA, 16 bp, Homo sapiens
ctgtctcagattggga

SEQ ID NO: 208870 - DNA, 15 bp, Homo sapiens
ctgtctcagcctccc

SEQ ID NO: 208871 - DNA, 17 bp, Homo sapiens
ctgtctcagcctcccag

SEQ ID NO: 208872 - DNA, 13 bp, Homo sapiens
ctgtctcataatt

SEQ ID NO: 208873 - DNA, 16 bp, Homo sapiens
ctgtctccagaccccc

SEQ ID NO: 208874 - DNA, 20 bp, Homo sapiens
ctgtctccagggcccccacc

SEQ ID NO: 208875 - DNA, 21 bp, Homo sapiens
ctgtctccagggcccccaccg

SEQ ID NO: 208876 - DNA, 18 bp, Homo sapiens
ctgtctcccctctgctgg

SEQ ID NO: 208877 - DNA, 20 bp, Homo sapiens
ctgtctccctataatgctgg

SEQ ID NO: 208878 - DNA, 12 bp, Homo sapiens
ctgtctccttcc

SEQ ID NO: 208879 - DNA, 15 bp, Homo sapiens
ctgtctccttcccac

SEQ ID NO: 208880 - DNA, 17 bp, Homo sapiens
ctgtctccttcccactg

SEQ ID NO: 208881 - DNA, 23 bp, Homo sapiens
ctgtctccttcccactgtccttt

SEQ ID NO: 208882 - DNA, 18 bp, Homo sapiens
ctgtctctctctcttttt

SEQ ID NO: 208883 - DNA, 23 bp, Homo sapiens
ctgtctctgttcagatgtgcatt

SEQ ID NO: 208884 - DNA, 18 bp, Homo sapiens
ctgtctcttgaaaaatgc

SEQ ID NO: 208885 - DNA, 14 bp, Homo sapiens
ctgtctctttccac

SEQ ID NO: 208886 - DNA, 13 bp, Homo sapiens
ctgtctgagccct

SEQ ID NO: 208887 - DNA, 16 bp, Homo sapiens
ctgtctgagccctgcc

SEQ ID NO: 208888 - DNA, 20 bp, Homo sapiens
ctgtctgcgccgctgtgctg

SEQ ID NO: 208889 - DNA, 20 bp, Homo sapiens
ctgtctggaagacgtggctc

SEQ ID NO: 208890 - DNA, 21 bp, Homo sapiens
ctgtctggaagacgtggctct

SEQ ID NO: 208891 - DNA, 23 bp, Homo sapiens
ctgtctggagctcacccaaggtc

SEQ ID NO: 208892 - DNA, 20 bp, Homo sapiens
ctgtctggctcggacccacc

SEQ ID NO: 208893 - DNA, 21 bp, Homo sapiens
ctgtctggctcggacccaccc

SEQ ID NO: 208894 - DNA, 19 bp, Homo sapiens
ctgtctgtcccagttaact

SEQ ID NO: 208895 - DNA, 20 bp, Homo sapiens
ctgtctgtctctccatctgt

SEQ ID NO: 208896 - DNA, 14 bp, Homo sapiens
ctgtctgtctgtct

SEQ ID NO: 208897 - DNA, 15 bp, Homo sapiens
ctgtctgtctgtctg

SEQ ID NO: 208898 - DNA, 20 bp, Homo sapiens
ctgtcttcaaccctgccctg

SEQ ID NO: 208899 - DNA, 21 bp, Homo sapiens
ctgtcttcaaccctgccctgc

SEQ ID NO: 208900 - DNA, 22 bp, Homo sapiens
ctgtcttcaaccctgccctgca

SEQ ID NO: 208901 - DNA, 14 bp, Homo sapiens
ctgtcttcaagggc

SEQ ID NO: 208902 - DNA, 15 bp, Homo sapiens
ctgtcttcaagggct

SEQ ID NO: 208903 - DNA, 19 bp, Homo sapiens
ctgtcttcacagctctgtg

SEQ ID NO: 208904 - DNA, 14 bp, Homo sapiens
ctgtcttccaagga

SEQ ID NO: 208905 - DNA, 19 bp, Homo sapiens
ctgtcttccaggcccagtc

SEQ ID NO: 208906 - DNA, 23 bp, Homo sapiens
ctgtcttctccctgcacaagcca

SEQ ID NO: 208907 - DNA, 14 bp, Homo sapiens
ctgtcttctttctc

SEQ ID NO: 208908 - DNA, 18 bp, Homo sapiens
ctgtcttctttctcctgt

SEQ ID NO: 208909 - DNA, 17 bp, Homo sapiens
ctgtcttgtcatctttt

SEQ ID NO: 208910 - DNA, 13 bp, Homo sapiens
ctgtctttaagaa

SEQ ID NO: 208911 - DNA, 15 bp, Homo sapiens
ctgtctttcagatac

SEQ ID NO: 208912 - DNA, 16 bp, Homo sapiens
ctgtctttgctgttta

SEQ ID NO: 208913 - DNA, 14 bp, Homo sapiens
ctgtgaacctggag

SEQ ID NO: 208914 - DNA, 15 bp, Homo sapiens
ctgtgaagaatgaag

SEQ ID NO: 208915 - DNA, 14 bp, Homo sapiens
ctgtgaagcccttt

SEQ ID NO: 208916 - DNA, 18 bp, Homo sapiens
ctgtgaagccctttgcct

SEQ ID NO: 208917 - DNA, 21 bp, Homo sapiens
ctgtgaataaaaaccctgtat

SEQ ID NO: 208918 - DNA, 18 bp, Homo sapiens
ctgtgaataaagccacat

SEQ ID NO: 208919 - DNA, 15 bp, Homo sapiens
ctgtgaatacttgaa

SEQ ID NO: 208920 - DNA, 20 bp, Homo sapiens
ctgtgaatgtaaaacagagc

SEQ ID NO: 208921 - DNA, 16 bp, Homo sapiens
ctgtgacaaaggatga

SEQ ID NO: 208922 - DNA, 16 bp, Homo sapiens
ctgtgacacagctgag

SEQ ID NO: 208923 - DNA, 17 bp, Homo sapiens
ctgtgacacagctgagc

SEQ ID NO: 208924 - DNA, 20 bp, Homo sapiens
ctgtgaccagcactgtctca

SEQ ID NO: 208925 - DNA, 19 bp, Homo sapiens
ctgtgaccatttataatgt

SEQ ID NO: 208926 - DNA, 13 bp, Homo sapiens
ctgtgaccctctc

SEQ ID NO: 208927 - DNA, 15 bp, Homo sapiens
ctgtgaccggggtcc

SEQ ID NO: 208928 - DNA, 22 bp, Homo sapiens
ctgtgaccggggtcctgaggct

SEQ ID NO: 208929 - DNA, 22 bp, Homo sapiens
ctgtgactcctcccttccccac

SEQ ID NO: 208930 - DNA, 22 bp, Homo sapiens
ctgtgacttcagctctgtttta

SEQ ID NO: 208931 - DNA, 19 bp, Homo sapiens
ctgtgagacccccacacct

SEQ ID NO: 208932 - DNA, 18 bp, Homo sapiens
ctgtgagacgaggcaggg

SEQ ID NO: 208933 - DNA, 19 bp, Homo sapiens
ctgtgagacgaggcagggg

SEQ ID NO: 208934 - DNA, 21 bp, Homo sapiens
ctgtgagacgaggcaggggct

SEQ ID NO: 208935 - DNA, 15 bp, Homo sapiens
ctgtgagataaatat

SEQ ID NO: 208936 - DNA, 13 bp, Homo sapiens
ctgtgagcaaagt

SEQ ID NO: 208937 - DNA, 14 bp, Homo sapiens
ctgtgagcagcctc

SEQ ID NO: 208938 - DNA, 14 bp, Homo sapiens
ctgtgagctcccca

SEQ ID NO: 208939 - DNA, 22 bp, Homo sapiens
ctgtgagctccccaatccaacc

SEQ ID NO: 208940 - DNA, 20 bp, Homo sapiens
ctgtgaggaatgctctgtgc

SEQ ID NO: 208941 - DNA, 15 bp, Homo sapiens
ctgtgaggacagaca

SEQ ID NO: 208942 - DNA, 14 bp, Homo sapiens
ctgtgaggcggcag

SEQ ID NO: 208943 - DNA, 17 bp, Homo sapiens
ctgtgaggctgtcctgt

SEQ ID NO: 208944 - DNA, 19 bp, Homo sapiens
ctgtgaggtgataggcaag

SEQ ID NO: 208945 - DNA, 15 bp, Homo sapiens
ctgtgagtctgtcct

SEQ ID NO: 208946 - DNA, 18 bp, Homo sapiens
ctgtgagtctgtcctttc

SEQ ID NO: 208947 - DNA, 13 bp, Homo sapiens
ctgtgagtgagtg

SEQ ID NO: 208948 - DNA, 19 bp, Homo sapiens
ctgtgagtgtaagtgtgag

SEQ ID NO: 208949 - DNA, 20 bp, Homo sapiens
ctgtgagtgtaagtgtgagt

SEQ ID NO: 208950 - DNA, 17 bp, Homo sapiens
ctgtgagtttaaagcaa

SEQ ID NO: 208951 - DNA, 21 bp, Homo sapiens
ctgtgatcactccagtgcact

SEQ ID NO: 208952 - DNA, 16 bp, Homo sapiens
ctgtgatgcatgagct

SEQ ID NO: 208953 - DNA, 14 bp, Homo sapiens
ctgtgatgccacac

SEQ ID NO: 208954 - DNA, 19 bp, Homo sapiens
ctgtgatgtcatgaaagca

SEQ ID NO: 208955 - DNA, 22 bp, Homo sapiens
ctgtgatgtcatgaaagcacct

SEQ ID NO: 208956 - DNA, 19 bp, Homo sapiens
ctgtgattaattattgaaa

SEQ ID NO: 208957 - DNA, 20 bp, Homo sapiens
ctgtgattgccatttcttcc

SEQ ID NO: 208958 - DNA, 18 bp, Homo sapiens
ctgtgatttatttggagt

SEQ ID NO: 208959 - DNA, 12 bp, Homo sapiens
ctgtgcagagac

SEQ ID NO: 208960 - DNA, 14 bp, Homo sapiens
ctgtgcagcaccct

SEQ ID NO: 208961 - DNA, 19 bp, Homo sapiens
ctgtgcagcagcccagctt

SEQ ID NO: 208962 - DNA, 23 bp, Homo sapiens
ctgtgcagcagcccagcttcctg

SEQ ID NO: 208963 - DNA, 13 bp, Homo sapiens
ctgtgcaggtgct

SEQ ID NO: 208964 - DNA, 17 bp, Homo sapiens
ctgtgcaggtgctgcct

SEQ ID NO: 208965 - DNA, 18 bp, Homo sapiens
ctgtgcatttgtgtctgc

SEQ ID NO: 208966 - DNA, 18 bp, Homo sapiens
ctgtgccaacctgatgcc

SEQ ID NO: 208967 - DNA, 16 bp, Homo sapiens
ctgtgccaagggcagg

SEQ ID NO: 208968 - DNA, 22 bp, Homo sapiens
ctgtgccagaaacagtgggagc

SEQ ID NO: 208969 - DNA, 15 bp, Homo sapiens
ctgtgccaggaggcg

SEQ ID NO: 208970 - DNA, 18 bp, Homo sapiens
ctgtgcccacccagggcc

SEQ ID NO: 208971 - DNA, 11 bp, Homo sapiens
ctgtgcccagc

SEQ ID NO: 208972 - DNA, 17 bp, Homo sapiens
ctgtgcccatcatctct

SEQ ID NO: 208973 - DNA, 21 bp, Homo sapiens
ctgtgcccatcatctctgcct

SEQ ID NO: 208974 - DNA, 23 bp, Homo sapiens
ctgtgccccatcagcagcttgac

SEQ ID NO: 208975 - DNA, 20 bp, Homo sapiens
ctgtgcccttgctgggtcca

SEQ ID NO: 208976 - DNA, 21 bp, Homo sapiens
ctgtgcccttgctgggtccag

SEQ ID NO: 208977 - DNA, 18 bp, Homo sapiens
ctgtgcctaacaccagcg

SEQ ID NO: 208978 - DNA, 13 bp, Homo sapiens
ctgtgcctccccc

SEQ ID NO: 208979 - DNA, 14 bp, Homo sapiens
ctgtgcctcccccc

SEQ ID NO: 208980 - DNA, 11 bp, Homo sapiens
ctgtgcctctg

SEQ ID NO: 208981 - DNA, 13 bp, Homo sapiens
ctgtgcctctgcc

SEQ ID NO: 208982 - DNA, 17 bp, Homo sapiens
ctgtgcctgctagagca

SEQ ID NO: 208983 - DNA, 19 bp, Homo sapiens
ctgtgcctgctagagcaac

SEQ ID NO: 208984 - DNA, 21 bp, Homo sapiens
ctgtgcctgctagagcaaccc

SEQ ID NO: 208985 - DNA, 13 bp, Homo sapiens
ctgtgcctggagc

SEQ ID NO: 208986 - DNA, 12 bp, Homo sapiens
ctgtgcctttgg

SEQ ID NO: 208987 - DNA, 14 bp, Homo sapiens
ctgtgcgctgacaa

SEQ ID NO: 208988 - DNA, 15 bp, Homo sapiens
ctgtgcgttcccttc

SEQ ID NO: 208989 - DNA, 16 bp, Homo sapiens
ctgtgcgttcccttca

SEQ ID NO: 208990 - DNA, 20 bp, Homo sapiens
ctgtgctaagttgtcttaca

SEQ ID NO: 208991 - DNA, 22 bp, Homo sapiens
ctgtgctacctctaacaccaca

SEQ ID NO: 208992 - DNA, 13 bp, Homo sapiens
ctgtgctatgaat

SEQ ID NO: 208993 - DNA, 15 bp, Homo sapiens
ctgtgctatgaattt

SEQ ID NO: 208994 - DNA, 17 bp, Homo sapiens
ctgtgctcatcggagac

SEQ ID NO: 208995 - DNA, 23 bp, Homo sapiens
ctgtgctccagcagtgctgggcc

SEQ ID NO: 208996 - DNA, 23 bp, Homo sapiens
ctgtgctcctaaaggcagcaacc

SEQ ID NO: 208997 - DNA, 15 bp, Homo sapiens
ctgtgctctggggat

SEQ ID NO: 208998 - DNA, 14 bp, Homo sapiens
gaaaacatatattt

SEQ ID NO: 208999 - DNA, 15 bp, Homo sapiens
gaaaacatatatttt

SEQ ID NO: 209000 - DNA, 19 bp, Homo sapiens
gaaaaccaagccgtggctt

SEQ ID NO: 209001 - DNA, 20 bp, Homo sapiens
gaaaaccatctggcctggcc

SEQ ID NO: 209002 - DNA, 20 bp, Homo sapiens
gaaaacccgacaacatttct

SEQ ID NO: 209003 - DNA, 22 bp, Homo sapiens
gaaaacccgacaacatttctgc

SEQ ID NO: 209004 - DNA, 17 bp, Homo sapiens
gaaaacggttaaaactg

SEQ ID NO: 209005 - DNA, 18 bp, Homo sapiens
gaaaacgttttattgtgt

SEQ ID NO: 209006 - DNA, 12 bp, Homo sapiens
gaaaactaagtt

SEQ ID NO: 209007 - DNA, 17 bp, Homo sapiens
gaaaactcaccatttca

SEQ ID NO: 209008 - DNA, 18 bp, Homo sapiens
gaaaactgaaaatctaat

SEQ ID NO: 209009 - DNA, 21 bp, Homo sapiens
gaaaactgcctgttccttgaa

SEQ ID NO: 209010 - DNA, 21 bp, Homo sapiens
gaaaactgtttatggtatttt

SEQ ID NO: 209011 - DNA, 12 bp, Homo sapiens
gaaaacttagtt

SEQ ID NO: 209012 - DNA, 16 bp, Homo sapiens
gaaaacttatttgagt

SEQ ID NO: 209013 - DNA, 14 bp, Homo sapiens
gaaaacttcaaagc

SEQ ID NO: 209014 - DNA, 19 bp, Homo sapiens
gaaaagaactgtttactgc

SEQ ID NO: 209015 - DNA, 20 bp, Homo sapiens
gaaaagaagaaagtctatgc

SEQ ID NO: 209016 - DNA, 23 bp, Homo sapiens
gaaaagagcacttcacacagaca

SEQ ID NO: 209017 - DNA, 16 bp, Homo sapiens
gaaaagatacgacttt

SEQ ID NO: 209018 - DNA, 19 bp, Homo sapiens
gaaaagatacgactttatt

SEQ ID NO: 209019 - DNA, 14 bp, Homo sapiens
gaaaagattccatt

SEQ ID NO: 209020 - DNA, 21 bp, Homo sapiens
gaaaagctgccatttcccttc

SEQ ID NO: 209021 - DNA, 22 bp, Homo sapiens
gaaaagctgccatttcccttct

SEQ ID NO: 209022 - DNA, 15 bp, Homo sapiens
gaaaagctgttccca

SEQ ID NO: 209023 - DNA, 15 bp, Homo sapiens
gaaaaggaagactag

SEQ ID NO: 209024 - DNA, 21 bp, Homo sapiens
gaaaaggaatgcaagagaagg

SEQ ID NO: 209025 - DNA, 22 bp, Homo sapiens
gaaaaggaatgcaagagaagga

SEQ ID NO: 209026 - DNA, 16 bp, Homo sapiens
gaaaagtaaattgcct

SEQ ID NO: 209027 - DNA, 14 bp, Homo sapiens
gaaaagtgctgttt

SEQ ID NO: 209028 - DNA, 18 bp, Homo sapiens
gaaaagtggcaagaccaa

SEQ ID NO: 209029 - DNA, 12 bp, Homo sapiens
gaaaagttcata

SEQ ID NO: 209030 - DNA, 12 bp, Homo sapiens
gaaaataaaata

SEQ ID NO: 209031 - DNA, 17 bp, Homo sapiens
gaaaataaaataaacga

SEQ ID NO: 209032 - DNA, 19 bp, Homo sapiens
gaaaataaaataaacgaaa

SEQ ID NO: 209033 - DNA, 13 bp, Homo sapiens
gaaaatacaataa

SEQ ID NO: 209034 - DNA, 14 bp, Homo sapiens
gaaaatacaataaa

SEQ ID NO: 209035 - DNA, 21 bp, Homo sapiens
gaaaatagggtccttgaaaca

SEQ ID NO: 209036 - DNA, 15 bp, Homo sapiens
gaaaatagtcctcca

SEQ ID NO: 209037 - DNA, 12 bp, Homo sapiens
gaaaatatgata

SEQ ID NO: 209038 - DNA, 17 bp, Homo sapiens
gaaaatattatgtgttt

SEQ ID NO: 209039 - DNA, 15 bp, Homo sapiens
gaaaatatttctatg

SEQ ID NO: 209040 - DNA, 16 bp, Homo sapiens
gaaaatatttctatgt

SEQ ID NO: 209041 - DNA, 21 bp, Homo sapiens
gaaaatatttctatgtaaatt

SEQ ID NO: 209042 - DNA, 17 bp, Homo sapiens
gaaaatatttttttcta

SEQ ID NO: 209043 - DNA, 18 bp, Homo sapiens
gaaaatatttttttctag

SEQ ID NO: 209044 - DNA, 13 bp, Homo sapiens
gaaaatcctacca

SEQ ID NO: 209045 - DNA, 14 bp, Homo sapiens
gaaaatcctaccaa

SEQ ID NO: 209046 - DNA, 20 bp, Homo sapiens
gaaaatctaatattaaaaat

SEQ ID NO: 209047 - DNA, 19 bp, Homo sapiens
gaaaatctgtaaaaaagaa

SEQ ID NO: 209048 - DNA, 15 bp, Homo sapiens
gaaaatgagaatctg

SEQ ID NO: 209049 - DNA, 16 bp, Homo sapiens
gaaaatgagaatctgt

SEQ ID NO: 209050 - DNA, 16 bp, Homo sapiens
gaaaatgagcatcaga

SEQ ID NO: 209051 - DNA, 23 bp, Homo sapiens
gaaaatggacgtgttatgactcc

SEQ ID NO: 209052 - DNA, 22 bp, Homo sapiens
gaaaatggatgacaaagaaaat

SEQ ID NO: 209053 - DNA, 23 bp, Homo sapiens
gaaaatggtgaagaatggactta

SEQ ID NO: 209054 - DNA, 16 bp, Homo sapiens
gaaaatgtgaagctga

SEQ ID NO: 209055 - DNA, 13 bp, Homo sapiens
gaaaatgtgtctg

SEQ ID NO: 209056 - DNA, 21 bp, Homo sapiens
gaaaatgtgtctgcaacatgg

SEQ ID NO: 209057 - DNA, 11 bp, Homo sapiens
gaaaattacac

SEQ ID NO: 209058 - DNA, 17 bp, Homo sapiens
gaaaattcaaaaagtgt

SEQ ID NO: 209059 - DNA, 22 bp, Homo sapiens
gaaaattctcaagtgatagtct

SEQ ID NO: 209060 - DNA, 24 bp, Homo sapiens
gaaacaaagcatttgactttctgt

SEQ ID NO: 209061 - DNA, 11 bp, Homo sapiens
gaaacacacac

SEQ ID NO: 209062 - DNA, 19 bp, Homo sapiens
gaaacacacacacattctt

SEQ ID NO: 209063 - DNA, 17 bp, Homo sapiens
gaaacacaccaggctgt

SEQ ID NO: 209064 - DNA, 23 bp, Homo sapiens
gaaacacaccaggctgtgggcct

SEQ ID NO: 209065 - DNA, 14 bp, Homo sapiens
gaaacacacttttg

SEQ ID NO: 209066 - DNA, 18 bp, Homo sapiens
gaaacacagaactcagcc

SEQ ID NO: 209067 - DNA, 14 bp, Homo sapiens
gaaacacagggttt

SEQ ID NO: 209068 - DNA, 19 bp, Homo sapiens
gaaacacatcaaataaact

SEQ ID NO: 209069 - DNA, 19 bp, Homo sapiens
gaaacactcgtgtgcatga

SEQ ID NO: 209070 - DNA, 19 bp, Homo sapiens
gaaacagagtccaatttaa

SEQ ID NO: 209071 - DNA, 22 bp, Homo sapiens
gaaacagagtccaatttaagga

SEQ ID NO: 209072 - DNA, 16 bp, Homo sapiens
gaaacagcagtcccag

SEQ ID NO: 209073 - DNA, 15 bp, Homo sapiens
gaaacagctttcaag

SEQ ID NO: 209074 - DNA, 21 bp, Homo sapiens
gaaacagctttcaagtgcctt

SEQ ID NO: 209075 - DNA, 13 bp, Homo sapiens
gaaacaggagaga

SEQ ID NO: 209076 - DNA, 21 bp, Homo sapiens
gaaacagggggaaaatgtttg

SEQ ID NO: 209077 - DNA, 18 bp, Homo sapiens
gaaacagtgggagccctg

SEQ ID NO: 209078 - DNA, 18 bp, Homo sapiens
gaaacattccgaagaggg

SEQ ID NO: 209079 - DNA, 15 bp, Homo sapiens
gaaaccaagtgggct

SEQ ID NO: 209080 - DNA, 19 bp, Homo sapiens
gaaaccattgttcagaaga

SEQ ID NO: 209081 - DNA, 21 bp, Homo sapiens
gaaacccagcgttcttcagga

SEQ ID NO: 209082 - DNA, 14 bp, Homo sapiens
gaaacccccaggag

SEQ ID NO: 209083 - DNA, 14 bp, Homo sapiens
gaaacccctgggga

SEQ ID NO: 209084 - DNA, 12 bp, Homo sapiens
gaaaccgaggcg

SEQ ID NO: 209085 - DNA, 19 bp, Homo sapiens
gaaacctccatcctgccag

SEQ ID NO: 209086 - DNA, 20 bp, Homo sapiens
gaaacctccatcctgccagg

SEQ ID NO: 209087 - DNA, 15 bp, Homo sapiens
gaaaccttgtctcta

SEQ ID NO: 209088 - DNA, 15 bp, Homo sapiens
gaaaccttgtttgtt

SEQ ID NO: 209089 - DNA, 20 bp, Homo sapiens
gaaaccttttaaaaaaataa

SEQ ID NO: 209090 - DNA, 16 bp, Homo sapiens
gaaacgagatttgcca

SEQ ID NO: 209091 - DNA, 17 bp, Homo sapiens
gaaacgagatttgccaa

SEQ ID NO: 209092 - DNA, 22 bp, Homo sapiens
gaaacgtacttaactgtgtgaa

SEQ ID NO: 209093 - DNA, 22 bp, Homo sapiens
gaaacgtccatctctctccctt

SEQ ID NO: 209094 - DNA, 12 bp, Homo sapiens
gaaactaacaga

SEQ ID NO: 209095 - DNA, 20 bp, Homo sapiens
gaaactaccagtgggcatgt

SEQ ID NO: 209096 - DNA, 20 bp, Homo sapiens
gaaactatgcacctataaat

SEQ ID NO: 209097 - DNA, 24 bp, Homo sapiens
gaaactatgcacctataaatacta

SEQ ID NO: 209098 - DNA, 18 bp, Homo sapiens
gaaactcacctgctggcc

SEQ ID NO: 209099 - DNA, 16 bp, Homo sapiens
gaaactgaaagtgttt

SEQ ID NO: 209100 - DNA, 18 bp, Homo sapiens
gaaactgaggcccagaga

SEQ ID NO: 209101 - DNA, 18 bp, Homo sapiens
gaaactgctaattacaca

SEQ ID NO: 209102 - DNA, 15 bp, Homo sapiens
gaaactgttgccaga

SEQ ID NO: 209103 - DNA, 23 bp, Homo sapiens
gaaactgttgccagagatggagg

SEQ ID NO: 209104 - DNA, 15 bp, Homo sapiens
gaaacttcagccctg

SEQ ID NO: 209105 - DNA, 15 bp, Homo sapiens
ccagccttcctctgc

SEQ ID NO: 209106 - DNA, 20 bp, Homo sapiens
ccagccttcctctgcagctg

SEQ ID NO: 209107 - DNA, 22 bp, Homo sapiens
ccagccttcctctgcagctgac

SEQ ID NO: 209108 - DNA, 14 bp, Homo sapiens
ccagcgaggcgagg

SEQ ID NO: 209109 - DNA, 17 bp, Homo sapiens
ccagcgaggcgaggctg

SEQ ID NO: 209110 - DNA, 21 bp, Homo sapiens
ccagcgaggcgaggctgcctc

SEQ ID NO: 209111 - DNA, 22 bp, Homo sapiens
ccagcgaggcgaggctgcctct

SEQ ID NO: 209112 - DNA, 19 bp, Homo sapiens
ccagcgagtaccccagcca

SEQ ID NO: 209113 - DNA, 20 bp, Homo sapiens
ccagcgagtctggagaccag

SEQ ID NO: 209114 - DNA, 18 bp, Homo sapiens
ccagcgcccgctgggctg

SEQ ID NO: 209115 - DNA, 15 bp, Homo sapiens
ccagcggcccctccc

SEQ ID NO: 209116 - DNA, 14 bp, Homo sapiens
ccagcgggccctct

SEQ ID NO: 209117 - DNA, 19 bp, Homo sapiens
ccagcgggccctctgccga

SEQ ID NO: 209118 - DNA, 23 bp, Homo sapiens
ccagcgtggcgcagtggccctga

SEQ ID NO: 209119 - DNA, 16 bp, Homo sapiens
ccagctaaagaggtgg

SEQ ID NO: 209120 - DNA, 17 bp, Homo sapiens
ccagctaaagaggtggg

SEQ ID NO: 209121 - DNA, 17 bp, Homo sapiens
ccagctaatctgtaggg

SEQ ID NO: 209122 - DNA, 20 bp, Homo sapiens
ccagctaatctgtagggctg

SEQ ID NO: 209123 - DNA, 20 bp, Homo sapiens
ccagctacaggggaggctga

SEQ ID NO: 209124 - DNA, 17 bp, Homo sapiens
ccagctacattcctcag

SEQ ID NO: 209125 - DNA, 20 bp, Homo sapiens
ccagctacattcctcagctg

SEQ ID NO: 209126 - DNA, 14 bp, Homo sapiens
ccagctaccccttc

SEQ ID NO: 209127 - DNA, 23 bp, Homo sapiens
ccagctaccccttctttgcaggg

SEQ ID NO: 209128 - DNA, 17 bp, Homo sapiens
gaacttacacttggagc

SEQ ID NO: 209129 - DNA, 13 bp, Homo sapiens
gaacttctaatat

SEQ ID NO: 209130 - DNA, 21 bp, Homo sapiens
gaacttctcgtagatgctgcc

SEQ ID NO: 209131 - DNA, 15 bp, Homo sapiens
gaacttgatttgcat

SEQ ID NO: 209132 - DNA, 17 bp, Homo sapiens
gaactttccaggaaggc

SEQ ID NO: 209133 - DNA, 23 bp, Homo sapiens
gaactttctcttcatactttttt

SEQ ID NO: 209134 - DNA, 16 bp, Homo sapiens
gaactttgaggaggaa

SEQ ID NO: 209135 - DNA, 18 bp, Homo sapiens
gaactttgcacacttcaa

SEQ ID NO: 209136 - DNA, 20 bp, Homo sapiens
gaagaaaagtgggccagtgt

SEQ ID NO: 209137 - DNA, 22 bp, Homo sapiens
gaagaaaatggatgacaaagaa

SEQ ID NO: 209138 - DNA, 19 bp, Homo sapiens
gaagaaagcaaaaaataaa

SEQ ID NO: 209139 - DNA, 23 bp, Homo sapiens
gaagaaagggtctgataaacaca

SEQ ID NO: 209140 - DNA, 16 bp, Homo sapiens
gaagaaagtaaaaaga

SEQ ID NO: 209141 - DNA, 20 bp, Homo sapiens
gaagaaagtaaaaagaacaa

SEQ ID NO: 209142 - DNA, 15 bp, Homo sapiens
gaagaacaaaaggct

SEQ ID NO: 209143 - DNA, 13 bp, Homo sapiens
gaagaacacagca

SEQ ID NO: 209144 - DNA, 16 bp, Homo sapiens
gaagaacacagcatgt

SEQ ID NO: 209145 - DNA, 21 bp, Homo sapiens
gaagaacagctgttcctgtgt

SEQ ID NO: 209146 - DNA, 13 bp, Homo sapiens
gaagaacatagaa

SEQ ID NO: 209147 - DNA, 13 bp, Homo sapiens
gaagaacatcaag

SEQ ID NO: 209148 - DNA, 16 bp, Homo sapiens
gaagaaccgcattttg

SEQ ID NO: 209149 - DNA, 19 bp, Homo sapiens
gaagaactagccatgtgct

SEQ ID NO: 209150 - DNA, 17 bp, Homo sapiens
gaagaactcatgtgatt

SEQ ID NO: 209151 - DNA, 21 bp, Homo sapiens
gaagaagccatcaattttaac

SEQ ID NO: 209152 - DNA, 17 bp, Homo sapiens
gaagaaggcccgggagg

SEQ ID NO: 209153 - DNA, 21 bp, Homo sapiens
gaagaaggcccgggaggagga

SEQ ID NO: 209154 - DNA, 13 bp, Homo sapiens
gaagaagtatatt

SEQ ID NO: 209155 - DNA, 14 bp, Homo sapiens
gaagaataaaaaag

SEQ ID NO: 209156 - DNA, 17 bp, Homo sapiens
gaagaataaaaaagaag

SEQ ID NO: 209157 - DNA, 14 bp, Homo sapiens
gaagaatattgtta

SEQ ID NO: 209158 - DNA, 16 bp, Homo sapiens
gaagaatgcattcaaa

SEQ ID NO: 209159 - DNA, 17 bp, Homo sapiens
gaagaatgcattcaaaa

SEQ ID NO: 209160 - DNA, 23 bp, Homo sapiens
gaagaatgtctcctgccactcct

SEQ ID NO: 209161 - DNA, 12 bp, Homo sapiens
gaagacacacag

SEQ ID NO: 209162 - DNA, 14 bp, Homo sapiens
gaagacacacagcc

SEQ ID NO: 209163 - DNA, 21 bp, Homo sapiens
gaagacactacagaggattct

SEQ ID NO: 209164 - DNA, 14 bp, Homo sapiens
gaagaccaaggcct

SEQ ID NO: 209165 - DNA, 19 bp, Homo sapiens
gaagaccagtcacagccat

SEQ ID NO: 209166 - DNA, 22 bp, Homo sapiens
gaagaccagtcacagccatttc

SEQ ID NO: 209167 - DNA, 20 bp, Homo sapiens
gaagactcgtcttggcacaa

SEQ ID NO: 209168 - DNA, 12 bp, Homo sapiens
gaagactggaag

SEQ ID NO: 209169 - DNA, 12 bp, Homo sapiens
gaagactggaga

SEQ ID NO: 209170 - DNA, 16 bp, Homo sapiens
gaagagactgggaaga

SEQ ID NO: 209171 - DNA, 14 bp, Homo sapiens
gaagagagagaccc

SEQ ID NO: 209172 - DNA, 15 bp, Homo sapiens
gaagagagagaccct

SEQ ID NO: 209173 - DNA, 12 bp, Homo sapiens
gaagagaggagt

SEQ ID NO: 209174 - DNA, 17 bp, Homo sapiens
gaagagaggagttcaat

SEQ ID NO: 209175 - DNA, 20 bp, Homo sapiens
gaagagaggagttcaatgat

SEQ ID NO: 209176 - DNA, 17 bp, Homo sapiens
gaagagaggcacctgct

SEQ ID NO: 209177 - DNA, 20 bp, Homo sapiens
gaagagaggcacctgctgga

SEQ ID NO: 209178 - DNA, 21 bp, Homo sapiens
gaagagattagcatgaaaggt

SEQ ID NO: 209179 - DNA, 13 bp, Homo sapiens
gaagagcagcctg

SEQ ID NO: 209180 - DNA, 14 bp, Homo sapiens
gaagagcagcctga

SEQ ID NO: 209181 - DNA, 17 bp, Homo sapiens
gaagagctattatataa

SEQ ID NO: 209182 - DNA, 11 bp, Homo sapiens
gaagagctgag

SEQ ID NO: 209183 - DNA, 15 bp, Homo sapiens
gaagagggagaagga

SEQ ID NO: 209184 - DNA, 19 bp, Homo sapiens
gaagagggcagtacctggg

SEQ ID NO: 209185 - DNA, 20 bp, Homo sapiens
gaagagggcctgtgggagcc

SEQ ID NO: 209186 - DNA, 16 bp, Homo sapiens
gaagagggctgagctg

SEQ ID NO: 209187 - DNA, 19 bp, Homo sapiens
gaagaggttctcagcaagt

SEQ ID NO: 209188 - DNA, 23 bp, Homo sapiens
gaagagttctatccccaagctgg

SEQ ID NO: 209189 - DNA, 23 bp, Homo sapiens
gaagataatgttctttaatgttg

SEQ ID NO: 209190 - DNA, 15 bp, Homo sapiens
gaagataatttgcat

SEQ ID NO: 209191 - DNA, 15 bp, Homo sapiens
gaagataggctctgc

SEQ ID NO: 209192 - DNA, 18 bp, Homo sapiens
gaagataggctctgcaca

SEQ ID NO: 209193 - DNA, 19 bp, Homo sapiens
gaagatcttgagagctgct

SEQ ID NO: 209194 - DNA, 18 bp, Homo sapiens
gaagatgaatcagtatga

SEQ ID NO: 209195 - DNA, 14 bp, Homo sapiens
gaagatgctggccc

SEQ ID NO: 209196 - DNA, 18 bp, Homo sapiens
gaagattattttttatga

SEQ ID NO: 209197 - DNA, 13 bp, Homo sapiens
gaagattgtgaat

SEQ ID NO: 209198 - DNA, 18 bp, Homo sapiens
gaagcaaacacacagact

SEQ ID NO: 209199 - DNA, 16 bp, Homo sapiens
gaagcaaataccaaag

SEQ ID NO: 209200 - DNA, 16 bp, Homo sapiens
gaagcaaatatgtttg

SEQ ID NO: 209201 - DNA, 15 bp, Homo sapiens
gaagcaaggccagcc

SEQ ID NO: 209202 - DNA, 17 bp, Homo sapiens
gaagcacaagaagtggg

SEQ ID NO: 209203 - DNA, 19 bp, Homo sapiens
gaagcacaagaagtgggag

SEQ ID NO: 209204 - DNA, 20 bp, Homo sapiens
gaagcacaagaagtgggagt

SEQ ID NO: 209205 - DNA, 14 bp, Homo sapiens
gaagcacaggccag

SEQ ID NO: 209206 - DNA, 16 bp, Homo sapiens
gaagcaccccaccaca

SEQ ID NO: 209207 - DNA, 16 bp, Homo sapiens
gaagcactctgctggc

SEQ ID NO: 209208 - DNA, 18 bp, Homo sapiens
gaagcactctgctggcgg

SEQ ID NO: 209209 - DNA, 12 bp, Homo sapiens
gaagcagagcac

SEQ ID NO: 209210 - DNA, 13 bp, Homo sapiens
gaagcagagcact

SEQ ID NO: 209211 - DNA, 15 bp, Homo sapiens
gaagcagagcactgt

SEQ ID NO: 209212 - DNA, 12 bp, Homo sapiens
gaagcaggctgg

SEQ ID NO: 209213 - DNA, 13 bp, Homo sapiens
gaagcaggctgga

SEQ ID NO: 209214 - DNA, 23 bp, Homo sapiens
gaagcagggagagttggggaagg

SEQ ID NO: 209215 - DNA, 18 bp, Homo sapiens
gaagcagtgccttccata

SEQ ID NO: 209216 - DNA, 12 bp, Homo sapiens
gaagcatgtttc

SEQ ID NO: 209217 - DNA, 18 bp, Homo sapiens
gaagcattaacttctctg

SEQ ID NO: 209218 - DNA, 13 bp, Homo sapiens
gaagccactggac

SEQ ID NO: 209219 - DNA, 17 bp, Homo sapiens
gaagccatcacttctcc

SEQ ID NO: 209220 - DNA, 20 bp, Homo sapiens
gaagcccacccgccccagag

SEQ ID NO: 209221 - DNA, 14 bp, Homo sapiens
gaagcccaggagga

SEQ ID NO: 209222 - DNA, 19 bp, Homo sapiens
gaagccccatttgcacagg

SEQ ID NO: 209223 - DNA, 17 bp, Homo sapiens
gaagccctccttgccac

SEQ ID NO: 209224 - DNA, 23 bp, Homo sapiens
gaagcccttctaccttcctgcaa

SEQ ID NO: 209225 - DNA, 23 bp, Homo sapiens
gaagccctttgcctgtagagcca

SEQ ID NO: 209226 - DNA, 23 bp, Homo sapiens
gaagccgccaggaccgccaaaga

SEQ ID NO: 209227 - DNA, 16 bp, Homo sapiens
gaagccggagggtgtt

SEQ ID NO: 209228 - DNA, 18 bp, Homo sapiens
gaagccggcggcccaagc

SEQ ID NO: 209229 - DNA, 18 bp, Homo sapiens
gaagcctaaataaaaagt

SEQ ID NO: 209230 - DNA, 17 bp, Homo sapiens
gaagcctcatgggagtc

SEQ ID NO: 209231 - DNA, 22 bp, Homo sapiens
gaagcctcatgggagtcaggga

SEQ ID NO: 209232 - DNA, 20 bp, Homo sapiens
gaagcctcctgctgagtggt

SEQ ID NO: 209233 - DNA, 13 bp, Homo sapiens
gaagcctctggct

SEQ ID NO: 209234 - DNA, 17 bp, Homo sapiens
gaagcctctggctagag

SEQ ID NO: 209235 - DNA, 15 bp, Homo sapiens
gaagcctgcaggagt

SEQ ID NO: 209236 - DNA, 12 bp, Homo sapiens
gaagcctgtcct

SEQ ID NO: 209237 - DNA, 16 bp, Homo sapiens
gaagcctgtcctcacc

SEQ ID NO: 209238 - DNA, 15 bp, Homo sapiens
gaagccttaagccat

SEQ ID NO: 209239 - DNA, 17 bp, Homo sapiens
gaagccttaccacgcag

SEQ ID NO: 209240 - DNA, 21 bp, Homo sapiens
gaagccttgctgaactaagtt

SEQ ID NO: 209241 - DNA, 22 bp, Homo sapiens
gaagcgaacatcttcatataaa

SEQ ID NO: 209242 - DNA, 24 bp, Homo sapiens
gaagcgtctcccttggccacggcc

SEQ ID NO: 209243 - DNA, 19 bp, Homo sapiens
gaagcgtgtttctttccca

SEQ ID NO: 209244 - DNA, 18 bp, Homo sapiens
gaagctcaaggctgcagt

SEQ ID NO: 209245 - DNA, 11 bp, Homo sapiens
gaagctccagt

SEQ ID NO: 209246 - DNA, 19 bp, Homo sapiens
gaagctccagtcctgctct

SEQ ID NO: 209247 - DNA, 18 bp, Homo sapiens
gaagctgcagctggtctg

SEQ ID NO: 209248 - DNA, 15 bp, Homo sapiens
gaagctggcaggaga

SEQ ID NO: 209249 - DNA, 20 bp, Homo sapiens
gaagctgtactcagagcaga

SEQ ID NO: 209250 - DNA, 18 bp, Homo sapiens
ccaggagccccagccagc

SEQ ID NO: 209251 - DNA, 20 bp, Homo sapiens
ccaggagccccagccagccc

SEQ ID NO: 209252 - DNA, 21 bp, Homo sapiens
ccaggagccccagccagccct

SEQ ID NO: 209253 - DNA, 22 bp, Homo sapiens
ccaggagccccagccagccctt

SEQ ID NO: 209254 - DNA, 16 bp, Homo sapiens
ccaggagctagcccag

SEQ ID NO: 209255 - DNA, 20 bp, Homo sapiens
ccaggagctagcccagtccc

SEQ ID NO: 209256 - DNA, 18 bp, Homo sapiens
ccaggagctcttcaggcc

SEQ ID NO: 209257 - DNA, 17 bp, Homo sapiens
ccaggagctgagtcacc

SEQ ID NO: 209258 - DNA, 19 bp, Homo sapiens
caagtccaacctgcctgtg

SEQ ID NO: 209259 - DNA, 20 bp, Homo sapiens
caagtccatagctgagctgg

SEQ ID NO: 209260 - DNA, 17 bp, Homo sapiens
caagtcccgaggcagca

SEQ ID NO: 209261 - DNA, 18 bp, Homo sapiens
caagtctctctgtgaata

SEQ ID NO: 209262 - DNA, 22 bp, Homo sapiens
caagtctctctgtgaatacaat

SEQ ID NO: 209263 - DNA, 22 bp, Homo sapiens
caagtctctgctggcccagcca

SEQ ID NO: 209264 - DNA, 13 bp, Homo sapiens
caagtctgcagcc

SEQ ID NO: 209265 - DNA, 13 bp, Homo sapiens
caagtctgtgaaa

SEQ ID NO: 209266 - DNA, 23 bp, Homo sapiens
caagtctgtgcctggagctcctg

SEQ ID NO: 209267 - DNA, 13 bp, Homo sapiens
caagtcttcctga

SEQ ID NO: 209268 - DNA, 13 bp, Homo sapiens
caagtgaacacat

SEQ ID NO: 209269 - DNA, 14 bp, Homo sapiens
caagtgaggcaaga

SEQ ID NO: 209270 - DNA, 19 bp, Homo sapiens
caagtgaggcaagagaaat

SEQ ID NO: 209271 - DNA, 15 bp, Homo sapiens
caagtgattgaaaat

SEQ ID NO: 209272 - DNA, 14 bp, Homo sapiens
caagtgcaggctgg

SEQ ID NO: 209273 - DNA, 18 bp, Homo sapiens
caagtgctgaacagtgga

SEQ ID NO: 209274 - DNA, 20 bp, Homo sapiens
caagtgctgaacagtggagg

SEQ ID NO: 209275 - DNA, 17 bp, Homo sapiens
caagtggcatgtgctgt

SEQ ID NO: 209276 - DNA, 19 bp, Homo sapiens
caagtggctcccacaccct

SEQ ID NO: 209277 - DNA, 13 bp, Homo sapiens
caagtgggctggt

SEQ ID NO: 209278 - DNA, 14 bp, Homo sapiens
caagtggtcaggag

SEQ ID NO: 209279 - DNA, 19 bp, Homo sapiens
caagtggtttccacatgct

SEQ ID NO: 209280 - DNA, 21 bp, Homo sapiens
caagtggtttccacatgctct

SEQ ID NO: 209281 - DNA, 13 bp, Homo sapiens
caagtgtacagaa

SEQ ID NO: 209282 - DNA, 15 bp, Homo sapiens
caagtgtacagaaga

SEQ ID NO: 209283 - DNA, 13 bp, Homo sapiens
caagtgtcttcca

SEQ ID NO: 209284 - DNA, 13 bp, Homo sapiens
caagtgtgcctgc

SEQ ID NO: 209285 - DNA, 14 bp, Homo sapiens
caagtgtgcctgct

SEQ ID NO: 209286 - DNA, 23 bp, Homo sapiens
caagtgtgcctgctatccagccg

SEQ ID NO: 209287 - DNA, 20 bp, Homo sapiens
caagtgtgtgcacatgtgtg

SEQ ID NO: 209288 - DNA, 17 bp, Homo sapiens
caagtgtgtgtgcaatg

SEQ ID NO: 209289 - DNA, 15 bp, Homo sapiens
caagtgttttcacac

SEQ ID NO: 209290 - DNA, 14 bp, Homo sapiens
caagttaaataaat

SEQ ID NO: 209291 - DNA, 18 bp, Homo sapiens
caagttaacaaggaatgc

SEQ ID NO: 209292 - DNA, 22 bp, Homo sapiens
caagttaaggtatctggtatct

SEQ ID NO: 209293 - DNA, 17 bp, Homo sapiens
caagttcttcacctcta

SEQ ID NO: 209294 - DNA, 19 bp, Homo sapiens
caagttgaagactttgttt

SEQ ID NO: 209295 - DNA, 17 bp, Homo sapiens
caagttgatcatgcagg

SEQ ID NO: 209296 - DNA, 20 bp, Homo sapiens
caagttgcgacggagagaaa

SEQ ID NO: 209297 - DNA, 14 bp, Homo sapiens
caagttgtgccttt

SEQ ID NO: 209298 - DNA, 14 bp, Homo sapiens
caagtttcagacag

SEQ ID NO: 209299 - DNA, 13 bp, Homo sapiens
caagtttcagtaa

SEQ ID NO: 209300 - DNA, 17 bp, Homo sapiens
caagtttcagtaatagc

SEQ ID NO: 209301 - DNA, 12 bp, Homo sapiens
caagttttgtat

SEQ ID NO: 209302 - DNA, 20 bp, Homo sapiens
caagtttttctctcaaatga

SEQ ID NO: 209303 - DNA, 14 bp, Homo sapiens
caataaaaaagtga

SEQ ID NO: 209304 - DNA, 13 bp, Homo sapiens
caataaaccaggt

SEQ ID NO: 209305 - DNA, 18 bp, Homo sapiens
caataaacgaaacacaga

SEQ ID NO: 209306 - DNA, 21 bp, Homo sapiens
caataaagaaaaaaatagttt

SEQ ID NO: 209307 - DNA, 14 bp, Homo sapiens
caataaagcactat

SEQ ID NO: 209308 - DNA, 17 bp, Homo sapiens
caataaagctggacaag

SEQ ID NO: 209309 - DNA, 22 bp, Homo sapiens
caataaagctggacaagaagct

SEQ ID NO: 209310 - DNA, 21 bp, Homo sapiens
caataaaggtcccttagcccc

SEQ ID NO: 209311 - DNA, 17 bp, Homo sapiens
caataaagtcctcttcc

SEQ ID NO: 209312 - DNA, 11 bp, Homo sapiens
caataaataat

SEQ ID NO: 209313 - DNA, 13 bp, Homo sapiens
caataaataatat

SEQ ID NO: 209314 - DNA, 17 bp, Homo sapiens
caataaataatattata

SEQ ID NO: 209315 - DNA, 23 bp, Homo sapiens
caataaataatattatattgtat

SEQ ID NO: 209316 - DNA, 15 bp, Homo sapiens
caataaatactttaa

SEQ ID NO: 209317 - DNA, 12 bp, Homo sapiens
caataaatgaat

SEQ ID NO: 209318 - DNA, 22 bp, Homo sapiens
caataactactgtgttcctggc

SEQ ID NO: 209319 - DNA, 12 bp, Homo sapiens
caataacttcag

SEQ ID NO: 209320 - DNA, 17 bp, Homo sapiens
caataagttcattaaac

SEQ ID NO: 209321 - DNA, 20 bp, Homo sapiens
caataataaaaaacaagaaa

SEQ ID NO: 209322 - DNA, 13 bp, Homo sapiens
caataataaatgt

SEQ ID NO: 209323 - DNA, 15 bp, Homo sapiens
caataataaatgtta

SEQ ID NO: 209324 - DNA, 14 bp, Homo sapiens
caataatgaataat

SEQ ID NO: 209325 - DNA, 19 bp, Homo sapiens
caataattgtggagaggag

SEQ ID NO: 209326 - DNA, 16 bp, Homo sapiens
caatacattaaaataa

SEQ ID NO: 209327 - DNA, 23 bp, Homo sapiens
caatacccctagtatctggctgg

SEQ ID NO: 209328 - DNA, 18 bp, Homo sapiens
caatactttgtgtctttt

SEQ ID NO: 209329 - DNA, 17 bp, Homo sapiens
caatacttttgtgtatt

SEQ ID NO: 209330 - DNA, 14 bp, Homo sapiens
caatagagactgta

SEQ ID NO: 209331 - DNA, 19 bp, Homo sapiens
caatagtattaactattag

SEQ ID NO: 209332 - DNA, 15 bp, Homo sapiens
caatagtgtgttctg

SEQ ID NO: 209333 - DNA, 23 bp, Homo sapiens
caatagtgtgttctgattagaaa

SEQ ID NO: 209334 - DNA, 18 bp, Homo sapiens
caatatatgatatataaa

SEQ ID NO: 209335 - DNA, 19 bp, Homo sapiens
caatatatgatatataaac

SEQ ID NO: 209336 - DNA, 18 bp, Homo sapiens
caatatattaccagcaag

SEQ ID NO: 209337 - DNA, 20 bp, Homo sapiens
caatatcattttcctgggag

SEQ ID NO: 209338 - DNA, 21 bp, Homo sapiens
caatatcattttcctgggagt

SEQ ID NO: 209339 - DNA, 17 bp, Homo sapiens
caatatgagtaatgttt

SEQ ID NO: 209340 - DNA, 21 bp, Homo sapiens
cctcacctggcttcccaggac

SEQ ID NO: 209341 - DNA, 24 bp, Homo sapiens
cctcacctggcttcccaggaccct

SEQ ID NO: 209342 - DNA, 21 bp, Homo sapiens
cctcaccttgcaacacacaga

SEQ ID NO: 209343 - DNA, 21 bp, Homo sapiens
cctcacctttcccacagtctc

SEQ ID NO: 209344 - DNA, 14 bp, Homo sapiens
cctcacgctctgga

SEQ ID NO: 209345 - DNA, 21 bp, Homo sapiens
cctcacggggttggctgttcc

SEQ ID NO: 209346 - DNA, 22 bp, Homo sapiens
cctcacggggttggctgttcca

SEQ ID NO: 209347 - DNA, 15 bp, Homo sapiens
cctcactccactccc

SEQ ID NO: 209348 - DNA, 19 bp, Homo sapiens
cctcactccactcccctca

SEQ ID NO: 209349 - DNA, 18 bp, Homo sapiens
cctcactctgccagggca

SEQ ID NO: 209350 - DNA, 14 bp, Homo sapiens
cctcactgcccgca

SEQ ID NO: 209351 - DNA, 15 bp, Homo sapiens
cctcactgcccgcac

SEQ ID NO: 209352 - DNA, 16 bp, Homo sapiens
cctcactgcccgcaca

SEQ ID NO: 209353 - DNA, 23 bp, Homo sapiens
cctcactgccctccctcggcccc

SEQ ID NO: 209354 - DNA, 21 bp, Homo sapiens
cctcactgctggggagtccct

SEQ ID NO: 209355 - DNA, 14 bp, Homo sapiens
cctcactgggtggg

SEQ ID NO: 209356 - DNA, 15 bp, Homo sapiens
cctcactggtgcatt

SEQ ID NO: 209357 - DNA, 16 bp, Homo sapiens
cctcactggtgcattt

SEQ ID NO: 209358 - DNA, 22 bp, Homo sapiens
cctcactgtcagcgtttctcca

SEQ ID NO: 209359 - DNA, 16 bp, Homo sapiens
cctcactgttgaattt

SEQ ID NO: 209360 - DNA, 14 bp, Homo sapiens
cctcacttgaatgt

SEQ ID NO: 209361 - DNA, 14 bp, Homo sapiens
cctcacttggggga

SEQ ID NO: 209362 - DNA, 15 bp, Homo sapiens
cctcagaaagtcacc

SEQ ID NO: 209363 - DNA, 15 bp, Homo sapiens
cctcagaacaccctg

SEQ ID NO: 209364 - DNA, 14 bp, Homo sapiens
cctcagaccaactc

SEQ ID NO: 209365 - DNA, 20 bp, Homo sapiens
cctcagacgggctgagagga

SEQ ID NO: 209366 - DNA, 15 bp, Homo sapiens
cctcagactcattgt

SEQ ID NO: 209367 - DNA, 11 bp, Homo sapiens
cctcagagaca

SEQ ID NO: 209368 - DNA, 12 bp, Homo sapiens
cctcagagacag

SEQ ID NO: 209369 - DNA, 18 bp, Homo sapiens
cctcagagtccaggcccc

SEQ ID NO: 209370 - DNA, 22 bp, Homo sapiens
cctcagcaacctgtaagactga

SEQ ID NO: 209371 - DNA, 17 bp, Homo sapiens
cctcagccagctgccca

SEQ ID NO: 209372 - DNA, 16 bp, Homo sapiens
cctcagccattcactg

SEQ ID NO: 209373 - DNA, 23 bp, Homo sapiens
cctcagccattcactgcccccag

SEQ ID NO: 209374 - DNA, 14 bp, Homo sapiens
cctcagccccaggg

SEQ ID NO: 209375 - DNA, 15 bp, Homo sapiens
cctcagccccagggc

SEQ ID NO: 209376 - DNA, 20 bp, Homo sapiens
cctcagccccagggccctgc

SEQ ID NO: 209377 - DNA, 23 bp, Homo sapiens
cctcagcccctcttgccccccac

SEQ ID NO: 209378 - DNA, 13 bp, Homo sapiens
cctcagcccttgc

SEQ ID NO: 209379 - DNA, 22 bp, Homo sapiens
cctcagcccttgcccccatccc

SEQ ID NO: 209380 - DNA, 15 bp, Homo sapiens
cctcagcctcctgag

SEQ ID NO: 209381 - DNA, 16 bp, Homo sapiens
cctcagcgctccctgt

SEQ ID NO: 209382 - DNA, 14 bp, Homo sapiens
cctcagcgctgccc

SEQ ID NO: 209383 - DNA, 15 bp, Homo sapiens
cctcagcgctgccca

SEQ ID NO: 209384 - DNA, 16 bp, Homo sapiens
cctcagcgctgcccac

SEQ ID NO: 209385 - DNA, 20 bp, Homo sapiens
cctcagcgctgcccacacca

SEQ ID NO: 209386 - DNA, 20 bp, Homo sapiens
cctcagctctgggagaggat

SEQ ID NO: 209387 - DNA, 13 bp, Homo sapiens
cctcagctgcaca

SEQ ID NO: 209388 - DNA, 17 bp, Homo sapiens
cctcagctgccaagcac

SEQ ID NO: 209389 - DNA, 22 bp, Homo sapiens
ctttgcagggagaccaggcttc

SEQ ID NO: 209390 - DNA, 20 bp, Homo sapiens
ctttgcagttggactctcag

SEQ ID NO: 209391 - DNA, 21 bp, Homo sapiens
ctttgcagttggactctcagg

SEQ ID NO: 209392 - DNA, 23 bp, Homo sapiens
ctttgcagttggactctcaggga

SEQ ID NO: 209393 - DNA, 21 bp, Homo sapiens
ctttgcatggaatttgtaagt

SEQ ID NO: 209394 - DNA, 13 bp, Homo sapiens
ctttgcatgttct

SEQ ID NO: 209395 - DNA, 17 bp, Homo sapiens
ctttgccaaggctctcc

SEQ ID NO: 209396 - DNA, 20 bp, Homo sapiens
ctttgccagcttttcctccc

SEQ ID NO: 209397 - DNA, 19 bp, Homo sapiens
ctttgccatgggcctgctg

SEQ ID NO: 209398 - DNA, 17 bp, Homo sapiens
ctttgcccaacctcagc

SEQ ID NO: 209399 - DNA, 21 bp, Homo sapiens
ctttgcccagggtcctgtgcc

SEQ ID NO: 209400 - DNA, 21 bp, Homo sapiens
ctttgcctgtagagccagcct

SEQ ID NO: 209401 - DNA, 22 bp, Homo sapiens
ctttgccttccacgctgtctcc

SEQ ID NO: 209402 - DNA, 21 bp, Homo sapiens
ctttgccttgatgttgtgttg

SEQ ID NO: 209403 - DNA, 16 bp, Homo sapiens
ctttgccttgggctgc

SEQ ID NO: 209404 - DNA, 17 bp, Homo sapiens
ctttgctacgaagaaag

SEQ ID NO: 209405 - DNA, 21 bp, Homo sapiens
ctttgctcagtggatcacaca

SEQ ID NO: 209406 - DNA, 18 bp, Homo sapiens
ctttgctcccagtttctt

SEQ ID NO: 209407 - DNA, 13 bp, Homo sapiens
ctttgctctgggt

SEQ ID NO: 209408 - DNA, 18 bp, Homo sapiens
ctttgctgaatgtcatta

SEQ ID NO: 209409 - DNA, 11 bp, Homo sapiens
ctttgctgccc

SEQ ID NO: 209410 - DNA, 18 bp, Homo sapiens
ctttgctggaaaatctgt

SEQ ID NO: 209411 - DNA, 21 bp, Homo sapiens
ctttgctggagtcctgttctc

SEQ ID NO: 209412 - DNA, 17 bp, Homo sapiens
ctttgctgtgaggctgt

SEQ ID NO: 209413 - DNA, 14 bp, Homo sapiens
ctttgctgtgccaa

SEQ ID NO: 209414 - DNA, 15 bp, Homo sapiens
ctttgctgtttatat

SEQ ID NO: 209415 - DNA, 15 bp, Homo sapiens
ctttgcttcccattg

SEQ ID NO: 209416 - DNA, 20 bp, Homo sapiens
ctttgcttctttttcttacc

SEQ ID NO: 209417 - DNA, 23 bp, Homo sapiens
ctttggaatgactataaacatta

SEQ ID NO: 209418 - DNA, 17 bp, Homo sapiens
ctttggacgcacacagc

SEQ ID NO: 209419 - DNA, 20 bp, Homo sapiens
ctttggctcgggacttcaaa

SEQ ID NO: 209420 - DNA, 13 bp, Homo sapiens
ctttgggaggctg

SEQ ID NO: 209421 - DNA, 17 bp, Homo sapiens
ctttgggatcagcctcc

SEQ ID NO: 209422 - DNA, 14 bp, Homo sapiens
ctttgggctgccct

SEQ ID NO: 209423 - DNA, 15 bp, Homo sapiens
ctttgggctgccctg

SEQ ID NO: 209424 - DNA, 19 bp, Homo sapiens
ctttgggctttgcaggctc

SEQ ID NO: 209425 - DNA, 22 bp, Homo sapiens
ctttggggacagttggcagaga

SEQ ID NO: 209426 - DNA, 24 bp, Homo sapiens
ctttggggacagttggcagagaag

SEQ ID NO: 209427 - DNA, 18 bp, Homo sapiens
ctttgggggattcaaatg

SEQ ID NO: 209428 - DNA, 20 bp, Homo sapiens
ctttgggggattcaaatgca

SEQ ID NO: 209429 - DNA, 22 bp, Homo sapiens
ctttgggggattcaaatgcatg

SEQ ID NO: 209430 - DNA, 23 bp, Homo sapiens
ctttggtcctaagtccctgcccc

SEQ ID NO: 209431 - DNA, 14 bp, Homo sapiens
ctttggtgaataac

SEQ ID NO: 209432 - DNA, 14 bp, Homo sapiens
ctttggtggcccct

SEQ ID NO: 209433 - DNA, 23 bp, Homo sapiens
ctttggtggcccctccccaactc

SEQ ID NO: 209434 - DNA, 13 bp, Homo sapiens
ctttggttttact

SEQ ID NO: 209435 - DNA, 16 bp, Homo sapiens
ctttgtaaggacttgt

SEQ ID NO: 209436 - DNA, 20 bp, Homo sapiens
ctttgtaaggacttgtgcct

SEQ ID NO: 209437 - DNA, 14 bp, Homo sapiens
ctttgtagcttaaa

SEQ ID NO: 209438 - DNA, 22 bp, Homo sapiens
ctttgtattctctgtccagggc

SEQ ID NO: 209439 - DNA, 23 bp, Homo sapiens
ctttgtcacagggtgttggaaga

SEQ ID NO: 209440 - DNA, 15 bp, Homo sapiens
ctttgtcacttctgc

SEQ ID NO: 209441 - DNA, 17 bp, Homo sapiens
ctttgtcacttctgctg

SEQ ID NO: 209442 - DNA, 15 bp, Homo sapiens
ctttgtccatttacc

SEQ ID NO: 209443 - DNA, 16 bp, Homo sapiens
ctttgtcccacagctt

SEQ ID NO: 209444 - DNA, 14 bp, Homo sapiens
ctttgtcccatttc

SEQ ID NO: 209445 - DNA, 21 bp, Homo sapiens
ctttgtcccctcacctccacc

SEQ ID NO: 209446 - DNA, 15 bp, Homo sapiens
ctttgtctcaccagc

SEQ ID NO: 209447 - DNA, 21 bp, Homo sapiens
ctttgtctcaccagctcagcc

SEQ ID NO: 209448 - DNA, 16 bp, Homo sapiens
ctttgtgcaaaagcag

SEQ ID NO: 209449 - DNA, 13 bp, Homo sapiens
ctttgtgcctttg

SEQ ID NO: 209450 - DNA, 14 bp, Homo sapiens
ctttgtgcttgggg

SEQ ID NO: 209451 - DNA, 17 bp, Homo sapiens
ctttgtgcttggggcta

SEQ ID NO: 209452 - DNA, 15 bp, Homo sapiens
ctttgtgcttgttct

SEQ ID NO: 209453 - DNA, 13 bp, Homo sapiens
ctttgtggacttt

SEQ ID NO: 209454 - DNA, 14 bp, Homo sapiens
ctttgtggcagtgg

SEQ ID NO: 209455 - DNA, 15 bp, Homo sapiens
ctttgtggcagtggc

SEQ ID NO: 209456 - DNA, 16 bp, Homo sapiens
ctttgtggggcttggc

SEQ ID NO: 209457 - DNA, 22 bp, Homo sapiens
ctttgtgtaataaaaatttgtt

SEQ ID NO: 209458 - DNA, 12 bp, Homo sapiens
ctttgtgtgctg

SEQ ID NO: 209459 - DNA, 18 bp, Homo sapiens
ctttgttaatgaaaatga

SEQ ID NO: 209460 - DNA, 21 bp, Homo sapiens
ctttgttacactgttattttc

SEQ ID NO: 209461 - DNA, 15 bp, Homo sapiens
ctttgttacaggcac

SEQ ID NO: 209462 - DNA, 20 bp, Homo sapiens
ctttgttatttttgtttctt

SEQ ID NO: 209463 - DNA, 20 bp, Homo sapiens
ctttgttcctgctttctctt

SEQ ID NO: 209464 - DNA, 17 bp, Homo sapiens
ctttgttggcccttcca

SEQ ID NO: 209465 - DNA, 13 bp, Homo sapiens
ctttgtttccaga

SEQ ID NO: 209466 - DNA, 19 bp, Homo sapiens
ctttgtttccagaaattct

SEQ ID NO: 209467 - DNA, 15 bp, Homo sapiens
ctttgtttccttgtt

SEQ ID NO: 209468 - DNA, 13 bp, Homo sapiens
ctttgtttctcat

SEQ ID NO: 209469 - DNA, 22 bp, Homo sapiens
ctttgtttcttttgcttaggaa

SEQ ID NO: 209470 - DNA, 20 bp, Homo sapiens
ctttgttttcccacacatat

SEQ ID NO: 209471 - DNA, 21 bp, Homo sapiens
ctttgtttttttttcctgtcc

SEQ ID NO: 209472 - DNA, 18 bp, Homo sapiens
cttttaaaaaaataatat

SEQ ID NO: 209473 - DNA, 18 bp, Homo sapiens
cttttaaaacacttccat

SEQ ID NO: 209474 - DNA, 19 bp, Homo sapiens
cttttaaactggagaggct

SEQ ID NO: 209475 - DNA, 14 bp, Homo sapiens
cttttaaatggcat

SEQ ID NO: 209476 - DNA, 19 bp, Homo sapiens
cttttaaatgggtgaaaaa

SEQ ID NO: 209477 - DNA, 14 bp, Homo sapiens
cttttaaattcttt

SEQ ID NO: 209478 - DNA, 22 bp, Homo sapiens
cttttaacgtatgtatttcatt

SEQ ID NO: 209479 - DNA, 19 bp, Homo sapiens
cttttaagatgtgtcttca

SEQ ID NO: 209480 - DNA, 20 bp, Homo sapiens
cttttaagatgtgtcttcaa

SEQ ID NO: 209481 - DNA, 14 bp, Homo sapiens
cttttaataaaatt

SEQ ID NO: 209482 - DNA, 19 bp, Homo sapiens
cttttaatgatactgtcta

SEQ ID NO: 209483 - DNA, 13 bp, Homo sapiens
cttttacaaaaca

SEQ ID NO: 209484 - DNA, 22 bp, Homo sapiens
ccagaggagctgggagccgggc

SEQ ID NO: 209485 - DNA, 15 bp, Homo sapiens
ccagaggcacagccg

SEQ ID NO: 209486 - DNA, 21 bp, Homo sapiens
ccagaggcagctaaggggcag

SEQ ID NO: 209487 - DNA, 13 bp, Homo sapiens
ccagagggaccag

SEQ ID NO: 209488 - DNA, 18 bp, Homo sapiens
ccagagggaccagctggg

SEQ ID NO: 209489 - DNA, 17 bp, Homo sapiens
ccagaggggcggggcca

SEQ ID NO: 209490 - DNA, 16 bp, Homo sapiens
ccagaggtgggaggcc

SEQ ID NO: 209491 - DNA, 20 bp, Homo sapiens
ccagaggtgggaggcccctg

SEQ ID NO: 209492 - DNA, 21 bp, Homo sapiens
ccagaggtgggaggcccctgg

SEQ ID NO: 209493 - DNA, 20 bp, Homo sapiens
ccagaggtggggaagagagc

SEQ ID NO: 209494 - DNA, 22 bp, Homo sapiens
ccagaggttatctgcctggcct

SEQ ID NO: 209495 - DNA, 23 bp, Homo sapiens
ccagagtagggttgccagtcctg

SEQ ID NO: 209496 - DNA, 21 bp, Homo sapiens
ccagagtaggtgggtcttgga

SEQ ID NO: 209497 - DNA, 17 bp, Homo sapiens
ccagagtccggaggcag

SEQ ID NO: 209498 - DNA, 18 bp, Homo sapiens
ccagagtccggaggcagc

SEQ ID NO: 209499 - DNA, 14 bp, Homo sapiens
ccagagtctgagcc

SEQ ID NO: 209500 - DNA, 15 bp, Homo sapiens
ccagagtctgagccc

SEQ ID NO: 209501 - DNA, 22 bp, Homo sapiens
ccagagtgaaagggctatggca

SEQ ID NO: 209502 - DNA, 16 bp, Homo sapiens
ccagagtggcctggcc

SEQ ID NO: 209503 - DNA, 17 bp, Homo sapiens
ccagagtggcctggcca

SEQ ID NO: 209504 - DNA, 22 bp, Homo sapiens
ccagagtggcctggccaggagc

SEQ ID NO: 209505 - DNA, 23 bp, Homo sapiens
ccagagtggcctggccaggagct

SEQ ID NO: 209506 - DNA, 21 bp, Homo sapiens
ccagatcaccagcccggcctg

SEQ ID NO: 209507 - DNA, 22 bp, Homo sapiens
ccagatcgttctgccacttgca

SEQ ID NO: 209508 - DNA, 22 bp, Homo sapiens
ccagatgagaagttaagcagcc

SEQ ID NO: 209509 - DNA, 23 bp, Homo sapiens
ccagatgcctcctctgtcctcat

SEQ ID NO: 209510 - DNA, 20 bp, Homo sapiens
ccagatgccttctagattca

SEQ ID NO: 209511 - DNA, 21 bp, Homo sapiens
ccagatgttgttcctggctag

SEQ ID NO: 209512 - DNA, 10 bp, Homo sapiens
ccagcaaaat

SEQ ID NO: 209513 - DNA, 18 bp, Homo sapiens
ccagcaaaccaggactct

SEQ ID NO: 209514 - DNA, 18 bp, Homo sapiens
ccagcaaagttttcagat

SEQ ID NO: 209515 - DNA, 19 bp, Homo sapiens
ccagcaacatctcgagccc

SEQ ID NO: 209516 - DNA, 17 bp, Homo sapiens
ccagcaagtcccagaca

SEQ ID NO: 209517 - DNA, 17 bp, Homo sapiens
ccagcaatgatgtccag

SEQ ID NO: 209518 - DNA, 18 bp, Homo sapiens
ctgtgctgggccagtggc

SEQ ID NO: 209519 - DNA, 14 bp, Homo sapiens
ctgtgctgtgcctg

SEQ ID NO: 209520 - DNA, 19 bp, Homo sapiens
ctgtgctgtgcctgctaga

SEQ ID NO: 209521 - DNA, 13 bp, Homo sapiens
ctgtgctgttgtc

SEQ ID NO: 209522 - DNA, 17 bp, Homo sapiens
ctgtgctgttgtctgcc

SEQ ID NO: 209523 - DNA, 20 bp, Homo sapiens
ctgtgcttgctcctaagcaa

SEQ ID NO: 209524 - DNA, 13 bp, Homo sapiens
ctgtggaacacta

SEQ ID NO: 209525 - DNA, 15 bp, Homo sapiens
ctgtggacactgtgg

SEQ ID NO: 209526 - DNA, 17 bp, Homo sapiens
ctgtggagaatgtacac

SEQ ID NO: 209527 - DNA, 19 bp, Homo sapiens
ctgtggagcaaaaggcagc

SEQ ID NO: 209528 - DNA, 23 bp, Homo sapiens
ctgtggagcaaaaggcagctcac

SEQ ID NO: 209529 - DNA, 13 bp, Homo sapiens
ctgtggaggcctg

SEQ ID NO: 209530 - DNA, 18 bp, Homo sapiens
ctgtggaggcctgatgct

SEQ ID NO: 209531 - DNA, 21 bp, Homo sapiens
ctgtggaggcctgatgctgcc

SEQ ID NO: 209532 - DNA, 22 bp, Homo sapiens
ctgtggaggcctgatgctgccc

SEQ ID NO: 209533 - DNA, 13 bp, Homo sapiens
ctgtggaggtggc

SEQ ID NO: 209534 - DNA, 15 bp, Homo sapiens
ctgtggattctatat

SEQ ID NO: 209535 - DNA, 17 bp, Homo sapiens
ctgtggattctatattt

SEQ ID NO: 209536 - DNA, 15 bp, Homo sapiens
ctgtggcacagactt

SEQ ID NO: 209537 - DNA, 21 bp, Homo sapiens
ctgtggcagaaaagaggagac

SEQ ID NO: 209538 - DNA, 19 bp, Homo sapiens
ctgtggcaggccagctgtg

SEQ ID NO: 209539 - DNA, 12 bp, Homo sapiens
ctgtggccagag

SEQ ID NO: 209540 - DNA, 15 bp, Homo sapiens
ctgtggccagagcac

SEQ ID NO: 209541 - DNA, 14 bp, Homo sapiens
ctgtggccagagct

SEQ ID NO: 209542 - DNA, 13 bp, Homo sapiens
ctgtggcccctcc

SEQ ID NO: 209543 - DNA, 21 bp, Homo sapiens
ctgtggcccctccttctcccc

SEQ ID NO: 209544 - DNA, 18 bp, Homo sapiens
ctgtggccgtctcctccc

SEQ ID NO: 209545 - DNA, 20 bp, Homo sapiens
ctgtggccgtctcctccctc

SEQ ID NO: 209546 - DNA, 16 bp, Homo sapiens
ctgtggcctcaggagg

SEQ ID NO: 209547 - DNA, 19 bp, Homo sapiens
ctgtggcctcaggaggcag

SEQ ID NO: 209548 - DNA, 15 bp, Homo sapiens
ctgtggcctctcagt

SEQ ID NO: 209549 - DNA, 18 bp, Homo sapiens
ctgtggcctctcagtcaa

SEQ ID NO: 209550 - DNA, 16 bp, Homo sapiens
ctgtggcctgtgtcca

SEQ ID NO: 209551 - DNA, 21 bp, Homo sapiens
ctgtggcctgtgtccagcagc

SEQ ID NO: 209552 - DNA, 22 bp, Homo sapiens
ctgtggcctgtgtccagcagct

SEQ ID NO: 209553 - DNA, 15 bp, Homo sapiens
ctgtggccttggtct

SEQ ID NO: 209554 - DNA, 14 bp, Homo sapiens
ctgtggctgggtgg

SEQ ID NO: 209555 - DNA, 20 bp, Homo sapiens
ctgtggctgggtggtcagca

SEQ ID NO: 209556 - DNA, 18 bp, Homo sapiens
ctgtgggagaagggacag

SEQ ID NO: 209557 - DNA, 13 bp, Homo sapiens
ctgtgggagtcca

SEQ ID NO: 209558 - DNA, 14 bp, Homo sapiens
ctgtgggagtccac

SEQ ID NO: 209559 - DNA, 15 bp, Homo sapiens
ctgtgggagtccact

SEQ ID NO: 209560 - DNA, 19 bp, Homo sapiens
ctgtgggagtccactttcc

SEQ ID NO: 209561 - DNA, 20 bp, Homo sapiens
ctgtgggcaggtgggagctt

SEQ ID NO: 209562 - DNA, 14 bp, Homo sapiens
ctgtgggcctcaag

SEQ ID NO: 209563 - DNA, 16 bp, Homo sapiens
ctgtgggcttggcctt

SEQ ID NO: 209564 - DNA, 19 bp, Homo sapiens
ctgtgggcttggccttgtg

SEQ ID NO: 209565 - DNA, 14 bp, Homo sapiens
ctgtggggagctgg

SEQ ID NO: 209566 - DNA, 17 bp, Homo sapiens
ctgtggggcaagcctga

SEQ ID NO: 209567 - DNA, 20 bp, Homo sapiens
ctgtggggcaagcctgagtg

SEQ ID NO: 209568 - DNA, 14 bp, Homo sapiens
ctgtggggccacac

SEQ ID NO: 209569 - DNA, 22 bp, Homo sapiens
ctgtgggtgaagacagagggaa

SEQ ID NO: 209570 - DNA, 13 bp, Homo sapiens
ctgtgggtgggga

SEQ ID NO: 209571 - DNA, 15 bp, Homo sapiens
ctgtgggtggggaag

SEQ ID NO: 209572 - DNA, 14 bp, Homo sapiens
ctgtggtaccctgg

SEQ ID NO: 209573 - DNA, 18 bp, Homo sapiens
ctgtggtaccctggcaga

SEQ ID NO: 209574 - DNA, 23 bp, Homo sapiens
ctgtggtagtactcctgcaaaat

SEQ ID NO: 209575 - DNA, 18 bp, Homo sapiens
ctgtggtccagaagaaat

SEQ ID NO: 209576 - DNA, 19 bp, Homo sapiens
ctgtggtgaagtgtggctg

SEQ ID NO: 209577 - DNA, 24 bp, Homo sapiens
ctgtggtgaagtgtggctggtgtc

SEQ ID NO: 209578 - DNA, 14 bp, Homo sapiens
ctgtggtgatctgt

SEQ ID NO: 209579 - DNA, 14 bp, Homo sapiens
ctgtggttacagtg

SEQ ID NO: 209580 - DNA, 23 bp, Homo sapiens
ctgtggttacagtgcagacaggc

SEQ ID NO: 209581 - DNA, 20 bp, Homo sapiens
ctgtggttcctaagcctgtt

SEQ ID NO: 209582 - DNA, 16 bp, Homo sapiens
ctgtggttttcccctc

SEQ ID NO: 209583 - DNA, 14 bp, Homo sapiens
ctgtgtaaataaac

SEQ ID NO: 209584 - DNA, 21 bp, Homo sapiens
ctgtgtaaatatttttccctc

SEQ ID NO: 209585 - DNA, 15 bp, Homo sapiens
ctgtgtaactgccca

SEQ ID NO: 209586 - DNA, 17 bp, Homo sapiens
ctgtgtaatctctgatt

SEQ ID NO: 209587 - DNA, 12 bp, Homo sapiens
ctgtgtatttct

SEQ ID NO: 209588 - DNA, 21 bp, Homo sapiens
ctgtgtatttctgtagaatgc

SEQ ID NO: 209589 - DNA, 15 bp, Homo sapiens
ctgtgtcatctgtca

SEQ ID NO: 209590 - DNA, 22 bp, Homo sapiens
ctgtgtccacatctaacaaagt

SEQ ID NO: 209591 - DNA, 15 bp, Homo sapiens
ctgtgtcccagcacc

SEQ ID NO: 209592 - DNA, 17 bp, Homo sapiens
ctgtgtcccctgacctg

SEQ ID NO: 209593 - DNA, 21 bp, Homo sapiens
ctgtgtcccctgacctgtcca

SEQ ID NO: 209594 - DNA, 19 bp, Homo sapiens
ctgtgtctcccttcatcct

SEQ ID NO: 209595 - DNA, 16 bp, Homo sapiens
ctgtgtctgtgtttta

SEQ ID NO: 209596 - DNA, 11 bp, Homo sapiens
ctgtgtcttta

SEQ ID NO: 209597 - DNA, 21 bp, Homo sapiens
ctgtgtgagcgtgtccacaga

SEQ ID NO: 209598 - DNA, 16 bp, Homo sapiens
ctgtgtgatgaacttt

SEQ ID NO: 209599 - DNA, 15 bp, Homo sapiens
ctgtgtgcagtgaag

SEQ ID NO: 209600 - DNA, 13 bp, Homo sapiens
ctgtgtggaccat

SEQ ID NO: 209601 - DNA, 12 bp, Homo sapiens
ctgtgtggagag

SEQ ID NO: 209602 - DNA, 15 bp, Homo sapiens
ctgtgtggagaggga

SEQ ID NO: 209603 - DNA, 22 bp, Homo sapiens
ctgtgtggagagggaatgtgaa

SEQ ID NO: 209604 - DNA, 23 bp, Homo sapiens
ctgtgtggagagggaatgtgaaa

SEQ ID NO: 209605 - DNA, 15 bp, Homo sapiens
ctgtgtggcaaacat

SEQ ID NO: 209606 - DNA, 18 bp, Homo sapiens
ctgtgtggcaaacattta

SEQ ID NO: 209607 - DNA, 11 bp, Homo sapiens
ctgtgtggttg

SEQ ID NO: 209608 - DNA, 12 bp, Homo sapiens
ctgtgtgtctgg

SEQ ID NO: 209609 - DNA, 21 bp, Homo sapiens
ctgtgtgtggaaggcacccgc

SEQ ID NO: 209610 - DNA, 18 bp, Homo sapiens
ctgtgtgttcttttgata

SEQ ID NO: 209611 - DNA, 20 bp, Homo sapiens
ctgtgtgttcttttgataca

SEQ ID NO: 209612 - DNA, 19 bp, Homo sapiens
ctgtgtgttgccacaggac

SEQ ID NO: 209613 - DNA, 16 bp, Homo sapiens
ctgtgtgttttcataa

SEQ ID NO: 209614 - DNA, 18 bp, Homo sapiens
ctgtgtgttttcataata

SEQ ID NO: 209615 - DNA, 16 bp, Homo sapiens
ctgtgttagtgtctgt

SEQ ID NO: 209616 - DNA, 17 bp, Homo sapiens
ctgtgttagtgtctgtc

SEQ ID NO: 209617 - DNA, 18 bp, Homo sapiens
ctgtgttagtgtctgtcc

SEQ ID NO: 209618 - DNA, 20 bp, Homo sapiens
ctgtgttagtgtctgtccat

SEQ ID NO: 209619 - DNA, 18 bp, Homo sapiens
ctgtgttcacactgtaaa

SEQ ID NO: 209620 - DNA, 17 bp, Homo sapiens
ctgtgttcttgctgagc

SEQ ID NO: 209621 - DNA, 17 bp, Homo sapiens
ctgtgttgactgctgct

SEQ ID NO: 209622 - DNA, 20 bp, Homo sapiens
ctgtgttgactgctgctccc

SEQ ID NO: 209623 - DNA, 22 bp, Homo sapiens
ctgtgttgactgctgctcccca

SEQ ID NO: 209624 - DNA, 19 bp, Homo sapiens
ctgtgttggggggcaaggt

SEQ ID NO: 209625 - DNA, 19 bp, Homo sapiens
ctgtgttgtctctagagca

SEQ ID NO: 209626 - DNA, 20 bp, Homo sapiens
ctgtgtttaatagtatatct

SEQ ID NO: 209627 - DNA, 15 bp, Homo sapiens
ctgtgtttgttccta

SEQ ID NO: 209628 - DNA, 13 bp, Homo sapiens
ctgtgttttgtga

SEQ ID NO: 209629 - DNA, 21 bp, Homo sapiens
ctgttaacactgtaatatctt

SEQ ID NO: 209630 - DNA, 13 bp, Homo sapiens
ctgttaaccaaat

SEQ ID NO: 209631 - DNA, 12 bp, Homo sapiens
ctgttaaccatt

SEQ ID NO: 209632 - DNA, 16 bp, Homo sapiens
ctgttaagtggtttca

SEQ ID NO: 209633 - DNA, 21 bp, Homo sapiens
ctgttaatagtactattaaca

SEQ ID NO: 209634 - DNA, 15 bp, Homo sapiens
ctgttaattctagat

SEQ ID NO: 209635 - DNA, 16 bp, Homo sapiens
ctgttaccatgtcact

SEQ ID NO: 209636 - DNA, 20 bp, Homo sapiens
ctgttaccatgtcactgtgg

SEQ ID NO: 209637 - DNA, 19 bp, Homo sapiens
ctgttacttacctaaacag

SEQ ID NO: 209638 - DNA, 20 bp, Homo sapiens
ctgttagatgctactaagaa

SEQ ID NO: 209639 - DNA, 13 bp, Homo sapiens
ctgttagatgctg

SEQ ID NO: 209640 - DNA, 14 bp, Homo sapiens
ctgttagatgctga

SEQ ID NO: 209641 - DNA, 14 bp, Homo sapiens
ctgttagtcatttg

SEQ ID NO: 209642 - DNA, 14 bp, Homo sapiens
ctgttatctgtctt

SEQ ID NO: 209643 - DNA, 16 bp, Homo sapiens
ctgttatgccaaacag

SEQ ID NO: 209644 - DNA, 16 bp, Homo sapiens
ctgttattttcagcat

SEQ ID NO: 209645 - DNA, 17 bp, Homo sapiens
ctgttcaaaatgttaat

SEQ ID NO: 209646 - DNA, 17 bp, Homo sapiens
ctgttcaacaagagtaa

SEQ ID NO: 209647 - DNA, 17 bp, Homo sapiens
ctgttcaatgtttaatg

SEQ ID NO: 209648 - DNA, 13 bp, Homo sapiens
ctgttcactctac

SEQ ID NO: 209649 - DNA, 16 bp, Homo sapiens
ctgttcagtaacaggg

SEQ ID NO: 209650 - DNA, 16 bp, Homo sapiens
ctgttccaagtgtgtg

SEQ ID NO: 209651 - DNA, 12 bp, Homo sapiens
ctgttccagact

SEQ ID NO: 209652 - DNA, 23 bp, Homo sapiens
ctgttcccagcaaagttttcaga

SEQ ID NO: 209653 - DNA, 22 bp, Homo sapiens
catgctggacaggtctgggaga

SEQ ID NO: 209654 - DNA, 15 bp, Homo sapiens
catgctggccagcct

SEQ ID NO: 209655 - DNA, 22 bp, Homo sapiens
catgctggcctcccaataaagc

SEQ ID NO: 209656 - DNA, 18 bp, Homo sapiens
catgctggcggcgcagag

SEQ ID NO: 209657 - DNA, 20 bp, Homo sapiens
catgctggctcccagggcca

SEQ ID NO: 209658 - DNA, 22 bp, Homo sapiens
catgctggctcccagggccatg

SEQ ID NO: 209659 - DNA, 22 bp, Homo sapiens
catgctgtgctctttgaagaga

SEQ ID NO: 209660 - DNA, 18 bp, Homo sapiens
catgctgtgtaagctgtg

SEQ ID NO: 209661 - DNA, 15 bp, Homo sapiens
catgctgttggcctc

SEQ ID NO: 209662 - DNA, 14 bp, Homo sapiens
catgctttctcctt

SEQ ID NO: 209663 - DNA, 16 bp, Homo sapiens
catggaaaatgtcctg

SEQ ID NO: 209664 - DNA, 18 bp, Homo sapiens
catggaaacctgaaaaaa

SEQ ID NO: 209665 - DNA, 14 bp, Homo sapiens
catggacagggcca

SEQ ID NO: 209666 - DNA, 15 bp, Homo sapiens
catggacagggccag

SEQ ID NO: 209667 - DNA, 18 bp, Homo sapiens
catggacatgatcttctt

SEQ ID NO: 209668 - DNA, 13 bp, Homo sapiens
catggacgcctgg

SEQ ID NO: 209669 - DNA, 22 bp, Homo sapiens
catggactctgggtttcatatc

SEQ ID NO: 209670 - DNA, 24 bp, Homo sapiens
catggactctgggtttcatatcca

SEQ ID NO: 209671 - DNA, 22 bp, Homo sapiens
catggaggagacgtccaccctg

SEQ ID NO: 209672 - DNA, 18 bp, Homo sapiens
catggagtgtgtattgtt

SEQ ID NO: 209673 - DNA, 22 bp, Homo sapiens
catggagtgtgtattgttccca

SEQ ID NO: 209674 - DNA, 14 bp, Homo sapiens
catggagtgtttga

SEQ ID NO: 209675 - DNA, 21 bp, Homo sapiens
catggagtgtttgacgaagaa

SEQ ID NO: 209676 - DNA, 16 bp, Homo sapiens
catggatgcatgccct

SEQ ID NO: 209677 - DNA, 19 bp, Homo sapiens
catggattccaaagcattt

SEQ ID NO: 209678 - DNA, 22 bp, Homo sapiens
catggattccaaagcattttca

SEQ ID NO: 209679 - DNA, 14 bp, Homo sapiens
catggattgattaa

SEQ ID NO: 209680 - DNA, 13 bp, Homo sapiens
catggatttggtt

SEQ ID NO: 209681 - DNA, 14 bp, Homo sapiens
catggattttggat

SEQ ID NO: 209682 - DNA, 19 bp, Homo sapiens
catggcaagagagaaagaa

SEQ ID NO: 209683 - DNA, 17 bp, Homo sapiens
catggcaccagccccct

SEQ ID NO: 209684 - DNA, 20 bp, Homo sapiens
catggcaccagccccctgga

SEQ ID NO: 209685 - DNA, 22 bp, Homo sapiens
catggcaccagccccctggatg

SEQ ID NO: 209686 - DNA, 17 bp, Homo sapiens
catggcagaagcgtctc

SEQ ID NO: 209687 - DNA, 14 bp, Homo sapiens
catggcatgtgaaa

SEQ ID NO: 209688 - DNA, 15 bp, Homo sapiens
catggccaaggggcc

SEQ ID NO: 209689 - DNA, 19 bp, Homo sapiens
catggccaaggggccagct

SEQ ID NO: 209690 - DNA, 13 bp, Homo sapiens
catggccacatcc

SEQ ID NO: 209691 - DNA, 12 bp, Homo sapiens
catggccacccc

SEQ ID NO: 209692 - DNA, 19 bp, Homo sapiens
catggccaccccgtgccac

SEQ ID NO: 209693 - DNA, 13 bp, Homo sapiens
catggccaggtgg

SEQ ID NO: 209694 - DNA, 14 bp, Homo sapiens
catggccaggtggc

SEQ ID NO: 209695 - DNA, 12 bp, Homo sapiens
catggcccagca

SEQ ID NO: 209696 - DNA, 13 bp, Homo sapiens
catggcccagcag

SEQ ID NO: 209697 - DNA, 15 bp, Homo sapiens
catggcccagcagct

SEQ ID NO: 209698 - DNA, 19 bp, Homo sapiens
catggcccagcctggagcc

SEQ ID NO: 209699 - DNA, 12 bp, Homo sapiens
catggccccagc

SEQ ID NO: 209700 - DNA, 13 bp, Homo sapiens
catggccccagct

SEQ ID NO: 209701 - DNA, 15 bp, Homo sapiens
catggccccagctgg

SEQ ID NO: 209702 - DNA, 17 bp, Homo sapiens
catggccccagctggct

SEQ ID NO: 209703 - DNA, 15 bp, Homo sapiens
catggcccctccagg

SEQ ID NO: 209704 - DNA, 17 bp, Homo sapiens
catggcccctccaggaa

SEQ ID NO: 209705 - DNA, 21 bp, Homo sapiens
catggcctattatattaaaat

SEQ ID NO: 209706 - DNA, 13 bp, Homo sapiens
catggcctcccag

SEQ ID NO: 209707 - DNA, 23 bp, Homo sapiens
catggcctctaagagtgcccgtg

SEQ ID NO: 209708 - DNA, 15 bp, Homo sapiens
catggcctgtgctgg

SEQ ID NO: 209709 - DNA, 22 bp, Homo sapiens
catggcctgtgctgggccagtg

SEQ ID NO: 209710 - DNA, 12 bp, Homo sapiens
catggccttccc

SEQ ID NO: 209711 - DNA, 19 bp, Homo sapiens
catggcctttgcttgaaag

SEQ ID NO: 209712 - DNA, 22 bp, Homo sapiens
catggcctttgcttgaaagaaa

SEQ ID NO: 209713 - DNA, 18 bp, Homo sapiens
catggcgtaatgggcctg

SEQ ID NO: 209714 - DNA, 19 bp, Homo sapiens
catggcgtaatgggcctgc

SEQ ID NO: 209715 - DNA, 23 bp, Homo sapiens
catggcgtaatgggcctgcccaa

SEQ ID NO: 209716 - DNA, 22 bp, Homo sapiens
catggctaagcttaaaaaaaac

SEQ ID NO: 209717 - DNA, 18 bp, Homo sapiens
catggctaaggcaccagc

SEQ ID NO: 209718 - DNA, 19 bp, Homo sapiens
catggctaaggcaccagcc

SEQ ID NO: 209719 - DNA, 17 bp, Homo sapiens
catggctcaaggattca

SEQ ID NO: 209720 - DNA, 17 bp, Homo sapiens
catggctcaggcaagcc

SEQ ID NO: 209721 - DNA, 18 bp, Homo sapiens
catggctcaggcaagccc

SEQ ID NO: 209722 - DNA, 13 bp, Homo sapiens
catggctccagtc

SEQ ID NO: 209723 - DNA, 15 bp, Homo sapiens
catggctccagtctg

SEQ ID NO: 209724 - DNA, 15 bp, Homo sapiens
catggcttaatgttt

SEQ ID NO: 209725 - DNA, 22 bp, Homo sapiens
catggctttcatcctgtgtccc

SEQ ID NO: 209726 - DNA, 23 bp, Homo sapiens
catgggaaactgttgtgggcgct

SEQ ID NO: 209727 - DNA, 20 bp, Homo sapiens
catgggaacgcagcctccag

SEQ ID NO: 209728 - DNA, 21 bp, Homo sapiens
catgggaacgcagcctccagt

SEQ ID NO: 209729 - DNA, 17 bp, Homo sapiens
catgggaatgaatgtca

SEQ ID NO: 209730 - DNA, 22 bp, Homo sapiens
catgggagtcagggagccctgg

SEQ ID NO: 209731 - DNA, 23 bp, Homo sapiens
catgggagtcagggagccctggg

SEQ ID NO: 209732 - DNA, 17 bp, Homo sapiens
catgggatatgtggtgt

SEQ ID NO: 209733 - DNA, 18 bp, Homo sapiens
catgggatgtctgaaatc

SEQ ID NO: 209734 - DNA, 17 bp, Homo sapiens
catgggcattgggttct

SEQ ID NO: 209735 - DNA, 19 bp, Homo sapiens
catgggcccctctgactcc

SEQ ID NO: 209736 - DNA, 17 bp, Homo sapiens
catgggccctctgagca

SEQ ID NO: 209737 - DNA, 14 bp, Homo sapiens
catgggcctgctgc

SEQ ID NO: 209738 - DNA, 23 bp, Homo sapiens
catgggcctggccacctctctcc

SEQ ID NO: 209739 - DNA, 17 bp, Homo sapiens
catgggcctgggcctgc

SEQ ID NO: 209740 - DNA, 23 bp, Homo sapiens
catgggcttggacttcctggggc

SEQ ID NO: 209741 - DNA, 21 bp, Homo sapiens
catgggggaggctctgaagag

SEQ ID NO: 209742 - DNA, 17 bp, Homo sapiens
catgggggcccctcggc

SEQ ID NO: 209743 - DNA, 18 bp, Homo sapiens
catggggtgggcctctgg

SEQ ID NO: 209744 - DNA, 20 bp, Homo sapiens
catggggttggctgggccca

SEQ ID NO: 209745 - DNA, 22 bp, Homo sapiens
catgggtgaagggagagccagc

SEQ ID NO: 209746 - DNA, 15 bp, Homo sapiens
catggtaccagccct

SEQ ID NO: 209747 - DNA, 16 bp, Homo sapiens
catggtaccagccctg

SEQ ID NO: 209748 - DNA, 17 bp, Homo sapiens
catggtaccagccctgg

SEQ ID NO: 209749 - DNA, 22 bp, Homo sapiens
catggtagcagggtctttgtgt

SEQ ID NO: 209750 - DNA, 14 bp, Homo sapiens
catggtatctcttt

SEQ ID NO: 209751 - DNA, 14 bp, Homo sapiens
catggtatttgaga

SEQ ID NO: 209752 - DNA, 14 bp, Homo sapiens
catggtcacagaga

SEQ ID NO: 209753 - DNA, 21 bp, Homo sapiens
catggtccatttcatgtgatc

SEQ ID NO: 209754 - DNA, 14 bp, Homo sapiens
catggtccctagca

SEQ ID NO: 209755 - DNA, 19 bp, Homo sapiens
catggtgaaaccccgtctc

SEQ ID NO: 209756 - DNA, 16 bp, Homo sapiens
catggtgatcagtgca

SEQ ID NO: 209757 - DNA, 15 bp, Homo sapiens
catggtgcctctgga

SEQ ID NO: 209758 - DNA, 16 bp, Homo sapiens
catggtgggagagact

SEQ ID NO: 209759 - DNA, 17 bp, Homo sapiens
catggtgtgtgtctctg

SEQ ID NO: 209760 - DNA, 18 bp, Homo sapiens
catggtgtgtgtctctga

SEQ ID NO: 209761 - DNA, 14 bp, Homo sapiens
catggttgagaaat

SEQ ID NO: 209762 - DNA, 12 bp, Homo sapiens
catgtaaaacaa

SEQ ID NO: 209763 - DNA, 15 bp, Homo sapiens
catgtaaaacaaaaa

SEQ ID NO: 209764 - DNA, 18 bp, Homo sapiens
catgtaaaacaaaaaaca

SEQ ID NO: 209765 - DNA, 14 bp, Homo sapiens
catgtaaataaata

SEQ ID NO: 209766 - DNA, 18 bp, Homo sapiens
catgtaaataccagactg

SEQ ID NO: 209767 - DNA, 14 bp, Homo sapiens
catgtaagaaataa

SEQ ID NO: 209768 - DNA, 15 bp, Homo sapiens
catgtaagaaataag

SEQ ID NO: 209769 - DNA, 12 bp, Homo sapiens
catgtaataaaa

SEQ ID NO: 209770 - DNA, 16 bp, Homo sapiens
catgtaatattaaatt

SEQ ID NO: 209771 - DNA, 21 bp, Homo sapiens
catgtacaaaatcgattggct

SEQ ID NO: 209772 - DNA, 15 bp, Homo sapiens
catgtacatgaagaa

SEQ ID NO: 209773 - DNA, 22 bp, Homo sapiens
catgtaccagtgtactgctttc

SEQ ID NO: 209774 - DNA, 13 bp, Homo sapiens
catgtactgtagt

SEQ ID NO: 209775 - DNA, 14 bp, Homo sapiens
catgtactgtagtt

SEQ ID NO: 209776 - DNA, 21 bp, Homo sapiens
catgtagaactcagcagttga

SEQ ID NO: 209777 - DNA, 23 bp, Homo sapiens
catgtagaagagggagaaggaga

SEQ ID NO: 209778 - DNA, 16 bp, Homo sapiens
catgtagcatataaat

SEQ ID NO: 209779 - DNA, 23 bp, Homo sapiens
catgtagcatataaatgtttata

SEQ ID NO: 209780 - DNA, 23 bp, Homo sapiens
catgtagctctatggggggaggg

SEQ ID NO: 209781 - DNA, 14 bp, Homo sapiens
catgtataaatgaa

SEQ ID NO: 209782 - DNA, 18 bp, Homo sapiens
catgtataaatgaagttt

SEQ ID NO: 209783 - DNA, 21 bp, Homo sapiens
catgtatagtgagtgtggctt

SEQ ID NO: 209784 - DNA, 17 bp, Homo sapiens
catgtattggcctggag

SEQ ID NO: 209785 - DNA, 21 bp, Homo sapiens
catgtcaaagtgaaagacatt

SEQ ID NO: 209786 - DNA, 18 bp, Homo sapiens
ctgttcccattcttgcat

SEQ ID NO: 209787 - DNA, 22 bp, Homo sapiens
ctgttcccctcactggatgaaa

SEQ ID NO: 209788 - DNA, 18 bp, Homo sapiens
ctgttccctgctgggtgg

SEQ ID NO: 209789 - DNA, 21 bp, Homo sapiens
ctgttcctggctcagcctcaa

SEQ ID NO: 209790 - DNA, 16 bp, Homo sapiens
ctgttccttgaatctg

SEQ ID NO: 209791 - DNA, 12 bp, Homo sapiens
ctgttctcagag

SEQ ID NO: 209792 - DNA, 16 bp, Homo sapiens
ctgttctgccccctca

SEQ ID NO: 209793 - DNA, 18 bp, Homo sapiens
ctgttctgccccctcagg

SEQ ID NO: 209794 - DNA, 19 bp, Homo sapiens
ctgttctggcctcagacca

SEQ ID NO: 209795 - DNA, 20 bp, Homo sapiens
ctgttctgggtgcagctgag

SEQ ID NO: 209796 - DNA, 15 bp, Homo sapiens
ctgttctggtggccc

SEQ ID NO: 209797 - DNA, 16 bp, Homo sapiens
ctgttctggtggcccc

SEQ ID NO: 209798 - DNA, 12 bp, Homo sapiens
ctgttctgtgtc

SEQ ID NO: 209799 - DNA, 17 bp, Homo sapiens
ctgttctgtgtctgctg

SEQ ID NO: 209800 - DNA, 17 bp, Homo sapiens
ctgttctttaagacttt

SEQ ID NO: 209801 - DNA, 14 bp, Homo sapiens
ctgttgaaaattat

SEQ ID NO: 209802 - DNA, 19 bp, Homo sapiens
ctgttgagtatttgctgtt

SEQ ID NO: 209803 - DNA, 15 bp, Homo sapiens
ctgttgattctttca

SEQ ID NO: 209804 - DNA, 15 bp, Homo sapiens
ctgttgattgcagga

SEQ ID NO: 209805 - DNA, 15 bp, Homo sapiens
ctgttgcatttactt

SEQ ID NO: 209806 - DNA, 12 bp, Homo sapiens
ctgttgcccagg

SEQ ID NO: 209807 - DNA, 14 bp, Homo sapiens
ctgttgcctcctct

SEQ ID NO: 209808 - DNA, 21 bp, Homo sapiens
ctgttgcctcctctctccctg

SEQ ID NO: 209809 - DNA, 21 bp, Homo sapiens
ctgttggcccctctgctgtcc

SEQ ID NO: 209810 - DNA, 23 bp, Homo sapiens
ctgttggcccctctgctgtcctg

SEQ ID NO: 209811 - DNA, 20 bp, Homo sapiens
ctgttgtctgccgtgagagc

SEQ ID NO: 209812 - DNA, 22 bp, Homo sapiens
ctgttgtgcagtgtgcctgtca

SEQ ID NO: 209813 - DNA, 22 bp, Homo sapiens
ctgttgtgtacgtggagaggga

SEQ ID NO: 209814 - DNA, 22 bp, Homo sapiens
ctgttgttcagaagttgttagt

SEQ ID NO: 209815 - DNA, 19 bp, Homo sapiens
ctgttgtttacctaccgta

SEQ ID NO: 209816 - DNA, 12 bp, Homo sapiens
ctgttgtttgaa

SEQ ID NO: 209817 - DNA, 16 bp, Homo sapiens
ctgttgttttgtttta

SEQ ID NO: 209818 - DNA, 20 bp, Homo sapiens
ctgttgttttgttttaaata

SEQ ID NO: 209819 - DNA, 16 bp, Homo sapiens
ctgtttaccctccctg

SEQ ID NO: 209820 - DNA, 17 bp, Homo sapiens
ctgtttatggcctcagc

SEQ ID NO: 209821 - DNA, 18 bp, Homo sapiens
ctgtttatggtattttcg

SEQ ID NO: 209822 - DNA, 21 bp, Homo sapiens
ctgtttccataggaatcatgt

SEQ ID NO: 209823 - DNA, 17 bp, Homo sapiens
ctgtttcccctgcactt

SEQ ID NO: 209824 - DNA, 21 bp, Homo sapiens
ctgtttcccttcccttccact

SEQ ID NO: 209825 - DNA, 14 bp, Homo sapiens
ctgtttccttctct

SEQ ID NO: 209826 - DNA, 16 bp, Homo sapiens
ctgtttccttctcttt

SEQ ID NO: 209827 - DNA, 22 bp, Homo sapiens
ctgtttcgtgtagtggaagagc

SEQ ID NO: 209828 - DNA, 15 bp, Homo sapiens
ctgtttctgcagccc

SEQ ID NO: 209829 - DNA, 15 bp, Homo sapiens
ctgtttcttcttgtg

SEQ ID NO: 209830 - DNA, 16 bp, Homo sapiens
ctgtttgaattttcaa

SEQ ID NO: 209831 - DNA, 20 bp, Homo sapiens
ctgtttgcaggcccagagga

SEQ ID NO: 209832 - DNA, 17 bp, Homo sapiens
ctgtttgctaagtgagg

SEQ ID NO: 209833 - DNA, 13 bp, Homo sapiens
ctgtttgcttcta

SEQ ID NO: 209834 - DNA, 15 bp, Homo sapiens
ctgtttggcttataa

SEQ ID NO: 209835 - DNA, 20 bp, Homo sapiens
ctgtttgggaggctggagtg

SEQ ID NO: 209836 - DNA, 22 bp, Homo sapiens
ctgttttacaaaaaagaaaaga

SEQ ID NO: 209837 - DNA, 12 bp, Homo sapiens
ctgttttactgc

SEQ ID NO: 209838 - DNA, 15 bp, Homo sapiens
ctgttttatgtcata

SEQ ID NO: 209839 - DNA, 21 bp, Homo sapiens
ctgttttatgtcatactctgt

SEQ ID NO: 209840 - DNA, 22 bp, Homo sapiens
ctgttttatgtcatactctgtg

SEQ ID NO: 209841 - DNA, 21 bp, Homo sapiens
ctgttttcaccatctttctaa

SEQ ID NO: 209842 - DNA, 16 bp, Homo sapiens
ctgttttctgtttctt

SEQ ID NO: 209843 - DNA, 13 bp, Homo sapiens
ctgttttggatga

SEQ ID NO: 209844 - DNA, 16 bp, Homo sapiens
ctgttttggatgaatg

SEQ ID NO: 209845 - DNA, 18 bp, Homo sapiens
ctgttttggatgaatgca

SEQ ID NO: 209846 - DNA, 23 bp, Homo sapiens
ctgttttgtcctttgagaaagaa

SEQ ID NO: 209847 - DNA, 18 bp, Homo sapiens
ctgtttttaagctgtttc

SEQ ID NO: 209848 - DNA, 14 bp, Homo sapiens
cttaaaaaatgtcc

SEQ ID NO: 209849 - DNA, 16 bp, Homo sapiens
cttaaaaatgtaaata

SEQ ID NO: 209850 - DNA, 22 bp, Homo sapiens
cttaaaaattaaattctctcta

SEQ ID NO: 209851 - DNA, 20 bp, Homo sapiens
cttaaaaattatctttaaaa

SEQ ID NO: 209852 - DNA, 15 bp, Homo sapiens
cttaaaagtattcat

SEQ ID NO: 209853 - DNA, 13 bp, Homo sapiens
cttaaaataagtg

SEQ ID NO: 209854 - DNA, 16 bp, Homo sapiens
cttaaaataagtgaat

SEQ ID NO: 209855 - DNA, 18 bp, Homo sapiens
cttaaaatattcctgcat

SEQ ID NO: 209856 - DNA, 20 bp, Homo sapiens
cttaaaatattcctgcattt

SEQ ID NO: 209857 - DNA, 18 bp, Homo sapiens
cttaaaattagcatctgg

SEQ ID NO: 209858 - DNA, 18 bp, Homo sapiens
cttaaaattcaagaaaat

SEQ ID NO: 209859 - DNA, 12 bp, Homo sapiens
cttaaacaaaaa

SEQ ID NO: 209860 - DNA, 21 bp, Homo sapiens
cttaaacaaaaactttccatg

SEQ ID NO: 209861 - DNA, 16 bp, Homo sapiens
cttaaacaaagtgact

SEQ ID NO: 209862 - DNA, 11 bp, Homo sapiens
cttaaacattt

SEQ ID NO: 209863 - DNA, 13 bp, Homo sapiens
cttaaactttgtc

SEQ ID NO: 209864 - DNA, 21 bp, Homo sapiens
cttaaactttgtcacttctgc

SEQ ID NO: 209865 - DNA, 17 bp, Homo sapiens
cttaaagaaacagcttt

SEQ ID NO: 209866 - DNA, 12 bp, Homo sapiens
cttaaagaaagt

SEQ ID NO: 209867 - DNA, 16 bp, Homo sapiens
cttaaagcaataagtt

SEQ ID NO: 209868 - DNA, 17 bp, Homo sapiens
cttaaaggacaggagga

SEQ ID NO: 209869 - DNA, 15 bp, Homo sapiens
cttaaaggcctggaa

SEQ ID NO: 209870 - DNA, 16 bp, Homo sapiens
cttaaaggcctggaac

SEQ ID NO: 209871 - DNA, 15 bp, Homo sapiens
cttaaataatttaag

SEQ ID NO: 209872 - DNA, 11 bp, Homo sapiens
cttaaattaaa

SEQ ID NO: 209873 - DNA, 17 bp, Homo sapiens
cttaaattaaacaattt

SEQ ID NO: 209874 - DNA, 19 bp, Homo sapiens
cttaaattaaacaatttat

SEQ ID NO: 209875 - DNA, 22 bp, Homo sapiens
cttaaattaaacaatttatttt

SEQ ID NO: 209876 - DNA, 22 bp, Homo sapiens
cttaacaactgactaaccattg

SEQ ID NO: 209877 - DNA, 15 bp, Homo sapiens
cttaacatgctgtgt

SEQ ID NO: 209878 - DNA, 23 bp, Homo sapiens
cttaacattaagtattccttggc

SEQ ID NO: 209879 - DNA, 20 bp, Homo sapiens
cttaacattgcatcatgaaa

SEQ ID NO: 209880 - DNA, 22 bp, Homo sapiens
cttaaccaccgcatatgcatgc

SEQ ID NO: 209881 - DNA, 15 bp, Homo sapiens
cttaacctgcttttg

SEQ ID NO: 209882 - DNA, 18 bp, Homo sapiens
cttaacctttaagtctta

SEQ ID NO: 209883 - DNA, 15 bp, Homo sapiens
cttaacggctccagg

SEQ ID NO: 209884 - DNA, 17 bp, Homo sapiens
cttaactcatctgttat

SEQ ID NO: 209885 - DNA, 19 bp, Homo sapiens
cttaactgcatttttagac

SEQ ID NO: 209886 - DNA, 20 bp, Homo sapiens
cttaactgtgctcagataca

SEQ ID NO: 209887 - DNA, 21 bp, Homo sapiens
cttaactgtgtgaagaaatgg

SEQ ID NO: 209888 - DNA, 22 bp, Homo sapiens
cttaactgtgtgaagaaatgga

SEQ ID NO: 209889 - DNA, 12 bp, Homo sapiens
cttaacttgttt

SEQ ID NO: 209890 - DNA, 14 bp, Homo sapiens
cttaagacaaatgg

SEQ ID NO: 209891 - DNA, 18 bp, Homo sapiens
cttaagacaaatgggact

SEQ ID NO: 209892 - DNA, 21 bp, Homo sapiens
cttaagacaaatgggactgat

SEQ ID NO: 209893 - DNA, 23 bp, Homo sapiens
cttaagacaaatgggactgatgt

SEQ ID NO: 209894 - DNA, 18 bp, Homo sapiens
cttaagattccattttgg

SEQ ID NO: 209895 - DNA, 18 bp, Homo sapiens
cttaagcagaagcattaa

SEQ ID NO: 209896 - DNA, 22 bp, Homo sapiens
cttaagcccaggagtctgagac

SEQ ID NO: 209897 - DNA, 22 bp, Homo sapiens
cttaaggaattgacttcagcag

SEQ ID NO: 209898 - DNA, 14 bp, Homo sapiens
cttaaggagaggag

SEQ ID NO: 209899 - DNA, 16 bp, Homo sapiens
cttaaggagaggagag

SEQ ID NO: 209900 - DNA, 19 bp, Homo sapiens
cttaaggcaataaaactag

SEQ ID NO: 209901 - DNA, 19 bp, Homo sapiens
cttaagggggccttggaat

SEQ ID NO: 209902 - DNA, 20 bp, Homo sapiens
cttaagggttgaaggcagtc

SEQ ID NO: 209903 - DNA, 21 bp, Homo sapiens
cttaagggttgaaggcagtct

SEQ ID NO: 209904 - DNA, 16 bp, Homo sapiens
cttaatactgaatttc

SEQ ID NO: 209905 - DNA, 15 bp, Homo sapiens
cttaatagccctccc

SEQ ID NO: 209906 - DNA, 14 bp, Homo sapiens
cttaatatgttaac

SEQ ID NO: 209907 - DNA, 18 bp, Homo sapiens
cttaatcggttgacccta

SEQ ID NO: 209908 - DNA, 22 bp, Homo sapiens
cttaatctttattttattattc

SEQ ID NO: 209909 - DNA, 18 bp, Homo sapiens
cttaatgacattcccctc

SEQ ID NO: 209910 - DNA, 12 bp, Homo sapiens
cttaatgagata

SEQ ID NO: 209911 - DNA, 14 bp, Homo sapiens
cttaatggatgctc

SEQ ID NO: 209912 - DNA, 12 bp, Homo sapiens
cttaatgtttat

SEQ ID NO: 209913 - DNA, 15 bp, Homo sapiens
cttaatgtttattcc

SEQ ID NO: 209914 - DNA, 16 bp, Homo sapiens
cttaatgtttattcct

SEQ ID NO: 209915 - DNA, 23 bp, Homo sapiens
cttaatgtttattcctgataata

SEQ ID NO: 209916 - DNA, 22 bp, Homo sapiens
cttaattatgctaacaaactga

SEQ ID NO: 209917 - DNA, 18 bp, Homo sapiens
cttaattcttacctcatt

SEQ ID NO: 209918 - DNA, 22 bp, Homo sapiens
cttaattcttacctcatttgca

SEQ ID NO: 209919 - DNA, 20 bp, Homo sapiens
cttaatttaagtttgtagtt

SEQ ID NO: 209920 - DNA, 15 bp, Homo sapiens
catgtcactgtggtc

SEQ ID NO: 209921 - DNA, 10 bp, Homo sapiens
catgtcatgt

SEQ ID NO: 209922 - DNA, 22 bp, Homo sapiens
catgtccaagttcttcacctct

SEQ ID NO: 209923 - DNA, 14 bp, Homo sapiens
catgtcgcctctgc

SEQ ID NO: 209924 - DNA, 15 bp, Homo sapiens
catgtcgcctctgca

SEQ ID NO: 209925 - DNA, 18 bp, Homo sapiens
catgtcgcctctgcattc

SEQ ID NO: 209926 - DNA, 13 bp, Homo sapiens
catgtcgcttttg

SEQ ID NO: 209927 - DNA, 17 bp, Homo sapiens
catgtctacaaaagcaa

SEQ ID NO: 209928 - DNA, 14 bp, Homo sapiens
catgtctctgcttc

SEQ ID NO: 209929 - DNA, 17 bp, Homo sapiens
catgtgaaaagtaaaac

SEQ ID NO: 209930 - DNA, 22 bp, Homo sapiens
catgtgaattctgtgaagaatg

SEQ ID NO: 209931 - DNA, 22 bp, Homo sapiens
catgtgagccaccgctgccagc

SEQ ID NO: 209932 - DNA, 14 bp, Homo sapiens
catgtgatctatta

SEQ ID NO: 209933 - DNA, 20 bp, Homo sapiens
catgtgatctattactctga

SEQ ID NO: 209934 - DNA, 16 bp, Homo sapiens
catgtgcaactcttgt

SEQ ID NO: 209935 - DNA, 17 bp, Homo sapiens
catgtgcaactcttgta

SEQ ID NO: 209936 - DNA, 19 bp, Homo sapiens
catgtgccaagattctact

SEQ ID NO: 209937 - DNA, 17 bp, Homo sapiens
catgtgccatctgtaca

SEQ ID NO: 209938 - DNA, 16 bp, Homo sapiens
catgtgccgaatgtgc

SEQ ID NO: 209939 - DNA, 20 bp, Homo sapiens
catgtgcctgcaccaggaga

SEQ ID NO: 209940 - DNA, 21 bp, Homo sapiens
catgtgcctgcaccaggagac

SEQ ID NO: 209941 - DNA, 14 bp, Homo sapiens
catgtgcctgtcac

SEQ ID NO: 209942 - DNA, 11 bp, Homo sapiens
catgtgctgca

SEQ ID NO: 209943 - DNA, 15 bp, Homo sapiens
catgtgctttgtagc

SEQ ID NO: 209944 - DNA, 18 bp, Homo sapiens
catgtgctttgtagctta

SEQ ID NO: 209945 - DNA, 16 bp, Homo sapiens
catgtggaaagtgaat

SEQ ID NO: 209946 - DNA, 17 bp, Homo sapiens
catgtggaaagtgaatt

SEQ ID NO: 209947 - DNA, 21 bp, Homo sapiens
catgtggcaaaatatggtttg

SEQ ID NO: 209948 - DNA, 12 bp, Homo sapiens
catgtgggagct

SEQ ID NO: 209949 - DNA, 19 bp, Homo sapiens
catgtggggacagggctgg

SEQ ID NO: 209950 - DNA, 18 bp, Homo sapiens
catgtggggccaggtcac

SEQ ID NO: 209951 - DNA, 14 bp, Homo sapiens
catgtgggggaagg

SEQ ID NO: 209952 - DNA, 22 bp, Homo sapiens
catgtgggggaaggccttgctg

SEQ ID NO: 209953 - DNA, 18 bp, Homo sapiens
catgtgggtgagccagtg

SEQ ID NO: 209954 - DNA, 17 bp, Homo sapiens
catgtgtaacttctaga

SEQ ID NO: 209955 - DNA, 13 bp, Homo sapiens
catgtgtataaaa

SEQ ID NO: 209956 - DNA, 13 bp, Homo sapiens
catgtgtatgaga

SEQ ID NO: 209957 - DNA, 16 bp, Homo sapiens
catgtgtctgtattca

SEQ ID NO: 209958 - DNA, 22 bp, Homo sapiens
catgtgtgagataacttccttc

SEQ ID NO: 209959 - DNA, 17 bp, Homo sapiens
catgtgtgagtgtgtgc

SEQ ID NO: 209960 - DNA, 14 bp, Homo sapiens
catgtgtggactca

SEQ ID NO: 209961 - DNA, 21 bp, Homo sapiens
catgtgtgtatcaccctcagc

SEQ ID NO: 209962 - DNA, 15 bp, Homo sapiens
catgtgtgtgcaagt

SEQ ID NO: 209963 - DNA, 15 bp, Homo sapiens
catgtgtgtgctcag

SEQ ID NO: 209964 - DNA, 20 bp, Homo sapiens
catgtgttgcaaattattct

SEQ ID NO: 209965 - DNA, 24 bp, Homo sapiens
catgtgttgcaaattattctagtc

SEQ ID NO: 209966 - DNA, 17 bp, Homo sapiens
catgttaatcctagctg

SEQ ID NO: 209967 - DNA, 13 bp, Homo sapiens
catgttatatatt

SEQ ID NO: 209968 - DNA, 14 bp, Homo sapiens
catgttatatattt

SEQ ID NO: 209969 - DNA, 16 bp, Homo sapiens
catgttctcatgtttg

SEQ ID NO: 209970 - DNA, 16 bp, Homo sapiens
catgttcttgttttgt

SEQ ID NO: 209971 - DNA, 19 bp, Homo sapiens
catgttgagccaggcctgg

SEQ ID NO: 209972 - DNA, 14 bp, Homo sapiens
catgttgctcagaa

SEQ ID NO: 209973 - DNA, 21 bp, Homo sapiens
catgttggatagtcagctgta

SEQ ID NO: 209974 - DNA, 16 bp, Homo sapiens
catgttggccaggctg

SEQ ID NO: 209975 - DNA, 20 bp, Homo sapiens
catgttggccaggctggtct

SEQ ID NO: 209976 - DNA, 16 bp, Homo sapiens
catgtttaatgttatc

SEQ ID NO: 209977 - DNA, 22 bp, Homo sapiens
catgtttcatgttttgtgacta

SEQ ID NO: 209978 - DNA, 23 bp, Homo sapiens
catgtttgatgtatctgagcagg

SEQ ID NO: 209979 - DNA, 20 bp, Homo sapiens
catgttttgatgagaaaaaa

SEQ ID NO: 209980 - DNA, 14 bp, Homo sapiens
catgttttgtgact

SEQ ID NO: 209981 - DNA, 15 bp, Homo sapiens
catgttttgtgacta

SEQ ID NO: 209982 - DNA, 23 bp, Homo sapiens
catgtttttgttttctttgaatg

SEQ ID NO: 209983 - DNA, 22 bp, Homo sapiens
cattaaaaaaaaaaaaaaaagt

SEQ ID NO: 209984 - DNA, 17 bp, Homo sapiens
cattaaaaaaaacagaa

SEQ ID NO: 209985 - DNA, 19 bp, Homo sapiens
cattaaaaataaaagttgt

SEQ ID NO: 209986 - DNA, 15 bp, Homo sapiens
cattaaaactgcttt

SEQ ID NO: 209987 - DNA, 20 bp, Homo sapiens
cattaaaagaagactggaag

SEQ ID NO: 209988 - DNA, 19 bp, Homo sapiens
cattaaaagttttatgtac

SEQ ID NO: 209989 - DNA, 23 bp, Homo sapiens
cattaaaagttttatgtactttg

SEQ ID NO: 209990 - DNA, 17 bp, Homo sapiens
cattaaacactgtaatc

SEQ ID NO: 209991 - DNA, 18 bp, Homo sapiens
cattaaacactgtaatct

SEQ ID NO: 209992 - DNA, 21 bp, Homo sapiens
cattaaacactgtaatcttaa

SEQ ID NO: 209993 - DNA, 12 bp, Homo sapiens
cattaaacagaa

SEQ ID NO: 209994 - DNA, 12 bp, Homo sapiens
cattaaacatga

SEQ ID NO: 209995 - DNA, 14 bp, Homo sapiens
cattaaacatgaat

SEQ ID NO: 209996 - DNA, 16 bp, Homo sapiens
cattaaacatgaattt

SEQ ID NO: 209997 - DNA, 15 bp, Homo sapiens
cattaacaggtcttt

SEQ ID NO: 209998 - DNA, 18 bp, Homo sapiens
cattaacaggtctttgaa

SEQ ID NO: 209999 - DNA, 16 bp, Homo sapiens
cattaacagttttcca

SEQ ID NO: 210000 - DNA, 21 bp, Homo sapiens
cattaacagttttccatgaaa

SEQ ID NO: 210001 - DNA, 13 bp, Homo sapiens
cattaagaggttt

SEQ ID NO: 210002 - DNA, 15 bp, Homo sapiens
cattaataggaaaga

SEQ ID NO: 210003 - DNA, 19 bp, Homo sapiens
cattaataggaaagattta

SEQ ID NO: 210004 - DNA, 23 bp, Homo sapiens
cattaataggaaagatttaatgt

SEQ ID NO: 210005 - DNA, 22 bp, Homo sapiens
cattaatcaatcatctgtgtga

SEQ ID NO: 210006 - DNA, 15 bp, Homo sapiens
cattaatttctctca

SEQ ID NO: 210007 - DNA, 14 bp, Homo sapiens
cattacagcttaat

SEQ ID NO: 210008 - DNA, 16 bp, Homo sapiens
cattacagcttaatca

SEQ ID NO: 210009 - DNA, 19 bp, Homo sapiens
cattacagtttggaagtgt

SEQ ID NO: 210010 - DNA, 14 bp, Homo sapiens
cattacatggctgt

SEQ ID NO: 210011 - DNA, 15 bp, Homo sapiens
cattacatggctgtg

SEQ ID NO: 210012 - DNA, 21 bp, Homo sapiens
cattacattccttgataatgt

SEQ ID NO: 210013 - DNA, 20 bp, Homo sapiens
cattactgccttcagtatca

SEQ ID NO: 210014 - DNA, 23 bp, Homo sapiens
cattagaaactgaaaactgtaaa

SEQ ID NO: 210015 - DNA, 12 bp, Homo sapiens
cattagaagaaa

SEQ ID NO: 210016 - DNA, 20 bp, Homo sapiens
cattagactgaatttaacta

SEQ ID NO: 210017 - DNA, 22 bp, Homo sapiens
cattagactgaatttaactact

SEQ ID NO: 210018 - DNA, 21 bp, Homo sapiens
cattagattatcaaaaagtat

SEQ ID NO: 210019 - DNA, 17 bp, Homo sapiens
cattagcaacgcctgcc

SEQ ID NO: 210020 - DNA, 18 bp, Homo sapiens
cattagcaacgcctgcct

SEQ ID NO: 210021 - DNA, 14 bp, Homo sapiens
cattagcccactgc

SEQ ID NO: 210022 - DNA, 21 bp, Homo sapiens
cattaggaattaagttatctt

SEQ ID NO: 210023 - DNA, 16 bp, Homo sapiens
cattagtaaaacacaa

SEQ ID NO: 210024 - DNA, 13 bp, Homo sapiens
cattatagaaatt

SEQ ID NO: 210025 - DNA, 15 bp, Homo sapiens
cattatattctctta

SEQ ID NO: 210026 - DNA, 15 bp, Homo sapiens
cattatccttttatc

SEQ ID NO: 210027 - DNA, 18 bp, Homo sapiens
cattatcgggagcagtgt

SEQ ID NO: 210028 - DNA, 14 bp, Homo sapiens
cattatctgctgtt

SEQ ID NO: 210029 - DNA, 17 bp, Homo sapiens
cattatctgctgttcct

SEQ ID NO: 210030 - DNA, 22 bp, Homo sapiens
cattatgagaggcaatgattgt

SEQ ID NO: 210031 - DNA, 12 bp, Homo sapiens
cattatgtagaa

SEQ ID NO: 210032 - DNA, 12 bp, Homo sapiens
cattattggaat

SEQ ID NO: 210033 - DNA, 13 bp, Homo sapiens
cattatttattaa

SEQ ID NO: 210034 - DNA, 20 bp, Homo sapiens
cattatttgagtttgacatt

SEQ ID NO: 210035 - DNA, 17 bp, Homo sapiens
cattatttgataacatt

SEQ ID NO: 210036 - DNA, 14 bp, Homo sapiens
cattatttgcatgt

SEQ ID NO: 210037 - DNA, 14 bp, Homo sapiens
cattattttgtggt

SEQ ID NO: 210038 - DNA, 20 bp, Homo sapiens
cattcaaaaacatggccaca

SEQ ID NO: 210039 - DNA, 17 bp, Homo sapiens
cattcaaaagcacaaac

SEQ ID NO: 210040 - DNA, 18 bp, Homo sapiens
cattcaaaatagttctat

SEQ ID NO: 210041 - DNA, 22 bp, Homo sapiens
cattcaaaatagttctatttct

SEQ ID NO: 210042 - DNA, 18 bp, Homo sapiens
cattcaatatctgacagt

SEQ ID NO: 210043 - DNA, 12 bp, Homo sapiens
cattcacacaca

SEQ ID NO: 210044 - DNA, 15 bp, Homo sapiens
cattcacacacagcc

SEQ ID NO: 210045 - DNA, 18 bp, Homo sapiens
cattcacacacagcctgg

SEQ ID NO: 210046 - DNA, 21 bp, Homo sapiens
cattcacacacagcctggcct

SEQ ID NO: 210047 - DNA, 12 bp, Homo sapiens
cattcacatttc

SEQ ID NO: 210048 - DNA, 15 bp, Homo sapiens
cattcacatttcaag

SEQ ID NO: 210049 - DNA, 19 bp, Homo sapiens
cattcaccaacaacagtca

SEQ ID NO: 210050 - DNA, 15 bp, Homo sapiens
cattcactagctttg

SEQ ID NO: 210051 - DNA, 15 bp, Homo sapiens
cattcacttgcattt

SEQ ID NO: 210052 - DNA, 11 bp, Homo sapiens
cattcagaact

SEQ ID NO: 210053 - DNA, 17 bp, Homo sapiens
cattcagaactctcaga

SEQ ID NO: 210054 - DNA, 18 bp, Homo sapiens
cattcagaactctcagac

SEQ ID NO: 210055 - DNA, 14 bp, Homo sapiens
cttaattttctaaa

SEQ ID NO: 210056 - DNA, 19 bp, Homo sapiens
cttaatttttttgttgttg

SEQ ID NO: 210057 - DNA, 16 bp, Homo sapiens
cttaattttttttaat

SEQ ID NO: 210058 - DNA, 22 bp, Homo sapiens
cttacaaaaacaagacacccaa

SEQ ID NO: 210059 - DNA, 16 bp, Homo sapiens
cttacaagccagctgg

SEQ ID NO: 210060 - DNA, 19 bp, Homo sapiens
cttacaaggcaggcctttc

SEQ ID NO: 210061 - DNA, 21 bp, Homo sapiens
cttacaagtaatgaattttat

SEQ ID NO: 210062 - DNA, 18 bp, Homo sapiens
cttacaatgtgcactgaa

SEQ ID NO: 210063 - DNA, 18 bp, Homo sapiens
cttacaattgcactgctg

SEQ ID NO: 210064 - DNA, 20 bp, Homo sapiens
cttacaattgcactgctgtt

SEQ ID NO: 210065 - DNA, 20 bp, Homo sapiens
cttacacaagactttcccca

SEQ ID NO: 210066 - DNA, 17 bp, Homo sapiens
cttacacttggagcccg

SEQ ID NO: 210067 - DNA, 23 bp, Homo sapiens
cttacacttggagcccgtgcagt

SEQ ID NO: 210068 - DNA, 19 bp, Homo sapiens
cttacattggctttttaaa

SEQ ID NO: 210069 - DNA, 12 bp, Homo sapiens
cttacatttgtg

SEQ ID NO: 210070 - DNA, 20 bp, Homo sapiens
cttacattttactttttcct

SEQ ID NO: 210071 - DNA, 22 bp, Homo sapiens
cttacatttttacaataaataa

SEQ ID NO: 210072 - DNA, 14 bp, Homo sapiens
cttaccaaaacata

SEQ ID NO: 210073 - DNA, 14 bp, Homo sapiens
cttaccaactttct

SEQ ID NO: 210074 - DNA, 14 bp, Homo sapiens
cttaccagatgcta

SEQ ID NO: 210075 - DNA, 16 bp, Homo sapiens
cttacccccaccacta

SEQ ID NO: 210076 - DNA, 19 bp, Homo sapiens
cttaccccgtccctttccc

SEQ ID NO: 210077 - DNA, 20 bp, Homo sapiens
cttaccccgtccctttccct

SEQ ID NO: 210078 - DNA, 20 bp, Homo sapiens
cttaccccttagcctccctg

SEQ ID NO: 210079 - DNA, 17 bp, Homo sapiens
cttaccctactggctgt

SEQ ID NO: 210080 - DNA, 17 bp, Homo sapiens
cttacccttctgtgccc

SEQ ID NO: 210081 - DNA, 18 bp, Homo sapiens
cttacccttctgtgccca

SEQ ID NO: 210082 - DNA, 21 bp, Homo sapiens
cttacccttctgtgcccagct

SEQ ID NO: 210083 - DNA, 15 bp, Homo sapiens
cttaccgtagcctcc

SEQ ID NO: 210084 - DNA, 15 bp, Homo sapiens
cttacctcatttgca

SEQ ID NO: 210085 - DNA, 15 bp, Homo sapiens
cttacctcttccgga

SEQ ID NO: 210086 - DNA, 19 bp, Homo sapiens
cttacctgggcattcttgt

SEQ ID NO: 210087 - DNA, 15 bp, Homo sapiens
cttacgtgagtcctg

SEQ ID NO: 210088 - DNA, 22 bp, Homo sapiens
cttactaaacattttgttattg

SEQ ID NO: 210089 - DNA, 13 bp, Homo sapiens
cttactaaatcta

SEQ ID NO: 210090 - DNA, 23 bp, Homo sapiens
cttactaatgtgccccatgtcca

SEQ ID NO: 210091 - DNA, 18 bp, Homo sapiens
cttactacagaaagcaaa

SEQ ID NO: 210092 - DNA, 19 bp, Homo sapiens
cttactattaagcagtaaa

SEQ ID NO: 210093 - DNA, 15 bp, Homo sapiens
cttactattcccact

SEQ ID NO: 210094 - DNA, 13 bp, Homo sapiens
cttactctgagcc

SEQ ID NO: 210095 - DNA, 14 bp, Homo sapiens
cttactctgagccc

SEQ ID NO: 210096 - DNA, 16 bp, Homo sapiens
cttactctgagcccag

SEQ ID NO: 210097 - DNA, 18 bp, Homo sapiens
cttactctgagcccaggc

SEQ ID NO: 210098 - DNA, 20 bp, Homo sapiens
cttactctgagcccaggccg

SEQ ID NO: 210099 - DNA, 13 bp, Homo sapiens
cttactgtgtaaa

SEQ ID NO: 210100 - DNA, 18 bp, Homo sapiens
cttacttagcatgcacaa

SEQ ID NO: 210101 - DNA, 13 bp, Homo sapiens
cttactttgtgca

SEQ ID NO: 210102 - DNA, 14 bp, Homo sapiens
cttactttgtgcaa

SEQ ID NO: 210103 - DNA, 23 bp, Homo sapiens
cttactttgtgcaaaagcaggct

SEQ ID NO: 210104 - DNA, 16 bp, Homo sapiens
cttagaaattgcattt

SEQ ID NO: 210105 - DNA, 17 bp, Homo sapiens
cttagaacagatggctg

SEQ ID NO: 210106 - DNA, 22 bp, Homo sapiens
cttagaacagatggctgtgaaa

SEQ ID NO: 210107 - DNA, 23 bp, Homo sapiens
cttagaacagatggctgtgaaaa

SEQ ID NO: 210108 - DNA, 17 bp, Homo sapiens
cttagaacccttctgct

SEQ ID NO: 210109 - DNA, 18 bp, Homo sapiens
cttagaacccttctgctt

SEQ ID NO: 210110 - DNA, 19 bp, Homo sapiens
cttagaacccttctgcttt

SEQ ID NO: 210111 - DNA, 15 bp, Homo sapiens
cttagaataaaattg

SEQ ID NO: 210112 - DNA, 12 bp, Homo sapiens
cttagaatgggg

SEQ ID NO: 210113 - DNA, 18 bp, Homo sapiens
cttagacccgccaggtca

SEQ ID NO: 210114 - DNA, 19 bp, Homo sapiens
cttagacttcgactcagga

SEQ ID NO: 210115 - DNA, 13 bp, Homo sapiens
cttagagaacaaa

SEQ ID NO: 210116 - DNA, 13 bp, Homo sapiens
cttagagaataag

SEQ ID NO: 210117 - DNA, 22 bp, Homo sapiens
cttagagacagttgggtgagaa

SEQ ID NO: 210118 - DNA, 12 bp, Homo sapiens
cttagagagaga

SEQ ID NO: 210119 - DNA, 17 bp, Homo sapiens
cttagagagaggaggca

SEQ ID NO: 210120 - DNA, 21 bp, Homo sapiens
cttagagatgctactgtcagt

SEQ ID NO: 210121 - DNA, 16 bp, Homo sapiens
cttagagattgcccca

SEQ ID NO: 210122 - DNA, 15 bp, Homo sapiens
cttagatctgagccc

SEQ ID NO: 210123 - DNA, 21 bp, Homo sapiens
cttagatctgagccctccctc

SEQ ID NO: 210124 - DNA, 12 bp, Homo sapiens
cttagcaacagc

SEQ ID NO: 210125 - DNA, 18 bp, Homo sapiens
cttagcagctcaggcgca

SEQ ID NO: 210126 - DNA, 16 bp, Homo sapiens
cttagcagcttccaga

SEQ ID NO: 210127 - DNA, 18 bp, Homo sapiens
cttagcagcttccagatt

SEQ ID NO: 210128 - DNA, 17 bp, Homo sapiens
cttagcatcccctgtga

SEQ ID NO: 210129 - DNA, 18 bp, Homo sapiens
cttagcccggatgcccac

SEQ ID NO: 210130 - DNA, 23 bp, Homo sapiens
cttagcccggatgcccacccctg

SEQ ID NO: 210131 - DNA, 14 bp, Homo sapiens
cttagcctccctga

SEQ ID NO: 210132 - DNA, 18 bp, Homo sapiens
cttagcctggatttcctt

SEQ ID NO: 210133 - DNA, 17 bp, Homo sapiens
cttagccttgctgtaga

SEQ ID NO: 210134 - DNA, 21 bp, Homo sapiens
cttagccttgctgtagagact

SEQ ID NO: 210135 - DNA, 22 bp, Homo sapiens
cttagccttgctgtagagactt

SEQ ID NO: 210136 - DNA, 14 bp, Homo sapiens
cttagccttgtgcc

SEQ ID NO: 210137 - DNA, 16 bp, Homo sapiens
cttagccttgtgccct

SEQ ID NO: 210138 - DNA, 19 bp, Homo sapiens
cttagcgttctggactctg

SEQ ID NO: 210139 - DNA, 24 bp, Homo sapiens
cttagcgttctggactctgcccca

SEQ ID NO: 210140 - DNA, 14 bp, Homo sapiens
cttagctatcagaa

SEQ ID NO: 210141 - DNA, 17 bp, Homo sapiens
cttagctccctcccgca

SEQ ID NO: 210142 - DNA, 12 bp, Homo sapiens
cttagctgccag

SEQ ID NO: 210143 - DNA, 16 bp, Homo sapiens
cttagctgccagtgct

SEQ ID NO: 210144 - DNA, 16 bp, Homo sapiens
cttagcttacaggaag

SEQ ID NO: 210145 - DNA, 13 bp, Homo sapiens
cttagctttacat

SEQ ID NO: 210146 - DNA, 14 bp, Homo sapiens
cttagctttacatt

SEQ ID NO: 210147 - DNA, 16 bp, Homo sapiens
cttaggagttttgttt

SEQ ID NO: 210148 - DNA, 23 bp, Homo sapiens
cttaggcaatggtgaactgtcat

SEQ ID NO: 210149 - DNA, 22 bp, Homo sapiens
cttagggaaagatgtagaaaga

SEQ ID NO: 210150 - DNA, 19 bp, Homo sapiens
cttagtgcccgcctaggag

SEQ ID NO: 210151 - DNA, 23 bp, Homo sapiens
cttagtgcccgcctaggagttga

SEQ ID NO: 210152 - DNA, 19 bp, Homo sapiens
cttagtgcggacaagtttt

SEQ ID NO: 210153 - DNA, 22 bp, Homo sapiens
cttagtgcggacaagttttaat

SEQ ID NO: 210154 - DNA, 17 bp, Homo sapiens
cttagtggtatgtctct

SEQ ID NO: 210155 - DNA, 18 bp, Homo sapiens
cttagtggtatgtctctt

SEQ ID NO: 210156 - DNA, 17 bp, Homo sapiens
cttagtgtcccttacct

SEQ ID NO: 210157 - DNA, 22 bp, Homo sapiens
cttagttcacctaccctgagtg

SEQ ID NO: 210158 - DNA, 13 bp, Homo sapiens
cttagtttgtgaa

SEQ ID NO: 210159 - DNA, 16 bp, Homo sapiens
cttagttttgttccaa

SEQ ID NO: 210160 - DNA, 18 bp, Homo sapiens
cttagtttttaaaaaggc

SEQ ID NO: 210161 - DNA, 21 bp, Homo sapiens
cttagtttttaaaaaggcctt

SEQ ID NO: 210162 - DNA, 13 bp, Homo sapiens
cttataaatcata

SEQ ID NO: 210163 - DNA, 12 bp, Homo sapiens
cttatacacatt

SEQ ID NO: 210164 - DNA, 12 bp, Homo sapiens
cttatagaaagt

SEQ ID NO: 210165 - DNA, 14 bp, Homo sapiens
cttatagaatattt

SEQ ID NO: 210166 - DNA, 16 bp, Homo sapiens
cttatagaatatttat

SEQ ID NO: 210167 - DNA, 20 bp, Homo sapiens
cttatagaatatttattacc

SEQ ID NO: 210168 - DNA, 20 bp, Homo sapiens
cttatatatttgaaagaagt

SEQ ID NO: 210169 - DNA, 18 bp, Homo sapiens
cttatatgctgaattgaa

SEQ ID NO: 210170 - DNA, 14 bp, Homo sapiens
cttatattcatcta

SEQ ID NO: 210171 - DNA, 14 bp, Homo sapiens
cttatatttcccta

SEQ ID NO: 210172 - DNA, 19 bp, Homo sapiens
cttatatttttaataaaag

SEQ ID NO: 210173 - DNA, 14 bp, Homo sapiens
cttatcaaatcatt

SEQ ID NO: 210174 - DNA, 17 bp, Homo sapiens
cttatcaagtgtcttcc

SEQ ID NO: 210175 - DNA, 19 bp, Homo sapiens
cttatcaagtgtcttccat

SEQ ID NO: 210176 - DNA, 21 bp, Homo sapiens
cttatcctaaaacaaatagtt

SEQ ID NO: 210177 - DNA, 15 bp, Homo sapiens
cttatctccctgctt

SEQ ID NO: 210178 - DNA, 20 bp, Homo sapiens
cttatctgtgcgtgaaacac

SEQ ID NO: 210179 - DNA, 21 bp, Homo sapiens
cttatctgtgcgtgaaacaca

SEQ ID NO: 210180 - DNA, 14 bp, Homo sapiens
cttatcttatgcca

SEQ ID NO: 210181 - DNA, 18 bp, Homo sapiens
cttatgaatatttataac

SEQ ID NO: 210182 - DNA, 23 bp, Homo sapiens
cttatgagaacatggtgtgtgtc

SEQ ID NO: 210183 - DNA, 22 bp, Homo sapiens
cttatgatattctcattatttc

SEQ ID NO: 210184 - DNA, 22 bp, Homo sapiens
cttatgtcctccaccacaagag

SEQ ID NO: 210185 - DNA, 14 bp, Homo sapiens
cttatgtgttgcat

SEQ ID NO: 210186 - DNA, 15 bp, Homo sapiens
cttattaatgctaag

SEQ ID NO: 210187 - DNA, 15 bp, Homo sapiens
cttattacagaggga

SEQ ID NO: 210188 - DNA, 14 bp, Homo sapiens
cttattactattat

SEQ ID NO: 210189 - DNA, 12 bp, Homo sapiens
cattcaggaacc

SEQ ID NO: 210190 - DNA, 18 bp, Homo sapiens
cattcaggtgttctcttc

SEQ ID NO: 210191 - DNA, 13 bp, Homo sapiens
cattcagtactta

SEQ ID NO: 210192 - DNA, 16 bp, Homo sapiens
cattcagtctgcagct

SEQ ID NO: 210193 - DNA, 14 bp, Homo sapiens
cattcataatttta

SEQ ID NO: 210194 - DNA, 19 bp, Homo sapiens
cattcatatcctccgccct

SEQ ID NO: 210195 - DNA, 17 bp, Homo sapiens
cattcatatttgcaata

SEQ ID NO: 210196 - DNA, 21 bp, Homo sapiens
cattcatatttgcaataaaaa

SEQ ID NO: 210197 - DNA, 17 bp, Homo sapiens
cattcatctgggctggc

SEQ ID NO: 210198 - DNA, 23 bp, Homo sapiens
cattcatctttcctttgctctgg

SEQ ID NO: 210199 - DNA, 22 bp, Homo sapiens
cattcatgttttaaaagtttgt

SEQ ID NO: 210200 - DNA, 17 bp, Homo sapiens
cattcattcaacagctg

SEQ ID NO: 210201 - DNA, 15 bp, Homo sapiens
cattccaaaacgaag

SEQ ID NO: 210202 - DNA, 13 bp, Homo sapiens
cattccacagagt

SEQ ID NO: 210203 - DNA, 22 bp, Homo sapiens
cattccacatccccaccttcca

SEQ ID NO: 210204 - DNA, 17 bp, Homo sapiens
cattccaccttcccatg

SEQ ID NO: 210205 - DNA, 16 bp, Homo sapiens
cattccagctctgccc

SEQ ID NO: 210206 - DNA, 18 bp, Homo sapiens
cattccagctctgccccc

SEQ ID NO: 210207 - DNA, 21 bp, Homo sapiens
cattccatcacagccagccca

SEQ ID NO: 210208 - DNA, 15 bp, Homo sapiens
cattccatgtgccca

SEQ ID NO: 210209 - DNA, 16 bp, Homo sapiens
cattcccactgcactt

SEQ ID NO: 210210 - DNA, 12 bp, Homo sapiens
cattcccagcgt

SEQ ID NO: 210211 - DNA, 13 bp, Homo sapiens
cattccccatggg

SEQ ID NO: 210212 - DNA, 18 bp, Homo sapiens
cattcccccatgtggctg

SEQ ID NO: 210213 - DNA, 20 bp, Homo sapiens
cattcccccatgtggctgaa

SEQ ID NO: 210214 - DNA, 16 bp, Homo sapiens
cattcccctcccacct

SEQ ID NO: 210215 - DNA, 15 bp, Homo sapiens
cattccctctcatcc

SEQ ID NO: 210216 - DNA, 15 bp, Homo sapiens
cattccctctcctgc

SEQ ID NO: 210217 - DNA, 22 bp, Homo sapiens
cattccgacaaccgatgctcca

SEQ ID NO: 210218 - DNA, 21 bp, Homo sapiens
cattcctaacacagcatgtgt

SEQ ID NO: 210219 - DNA, 12 bp, Homo sapiens
cattcctcagct

SEQ ID NO: 210220 - DNA, 17 bp, Homo sapiens
cattcctcatgaatgta

SEQ ID NO: 210221 - DNA, 17 bp, Homo sapiens
cattcctccagcctccc

SEQ ID NO: 210222 - DNA, 18 bp, Homo sapiens
cattcctccagcctcccc

SEQ ID NO: 210223 - DNA, 19 bp, Homo sapiens
cattcctccagcctcccct

SEQ ID NO: 210224 - DNA, 21 bp, Homo sapiens
cattcctccagcctcccctcc

SEQ ID NO: 210225 - DNA, 13 bp, Homo sapiens
cattcctgaaaga

SEQ ID NO: 210226 - DNA, 19 bp, Homo sapiens
cattcctgagattctggga

SEQ ID NO: 210227 - DNA, 12 bp, Homo sapiens
cattcctgttcc

SEQ ID NO: 210228 - DNA, 14 bp, Homo sapiens
cattcctgttctct

SEQ ID NO: 210229 - DNA, 15 bp, Homo sapiens
cattccttgataatg

SEQ ID NO: 210230 - DNA, 20 bp, Homo sapiens
cattcgaggtgtcaccctgc

SEQ ID NO: 210231 - DNA, 14 bp, Homo sapiens
cattcgcagcagct

SEQ ID NO: 210232 - DNA, 23 bp, Homo sapiens
cattcgcagcagctccgcctggc

SEQ ID NO: 210233 - DNA, 18 bp, Homo sapiens
cattctaaaccaaaacag

SEQ ID NO: 210234 - DNA, 19 bp, Homo sapiens
cattctaaaccaaaacaga

SEQ ID NO: 210235 - DNA, 20 bp, Homo sapiens
cattctacaagtaattttgc

SEQ ID NO: 210236 - DNA, 14 bp, Homo sapiens
cattctacacctgg

SEQ ID NO: 210237 - DNA, 16 bp, Homo sapiens
cattctacacctggac

SEQ ID NO: 210238 - DNA, 14 bp, Homo sapiens
cattctacctgagg

SEQ ID NO: 210239 - DNA, 14 bp, Homo sapiens
cattctacttcagc

SEQ ID NO: 210240 - DNA, 10 bp, Homo sapiens
cattctagat

SEQ ID NO: 210241 - DNA, 23 bp, Homo sapiens
cattctagatcctgcaccccagc

SEQ ID NO: 210242 - DNA, 13 bp, Homo sapiens
cattctagcacct

SEQ ID NO: 210243 - DNA, 19 bp, Homo sapiens
cattctagcaccttgttct

SEQ ID NO: 210244 - DNA, 17 bp, Homo sapiens
cattctcactcctacct

SEQ ID NO: 210245 - DNA, 13 bp, Homo sapiens
cattctcattgca

SEQ ID NO: 210246 - DNA, 16 bp, Homo sapiens
cattctccctccatgg

SEQ ID NO: 210247 - DNA, 20 bp, Homo sapiens
cattctccctccatggcagg

SEQ ID NO: 210248 - DNA, 15 bp, Homo sapiens
cattctcctgcctca

SEQ ID NO: 210249 - DNA, 13 bp, Homo sapiens
cattctgagctgg

SEQ ID NO: 210250 - DNA, 12 bp, Homo sapiens
cattctgcctgc

SEQ ID NO: 210251 - DNA, 18 bp, Homo sapiens
cattctgcctgcctggga

SEQ ID NO: 210252 - DNA, 17 bp, Homo sapiens
cattctgctgcccccag

SEQ ID NO: 210253 - DNA, 20 bp, Homo sapiens
cattctggggtggggcttgg

SEQ ID NO: 210254 - DNA, 16 bp, Homo sapiens
cattctgttgcccagg

SEQ ID NO: 210255 - DNA, 21 bp, Homo sapiens
cattcttacaattgcactgct

SEQ ID NO: 210256 - DNA, 13 bp, Homo sapiens
cattcttcactgt

SEQ ID NO: 210257 - DNA, 19 bp, Homo sapiens
cattcttcactgtctgttg

SEQ ID NO: 210258 - DNA, 17 bp, Homo sapiens
cattcttctctcccaca

SEQ ID NO: 210259 - DNA, 17 bp, Homo sapiens
cattcttgaaagctgtg

SEQ ID NO: 210260 - DNA, 19 bp, Homo sapiens
cattctttataaaccataa

SEQ ID NO: 210261 - DNA, 18 bp, Homo sapiens
cattctttatcttgacat

SEQ ID NO: 210262 - DNA, 13 bp, Homo sapiens
cattctttcttcc

SEQ ID NO: 210263 - DNA, 21 bp, Homo sapiens
cattctttgtatcttaaatct

SEQ ID NO: 210264 - DNA, 16 bp, Homo sapiens
cattgaaagagaacca

SEQ ID NO: 210265 - DNA, 13 bp, Homo sapiens
cattgaatacttt

SEQ ID NO: 210266 - DNA, 18 bp, Homo sapiens
cattgaccaagaactgca

SEQ ID NO: 210267 - DNA, 21 bp, Homo sapiens
cattgaccaagaactgcatgg

SEQ ID NO: 210268 - DNA, 14 bp, Homo sapiens
cattgacctcagct

SEQ ID NO: 210269 - DNA, 17 bp, Homo sapiens
cattgacctcagctgca

SEQ ID NO: 210270 - DNA, 23 bp, Homo sapiens
cattgacctcagctgcacattcc

SEQ ID NO: 210271 - DNA, 20 bp, Homo sapiens
cattgatcacagatgtgccc

SEQ ID NO: 210272 - DNA, 13 bp, Homo sapiens
cattgatgaatga

SEQ ID NO: 210273 - DNA, 14 bp, Homo sapiens
cattgatgagcact

SEQ ID NO: 210274 - DNA, 17 bp, Homo sapiens
cattgattgtcagctac

SEQ ID NO: 210275 - DNA, 13 bp, Homo sapiens
cattgcaaaaggt

SEQ ID NO: 210276 - DNA, 16 bp, Homo sapiens
cattgcaaaaggttaa

SEQ ID NO: 210277 - DNA, 16 bp, Homo sapiens
cattgcactaaaagtg

SEQ ID NO: 210278 - DNA, 19 bp, Homo sapiens
cattgcattcaaaatcttc

SEQ ID NO: 210279 - DNA, 10 bp, Homo sapiens
cattgcattt

SEQ ID NO: 210280 - DNA, 13 bp, Homo sapiens
cattgccaccagg

SEQ ID NO: 210281 - DNA, 16 bp, Homo sapiens
cattgccaccaggaga

SEQ ID NO: 210282 - DNA, 16 bp, Homo sapiens
cattgcccacacctgc

SEQ ID NO: 210283 - DNA, 19 bp, Homo sapiens
cattgccttcctaccctct

SEQ ID NO: 210284 - DNA, 20 bp, Homo sapiens
cattgctagcgagccgcctc

SEQ ID NO: 210285 - DNA, 19 bp, Homo sapiens
cattgctccctaagactgt

SEQ ID NO: 210286 - DNA, 13 bp, Homo sapiens
cattgctgtgtca

SEQ ID NO: 210287 - DNA, 17 bp, Homo sapiens
cattgcttcactaccca

SEQ ID NO: 210288 - DNA, 15 bp, Homo sapiens
cattggaagacccca

SEQ ID NO: 210289 - DNA, 18 bp, Homo sapiens
cattggaagaccccaccc

SEQ ID NO: 210290 - DNA, 22 bp, Homo sapiens
cattggctttttaaattttcca

SEQ ID NO: 210291 - DNA, 18 bp, Homo sapiens
cattgggaggggcttctg

SEQ ID NO: 210292 - DNA, 21 bp, Homo sapiens
cattgggaggggcttctgaat

SEQ ID NO: 210293 - DNA, 15 bp, Homo sapiens
cattgggctgacacc

SEQ ID NO: 210294 - DNA, 16 bp, Homo sapiens
cattgggttttatcag

SEQ ID NO: 210295 - DNA, 17 bp, Homo sapiens
cattggtctgcatgtct

SEQ ID NO: 210296 - DNA, 14 bp, Homo sapiens
cattggtggcttgg

SEQ ID NO: 210297 - DNA, 22 bp, Homo sapiens
cattggttccctttgctccacc

SEQ ID NO: 210298 - DNA, 20 bp, Homo sapiens
cattgtaacctcgtgtctag

SEQ ID NO: 210299 - DNA, 22 bp, Homo sapiens
cattgtaacctcgtgtctagta

SEQ ID NO: 210300 - DNA, 15 bp, Homo sapiens
cattgtaatctgctt

SEQ ID NO: 210301 - DNA, 15 bp, Homo sapiens
cattgtaatgttact

SEQ ID NO: 210302 - DNA, 20 bp, Homo sapiens
cattgtactccagcctgggt

SEQ ID NO: 210303 - DNA, 15 bp, Homo sapiens
cattgtagagcttct

SEQ ID NO: 210304 - DNA, 21 bp, Homo sapiens
cattgtagagcttctggcact

SEQ ID NO: 210305 - DNA, 17 bp, Homo sapiens
cattgtataggccatct

SEQ ID NO: 210306 - DNA, 16 bp, Homo sapiens
cattgtatatatgtgt

SEQ ID NO: 210307 - DNA, 17 bp, Homo sapiens
cattgtatatatgtgtg

SEQ ID NO: 210308 - DNA, 22 bp, Homo sapiens
cattgtatgatgtgttgtgata

SEQ ID NO: 210309 - DNA, 15 bp, Homo sapiens
cattgtatgtatcta

SEQ ID NO: 210310 - DNA, 17 bp, Homo sapiens
cattgtatgtatctatt

SEQ ID NO: 210311 - DNA, 11 bp, Homo sapiens
cattgtattgt

SEQ ID NO: 210312 - DNA, 16 bp, Homo sapiens
cattgtctcattgcca

SEQ ID NO: 210313 - DNA, 17 bp, Homo sapiens
cattgtctccttccaca

SEQ ID NO: 210314 - DNA, 16 bp, Homo sapiens
cattgtgaagcaccta

SEQ ID NO: 210315 - DNA, 21 bp, Homo sapiens
cattgtgaatgttgtcctgtg

SEQ ID NO: 210316 - DNA, 16 bp, Homo sapiens
cattgttattgtggaa

SEQ ID NO: 210317 - DNA, 13 bp, Homo sapiens
cattgttcagaag

SEQ ID NO: 210318 - DNA, 14 bp, Homo sapiens
cattgttcagaaga

SEQ ID NO: 210319 - DNA, 21 bp, Homo sapiens
cattgttgaggtggtctgaat

SEQ ID NO: 210320 - DNA, 23 bp, Homo sapiens
cattgttgatgctcacatatgat

SEQ ID NO: 210321 - DNA, 18 bp, Homo sapiens
cattgtttgcttattgtt

SEQ ID NO: 210322 - DNA, 22 bp, Homo sapiens
cattgtttgtctgtcttcatag

SEQ ID NO: 210323 - DNA, 21 bp, Homo sapiens
catttaaaaaaaaaatttgtt

SEQ ID NO: 210324 - DNA, 20 bp, Homo sapiens
cttattcatgctttctcctt

SEQ ID NO: 210325 - DNA, 22 bp, Homo sapiens
cttattcatgctttctcctttt

SEQ ID NO: 210326 - DNA, 20 bp, Homo sapiens
cttattcccaaactacagaa

SEQ ID NO: 210327 - DNA, 23 bp, Homo sapiens
cttattctaataaatatactatg

SEQ ID NO: 210328 - DNA, 15 bp, Homo sapiens
cttattctcctccct

SEQ ID NO: 210329 - DNA, 17 bp, Homo sapiens
cttattgatctttgccc

SEQ ID NO: 210330 - DNA, 18 bp, Homo sapiens
cttattgattaagtatat

SEQ ID NO: 210331 - DNA, 20 bp, Homo sapiens
cttattgctttgaaactaga

SEQ ID NO: 210332 - DNA, 14 bp, Homo sapiens
cttattgtacctct

SEQ ID NO: 210333 - DNA, 15 bp, Homo sapiens
cttattgtagcatat

SEQ ID NO: 210334 - DNA, 17 bp, Homo sapiens
cttattgttccaagaca

SEQ ID NO: 210335 - DNA, 21 bp, Homo sapiens
cttattgttccaagacattgt

SEQ ID NO: 210336 - DNA, 21 bp, Homo sapiens
cttatttatattcatcaaata

SEQ ID NO: 210337 - DNA, 18 bp, Homo sapiens
cttattttataattttaa

SEQ ID NO: 210338 - DNA, 19 bp, Homo sapiens
cttattttataattttaaa

SEQ ID NO: 210339 - DNA, 22 bp, Homo sapiens
cttattttataattttaaaatt

SEQ ID NO: 210340 - DNA, 15 bp, Homo sapiens
cttattttatttcca

SEQ ID NO: 210341 - DNA, 20 bp, Homo sapiens
cttattttatttccatcatg

SEQ ID NO: 210342 - DNA, 22 bp, Homo sapiens
cttattttctgaattcataaaa

SEQ ID NO: 210343 - DNA, 15 bp, Homo sapiens
cttattttgtattac

SEQ ID NO: 210344 - DNA, 15 bp, Homo sapiens
cttatttttggactt

SEQ ID NO: 210345 - DNA, 13 bp, Homo sapiens
cttcaaaaggtga

SEQ ID NO: 210346 - DNA, 20 bp, Homo sapiens
cttcaaaaggtgattaaata

SEQ ID NO: 210347 - DNA, 21 bp, Homo sapiens
cttcaaaaggtgattaaatat

SEQ ID NO: 210348 - DNA, 15 bp, Homo sapiens
cttcaaaatcagtga

SEQ ID NO: 210349 - DNA, 16 bp, Homo sapiens
cttcaaagcttgaaga

SEQ ID NO: 210350 - DNA, 13 bp, Homo sapiens
cttcaaatcagag

SEQ ID NO: 210351 - DNA, 18 bp, Homo sapiens
cttcaacatcaatgttca

SEQ ID NO: 210352 - DNA, 14 bp, Homo sapiens
cttcaaccctgccc

SEQ ID NO: 210353 - DNA, 20 bp, Homo sapiens
cttcaactgaccagcctcca

SEQ ID NO: 210354 - DNA, 14 bp, Homo sapiens
cttcaagctgtccc

SEQ ID NO: 210355 - DNA, 15 bp, Homo sapiens
cttcaagctgtcccc

SEQ ID NO: 210356 - DNA, 12 bp, Homo sapiens
cttcaaggccaa

SEQ ID NO: 210357 - DNA, 14 bp, Homo sapiens
cttcaagtctgtgc

SEQ ID NO: 210358 - DNA, 20 bp, Homo sapiens
cttcaagtgagtggcatgtg

SEQ ID NO: 210359 - DNA, 15 bp, Homo sapiens
cttcaataaatcttt

SEQ ID NO: 210360 - DNA, 16 bp, Homo sapiens
cttcaatactgaaaat

SEQ ID NO: 210361 - DNA, 13 bp, Homo sapiens
cttcaatctctgt

SEQ ID NO: 210362 - DNA, 18 bp, Homo sapiens
cttcaatgctagaaaatc

SEQ ID NO: 210363 - DNA, 20 bp, Homo sapiens
cttcaatgctagaaaatcga

SEQ ID NO: 210364 - DNA, 23 bp, Homo sapiens
cttcaatggcaccttcattctcc

SEQ ID NO: 210365 - DNA, 10 bp, Homo sapiens
cttcaatttg

SEQ ID NO: 210366 - DNA, 13 bp, Homo sapiens
cttcaatttgaaa

SEQ ID NO: 210367 - DNA, 22 bp, Homo sapiens
cttcacacagcacctcctctct

SEQ ID NO: 210368 - DNA, 21 bp, Homo sapiens
cttcacacccctcagcgctcc

SEQ ID NO: 210369 - DNA, 19 bp, Homo sapiens
cttcacaggcagtgcatgt

SEQ ID NO: 210370 - DNA, 21 bp, Homo sapiens
cttcacaggcagtgcatgtga

SEQ ID NO: 210371 - DNA, 19 bp, Homo sapiens
cttcaccacctcatgtcat

SEQ ID NO: 210372 - DNA, 19 bp, Homo sapiens
cttcaccagagcatttcca

SEQ ID NO: 210373 - DNA, 22 bp, Homo sapiens
cttcacccagctaatctgtagg

SEQ ID NO: 210374 - DNA, 15 bp, Homo sapiens
cttcacccccaactt

SEQ ID NO: 210375 - DNA, 19 bp, Homo sapiens
cttcaccccggcaggccct

SEQ ID NO: 210376 - DNA, 13 bp, Homo sapiens
cttcacccctgca

SEQ ID NO: 210377 - DNA, 21 bp, Homo sapiens
cttcaccctgaatggttccat

SEQ ID NO: 210378 - DNA, 21 bp, Homo sapiens
cttcaccctgtcaagttaaca

SEQ ID NO: 210379 - DNA, 13 bp, Homo sapiens
cttcacctctatc

SEQ ID NO: 210380 - DNA, 11 bp, Homo sapiens
cttcaccttaa

SEQ ID NO: 210381 - DNA, 13 bp, Homo sapiens
cttcacgctggct

SEQ ID NO: 210382 - DNA, 19 bp, Homo sapiens
cttcacggactctttgctg

SEQ ID NO: 210383 - DNA, 20 bp, Homo sapiens
cttcacggactctttgctgt

SEQ ID NO: 210384 - DNA, 21 bp, Homo sapiens
cttcacggactctttgctgtt

SEQ ID NO: 210385 - DNA, 18 bp, Homo sapiens
cttcactattcagaactt

SEQ ID NO: 210386 - DNA, 15 bp, Homo sapiens
cttcactctctgaag

SEQ ID NO: 210387 - DNA, 17 bp, Homo sapiens
cttcactggagaccgga

SEQ ID NO: 210388 - DNA, 18 bp, Homo sapiens
cttcactgttgaaaatta

SEQ ID NO: 210389 - DNA, 19 bp, Homo sapiens
cttcactgttgaaaattat

SEQ ID NO: 210390 - DNA, 15 bp, Homo sapiens
cttcacttaaaatca

SEQ ID NO: 210391 - DNA, 20 bp, Homo sapiens
cttcagaaagtgtgctttat

SEQ ID NO: 210392 - DNA, 20 bp, Homo sapiens
cttcagaaggggacctgttt

SEQ ID NO: 210393 - DNA, 17 bp, Homo sapiens
cttcagactctctcctc

SEQ ID NO: 210394 - DNA, 16 bp, Homo sapiens
cttcagactgcaagtg

SEQ ID NO: 210395 - DNA, 14 bp, Homo sapiens
cttcagagaagtca

SEQ ID NO: 210396 - DNA, 11 bp, Homo sapiens
cttcagagctc

SEQ ID NO: 210397 - DNA, 14 bp, Homo sapiens
cttcagatattttg

SEQ ID NO: 210398 - DNA, 14 bp, Homo sapiens
cttcagatcctacc

SEQ ID NO: 210399 - DNA, 15 bp, Homo sapiens
cttcagatcctaccc

SEQ ID NO: 210400 - DNA, 16 bp, Homo sapiens
cttcagatcctacccc

SEQ ID NO: 210401 - DNA, 14 bp, Homo sapiens
cttcagatcctgct

SEQ ID NO: 210402 - DNA, 23 bp, Homo sapiens
cttcagcataattcggaagggaa

SEQ ID NO: 210403 - DNA, 12 bp, Homo sapiens
cttcagcccctg

SEQ ID NO: 210404 - DNA, 13 bp, Homo sapiens
cttcagccctggc

SEQ ID NO: 210405 - DNA, 15 bp, Homo sapiens
cttcagcgagaccct

SEQ ID NO: 210406 - DNA, 13 bp, Homo sapiens
cttcagctgcctg

SEQ ID NO: 210407 - DNA, 15 bp, Homo sapiens
cttcagctgcctgaa

SEQ ID NO: 210408 - DNA, 19 bp, Homo sapiens
cttcagctgcctgaaacag

SEQ ID NO: 210409 - DNA, 18 bp, Homo sapiens
cttcaggagatgatgtga

SEQ ID NO: 210410 - DNA, 22 bp, Homo sapiens
cttcaggatgcacggtttctgt

SEQ ID NO: 210411 - DNA, 17 bp, Homo sapiens
cttcaggctcttctcct

SEQ ID NO: 210412 - DNA, 18 bp, Homo sapiens
cttcaggctcttctcctt

SEQ ID NO: 210413 - DNA, 21 bp, Homo sapiens
cttcaggcttcctgcaatttt

SEQ ID NO: 210414 - DNA, 19 bp, Homo sapiens
cttcagggcagggctctga

SEQ ID NO: 210415 - DNA, 22 bp, Homo sapiens
cttcagggccagaaggagggca

SEQ ID NO: 210416 - DNA, 14 bp, Homo sapiens
cttcagggggccag

SEQ ID NO: 210417 - DNA, 23 bp, Homo sapiens
cttcagggggccaggtgcacaga

SEQ ID NO: 210418 - DNA, 18 bp, Homo sapiens
cttcaggggtcacctcct

SEQ ID NO: 210419 - DNA, 19 bp, Homo sapiens
cttcaggggtcacctcctc

SEQ ID NO: 210420 - DNA, 19 bp, Homo sapiens
cttcagggttctaaccttt

SEQ ID NO: 210421 - DNA, 15 bp, Homo sapiens
cttcaggttcttagt

SEQ ID NO: 210422 - DNA, 19 bp, Homo sapiens
cttcaggttcttagtgtca

SEQ ID NO: 210423 - DNA, 20 bp, Homo sapiens
cttcaggttgttctgtataa

SEQ ID NO: 210424 - DNA, 15 bp, Homo sapiens
cttcagtatcaaggc

SEQ ID NO: 210425 - DNA, 17 bp, Homo sapiens
cttcagtgagcccctcc

SEQ ID NO: 210426 - DNA, 14 bp, Homo sapiens
cttcagtgtgttga

SEQ ID NO: 210427 - DNA, 17 bp, Homo sapiens
cttcagttgttttcccg

SEQ ID NO: 210428 - DNA, 17 bp, Homo sapiens
cttcataatataacaac

SEQ ID NO: 210429 - DNA, 14 bp, Homo sapiens
cttcatagctcctt

SEQ ID NO: 210430 - DNA, 17 bp, Homo sapiens
cttcataggcagagccc

SEQ ID NO: 210431 - DNA, 16 bp, Homo sapiens
cttcatcgcagtggac

SEQ ID NO: 210432 - DNA, 13 bp, Homo sapiens
cttcatctccagg

SEQ ID NO: 210433 - DNA, 17 bp, Homo sapiens
cttcatctccagggagt

SEQ ID NO: 210434 - DNA, 20 bp, Homo sapiens
cttcatcttgagcctgagcc

SEQ ID NO: 210435 - DNA, 16 bp, Homo sapiens
cttcatgaaaatccta

SEQ ID NO: 210436 - DNA, 13 bp, Homo sapiens
cttcatgcaatga

SEQ ID NO: 210437 - DNA, 14 bp, Homo sapiens
cttcatgcctttgt

SEQ ID NO: 210438 - DNA, 12 bp, Homo sapiens
cttcatggtctc

SEQ ID NO: 210439 - DNA, 23 bp, Homo sapiens
cttcatgtcaacttctggctcct

SEQ ID NO: 210440 - DNA, 16 bp, Homo sapiens
cttcattcccactgca

SEQ ID NO: 210441 - DNA, 16 bp, Homo sapiens
cttcattccgttagga

SEQ ID NO: 210442 - DNA, 20 bp, Homo sapiens
cttcattctaaaccaaaaca

SEQ ID NO: 210443 - DNA, 20 bp, Homo sapiens
cttcattcttgaaagctgtg

SEQ ID NO: 210444 - DNA, 14 bp, Homo sapiens
cttcatttcatcct

SEQ ID NO: 210445 - DNA, 16 bp, Homo sapiens
cttcatttcatcctgt

SEQ ID NO: 210446 - DNA, 18 bp, Homo sapiens
cttcatttcatcctgttg

SEQ ID NO: 210447 - DNA, 17 bp, Homo sapiens
cttcatttcattgtatg

SEQ ID NO: 210448 - DNA, 14 bp, Homo sapiens
cttcatttgtgtca

SEQ ID NO: 210449 - DNA, 17 bp, Homo sapiens
cttcatttttcctaaca

SEQ ID NO: 210450 - DNA, 17 bp, Homo sapiens
cttccaaaaattattat

SEQ ID NO: 210451 - DNA, 19 bp, Homo sapiens
cttccaaaaattattataa

SEQ ID NO: 210452 - DNA, 13 bp, Homo sapiens
cttccaaagcaca

SEQ ID NO: 210453 - DNA, 17 bp, Homo sapiens
cttccaactatgtccag

SEQ ID NO: 210454 - DNA, 15 bp, Homo sapiens
cttccaactgctgcc

SEQ ID NO: 210455 - DNA, 14 bp, Homo sapiens
cttccaagaaaaat

SEQ ID NO: 210456 - DNA, 16 bp, Homo sapiens
cttccaagaaaaataa

SEQ ID NO: 210457 - DNA, 13 bp, Homo sapiens
cttccaagacctg

SEQ ID NO: 210458 - DNA, 18 bp, Homo sapiens
cttccaagacctgactca

SEQ ID NO: 210459 - DNA, 15 bp, Homo sapiens
catttaaaacatttg

SEQ ID NO: 210460 - DNA, 16 bp, Homo sapiens
catttaaaatgattag

SEQ ID NO: 210461 - DNA, 16 bp, Homo sapiens
catttaaaatggactt

SEQ ID NO: 210462 - DNA, 22 bp, Homo sapiens
catttaaaatgtaaactcttca

SEQ ID NO: 210463 - DNA, 19 bp, Homo sapiens
catttaactagcactttat

SEQ ID NO: 210464 - DNA, 18 bp, Homo sapiens
catttaatcaatatttaa

SEQ ID NO: 210465 - DNA, 13 bp, Homo sapiens
catttaatcattt

SEQ ID NO: 210466 - DNA, 23 bp, Homo sapiens
catttacaggaaattgcaaagaa

SEQ ID NO: 210467 - DNA, 19 bp, Homo sapiens
catttacgtaaaaagatat

SEQ ID NO: 210468 - DNA, 14 bp, Homo sapiens
catttactttgttt

SEQ ID NO: 210469 - DNA, 12 bp, Homo sapiens
catttactttta

SEQ ID NO: 210470 - DNA, 12 bp, Homo sapiens
catttagaaaat

SEQ ID NO: 210471 - DNA, 22 bp, Homo sapiens
catttagaaaatagagctttta

SEQ ID NO: 210472 - DNA, 20 bp, Homo sapiens
catttagaatttgaaaggaa

SEQ ID NO: 210473 - DNA, 13 bp, Homo sapiens
catttaggagaag

SEQ ID NO: 210474 - DNA, 18 bp, Homo sapiens
catttaggtgaggaagca

SEQ ID NO: 210475 - DNA, 16 bp, Homo sapiens
catttagtcctcacct

SEQ ID NO: 210476 - DNA, 22 bp, Homo sapiens
catttagttgggtctgaaagga

SEQ ID NO: 210477 - DNA, 20 bp, Homo sapiens
catttataaccccagcctga

SEQ ID NO: 210478 - DNA, 14 bp, Homo sapiens
catttataatgttt

SEQ ID NO: 210479 - DNA, 20 bp, Homo sapiens
catttatcaagcagagacct

SEQ ID NO: 210480 - DNA, 12 bp, Homo sapiens
catttatcattc

SEQ ID NO: 210481 - DNA, 15 bp, Homo sapiens
catttatcttctgtt

SEQ ID NO: 210482 - DNA, 23 bp, Homo sapiens
catttatcttctgtttttctcaa

SEQ ID NO: 210483 - DNA, 17 bp, Homo sapiens
catttatgcatgagaac

SEQ ID NO: 210484 - DNA, 21 bp, Homo sapiens
catttatgcatgagaactaaa

SEQ ID NO: 210485 - DNA, 17 bp, Homo sapiens
catttattgcagtttat

SEQ ID NO: 210486 - DNA, 15 bp, Homo sapiens
catttcaactgtttg

SEQ ID NO: 210487 - DNA, 13 bp, Homo sapiens
catttcaggaggg

SEQ ID NO: 210488 - DNA, 14 bp, Homo sapiens
catttcataaaaat

SEQ ID NO: 210489 - DNA, 15 bp, Homo sapiens
catttcataaaaatc

SEQ ID NO: 210490 - DNA, 19 bp, Homo sapiens
catttcataaggcctgccc

SEQ ID NO: 210491 - DNA, 17 bp, Homo sapiens
catttcatgtgatctat

SEQ ID NO: 210492 - DNA, 19 bp, Homo sapiens
catttccaacaccacagac

SEQ ID NO: 210493 - DNA, 22 bp, Homo sapiens
catttccaacaccacagacaca

SEQ ID NO: 210494 - DNA, 15 bp, Homo sapiens
catttccagcaaaat

SEQ ID NO: 210495 - DNA, 19 bp, Homo sapiens
catttccagcaaaatatat

SEQ ID NO: 210496 - DNA, 20 bp, Homo sapiens
catttccccagacctgagct

SEQ ID NO: 210497 - DNA, 16 bp, Homo sapiens
catttcctcttccttc

SEQ ID NO: 210498 - DNA, 17 bp, Homo sapiens
catttcctcttccttct

SEQ ID NO: 210499 - DNA, 14 bp, Homo sapiens
catttctactttga

SEQ ID NO: 210500 - DNA, 16 bp, Homo sapiens
catttctactttgact

SEQ ID NO: 210501 - DNA, 14 bp, Homo sapiens
catttctatttatt

SEQ ID NO: 210502 - DNA, 18 bp, Homo sapiens
catttctatttatttact

SEQ ID NO: 210503 - DNA, 23 bp, Homo sapiens
catttctatttatttactgagct

SEQ ID NO: 210504 - DNA, 20 bp, Homo sapiens
catttctcaaagtttttaca

SEQ ID NO: 210505 - DNA, 13 bp, Homo sapiens
catttctcactga

SEQ ID NO: 210506 - DNA, 16 bp, Homo sapiens
catttctcatgtgctt

SEQ ID NO: 210507 - DNA, 15 bp, Homo sapiens
catttctgatgtctc

SEQ ID NO: 210508 - DNA, 16 bp, Homo sapiens
catttctgtctcccct

SEQ ID NO: 210509 - DNA, 14 bp, Homo sapiens
catttcttcagagg

SEQ ID NO: 210510 - DNA, 17 bp, Homo sapiens
catttcttcagagggaa

SEQ ID NO: 210511 - DNA, 14 bp, Homo sapiens
catttcttgggccc

SEQ ID NO: 210512 - DNA, 21 bp, Homo sapiens
catttgaaagtgggtttcaat

SEQ ID NO: 210513 - DNA, 16 bp, Homo sapiens
catttgatgctaaata

SEQ ID NO: 210514 - DNA, 21 bp, Homo sapiens
catttgatgtctagataacat

SEQ ID NO: 210515 - DNA, 15 bp, Homo sapiens
catttgcagctgctg

SEQ ID NO: 210516 - DNA, 20 bp, Homo sapiens
catttgcgcacaacttaaaa

SEQ ID NO: 210517 - DNA, 11 bp, Homo sapiens
catttgctaat

SEQ ID NO: 210518 - DNA, 12 bp, Homo sapiens
catttgctgaat

SEQ ID NO: 210519 - DNA, 21 bp, Homo sapiens
catttgctgaatatgcaattt

SEQ ID NO: 210520 - DNA, 21 bp, Homo sapiens
catttgctgcatttcaagtta

SEQ ID NO: 210521 - DNA, 18 bp, Homo sapiens
catttgctttttgcttgt

SEQ ID NO: 210522 - DNA, 16 bp, Homo sapiens
catttggaaggaaagg

SEQ ID NO: 210523 - DNA, 17 bp, Homo sapiens
catttgggactgtcttg

SEQ ID NO: 210524 - DNA, 22 bp, Homo sapiens
catttgggactgtcttgagaaa

SEQ ID NO: 210525 - DNA, 18 bp, Homo sapiens
catttgggagactgagct

SEQ ID NO: 210526 - DNA, 20 bp, Homo sapiens
catttggtgcacttttctgt

SEQ ID NO: 210527 - DNA, 16 bp, Homo sapiens
catttgtaataaagta

SEQ ID NO: 210528 - DNA, 17 bp, Homo sapiens
catttgtaatgtatctt

SEQ ID NO: 210529 - DNA, 21 bp, Homo sapiens
catttgtaatttttttctagt

SEQ ID NO: 210530 - DNA, 18 bp, Homo sapiens
catttgtacattcctgat

SEQ ID NO: 210531 - DNA, 23 bp, Homo sapiens
catttgtatgttgtgaagatgtt

SEQ ID NO: 210532 - DNA, 13 bp, Homo sapiens
catttgtcctgca

SEQ ID NO: 210533 - DNA, 21 bp, Homo sapiens
catttgtcctgcagagctggg

SEQ ID NO: 210534 - DNA, 17 bp, Homo sapiens
catttgtcttagagaga

SEQ ID NO: 210535 - DNA, 16 bp, Homo sapiens
catttgtgaaatgatg

SEQ ID NO: 210536 - DNA, 15 bp, Homo sapiens
catttgtgaggccca

SEQ ID NO: 210537 - DNA, 16 bp, Homo sapiens
catttgtgcataaatt

SEQ ID NO: 210538 - DNA, 17 bp, Homo sapiens
catttgtgcataaattt

SEQ ID NO: 210539 - DNA, 18 bp, Homo sapiens
catttgtgcataaatttc

SEQ ID NO: 210540 - DNA, 19 bp, Homo sapiens
catttgtgtgtgtgcaagt

SEQ ID NO: 210541 - DNA, 22 bp, Homo sapiens
catttgtgtgtgtgcaagtgtg

SEQ ID NO: 210542 - DNA, 13 bp, Homo sapiens
catttgttaaaat

SEQ ID NO: 210543 - DNA, 17 bp, Homo sapiens
catttgttcattaaacg

SEQ ID NO: 210544 - DNA, 21 bp, Homo sapiens
cattttaacagtacctgtgcc

SEQ ID NO: 210545 - DNA, 17 bp, Homo sapiens
cattttaattattattc

SEQ ID NO: 210546 - DNA, 15 bp, Homo sapiens
cattttactgtctgt

SEQ ID NO: 210547 - DNA, 16 bp, Homo sapiens
cattttactgtctgta

SEQ ID NO: 210548 - DNA, 15 bp, Homo sapiens
cattttagacagtaa

SEQ ID NO: 210549 - DNA, 16 bp, Homo sapiens
cattttatacaagaag

SEQ ID NO: 210550 - DNA, 22 bp, Homo sapiens
cattttattcacatatgtctta

SEQ ID NO: 210551 - DNA, 17 bp, Homo sapiens
cattttcagtaccaaag

SEQ ID NO: 210552 - DNA, 19 bp, Homo sapiens
cattttccacggaaacaga

SEQ ID NO: 210553 - DNA, 20 bp, Homo sapiens
cattttcctcgcctaggcct

SEQ ID NO: 210554 - DNA, 12 bp, Homo sapiens
cattttcctggg

SEQ ID NO: 210555 - DNA, 14 bp, Homo sapiens
cattttctctcctc

SEQ ID NO: 210556 - DNA, 19 bp, Homo sapiens
cattttctgtaattgctgc

SEQ ID NO: 210557 - DNA, 14 bp, Homo sapiens
cattttcttgtcaa

SEQ ID NO: 210558 - DNA, 14 bp, Homo sapiens
cattttgacctact

SEQ ID NO: 210559 - DNA, 12 bp, Homo sapiens
cattttgcaaaa

SEQ ID NO: 210560 - DNA, 15 bp, Homo sapiens
cattttgcaaaattt

SEQ ID NO: 210561 - DNA, 17 bp, Homo sapiens
cattttgcaaaatttcc

SEQ ID NO: 210562 - DNA, 16 bp, Homo sapiens
cattttgcagcagtga

SEQ ID NO: 210563 - DNA, 20 bp, Homo sapiens
cattttgcagcagtgagtct

SEQ ID NO: 210564 - DNA, 23 bp, Homo sapiens
cattttgccacctttcctgttca

SEQ ID NO: 210565 - DNA, 15 bp, Homo sapiens
cattttgcgatgtgt

SEQ ID NO: 210566 - DNA, 16 bp, Homo sapiens
cattttgggaaattct

SEQ ID NO: 210567 - DNA, 13 bp, Homo sapiens
cattttgtaactg

SEQ ID NO: 210568 - DNA, 16 bp, Homo sapiens
cattttgtatgtatgt

SEQ ID NO: 210569 - DNA, 15 bp, Homo sapiens
cattttgtgtaatat

SEQ ID NO: 210570 - DNA, 11 bp, Homo sapiens
cattttgtgtc

SEQ ID NO: 210571 - DNA, 17 bp, Homo sapiens
cattttgttatagaata

SEQ ID NO: 210572 - DNA, 21 bp, Homo sapiens
catttttaaaggacaaacagt

SEQ ID NO: 210573 - DNA, 23 bp, Homo sapiens
catttttaaaggacaaacagtga

SEQ ID NO: 210574 - DNA, 13 bp, Homo sapiens
catttttaagaat

SEQ ID NO: 210575 - DNA, 17 bp, Homo sapiens
catttttacaataaata

SEQ ID NO: 210576 - DNA, 18 bp, Homo sapiens
catttttactaaagcagt

SEQ ID NO: 210577 - DNA, 20 bp, Homo sapiens
catttttactactattctgt

SEQ ID NO: 210578 - DNA, 17 bp, Homo sapiens
catttttcattttctct

SEQ ID NO: 210579 - DNA, 13 bp, Homo sapiens
catttttcctaac

SEQ ID NO: 210580 - DNA, 15 bp, Homo sapiens
catttttgtattttg

SEQ ID NO: 210581 - DNA, 21 bp, Homo sapiens
catttttgtattttgtacaaa

SEQ ID NO: 210582 - DNA, 21 bp, Homo sapiens
catttttgtgggggctagaaa

SEQ ID NO: 210583 - DNA, 19 bp, Homo sapiens
ccaaaaaatgtgagctata

SEQ ID NO: 210584 - DNA, 23 bp, Homo sapiens
ccaaaaagaatctgcatttagca

SEQ ID NO: 210585 - DNA, 20 bp, Homo sapiens
ccaaaagtgagatgggaagg

SEQ ID NO: 210586 - DNA, 23 bp, Homo sapiens
ccaaacagttgtaccactgctaa

SEQ ID NO: 210587 - DNA, 21 bp, Homo sapiens
ccaaacatcagacctgtcttc

SEQ ID NO: 210588 - DNA, 11 bp, Homo sapiens
ccaaaccactt

SEQ ID NO: 210589 - DNA, 13 bp, Homo sapiens
ccaaaccccagcc

SEQ ID NO: 210590 - DNA, 17 bp, Homo sapiens
ccaaaccccagccccaa

SEQ ID NO: 210591 - DNA, 16 bp, Homo sapiens
ccaaacccttcagtgc

SEQ ID NO: 210592 - DNA, 15 bp, Homo sapiens
ccaaacctgacagat

SEQ ID NO: 210593 - DNA, 13 bp, Homo sapiens
cttccaaggagac

SEQ ID NO: 210594 - DNA, 15 bp, Homo sapiens
cttccaaggagacca

SEQ ID NO: 210595 - DNA, 22 bp, Homo sapiens
cttccaatgatgcttactacag

SEQ ID NO: 210596 - DNA, 22 bp, Homo sapiens
cttccacagcaaatgagatgta

SEQ ID NO: 210597 - DNA, 17 bp, Homo sapiens
cttccacagcagcagaa

SEQ ID NO: 210598 - DNA, 15 bp, Homo sapiens
cttccacctccctcc

SEQ ID NO: 210599 - DNA, 18 bp, Homo sapiens
cttccacgctgtctccag

SEQ ID NO: 210600 - DNA, 22 bp, Homo sapiens
cttccacgctgtctccagaccc

SEQ ID NO: 210601 - DNA, 16 bp, Homo sapiens
cttccactgcctctgc

SEQ ID NO: 210602 - DNA, 19 bp, Homo sapiens
cttccagatgtctaaaaga

SEQ ID NO: 210603 - DNA, 16 bp, Homo sapiens
cttccagcgggccctc

SEQ ID NO: 210604 - DNA, 22 bp, Homo sapiens
cttccaggcccagtccactggg

SEQ ID NO: 210605 - DNA, 18 bp, Homo sapiens
cttccaggcgtagggcca

SEQ ID NO: 210606 - DNA, 13 bp, Homo sapiens
cttccaggctctt

SEQ ID NO: 210607 - DNA, 22 bp, Homo sapiens
cttccaggctcttcctggacct

SEQ ID NO: 210608 - DNA, 21 bp, Homo sapiens
cttccaggggtcaccttgaga

SEQ ID NO: 210609 - DNA, 22 bp, Homo sapiens
cttccaggtatgggacctgcta

SEQ ID NO: 210610 - DNA, 23 bp, Homo sapiens
cttccaggttccatccaccacct

SEQ ID NO: 210611 - DNA, 11 bp, Homo sapiens
cttccataatc

SEQ ID NO: 210612 - DNA, 23 bp, Homo sapiens
cttccataatgtataaagaacaa

SEQ ID NO: 210613 - DNA, 11 bp, Homo sapiens
cttccataatt

SEQ ID NO: 210614 - DNA, 14 bp, Homo sapiens
cttccataattatg

SEQ ID NO: 210615 - DNA, 18 bp, Homo sapiens
cttccataggacatactg

SEQ ID NO: 210616 - DNA, 23 bp, Homo sapiens
cttccataggacatactgcatgt

SEQ ID NO: 210617 - DNA, 13 bp, Homo sapiens
cttccatcagcag

SEQ ID NO: 210618 - DNA, 17 bp, Homo sapiens
cttccatcagcagtgat

SEQ ID NO: 210619 - DNA, 20 bp, Homo sapiens
cttccatcagcagtgattga

SEQ ID NO: 210620 - DNA, 14 bp, Homo sapiens
cttccatcagctct

SEQ ID NO: 210621 - DNA, 19 bp, Homo sapiens
cttccatcagctctctgca

SEQ ID NO: 210622 - DNA, 14 bp, Homo sapiens
cttccatccctacc

SEQ ID NO: 210623 - DNA, 17 bp, Homo sapiens
cttccatggcttcctga

SEQ ID NO: 210624 - DNA, 19 bp, Homo sapiens
cttccatggcttcctgaga

SEQ ID NO: 210625 - DNA, 12 bp, Homo sapiens
cttccattcttt

SEQ ID NO: 210626 - DNA, 21 bp, Homo sapiens
cttccattgctcccagtgcca

SEQ ID NO: 210627 - DNA, 12 bp, Homo sapiens
cttccatttata

SEQ ID NO: 210628 - DNA, 22 bp, Homo sapiens
cttcccaaaccaagtgccttga

SEQ ID NO: 210629 - DNA, 13 bp, Homo sapiens
cttcccaaactcc

SEQ ID NO: 210630 - DNA, 16 bp, Homo sapiens
cttcccaaactcccag

SEQ ID NO: 210631 - DNA, 16 bp, Homo sapiens
cttcccaacagcctta

SEQ ID NO: 210632 - DNA, 19 bp, Homo sapiens
cttcccaacagccttagct

SEQ ID NO: 210633 - DNA, 22 bp, Homo sapiens
cttcccaacagccttagctgcc

SEQ ID NO: 210634 - DNA, 21 bp, Homo sapiens
cttcccaacgtactcctcaga

SEQ ID NO: 210635 - DNA, 12 bp, Homo sapiens
cttcccacccct

SEQ ID NO: 210636 - DNA, 18 bp, Homo sapiens
cttcccacggccactgca

SEQ ID NO: 210637 - DNA, 19 bp, Homo sapiens
cttcccacggccactgcag

SEQ ID NO: 210638 - DNA, 13 bp, Homo sapiens
cttcccactgtcc

SEQ ID NO: 210639 - DNA, 14 bp, Homo sapiens
cttcccactgtcct

SEQ ID NO: 210640 - DNA, 17 bp, Homo sapiens
cttcccactgtcctttc

SEQ ID NO: 210641 - DNA, 18 bp, Homo sapiens
cttcccactgtcctttct

SEQ ID NO: 210642 - DNA, 19 bp, Homo sapiens
cttcccactgtcctttctc

SEQ ID NO: 210643 - DNA, 22 bp, Homo sapiens
cttcccactgtcctttctccag

SEQ ID NO: 210644 - DNA, 19 bp, Homo sapiens
cttcccagctggcagcgcc

SEQ ID NO: 210645 - DNA, 12 bp, Homo sapiens
cttcccaggcca

SEQ ID NO: 210646 - DNA, 16 bp, Homo sapiens
cttcccatgactgcac

SEQ ID NO: 210647 - DNA, 17 bp, Homo sapiens
cttcccatgactgcacc

SEQ ID NO: 210648 - DNA, 18 bp, Homo sapiens
cttcccatgactgcaccc

SEQ ID NO: 210649 - DNA, 14 bp, Homo sapiens
cttcccatgcctgt

SEQ ID NO: 210650 - DNA, 15 bp, Homo sapiens
cttcccatgcctgtc

SEQ ID NO: 210651 - DNA, 15 bp, Homo sapiens
cttcccattgtggct

SEQ ID NO: 210652 - DNA, 23 bp, Homo sapiens
cttccccaacgaaaagcacatcc

SEQ ID NO: 210653 - DNA, 11 bp, Homo sapiens
cttccccactc

SEQ ID NO: 210654 - DNA, 12 bp, Homo sapiens
cttccccactcc

SEQ ID NO: 210655 - DNA, 13 bp, Homo sapiens
cttccccactccc

SEQ ID NO: 210656 - DNA, 21 bp, Homo sapiens
cttccccactctgctcccagc

SEQ ID NO: 210657 - DNA, 20 bp, Homo sapiens
cttccccactgcctgcccac

SEQ ID NO: 210658 - DNA, 19 bp, Homo sapiens
cttccccagggttctgtat

SEQ ID NO: 210659 - DNA, 20 bp, Homo sapiens
cttccccagggttctgtatt

SEQ ID NO: 210660 - DNA, 14 bp, Homo sapiens
cttccccatcccga

SEQ ID NO: 210661 - DNA, 13 bp, Homo sapiens
cttccccatttcc

SEQ ID NO: 210662 - DNA, 20 bp, Homo sapiens
cttcccccagcccaataaag

SEQ ID NO: 210663 - DNA, 18 bp, Homo sapiens
cttccccctgtagactag

SEQ ID NO: 210664 - DNA, 14 bp, Homo sapiens
cttcccccttcccc

SEQ ID NO: 210665 - DNA, 20 bp, Homo sapiens
cttcccccttcccctgcgcc

SEQ ID NO: 210666 - DNA, 13 bp, Homo sapiens
cttcccctccctg

SEQ ID NO: 210667 - DNA, 16 bp, Homo sapiens
cttcccctccctggct

SEQ ID NO: 210668 - DNA, 18 bp, Homo sapiens
cttcccctccctggctcc

SEQ ID NO: 210669 - DNA, 14 bp, Homo sapiens
cttcccctccctgt

SEQ ID NO: 210670 - DNA, 17 bp, Homo sapiens
cttcccctgcgccctcc

SEQ ID NO: 210671 - DNA, 20 bp, Homo sapiens
cttcccctgcgccctccctc

SEQ ID NO: 210672 - DNA, 14 bp, Homo sapiens
cttcccctgctgac

SEQ ID NO: 210673 - DNA, 15 bp, Homo sapiens
cttccccttccaact

SEQ ID NO: 210674 - DNA, 17 bp, Homo sapiens
cttccccttgaacctca

SEQ ID NO: 210675 - DNA, 19 bp, Homo sapiens
cttccccttgaacctcatt

SEQ ID NO: 210676 - DNA, 22 bp, Homo sapiens
cttccccttgggatgggcacag

SEQ ID NO: 210677 - DNA, 18 bp, Homo sapiens
cttccccttttgcctggc

SEQ ID NO: 210678 - DNA, 20 bp, Homo sapiens
cttccccttttgcctggctg

SEQ ID NO: 210679 - DNA, 21 bp, Homo sapiens
cttccccttttgcctggctgt

SEQ ID NO: 210680 - DNA, 15 bp, Homo sapiens
cttcccgcagcacca

SEQ ID NO: 210681 - DNA, 20 bp, Homo sapiens
cttcccgcagcaccagcctg

SEQ ID NO: 210682 - DNA, 17 bp, Homo sapiens
cttcccgcctcagcctc

SEQ ID NO: 210683 - DNA, 15 bp, Homo sapiens
cttccctacctcagg

SEQ ID NO: 210684 - DNA, 23 bp, Homo sapiens
cttccctagagggttcctgtaga

SEQ ID NO: 210685 - DNA, 19 bp, Homo sapiens
cttccctagatggttccct

SEQ ID NO: 210686 - DNA, 17 bp, Homo sapiens
cttccctagggctgggt

SEQ ID NO: 210687 - DNA, 14 bp, Homo sapiens
cttccctagttctt

SEQ ID NO: 210688 - DNA, 18 bp, Homo sapiens
cttccctcactcttcctc

SEQ ID NO: 210689 - DNA, 20 bp, Homo sapiens
cttccctccccacagtcctc

SEQ ID NO: 210690 - DNA, 16 bp, Homo sapiens
cttccctctccccaag

SEQ ID NO: 210691 - DNA, 17 bp, Homo sapiens
cttccctctcgctcccc

SEQ ID NO: 210692 - DNA, 18 bp, Homo sapiens
cttccctctcgctcccct

SEQ ID NO: 210693 - DNA, 13 bp, Homo sapiens
cttccctctgcct

SEQ ID NO: 210694 - DNA, 18 bp, Homo sapiens
cttccctctgcctgtccc

SEQ ID NO: 210695 - DNA, 11 bp, Homo sapiens
cttccctgctt

SEQ ID NO: 210696 - DNA, 15 bp, Homo sapiens
cttccctgggaaggc

SEQ ID NO: 210697 - DNA, 12 bp, Homo sapiens
cttccctggggg

SEQ ID NO: 210698 - DNA, 17 bp, Homo sapiens
cttccctgggggtccca

SEQ ID NO: 210699 - DNA, 20 bp, Homo sapiens
cttccctggtccagattgta

SEQ ID NO: 210700 - DNA, 19 bp, Homo sapiens
cttcccttagcctctccca

SEQ ID NO: 210701 - DNA, 15 bp, Homo sapiens
cttcccttccactgc

SEQ ID NO: 210702 - DNA, 19 bp, Homo sapiens
cttccgagtagctgggatt

SEQ ID NO: 210703 - DNA, 13 bp, Homo sapiens
cttccgctcccac

SEQ ID NO: 210704 - DNA, 17 bp, Homo sapiens
cttccgctcccaccagc

SEQ ID NO: 210705 - DNA, 23 bp, Homo sapiens
cttccgctgcgggcccagctgag

SEQ ID NO: 210706 - DNA, 13 bp, Homo sapiens
cttccgggagctg

SEQ ID NO: 210707 - DNA, 23 bp, Homo sapiens
cttccgggagctggtgacagcct

SEQ ID NO: 210708 - DNA, 23 bp, Homo sapiens
cttccgtcacccttggtagagtt

SEQ ID NO: 210709 - DNA, 21 bp, Homo sapiens
cttccgtgggtcatcccagca

SEQ ID NO: 210710 - DNA, 22 bp, Homo sapiens
cttcctacaagagcagcctgtg

SEQ ID NO: 210711 - DNA, 24 bp, Homo sapiens
cttcctacaagagcagcctgtggc

SEQ ID NO: 210712 - DNA, 21 bp, Homo sapiens
cttcctagagcatctgtccca

SEQ ID NO: 210713 - DNA, 19 bp, Homo sapiens
cttcctagcttatctccct

SEQ ID NO: 210714 - DNA, 15 bp, Homo sapiens
cttcctatgcccagg

SEQ ID NO: 210715 - DNA, 18 bp, Homo sapiens
cttcctcaagtcttgaca

SEQ ID NO: 210716 - DNA, 15 bp, Homo sapiens
cttcctcaccctgat

SEQ ID NO: 210717 - DNA, 14 bp, Homo sapiens
cttcctcacttcca

SEQ ID NO: 210718 - DNA, 11 bp, Homo sapiens
cttcctccaga

SEQ ID NO: 210719 - DNA, 12 bp, Homo sapiens
cttcctccagag

SEQ ID NO: 210720 - DNA, 20 bp, Homo sapiens
cttcctccagtctgttctca

SEQ ID NO: 210721 - DNA, 21 bp, Homo sapiens
cttcctccagtctgttctcac

SEQ ID NO: 210722 - DNA, 22 bp, Homo sapiens
cttcctccatggcccatcactc

SEQ ID NO: 210723 - DNA, 16 bp, Homo sapiens
cttcctccctccctgc

SEQ ID NO: 210724 - DNA, 17 bp, Homo sapiens
cttcctccctccctgca

SEQ ID NO: 210725 - DNA, 18 bp, Homo sapiens
cttcctccctccctgcag

SEQ ID NO: 210726 - DNA, 20 bp, Homo sapiens
cttcctccctccctgcaggg

SEQ ID NO: 210727 - DNA, 15 bp, Homo sapiens
ccaaactactttctt

SEQ ID NO: 210728 - DNA, 16 bp, Homo sapiens
ccaaactcctgcctgt

SEQ ID NO: 210729 - DNA, 16 bp, Homo sapiens
ccaaagaacttgattt

SEQ ID NO: 210730 - DNA, 21 bp, Homo sapiens
ccaaagaacttgatttgcatg

SEQ ID NO: 210731 - DNA, 14 bp, Homo sapiens
ccaaagacctgcct

SEQ ID NO: 210732 - DNA, 19 bp, Homo sapiens
ccaaagactgtactggcca

SEQ ID NO: 210733 - DNA, 16 bp, Homo sapiens
ccaaagagaaaagatt

SEQ ID NO: 210734 - DNA, 13 bp, Homo sapiens
ccaaagagctctt

SEQ ID NO: 210735 - DNA, 20 bp, Homo sapiens
ccaaagcaatgtgagtccca

SEQ ID NO: 210736 - DNA, 21 bp, Homo sapiens
ccaaagcagttgggagtacat

SEQ ID NO: 210737 - DNA, 15 bp, Homo sapiens
ccaaagccagacagc

SEQ ID NO: 210738 - DNA, 13 bp, Homo sapiens
ccaaagcccagcc

SEQ ID NO: 210739 - DNA, 16 bp, Homo sapiens
ccaaagcccagcccgg

SEQ ID NO: 210740 - DNA, 18 bp, Homo sapiens
ccaaagcccagcccggct

SEQ ID NO: 210741 - DNA, 23 bp, Homo sapiens
ccaaagccccttgctctcccctg

SEQ ID NO: 210742 - DNA, 23 bp, Homo sapiens
ccaaagctagggtggcccttgca

SEQ ID NO: 210743 - DNA, 21 bp, Homo sapiens
ccaaagctgacgaggctgggc

SEQ ID NO: 210744 - DNA, 13 bp, Homo sapiens
ccaaagctttcct

SEQ ID NO: 210745 - DNA, 21 bp, Homo sapiens
ccaaagggaaaactcttcatt

SEQ ID NO: 210746 - DNA, 14 bp, Homo sapiens
ccaaaggggctgct

SEQ ID NO: 210747 - DNA, 18 bp, Homo sapiens
ccaaagtcagtaggagag

SEQ ID NO: 210748 - DNA, 19 bp, Homo sapiens
ccaaagtcagtaggagagg

SEQ ID NO: 210749 - DNA, 14 bp, Homo sapiens
ccaaagtgcagccc

SEQ ID NO: 210750 - DNA, 22 bp, Homo sapiens
ccaaagtgcagcccttcctcct

SEQ ID NO: 210751 - DNA, 22 bp, Homo sapiens
ccaaagtgctgggattacaggg

SEQ ID NO: 210752 - DNA, 20 bp, Homo sapiens
ccaaagtggggagggacaag

SEQ ID NO: 210753 - DNA, 23 bp, Homo sapiens
ccaaagtggggagggacaaggga

SEQ ID NO: 210754 - DNA, 22 bp, Homo sapiens
ccaaagtgttgggattacaggc

SEQ ID NO: 210755 - DNA, 18 bp, Homo sapiens
ccaaataaagttaaaagt

SEQ ID NO: 210756 - DNA, 15 bp, Homo sapiens
ccaaataagaaacct

SEQ ID NO: 210757 - DNA, 20 bp, Homo sapiens
ccaaatagggcaaagaatca

SEQ ID NO: 210758 - DNA, 13 bp, Homo sapiens
ccaaatatgcact

SEQ ID NO: 210759 - DNA, 16 bp, Homo sapiens
ccaaatatgcactttc

SEQ ID NO: 210760 - DNA, 13 bp, Homo sapiens
ccaaatatgtcct

SEQ ID NO: 210761 - DNA, 16 bp, Homo sapiens
ccaaatccacaagcca

SEQ ID NO: 210762 - DNA, 15 bp, Homo sapiens
ccaaatcccagggaa

SEQ ID NO: 210763 - DNA, 21 bp, Homo sapiens
ccaaatcctgggcatccccag

SEQ ID NO: 210764 - DNA, 22 bp, Homo sapiens
ccaaatcctgggcatccccagc

SEQ ID NO: 210765 - DNA, 16 bp, Homo sapiens
ccaaatctactgagcc

SEQ ID NO: 210766 - DNA, 23 bp, Homo sapiens
ccaaatctagccagagcccttca

SEQ ID NO: 210767 - DNA, 13 bp, Homo sapiens
ccaaatctgtcta

SEQ ID NO: 210768 - DNA, 15 bp, Homo sapiens
ccaaatgacttcatt

SEQ ID NO: 210769 - DNA, 19 bp, Homo sapiens
ccaaatgacttcatttctg

SEQ ID NO: 210770 - DNA, 21 bp, Homo sapiens
ccaaatgcacaagctcagaat

SEQ ID NO: 210771 - DNA, 21 bp, Homo sapiens
ccaaatgcagggaggggaggc

SEQ ID NO: 210772 - DNA, 18 bp, Homo sapiens
ccaaatgcctctgccttg

SEQ ID NO: 210773 - DNA, 16 bp, Homo sapiens
ccaaattaaaaatttt

SEQ ID NO: 210774 - DNA, 18 bp, Homo sapiens
ccaaattatcaagctaat

SEQ ID NO: 210775 - DNA, 13 bp, Homo sapiens
ccaaattctctga

SEQ ID NO: 210776 - DNA, 15 bp, Homo sapiens
ccaaattctttattc

SEQ ID NO: 210777 - DNA, 14 bp, Homo sapiens
ccaaattgatgggt

SEQ ID NO: 210778 - DNA, 18 bp, Homo sapiens
ccaacaactccaggaaaa

SEQ ID NO: 210779 - DNA, 16 bp, Homo sapiens
ccaacaaggaaataga

SEQ ID NO: 210780 - DNA, 18 bp, Homo sapiens
ccaacaaggttggcaccc

SEQ ID NO: 210781 - DNA, 21 bp, Homo sapiens
ccaacaaggttggcaccccag

SEQ ID NO: 210782 - DNA, 22 bp, Homo sapiens
ccaacaaggttggcaccccagc

SEQ ID NO: 210783 - DNA, 18 bp, Homo sapiens
ccaacaatggggtgggcc

SEQ ID NO: 210784 - DNA, 23 bp, Homo sapiens
ccaacaattaggtctgcattttc

SEQ ID NO: 210785 - DNA, 22 bp, Homo sapiens
ccaacaccacaaacctttcagc

SEQ ID NO: 210786 - DNA, 15 bp, Homo sapiens
ccaacaccacagaca

SEQ ID NO: 210787 - DNA, 23 bp, Homo sapiens
ccaacaccacagacacacacacg

SEQ ID NO: 210788 - DNA, 18 bp, Homo sapiens
ccaacaccaccccttgcc

SEQ ID NO: 210789 - DNA, 22 bp, Homo sapiens
ccaacaccatcacagcttgttt

SEQ ID NO: 210790 - DNA, 20 bp, Homo sapiens
ccaacaccctgtctaaaaaa

SEQ ID NO: 210791 - DNA, 19 bp, Homo sapiens
ccaacaccttcttggcttc

SEQ ID NO: 210792 - DNA, 23 bp, Homo sapiens
ccaacacttgtgttgctttctga

SEQ ID NO: 210793 - DNA, 20 bp, Homo sapiens
ccaacactttgagcattttt

SEQ ID NO: 210794 - DNA, 16 bp, Homo sapiens
ccaacagaggcctccc

SEQ ID NO: 210795 - DNA, 13 bp, Homo sapiens
ccaacagagtgga

SEQ ID NO: 210796 - DNA, 22 bp, Homo sapiens
ccaacagagtggactcttccct

SEQ ID NO: 210797 - DNA, 14 bp, Homo sapiens
ccaacataaaacaa

SEQ ID NO: 210798 - DNA, 16 bp, Homo sapiens
ccaacatcaacatctt

SEQ ID NO: 210799 - DNA, 17 bp, Homo sapiens
ccaacatcgtgaaaccc

SEQ ID NO: 210800 - DNA, 19 bp, Homo sapiens
ccaacattgccttgcattt

SEQ ID NO: 210801 - DNA, 20 bp, Homo sapiens
ccaaccaagtggctcccaca

SEQ ID NO: 210802 - DNA, 18 bp, Homo sapiens
ccaaccaatgcacacagt

SEQ ID NO: 210803 - DNA, 15 bp, Homo sapiens
ccaaccacctctggc

SEQ ID NO: 210804 - DNA, 19 bp, Homo sapiens
ccaaccacctctggccctg

SEQ ID NO: 210805 - DNA, 21 bp, Homo sapiens
ccaaccacctctggccctgtt

SEQ ID NO: 210806 - DNA, 23 bp, Homo sapiens
ccaaccaggaggggtctgcctcc

SEQ ID NO: 210807 - DNA, 12 bp, Homo sapiens
ccaaccaggcag

SEQ ID NO: 210808 - DNA, 16 bp, Homo sapiens
ccaacccatgcatggc

SEQ ID NO: 210809 - DNA, 14 bp, Homo sapiens
ccaacccatgccct

SEQ ID NO: 210810 - DNA, 16 bp, Homo sapiens
ccaacccccaccccac

SEQ ID NO: 210811 - DNA, 17 bp, Homo sapiens
ccaacccccaccccaca

SEQ ID NO: 210812 - DNA, 15 bp, Homo sapiens
ccaacccccacctcc

SEQ ID NO: 210813 - DNA, 16 bp, Homo sapiens
ccaacccccacctccc

SEQ ID NO: 210814 - DNA, 18 bp, Homo sapiens
ccaacccccacctcccgg

SEQ ID NO: 210815 - DNA, 14 bp, Homo sapiens
ccaaccccggggca

SEQ ID NO: 210816 - DNA, 15 bp, Homo sapiens
ccaaccccggggcat

SEQ ID NO: 210817 - DNA, 14 bp, Homo sapiens
ccaaccgccttggg

SEQ ID NO: 210818 - DNA, 15 bp, Homo sapiens
ccaacctcaatgccc

SEQ ID NO: 210819 - DNA, 17 bp, Homo sapiens
ccaacctcactgccctc

SEQ ID NO: 210820 - DNA, 11 bp, Homo sapiens
ccaacctcagc

SEQ ID NO: 210821 - DNA, 22 bp, Homo sapiens
ccaacctcggcttgtgggctgg

SEQ ID NO: 210822 - DNA, 15 bp, Homo sapiens
ccaacctgaaggagg

SEQ ID NO: 210823 - DNA, 14 bp, Homo sapiens
ccaacgaaaagcac

SEQ ID NO: 210824 - DNA, 15 bp, Homo sapiens
ccaacgaaaagcaca

SEQ ID NO: 210825 - DNA, 19 bp, Homo sapiens
ccaacgatcatatctgtat

SEQ ID NO: 210826 - DNA, 15 bp, Homo sapiens
ccaacgggtctgtgg

SEQ ID NO: 210827 - DNA, 16 bp, Homo sapiens
ccaacgtcccctccgc

SEQ ID NO: 210828 - DNA, 15 bp, Homo sapiens
ccaacgtggggcagc

SEQ ID NO: 210829 - DNA, 19 bp, Homo sapiens
ccaactaacaagaaactca

SEQ ID NO: 210830 - DNA, 21 bp, Homo sapiens
ccaactacccgggcctgaccc

SEQ ID NO: 210831 - DNA, 14 bp, Homo sapiens
ccaactccaggggc

SEQ ID NO: 210832 - DNA, 16 bp, Homo sapiens
ccaactccaggggcac

SEQ ID NO: 210833 - DNA, 16 bp, Homo sapiens
ccaactcccagccacc

SEQ ID NO: 210834 - DNA, 19 bp, Homo sapiens
ccaactccgcccagcctct

SEQ ID NO: 210835 - DNA, 20 bp, Homo sapiens
ccaactccgcccagcctctc

SEQ ID NO: 210836 - DNA, 15 bp, Homo sapiens
ccaactctccccagt

SEQ ID NO: 210837 - DNA, 16 bp, Homo sapiens
ccaactgacttctgct

SEQ ID NO: 210838 - DNA, 21 bp, Homo sapiens
ccaactgccttaaccttctgg

SEQ ID NO: 210839 - DNA, 16 bp, Homo sapiens
ccaactgggcccaaga

SEQ ID NO: 210840 - DNA, 18 bp, Homo sapiens
ccaacttaagtttagaaa

SEQ ID NO: 210841 - DNA, 17 bp, Homo sapiens
ccaacttcaccaccccc

SEQ ID NO: 210842 - DNA, 18 bp, Homo sapiens
ccaacttcaccaccccct

SEQ ID NO: 210843 - DNA, 21 bp, Homo sapiens
ccaacttggttctgcttcaat

SEQ ID NO: 210844 - DNA, 15 bp, Homo sapiens
ccaactttccagact

SEQ ID NO: 210845 - DNA, 21 bp, Homo sapiens
ccaagaaaaataattaaaaaa

SEQ ID NO: 210846 - DNA, 13 bp, Homo sapiens
ccaagaactgaaa

SEQ ID NO: 210847 - DNA, 17 bp, Homo sapiens
ccaagaagccctccttg

SEQ ID NO: 210848 - DNA, 16 bp, Homo sapiens
ccaagaagtgaggcct

SEQ ID NO: 210849 - DNA, 19 bp, Homo sapiens
ccaagaagtgaggcctggg

SEQ ID NO: 210850 - DNA, 19 bp, Homo sapiens
ccaagacagatgccccaga

SEQ ID NO: 210851 - DNA, 17 bp, Homo sapiens
ccaagacagtggcagca

SEQ ID NO: 210852 - DNA, 19 bp, Homo sapiens
ccaagacataatgcactgg

SEQ ID NO: 210853 - DNA, 22 bp, Homo sapiens
ccaagacttggcaacagaagca

SEQ ID NO: 210854 - DNA, 19 bp, Homo sapiens
ccaagacttggtgtccttt

SEQ ID NO: 210855 - DNA, 22 bp, Homo sapiens
ccaagacttggtgtcctttccc

SEQ ID NO: 210856 - DNA, 23 bp, Homo sapiens
ccaagagcagagtctgggcctct

SEQ ID NO: 210857 - DNA, 19 bp, Homo sapiens
ccaagagtggtggcagctc

SEQ ID NO: 210858 - DNA, 19 bp, Homo sapiens
ccaagatgagctgcagccc

SEQ ID NO: 210859 - DNA, 10 bp, Homo sapiens
ccaagcaaac

SEQ ID NO: 210860 - DNA, 18 bp, Homo sapiens
cttcctccgtccacccag

SEQ ID NO: 210861 - DNA, 13 bp, Homo sapiens
cttcctcctcctc

SEQ ID NO: 210862 - DNA, 22 bp, Homo sapiens
cttcctcctgaagcctctgccc

SEQ ID NO: 210863 - DNA, 17 bp, Homo sapiens
cttcctcgctctcctaa

SEQ ID NO: 210864 - DNA, 13 bp, Homo sapiens
cttcctctccact

SEQ ID NO: 210865 - DNA, 16 bp, Homo sapiens
cttcctctccactgcc

SEQ ID NO: 210866 - DNA, 19 bp, Homo sapiens
cttcctctccactgccttc

SEQ ID NO: 210867 - DNA, 20 bp, Homo sapiens
cttcctctgcagctgacctc

SEQ ID NO: 210868 - DNA, 21 bp, Homo sapiens
cttcctctggtaaacattcct

SEQ ID NO: 210869 - DNA, 22 bp, Homo sapiens
cttcctgagaaacgtccatctc

SEQ ID NO: 210870 - DNA, 21 bp, Homo sapiens
cttcctgagaaagcccacctg

SEQ ID NO: 210871 - DNA, 23 bp, Homo sapiens
cttcctgagaaagcccacctggg

SEQ ID NO: 210872 - DNA, 12 bp, Homo sapiens
cttcctgagggc

SEQ ID NO: 210873 - DNA, 17 bp, Homo sapiens
cttcctgcaacaccttg

SEQ ID NO: 210874 - DNA, 20 bp, Homo sapiens
cttcctgccccaaaattata

SEQ ID NO: 210875 - DNA, 14 bp, Homo sapiens
cttcctgccctgta

SEQ ID NO: 210876 - DNA, 15 bp, Homo sapiens
cttcctgccctgtac

SEQ ID NO: 210877 - DNA, 16 bp, Homo sapiens
cttcctgccctgtacc

SEQ ID NO: 210878 - DNA, 17 bp, Homo sapiens
cttcctgccctgtacct

SEQ ID NO: 210879 - DNA, 22 bp, Homo sapiens
cttcctgccctgtacctctctc

SEQ ID NO: 210880 - DNA, 12 bp, Homo sapiens
cttcctgctgct

SEQ ID NO: 210881 - DNA, 12 bp, Homo sapiens
cttcctggacct

SEQ ID NO: 210882 - DNA, 13 bp, Homo sapiens
cttcctggacctg

SEQ ID NO: 210883 - DNA, 16 bp, Homo sapiens
cttcctggacctgagt

SEQ ID NO: 210884 - DNA, 17 bp, Homo sapiens
cttcctggacctgagtc

SEQ ID NO: 210885 - DNA, 16 bp, Homo sapiens
cttcctggactggccc

SEQ ID NO: 210886 - DNA, 23 bp, Homo sapiens
cttcctggactggcccttgccca

SEQ ID NO: 210887 - DNA, 15 bp, Homo sapiens
cttcctggagcccca

SEQ ID NO: 210888 - DNA, 23 bp, Homo sapiens
cttcctggattttctttctatgt

SEQ ID NO: 210889 - DNA, 11 bp, Homo sapiens
cttcctggcct

SEQ ID NO: 210890 - DNA, 20 bp, Homo sapiens
cttcctggcctcactggctg

SEQ ID NO: 210891 - DNA, 21 bp, Homo sapiens
cttcctggcctcactggctgg

SEQ ID NO: 210892 - DNA, 16 bp, Homo sapiens
cttcctgggcagccca

SEQ ID NO: 210893 - DNA, 21 bp, Homo sapiens
cttcctgggcagcccagagag

SEQ ID NO: 210894 - DNA, 19 bp, Homo sapiens
cttcctggtgaggcccagc

SEQ ID NO: 210895 - DNA, 23 bp, Homo sapiens
cttcctggtgaggcccagcctgt

SEQ ID NO: 210896 - DNA, 24 bp, Homo sapiens
cttcctggtgaggcccagcctgtc

SEQ ID NO: 210897 - DNA, 17 bp, Homo sapiens
cttcctgtccgccctct

SEQ ID NO: 210898 - DNA, 12 bp, Homo sapiens
cttcctgtcctg

SEQ ID NO: 210899 - DNA, 21 bp, Homo sapiens
cttcctgttctgtgtctgctg

SEQ ID NO: 210900 - DNA, 22 bp, Homo sapiens
cttccttccaagtcttcctgac

SEQ ID NO: 210901 - DNA, 23 bp, Homo sapiens
cttccttcccaactcactgtgct

SEQ ID NO: 210902 - DNA, 14 bp, Homo sapiens
cttccttctctact

SEQ ID NO: 210903 - DNA, 18 bp, Homo sapiens
cttccttgaccttcctct

SEQ ID NO: 210904 - DNA, 13 bp, Homo sapiens
cttccttgctttt

SEQ ID NO: 210905 - DNA, 23 bp, Homo sapiens
cttccttggttccctcttccctg

SEQ ID NO: 210906 - DNA, 20 bp, Homo sapiens
cttccttttttctttcttta

SEQ ID NO: 210907 - DNA, 16 bp, Homo sapiens
cttcgaaaacagatga

SEQ ID NO: 210908 - DNA, 13 bp, Homo sapiens
cttcgactgtgac

SEQ ID NO: 210909 - DNA, 17 bp, Homo sapiens
cttcgagcactgtccag

SEQ ID NO: 210910 - DNA, 20 bp, Homo sapiens
cttcgagggttccaggctgt

SEQ ID NO: 210911 - DNA, 16 bp, Homo sapiens
cttcgatacaccgggc

SEQ ID NO: 210912 - DNA, 20 bp, Homo sapiens
cttcgctattcccaggcagg

SEQ ID NO: 210913 - DNA, 17 bp, Homo sapiens
cttcgctgctctagctg

SEQ ID NO: 210914 - DNA, 20 bp, Homo sapiens
cttcgctgctctagctggca

SEQ ID NO: 210915 - DNA, 23 bp, Homo sapiens
cttcgctgtgatgcatgagctcc

SEQ ID NO: 210916 - DNA, 16 bp, Homo sapiens
cttcggaggaggtgga

SEQ ID NO: 210917 - DNA, 19 bp, Homo sapiens
cttcggaggaggtggacat

SEQ ID NO: 210918 - DNA, 14 bp, Homo sapiens
cttcggaggtggca

SEQ ID NO: 210919 - DNA, 21 bp, Homo sapiens
cttcgggaagagaggagttca

SEQ ID NO: 210920 - DNA, 22 bp, Homo sapiens
cttcgggaagagaggagttcaa

SEQ ID NO: 210921 - DNA, 12 bp, Homo sapiens
cttcgtacagtt

SEQ ID NO: 210922 - DNA, 13 bp, Homo sapiens
cttcgtacagttc

SEQ ID NO: 210923 - DNA, 23 bp, Homo sapiens
cttcgtacagttcttcgggaaga

SEQ ID NO: 210924 - DNA, 14 bp, Homo sapiens
cttcgtccttttgg

SEQ ID NO: 210925 - DNA, 15 bp, Homo sapiens
cttcgtgccccccct

SEQ ID NO: 210926 - DNA, 16 bp, Homo sapiens
cttcgtggatgacctc

SEQ ID NO: 210927 - DNA, 19 bp, Homo sapiens
cttcgtgtgtgcgcccctc

SEQ ID NO: 210928 - DNA, 23 bp, Homo sapiens
cttctaaaggtttcactgttcat

SEQ ID NO: 210929 - DNA, 15 bp, Homo sapiens
cttctaatatatttt

SEQ ID NO: 210930 - DNA, 20 bp, Homo sapiens
cttctaatatatttttatat

SEQ ID NO: 210931 - DNA, 16 bp, Homo sapiens
cttctaatatcattca

SEQ ID NO: 210932 - DNA, 20 bp, Homo sapiens
cttctaatccatgtgctgct

SEQ ID NO: 210933 - DNA, 23 bp, Homo sapiens
cttctaattttgtgctctttcct

SEQ ID NO: 210934 - DNA, 15 bp, Homo sapiens
cttctacaaccagag

SEQ ID NO: 210935 - DNA, 16 bp, Homo sapiens
cttctacaaccagagc

SEQ ID NO: 210936 - DNA, 17 bp, Homo sapiens
cttctacaaccagagcc

SEQ ID NO: 210937 - DNA, 13 bp, Homo sapiens
cttctacactctc

SEQ ID NO: 210938 - DNA, 14 bp, Homo sapiens
cttctacactctcc

SEQ ID NO: 210939 - DNA, 21 bp, Homo sapiens
cttctacttttaagttgctga

SEQ ID NO: 210940 - DNA, 22 bp, Homo sapiens
cttctactttttccttcctgcc

SEQ ID NO: 210941 - DNA, 21 bp, Homo sapiens
cttctagacactgaaggcaaa

SEQ ID NO: 210942 - DNA, 22 bp, Homo sapiens
cttctagctcggaacttactgt

SEQ ID NO: 210943 - DNA, 20 bp, Homo sapiens
cttctaggaggatgctgtgc

SEQ ID NO: 210944 - DNA, 20 bp, Homo sapiens
cttctaggcatctcctctcc

SEQ ID NO: 210945 - DNA, 23 bp, Homo sapiens
cttctaggcatctcctctcccca

SEQ ID NO: 210946 - DNA, 16 bp, Homo sapiens
cttctaggttctaaaa

SEQ ID NO: 210947 - DNA, 21 bp, Homo sapiens
cttctagtgatttctggggcc

SEQ ID NO: 210948 - DNA, 15 bp, Homo sapiens
cttctatcccaggag

SEQ ID NO: 210949 - DNA, 17 bp, Homo sapiens
cttctatgtccaacaga

SEQ ID NO: 210950 - DNA, 22 bp, Homo sapiens
cttctatgtccaacagagtgga

SEQ ID NO: 210951 - DNA, 22 bp, Homo sapiens
cttctcaaggacacatttggaa

SEQ ID NO: 210952 - DNA, 16 bp, Homo sapiens
cttctcaagtgcctta

SEQ ID NO: 210953 - DNA, 13 bp, Homo sapiens
cttctcacagcac

SEQ ID NO: 210954 - DNA, 23 bp, Homo sapiens
cttctcacagcacatgctggcca

SEQ ID NO: 210955 - DNA, 17 bp, Homo sapiens
cttctcagctccactct

SEQ ID NO: 210956 - DNA, 22 bp, Homo sapiens
cttctcagctccactctgaagt

SEQ ID NO: 210957 - DNA, 20 bp, Homo sapiens
cttctcattccaacagtgag

SEQ ID NO: 210958 - DNA, 13 bp, Homo sapiens
cttctccactgga

SEQ ID NO: 210959 - DNA, 15 bp, Homo sapiens
cttctccactggatg

SEQ ID NO: 210960 - DNA, 17 bp, Homo sapiens
cttctccactggatgga

SEQ ID NO: 210961 - DNA, 14 bp, Homo sapiens
cttctcccacactg

SEQ ID NO: 210962 - DNA, 15 bp, Homo sapiens
cttctcccagcacac

SEQ ID NO: 210963 - DNA, 14 bp, Homo sapiens
cttctccccgcagc

SEQ ID NO: 210964 - DNA, 15 bp, Homo sapiens
cttctccccgcagcc

SEQ ID NO: 210965 - DNA, 22 bp, Homo sapiens
cttctcccctccagacccctac

SEQ ID NO: 210966 - DNA, 13 bp, Homo sapiens
cttctcccctgca

SEQ ID NO: 210967 - DNA, 20 bp, Homo sapiens
cttctcccctgcactgtaaa

SEQ ID NO: 210968 - DNA, 23 bp, Homo sapiens
cttctcccctgcactgtaaaatg

SEQ ID NO: 210969 - DNA, 13 bp, Homo sapiens
cttctcccctgcc

SEQ ID NO: 210970 - DNA, 14 bp, Homo sapiens
cttctcccctgccc

SEQ ID NO: 210971 - DNA, 14 bp, Homo sapiens
cttctcctctctgg

SEQ ID NO: 210972 - DNA, 18 bp, Homo sapiens
cttctcctctctgggcct

SEQ ID NO: 210973 - DNA, 19 bp, Homo sapiens
cttctcctgacccagtccc

SEQ ID NO: 210974 - DNA, 16 bp, Homo sapiens
cttctcggaggccagg

SEQ ID NO: 210975 - DNA, 19 bp, Homo sapiens
cttctcggaggccaggccc

SEQ ID NO: 210976 - DNA, 21 bp, Homo sapiens
cttctcggaggccaggccctc

SEQ ID NO: 210977 - DNA, 20 bp, Homo sapiens
cttctcgtagatgctgccta

SEQ ID NO: 210978 - DNA, 18 bp, Homo sapiens
cttctctcacctcctaaa

SEQ ID NO: 210979 - DNA, 12 bp, Homo sapiens
cttctctccact

SEQ ID NO: 210980 - DNA, 21 bp, Homo sapiens
cttctctcccacacaagcagt

SEQ ID NO: 210981 - DNA, 23 bp, Homo sapiens
cttctctctctctcaaaattata

SEQ ID NO: 210982 - DNA, 20 bp, Homo sapiens
cttctctcttcaatctctgg

SEQ ID NO: 210983 - DNA, 19 bp, Homo sapiens
cttctctcttgattgattt

SEQ ID NO: 210984 - DNA, 11 bp, Homo sapiens
cttctctgctc

SEQ ID NO: 210985 - DNA, 13 bp, Homo sapiens
cttctctgctcca

SEQ ID NO: 210986 - DNA, 22 bp, Homo sapiens
cttctctgctccaccacatcct

SEQ ID NO: 210987 - DNA, 19 bp, Homo sapiens
cttctctggaaagggggga

SEQ ID NO: 210988 - DNA, 21 bp, Homo sapiens
cttctctgtgaacgatttaga

SEQ ID NO: 210989 - DNA, 14 bp, Homo sapiens
cttctcttctgagc

SEQ ID NO: 210990 - DNA, 18 bp, Homo sapiens
cttctcttttcctcgcag

SEQ ID NO: 210991 - DNA, 14 bp, Homo sapiens
cttctctttttcca

SEQ ID NO: 210992 - DNA, 18 bp, Homo sapiens
cttctgaaccgcaaggag

SEQ ID NO: 210993 - DNA, 22 bp, Homo sapiens
ccaagcactcgagaccatcctg

SEQ ID NO: 210994 - DNA, 11 bp, Homo sapiens
ccaagcagcca

SEQ ID NO: 210995 - DNA, 13 bp, Homo sapiens
ccaagcagccagc

SEQ ID NO: 210996 - DNA, 16 bp, Homo sapiens
ccaagcagccagccag

SEQ ID NO: 210997 - DNA, 16 bp, Homo sapiens
ccaagcatcagcaaga

SEQ ID NO: 210998 - DNA, 19 bp, Homo sapiens
ccaagccagggttccagac

SEQ ID NO: 210999 - DNA, 21 bp, Homo sapiens
ccaagccagggttccagacag

SEQ ID NO: 211000 - DNA, 14 bp, Homo sapiens
ccaagccatcacag

SEQ ID NO: 211001 - DNA, 21 bp, Homo sapiens
ccaagccccttggccctctcc

SEQ ID NO: 211002 - DNA, 22 bp, Homo sapiens
ccaagccccttggccctctccc

SEQ ID NO: 211003 - DNA, 17 bp, Homo sapiens
ccaagcccgacttgctg

SEQ ID NO: 211004 - DNA, 18 bp, Homo sapiens
ccaagcccgacttgctgt

SEQ ID NO: 211005 - DNA, 19 bp, Homo sapiens
ccaagcccttccctctgtt

SEQ ID NO: 211006 - DNA, 21 bp, Homo sapiens
ccaagcccttttacagctctt

SEQ ID NO: 211007 - DNA, 15 bp, Homo sapiens
ccaagccgtggcttc

SEQ ID NO: 211008 - DNA, 17 bp, Homo sapiens
ccaagccgtggcttccc

SEQ ID NO: 211009 - DNA, 21 bp, Homo sapiens
ccaagccgtggcttcccgctc

SEQ ID NO: 211010 - DNA, 23 bp, Homo sapiens
ccaagccgtggcttcccgctcag

SEQ ID NO: 211011 - DNA, 13 bp, Homo sapiens
ccaagcctgcagc

SEQ ID NO: 211012 - DNA, 13 bp, Homo sapiens
ccaagcctgcctc

SEQ ID NO: 211013 - DNA, 12 bp, Homo sapiens
ccaagcctggag

SEQ ID NO: 211014 - DNA, 22 bp, Homo sapiens
ccaagcctggagcccctgtgtt

SEQ ID NO: 211015 - DNA, 16 bp, Homo sapiens
ccaagcctgggccact

SEQ ID NO: 211016 - DNA, 17 bp, Homo sapiens
ccaagcctgggccactg

SEQ ID NO: 211017 - DNA, 19 bp, Homo sapiens
ccaagcctgggccactggc

SEQ ID NO: 211018 - DNA, 18 bp, Homo sapiens
ccaagcgttcctggcctt

SEQ ID NO: 211019 - DNA, 22 bp, Homo sapiens
ccaagcgttcctggccttctga

SEQ ID NO: 211020 - DNA, 17 bp, Homo sapiens
ccaagcttaaggagagg

SEQ ID NO: 211021 - DNA, 20 bp, Homo sapiens
ccaagcttgtttccctgctg

SEQ ID NO: 211022 - DNA, 22 bp, Homo sapiens
ccaagcttgtttccctgctggc

SEQ ID NO: 211023 - DNA, 23 bp, Homo sapiens
ccaagcttgtttccctgctggcc

SEQ ID NO: 211024 - DNA, 15 bp, Homo sapiens
ccaagctttcttcta

SEQ ID NO: 211025 - DNA, 15 bp, Homo sapiens
ccaaggacccctcac

SEQ ID NO: 211026 - DNA, 22 bp, Homo sapiens
ccaaggacccctcaccttgcaa

SEQ ID NO: 211027 - DNA, 15 bp, Homo sapiens
ccaaggactgccgac

SEQ ID NO: 211028 - DNA, 23 bp, Homo sapiens
ccaaggagctgatttccaggccc

SEQ ID NO: 211029 - DNA, 22 bp, Homo sapiens
ccaaggagtctgattgcaggaa

SEQ ID NO: 211030 - DNA, 13 bp, Homo sapiens
ccaaggcaaacaa

SEQ ID NO: 211031 - DNA, 13 bp, Homo sapiens
ccaaggcaaatgt

SEQ ID NO: 211032 - DNA, 16 bp, Homo sapiens
ccaaggcaaatgtcca

SEQ ID NO: 211033 - DNA, 16 bp, Homo sapiens
ccaaggcagcctccag

SEQ ID NO: 211034 - DNA, 17 bp, Homo sapiens
ccaaggcagcctccaga

SEQ ID NO: 211035 - DNA, 19 bp, Homo sapiens
ccaaggcagcctccagagc

SEQ ID NO: 211036 - DNA, 20 bp, Homo sapiens
ccaaggcagcctccagagcc

SEQ ID NO: 211037 - DNA, 22 bp, Homo sapiens
ccaaggcagcctccagagccag

SEQ ID NO: 211038 - DNA, 23 bp, Homo sapiens
ccaaggcagcctccagagccagc

SEQ ID NO: 211039 - DNA, 19 bp, Homo sapiens
ccaaggccagagtggcctg

SEQ ID NO: 211040 - DNA, 21 bp, Homo sapiens
ccaaggcctatgccacctgca

SEQ ID NO: 211041 - DNA, 12 bp, Homo sapiens
ccaaggcctcag

SEQ ID NO: 211042 - DNA, 14 bp, Homo sapiens
ccaaggcctcagga

SEQ ID NO: 211043 - DNA, 18 bp, Homo sapiens
ccaaggctctcccctctc

SEQ ID NO: 211044 - DNA, 14 bp, Homo sapiens
ccaagggcccagag

SEQ ID NO: 211045 - DNA, 22 bp, Homo sapiens
ccaagggcctcccaccagagac

SEQ ID NO: 211046 - DNA, 15 bp, Homo sapiens
ccaaggggcagtctg

SEQ ID NO: 211047 - DNA, 14 bp, Homo sapiens
ccaaggggccagct

SEQ ID NO: 211048 - DNA, 16 bp, Homo sapiens
ccaaggggccagctgc

SEQ ID NO: 211049 - DNA, 17 bp, Homo sapiens
ccaaggggccagctgcc

SEQ ID NO: 211050 - DNA, 22 bp, Homo sapiens
ccaaggggtctgtatatacatt

SEQ ID NO: 211051 - DNA, 14 bp, Homo sapiens
ccaaggtcctgctc

SEQ ID NO: 211052 - DNA, 21 bp, Homo sapiens
ccaaggtggtcttggagagga

SEQ ID NO: 211053 - DNA, 23 bp, Homo sapiens
ccaaggtttggggaagaacgaag

SEQ ID NO: 211054 - DNA, 21 bp, Homo sapiens
ccaagtaaccaggccccagcc

SEQ ID NO: 211055 - DNA, 17 bp, Homo sapiens
ccaagtaccaatgctgt

SEQ ID NO: 211056 - DNA, 22 bp, Homo sapiens
ccaagtccaacctgcctgtgca

SEQ ID NO: 211057 - DNA, 12 bp, Homo sapiens
ccaagtcccacc

SEQ ID NO: 211058 - DNA, 18 bp, Homo sapiens
ccaagtcctccctctcta

SEQ ID NO: 211059 - DNA, 16 bp, Homo sapiens
ccaagtctcaggagga

SEQ ID NO: 211060 - DNA, 12 bp, Homo sapiens
ccaagtctctct

SEQ ID NO: 211061 - DNA, 15 bp, Homo sapiens
ccaagtctctctgtg

SEQ ID NO: 211062 - DNA, 17 bp, Homo sapiens
ccaagtctctctgtgaa

SEQ ID NO: 211063 - DNA, 18 bp, Homo sapiens
ccaagtctctctgtgaat

SEQ ID NO: 211064 - DNA, 21 bp, Homo sapiens
ccaagtctctctgtgaataca

SEQ ID NO: 211065 - DNA, 14 bp, Homo sapiens
ccaagtgcaggctg

SEQ ID NO: 211066 - DNA, 14 bp, Homo sapiens
ccaagtgccttgag

SEQ ID NO: 211067 - DNA, 19 bp, Homo sapiens
ccaagtgccttgagctgcc

SEQ ID NO: 211068 - DNA, 20 bp, Homo sapiens
ccaagtggaagccactggac

SEQ ID NO: 211069 - DNA, 16 bp, Homo sapiens
ccaagtggctcccaca

SEQ ID NO: 211070 - DNA, 14 bp, Homo sapiens
ccaagtgggctggt

SEQ ID NO: 211071 - DNA, 23 bp, Homo sapiens
ccaagtgggctggtattctctct

SEQ ID NO: 211072 - DNA, 19 bp, Homo sapiens
ccaagtgtagatgtagcat

SEQ ID NO: 211073 - DNA, 22 bp, Homo sapiens
ccaagtgtagatgtagcattgt

SEQ ID NO: 211074 - DNA, 14 bp, Homo sapiens
ccaagtgtgtgtgc

SEQ ID NO: 211075 - DNA, 17 bp, Homo sapiens
ccaagtgtgtgtgcaat

SEQ ID NO: 211076 - DNA, 20 bp, Homo sapiens
ccaagttcttcacctctatc

SEQ ID NO: 211077 - DNA, 13 bp, Homo sapiens
ccaataaaccagg

SEQ ID NO: 211078 - DNA, 13 bp, Homo sapiens
ccaataaagctgg

SEQ ID NO: 211079 - DNA, 18 bp, Homo sapiens
ccaataacttcagagaag

SEQ ID NO: 211080 - DNA, 21 bp, Homo sapiens
ccaataataaaaaacaagaaa

SEQ ID NO: 211081 - DNA, 17 bp, Homo sapiens
ccaatagtcatatgtga

SEQ ID NO: 211082 - DNA, 16 bp, Homo sapiens
ccaatatggtggccct

SEQ ID NO: 211083 - DNA, 19 bp, Homo sapiens
ccaatatggtggccctggg

SEQ ID NO: 211084 - DNA, 21 bp, Homo sapiens
ccaatatggtggccctgggga

SEQ ID NO: 211085 - DNA, 22 bp, Homo sapiens
ccaatatggtggccctggggaa

SEQ ID NO: 211086 - DNA, 13 bp, Homo sapiens
ccaatattataat

SEQ ID NO: 211087 - DNA, 23 bp, Homo sapiens
ccaatcaacagcatgtctactgc

SEQ ID NO: 211088 - DNA, 13 bp, Homo sapiens
ccaatcacattca

SEQ ID NO: 211089 - DNA, 21 bp, Homo sapiens
ccaatcaccctacaagatgcc

SEQ ID NO: 211090 - DNA, 19 bp, Homo sapiens
ccaatcacgagatcttcct

SEQ ID NO: 211091 - DNA, 22 bp, Homo sapiens
ccaatcacgagatcttccttcc

SEQ ID NO: 211092 - DNA, 13 bp, Homo sapiens
ccaatcactgcct

SEQ ID NO: 211093 - DNA, 19 bp, Homo sapiens
ccaatcagcttttgttcta

SEQ ID NO: 211094 - DNA, 20 bp, Homo sapiens
ccaatcagcttttgttctag

SEQ ID NO: 211095 - DNA, 21 bp, Homo sapiens
ccaatcagcttttgttctaga

SEQ ID NO: 211096 - DNA, 22 bp, Homo sapiens
ccaatcattttaattattattc

SEQ ID NO: 211097 - DNA, 17 bp, Homo sapiens
ccaatccaacccatgca

SEQ ID NO: 211098 - DNA, 22 bp, Homo sapiens
ccaatcctttccaccctattcc

SEQ ID NO: 211099 - DNA, 18 bp, Homo sapiens
ccaatcgggtccagagac

SEQ ID NO: 211100 - DNA, 11 bp, Homo sapiens
ccaatctctgt

SEQ ID NO: 211101 - DNA, 13 bp, Homo sapiens
ccaatctctgtga

SEQ ID NO: 211102 - DNA, 17 bp, Homo sapiens
ccaatgaacagctcctc

SEQ ID NO: 211103 - DNA, 19 bp, Homo sapiens
ccaatgaggtctgaaatgg

SEQ ID NO: 211104 - DNA, 14 bp, Homo sapiens
ccaatgccacagcc

SEQ ID NO: 211105 - DNA, 17 bp, Homo sapiens
ccaatgccacagccaag

SEQ ID NO: 211106 - DNA, 18 bp, Homo sapiens
ccaatgccacagccaagc

SEQ ID NO: 211107 - DNA, 17 bp, Homo sapiens
ccaatgctttgggaggc

SEQ ID NO: 211108 - DNA, 16 bp, Homo sapiens
ccaatggtgagggctg

SEQ ID NO: 211109 - DNA, 18 bp, Homo sapiens
ccaatggtgagggctgag

SEQ ID NO: 211110 - DNA, 22 bp, Homo sapiens
ccaatggtgagggctgagaggg

SEQ ID NO: 211111 - DNA, 16 bp, Homo sapiens
ccaatggtgatcctct

SEQ ID NO: 211112 - DNA, 22 bp, Homo sapiens
ccaatggtgtagctgtcctctc

SEQ ID NO: 211113 - DNA, 14 bp, Homo sapiens
ccaatgtgcccagt

SEQ ID NO: 211114 - DNA, 19 bp, Homo sapiens
ccaattaagtcctacttta

SEQ ID NO: 211115 - DNA, 15 bp, Homo sapiens
ccaattatgtgacaa

SEQ ID NO: 211116 - DNA, 12 bp, Homo sapiens
ccaattgccctg

SEQ ID NO: 211117 - DNA, 13 bp, Homo sapiens
ccaattgccctgc

SEQ ID NO: 211118 - DNA, 10 bp, Homo sapiens
ccaatttaag

SEQ ID NO: 211119 - DNA, 15 bp, Homo sapiens
ccaatttgtctccta

SEQ ID NO: 211120 - DNA, 17 bp, Homo sapiens
ccaattttaaaaaataa

SEQ ID NO: 211121 - DNA, 18 bp, Homo sapiens
ccacaaaatatttctaag

SEQ ID NO: 211122 - DNA, 16 bp, Homo sapiens
ccacaaactgcctgtt

SEQ ID NO: 211123 - DNA, 22 bp, Homo sapiens
ccacaaagccttatcaagtgtc

SEQ ID NO: 211124 - DNA, 23 bp, Homo sapiens
ccacaaagccttatcaagtgtct

SEQ ID NO: 211125 - DNA, 13 bp, Homo sapiens
ccacaaatgtcct

SEQ ID NO: 211126 - DNA, 23 bp, Homo sapiens
cttctgaactccatacagcctct

SEQ ID NO: 211127 - DNA, 14 bp, Homo sapiens
cttctgaagatgga

SEQ ID NO: 211128 - DNA, 18 bp, Homo sapiens
cttctgaatattttatct

SEQ ID NO: 211129 - DNA, 18 bp, Homo sapiens
cttctgaccacacttcct

SEQ ID NO: 211130 - DNA, 14 bp, Homo sapiens
cttctgacctcagc

SEQ ID NO: 211131 - DNA, 15 bp, Homo sapiens
cttctgacctcagca

SEQ ID NO: 211132 - DNA, 16 bp, Homo sapiens
cttctgacggccctgc

SEQ ID NO: 211133 - DNA, 19 bp, Homo sapiens
cttctgacggccctgcaat

SEQ ID NO: 211134 - DNA, 20 bp, Homo sapiens
cttctgagcagttttccagg

SEQ ID NO: 211135 - DNA, 23 bp, Homo sapiens
cttctgataagactggaaaatag

SEQ ID NO: 211136 - DNA, 14 bp, Homo sapiens
cttctgcccaaatc

SEQ ID NO: 211137 - DNA, 12 bp, Homo sapiens
cttctgcctgca

SEQ ID NO: 211138 - DNA, 14 bp, Homo sapiens
cttctgcctgttat

SEQ ID NO: 211139 - DNA, 17 bp, Homo sapiens
cttctgcggtgaggcag

SEQ ID NO: 211140 - DNA, 22 bp, Homo sapiens
cttctgctcacattccctctca

SEQ ID NO: 211141 - DNA, 15 bp, Homo sapiens
cttctgctccaccct

SEQ ID NO: 211142 - DNA, 23 bp, Homo sapiens
cttctgctccacccttggcctgt

SEQ ID NO: 211143 - DNA, 14 bp, Homo sapiens
cttctgctgccctg

SEQ ID NO: 211144 - DNA, 18 bp, Homo sapiens
cttctgctgccctgatgc

SEQ ID NO: 211145 - DNA, 16 bp, Homo sapiens
cttctgcttaggagag

SEQ ID NO: 211146 - DNA, 23 bp, Homo sapiens
cttctgctttctattacccctca

SEQ ID NO: 211147 - DNA, 19 bp, Homo sapiens
cttctggacactgagaggg

SEQ ID NO: 211148 - DNA, 17 bp, Homo sapiens
cttctgggacctgtgtt

SEQ ID NO: 211149 - DNA, 19 bp, Homo sapiens
cttctgggacttgaaatca

SEQ ID NO: 211150 - DNA, 16 bp, Homo sapiens
cttctgggcaaggggg

SEQ ID NO: 211151 - DNA, 18 bp, Homo sapiens
cttctgggcaaggtgagg

SEQ ID NO: 211152 - DNA, 17 bp, Homo sapiens
cttctgggcagagcctg

SEQ ID NO: 211153 - DNA, 21 bp, Homo sapiens
cttctgggcagagcctgtccc

SEQ ID NO: 211154 - DNA, 22 bp, Homo sapiens
cttctgggcctgatggagagga

SEQ ID NO: 211155 - DNA, 16 bp, Homo sapiens
cttctggttgtatttc

SEQ ID NO: 211156 - DNA, 18 bp, Homo sapiens
cttctggttgtatttcta

SEQ ID NO: 211157 - DNA, 22 bp, Homo sapiens
cttctgtaacgggtcgtgctca

SEQ ID NO: 211158 - DNA, 21 bp, Homo sapiens
cttctgtagtactccttaaga

SEQ ID NO: 211159 - DNA, 16 bp, Homo sapiens
cttctgtccatcagtg

SEQ ID NO: 211160 - DNA, 21 bp, Homo sapiens
cttctgtcccttgtttttgat

SEQ ID NO: 211161 - DNA, 14 bp, Homo sapiens
cttctgtgaaagta

SEQ ID NO: 211162 - DNA, 19 bp, Homo sapiens
cttctgtgagacccccaca

SEQ ID NO: 211163 - DNA, 20 bp, Homo sapiens
cttctgtgagacccccacac

SEQ ID NO: 211164 - DNA, 21 bp, Homo sapiens
cttctgtgagacccccacacc

SEQ ID NO: 211165 - DNA, 22 bp, Homo sapiens
cttctgtgagacccccacacct

SEQ ID NO: 211166 - DNA, 18 bp, Homo sapiens
cttctgtgcccagctcag

SEQ ID NO: 211167 - DNA, 13 bp, Homo sapiens
cttctgtggctca

SEQ ID NO: 211168 - DNA, 15 bp, Homo sapiens
cttctgtggctcaca

SEQ ID NO: 211169 - DNA, 22 bp, Homo sapiens
cttctgtggctcacagaaccct

SEQ ID NO: 211170 - DNA, 12 bp, Homo sapiens
cttctgtgtctg

SEQ ID NO: 211171 - DNA, 13 bp, Homo sapiens
cttctgtttttct

SEQ ID NO: 211172 - DNA, 17 bp, Homo sapiens
cttctgtttttctcaaa

SEQ ID NO: 211173 - DNA, 18 bp, Homo sapiens
cttctgtttttctcaaat

SEQ ID NO: 211174 - DNA, 20 bp, Homo sapiens
cttctgtttttctcaaataa

SEQ ID NO: 211175 - DNA, 15 bp, Homo sapiens
cttcttacatgcatt

SEQ ID NO: 211176 - DNA, 13 bp, Homo sapiens
cttcttatacatt

SEQ ID NO: 211177 - DNA, 14 bp, Homo sapiens
cttcttcacccagc

SEQ ID NO: 211178 - DNA, 22 bp, Homo sapiens
cttcttcacccagctaatctgt

SEQ ID NO: 211179 - DNA, 21 bp, Homo sapiens
cttcttccaatgatgcttact

SEQ ID NO: 211180 - DNA, 16 bp, Homo sapiens
cttcttccccagggtt

SEQ ID NO: 211181 - DNA, 20 bp, Homo sapiens
cttcttccttcttgtcacca

SEQ ID NO: 211182 - DNA, 18 bp, Homo sapiens
cttcttcggaggtggcag

SEQ ID NO: 211183 - DNA, 20 bp, Homo sapiens
cttcttctgcgtttgtccct

SEQ ID NO: 211184 - DNA, 17 bp, Homo sapiens
cttcttgaaacagcctg

SEQ ID NO: 211185 - DNA, 14 bp, Homo sapiens
cttcttgccctgag

SEQ ID NO: 211186 - DNA, 15 bp, Homo sapiens
cttcttgccctgagc

SEQ ID NO: 211187 - DNA, 18 bp, Homo sapiens
cttcttgcggcaccgccc

SEQ ID NO: 211188 - DNA, 22 bp, Homo sapiens
cttcttgcggcaccgcccaccc

SEQ ID NO: 211189 - DNA, 14 bp, Homo sapiens
cttcttgctcctgt

SEQ ID NO: 211190 - DNA, 16 bp, Homo sapiens
cttcttggcttctggg

SEQ ID NO: 211191 - DNA, 22 bp, Homo sapiens
cttcttgtgattgctgccataa

SEQ ID NO: 211192 - DNA, 19 bp, Homo sapiens
cttcttgtgtttgaaacac

SEQ ID NO: 211193 - DNA, 21 bp, Homo sapiens
cttcttgttcatgttttgcta

SEQ ID NO: 211194 - DNA, 19 bp, Homo sapiens
cttctttaccttcatttca

SEQ ID NO: 211195 - DNA, 23 bp, Homo sapiens
cttctttgaatttcctatctgta

SEQ ID NO: 211196 - DNA, 19 bp, Homo sapiens
cttctttgcaacaataata

SEQ ID NO: 211197 - DNA, 23 bp, Homo sapiens
cttctttgcaacaataataaatg

SEQ ID NO: 211198 - DNA, 15 bp, Homo sapiens
cttctttgcagggct

SEQ ID NO: 211199 - DNA, 14 bp, Homo sapiens
cttctttgcttctt

SEQ ID NO: 211200 - DNA, 23 bp, Homo sapiens
cttcttttaagatgtgtcttcaa

SEQ ID NO: 211201 - DNA, 23 bp, Homo sapiens
cttcttttgaactgttagatgct

SEQ ID NO: 211202 - DNA, 20 bp, Homo sapiens
cttcttttgaccccttcctg

SEQ ID NO: 211203 - DNA, 17 bp, Homo sapiens
cttctttttcttaccct

SEQ ID NO: 211204 - DNA, 23 bp, Homo sapiens
cttctttttcttaccctctcttt

SEQ ID NO: 211205 - DNA, 18 bp, Homo sapiens
cttctttttctttgagaa

SEQ ID NO: 211206 - DNA, 13 bp, Homo sapiens
cttctttttggca

SEQ ID NO: 211207 - DNA, 16 bp, Homo sapiens
cttcttttttttcatt

SEQ ID NO: 211208 - DNA, 15 bp, Homo sapiens
cttgaaacagcctgg

SEQ ID NO: 211209 - DNA, 17 bp, Homo sapiens
cttgaaacagcctgggt

SEQ ID NO: 211210 - DNA, 23 bp, Homo sapiens
cttgaaagaaaggggcaggagct

SEQ ID NO: 211211 - DNA, 19 bp, Homo sapiens
cttgaaagaagaaaaggtt

SEQ ID NO: 211212 - DNA, 20 bp, Homo sapiens
cttgaaagcatccatgtgtg

SEQ ID NO: 211213 - DNA, 13 bp, Homo sapiens
cttgaaagctgtg

SEQ ID NO: 211214 - DNA, 15 bp, Homo sapiens
cttgaacaccacgct

SEQ ID NO: 211215 - DNA, 15 bp, Homo sapiens
cttgaacccaggaga

SEQ ID NO: 211216 - DNA, 15 bp, Homo sapiens
cttgaacctcattaa

SEQ ID NO: 211217 - DNA, 19 bp, Homo sapiens
cttgaactctgttccccca

SEQ ID NO: 211218 - DNA, 13 bp, Homo sapiens
cttgaagaatatt

SEQ ID NO: 211219 - DNA, 15 bp, Homo sapiens
cttgaagaatattgt

SEQ ID NO: 211220 - DNA, 18 bp, Homo sapiens
cttgaagaatattgttaa

SEQ ID NO: 211221 - DNA, 23 bp, Homo sapiens
cttgaagaggggaggggcctagg

SEQ ID NO: 211222 - DNA, 13 bp, Homo sapiens
cttgaagatcgtt

SEQ ID NO: 211223 - DNA, 16 bp, Homo sapiens
cttgaagatgtagctt

SEQ ID NO: 211224 - DNA, 16 bp, Homo sapiens
cttgaagtaaccttat

SEQ ID NO: 211225 - DNA, 13 bp, Homo sapiens
cttgaatgtacaa

SEQ ID NO: 211226 - DNA, 15 bp, Homo sapiens
cttgaatgtacaaag

SEQ ID NO: 211227 - DNA, 16 bp, Homo sapiens
cttgaatgtacaaaga

SEQ ID NO: 211228 - DNA, 20 bp, Homo sapiens
cttgaatgtccccattctat

SEQ ID NO: 211229 - DNA, 21 bp, Homo sapiens
cttgaatgtccccattctata

SEQ ID NO: 211230 - DNA, 16 bp, Homo sapiens
cttgaatttctagaca

SEQ ID NO: 211231 - DNA, 14 bp, Homo sapiens
cttgacaagtacat

SEQ ID NO: 211232 - DNA, 22 bp, Homo sapiens
cttgacaagttgcgacggagag

SEQ ID NO: 211233 - DNA, 16 bp, Homo sapiens
cttgacatcaactgca

SEQ ID NO: 211234 - DNA, 15 bp, Homo sapiens
cttgaccgtactctc

SEQ ID NO: 211235 - DNA, 17 bp, Homo sapiens
cttgacctgaactctgc

SEQ ID NO: 211236 - DNA, 14 bp, Homo sapiens
cttgaccttcctct

SEQ ID NO: 211237 - DNA, 15 bp, Homo sapiens
cttgacgtgtgtggt

SEQ ID NO: 211238 - DNA, 16 bp, Homo sapiens
cttgactctaaatgca

SEQ ID NO: 211239 - DNA, 16 bp, Homo sapiens
cttgactcttgaataa

SEQ ID NO: 211240 - DNA, 11 bp, Homo sapiens
cttgactgaag

SEQ ID NO: 211241 - DNA, 21 bp, Homo sapiens
cttgactgaagcgaacatctt

SEQ ID NO: 211242 - DNA, 14 bp, Homo sapiens
cttgagagctgctg

SEQ ID NO: 211243 - DNA, 15 bp, Homo sapiens
cttgagagctgctga

SEQ ID NO: 211244 - DNA, 16 bp, Homo sapiens
cttgagagctgctgag

SEQ ID NO: 211245 - DNA, 17 bp, Homo sapiens
cttgagagctgctgagg

SEQ ID NO: 211246 - DNA, 18 bp, Homo sapiens
cttgagagtgggggagaa

SEQ ID NO: 211247 - DNA, 22 bp, Homo sapiens
cttgagcaaggcaagaagtggg

SEQ ID NO: 211248 - DNA, 13 bp, Homo sapiens
cttgagcagtggc

SEQ ID NO: 211249 - DNA, 14 bp, Homo sapiens
cttgagcccactcc

SEQ ID NO: 211250 - DNA, 11 bp, Homo sapiens
cttgagcccag

SEQ ID NO: 211251 - DNA, 16 bp, Homo sapiens
cttgagccccagaggc

SEQ ID NO: 211252 - DNA, 11 bp, Homo sapiens
cttgagcctcc

SEQ ID NO: 211253 - DNA, 21 bp, Homo sapiens
cttgagctcccctggagccag

SEQ ID NO: 211254 - DNA, 10 bp, Homo sapiens
cttgagctga

SEQ ID NO: 211255 - DNA, 23 bp, Homo sapiens
cttgagctgcctgctctgcagcc

SEQ ID NO: 211256 - DNA, 14 bp, Homo sapiens
cttgaggacacatg

SEQ ID NO: 211257 - DNA, 15 bp, Homo sapiens
cttgaggacacatgt

SEQ ID NO: 211258 - DNA, 17 bp, Homo sapiens
cttgaggacacatgtcc

SEQ ID NO: 211259 - DNA, 15 bp, Homo sapiens
cttgaggacctccac

SEQ ID NO: 211260 - DNA, 18 bp, Homo sapiens
ccacaaatgtcctcagag

SEQ ID NO: 211261 - DNA, 22 bp, Homo sapiens
ccacaaatgtgtcccagtgaac

SEQ ID NO: 211262 - DNA, 18 bp, Homo sapiens
ccacaactaacaatgcct

SEQ ID NO: 211263 - DNA, 15 bp, Homo sapiens
ccacaagagctcctt

SEQ ID NO: 211264 - DNA, 17 bp, Homo sapiens
ccacaagagctccttga

SEQ ID NO: 211265 - DNA, 23 bp, Homo sapiens
ccacaagccattttttgaggaga

SEQ ID NO: 211266 - DNA, 24 bp, Homo sapiens
ccacaaggaataaatgagagggaa

SEQ ID NO: 211267 - DNA, 21 bp, Homo sapiens
ccacaaggctgaaaagtgctt

SEQ ID NO: 211268 - DNA, 13 bp, Homo sapiens
ccacaaggctggc

SEQ ID NO: 211269 - DNA, 17 bp, Homo sapiens
ccacaaggctggccagc

SEQ ID NO: 211270 - DNA, 18 bp, Homo sapiens
ccacaaggctggccagca

SEQ ID NO: 211271 - DNA, 20 bp, Homo sapiens
ccacaagggtgcccacctct

SEQ ID NO: 211272 - DNA, 22 bp, Homo sapiens
ccacaaggtccactccctgctc

SEQ ID NO: 211273 - DNA, 16 bp, Homo sapiens
ccacaatcctccccac

SEQ ID NO: 211274 - DNA, 20 bp, Homo sapiens
ccacacaacaccaggactta

SEQ ID NO: 211275 - DNA, 23 bp, Homo sapiens
ccacacacacccacacactcgcc

SEQ ID NO: 211276 - DNA, 14 bp, Homo sapiens
ccacacacaccctt

SEQ ID NO: 211277 - DNA, 12 bp, Homo sapiens
ccacacacccca

SEQ ID NO: 211278 - DNA, 15 bp, Homo sapiens
ccacacactcgcccg

SEQ ID NO: 211279 - DNA, 13 bp, Homo sapiens
ccacacagagtgg

SEQ ID NO: 211280 - DNA, 11 bp, Homo sapiens
ccacacaggcc

SEQ ID NO: 211281 - DNA, 13 bp, Homo sapiens
ccacacaggccca

SEQ ID NO: 211282 - DNA, 13 bp, Homo sapiens
ccacacaggcctg

SEQ ID NO: 211283 - DNA, 15 bp, Homo sapiens
ccacacaggcctggc

SEQ ID NO: 211284 - DNA, 19 bp, Homo sapiens
ccacacaggcctggcccag

SEQ ID NO: 211285 - DNA, 21 bp, Homo sapiens
ccacacaggcctggcccagcc

SEQ ID NO: 211286 - DNA, 12 bp, Homo sapiens
ccacacatttaa

SEQ ID NO: 211287 - DNA, 20 bp, Homo sapiens
ccacaccactaaccatcccc

SEQ ID NO: 211288 - DNA, 19 bp, Homo sapiens
ccacacccatgactgcccc

SEQ ID NO: 211289 - DNA, 16 bp, Homo sapiens
ccacaccccagcccac

SEQ ID NO: 211290 - DNA, 15 bp, Homo sapiens
ccacaccccagcgcc

SEQ ID NO: 211291 - DNA, 18 bp, Homo sapiens
ccacaccccgtctgcccc

SEQ ID NO: 211292 - DNA, 18 bp, Homo sapiens
ccacacctcagttccctt

SEQ ID NO: 211293 - DNA, 14 bp, Homo sapiens
ccacacctgcctct

SEQ ID NO: 211294 - DNA, 12 bp, Homo sapiens
ccacacctggtc

SEQ ID NO: 211295 - DNA, 15 bp, Homo sapiens
ccacacgccggggct

SEQ ID NO: 211296 - DNA, 21 bp, Homo sapiens
ccacacgccggggctggccct

SEQ ID NO: 211297 - DNA, 23 bp, Homo sapiens
ccacacgccggggctggccctgc

SEQ ID NO: 211298 - DNA, 13 bp, Homo sapiens
ccacacgctgccc

SEQ ID NO: 211299 - DNA, 20 bp, Homo sapiens
ccacacgctgcccaggctct

SEQ ID NO: 211300 - DNA, 22 bp, Homo sapiens
ccacacgctgcccaggctctgc

SEQ ID NO: 211301 - DNA, 16 bp, Homo sapiens
ccacacggactcccgg

SEQ ID NO: 211302 - DNA, 23 bp, Homo sapiens
ccacacggactcccgggccacgc

SEQ ID NO: 211303 - DNA, 16 bp, Homo sapiens
ccacactaacctgggt

SEQ ID NO: 211304 - DNA, 17 bp, Homo sapiens
ccacactattaccatga

SEQ ID NO: 211305 - DNA, 18 bp, Homo sapiens
ccacactattaccatgag

SEQ ID NO: 211306 - DNA, 13 bp, Homo sapiens
ccacactgaccac

SEQ ID NO: 211307 - DNA, 14 bp, Homo sapiens
ccacactgaccaca

SEQ ID NO: 211308 - DNA, 14 bp, Homo sapiens
ccacactgcaacag

SEQ ID NO: 211309 - DNA, 14 bp, Homo sapiens
ccacactgctacac

SEQ ID NO: 211310 - DNA, 21 bp, Homo sapiens
ccacactgctacacttctgat

SEQ ID NO: 211311 - DNA, 16 bp, Homo sapiens
ccacacttcaggctct

SEQ ID NO: 211312 - DNA, 17 bp, Homo sapiens
ccacacttgagaggatg

SEQ ID NO: 211313 - DNA, 13 bp, Homo sapiens
ccacacttgctgg

SEQ ID NO: 211314 - DNA, 15 bp, Homo sapiens
ccacagaagacacgt

SEQ ID NO: 211315 - DNA, 16 bp, Homo sapiens
ccacagaagacacgtg

SEQ ID NO: 211316 - DNA, 21 bp, Homo sapiens
ccacagaagacacgtgttttt

SEQ ID NO: 211317 - DNA, 21 bp, Homo sapiens
ccacagacaaggtagccctgg

SEQ ID NO: 211318 - DNA, 12 bp, Homo sapiens
ccacagacacac

SEQ ID NO: 211319 - DNA, 13 bp, Homo sapiens
ccacagacacaca

SEQ ID NO: 211320 - DNA, 15 bp, Homo sapiens
ccacagacacacaca

SEQ ID NO: 211321 - DNA, 20 bp, Homo sapiens
ccacagacacacacacgcac

SEQ ID NO: 211322 - DNA, 16 bp, Homo sapiens
ccacagacagatccca

SEQ ID NO: 211323 - DNA, 13 bp, Homo sapiens
ccacagacgccac

SEQ ID NO: 211324 - DNA, 18 bp, Homo sapiens
ccacagacgccacctggc

SEQ ID NO: 211325 - DNA, 20 bp, Homo sapiens
ccacagagattagcctgtag

SEQ ID NO: 211326 - DNA, 14 bp, Homo sapiens
ccacagaggacagt

SEQ ID NO: 211327 - DNA, 13 bp, Homo sapiens
ccacagaggccag

SEQ ID NO: 211328 - DNA, 19 bp, Homo sapiens
ccacagatcagttttccta

SEQ ID NO: 211329 - DNA, 18 bp, Homo sapiens
ccacagcagcagaacaag

SEQ ID NO: 211330 - DNA, 15 bp, Homo sapiens
ccacagccaagccca

SEQ ID NO: 211331 - DNA, 20 bp, Homo sapiens
ccacagccctgtcagtgcag

SEQ ID NO: 211332 - DNA, 11 bp, Homo sapiens
ccacagctgct

SEQ ID NO: 211333 - DNA, 13 bp, Homo sapiens
ccacaggaagccg

SEQ ID NO: 211334 - DNA, 17 bp, Homo sapiens
ccacaggacacagtcag

SEQ ID NO: 211335 - DNA, 19 bp, Homo sapiens
ccacaggaggcaagcaagc

SEQ ID NO: 211336 - DNA, 18 bp, Homo sapiens
ccacaggccactgcaaac

SEQ ID NO: 211337 - DNA, 19 bp, Homo sapiens
ccacaggcccttcctctcc

SEQ ID NO: 211338 - DNA, 23 bp, Homo sapiens
ccacaggcccttcctctccactg

SEQ ID NO: 211339 - DNA, 14 bp, Homo sapiens
ccacagggcctgac

SEQ ID NO: 211340 - DNA, 20 bp, Homo sapiens
ccacagggcctgacttttac

SEQ ID NO: 211341 - DNA, 14 bp, Homo sapiens
ccacaggggcaggc

SEQ ID NO: 211342 - DNA, 18 bp, Homo sapiens
ccacaggggcaggcctgg

SEQ ID NO: 211343 - DNA, 22 bp, Homo sapiens
ccacaggggcaggcctgggacc

SEQ ID NO: 211344 - DNA, 23 bp, Homo sapiens
ccacagggtgggatgagcctctc

SEQ ID NO: 211345 - DNA, 18 bp, Homo sapiens
ccacagggttcaaaatgt

SEQ ID NO: 211346 - DNA, 21 bp, Homo sapiens
ccacaggtgtccccagcccac

SEQ ID NO: 211347 - DNA, 21 bp, Homo sapiens
ccacaggttctatgatttgta

SEQ ID NO: 211348 - DNA, 11 bp, Homo sapiens
ccacagtattg

SEQ ID NO: 211349 - DNA, 16 bp, Homo sapiens
ccacagtattgttctt

SEQ ID NO: 211350 - DNA, 15 bp, Homo sapiens
ccacagtcctcacag

SEQ ID NO: 211351 - DNA, 20 bp, Homo sapiens
ccacagtgctcagttgtact

SEQ ID NO: 211352 - DNA, 14 bp, Homo sapiens
ccacagtgctgctt

SEQ ID NO: 211353 - DNA, 15 bp, Homo sapiens
ccacagtggggccca

SEQ ID NO: 211354 - DNA, 17 bp, Homo sapiens
ccacagttgtcagttgt

SEQ ID NO: 211355 - DNA, 18 bp, Homo sapiens
ccacagttgtcagttgtg

SEQ ID NO: 211356 - DNA, 23 bp, Homo sapiens
ccacataatacattccatcacag

SEQ ID NO: 211357 - DNA, 21 bp, Homo sapiens
ccacatagtgatggttcccct

SEQ ID NO: 211358 - DNA, 14 bp, Homo sapiens
ccacatcccagcag

SEQ ID NO: 211359 - DNA, 12 bp, Homo sapiens
ccacatcccagg

SEQ ID NO: 211360 - DNA, 18 bp, Homo sapiens
ccacatcccaggcttcac

SEQ ID NO: 211361 - DNA, 17 bp, Homo sapiens
ccacatccccaccttcc

SEQ ID NO: 211362 - DNA, 23 bp, Homo sapiens
ccacatccccaccttccaaggaa

SEQ ID NO: 211363 - DNA, 17 bp, Homo sapiens
ccacatgagtcccagtg

SEQ ID NO: 211364 - DNA, 19 bp, Homo sapiens
ccacatgagtcccagtggg

SEQ ID NO: 211365 - DNA, 17 bp, Homo sapiens
ccacattctacttcagc

SEQ ID NO: 211366 - DNA, 16 bp, Homo sapiens
ccacattctgctgccc

SEQ ID NO: 211367 - DNA, 20 bp, Homo sapiens
ccacattctgctgcccccag

SEQ ID NO: 211368 - DNA, 21 bp, Homo sapiens
ccacattctgctgcccccaga

SEQ ID NO: 211369 - DNA, 16 bp, Homo sapiens
ccacatttgtcacaga

SEQ ID NO: 211370 - DNA, 13 bp, Homo sapiens
ccacattttaaca

SEQ ID NO: 211371 - DNA, 16 bp, Homo sapiens
ccacattttgctttat

SEQ ID NO: 211372 - DNA, 24 bp, Homo sapiens
ccaccaaactgcacacacagctcc

SEQ ID NO: 211373 - DNA, 19 bp, Homo sapiens
ccaccaagggtatctgctg

SEQ ID NO: 211374 - DNA, 11 bp, Homo sapiens
ccaccaataaa

SEQ ID NO: 211375 - DNA, 13 bp, Homo sapiens
ccaccacccctcc

SEQ ID NO: 211376 - DNA, 21 bp, Homo sapiens
ccaccacccctccctctgctc

SEQ ID NO: 211377 - DNA, 22 bp, Homo sapiens
ccaccacccctccctctgctct

SEQ ID NO: 211378 - DNA, 16 bp, Homo sapiens
ccaccacgtctgccag

SEQ ID NO: 211379 - DNA, 17 bp, Homo sapiens
ccaccacgtctgccagg

SEQ ID NO: 211380 - DNA, 19 bp, Homo sapiens
ccaccacgtctgccaggcc

SEQ ID NO: 211381 - DNA, 22 bp, Homo sapiens
ccaccacgtctgccaggcccat

SEQ ID NO: 211382 - DNA, 16 bp, Homo sapiens
ccaccactcttgactc

SEQ ID NO: 211383 - DNA, 17 bp, Homo sapiens
ccaccactgtccctacc

SEQ ID NO: 211384 - DNA, 18 bp, Homo sapiens
ccaccactgtccctacca

SEQ ID NO: 211385 - DNA, 21 bp, Homo sapiens
ccaccagaacgcaccccactg

SEQ ID NO: 211386 - DNA, 15 bp, Homo sapiens
ccaccagagactggg

SEQ ID NO: 211387 - DNA, 11 bp, Homo sapiens
ccaccagcagc

SEQ ID NO: 211388 - DNA, 17 bp, Homo sapiens
ccaccagccgccccagc

SEQ ID NO: 211389 - DNA, 19 bp, Homo sapiens
ccaccagctccactggcct

SEQ ID NO: 211390 - DNA, 15 bp, Homo sapiens
ccaccagctgctgga

SEQ ID NO: 211391 - DNA, 14 bp, Homo sapiens
ccaccaggagaacc

SEQ ID NO: 211392 - DNA, 22 bp, Homo sapiens
ccaccagtcagggacagcagcc

SEQ ID NO: 211393 - DNA, 15 bp, Homo sapiens
ccaccatgcccagct

SEQ ID NO: 211394 - DNA, 19 bp, Homo sapiens
cttgaggacctccacctgg

SEQ ID NO: 211395 - DNA, 24 bp, Homo sapiens
cttgaggacctccacctgggagat

SEQ ID NO: 211396 - DNA, 16 bp, Homo sapiens
cttgagggagcttagc

SEQ ID NO: 211397 - DNA, 23 bp, Homo sapiens
cttgagggtcattttcctttctg

SEQ ID NO: 211398 - DNA, 23 bp, Homo sapiens
cttgaggtaccagttgtatttaa

SEQ ID NO: 211399 - DNA, 18 bp, Homo sapiens
cttgaggtcttttgacat

SEQ ID NO: 211400 - DNA, 16 bp, Homo sapiens
cttgagtgggccccct

SEQ ID NO: 211401 - DNA, 17 bp, Homo sapiens
cttgagtgggccccctc

SEQ ID NO: 211402 - DNA, 18 bp, Homo sapiens
cttgagtgggccccctct

SEQ ID NO: 211403 - DNA, 18 bp, Homo sapiens
cttgagttggagtactat

SEQ ID NO: 211404 - DNA, 22 bp, Homo sapiens
cttgatatcctctttgagtgaa

SEQ ID NO: 211405 - DNA, 17 bp, Homo sapiens
cttgatctcctgacctc

SEQ ID NO: 211406 - DNA, 13 bp, Homo sapiens
cttgatgcactta

SEQ ID NO: 211407 - DNA, 21 bp, Homo sapiens
cttgatgcacttattttttaa

SEQ ID NO: 211408 - DNA, 22 bp, Homo sapiens
cttgatggagaaggaaaaggct

SEQ ID NO: 211409 - DNA, 23 bp, Homo sapiens
cttgatggagaaggaaaaggctg

SEQ ID NO: 211410 - DNA, 13 bp, Homo sapiens
cttgatgtaaaat

SEQ ID NO: 211411 - DNA, 14 bp, Homo sapiens
cttgatgtaaaatc

SEQ ID NO: 211412 - DNA, 15 bp, Homo sapiens
cttgatgtaaaatct

SEQ ID NO: 211413 - DNA, 17 bp, Homo sapiens
cttgatgtaaaatcttg

SEQ ID NO: 211414 - DNA, 21 bp, Homo sapiens
cttgatgtcttgagagcgctg

SEQ ID NO: 211415 - DNA, 17 bp, Homo sapiens
cttgatgtgaagataat

SEQ ID NO: 211416 - DNA, 15 bp, Homo sapiens
cttgatgtgttatct

SEQ ID NO: 211417 - DNA, 18 bp, Homo sapiens
cttgattaagattttaca

SEQ ID NO: 211418 - DNA, 20 bp, Homo sapiens
cttgattaagattttacaaa

SEQ ID NO: 211419 - DNA, 22 bp, Homo sapiens
cttgattagaagccaagacagt

SEQ ID NO: 211420 - DNA, 12 bp, Homo sapiens
cttgattcataa

SEQ ID NO: 211421 - DNA, 19 bp, Homo sapiens
cttgattcataatgactta

SEQ ID NO: 211422 - DNA, 13 bp, Homo sapiens
cttgattctaaag

SEQ ID NO: 211423 - DNA, 16 bp, Homo sapiens
cttgattctaaagggg

SEQ ID NO: 211424 - DNA, 13 bp, Homo sapiens
cttgcaaaacaaa

SEQ ID NO: 211425 - DNA, 15 bp, Homo sapiens
cttgcaaagccttta

SEQ ID NO: 211426 - DNA, 14 bp, Homo sapiens
cttgcaacacacag

SEQ ID NO: 211427 - DNA, 13 bp, Homo sapiens
cttgcacaggcca

SEQ ID NO: 211428 - DNA, 14 bp, Homo sapiens
cttgcacaggccac

SEQ ID NO: 211429 - DNA, 19 bp, Homo sapiens
cttgcacaggccacttgct

SEQ ID NO: 211430 - DNA, 23 bp, Homo sapiens
cttgcaccccaaagctttcctgc

SEQ ID NO: 211431 - DNA, 17 bp, Homo sapiens
cttgcacggtgacccct

SEQ ID NO: 211432 - DNA, 18 bp, Homo sapiens
cttgcactgtatccaagt

SEQ ID NO: 211433 - DNA, 13 bp, Homo sapiens
cttgcactgtgct

SEQ ID NO: 211434 - DNA, 14 bp, Homo sapiens
cttgcactgtgctt

SEQ ID NO: 211435 - DNA, 21 bp, Homo sapiens
cttgcactgtgcttgctccta

SEQ ID NO: 211436 - DNA, 13 bp, Homo sapiens
cttgcagagaagc

SEQ ID NO: 211437 - DNA, 18 bp, Homo sapiens
cttgcagagaagccttgg

SEQ ID NO: 211438 - DNA, 21 bp, Homo sapiens
cttgcaggggtcccccctcaa

SEQ ID NO: 211439 - DNA, 19 bp, Homo sapiens
cttgcatcctcctcccaac

SEQ ID NO: 211440 - DNA, 20 bp, Homo sapiens
cttgcatcctcctcccaact

SEQ ID NO: 211441 - DNA, 14 bp, Homo sapiens
cttgccaagaaatc

SEQ ID NO: 211442 - DNA, 18 bp, Homo sapiens
cttgccaaggccgcccac

SEQ ID NO: 211443 - DNA, 12 bp, Homo sapiens
cttgccacacag

SEQ ID NO: 211444 - DNA, 13 bp, Homo sapiens
cttgccacccccc

SEQ ID NO: 211445 - DNA, 15 bp, Homo sapiens
cttgccactgcctct

SEQ ID NO: 211446 - DNA, 13 bp, Homo sapiens
cttgccccagtcc

SEQ ID NO: 211447 - DNA, 15 bp, Homo sapiens
cttgccccccacccc

SEQ ID NO: 211448 - DNA, 17 bp, Homo sapiens
cttgcccgccagccagt

SEQ ID NO: 211449 - DNA, 21 bp, Homo sapiens
cttgcccgccagccagtggcc

SEQ ID NO: 211450 - DNA, 19 bp, Homo sapiens
cttgcccgccagcctcagt

SEQ ID NO: 211451 - DNA, 15 bp, Homo sapiens
cttgcccgctcccac

SEQ ID NO: 211452 - DNA, 17 bp, Homo sapiens
cttgcccgctcccacag

SEQ ID NO: 211453 - DNA, 14 bp, Homo sapiens
cttgccctgagctt

SEQ ID NO: 211454 - DNA, 13 bp, Homo sapiens
cttgccgaggagc

SEQ ID NO: 211455 - DNA, 15 bp, Homo sapiens
cttgccgaggagcca

SEQ ID NO: 211456 - DNA, 17 bp, Homo sapiens
cttgccgaggagccagg

SEQ ID NO: 211457 - DNA, 13 bp, Homo sapiens
cttgccgctggga

SEQ ID NO: 211458 - DNA, 17 bp, Homo sapiens
cttgccgctgggagagc

SEQ ID NO: 211459 - DNA, 14 bp, Homo sapiens
cttgcctaggccaa

SEQ ID NO: 211460 - DNA, 14 bp, Homo sapiens
cttgcctagggcct

SEQ ID NO: 211461 - DNA, 16 bp, Homo sapiens
cttgcctagggcctgg

SEQ ID NO: 211462 - DNA, 15 bp, Homo sapiens
cttgcctcaatgcca

SEQ ID NO: 211463 - DNA, 18 bp, Homo sapiens
cttgcctcaatgccagta

SEQ ID NO: 211464 - DNA, 19 bp, Homo sapiens
cttgcctccatggtgcctc

SEQ ID NO: 211465 - DNA, 20 bp, Homo sapiens
cttgcctccatggtgcctct

SEQ ID NO: 211466 - DNA, 20 bp, Homo sapiens
cttgcctcccctcctctcct

SEQ ID NO: 211467 - DNA, 21 bp, Homo sapiens
cttgccttccccttgaacctc

SEQ ID NO: 211468 - DNA, 23 bp, Homo sapiens
cttgcgccgagaccgcagaggga

SEQ ID NO: 211469 - DNA, 18 bp, Homo sapiens
cttgcggaactcttcctg

SEQ ID NO: 211470 - DNA, 21 bp, Homo sapiens
cttgcggcaccgcccacccac

SEQ ID NO: 211471 - DNA, 22 bp, Homo sapiens
cttgcggcaccgcccacccaca

SEQ ID NO: 211472 - DNA, 15 bp, Homo sapiens
cttgcgtcctgcaga

SEQ ID NO: 211473 - DNA, 18 bp, Homo sapiens
cttgcgtcctgcagagga

SEQ ID NO: 211474 - DNA, 19 bp, Homo sapiens
cttgcgtcctgcagaggac

SEQ ID NO: 211475 - DNA, 23 bp, Homo sapiens
cttgctaactttgcccttcactg

SEQ ID NO: 211476 - DNA, 21 bp, Homo sapiens
cttgctagacaaggttgctgt

SEQ ID NO: 211477 - DNA, 14 bp, Homo sapiens
cttgctagccctgg

SEQ ID NO: 211478 - DNA, 16 bp, Homo sapiens
cttgctagtgatacac

SEQ ID NO: 211479 - DNA, 23 bp, Homo sapiens
cttgctagtgatacactgtatct

SEQ ID NO: 211480 - DNA, 14 bp, Homo sapiens
cttgctcactccct

SEQ ID NO: 211481 - DNA, 16 bp, Homo sapiens
cttgctcactccctaa

SEQ ID NO: 211482 - DNA, 19 bp, Homo sapiens
cttgctcagacgagacacc

SEQ ID NO: 211483 - DNA, 20 bp, Homo sapiens
cttgctcagtgcctcctggc

SEQ ID NO: 211484 - DNA, 22 bp, Homo sapiens
cttgctcagtgcctcctggccg

SEQ ID NO: 211485 - DNA, 13 bp, Homo sapiens
cttgctccagggt

SEQ ID NO: 211486 - DNA, 17 bp, Homo sapiens
cttgctccagggtcttg

SEQ ID NO: 211487 - DNA, 16 bp, Homo sapiens
cttgctcccaacccat

SEQ ID NO: 211488 - DNA, 15 bp, Homo sapiens
cttgctctccctctt

SEQ ID NO: 211489 - DNA, 15 bp, Homo sapiens
cttgctctctggcct

SEQ ID NO: 211490 - DNA, 22 bp, Homo sapiens
cttgctctctggccttttccta

SEQ ID NO: 211491 - DNA, 15 bp, Homo sapiens
cttgctgatggcttg

SEQ ID NO: 211492 - DNA, 16 bp, Homo sapiens
cttgctgatggcttga

SEQ ID NO: 211493 - DNA, 12 bp, Homo sapiens
cttgctggtgca

SEQ ID NO: 211494 - DNA, 13 bp, Homo sapiens
cttgctgtagaga

SEQ ID NO: 211495 - DNA, 16 bp, Homo sapiens
cttgctgtagagactt

SEQ ID NO: 211496 - DNA, 18 bp, Homo sapiens
cttgctgtgaaatgactg

SEQ ID NO: 211497 - DNA, 22 bp, Homo sapiens
cttgcttctggctttgttcttg

SEQ ID NO: 211498 - DNA, 19 bp, Homo sapiens
cttgcttgccgagcctaat

SEQ ID NO: 211499 - DNA, 13 bp, Homo sapiens
cttgcttgctttt

SEQ ID NO: 211500 - DNA, 15 bp, Homo sapiens
cttgcttgtaaaaat

SEQ ID NO: 211501 - DNA, 23 bp, Homo sapiens
cttgctttcacaaatatagttga

SEQ ID NO: 211502 - DNA, 21 bp, Homo sapiens
cttgctttctttgtttggctg

SEQ ID NO: 211503 - DNA, 12 bp, Homo sapiens
cttgctttgggc

SEQ ID NO: 211504 - DNA, 23 bp, Homo sapiens
cttggaaaagtggcaagaccaaa

SEQ ID NO: 211505 - DNA, 14 bp, Homo sapiens
cttggaaacctgcc

SEQ ID NO: 211506 - DNA, 15 bp, Homo sapiens
cttggaaacctgccc

SEQ ID NO: 211507 - DNA, 16 bp, Homo sapiens
cttggaaacctgccct

SEQ ID NO: 211508 - DNA, 20 bp, Homo sapiens
cttggaaacctgccctgcct

SEQ ID NO: 211509 - DNA, 22 bp, Homo sapiens
cttggaaacctgccctgcctga

SEQ ID NO: 211510 - DNA, 19 bp, Homo sapiens
cttggaaatattaaaagaa

SEQ ID NO: 211511 - DNA, 19 bp, Homo sapiens
cttggaatatctgctgtat

SEQ ID NO: 211512 - DNA, 17 bp, Homo sapiens
cttggaatctatagtat

SEQ ID NO: 211513 - DNA, 18 bp, Homo sapiens
cttggacctcgtgcttta

SEQ ID NO: 211514 - DNA, 19 bp, Homo sapiens
cttggactacctataaatg

SEQ ID NO: 211515 - DNA, 18 bp, Homo sapiens
cttggactccctccccac

SEQ ID NO: 211516 - DNA, 18 bp, Homo sapiens
cttggactcttgctcttt

SEQ ID NO: 211517 - DNA, 14 bp, Homo sapiens
cttggacttcctgg

SEQ ID NO: 211518 - DNA, 23 bp, Homo sapiens
cttggacttcctggggccccgct

SEQ ID NO: 211519 - DNA, 15 bp, Homo sapiens
cttggagagaatcat

SEQ ID NO: 211520 - DNA, 22 bp, Homo sapiens
cttggagagcagctggctctcc

SEQ ID NO: 211521 - DNA, 14 bp, Homo sapiens
cttggagagctcag

SEQ ID NO: 211522 - DNA, 21 bp, Homo sapiens
cttggagaggaggtgtggagt

SEQ ID NO: 211523 - DNA, 20 bp, Homo sapiens
cttggagagggacgaagaaa

SEQ ID NO: 211524 - DNA, 21 bp, Homo sapiens
cttggagagggacgaagaaag

SEQ ID NO: 211525 - DNA, 15 bp, Homo sapiens
cttggagcagagacg

SEQ ID NO: 211526 - DNA, 15 bp, Homo sapiens
cttggagcagaggtg

SEQ ID NO: 211527 - DNA, 22 bp, Homo sapiens
cttggagccaatggagactgtc

SEQ ID NO: 211528 - DNA, 22 bp, Homo sapiens
ccaccatgcccagctcagaggg

SEQ ID NO: 211529 - DNA, 20 bp, Homo sapiens
ccacccaaaccccttcccac

SEQ ID NO: 211530 - DNA, 15 bp, Homo sapiens
ccacccaagcttggc

SEQ ID NO: 211531 - DNA, 21 bp, Homo sapiens
ccacccaagcttggcagccga

SEQ ID NO: 211532 - DNA, 14 bp, Homo sapiens
ccacccaccagggc

SEQ ID NO: 211533 - DNA, 13 bp, Homo sapiens
ccacccacctcca

SEQ ID NO: 211534 - DNA, 15 bp, Homo sapiens
ccacccactagccct

SEQ ID NO: 211535 - DNA, 16 bp, Homo sapiens
ccacccactagccctc

SEQ ID NO: 211536 - DNA, 13 bp, Homo sapiens
ccacccactcagg

SEQ ID NO: 211537 - DNA, 18 bp, Homo sapiens
ccacccacttagtccact

SEQ ID NO: 211538 - DNA, 12 bp, Homo sapiens
ccacccagccag

SEQ ID NO: 211539 - DNA, 14 bp, Homo sapiens
ccacccagccagga

SEQ ID NO: 211540 - DNA, 12 bp, Homo sapiens
ccacccagcccc

SEQ ID NO: 211541 - DNA, 12 bp, Homo sapiens
ccacccaggagg

SEQ ID NO: 211542 - DNA, 15 bp, Homo sapiens
ccacccaggcaggcc

SEQ ID NO: 211543 - DNA, 16 bp, Homo sapiens
ccacccaggctgcact

SEQ ID NO: 211544 - DNA, 20 bp, Homo sapiens
ccacccagggcccggcacag

SEQ ID NO: 211545 - DNA, 23 bp, Homo sapiens
ccacccagggctccctcctggag

SEQ ID NO: 211546 - DNA, 15 bp, Homo sapiens
ccacccagtgctgcc

SEQ ID NO: 211547 - DNA, 19 bp, Homo sapiens
ccacccatcttcctgctgc

SEQ ID NO: 211548 - DNA, 20 bp, Homo sapiens
ccacccatcttcctgctgct

SEQ ID NO: 211549 - DNA, 22 bp, Homo sapiens
ccacccatcttcctgctgctgt

SEQ ID NO: 211550 - DNA, 18 bp, Homo sapiens
ccaccccaaaccccagcc

SEQ ID NO: 211551 - DNA, 13 bp, Homo sapiens
ccaccccaactct

SEQ ID NO: 211552 - DNA, 13 bp, Homo sapiens
ccaccccagctgc

SEQ ID NO: 211553 - DNA, 18 bp, Homo sapiens
ccaccccagctgctcccc

SEQ ID NO: 211554 - DNA, 12 bp, Homo sapiens
ccaccccagtcc

SEQ ID NO: 211555 - DNA, 14 bp, Homo sapiens
ccaccccagtcccc

SEQ ID NO: 211556 - DNA, 19 bp, Homo sapiens
ccaccccagtgcacccact

SEQ ID NO: 211557 - DNA, 20 bp, Homo sapiens
ccacccccaaagacctgcct

SEQ ID NO: 211558 - DNA, 16 bp, Homo sapiens
ccacccccgccacggc

SEQ ID NO: 211559 - DNA, 19 bp, Homo sapiens
ccacccccgggtgcctgtg

SEQ ID NO: 211560 - DNA, 14 bp, Homo sapiens
ccaccccctgtccc

SEQ ID NO: 211561 - DNA, 15 bp, Homo sapiens
ccaccccctgtccca

SEQ ID NO: 211562 - DNA, 15 bp, Homo sapiens
ccaccccggcctcca

SEQ ID NO: 211563 - DNA, 17 bp, Homo sapiens
ccaccccggctccccct

SEQ ID NO: 211564 - DNA, 23 bp, Homo sapiens
ccaccccggctccccctgccagc

SEQ ID NO: 211565 - DNA, 12 bp, Homo sapiens
ccaccccgtccc

SEQ ID NO: 211566 - DNA, 19 bp, Homo sapiens
ccacccctaagtgcccaaa

SEQ ID NO: 211567 - DNA, 17 bp, Homo sapiens
ccacccctacagcctgc

SEQ ID NO: 211568 - DNA, 13 bp, Homo sapiens
ccacccctcaagc

SEQ ID NO: 211569 - DNA, 14 bp, Homo sapiens
ccacccctccctct

SEQ ID NO: 211570 - DNA, 21 bp, Homo sapiens
ccacccctccctctgctctca

SEQ ID NO: 211571 - DNA, 14 bp, Homo sapiens
ccacccctgccttt

SEQ ID NO: 211572 - DNA, 13 bp, Homo sapiens
ccacccgccccag

SEQ ID NO: 211573 - DNA, 14 bp, Homo sapiens
ccacccgccccaga

SEQ ID NO: 211574 - DNA, 20 bp, Homo sapiens
ccacccgccccagagactgc

SEQ ID NO: 211575 - DNA, 22 bp, Homo sapiens
ccacccgccccagagactgccc

SEQ ID NO: 211576 - DNA, 20 bp, Homo sapiens
ccacccggatctccaggccc

SEQ ID NO: 211577 - DNA, 21 bp, Homo sapiens
ccacccgtcttcaatctctgt

SEQ ID NO: 211578 - DNA, 17 bp, Homo sapiens
ccacccgtttccaagcc

SEQ ID NO: 211579 - DNA, 20 bp, Homo sapiens
ccacccgtttccaagcctgg

SEQ ID NO: 211580 - DNA, 19 bp, Homo sapiens
ccaccctcatttctgccag

SEQ ID NO: 211581 - DNA, 20 bp, Homo sapiens
ccaccctcatttctgccagc

SEQ ID NO: 211582 - DNA, 14 bp, Homo sapiens
ccaccctcccctct

SEQ ID NO: 211583 - DNA, 18 bp, Homo sapiens
ccaccctcccctctcctg

SEQ ID NO: 211584 - DNA, 19 bp, Homo sapiens
ccaccctcgtggacacctg

SEQ ID NO: 211585 - DNA, 14 bp, Homo sapiens
ccaccctctgcagg

SEQ ID NO: 211586 - DNA, 14 bp, Homo sapiens
ccaccctctggtcc

SEQ ID NO: 211587 - DNA, 19 bp, Homo sapiens
ccaccctgctgccttctga

SEQ ID NO: 211588 - DNA, 12 bp, Homo sapiens
ccaccctggccc

SEQ ID NO: 211589 - DNA, 16 bp, Homo sapiens
ccaccctgggcctccc

SEQ ID NO: 211590 - DNA, 22 bp, Homo sapiens
ccacccttggcctgtccacctg

SEQ ID NO: 211591 - DNA, 19 bp, Homo sapiens
ccaccgcatatgcatgcca

SEQ ID NO: 211592 - DNA, 23 bp, Homo sapiens
ccaccgcatatgcatgccaggct

SEQ ID NO: 211593 - DNA, 22 bp, Homo sapiens
ccaccgggctgggagctctgca

SEQ ID NO: 211594 - DNA, 18 bp, Homo sapiens
ccaccggttgcttctggg

SEQ ID NO: 211595 - DNA, 23 bp, Homo sapiens
ccacctaagggctaaggcctctt

SEQ ID NO: 211596 - DNA, 19 bp, Homo sapiens
ccacctacttgtgactgaa

SEQ ID NO: 211597 - DNA, 18 bp, Homo sapiens
ccacctatctcgtgggag

SEQ ID NO: 211598 - DNA, 21 bp, Homo sapiens
ccacctatctcgtgggagagc

SEQ ID NO: 211599 - DNA, 16 bp, Homo sapiens
ccacctcacaactcct

SEQ ID NO: 211600 - DNA, 18 bp, Homo sapiens
ccacctcacaactccttc

SEQ ID NO: 211601 - DNA, 16 bp, Homo sapiens
ccacctcactcctgtt

SEQ ID NO: 211602 - DNA, 15 bp, Homo sapiens
ccacctccacccact

SEQ ID NO: 211603 - DNA, 18 bp, Homo sapiens
ccacctccacccagcccc

SEQ ID NO: 211604 - DNA, 21 bp, Homo sapiens
ccacctccacccagcccctgg

SEQ ID NO: 211605 - DNA, 13 bp, Homo sapiens
ccacctccccagg

SEQ ID NO: 211606 - DNA, 20 bp, Homo sapiens
ccacctcccccaaaccctgc

SEQ ID NO: 211607 - DNA, 21 bp, Homo sapiens
ccacctcccccaaaccctgct

SEQ ID NO: 211608 - DNA, 18 bp, Homo sapiens
ccacctccctgcccaggc

SEQ ID NO: 211609 - DNA, 17 bp, Homo sapiens
ccacctcctctcttgga

SEQ ID NO: 211610 - DNA, 21 bp, Homo sapiens
ccacctctccaagtctctctg

SEQ ID NO: 211611 - DNA, 12 bp, Homo sapiens
ccacctctccct

SEQ ID NO: 211612 - DNA, 19 bp, Homo sapiens
ccacctctctcctttgctg

SEQ ID NO: 211613 - DNA, 15 bp, Homo sapiens
ccacctctgctgccc

SEQ ID NO: 211614 - DNA, 14 bp, Homo sapiens
ccacctcttttcct

SEQ ID NO: 211615 - DNA, 17 bp, Homo sapiens
ccacctgaaagcctgtc

SEQ ID NO: 211616 - DNA, 15 bp, Homo sapiens
ccacctgcagcgtct

SEQ ID NO: 211617 - DNA, 23 bp, Homo sapiens
ccacctgcatcagcctctggcca

SEQ ID NO: 211618 - DNA, 15 bp, Homo sapiens
ccacctgcccatcac

SEQ ID NO: 211619 - DNA, 18 bp, Homo sapiens
ccacctgcccccttctcc

SEQ ID NO: 211620 - DNA, 20 bp, Homo sapiens
ccacctgcccccttctccca

SEQ ID NO: 211621 - DNA, 14 bp, Homo sapiens
ccacctgcctatcc

SEQ ID NO: 211622 - DNA, 16 bp, Homo sapiens
ccacctgcctatccat

SEQ ID NO: 211623 - DNA, 18 bp, Homo sapiens
ccacctgcctcggcctcc

SEQ ID NO: 211624 - DNA, 15 bp, Homo sapiens
ccacctgcctgacca

SEQ ID NO: 211625 - DNA, 22 bp, Homo sapiens
ccacctggatggatctgctcca

SEQ ID NO: 211626 - DNA, 21 bp, Homo sapiens
ccacctgggagatgctgggac

SEQ ID NO: 211627 - DNA, 14 bp, Homo sapiens
ccacctgggctggg

SEQ ID NO: 211628 - DNA, 17 bp, Homo sapiens
ccacctgggctgggcgc

SEQ ID NO: 211629 - DNA, 14 bp, Homo sapiens
ccacctggggcagt

SEQ ID NO: 211630 - DNA, 20 bp, Homo sapiens
ccacctggggcagtcacctg

SEQ ID NO: 211631 - DNA, 21 bp, Homo sapiens
ccacctggttccggaatcctg

SEQ ID NO: 211632 - DNA, 15 bp, Homo sapiens
ccacctgtcccacct

SEQ ID NO: 211633 - DNA, 11 bp, Homo sapiens
ccacctgtctc

SEQ ID NO: 211634 - DNA, 16 bp, Homo sapiens
ccacctgtctcagcct

SEQ ID NO: 211635 - DNA, 18 bp, Homo sapiens
ccacctgtctcagcctcc

SEQ ID NO: 211636 - DNA, 14 bp, Homo sapiens
ccacctgtgctgct

SEQ ID NO: 211637 - DNA, 15 bp, Homo sapiens
ccacctgtgctgctg

SEQ ID NO: 211638 - DNA, 14 bp, Homo sapiens
ccaccttaaattaa

SEQ ID NO: 211639 - DNA, 22 bp, Homo sapiens
ccaccttaaattaaacaattta

SEQ ID NO: 211640 - DNA, 14 bp, Homo sapiens
ccaccttcccatgc

SEQ ID NO: 211641 - DNA, 19 bp, Homo sapiens
ccaccttcctgactgggaa

SEQ ID NO: 211642 - DNA, 18 bp, Homo sapiens
ccaccttctgtccccagc

SEQ ID NO: 211643 - DNA, 22 bp, Homo sapiens
ccaccttctgtccccagccctg

SEQ ID NO: 211644 - DNA, 21 bp, Homo sapiens
ccaccttgcactattggactt

SEQ ID NO: 211645 - DNA, 17 bp, Homo sapiens
ccaccttgttggagcct

SEQ ID NO: 211646 - DNA, 20 bp, Homo sapiens
ccaccttgttggagcctgca

SEQ ID NO: 211647 - DNA, 21 bp, Homo sapiens
ccaccttgttggagcctgcag

SEQ ID NO: 211648 - DNA, 16 bp, Homo sapiens
ccacctttcctgttca

SEQ ID NO: 211649 - DNA, 21 bp, Homo sapiens
ccacctttgaagaagtaagga

SEQ ID NO: 211650 - DNA, 20 bp, Homo sapiens
ccacctttgggatcagcctc

SEQ ID NO: 211651 - DNA, 21 bp, Homo sapiens
ccacctttgggatcagcctcc

SEQ ID NO: 211652 - DNA, 20 bp, Homo sapiens
ccacgacaaaaacaagactg

SEQ ID NO: 211653 - DNA, 21 bp, Homo sapiens
ccacgaggtggtagctctgag

SEQ ID NO: 211654 - DNA, 23 bp, Homo sapiens
ccacgagtcacctgcaagcccca

SEQ ID NO: 211655 - DNA, 13 bp, Homo sapiens
ccacgcactccat

SEQ ID NO: 211656 - DNA, 19 bp, Homo sapiens
ccacgcagagccccggagc

SEQ ID NO: 211657 - DNA, 15 bp, Homo sapiens
ccacgcagccaggac

SEQ ID NO: 211658 - DNA, 13 bp, Homo sapiens
ccacgccccagcc

SEQ ID NO: 211659 - DNA, 14 bp, Homo sapiens
ccacgccccagccc

SEQ ID NO: 211660 - DNA, 15 bp, Homo sapiens
ccacgccccgtgtct

SEQ ID NO: 211661 - DNA, 13 bp, Homo sapiens
ccacgccctgggg

SEQ ID NO: 211662 - DNA, 15 bp, Homo sapiens
cttggagcccgtgca

SEQ ID NO: 211663 - DNA, 14 bp, Homo sapiens
cttggagccggact

SEQ ID NO: 211664 - DNA, 15 bp, Homo sapiens
cttggaggaatgaca

SEQ ID NO: 211665 - DNA, 16 bp, Homo sapiens
cttggaggaatgacaa

SEQ ID NO: 211666 - DNA, 17 bp, Homo sapiens
cttggaggcaacctccc

SEQ ID NO: 211667 - DNA, 12 bp, Homo sapiens
cttggagggcat

SEQ ID NO: 211668 - DNA, 23 bp, Homo sapiens
cttggagggcatgaagacagata

SEQ ID NO: 211669 - DNA, 19 bp, Homo sapiens
cttggagggcccacttgta

SEQ ID NO: 211670 - DNA, 20 bp, Homo sapiens
cttggagggcccacttgtat

SEQ ID NO: 211671 - DNA, 21 bp, Homo sapiens
cttggattattttaaatcatt

SEQ ID NO: 211672 - DNA, 19 bp, Homo sapiens
cttggatttgcatttttgt

SEQ ID NO: 211673 - DNA, 20 bp, Homo sapiens
cttggcaacagaagcagttg

SEQ ID NO: 211674 - DNA, 21 bp, Homo sapiens
cttggcacatagtgggccttc

SEQ ID NO: 211675 - DNA, 23 bp, Homo sapiens
cttggcacatagtgggccttcat

SEQ ID NO: 211676 - DNA, 19 bp, Homo sapiens
cttggcaccaaagatgcag

SEQ ID NO: 211677 - DNA, 20 bp, Homo sapiens
cttggcacccccatgctgcc

SEQ ID NO: 211678 - DNA, 22 bp, Homo sapiens
cttggcacccccatgctgcctt

SEQ ID NO: 211679 - DNA, 22 bp, Homo sapiens
cttggccacaacctgaaagaca

SEQ ID NO: 211680 - DNA, 19 bp, Homo sapiens
cttggccacggcctgggag

SEQ ID NO: 211681 - DNA, 22 bp, Homo sapiens
cttggccagaagggggccatga

SEQ ID NO: 211682 - DNA, 21 bp, Homo sapiens
cttggcccagcagcggcccag

SEQ ID NO: 211683 - DNA, 17 bp, Homo sapiens
cttggcccaggaaaaac

SEQ ID NO: 211684 - DNA, 14 bp, Homo sapiens
cttggcccctctct

SEQ ID NO: 211685 - DNA, 18 bp, Homo sapiens
cttggccgcttccctacc

SEQ ID NO: 211686 - DNA, 13 bp, Homo sapiens
cttggcctgacct

SEQ ID NO: 211687 - DNA, 13 bp, Homo sapiens
cttggcctgtcca

SEQ ID NO: 211688 - DNA, 22 bp, Homo sapiens
cttggccttggggccagactgg

SEQ ID NO: 211689 - DNA, 18 bp, Homo sapiens
cttggcgtggagcaggcg

SEQ ID NO: 211690 - DNA, 14 bp, Homo sapiens
cttggcgtggagcc

SEQ ID NO: 211691 - DNA, 21 bp, Homo sapiens
cttggcgtgtgtccctgtggt

SEQ ID NO: 211692 - DNA, 15 bp, Homo sapiens
cttggcgttcctgcc

SEQ ID NO: 211693 - DNA, 14 bp, Homo sapiens
cttggctccatgct

SEQ ID NO: 211694 - DNA, 13 bp, Homo sapiens
cttggctgagccc

SEQ ID NO: 211695 - DNA, 16 bp, Homo sapiens
cttggctgagccccct

SEQ ID NO: 211696 - DNA, 15 bp, Homo sapiens
cttggctgccccaca

SEQ ID NO: 211697 - DNA, 13 bp, Homo sapiens
cttggctgtcccc

SEQ ID NO: 211698 - DNA, 18 bp, Homo sapiens
cttggcttccactcagca

SEQ ID NO: 211699 - DNA, 15 bp, Homo sapiens
cttggcttctgggac

SEQ ID NO: 211700 - DNA, 13 bp, Homo sapiens
cttgggaaaatat

SEQ ID NO: 211701 - DNA, 20 bp, Homo sapiens
cttgggaaaatatcactttg

SEQ ID NO: 211702 - DNA, 18 bp, Homo sapiens
cttgggacagccagagct

SEQ ID NO: 211703 - DNA, 16 bp, Homo sapiens
cttgggagagcccctg

SEQ ID NO: 211704 - DNA, 17 bp, Homo sapiens
cttgggagcctgaggca

SEQ ID NO: 211705 - DNA, 17 bp, Homo sapiens
cttgggatgggcacagg

SEQ ID NO: 211706 - DNA, 18 bp, Homo sapiens
cttgggatgggcacaggc

SEQ ID NO: 211707 - DNA, 21 bp, Homo sapiens
cttgggcacgggagagcgcca

SEQ ID NO: 211708 - DNA, 23 bp, Homo sapiens
cttgggcacgggagagcgccacc

SEQ ID NO: 211709 - DNA, 17 bp, Homo sapiens
cttgggcatccacccag

SEQ ID NO: 211710 - DNA, 14 bp, Homo sapiens
cttgggcccagctg

SEQ ID NO: 211711 - DNA, 13 bp, Homo sapiens
cttgggccctcct

SEQ ID NO: 211712 - DNA, 16 bp, Homo sapiens
cttgggcctttcagtc

SEQ ID NO: 211713 - DNA, 12 bp, Homo sapiens
cttgggcggctg

SEQ ID NO: 211714 - DNA, 14 bp, Homo sapiens
cttgggcggctgag

SEQ ID NO: 211715 - DNA, 18 bp, Homo sapiens
cttgggcggctgagagcc

SEQ ID NO: 211716 - DNA, 22 bp, Homo sapiens
cttgggcggctgagagccccag

SEQ ID NO: 211717 - DNA, 17 bp, Homo sapiens
cttgggctactggcagc

SEQ ID NO: 211718 - DNA, 15 bp, Homo sapiens
cttgggctcctggct

SEQ ID NO: 211719 - DNA, 16 bp, Homo sapiens
cttgggctcctggctg

SEQ ID NO: 211720 - DNA, 17 bp, Homo sapiens
cttgggctcctggctgc

SEQ ID NO: 211721 - DNA, 18 bp, Homo sapiens
cttgggctcctggctgcc

SEQ ID NO: 211722 - DNA, 20 bp, Homo sapiens
cttgggctcctggctgccag

SEQ ID NO: 211723 - DNA, 17 bp, Homo sapiens
cttgggctgagactgga

SEQ ID NO: 211724 - DNA, 17 bp, Homo sapiens
cttggggaacccatgag

SEQ ID NO: 211725 - DNA, 18 bp, Homo sapiens
cttggggaggggtcagct

SEQ ID NO: 211726 - DNA, 21 bp, Homo sapiens
cttggggaggggtcagctctg

SEQ ID NO: 211727 - DNA, 22 bp, Homo sapiens
cttggggaggggtcagctctgg

SEQ ID NO: 211728 - DNA, 13 bp, Homo sapiens
cttggggccatcg

SEQ ID NO: 211729 - DNA, 23 bp, Homo sapiens
cttggggcctggcttgctccagg

SEQ ID NO: 211730 - DNA, 14 bp, Homo sapiens
cttggggcttccta

SEQ ID NO: 211731 - DNA, 17 bp, Homo sapiens
cttgggggcagagcagc

SEQ ID NO: 211732 - DNA, 13 bp, Homo sapiens
cttgggggtcagg

SEQ ID NO: 211733 - DNA, 18 bp, Homo sapiens
cttgggggttcagggaac

SEQ ID NO: 211734 - DNA, 22 bp, Homo sapiens
cttggggtactcttgatgtgaa

SEQ ID NO: 211735 - DNA, 16 bp, Homo sapiens
cttggggtagagagga

SEQ ID NO: 211736 - DNA, 16 bp, Homo sapiens
cttggggtgtggggtg

SEQ ID NO: 211737 - DNA, 18 bp, Homo sapiens
cttggggtgtggggtggg

SEQ ID NO: 211738 - DNA, 19 bp, Homo sapiens
cttgggttccaaccaggca

SEQ ID NO: 211739 - DNA, 14 bp, Homo sapiens
cttgggttctgata

SEQ ID NO: 211740 - DNA, 15 bp, Homo sapiens
cttggtaagagggag

SEQ ID NO: 211741 - DNA, 20 bp, Homo sapiens
cttggtagttctgtgcctcc

SEQ ID NO: 211742 - DNA, 21 bp, Homo sapiens
cttggtagttctgtgcctccc

SEQ ID NO: 211743 - DNA, 20 bp, Homo sapiens
cttggtcaagtttttctctc

SEQ ID NO: 211744 - DNA, 15 bp, Homo sapiens
cttggtcacctcaaa

SEQ ID NO: 211745 - DNA, 23 bp, Homo sapiens
cttggtccctatgggcttccgca

SEQ ID NO: 211746 - DNA, 17 bp, Homo sapiens
cttggtccctggtccct

SEQ ID NO: 211747 - DNA, 15 bp, Homo sapiens
cttggtccttgattt

SEQ ID NO: 211748 - DNA, 22 bp, Homo sapiens
cttggtctaacttttgtgtgaa

SEQ ID NO: 211749 - DNA, 18 bp, Homo sapiens
cttggtctctttctttcc

SEQ ID NO: 211750 - DNA, 14 bp, Homo sapiens
cttggtgaggagga

SEQ ID NO: 211751 - DNA, 17 bp, Homo sapiens
cttggttcatcagtgtt

SEQ ID NO: 211752 - DNA, 16 bp, Homo sapiens
cttggttcccatttgc

SEQ ID NO: 211753 - DNA, 16 bp, Homo sapiens
cttggttcctccagca

SEQ ID NO: 211754 - DNA, 22 bp, Homo sapiens
cttggttcctccagcaatgcct

SEQ ID NO: 211755 - DNA, 21 bp, Homo sapiens
cttggttgtgaaccaactgcc

SEQ ID NO: 211756 - DNA, 19 bp, Homo sapiens
cttggttgttcctttttct

SEQ ID NO: 211757 - DNA, 20 bp, Homo sapiens
cttggtttatgagaactggt

SEQ ID NO: 211758 - DNA, 21 bp, Homo sapiens
cttggtttggtcatgcccgtc

SEQ ID NO: 211759 - DNA, 21 bp, Homo sapiens
cttggtttgttatatcaggga

SEQ ID NO: 211760 - DNA, 21 bp, Homo sapiens
cttggttttgtattgtttaaa

SEQ ID NO: 211761 - DNA, 13 bp, Homo sapiens
cttgtaaaaatat

SEQ ID NO: 211762 - DNA, 15 bp, Homo sapiens
cttgtaaacctggag

SEQ ID NO: 211763 - DNA, 17 bp, Homo sapiens
cttgtaaacctggaggg

SEQ ID NO: 211764 - DNA, 14 bp, Homo sapiens
cttgtaatatttct

SEQ ID NO: 211765 - DNA, 16 bp, Homo sapiens
cttgtaattctaaatg

SEQ ID NO: 211766 - DNA, 14 bp, Homo sapiens
cttgtacagaacca

SEQ ID NO: 211767 - DNA, 21 bp, Homo sapiens
cttgtacagaaccagcactcc

SEQ ID NO: 211768 - DNA, 20 bp, Homo sapiens
cttgtacagttgactggctt

SEQ ID NO: 211769 - DNA, 12 bp, Homo sapiens
cttgtacatatt

SEQ ID NO: 211770 - DNA, 24 bp, Homo sapiens
cttgtactaagccaggaggcttta

SEQ ID NO: 211771 - DNA, 19 bp, Homo sapiens
cttgtagctggactgcaat

SEQ ID NO: 211772 - DNA, 21 bp, Homo sapiens
cttgtaggaatctgccttcca

SEQ ID NO: 211773 - DNA, 15 bp, Homo sapiens
cttgtatagtgtaaa

SEQ ID NO: 211774 - DNA, 16 bp, Homo sapiens
cttgtatagtgtaaaa

SEQ ID NO: 211775 - DNA, 17 bp, Homo sapiens
cttgtatagtgtaaaat

SEQ ID NO: 211776 - DNA, 21 bp, Homo sapiens
cttgtatgaaagatggctgtg

SEQ ID NO: 211777 - DNA, 14 bp, Homo sapiens
cttgtattgctcca

SEQ ID NO: 211778 - DNA, 22 bp, Homo sapiens
cttgtcaccagttaaaagcatt

SEQ ID NO: 211779 - DNA, 22 bp, Homo sapiens
cttgtcactacaaaaatacaat

SEQ ID NO: 211780 - DNA, 21 bp, Homo sapiens
cttgtcagagctgggaggggt

SEQ ID NO: 211781 - DNA, 23 bp, Homo sapiens
cttgtcatcagtaagtataacaa

SEQ ID NO: 211782 - DNA, 15 bp, Homo sapiens
cttgtcatccacaca

SEQ ID NO: 211783 - DNA, 21 bp, Homo sapiens
cttgtcatccacacaacacca

SEQ ID NO: 211784 - DNA, 23 bp, Homo sapiens
cttgtcatggaaaatgtcctgtg

SEQ ID NO: 211785 - DNA, 14 bp, Homo sapiens
cttgtcatgtgtat

SEQ ID NO: 211786 - DNA, 16 bp, Homo sapiens
cttgtcatgtgtataa

SEQ ID NO: 211787 - DNA, 19 bp, Homo sapiens
cttgtcatgtgtataaaaa

SEQ ID NO: 211788 - DNA, 14 bp, Homo sapiens
cttgtccacattct

SEQ ID NO: 211789 - DNA, 20 bp, Homo sapiens
cttgtccaggtctcactgct

SEQ ID NO: 211790 - DNA, 14 bp, Homo sapiens
cttgtcctgccagc

SEQ ID NO: 211791 - DNA, 16 bp, Homo sapiens
cttgtcctgccagctg

SEQ ID NO: 211792 - DNA, 18 bp, Homo sapiens
cttgtcctgccagctgcc

SEQ ID NO: 211793 - DNA, 22 bp, Homo sapiens
cttgtcctgccagctgccttcc

SEQ ID NO: 211794 - DNA, 16 bp, Homo sapiens
cttgtctaaccccagg

SEQ ID NO: 211795 - DNA, 14 bp, Homo sapiens
ccacgccctgggga

SEQ ID NO: 211796 - DNA, 15 bp, Homo sapiens
ccacgccctggggag

SEQ ID NO: 211797 - DNA, 19 bp, Homo sapiens
ccacgccctggggagtgag

SEQ ID NO: 211798 - DNA, 15 bp, Homo sapiens
ccacgcgtgttctga

SEQ ID NO: 211799 - DNA, 14 bp, Homo sapiens
ccacgctcatcttg

SEQ ID NO: 211800 - DNA, 15 bp, Homo sapiens
ccacgctgtctccag

SEQ ID NO: 211801 - DNA, 20 bp, Homo sapiens
ccacggaaaatgccaatctc

SEQ ID NO: 211802 - DNA, 17 bp, Homo sapiens
ccacggaaacagaactc

SEQ ID NO: 211803 - DNA, 18 bp, Homo sapiens
ccacggacgtttccatca

SEQ ID NO: 211804 - DNA, 14 bp, Homo sapiens
ccacggccaccctc

SEQ ID NO: 211805 - DNA, 22 bp, Homo sapiens
ccacggccctgtcagagccgcc

SEQ ID NO: 211806 - DNA, 13 bp, Homo sapiens
ccacggctaagag

SEQ ID NO: 211807 - DNA, 17 bp, Homo sapiens
ccacggctaagaggctg

SEQ ID NO: 211808 - DNA, 18 bp, Homo sapiens
ccacggctctaggtgggg

SEQ ID NO: 211809 - DNA, 19 bp, Homo sapiens
ccacggctggatacctgtg

SEQ ID NO: 211810 - DNA, 17 bp, Homo sapiens
ccacggtgcgtggctgt

SEQ ID NO: 211811 - DNA, 21 bp, Homo sapiens
ccacggtgcgtggctgtggca

SEQ ID NO: 211812 - DNA, 22 bp, Homo sapiens
ccacgtccccctggggcttctc

SEQ ID NO: 211813 - DNA, 13 bp, Homo sapiens
ccacgtctgccag

SEQ ID NO: 211814 - DNA, 14 bp, Homo sapiens
ccacgtctgccagg

SEQ ID NO: 211815 - DNA, 22 bp, Homo sapiens
ccacgtctgccaggcccatctc

SEQ ID NO: 211816 - DNA, 17 bp, Homo sapiens
ccacgtctggccaggca

SEQ ID NO: 211817 - DNA, 18 bp, Homo sapiens
ccacgtctggccaggcac

SEQ ID NO: 211818 - DNA, 17 bp, Homo sapiens
ccacgtctgtcttcaca

SEQ ID NO: 211819 - DNA, 22 bp, Homo sapiens
ccacgtgagagaatctgcctgt

SEQ ID NO: 211820 - DNA, 23 bp, Homo sapiens
ccacgtgagagaatctgcctgtg

SEQ ID NO: 211821 - DNA, 21 bp, Homo sapiens
ccacgtgccattgtctttcct

SEQ ID NO: 211822 - DNA, 22 bp, Homo sapiens
ccacgtgtctggaatcccagct

SEQ ID NO: 211823 - DNA, 17 bp, Homo sapiens
ccactaaccatccccaa

SEQ ID NO: 211824 - DNA, 19 bp, Homo sapiens
ccactaatattcagtcctg

SEQ ID NO: 211825 - DNA, 17 bp, Homo sapiens
ccactaatttgtcactg

SEQ ID NO: 211826 - DNA, 15 bp, Homo sapiens
ccactaccctccctc

SEQ ID NO: 211827 - DNA, 17 bp, Homo sapiens
ccactacgctcctgtct

SEQ ID NO: 211828 - DNA, 19 bp, Homo sapiens
ccactacgctcctgtctcc

SEQ ID NO: 211829 - DNA, 20 bp, Homo sapiens
ccactacgctcctgtctcca

SEQ ID NO: 211830 - DNA, 16 bp, Homo sapiens
ccactagactcttcac

SEQ ID NO: 211831 - DNA, 19 bp, Homo sapiens
ccactagccctctttctct

SEQ ID NO: 211832 - DNA, 23 bp, Homo sapiens
ccactagccctctttctctctgt

SEQ ID NO: 211833 - DNA, 18 bp, Homo sapiens
ccactaggatcccactgg

SEQ ID NO: 211834 - DNA, 20 bp, Homo sapiens
ccactaggctgggtgcccac

SEQ ID NO: 211835 - DNA, 20 bp, Homo sapiens
ccactagggtcctggccctc

SEQ ID NO: 211836 - DNA, 16 bp, Homo sapiens
ccactaggtgtcccca

SEQ ID NO: 211837 - DNA, 14 bp, Homo sapiens
ccactatgcaaaga

SEQ ID NO: 211838 - DNA, 16 bp, Homo sapiens
ccactatgcaaagaac

SEQ ID NO: 211839 - DNA, 13 bp, Homo sapiens
ccactcaccccct

SEQ ID NO: 211840 - DNA, 22 bp, Homo sapiens
ccactcaccccctttgctgtga

SEQ ID NO: 211841 - DNA, 13 bp, Homo sapiens
ccactcactgcat

SEQ ID NO: 211842 - DNA, 14 bp, Homo sapiens
ccactcactgcatt

SEQ ID NO: 211843 - DNA, 22 bp, Homo sapiens
ccactcagcttggttcctgccc

SEQ ID NO: 211844 - DNA, 17 bp, Homo sapiens
ccactcagggctggccc

SEQ ID NO: 211845 - DNA, 19 bp, Homo sapiens
ccactcagggctggcccgg

SEQ ID NO: 211846 - DNA, 19 bp, Homo sapiens
ccactccagacccctggct

SEQ ID NO: 211847 - DNA, 20 bp, Homo sapiens
ccactccagacccctggctt

SEQ ID NO: 211848 - DNA, 16 bp, Homo sapiens
ccactcccccacctga

SEQ ID NO: 211849 - DNA, 12 bp, Homo sapiens
ccactcccctca

SEQ ID NO: 211850 - DNA, 17 bp, Homo sapiens
ccactcccctcatccac

SEQ ID NO: 211851 - DNA, 14 bp, Homo sapiens
ccactccctgagct

SEQ ID NO: 211852 - DNA, 18 bp, Homo sapiens
ccactccctgagctttgg

SEQ ID NO: 211853 - DNA, 14 bp, Homo sapiens
ccactccctgctcc

SEQ ID NO: 211854 - DNA, 21 bp, Homo sapiens
ccactccggattccggccctg

SEQ ID NO: 211855 - DNA, 23 bp, Homo sapiens
ccactccggattccggccctggc

SEQ ID NO: 211856 - DNA, 16 bp, Homo sapiens
ccactcctcccaactc

SEQ ID NO: 211857 - DNA, 18 bp, Homo sapiens
ccactcctcccaactctg

SEQ ID NO: 211858 - DNA, 15 bp, Homo sapiens
ccactcctcctccag

SEQ ID NO: 211859 - DNA, 15 bp, Homo sapiens
ccactcctgtacact

SEQ ID NO: 211860 - DNA, 13 bp, Homo sapiens
ccactcctgtccc

SEQ ID NO: 211861 - DNA, 21 bp, Homo sapiens
ccactcctgtcccgccttcct

SEQ ID NO: 211862 - DNA, 12 bp, Homo sapiens
ccactccttcct

SEQ ID NO: 211863 - DNA, 14 bp, Homo sapiens
ccactcgcagtcgc

SEQ ID NO: 211864 - DNA, 16 bp, Homo sapiens
ccactctaccctccca

SEQ ID NO: 211865 - DNA, 19 bp, Homo sapiens
ccactctagttctagatga

SEQ ID NO: 211866 - DNA, 11 bp, Homo sapiens
ccactctcctt

SEQ ID NO: 211867 - DNA, 13 bp, Homo sapiens
ccactctcggggc

SEQ ID NO: 211868 - DNA, 15 bp, Homo sapiens
ccactctctgcccac

SEQ ID NO: 211869 - DNA, 21 bp, Homo sapiens
ccactctgaagtcccttcctg

SEQ ID NO: 211870 - DNA, 23 bp, Homo sapiens
ccactctgaagtcccttcctgtc

SEQ ID NO: 211871 - DNA, 15 bp, Homo sapiens
ccactgacagcctcc

SEQ ID NO: 211872 - DNA, 19 bp, Homo sapiens
ccactgacagcctcccacc

SEQ ID NO: 211873 - DNA, 13 bp, Homo sapiens
ccactgacctgga

SEQ ID NO: 211874 - DNA, 15 bp, Homo sapiens
ccactgacctggaag

SEQ ID NO: 211875 - DNA, 17 bp, Homo sapiens
ccactgactgcagggac

SEQ ID NO: 211876 - DNA, 17 bp, Homo sapiens
ccactgagcccttgcac

SEQ ID NO: 211877 - DNA, 20 bp, Homo sapiens
ccactgcactccagcctggg

SEQ ID NO: 211878 - DNA, 11 bp, Homo sapiens
ccactgccagg

SEQ ID NO: 211879 - DNA, 14 bp, Homo sapiens
ccactgccaggcac

SEQ ID NO: 211880 - DNA, 17 bp, Homo sapiens
ccactgccaggcacctg

SEQ ID NO: 211881 - DNA, 18 bp, Homo sapiens
ccactgccaggcacctgg

SEQ ID NO: 211882 - DNA, 22 bp, Homo sapiens
ccactgccaggcacctggcctg

SEQ ID NO: 211883 - DNA, 23 bp, Homo sapiens
ccactgccaggcacctggcctgc

SEQ ID NO: 211884 - DNA, 16 bp, Homo sapiens
ccactgcccgagctgg

SEQ ID NO: 211885 - DNA, 20 bp, Homo sapiens
ccactgcccgagctggtgca

SEQ ID NO: 211886 - DNA, 15 bp, Homo sapiens
ccactgccctctcca

SEQ ID NO: 211887 - DNA, 23 bp, Homo sapiens
ccactgccctctccacacccatg

SEQ ID NO: 211888 - DNA, 14 bp, Homo sapiens
ccactgccctctgt

SEQ ID NO: 211889 - DNA, 13 bp, Homo sapiens
ccactgccctgcc

SEQ ID NO: 211890 - DNA, 17 bp, Homo sapiens
ccactgccctgcctgcc

SEQ ID NO: 211891 - DNA, 13 bp, Homo sapiens
ccactgcctctgc

SEQ ID NO: 211892 - DNA, 14 bp, Homo sapiens
ccactgcctctgcc

SEQ ID NO: 211893 - DNA, 15 bp, Homo sapiens
ccactgcctctgcct

SEQ ID NO: 211894 - DNA, 17 bp, Homo sapiens
ccactgcctctgcctta

SEQ ID NO: 211895 - DNA, 21 bp, Homo sapiens
ccactgcctctgccttagagg

SEQ ID NO: 211896 - DNA, 13 bp, Homo sapiens
ccactgcctcttc

SEQ ID NO: 211897 - DNA, 16 bp, Homo sapiens
ccactgcctcttcctc

SEQ ID NO: 211898 - DNA, 12 bp, Homo sapiens
ccactgcctgcc

SEQ ID NO: 211899 - DNA, 13 bp, Homo sapiens
ccactgcctgccc

SEQ ID NO: 211900 - DNA, 14 bp, Homo sapiens
ccactgcctgccca

SEQ ID NO: 211901 - DNA, 17 bp, Homo sapiens
ccactgcctgcccaccc

SEQ ID NO: 211902 - DNA, 13 bp, Homo sapiens
ccactgctaataa

SEQ ID NO: 211903 - DNA, 16 bp, Homo sapiens
ccactgctaataaatg

SEQ ID NO: 211904 - DNA, 17 bp, Homo sapiens
ccactgctaataaatga

SEQ ID NO: 211905 - DNA, 20 bp, Homo sapiens
ccactgctaataaatgacca

SEQ ID NO: 211906 - DNA, 18 bp, Homo sapiens
ccactggcatctctggag

SEQ ID NO: 211907 - DNA, 13 bp, Homo sapiens
ccactgggcctgc

SEQ ID NO: 211908 - DNA, 15 bp, Homo sapiens
ccactgggcctgcta

SEQ ID NO: 211909 - DNA, 18 bp, Homo sapiens
ccactggggagtgctgga

SEQ ID NO: 211910 - DNA, 15 bp, Homo sapiens
ccactgggtctcact

SEQ ID NO: 211911 - DNA, 18 bp, Homo sapiens
ccactgggtctcactcct

SEQ ID NO: 211912 - DNA, 14 bp, Homo sapiens
ccactgtaaaatga

SEQ ID NO: 211913 - DNA, 18 bp, Homo sapiens
ccactgtaaaatgaaatt

SEQ ID NO: 211914 - DNA, 18 bp, Homo sapiens
ccactgtccccctaccca

SEQ ID NO: 211915 - DNA, 21 bp, Homo sapiens
ccactgtccccctacccaccg

SEQ ID NO: 211916 - DNA, 17 bp, Homo sapiens
ccactgtccctaccact

SEQ ID NO: 211917 - DNA, 23 bp, Homo sapiens
ccactgtccctaccactgagccc

SEQ ID NO: 211918 - DNA, 13 bp, Homo sapiens
ccactgtcctggg

SEQ ID NO: 211919 - DNA, 14 bp, Homo sapiens
ccactgtcctgggc

SEQ ID NO: 211920 - DNA, 15 bp, Homo sapiens
ccactgtcctgggcg

SEQ ID NO: 211921 - DNA, 16 bp, Homo sapiens
ccactgtcctgggcgc

SEQ ID NO: 211922 - DNA, 22 bp, Homo sapiens
ccactgtcctgggcgccctgga

SEQ ID NO: 211923 - DNA, 15 bp, Homo sapiens
ccactgtggccagag

SEQ ID NO: 211924 - DNA, 18 bp, Homo sapiens
ccactgtggccagagctg

SEQ ID NO: 211925 - DNA, 19 bp, Homo sapiens
ccactgtggccagagctgg

SEQ ID NO: 211926 - DNA, 20 bp, Homo sapiens
ccactgtggccagagctgga

SEQ ID NO: 211927 - DNA, 13 bp, Homo sapiens
ccactgtgtccag

SEQ ID NO: 211928 - DNA, 16 bp, Homo sapiens
ccacttaaaaaatgtc

SEQ ID NO: 211929 - DNA, 23 bp, Homo sapiens
ccacttaatcttctctcttgatt

SEQ ID NO: 211930 - DNA, 16 bp, Homo sapiens
cttgtctgaggcctca

SEQ ID NO: 211931 - DNA, 20 bp, Homo sapiens
cttgtctgaggcctcatccc

SEQ ID NO: 211932 - DNA, 16 bp, Homo sapiens
cttgtctgtgtatttc

SEQ ID NO: 211933 - DNA, 14 bp, Homo sapiens
cttgtcttgctctt

SEQ ID NO: 211934 - DNA, 17 bp, Homo sapiens
cttgtctttactgacaa

SEQ ID NO: 211935 - DNA, 19 bp, Homo sapiens
cttgtcttttcccctcatt

SEQ ID NO: 211936 - DNA, 20 bp, Homo sapiens
cttgtcttttcccctcattg

SEQ ID NO: 211937 - DNA, 16 bp, Homo sapiens
cttgtgacattcactc

SEQ ID NO: 211938 - DNA, 16 bp, Homo sapiens
cttgtgactagtgctg

SEQ ID NO: 211939 - DNA, 18 bp, Homo sapiens
cttgtgactagtgctgaa

SEQ ID NO: 211940 - DNA, 17 bp, Homo sapiens
cttgtgactcagtgtat

SEQ ID NO: 211941 - DNA, 18 bp, Homo sapiens
cttgtgactgaaggggca

SEQ ID NO: 211942 - DNA, 15 bp, Homo sapiens
cttgtgagagcccat

SEQ ID NO: 211943 - DNA, 18 bp, Homo sapiens
cttgtgagatccttcaca

SEQ ID NO: 211944 - DNA, 20 bp, Homo sapiens
cttgtgatttccatttctga

SEQ ID NO: 211945 - DNA, 13 bp, Homo sapiens
cttgtgccctgcc

SEQ ID NO: 211946 - DNA, 16 bp, Homo sapiens
cttgtgccctgccccc

SEQ ID NO: 211947 - DNA, 19 bp, Homo sapiens
cttgtgcctcttgggagac

SEQ ID NO: 211948 - DNA, 16 bp, Homo sapiens
cttgtgctcacgctcc

SEQ ID NO: 211949 - DNA, 20 bp, Homo sapiens
cttgtgctgatcgtgctaaa

SEQ ID NO: 211950 - DNA, 18 bp, Homo sapiens
cttgtgcttggtggggct

SEQ ID NO: 211951 - DNA, 21 bp, Homo sapiens
cttgtgggctggtgccccaca

SEQ ID NO: 211952 - DNA, 20 bp, Homo sapiens
cttgtggttttcaaattgga

SEQ ID NO: 211953 - DNA, 20 bp, Homo sapiens
cttgtgtactgataaaatac

SEQ ID NO: 211954 - DNA, 12 bp, Homo sapiens
cttgtgtctgtt

SEQ ID NO: 211955 - DNA, 14 bp, Homo sapiens
cttgtgtctgttgc

SEQ ID NO: 211956 - DNA, 21 bp, Homo sapiens
cttgtgtgtgggctgtgagtg

SEQ ID NO: 211957 - DNA, 21 bp, Homo sapiens
cttgtgtgtttattgtcaaag

SEQ ID NO: 211958 - DNA, 18 bp, Homo sapiens
cttgtgtttgcttaaaca

SEQ ID NO: 211959 - DNA, 17 bp, Homo sapiens
cttgttcatttctgtct

SEQ ID NO: 211960 - DNA, 12 bp, Homo sapiens
cttgttcctaga

SEQ ID NO: 211961 - DNA, 22 bp, Homo sapiens
cttgttctctctatggtaaaga

SEQ ID NO: 211962 - DNA, 13 bp, Homo sapiens
cttgttctgtttt

SEQ ID NO: 211963 - DNA, 13 bp, Homo sapiens
cttgttcttcctc

SEQ ID NO: 211964 - DNA, 20 bp, Homo sapiens
cttgttgctcaaaaaatgag

SEQ ID NO: 211965 - DNA, 15 bp, Homo sapiens
cttgttggagcctgc

SEQ ID NO: 211966 - DNA, 18 bp, Homo sapiens
cttgttggagcctgcagg

SEQ ID NO: 211967 - DNA, 14 bp, Homo sapiens
cttgttggtcagag

SEQ ID NO: 211968 - DNA, 15 bp, Homo sapiens
cttgttgtttttaag

SEQ ID NO: 211969 - DNA, 13 bp, Homo sapiens
cttgtttaattct

SEQ ID NO: 211970 - DNA, 16 bp, Homo sapiens
cttgtttaccaaagaa

SEQ ID NO: 211971 - DNA, 21 bp, Homo sapiens
cttgtttaccaaagaagagtt

SEQ ID NO: 211972 - DNA, 23 bp, Homo sapiens
cttgtttatgatatttcttgctt

SEQ ID NO: 211973 - DNA, 12 bp, Homo sapiens
cttgtttcaatt

SEQ ID NO: 211974 - DNA, 17 bp, Homo sapiens
cttgtttccctgctggc

SEQ ID NO: 211975 - DNA, 19 bp, Homo sapiens
cttgtttccctgctggcca

SEQ ID NO: 211976 - DNA, 13 bp, Homo sapiens
cttgtttcctgtg

SEQ ID NO: 211977 - DNA, 18 bp, Homo sapiens
cttgtttctatactgttt

SEQ ID NO: 211978 - DNA, 23 bp, Homo sapiens
cttgtttctatactgtttgtaat

SEQ ID NO: 211979 - DNA, 17 bp, Homo sapiens
cttgtttgcttcaactg

SEQ ID NO: 211980 - DNA, 23 bp, Homo sapiens
cttgtttggagggatcattttct

SEQ ID NO: 211981 - DNA, 17 bp, Homo sapiens
cttgttttcttgccaat

SEQ ID NO: 211982 - DNA, 14 bp, Homo sapiens
cttgttttggatgc

SEQ ID NO: 211983 - DNA, 19 bp, Homo sapiens
cttgttttgttatataaaa

SEQ ID NO: 211984 - DNA, 20 bp, Homo sapiens
cttgttttgttatataaaaa

SEQ ID NO: 211985 - DNA, 19 bp, Homo sapiens
cttgttttttttttccact

SEQ ID NO: 211986 - DNA, 16 bp, Homo sapiens
ctttaaaacttactat

SEQ ID NO: 211987 - DNA, 15 bp, Homo sapiens
ctttaaaagatgaaa

SEQ ID NO: 211988 - DNA, 21 bp, Homo sapiens
ctttaaaataataatagtact

SEQ ID NO: 211989 - DNA, 22 bp, Homo sapiens
ctttaaactactgaactgttac

SEQ ID NO: 211990 - DNA, 16 bp, Homo sapiens
ctttaaagacttgatg

SEQ ID NO: 211991 - DNA, 16 bp, Homo sapiens
ctttaaagtacctgta

SEQ ID NO: 211992 - DNA, 18 bp, Homo sapiens
ctttaaagtacctgtagt

SEQ ID NO: 211993 - DNA, 13 bp, Homo sapiens
ctttaaataaatg

SEQ ID NO: 211994 - DNA, 23 bp, Homo sapiens
ctttaaataaatgtgagaactgt

SEQ ID NO: 211995 - DNA, 13 bp, Homo sapiens
ctttaaatatcat

SEQ ID NO: 211996 - DNA, 14 bp, Homo sapiens
ctttaaatatcatt

SEQ ID NO: 211997 - DNA, 21 bp, Homo sapiens
ctttaaatatcattctttgta

SEQ ID NO: 211998 - DNA, 10 bp, Homo sapiens
ctttaaatta

SEQ ID NO: 211999 - DNA, 22 bp, Homo sapiens
ctttaaattatatgatatgcat

SEQ ID NO: 212000 - DNA, 22 bp, Homo sapiens
ctttaaattgttcctctttgtt

SEQ ID NO: 212001 - DNA, 18 bp, Homo sapiens
ctttaacaaaacaagaaa

SEQ ID NO: 212002 - DNA, 15 bp, Homo sapiens
ctttaacagctttct

SEQ ID NO: 212003 - DNA, 20 bp, Homo sapiens
ctttaacagctttctccaga

SEQ ID NO: 212004 - DNA, 17 bp, Homo sapiens
ctttaaccagtctgaag

SEQ ID NO: 212005 - DNA, 18 bp, Homo sapiens
ctttaacccaatggagac

SEQ ID NO: 212006 - DNA, 20 bp, Homo sapiens
ctttaactgtatccttaacc

SEQ ID NO: 212007 - DNA, 14 bp, Homo sapiens
ctttaagacatact

SEQ ID NO: 212008 - DNA, 19 bp, Homo sapiens
ctttaagcactacataaac

SEQ ID NO: 212009 - DNA, 20 bp, Homo sapiens
ctttaagcactacataaact

SEQ ID NO: 212010 - DNA, 20 bp, Homo sapiens
ctttaagcgaggcagaatgg

SEQ ID NO: 212011 - DNA, 17 bp, Homo sapiens
ctttaagctccagcttt

SEQ ID NO: 212012 - DNA, 20 bp, Homo sapiens
ctttaagtcttacaggaagc

SEQ ID NO: 212013 - DNA, 20 bp, Homo sapiens
ctttaagtgcctacattatc

SEQ ID NO: 212014 - DNA, 20 bp, Homo sapiens
ctttaatactcacctcctcc

SEQ ID NO: 212015 - DNA, 19 bp, Homo sapiens
ctttaatcaaaagtcctta

SEQ ID NO: 212016 - DNA, 22 bp, Homo sapiens
ctttaatctgttgtttgaagaa

SEQ ID NO: 212017 - DNA, 22 bp, Homo sapiens
ctttaatcttcagttttatctt

SEQ ID NO: 212018 - DNA, 22 bp, Homo sapiens
ctttaattgtgaattgataata

SEQ ID NO: 212019 - DNA, 20 bp, Homo sapiens
ctttaattgttgcttttacg

SEQ ID NO: 212020 - DNA, 19 bp, Homo sapiens
ctttacaaaatgaatgcat

SEQ ID NO: 212021 - DNA, 15 bp, Homo sapiens
ctttacaactaaata

SEQ ID NO: 212022 - DNA, 23 bp, Homo sapiens
ctttacaggatcatgtaaatgct

SEQ ID NO: 212023 - DNA, 17 bp, Homo sapiens
ctttacatatgctttaa

SEQ ID NO: 212024 - DNA, 22 bp, Homo sapiens
ctttacatctgtgttctatgca

SEQ ID NO: 212025 - DNA, 14 bp, Homo sapiens
ctttacatgcaatt

SEQ ID NO: 212026 - DNA, 17 bp, Homo sapiens
ctttacatgcaatttat

SEQ ID NO: 212027 - DNA, 23 bp, Homo sapiens
ctttacattttcagtaccaaaga

SEQ ID NO: 212028 - DNA, 13 bp, Homo sapiens
ctttacctgagac

SEQ ID NO: 212029 - DNA, 16 bp, Homo sapiens
ctttacctgagaccag

SEQ ID NO: 212030 - DNA, 17 bp, Homo sapiens
ctttaccttcatttcat

SEQ ID NO: 212031 - DNA, 20 bp, Homo sapiens
ctttactactgcaagttcaa

SEQ ID NO: 212032 - DNA, 19 bp, Homo sapiens
ctttactcccttcctggcc

SEQ ID NO: 212033 - DNA, 14 bp, Homo sapiens
ctttactgggaagc

SEQ ID NO: 212034 - DNA, 21 bp, Homo sapiens
ctttagaaactgagtcctgtt

SEQ ID NO: 212035 - DNA, 16 bp, Homo sapiens
ctttagaaataaatgt

SEQ ID NO: 212036 - DNA, 17 bp, Homo sapiens
ctttagaagtgcatttc

SEQ ID NO: 212037 - DNA, 14 bp, Homo sapiens
ctttagagacaggg

SEQ ID NO: 212038 - DNA, 16 bp, Homo sapiens
ctttagccaaaccctt

SEQ ID NO: 212039 - DNA, 18 bp, Homo sapiens
ctttaggcagcagctttt

SEQ ID NO: 212040 - DNA, 16 bp, Homo sapiens
ctttaggcagcctgcc

SEQ ID NO: 212041 - DNA, 21 bp, Homo sapiens
ctttagggagacccaataaag

SEQ ID NO: 212042 - DNA, 19 bp, Homo sapiens
ctttagggggtgggagggg

SEQ ID NO: 212043 - DNA, 23 bp, Homo sapiens
ctttaggtagtagaatctcagca

SEQ ID NO: 212044 - DNA, 18 bp, Homo sapiens
ctttagtgattgctttta

SEQ ID NO: 212045 - DNA, 18 bp, Homo sapiens
ctttagtgccggctgtgg

SEQ ID NO: 212046 - DNA, 22 bp, Homo sapiens
ctttagtgccggctgtggagca

SEQ ID NO: 212047 - DNA, 22 bp, Homo sapiens
ctttataagccaatgaagcaaa

SEQ ID NO: 212048 - DNA, 20 bp, Homo sapiens
ctttataccccatttgattt

SEQ ID NO: 212049 - DNA, 20 bp, Homo sapiens
ctttatagaacatattttcc

SEQ ID NO: 212050 - DNA, 15 bp, Homo sapiens
ctttatattttctat

SEQ ID NO: 212051 - DNA, 14 bp, Homo sapiens
ctttatcattaaac

SEQ ID NO: 212052 - DNA, 20 bp, Homo sapiens
ctttatcattaaacatgaat

SEQ ID NO: 212053 - DNA, 22 bp, Homo sapiens
ctttatcattaaacatgaattt

SEQ ID NO: 212054 - DNA, 16 bp, Homo sapiens
ctttatctcctgctct

SEQ ID NO: 212055 - DNA, 20 bp, Homo sapiens
ctttatgaaaaaaatatatt

SEQ ID NO: 212056 - DNA, 22 bp, Homo sapiens
ctttatgaatgaaaaaacagtc

SEQ ID NO: 212057 - DNA, 23 bp, Homo sapiens
ctttatgactgtttttgtagtgg

SEQ ID NO: 212058 - DNA, 20 bp, Homo sapiens
ctttatgaggtcgtataatt

SEQ ID NO: 212059 - DNA, 15 bp, Homo sapiens
ctttatgcacaaaat

SEQ ID NO: 212060 - DNA, 17 bp, Homo sapiens
ctttatggctctaacat

SEQ ID NO: 212061 - DNA, 24 bp, Homo sapiens
ctttatggctctaacattactgcc

SEQ ID NO: 212062 - DNA, 16 bp, Homo sapiens
atgaaggtgtgctaca

SEQ ID NO: 212063 - DNA, 17 bp, Homo sapiens
atgaaggtgtgctacag

SEQ ID NO: 212064 - DNA, 20 bp, Homo sapiens
atgaaggttaggatttaaca

SEQ ID NO: 212065 - DNA, 17 bp, Homo sapiens
atgaataaagacaccta

SEQ ID NO: 212066 - DNA, 20 bp, Homo sapiens
atgaatacgtaaactgcgta

SEQ ID NO: 212067 - DNA, 20 bp, Homo sapiens
atgaatagatgtgatcactg

SEQ ID NO: 212068 - DNA, 17 bp, Homo sapiens
atgaatgaaacattttg

SEQ ID NO: 212069 - DNA, 14 bp, Homo sapiens
atgaatgaaatata

SEQ ID NO: 212070 - DNA, 21 bp, Homo sapiens
atgaatgaaatataaactgtg

SEQ ID NO: 212071 - DNA, 22 bp, Homo sapiens
atgaatgaaatataaactgtga

SEQ ID NO: 212072 - DNA, 15 bp, Homo sapiens
atgaatgatgtttta

SEQ ID NO: 212073 - DNA, 23 bp, Homo sapiens
atgaatggagatttgaaggtctg

SEQ ID NO: 212074 - DNA, 21 bp, Homo sapiens
atgaatgggctgagctgcctg

SEQ ID NO: 212075 - DNA, 19 bp, Homo sapiens
atgaatgtaaatttgtact

SEQ ID NO: 212076 - DNA, 21 bp, Homo sapiens
atgaatgtaaatttgtactat

SEQ ID NO: 212077 - DNA, 17 bp, Homo sapiens
atgaatgtatgtgcact

SEQ ID NO: 212078 - DNA, 18 bp, Homo sapiens
atgaatgtatgtgcactg

SEQ ID NO: 212079 - DNA, 20 bp, Homo sapiens
atgaattaaatattgaaaca

SEQ ID NO: 212080 - DNA, 23 bp, Homo sapiens
atgaattagaagaaaatggatga

SEQ ID NO: 212081 - DNA, 20 bp, Homo sapiens
atgaattcaagaaaggaaat

SEQ ID NO: 212082 - DNA, 16 bp, Homo sapiens
atgaattcatactctg

SEQ ID NO: 212083 - DNA, 23 bp, Homo sapiens
atgaattcatactctgttgcctc

SEQ ID NO: 212084 - DNA, 20 bp, Homo sapiens
atgaattctctctaaaaata

SEQ ID NO: 212085 - DNA, 14 bp, Homo sapiens
atgaatttaaatat

SEQ ID NO: 212086 - DNA, 14 bp, Homo sapiens
atgaatttgactgg

SEQ ID NO: 212087 - DNA, 18 bp, Homo sapiens
atgaattttaaaagcata

SEQ ID NO: 212088 - DNA, 15 bp, Homo sapiens
atgaattttatgtga

SEQ ID NO: 212089 - DNA, 16 bp, Homo sapiens
atgacaacttctaatt

SEQ ID NO: 212090 - DNA, 19 bp, Homo sapiens
atgacaacttctaattgcc

SEQ ID NO: 212091 - DNA, 15 bp, Homo sapiens
atgacaactttgcca

SEQ ID NO: 212092 - DNA, 13 bp, Homo sapiens
atgacaagcattt

SEQ ID NO: 212093 - DNA, 14 bp, Homo sapiens
atgacaaggtgtgc

SEQ ID NO: 212094 - DNA, 15 bp, Homo sapiens
atgacaatttcaaaa

SEQ ID NO: 212095 - DNA, 21 bp, Homo sapiens
atgacactgagaacagatctc

SEQ ID NO: 212096 - DNA, 12 bp, Homo sapiens
atgacagagagt

SEQ ID NO: 212097 - DNA, 22 bp, Homo sapiens
atgacagctactaacctggaga

SEQ ID NO: 212098 - DNA, 21 bp, Homo sapiens
atgacagtagcatactgatga

SEQ ID NO: 212099 - DNA, 18 bp, Homo sapiens
atgacatgaacaatgtgt

SEQ ID NO: 212100 - DNA, 17 bp, Homo sapiens
atgacatgttatatatt

SEQ ID NO: 212101 - DNA, 17 bp, Homo sapiens
atgacatttctcaaagt

SEQ ID NO: 212102 - DNA, 22 bp, Homo sapiens
atgacatttgtcctgcagagct

SEQ ID NO: 212103 - DNA, 17 bp, Homo sapiens
atgaccaatctctgtga

SEQ ID NO: 212104 - DNA, 17 bp, Homo sapiens
atgaccactgggcctgc

SEQ ID NO: 212105 - DNA, 21 bp, Homo sapiens
atgaccactgggcctgctagt

SEQ ID NO: 212106 - DNA, 12 bp, Homo sapiens
atgaccaggcca

SEQ ID NO: 212107 - DNA, 15 bp, Homo sapiens
atgaccaggccacca

SEQ ID NO: 212108 - DNA, 23 bp, Homo sapiens
atgacccggcccccgccctctgc

SEQ ID NO: 212109 - DNA, 11 bp, Homo sapiens
atgaccctgga

SEQ ID NO: 212110 - DNA, 21 bp, Homo sapiens
atgacctgtgaccagcactgt

SEQ ID NO: 212111 - DNA, 19 bp, Homo sapiens
atgaccttttggcctttgt

SEQ ID NO: 212112 - DNA, 21 bp, Homo sapiens
atgaccttttggcctttgtaa

SEQ ID NO: 212113 - DNA, 23 bp, Homo sapiens
atgacgagacctcagatgtgttg

SEQ ID NO: 212114 - DNA, 18 bp, Homo sapiens
atgacgcggctcaaaagg

SEQ ID NO: 212115 - DNA, 15 bp, Homo sapiens
atgacggaagaacat

SEQ ID NO: 212116 - DNA, 21 bp, Homo sapiens
atgacggaagaacatagaact

SEQ ID NO: 212117 - DNA, 17 bp, Homo sapiens
atgacgtattgtgaaat

SEQ ID NO: 212118 - DNA, 20 bp, Homo sapiens
atgactaaagagagaatgta

SEQ ID NO: 212119 - DNA, 18 bp, Homo sapiens
atgactagaaagtgaata

SEQ ID NO: 212120 - DNA, 20 bp, Homo sapiens
atgactagagacgcaccttg

SEQ ID NO: 212121 - DNA, 16 bp, Homo sapiens
atgactataaacatta

SEQ ID NO: 212122 - DNA, 17 bp, Homo sapiens
atgactccagaatttcc

SEQ ID NO: 212123 - DNA, 14 bp, Homo sapiens
atgactgaaagaag

SEQ ID NO: 212124 - DNA, 18 bp, Homo sapiens
atgactgagtctggcaaa

SEQ ID NO: 212125 - DNA, 23 bp, Homo sapiens
atgactgagtctggcaaacatgt

SEQ ID NO: 212126 - DNA, 21 bp, Homo sapiens
atgactgccccttgcttctca

SEQ ID NO: 212127 - DNA, 18 bp, Homo sapiens
atgactgctttgtttgga

SEQ ID NO: 212128 - DNA, 20 bp, Homo sapiens
atgactggctgtctgcctgt

SEQ ID NO: 212129 - DNA, 20 bp, Homo sapiens
atgactgtgaccaccttctg

SEQ ID NO: 212130 - DNA, 17 bp, Homo sapiens
atgactgtttttgtagt

SEQ ID NO: 212131 - DNA, 22 bp, Homo sapiens
atgacttaagcacacttgacat

SEQ ID NO: 212132 - DNA, 17 bp, Homo sapiens
atgacttttccatgtat

SEQ ID NO: 212133 - DNA, 12 bp, Homo sapiens
atgagaaaaaaa

SEQ ID NO: 212134 - DNA, 14 bp, Homo sapiens
atgagaaaaaaaca

SEQ ID NO: 212135 - DNA, 18 bp, Homo sapiens
atgagaaaaaaacagcag

SEQ ID NO: 212136 - DNA, 12 bp, Homo sapiens
atgagaaaaaac

SEQ ID NO: 212137 - DNA, 12 bp, Homo sapiens
atgagaaagaaa

SEQ ID NO: 212138 - DNA, 14 bp, Homo sapiens
atgagaaagaaaag

SEQ ID NO: 212139 - DNA, 15 bp, Homo sapiens
atgagaaagaaaagg

SEQ ID NO: 212140 - DNA, 16 bp, Homo sapiens
atgagaaagaaaagga

SEQ ID NO: 212141 - DNA, 17 bp, Homo sapiens
atgagaacaagtcacag

SEQ ID NO: 212142 - DNA, 16 bp, Homo sapiens
atgagaactggttctt

SEQ ID NO: 212143 - DNA, 15 bp, Homo sapiens
atgagaagagggcct

SEQ ID NO: 212144 - DNA, 16 bp, Homo sapiens
atgagaagagggcctg

SEQ ID NO: 212145 - DNA, 16 bp, Homo sapiens
atgagaatctgtgcag

SEQ ID NO: 212146 - DNA, 14 bp, Homo sapiens
atgagaatgtcatt

SEQ ID NO: 212147 - DNA, 15 bp, Homo sapiens
atgagaatgtcattt

SEQ ID NO: 212148 - DNA, 16 bp, Homo sapiens
atgagaattcagctgc

SEQ ID NO: 212149 - DNA, 19 bp, Homo sapiens
atgagaattcagctgcccc

SEQ ID NO: 212150 - DNA, 23 bp, Homo sapiens
atgagacagggttttttcatttt

SEQ ID NO: 212151 - DNA, 15 bp, Homo sapiens
atgagacttgctctc

SEQ ID NO: 212152 - DNA, 21 bp, Homo sapiens
atgagatatatctttatactt

SEQ ID NO: 212153 - DNA, 19 bp, Homo sapiens
atgagatattaaaataagc

SEQ ID NO: 212154 - DNA, 22 bp, Homo sapiens
atgagatctaagcctttccata

SEQ ID NO: 212155 - DNA, 23 bp, Homo sapiens
atgagatctaagcctttccataa

SEQ ID NO: 212156 - DNA, 14 bp, Homo sapiens
atgagattcagtga

SEQ ID NO: 212157 - DNA, 15 bp, Homo sapiens
atgagattcagtgaa

SEQ ID NO: 212158 - DNA, 12 bp, Homo sapiens
atgagattggaa

SEQ ID NO: 212159 - DNA, 22 bp, Homo sapiens
atgagattggaaaaaattagac

SEQ ID NO: 212160 - DNA, 19 bp, Homo sapiens
atgagatttgccagcacag

SEQ ID NO: 212161 - DNA, 14 bp, Homo sapiens
atgagcaaggacat

SEQ ID NO: 212162 - DNA, 16 bp, Homo sapiens
atgagcaaggacattg

SEQ ID NO: 212163 - DNA, 20 bp, Homo sapiens
atgagcaaggacattgcccc

SEQ ID NO: 212164 - DNA, 20 bp, Homo sapiens
atgagcactcctgattttta

SEQ ID NO: 212165 - DNA, 20 bp, Homo sapiens
atgagcagcaggcgtgcctc

SEQ ID NO: 212166 - DNA, 11 bp, Homo sapiens
atgagccagac

SEQ ID NO: 212167 - DNA, 17 bp, Homo sapiens
atgagcctctccttgcc

SEQ ID NO: 212168 - DNA, 23 bp, Homo sapiens
atgagcctgtaatcctcagctga

SEQ ID NO: 212169 - DNA, 21 bp, Homo sapiens
atgagctatttccattccaga

SEQ ID NO: 212170 - DNA, 22 bp, Homo sapiens
atgagctatttccattccagaa

SEQ ID NO: 212171 - DNA, 13 bp, Homo sapiens
atgagctccagac

SEQ ID NO: 212172 - DNA, 16 bp, Homo sapiens
atgagctccagacccc

SEQ ID NO: 212173 - DNA, 22 bp, Homo sapiens
atgagctccagacccccagcaa

SEQ ID NO: 212174 - DNA, 16 bp, Homo sapiens
atgagctgaaaagtga

SEQ ID NO: 212175 - DNA, 13 bp, Homo sapiens
atgagctggaagg

SEQ ID NO: 212176 - DNA, 15 bp, Homo sapiens
atgagctgggccctg

SEQ ID NO: 212177 - DNA, 13 bp, Homo sapiens
atgaggaaataat

SEQ ID NO: 212178 - DNA, 21 bp, Homo sapiens
atgaggaacaatcacaaaagc

SEQ ID NO: 212179 - DNA, 20 bp, Homo sapiens
atgaggcacgcctgccttct

SEQ ID NO: 212180 - DNA, 14 bp, Homo sapiens
atgagggctgagat

SEQ ID NO: 212181 - DNA, 15 bp, Homo sapiens
atgaggtaaaagagc

SEQ ID NO: 212182 - DNA, 17 bp, Homo sapiens
atgaggtctgaaatgga

SEQ ID NO: 212183 - DNA, 14 bp, Homo sapiens
atgaggtgctggga

SEQ ID NO: 212184 - DNA, 15 bp, Homo sapiens
atgaggtgctgggag

SEQ ID NO: 212185 - DNA, 18 bp, Homo sapiens
atgaggtgctgggaggga

SEQ ID NO: 212186 - DNA, 19 bp, Homo sapiens
atgaggttatgagaaaaaa

SEQ ID NO: 212187 - DNA, 21 bp, Homo sapiens
atgagtaaataaactcttcaa

SEQ ID NO: 212188 - DNA, 18 bp, Homo sapiens
atgagtaactattattat

SEQ ID NO: 212189 - DNA, 20 bp, Homo sapiens
atgagtatctttaaatataa

SEQ ID NO: 212190 - DNA, 19 bp, Homo sapiens
atgagtcaatgtgcagtgt

SEQ ID NO: 212191 - DNA, 15 bp, Homo sapiens
atgagttcaaatact

SEQ ID NO: 212192 - DNA, 20 bp, Homo sapiens
atgagttgtcagctttgact

SEQ ID NO: 212193 - DNA, 18 bp, Homo sapiens
atgagtttaaaaaaataa

SEQ ID NO: 212194 - DNA, 15 bp, Homo sapiens
atgagtttgccctgg

SEQ ID NO: 212195 - DNA, 18 bp, Homo sapiens
ccaccccaaacttccagg

SEQ ID NO: 212196 - DNA, 12 bp, Homo sapiens
ccaccccacact

SEQ ID NO: 212197 - DNA, 13 bp, Homo sapiens
ccaccccacagat

SEQ ID NO: 212198 - DNA, 15 bp, Homo sapiens
ccaccccacagatca

SEQ ID NO: 212199 - DNA, 18 bp, Homo sapiens
ccacccccgccacggcca

SEQ ID NO: 212200 - DNA, 13 bp, Homo sapiens
ccacccccgggtg

SEQ ID NO: 212201 - DNA, 17 bp, Homo sapiens
ccacccccgggtgcctg

SEQ ID NO: 212202 - DNA, 13 bp, Homo sapiens
ccaccccctcctg

SEQ ID NO: 212203 - DNA, 18 bp, Homo sapiens
ccacccccttctctgctc

SEQ ID NO: 212204 - DNA, 18 bp, Homo sapiens
ccaccccgctgcctggcg

SEQ ID NO: 212205 - DNA, 18 bp, Homo sapiens
ccaccccgggctctctgc

SEQ ID NO: 212206 - DNA, 15 bp, Homo sapiens
ccaccccgtcccggc

SEQ ID NO: 212207 - DNA, 16 bp, Homo sapiens
ccaccccgtgccaccc

SEQ ID NO: 212208 - DNA, 18 bp, Homo sapiens
ccacccctcaagccagga

SEQ ID NO: 212209 - DNA, 16 bp, Homo sapiens
ccacccctccctctgc

SEQ ID NO: 212210 - DNA, 13 bp, Homo sapiens
ccacccctcttcc

SEQ ID NO: 212211 - DNA, 14 bp, Homo sapiens
ccacccctcttccc

SEQ ID NO: 212212 - DNA, 17 bp, Homo sapiens
ccacccctcttccccct

SEQ ID NO: 212213 - DNA, 13 bp, Homo sapiens
ccacccctgccca

SEQ ID NO: 212214 - DNA, 15 bp, Homo sapiens
ccacccctgcccagg

SEQ ID NO: 212215 - DNA, 17 bp, Homo sapiens
ccacccctgcctttgtt

SEQ ID NO: 212216 - DNA, 12 bp, Homo sapiens
ccacccctgctg

SEQ ID NO: 212217 - DNA, 14 bp, Homo sapiens
ccacccggccacag

SEQ ID NO: 212218 - DNA, 21 bp, Homo sapiens
ccacccggccacagctgctgg

SEQ ID NO: 212219 - DNA, 22 bp, Homo sapiens
ccacccggccacagctgctgga

SEQ ID NO: 212220 - DNA, 16 bp, Homo sapiens
ccacccgtaggcagcc

SEQ ID NO: 212221 - DNA, 23 bp, Homo sapiens
ccacccgtaggcagcctctctgc

SEQ ID NO: 212222 - DNA, 15 bp, Homo sapiens
ccacccgtgttctcc

SEQ ID NO: 212223 - DNA, 19 bp, Homo sapiens
ccacccgttctgctggcct

SEQ ID NO: 212224 - DNA, 22 bp, Homo sapiens
ccacccgttctgctggcctgga

SEQ ID NO: 212225 - DNA, 18 bp, Homo sapiens
ccacccgtttccaagcct

SEQ ID NO: 212226 - DNA, 23 bp, Homo sapiens
ccacccgtttccaagcctgggcc

SEQ ID NO: 212227 - DNA, 15 bp, Homo sapiens
ccaccctaactgagc

SEQ ID NO: 212228 - DNA, 17 bp, Homo sapiens
ccaccctaactgagctg

SEQ ID NO: 212229 - DNA, 23 bp, Homo sapiens
ccaccctaatttgcccttcagga

SEQ ID NO: 212230 - DNA, 23 bp, Homo sapiens
ccaccctcacacacacagctggg

SEQ ID NO: 212231 - DNA, 22 bp, Homo sapiens
ccaccctcgtggacacctgccc

SEQ ID NO: 212232 - DNA, 20 bp, Homo sapiens
ccaccctctgcagggcagcc

SEQ ID NO: 212233 - DNA, 16 bp, Homo sapiens
ccaccctgcagccagg

SEQ ID NO: 212234 - DNA, 15 bp, Homo sapiens
ccaccctgctcctcc

SEQ ID NO: 212235 - DNA, 20 bp, Homo sapiens
ccaccctgctcctcctgccc

SEQ ID NO: 212236 - DNA, 22 bp, Homo sapiens
ccaccctgctcctcctgccctg

SEQ ID NO: 212237 - DNA, 15 bp, Homo sapiens
ccaccctgctgcctt

SEQ ID NO: 212238 - DNA, 15 bp, Homo sapiens
ccaccctggcccgcc

SEQ ID NO: 212239 - DNA, 12 bp, Homo sapiens
ccaccctgggcc

SEQ ID NO: 212240 - DNA, 13 bp, Homo sapiens
ccaccctgggcct

SEQ ID NO: 212241 - DNA, 20 bp, Homo sapiens
ccacccttcacgctggcttc

SEQ ID NO: 212242 - DNA, 14 bp, Homo sapiens
ccacccttggcctg

SEQ ID NO: 212243 - DNA, 23 bp, Homo sapiens
ccaccctttggggggggcccgcc

SEQ ID NO: 212244 - DNA, 12 bp, Homo sapiens
ccaccgaccccc

SEQ ID NO: 212245 - DNA, 13 bp, Homo sapiens
ccaccgaccccct

SEQ ID NO: 212246 - DNA, 22 bp, Homo sapiens
ccaccgccctcctcgctgtgcc

SEQ ID NO: 212247 - DNA, 15 bp, Homo sapiens
ccaccgctccccagc

SEQ ID NO: 212248 - DNA, 14 bp, Homo sapiens
ccaccgctgccagc

SEQ ID NO: 212249 - DNA, 15 bp, Homo sapiens
ccaccgctgccagca

SEQ ID NO: 212250 - DNA, 20 bp, Homo sapiens
ccaccgctgccagcacagag

SEQ ID NO: 212251 - DNA, 21 bp, Homo sapiens
ccaccgctgccagcacagagc

SEQ ID NO: 212252 - DNA, 17 bp, Homo sapiens
ccaccggggcaagaggg

SEQ ID NO: 212253 - DNA, 19 bp, Homo sapiens
ccaccggggcaagagggaa

SEQ ID NO: 212254 - DNA, 21 bp, Homo sapiens
ccaccggggcactggctgctc

SEQ ID NO: 212255 - DNA, 22 bp, Homo sapiens
ccaccggggcactggctgctct

SEQ ID NO: 212256 - DNA, 14 bp, Homo sapiens
ccaccggtgcctcc

SEQ ID NO: 212257 - DNA, 20 bp, Homo sapiens
ccacctaccttcaaagctga

SEQ ID NO: 212258 - DNA, 20 bp, Homo sapiens
ccacctatctcgtgggagag

SEQ ID NO: 212259 - DNA, 16 bp, Homo sapiens
ccacctatgcctgtgg

SEQ ID NO: 212260 - DNA, 21 bp, Homo sapiens
ccacctatgcctgtggtgaag

SEQ ID NO: 212261 - DNA, 18 bp, Homo sapiens
ccacctcactcctgttac

SEQ ID NO: 212262 - DNA, 14 bp, Homo sapiens
ccacctccacccag

SEQ ID NO: 212263 - DNA, 15 bp, Homo sapiens
ccacctccacccagc

SEQ ID NO: 212264 - DNA, 19 bp, Homo sapiens
ccacctccacccagcccct

SEQ ID NO: 212265 - DNA, 22 bp, Homo sapiens
ccacctccacccagcccctggc

SEQ ID NO: 212266 - DNA, 23 bp, Homo sapiens
ccacctccacccccaagaaacct

SEQ ID NO: 212267 - DNA, 22 bp, Homo sapiens
ccacctccacccccgccacggc

SEQ ID NO: 212268 - DNA, 23 bp, Homo sapiens
ccacctccacccccgccacggcc

SEQ ID NO: 212269 - DNA, 14 bp, Homo sapiens
ccacctccagccca

SEQ ID NO: 212270 - DNA, 15 bp, Homo sapiens
ccacctccagcccac

SEQ ID NO: 212271 - DNA, 16 bp, Homo sapiens
ccacctccccaggccg

SEQ ID NO: 212272 - DNA, 13 bp, Homo sapiens
ccacctccctgcc

SEQ ID NO: 212273 - DNA, 18 bp, Homo sapiens
ccacctcctagaggtggg

SEQ ID NO: 212274 - DNA, 11 bp, Homo sapiens
ccacctcctcc

SEQ ID NO: 212275 - DNA, 15 bp, Homo sapiens
ccacctcctctcttg

SEQ ID NO: 212276 - DNA, 19 bp, Homo sapiens
ccacctcgcggcgcagccc

SEQ ID NO: 212277 - DNA, 23 bp, Homo sapiens
ccacctcgcggcgcagcccctgg

SEQ ID NO: 212278 - DNA, 14 bp, Homo sapiens
ccacctctcaatat

SEQ ID NO: 212279 - DNA, 13 bp, Homo sapiens
ccacctctccctc

SEQ ID NO: 212280 - DNA, 17 bp, Homo sapiens
ccacctctctcctttgc

SEQ ID NO: 212281 - DNA, 24 bp, Homo sapiens
ccacctctctcctttgctgaggcc

SEQ ID NO: 212282 - DNA, 15 bp, Homo sapiens
ccacctcttttccta

SEQ ID NO: 212283 - DNA, 15 bp, Homo sapiens
ccacctgaaagcctg

SEQ ID NO: 212284 - DNA, 20 bp, Homo sapiens
ccacctgaaagcctgtctct

SEQ ID NO: 212285 - DNA, 20 bp, Homo sapiens
ccacctgaagtgatgatgga

SEQ ID NO: 212286 - DNA, 19 bp, Homo sapiens
ccacctgacaatggcagct

SEQ ID NO: 212287 - DNA, 20 bp, Homo sapiens
ccacctgacaatggcagcta

SEQ ID NO: 212288 - DNA, 22 bp, Homo sapiens
ccacctgagctttggacgcaca

SEQ ID NO: 212289 - DNA, 13 bp, Homo sapiens
ccacctgcatcag

SEQ ID NO: 212290 - DNA, 14 bp, Homo sapiens
ccacctgcatcagc

SEQ ID NO: 212291 - DNA, 20 bp, Homo sapiens
ccacctgccactaggctggg

SEQ ID NO: 212292 - DNA, 12 bp, Homo sapiens
ccacctgcccag

SEQ ID NO: 212293 - DNA, 13 bp, Homo sapiens
ccacctgcccagt

SEQ ID NO: 212294 - DNA, 21 bp, Homo sapiens
ccacctgcccagttagcccgg

SEQ ID NO: 212295 - DNA, 22 bp, Homo sapiens
ccacctgcccagttagcccggc

SEQ ID NO: 212296 - DNA, 14 bp, Homo sapiens
ccacctgcccatca

SEQ ID NO: 212297 - DNA, 12 bp, Homo sapiens
ccacctgccccc

SEQ ID NO: 212298 - DNA, 21 bp, Homo sapiens
ccacctgcccccttctcccac

SEQ ID NO: 212299 - DNA, 22 bp, Homo sapiens
ccacctgcccccttctcccaca

SEQ ID NO: 212300 - DNA, 15 bp, Homo sapiens
ccacctgcctatcca

SEQ ID NO: 212301 - DNA, 23 bp, Homo sapiens
ccacctgcctcggcctcccaaag

SEQ ID NO: 212302 - DNA, 18 bp, Homo sapiens
atgcagatctagccaggc

SEQ ID NO: 212303 - DNA, 21 bp, Homo sapiens
atgcagatctagccaggcctc

SEQ ID NO: 212304 - DNA, 16 bp, Homo sapiens
atgcagatgccagagc

SEQ ID NO: 212305 - DNA, 16 bp, Homo sapiens
atgcagattcctgggc

SEQ ID NO: 212306 - DNA, 18 bp, Homo sapiens
atgcagcaacacccaagt

SEQ ID NO: 212307 - DNA, 11 bp, Homo sapiens
atgcagcagct

SEQ ID NO: 212308 - DNA, 17 bp, Homo sapiens
atgcagcatacaaaaat

SEQ ID NO: 212309 - DNA, 22 bp, Homo sapiens
atgcagcatacaaaaatatatt

SEQ ID NO: 212310 - DNA, 21 bp, Homo sapiens
atgcagcccatgcccacctgc

SEQ ID NO: 212311 - DNA, 19 bp, Homo sapiens
atgcagggaggggaggcag

SEQ ID NO: 212312 - DNA, 14 bp, Homo sapiens
atgcaggtctccat

SEQ ID NO: 212313 - DNA, 14 bp, Homo sapiens
atgcagtataaaat

SEQ ID NO: 212314 - DNA, 15 bp, Homo sapiens
atgcagttattagaa

SEQ ID NO: 212315 - DNA, 20 bp, Homo sapiens
atgcagttattagaacttag

SEQ ID NO: 212316 - DNA, 15 bp, Homo sapiens
atgcataaaatatat

SEQ ID NO: 212317 - DNA, 17 bp, Homo sapiens
atgcataaacaacagta

SEQ ID NO: 212318 - DNA, 14 bp, Homo sapiens
atgcataccagtaa

SEQ ID NO: 212319 - DNA, 18 bp, Homo sapiens
atgcatatcctgagccat

SEQ ID NO: 212320 - DNA, 18 bp, Homo sapiens
atgcatctttgagaatat

SEQ ID NO: 212321 - DNA, 16 bp, Homo sapiens
atgcatgagaactaaa

SEQ ID NO: 212322 - DNA, 17 bp, Homo sapiens
atgcatgagaactaaat

SEQ ID NO: 212323 - DNA, 18 bp, Homo sapiens
atgcatgagaactaaata

SEQ ID NO: 212324 - DNA, 13 bp, Homo sapiens
atgcatgagctcc

SEQ ID NO: 212325 - DNA, 22 bp, Homo sapiens
atgcatgatattgtatgtacct

SEQ ID NO: 212326 - DNA, 20 bp, Homo sapiens
atgcatgcagccactgtgct

SEQ ID NO: 212327 - DNA, 12 bp, Homo sapiens
atgcatggaaac

SEQ ID NO: 212328 - DNA, 21 bp, Homo sapiens
atgcatggcagcaggcctgtt

SEQ ID NO: 212329 - DNA, 20 bp, Homo sapiens
atgcatggcctcccagccac

SEQ ID NO: 212330 - DNA, 13 bp, Homo sapiens
atgcatgtagcat

SEQ ID NO: 212331 - DNA, 15 bp, Homo sapiens
atgcatgtagcatat

SEQ ID NO: 212332 - DNA, 23 bp, Homo sapiens
atgcatgtagcatataaatgttt

SEQ ID NO: 212333 - DNA, 21 bp, Homo sapiens
ccacgagtcacctgcaagccc

SEQ ID NO: 212334 - DNA, 12 bp, Homo sapiens
ccacgattttaa

SEQ ID NO: 212335 - DNA, 13 bp, Homo sapiens
ccacgcagagccc

SEQ ID NO: 212336 - DNA, 14 bp, Homo sapiens
ccacgcagagcccc

SEQ ID NO: 212337 - DNA, 16 bp, Homo sapiens
ccacgcagagccccgg

SEQ ID NO: 212338 - DNA, 20 bp, Homo sapiens
ccacgcagagccccggagca

SEQ ID NO: 212339 - DNA, 13 bp, Homo sapiens
ccacgcagccagg

SEQ ID NO: 212340 - DNA, 17 bp, Homo sapiens
ccacgcagccaggacac

SEQ ID NO: 212341 - DNA, 17 bp, Homo sapiens
ccacgccccagcccgac

SEQ ID NO: 212342 - DNA, 18 bp, Homo sapiens
ccacgccctggggagtga

SEQ ID NO: 212343 - DNA, 12 bp, Homo sapiens
ccacgctcctgc

SEQ ID NO: 212344 - DNA, 16 bp, Homo sapiens
ccacgctgggacacag

SEQ ID NO: 212345 - DNA, 18 bp, Homo sapiens
ccacgctttgctgctacc

SEQ ID NO: 212346 - DNA, 19 bp, Homo sapiens
ccacggaccgcatcctcca

SEQ ID NO: 212347 - DNA, 20 bp, Homo sapiens
ccacggaccgcatcctccag

SEQ ID NO: 212348 - DNA, 19 bp, Homo sapiens
ccacggacgtttccatcag

SEQ ID NO: 212349 - DNA, 20 bp, Homo sapiens
ccacggacgtttccatcagg

SEQ ID NO: 212350 - DNA, 12 bp, Homo sapiens
ccacggccaccc

SEQ ID NO: 212351 - DNA, 17 bp, Homo sapiens
ccacggccacccaccct

SEQ ID NO: 212352 - DNA, 16 bp, Homo sapiens
ccacggccaccctcct

SEQ ID NO: 212353 - DNA, 13 bp, Homo sapiens
ccacggccactgc

SEQ ID NO: 212354 - DNA, 14 bp, Homo sapiens
ccacggccactgca

SEQ ID NO: 212355 - DNA, 21 bp, Homo sapiens
ccacggctaagaggctgctga

SEQ ID NO: 212356 - DNA, 21 bp, Homo sapiens
ccacggctctcgtccctctgc

SEQ ID NO: 212357 - DNA, 22 bp, Homo sapiens
ccacggctctcgtccctctgct

SEQ ID NO: 212358 - DNA, 18 bp, Homo sapiens
ccacgggaagtttagaga

SEQ ID NO: 212359 - DNA, 17 bp, Homo sapiens
ccacgggggaggccgag

SEQ ID NO: 212360 - DNA, 23 bp, Homo sapiens
ccacgggggaggccgaggcaggg

SEQ ID NO: 212361 - DNA, 23 bp, Homo sapiens
ccacggggtcgggggaggagcac

SEQ ID NO: 212362 - DNA, 13 bp, Homo sapiens
ccacggtgcgtgg

SEQ ID NO: 212363 - DNA, 16 bp, Homo sapiens
ccacggtgcgtggctg

SEQ ID NO: 212364 - DNA, 19 bp, Homo sapiens
ccacggtgcgtggctgtgg

SEQ ID NO: 212365 - DNA, 22 bp, Homo sapiens
ccacgtcagccaaatgacttca

SEQ ID NO: 212366 - DNA, 21 bp, Homo sapiens
ccacgtcctcgaattctcaga

SEQ ID NO: 212367 - DNA, 15 bp, Homo sapiens
ccacgtctgccaggc

SEQ ID NO: 212368 - DNA, 16 bp, Homo sapiens
ccacgtctgccaggcc

SEQ ID NO: 212369 - DNA, 13 bp, Homo sapiens
ccacgtctggcca

SEQ ID NO: 212370 - DNA, 23 bp, Homo sapiens
ccacgtctggccaggcactgcct

SEQ ID NO: 212371 - DNA, 17 bp, Homo sapiens
ccacgtgacagtgcctg

SEQ ID NO: 212372 - DNA, 21 bp, Homo sapiens
ccacgtgagagaatctgcctg

SEQ ID NO: 212373 - DNA, 15 bp, Homo sapiens
ccacgtggactctgt

SEQ ID NO: 212374 - DNA, 20 bp, Homo sapiens
ccacgtggactctgtgctca

SEQ ID NO: 212375 - DNA, 20 bp, Homo sapiens
ccacgtgtctggaatcccag

SEQ ID NO: 212376 - DNA, 15 bp, Homo sapiens
ccacgttcacccctc

SEQ ID NO: 212377 - DNA, 17 bp, Homo sapiens
ccacgttcacccctcca

SEQ ID NO: 212378 - DNA, 20 bp, Homo sapiens
ccactaaccatccccaactc

SEQ ID NO: 212379 - DNA, 17 bp, Homo sapiens
ccactaagctttctcct

SEQ ID NO: 212380 - DNA, 18 bp, Homo sapiens
ccactaagctttctcctt

SEQ ID NO: 212381 - DNA, 13 bp, Homo sapiens
ccactaccttctg

SEQ ID NO: 212382 - DNA, 14 bp, Homo sapiens
ccactacctttgtc

SEQ ID NO: 212383 - DNA, 14 bp, Homo sapiens
ccactacgctcctg

SEQ ID NO: 212384 - DNA, 13 bp, Homo sapiens
ccactagccctct

SEQ ID NO: 212385 - DNA, 22 bp, Homo sapiens
ccactagccctctttctctctg

SEQ ID NO: 212386 - DNA, 16 bp, Homo sapiens
ccactaggataggaac

SEQ ID NO: 212387 - DNA, 14 bp, Homo sapiens
ccactaggctgggt

SEQ ID NO: 212388 - DNA, 16 bp, Homo sapiens
ccactaggctgggtgc

SEQ ID NO: 212389 - DNA, 21 bp, Homo sapiens
ccactaggctgggtgcccaca

SEQ ID NO: 212390 - DNA, 17 bp, Homo sapiens
ccactaggtgtccccaa

SEQ ID NO: 212391 - DNA, 21 bp, Homo sapiens
ccactatgggaagctctgtgt

SEQ ID NO: 212392 - DNA, 13 bp, Homo sapiens
ccactcaccaggg

SEQ ID NO: 212393 - DNA, 15 bp, Homo sapiens
ccactcaccagggtc

SEQ ID NO: 212394 - DNA, 12 bp, Homo sapiens
ccactcaccccc

SEQ ID NO: 212395 - DNA, 14 bp, Homo sapiens
ccactcactccagc

SEQ ID NO: 212396 - DNA, 15 bp, Homo sapiens
ccactcactccagcc

SEQ ID NO: 212397 - DNA, 11 bp, Homo sapiens
ccactcagcat

SEQ ID NO: 212398 - DNA, 16 bp, Homo sapiens
ccactcagcttggttc

SEQ ID NO: 212399 - DNA, 15 bp, Homo sapiens
ccactcagggctggc

SEQ ID NO: 212400 - DNA, 18 bp, Homo sapiens
ccactcagggctggcccg

SEQ ID NO: 212401 - DNA, 22 bp, Homo sapiens
ccactccagacccctggctttt

SEQ ID NO: 212402 - DNA, 18 bp, Homo sapiens
ccactcccgccacacgct

SEQ ID NO: 212403 - DNA, 13 bp, Homo sapiens
ccactccctgagc

SEQ ID NO: 212404 - DNA, 15 bp, Homo sapiens
ccactccctgagctt

SEQ ID NO: 212405 - DNA, 13 bp, Homo sapiens
ccactccctgcca

SEQ ID NO: 212406 - DNA, 14 bp, Homo sapiens
ccactccctgccaa

SEQ ID NO: 212407 - DNA, 16 bp, Homo sapiens
ccactccctttcccct

SEQ ID NO: 212408 - DNA, 17 bp, Homo sapiens
ccactccctttcccctc

SEQ ID NO: 212409 - DNA, 22 bp, Homo sapiens
ccactccggattccggccctgg

SEQ ID NO: 212410 - DNA, 17 bp, Homo sapiens
ccactcctcccaactct

SEQ ID NO: 212411 - DNA, 22 bp, Homo sapiens
ccactcctcccaactctggcct

SEQ ID NO: 212412 - DNA, 15 bp, Homo sapiens
ccactcctcttattt

SEQ ID NO: 212413 - DNA, 14 bp, Homo sapiens
ccactcctgtcccg

SEQ ID NO: 212414 - DNA, 20 bp, Homo sapiens
ccactcctgtcccgccttcc

SEQ ID NO: 212415 - DNA, 19 bp, Homo sapiens
ccactcctgttccttgcta

SEQ ID NO: 212416 - DNA, 13 bp, Homo sapiens
ccactccttcctg

SEQ ID NO: 212417 - DNA, 18 bp, Homo sapiens
ccactcgcagtcgcagga

SEQ ID NO: 212418 - DNA, 19 bp, Homo sapiens
ccactctaccctcccaccc

SEQ ID NO: 212419 - DNA, 21 bp, Homo sapiens
ccactctaggggtcaggctcc

SEQ ID NO: 212420 - DNA, 22 bp, Homo sapiens
ccactctaggggtcaggctcca

SEQ ID NO: 212421 - DNA, 23 bp, Homo sapiens
ccactctaggggtcaggctccat

SEQ ID NO: 212422 - DNA, 12 bp, Homo sapiens
ccactctcccca

SEQ ID NO: 212423 - DNA, 16 bp, Homo sapiens
ccactctccccacact

SEQ ID NO: 212424 - DNA, 12 bp, Homo sapiens
ccactctgctcc

SEQ ID NO: 212425 - DNA, 14 bp, Homo sapiens
ccactctgctccca

SEQ ID NO: 212426 - DNA, 15 bp, Homo sapiens
ccactctgctcccag

SEQ ID NO: 212427 - DNA, 16 bp, Homo sapiens
ccactctgctcccagc

SEQ ID NO: 212428 - DNA, 23 bp, Homo sapiens
ccactgaaaacatttcaaagctg

SEQ ID NO: 212429 - DNA, 17 bp, Homo sapiens
ccactgacagcctccca

SEQ ID NO: 212430 - DNA, 20 bp, Homo sapiens
ccactgacctggaagagctg

SEQ ID NO: 212431 - DNA, 21 bp, Homo sapiens
ccactgacctggaagagctgg

SEQ ID NO: 212432 - DNA, 15 bp, Homo sapiens
ccactgagcccttgc

SEQ ID NO: 212433 - DNA, 19 bp, Homo sapiens
atgctccagccaacccctg

SEQ ID NO: 212434 - DNA, 17 bp, Homo sapiens
atgctcccagcatttgt

SEQ ID NO: 212435 - DNA, 13 bp, Homo sapiens
atgctcctcacct

SEQ ID NO: 212436 - DNA, 20 bp, Homo sapiens
atgctcctcacctgtctagg

SEQ ID NO: 212437 - DNA, 16 bp, Homo sapiens
atgctctctatagagg

SEQ ID NO: 212438 - DNA, 23 bp, Homo sapiens
atgctctgagaagaggagccctc

SEQ ID NO: 212439 - DNA, 16 bp, Homo sapiens
atgctcttaaaggcag

SEQ ID NO: 212440 - DNA, 16 bp, Homo sapiens
atgctgaatatctgtt

SEQ ID NO: 212441 - DNA, 20 bp, Homo sapiens
atgctgactgtactcctccc

SEQ ID NO: 212442 - DNA, 21 bp, Homo sapiens
atgctgcaatacattaaaata

SEQ ID NO: 212443 - DNA, 22 bp, Homo sapiens
atgctgcacaccagttactgtt

SEQ ID NO: 212444 - DNA, 17 bp, Homo sapiens
atgctgcctaggctgac

SEQ ID NO: 212445 - DNA, 23 bp, Homo sapiens
atgctgcctagggttgcttgggc

SEQ ID NO: 212446 - DNA, 12 bp, Homo sapiens
atgctgcctcca

SEQ ID NO: 212447 - DNA, 15 bp, Homo sapiens
atgctgcctccagaa

SEQ ID NO: 212448 - DNA, 18 bp, Homo sapiens
atgctgcctgcctgtctg

SEQ ID NO: 212449 - DNA, 22 bp, Homo sapiens
atgctgccttcagggagacagg

SEQ ID NO: 212450 - DNA, 21 bp, Homo sapiens
atgctgctacttaattccttt

SEQ ID NO: 212451 - DNA, 11 bp, Homo sapiens
atgctgctgtg

SEQ ID NO: 212452 - DNA, 14 bp, Homo sapiens
atgctgctgtgaat

SEQ ID NO: 212453 - DNA, 20 bp, Homo sapiens
atgctgctttaattgtgaat

SEQ ID NO: 212454 - DNA, 22 bp, Homo sapiens
atgctgctttttggcacagttg

SEQ ID NO: 212455 - DNA, 21 bp, Homo sapiens
atgctggacaggtctgggaga

SEQ ID NO: 212456 - DNA, 23 bp, Homo sapiens
atgctggacaggtctgggagagg

SEQ ID NO: 212457 - DNA, 14 bp, Homo sapiens
atgctggagaggtt

SEQ ID NO: 212458 - DNA, 22 bp, Homo sapiens
atgctggccccaaaagccttac

SEQ ID NO: 212459 - DNA, 22 bp, Homo sapiens
atgctggcctcccaataaagct

SEQ ID NO: 212460 - DNA, 21 bp, Homo sapiens
atgctggcggcgcagagggaa

SEQ ID NO: 212461 - DNA, 12 bp, Homo sapiens
atgctgtagaat

SEQ ID NO: 212462 - DNA, 17 bp, Homo sapiens
atgctgtgctatgaatt

SEQ ID NO: 212463 - DNA, 18 bp, Homo sapiens
atgctgtgctctttgaag

SEQ ID NO: 212464 - DNA, 21 bp, Homo sapiens
atgctgttgcatttagaactt

SEQ ID NO: 212465 - DNA, 14 bp, Homo sapiens
atgctgttgtaaac

SEQ ID NO: 212466 - DNA, 13 bp, Homo sapiens
atgcttagagcat

SEQ ID NO: 212467 - DNA, 18 bp, Homo sapiens
atgcttcatgaaaatcct

SEQ ID NO: 212468 - DNA, 14 bp, Homo sapiens
atgcttctgctcac

SEQ ID NO: 212469 - DNA, 20 bp, Homo sapiens
atgcttggaatatctgctgt

SEQ ID NO: 212470 - DNA, 14 bp, Homo sapiens
ccactgtccctacc

SEQ ID NO: 212471 - DNA, 21 bp, Homo sapiens
ccactgtccctaccactgagc

SEQ ID NO: 212472 - DNA, 15 bp, Homo sapiens
ccactgtccgcctct

SEQ ID NO: 212473 - DNA, 19 bp, Homo sapiens
ccactgtcctttctccagg

SEQ ID NO: 212474 - DNA, 20 bp, Homo sapiens
ccactgtcctttctccaggc

SEQ ID NO: 212475 - DNA, 12 bp, Homo sapiens
ccactgtggcca

SEQ ID NO: 212476 - DNA, 19 bp, Homo sapiens
ccactgtggggcaagcctg

SEQ ID NO: 212477 - DNA, 19 bp, Homo sapiens
ccacttaaaaaatgtccat

SEQ ID NO: 212478 - DNA, 11 bp, Homo sapiens
ccacttaatct

SEQ ID NO: 212479 - DNA, 19 bp, Homo sapiens
ccacttagaaattgcattt

SEQ ID NO: 212480 - DNA, 15 bp, Homo sapiens
ccacttagccgtcca

SEQ ID NO: 212481 - DNA, 14 bp, Homo sapiens
ccacttagtccact

SEQ ID NO: 212482 - DNA, 14 bp, Homo sapiens
ccacttatgctgct

SEQ ID NO: 212483 - DNA, 15 bp, Homo sapiens
ccacttatgctgctg

SEQ ID NO: 212484 - DNA, 13 bp, Homo sapiens
ccacttatttcta

SEQ ID NO: 212485 - DNA, 14 bp, Homo sapiens
ccacttatttctaa

SEQ ID NO: 212486 - DNA, 24 bp, Homo sapiens
ccacttcacccccaacttcaccac

SEQ ID NO: 212487 - DNA, 21 bp, Homo sapiens
ccacttcagggttctcctctc

SEQ ID NO: 212488 - DNA, 21 bp, Homo sapiens
ccacttcattcttgaaagctg

SEQ ID NO: 212489 - DNA, 23 bp, Homo sapiens
ccacttcattcttgaaagctgtg

SEQ ID NO: 212490 - DNA, 14 bp, Homo sapiens
ccacttctggtccc

SEQ ID NO: 212491 - DNA, 15 bp, Homo sapiens
ccacttctggtcccc

SEQ ID NO: 212492 - DNA, 19 bp, Homo sapiens
ccacttcttaaaggcctgg

SEQ ID NO: 212493 - DNA, 22 bp, Homo sapiens
ccacttcttaaaggcctggaac

SEQ ID NO: 212494 - DNA, 20 bp, Homo sapiens
ccacttcttgttccccactg

SEQ ID NO: 212495 - DNA, 21 bp, Homo sapiens
ccacttgacattccttgtcac

SEQ ID NO: 212496 - DNA, 17 bp, Homo sapiens
ccacttgggtcttccct

SEQ ID NO: 212497 - DNA, 13 bp, Homo sapiens
ccactttcattca

SEQ ID NO: 212498 - DNA, 14 bp, Homo sapiens
ccactttcccttcc

SEQ ID NO: 212499 - DNA, 13 bp, Homo sapiens
ccactttcctctc

SEQ ID NO: 212500 - DNA, 14 bp, Homo sapiens
ccactttcctctct

SEQ ID NO: 212501 - DNA, 15 bp, Homo sapiens
ccactttgcagacct

SEQ ID NO: 212502 - DNA, 19 bp, Homo sapiens
ccactttgcagacctggga

SEQ ID NO: 212503 - DNA, 15 bp, Homo sapiens
ccactttgttcttta

SEQ ID NO: 212504 - DNA, 15 bp, Homo sapiens
ccactttttgcagct

SEQ ID NO: 212505 - DNA, 20 bp, Homo sapiens
ccagaaaatagggtggacag

SEQ ID NO: 212506 - DNA, 17 bp, Homo sapiens
ccagaaaatatgatata

SEQ ID NO: 212507 - DNA, 21 bp, Homo sapiens
ccagaaaatatgatatatatg

SEQ ID NO: 212508 - DNA, 15 bp, Homo sapiens
ccagaaacagtggga

SEQ ID NO: 212509 - DNA, 21 bp, Homo sapiens
ccagaaacagtgggagccctg

SEQ ID NO: 212510 - DNA, 22 bp, Homo sapiens
ccagaaactgaactggccgctg

SEQ ID NO: 212511 - DNA, 23 bp, Homo sapiens
ccagaaaggatatttaagaaaat

SEQ ID NO: 212512 - DNA, 17 bp, Homo sapiens
ccagaaattagaaacct

SEQ ID NO: 212513 - DNA, 13 bp, Homo sapiens
ccagaacgggcct

SEQ ID NO: 212514 - DNA, 16 bp, Homo sapiens
ccagaacgggcctccc

SEQ ID NO: 212515 - DNA, 16 bp, Homo sapiens
ccagaacgtctctcac

SEQ ID NO: 212516 - DNA, 19 bp, Homo sapiens
ccagaactgcccccactgt

SEQ ID NO: 212517 - DNA, 19 bp, Homo sapiens
ccagaagaatattcaggac

SEQ ID NO: 212518 - DNA, 17 bp, Homo sapiens
ccagaagatgccctcca

SEQ ID NO: 212519 - DNA, 19 bp, Homo sapiens
ccagaagcggcctgtgcgt

SEQ ID NO: 212520 - DNA, 23 bp, Homo sapiens
ccagaaggaacccggtcccaggc

SEQ ID NO: 212521 - DNA, 12 bp, Homo sapiens
ccagaaggaagc

SEQ ID NO: 212522 - DNA, 17 bp, Homo sapiens
ccagaaggagggcagag

SEQ ID NO: 212523 - DNA, 19 bp, Homo sapiens
ccagaaggagggcagagcc

SEQ ID NO: 212524 - DNA, 23 bp, Homo sapiens
ccagaaggagggcagagccatgg

SEQ ID NO: 212525 - DNA, 15 bp, Homo sapiens
ccagaaggccacagg

SEQ ID NO: 212526 - DNA, 14 bp, Homo sapiens
ccagaaggggtttg

SEQ ID NO: 212527 - DNA, 16 bp, Homo sapiens
ccagaagtgccatgct

SEQ ID NO: 212528 - DNA, 13 bp, Homo sapiens
ccagaatctgctg

SEQ ID NO: 212529 - DNA, 17 bp, Homo sapiens
ccagaatctgctgttgc

SEQ ID NO: 212530 - DNA, 19 bp, Homo sapiens
ccagaattagtcctcacag

SEQ ID NO: 212531 - DNA, 13 bp, Homo sapiens
ccagaattcacta

SEQ ID NO: 212532 - DNA, 12 bp, Homo sapiens
ccagaattgaga

SEQ ID NO: 212533 - DNA, 20 bp, Homo sapiens
ccagaattgtgcaaatggaa

SEQ ID NO: 212534 - DNA, 12 bp, Homo sapiens
ccagaatttccc

SEQ ID NO: 212535 - DNA, 14 bp, Homo sapiens
ccagacaccacaga

SEQ ID NO: 212536 - DNA, 22 bp, Homo sapiens
ccagacagacatctctgcaccc

SEQ ID NO: 212537 - DNA, 18 bp, Homo sapiens
ccagacagagtggatctg

SEQ ID NO: 212538 - DNA, 15 bp, Homo sapiens
ccagacaggccctcc

SEQ ID NO: 212539 - DNA, 20 bp, Homo sapiens
ccagacaggccctccctgtc

SEQ ID NO: 212540 - DNA, 21 bp, Homo sapiens
ccagacaggccctccctgtct

SEQ ID NO: 212541 - DNA, 14 bp, Homo sapiens
ccagacagggtggg

SEQ ID NO: 212542 - DNA, 13 bp, Homo sapiens
ccagacattgtat

SEQ ID NO: 212543 - DNA, 15 bp, Homo sapiens
ccagacattgtattt

SEQ ID NO: 212544 - DNA, 13 bp, Homo sapiens
ccagaccagagct

SEQ ID NO: 212545 - DNA, 16 bp, Homo sapiens
ccagaccagagctctg

SEQ ID NO: 212546 - DNA, 16 bp, Homo sapiens
ccagacccagggcagt

SEQ ID NO: 212547 - DNA, 16 bp, Homo sapiens
ccagaccccagggcag

SEQ ID NO: 212548 - DNA, 12 bp, Homo sapiens
ccagaccccatc

SEQ ID NO: 212549 - DNA, 15 bp, Homo sapiens
ccagaccccatccag

SEQ ID NO: 212550 - DNA, 14 bp, Homo sapiens
ccagacccccaccc

SEQ ID NO: 212551 - DNA, 21 bp, Homo sapiens
ccagacccccaccccttcccc

SEQ ID NO: 212552 - DNA, 22 bp, Homo sapiens
ccagacccccagcaaccctcct

SEQ ID NO: 212553 - DNA, 12 bp, Homo sapiens
ccagacccctct

SEQ ID NO: 212554 - DNA, 18 bp, Homo sapiens
ccagacccctctggccag

SEQ ID NO: 212555 - DNA, 21 bp, Homo sapiens
ccagacccctctggccaggat

SEQ ID NO: 212556 - DNA, 16 bp, Homo sapiens
ccagacccctggcttt

SEQ ID NO: 212557 - DNA, 12 bp, Homo sapiens
ccagaccctgcc

SEQ ID NO: 212558 - DNA, 19 bp, Homo sapiens
ccagaccctgcctgagccc

SEQ ID NO: 212559 - DNA, 18 bp, Homo sapiens
ccagaccgatccttccca

SEQ ID NO: 212560 - DNA, 13 bp, Homo sapiens
ccagacctgagct

SEQ ID NO: 212561 - DNA, 16 bp, Homo sapiens
ccagacctgggccctg

SEQ ID NO: 212562 - DNA, 18 bp, Homo sapiens
ccagacgcacgtgggtct

SEQ ID NO: 212563 - DNA, 18 bp, Homo sapiens
ccagcagctgcgggtctg

SEQ ID NO: 212564 - DNA, 15 bp, Homo sapiens
ccagcagcttggctg

SEQ ID NO: 212565 - DNA, 17 bp, Homo sapiens
ccagcagcttggctgag

SEQ ID NO: 212566 - DNA, 16 bp, Homo sapiens
ccagcagggctgtgat

SEQ ID NO: 212567 - DNA, 15 bp, Homo sapiens
ccagcaggtggggag

SEQ ID NO: 212568 - DNA, 21 bp, Homo sapiens
ccagcaggttctctcctgtga

SEQ ID NO: 212569 - DNA, 13 bp, Homo sapiens
ccagcagtgctgg

SEQ ID NO: 212570 - DNA, 14 bp, Homo sapiens
ccagcagtgctggg

SEQ ID NO: 212571 - DNA, 16 bp, Homo sapiens
ccagcagtgctgggcc

SEQ ID NO: 212572 - DNA, 23 bp, Homo sapiens
ccagcagtgctgggcccagccgg

SEQ ID NO: 212573 - DNA, 14 bp, Homo sapiens
ccagcatccagcct

SEQ ID NO: 212574 - DNA, 18 bp, Homo sapiens
ccagcatccagcctgtgt

SEQ ID NO: 212575 - DNA, 19 bp, Homo sapiens
ccagcatccagcctgtgtg

SEQ ID NO: 212576 - DNA, 14 bp, Homo sapiens
ccagcatcccaaga

SEQ ID NO: 212577 - DNA, 17 bp, Homo sapiens
ccagcatgtgtgtgtct

SEQ ID NO: 212578 - DNA, 20 bp, Homo sapiens
ccagcatgtgtgtgtctcta

SEQ ID NO: 212579 - DNA, 14 bp, Homo sapiens
ccagcattccagct

SEQ ID NO: 212580 - DNA, 15 bp, Homo sapiens
ccagcattccagctc

SEQ ID NO: 212581 - DNA, 16 bp, Homo sapiens
ccagcattccagctct

SEQ ID NO: 212582 - DNA, 17 bp, Homo sapiens
ccagcattccagctctg

SEQ ID NO: 212583 - DNA, 19 bp, Homo sapiens
ccagcattccagctctgcc

SEQ ID NO: 212584 - DNA, 23 bp, Homo sapiens
ccagcattccagctctgcccccg

SEQ ID NO: 212585 - DNA, 12 bp, Homo sapiens
ccagcatttgtc

SEQ ID NO: 212586 - DNA, 13 bp, Homo sapiens
ccagccaacccct

SEQ ID NO: 212587 - DNA, 18 bp, Homo sapiens
ccagccaacccctgtgga

SEQ ID NO: 212588 - DNA, 19 bp, Homo sapiens
ccagccaacccctgtggag

SEQ ID NO: 212589 - DNA, 13 bp, Homo sapiens
ccagccaagtgcc

SEQ ID NO: 212590 - DNA, 16 bp, Homo sapiens
ccagccaagtgccttc

SEQ ID NO: 212591 - DNA, 18 bp, Homo sapiens
ccagccaagtgccttccg

SEQ ID NO: 212592 - DNA, 17 bp, Homo sapiens
ccagccacccagccagg

SEQ ID NO: 212593 - DNA, 13 bp, Homo sapiens
ccagccaccccgg

SEQ ID NO: 212594 - DNA, 23 bp, Homo sapiens
ccagccacccggatctccaggcc

SEQ ID NO: 212595 - DNA, 22 bp, Homo sapiens
ccagccaccctaactgagctgc

SEQ ID NO: 212596 - DNA, 23 bp, Homo sapiens
ccagccaccctaactgagctgcc

SEQ ID NO: 212597 - DNA, 13 bp, Homo sapiens
ccagccaccttcc

SEQ ID NO: 212598 - DNA, 22 bp, Homo sapiens
ccagccagcaatgatgtccaga

SEQ ID NO: 212599 - DNA, 12 bp, Homo sapiens
ccagccagcagg

SEQ ID NO: 212600 - DNA, 22 bp, Homo sapiens
ccagccagtcttgcctaggcca

SEQ ID NO: 212601 - DNA, 12 bp, Homo sapiens
ccagccagtggc

SEQ ID NO: 212602 - DNA, 14 bp, Homo sapiens
ccagccagtggccg

SEQ ID NO: 212603 - DNA, 12 bp, Homo sapiens
ccagcccaaagc

SEQ ID NO: 212604 - DNA, 15 bp, Homo sapiens
ccagcccaaagctgg

SEQ ID NO: 212605 - DNA, 13 bp, Homo sapiens
ccagcccaataaa

SEQ ID NO: 212606 - DNA, 15 bp, Homo sapiens
ccagcccaccctgct

SEQ ID NO: 212607 - DNA, 12 bp, Homo sapiens
ccagcccagacc

SEQ ID NO: 212608 - DNA, 15 bp, Homo sapiens
ccagcccagcccagc

SEQ ID NO: 212609 - DNA, 16 bp, Homo sapiens
ccagcccagctgctct

SEQ ID NO: 212610 - DNA, 12 bp, Homo sapiens
ccagcccaggat

SEQ ID NO: 212611 - DNA, 18 bp, Homo sapiens
ccagcccatcttgcctcc

SEQ ID NO: 212612 - DNA, 16 bp, Homo sapiens
ccagccccacccagga

SEQ ID NO: 212613 - DNA, 18 bp, Homo sapiens
ccagccccacccaggagg

SEQ ID NO: 212614 - DNA, 17 bp, Homo sapiens
ccagccccagcgagtct

SEQ ID NO: 212615 - DNA, 23 bp, Homo sapiens
ccagccccccaccccacagatca

SEQ ID NO: 212616 - DNA, 13 bp, Homo sapiens
ccagccccctgga

SEQ ID NO: 212617 - DNA, 23 bp, Homo sapiens
ccagccccctggatgggcattgg

SEQ ID NO: 212618 - DNA, 22 bp, Homo sapiens
ccagcccctaccttgagaccct

SEQ ID NO: 212619 - DNA, 12 bp, Homo sapiens
ccagcccctgta

SEQ ID NO: 212620 - DNA, 16 bp, Homo sapiens
ccagccccttctccca

SEQ ID NO: 212621 - DNA, 21 bp, Homo sapiens
ccagccccttctcccagcaca

SEQ ID NO: 212622 - DNA, 14 bp, Homo sapiens
ccagccccttgaga

SEQ ID NO: 212623 - DNA, 14 bp, Homo sapiens
ccagcccggcctgc

SEQ ID NO: 212624 - DNA, 15 bp, Homo sapiens
ccagcccggcctgct

SEQ ID NO: 212625 - DNA, 17 bp, Homo sapiens
ccagccctaggctaccc

SEQ ID NO: 212626 - DNA, 12 bp, Homo sapiens
ccagccctccag

SEQ ID NO: 212627 - DNA, 15 bp, Homo sapiens
ccagccctccagagc

SEQ ID NO: 212628 - DNA, 16 bp, Homo sapiens
ccagccctccagagca

SEQ ID NO: 212629 - DNA, 18 bp, Homo sapiens
ccagccctccagagcagg

SEQ ID NO: 212630 - DNA, 14 bp, Homo sapiens
ccagccctcccagc

SEQ ID NO: 212631 - DNA, 17 bp, Homo sapiens
ccagccctcccagctgg

SEQ ID NO: 212632 - DNA, 21 bp, Homo sapiens
ccagccctccccgcagtggga

SEQ ID NO: 212633 - DNA, 16 bp, Homo sapiens
ccagccctccctggct

SEQ ID NO: 212634 - DNA, 18 bp, Homo sapiens
ccagccctccctggctgt

SEQ ID NO: 212635 - DNA, 20 bp, Homo sapiens
ccagccctctcactgtgtcc

SEQ ID NO: 212636 - DNA, 21 bp, Homo sapiens
ccagccctgctgcttcctaac

SEQ ID NO: 212637 - DNA, 15 bp, Homo sapiens
ccagccctggggctg

SEQ ID NO: 212638 - DNA, 13 bp, Homo sapiens
ccagccctgtcct

SEQ ID NO: 212639 - DNA, 14 bp, Homo sapiens
ccagccctgtggaa

SEQ ID NO: 212640 - DNA, 12 bp, Homo sapiens
ccagcccttccc

SEQ ID NO: 212641 - DNA, 19 bp, Homo sapiens
ccagcccttcccaggccag

SEQ ID NO: 212642 - DNA, 20 bp, Homo sapiens
ccagcccttcccaggccagc

SEQ ID NO: 212643 - DNA, 16 bp, Homo sapiens
ccagcccttccctgct

SEQ ID NO: 212644 - DNA, 17 bp, Homo sapiens
ccagcccttccctgctt

SEQ ID NO: 212645 - DNA, 16 bp, Homo sapiens
ccagcccttccctggc

SEQ ID NO: 212646 - DNA, 13 bp, Homo sapiens
ccagcccttctgc

SEQ ID NO: 212647 - DNA, 14 bp, Homo sapiens
ccagcccttctgcc

SEQ ID NO: 212648 - DNA, 18 bp, Homo sapiens
ccagccctttgcaggccc

SEQ ID NO: 212649 - DNA, 15 bp, Homo sapiens
ccagccgccccagcc

SEQ ID NO: 212650 - DNA, 16 bp, Homo sapiens
ccagccgccccagccc

SEQ ID NO: 212651 - DNA, 23 bp, Homo sapiens
ccagccggggtggggtgcctgag

SEQ ID NO: 212652 - DNA, 19 bp, Homo sapiens
ccagccgtgatgctcaggc

SEQ ID NO: 212653 - DNA, 21 bp, Homo sapiens
ccagccgtgatgctcaggctt

SEQ ID NO: 212654 - DNA, 14 bp, Homo sapiens
ccagcctcaccctt

SEQ ID NO: 212655 - DNA, 15 bp, Homo sapiens
ccagcctccatgctg

SEQ ID NO: 212656 - DNA, 13 bp, Homo sapiens
ccagcctccccca

SEQ ID NO: 212657 - DNA, 17 bp, Homo sapiens
ccagcctcccctcccct

SEQ ID NO: 212658 - DNA, 21 bp, Homo sapiens
ccagcctcccctcccctgggg

SEQ ID NO: 212659 - DNA, 20 bp, Homo sapiens
ccagcctcctgtttgcaggc

SEQ ID NO: 212660 - DNA, 16 bp, Homo sapiens
ccagcctctcccggct

SEQ ID NO: 212661 - DNA, 23 bp, Homo sapiens
ccagcctctcccggctgcctgcc

SEQ ID NO: 212662 - DNA, 17 bp, Homo sapiens
ccagcctgacctgagac

SEQ ID NO: 212663 - DNA, 19 bp, Homo sapiens
ccagcctgagatgtaggct

SEQ ID NO: 212664 - DNA, 12 bp, Homo sapiens
ccagcctgagcc

SEQ ID NO: 212665 - DNA, 13 bp, Homo sapiens
ccagcctgagcca

SEQ ID NO: 212666 - DNA, 15 bp, Homo sapiens
ccagcctgagccaca

SEQ ID NO: 212667 - DNA, 16 bp, Homo sapiens
ccagcctgagccacag

SEQ ID NO: 212668 - DNA, 19 bp, Homo sapiens
ccagcctgagccacagtgg

SEQ ID NO: 212669 - DNA, 20 bp, Homo sapiens
ccagcctgctgagagccccc

SEQ ID NO: 212670 - DNA, 21 bp, Homo sapiens
ccagcctgctgagagccccca

SEQ ID NO: 212671 - DNA, 23 bp, Homo sapiens
ccagcctggccacgcagccagga

SEQ ID NO: 212672 - DNA, 12 bp, Homo sapiens
ccagcctggccc

SEQ ID NO: 212673 - DNA, 13 bp, Homo sapiens
ccagcctggcccc

SEQ ID NO: 212674 - DNA, 19 bp, Homo sapiens
ccagcctgggtgacagagc

SEQ ID NO: 212675 - DNA, 16 bp, Homo sapiens
ccagcctgtcctggta

SEQ ID NO: 212676 - DNA, 21 bp, Homo sapiens
ccagcctgtggttacagtgca

SEQ ID NO: 212677 - DNA, 13 bp, Homo sapiens
ccagcctgtgtgt

SEQ ID NO: 212678 - DNA, 15 bp, Homo sapiens
ccagcctgtgtgttc

SEQ ID NO: 212679 - DNA, 16 bp, Homo sapiens
ccagccttcctctgca

SEQ ID NO: 212680 - DNA, 21 bp, Homo sapiens
ccagccttcctctgcagctga

SEQ ID NO: 212681 - DNA, 10 bp, Homo sapiens
ccagcctttc

SEQ ID NO: 212682 - DNA, 12 bp, Homo sapiens
ccagcctttctt

SEQ ID NO: 212683 - DNA, 22 bp, Homo sapiens
ccagcgagtaccccagccactc

SEQ ID NO: 212684 - DNA, 15 bp, Homo sapiens
ccagcgagtggtcaa

SEQ ID NO: 212685 - DNA, 22 bp, Homo sapiens
ccagcgcccgctgggctgagcc

SEQ ID NO: 212686 - DNA, 15 bp, Homo sapiens
ccagcgcctgtgctg

SEQ ID NO: 212687 - DNA, 13 bp, Homo sapiens
ccagcgggccctc

SEQ ID NO: 212688 - DNA, 16 bp, Homo sapiens
ccagcgggccctctgc

SEQ ID NO: 212689 - DNA, 15 bp, Homo sapiens
ccagcgtcccagtct

SEQ ID NO: 212690 - DNA, 23 bp, Homo sapiens
ccagcgtctgcgcggatgtagca

SEQ ID NO: 212691 - DNA, 17 bp, Homo sapiens
ccagcgtttgaggggct

SEQ ID NO: 212692 - DNA, 23 bp, Homo sapiens
ccagctaatctgtagggctggac

SEQ ID NO: 212693 - DNA, 21 bp, Homo sapiens
ccagctacatgggaggctgag

SEQ ID NO: 212694 - DNA, 14 bp, Homo sapiens
ccagctacattcct

SEQ ID NO: 212695 - DNA, 15 bp, Homo sapiens
ccagctacattcctc

SEQ ID NO: 212696 - DNA, 19 bp, Homo sapiens
ccagctacattcctcagct

SEQ ID NO: 212697 - DNA, 18 bp, Homo sapiens
ccagctaccccttctttg

SEQ ID NO: 212698 - DNA, 20 bp, Homo sapiens
ccagctaccccttctttgca

SEQ ID NO: 212699 - DNA, 23 bp, Homo sapiens
ccagctactctgtccaggccact

SEQ ID NO: 212700 - DNA, 22 bp, Homo sapiens
ccagctacttgggagcctgagg

SEQ ID NO: 212701 - DNA, 12 bp, Homo sapiens
ccagctcagccc

SEQ ID NO: 212702 - DNA, 13 bp, Homo sapiens
ccagctcagcccc

SEQ ID NO: 212703 - DNA, 18 bp, Homo sapiens
ccagctcagccccggcca

SEQ ID NO: 212704 - DNA, 19 bp, Homo sapiens
ccagctcagccccggccac

SEQ ID NO: 212705 - DNA, 15 bp, Homo sapiens
ccagctccacagggt

SEQ ID NO: 212706 - DNA, 18 bp, Homo sapiens
ccagctccactggcctgc

SEQ ID NO: 212707 - DNA, 15 bp, Homo sapiens
ccagctccaggggcc

SEQ ID NO: 212708 - DNA, 14 bp, Homo sapiens
ccagctccccaaga

SEQ ID NO: 212709 - DNA, 23 bp, Homo sapiens
ccagctccccaagaaagcctcag

SEQ ID NO: 212710 - DNA, 23 bp, Homo sapiens
ccagctcccccttgcccgccagc

SEQ ID NO: 212711 - DNA, 15 bp, Homo sapiens
ccagctccctagact

SEQ ID NO: 212712 - DNA, 17 bp, Homo sapiens
ccagctccctagactgc

SEQ ID NO: 212713 - DNA, 17 bp, Homo sapiens
ccagctccttaaactga

SEQ ID NO: 212714 - DNA, 20 bp, Homo sapiens
ccagctccttttgtccccag

SEQ ID NO: 212715 - DNA, 20 bp, Homo sapiens
ccagctcgtttttcagcacc

SEQ ID NO: 212716 - DNA, 18 bp, Homo sapiens
ccagctctagacaaccct

SEQ ID NO: 212717 - DNA, 12 bp, Homo sapiens
ccagctctccca

SEQ ID NO: 212718 - DNA, 14 bp, Homo sapiens
ccagctctcccctg

SEQ ID NO: 212719 - DNA, 13 bp, Homo sapiens
ccagctctgcccc

SEQ ID NO: 212720 - DNA, 14 bp, Homo sapiens
ccagctctgccccc

SEQ ID NO: 212721 - DNA, 12 bp, Homo sapiens
ccagctctgtgg

SEQ ID NO: 212722 - DNA, 14 bp, Homo sapiens
ccagctctgtggcc

SEQ ID NO: 212723 - DNA, 15 bp, Homo sapiens
ccagctctgtggcct

SEQ ID NO: 212724 - DNA, 17 bp, Homo sapiens
ccagctctttcctcctt

SEQ ID NO: 212725 - DNA, 15 bp, Homo sapiens
ccagctgactgtggc

SEQ ID NO: 212726 - DNA, 16 bp, Homo sapiens
ccagctgactgtggcc

SEQ ID NO: 212727 - DNA, 15 bp, Homo sapiens
ccagctgccaagtgc

SEQ ID NO: 212728 - DNA, 18 bp, Homo sapiens
ccagctgccaagtgctct

SEQ ID NO: 212729 - DNA, 19 bp, Homo sapiens
ccagctgccaagtgctctt

SEQ ID NO: 212730 - DNA, 19 bp, Homo sapiens
ccagctgctctgcccagag

SEQ ID NO: 212731 - DNA, 16 bp, Homo sapiens
ccagctgctctgcccc

SEQ ID NO: 212732 - DNA, 12 bp, Homo sapiens
ccagctggcagc

SEQ ID NO: 212733 - DNA, 17 bp, Homo sapiens
ccagctggcagcgcctc

SEQ ID NO: 212734 - DNA, 20 bp, Homo sapiens
ccagctggctgggtcgcccc

SEQ ID NO: 212735 - DNA, 12 bp, Homo sapiens
ccagctgggctc

SEQ ID NO: 212736 - DNA, 21 bp, Homo sapiens
ccagctgggctctgccaccct

SEQ ID NO: 212737 - DNA, 20 bp, Homo sapiens
ccagctggtgtcactctgcc

SEQ ID NO: 212738 - DNA, 20 bp, Homo sapiens
ccagctgtgactgagggcct

SEQ ID NO: 212739 - DNA, 23 bp, Homo sapiens
ccagctgtgggtacagagaggtc

SEQ ID NO: 212740 - DNA, 13 bp, Homo sapiens
ccagctgtggttt

SEQ ID NO: 212741 - DNA, 14 bp, Homo sapiens
ccagctgtggtttt

SEQ ID NO: 212742 - DNA, 23 bp, Homo sapiens
ccagctgtggttttcttttgcca

SEQ ID NO: 212743 - DNA, 22 bp, Homo sapiens
ccagcttctggtactctcctag

SEQ ID NO: 212744 - DNA, 17 bp, Homo sapiens
atgcttgtaacaagaaa

SEQ ID NO: 212745 - DNA, 21 bp, Homo sapiens
atgcttgtaacaagaaaacat

SEQ ID NO: 212746 - DNA, 17 bp, Homo sapiens
atgcttgtttatgatat

SEQ ID NO: 212747 - DNA, 14 bp, Homo sapiens
atgctttgctgcta

SEQ ID NO: 212748 - DNA, 16 bp, Homo sapiens
atgctttgggaggcca

SEQ ID NO: 212749 - DNA, 16 bp, Homo sapiens
atgctttgtgtgattg

SEQ ID NO: 212750 - DNA, 21 bp, Homo sapiens
atgcttttctagcaactgttg

SEQ ID NO: 212751 - DNA, 14 bp, Homo sapiens
atgcttttctcatg

SEQ ID NO: 212752 - DNA, 16 bp, Homo sapiens
atgcttttctcatggt

SEQ ID NO: 212753 - DNA, 16 bp, Homo sapiens
atggaaaaaaaaaaca

SEQ ID NO: 212754 - DNA, 15 bp, Homo sapiens
atggaaaacttagtt

SEQ ID NO: 212755 - DNA, 16 bp, Homo sapiens
atggaaaacttagttt

SEQ ID NO: 212756 - DNA, 21 bp, Homo sapiens
atggaaaagtcttcaagggct

SEQ ID NO: 212757 - DNA, 20 bp, Homo sapiens
atggaaactgttgccagaga

SEQ ID NO: 212758 - DNA, 18 bp, Homo sapiens
atggaaagaaaagaatgt

SEQ ID NO: 212759 - DNA, 17 bp, Homo sapiens
atggaaagaatctaata

SEQ ID NO: 212760 - DNA, 14 bp, Homo sapiens
atggaaaggaagaa

SEQ ID NO: 212761 - DNA, 17 bp, Homo sapiens
atggaaaggtcctgtgg

SEQ ID NO: 212762 - DNA, 14 bp, Homo sapiens
atggaacacacaca

SEQ ID NO: 212763 - DNA, 23 bp, Homo sapiens
atggaacccttttggcccccgag

SEQ ID NO: 212764 - DNA, 14 bp, Homo sapiens
atggaactgacccc

SEQ ID NO: 212765 - DNA, 15 bp, Homo sapiens
atggaaggagagagg

SEQ ID NO: 212766 - DNA, 10 bp, Homo sapiens
atggaagtgt

SEQ ID NO: 212767 - DNA, 12 bp, Homo sapiens
atggaatttgta

SEQ ID NO: 212768 - DNA, 19 bp, Homo sapiens
atggacatcgatatgaaaa

SEQ ID NO: 212769 - DNA, 14 bp, Homo sapiens
atggacccctccct

SEQ ID NO: 212770 - DNA, 19 bp, Homo sapiens
atggacgtgttatgactcc

SEQ ID NO: 212771 - DNA, 20 bp, Homo sapiens
atggacgtgttatgactcca

SEQ ID NO: 212772 - DNA, 16 bp, Homo sapiens
atggactctacactgt

SEQ ID NO: 212773 - DNA, 18 bp, Homo sapiens
atggactctgggtttcat

SEQ ID NO: 212774 - DNA, 13 bp, Homo sapiens
atggactgcacaa

SEQ ID NO: 212775 - DNA, 17 bp, Homo sapiens
atggactgcacaaaagt

SEQ ID NO: 212776 - DNA, 12 bp, Homo sapiens
atggacttgctt

SEQ ID NO: 212777 - DNA, 20 bp, Homo sapiens
atggacttttgttcatggga

SEQ ID NO: 212778 - DNA, 21 bp, Homo sapiens
atggacttttgttcatgggag

SEQ ID NO: 212779 - DNA, 15 bp, Homo sapiens
atggagaaggaaaag

SEQ ID NO: 212780 - DNA, 19 bp, Homo sapiens
atggagaaggaaaaggctg

SEQ ID NO: 212781 - DNA, 17 bp, Homo sapiens
atggagaatgccagccc

SEQ ID NO: 212782 - DNA, 15 bp, Homo sapiens
atggagcccccagat

SEQ ID NO: 212783 - DNA, 15 bp, Homo sapiens
atggagcctctgcag

SEQ ID NO: 212784 - DNA, 23 bp, Homo sapiens
atggagctgtataactgtgcaga

SEQ ID NO: 212785 - DNA, 14 bp, Homo sapiens
atggagcttgtaca

SEQ ID NO: 212786 - DNA, 15 bp, Homo sapiens
atggagcttgtacat

SEQ ID NO: 212787 - DNA, 22 bp, Homo sapiens
atggaggaaaaccaagccgtgg

SEQ ID NO: 212788 - DNA, 17 bp, Homo sapiens
atggaggagagtgttta

SEQ ID NO: 212789 - DNA, 14 bp, Homo sapiens
atggaggaggaggc

SEQ ID NO: 212790 - DNA, 19 bp, Homo sapiens
atggaggattctttcccca

SEQ ID NO: 212791 - DNA, 20 bp, Homo sapiens
atggaggattctttccccag

SEQ ID NO: 212792 - DNA, 21 bp, Homo sapiens
atggaggattctttccccaga

SEQ ID NO: 212793 - DNA, 22 bp, Homo sapiens
atggaggattctttccccagag

SEQ ID NO: 212794 - DNA, 19 bp, Homo sapiens
atggaggcacacagctgca

SEQ ID NO: 212795 - DNA, 12 bp, Homo sapiens
atggaggccaag

SEQ ID NO: 212796 - DNA, 16 bp, Homo sapiens
atggaggccaagcctg

SEQ ID NO: 212797 - DNA, 12 bp, Homo sapiens
atggagtacatg

SEQ ID NO: 212798 - DNA, 18 bp, Homo sapiens
atggagtagacccctggc

SEQ ID NO: 212799 - DNA, 22 bp, Homo sapiens
atggagtccagacctgggccct

SEQ ID NO: 212800 - DNA, 18 bp, Homo sapiens
atggagtgtgtattgttc

SEQ ID NO: 212801 - DNA, 21 bp, Homo sapiens
atggagtgtgtattgttccca

SEQ ID NO: 212802 - DNA, 14 bp, Homo sapiens
atggataatcttcg

SEQ ID NO: 212803 - DNA, 19 bp, Homo sapiens
atggatatgtgtaaatgtt

SEQ ID NO: 212804 - DNA, 17 bp, Homo sapiens
atggatccccagtgaaa

SEQ ID NO: 212805 - DNA, 17 bp, Homo sapiens
atggatgacaaagaaaa

SEQ ID NO: 212806 - DNA, 20 bp, Homo sapiens
atggatgattcttttcccat

SEQ ID NO: 212807 - DNA, 21 bp, Homo sapiens
atggatggggcccaggggctt

SEQ ID NO: 212808 - DNA, 23 bp, Homo sapiens
atggatgggggttacctagccct

SEQ ID NO: 212809 - DNA, 12 bp, Homo sapiens
atggatgtagat

SEQ ID NO: 212810 - DNA, 15 bp, Homo sapiens
atggattaaatggca

SEQ ID NO: 212811 - DNA, 21 bp, Homo sapiens
atggattaaatggcacctgta

SEQ ID NO: 212812 - DNA, 22 bp, Homo sapiens
atggattaaatggcacctgtat

SEQ ID NO: 212813 - DNA, 14 bp, Homo sapiens
atggattcacttct

SEQ ID NO: 212814 - DNA, 18 bp, Homo sapiens
atggattcacttctattt

SEQ ID NO: 212815 - DNA, 22 bp, Homo sapiens
atggatttggttatgatggaaa

SEQ ID NO: 212816 - DNA, 18 bp, Homo sapiens
atggattttctattgtta

SEQ ID NO: 212817 - DNA, 21 bp, Homo sapiens
atggattttctattgttactc

SEQ ID NO: 212818 - DNA, 13 bp, Homo sapiens
atggatttttaaa

SEQ ID NO: 212819 - DNA, 14 bp, Homo sapiens
atggcaaaaatggc

SEQ ID NO: 212820 - DNA, 17 bp, Homo sapiens
atggcaagtttttggta

SEQ ID NO: 212821 - DNA, 23 bp, Homo sapiens
atggcaattctttgacctcaacc

SEQ ID NO: 212822 - DNA, 14 bp, Homo sapiens
atggcaccagcccc

SEQ ID NO: 212823 - DNA, 13 bp, Homo sapiens
atggcacctgtat

SEQ ID NO: 212824 - DNA, 16 bp, Homo sapiens
atggcacctgtggcca

SEQ ID NO: 212825 - DNA, 22 bp, Homo sapiens
atggtctcctctgattatcagg

SEQ ID NO: 212826 - DNA, 17 bp, Homo sapiens
atggtcttgatctcctg

SEQ ID NO: 212827 - DNA, 14 bp, Homo sapiens
atggtgaaaatgta

SEQ ID NO: 212828 - DNA, 20 bp, Homo sapiens
atggtgaaaccccgtctcta

SEQ ID NO: 212829 - DNA, 16 bp, Homo sapiens
atggtgagctgggaag

SEQ ID NO: 212830 - DNA, 14 bp, Homo sapiens
atggtgagggctga

SEQ ID NO: 212831 - DNA, 18 bp, Homo sapiens
atggtgagggctgagagg

SEQ ID NO: 212832 - DNA, 16 bp, Homo sapiens
atggtgatcctctatt

SEQ ID NO: 212833 - DNA, 23 bp, Homo sapiens
atggtgatcctctattttgtgat

SEQ ID NO: 212834 - DNA, 18 bp, Homo sapiens
atggtgatgcaagtcact

SEQ ID NO: 212835 - DNA, 15 bp, Homo sapiens
atggtgatttcttgc

SEQ ID NO: 212836 - DNA, 22 bp, Homo sapiens
atggtgcagaaaaaaaaaaaga

SEQ ID NO: 212837 - DNA, 13 bp, Homo sapiens
atggtgcagtgaa

SEQ ID NO: 212838 - DNA, 16 bp, Homo sapiens
atggtgccccctgggg

SEQ ID NO: 212839 - DNA, 13 bp, Homo sapiens
atggtgcccttgg

SEQ ID NO: 212840 - DNA, 13 bp, Homo sapiens
atggtgcctctgg

SEQ ID NO: 212841 - DNA, 13 bp, Homo sapiens
atggtgctgagaa

SEQ ID NO: 212842 - DNA, 14 bp, Homo sapiens
atggtgctgagaag

SEQ ID NO: 212843 - DNA, 13 bp, Homo sapiens
atggtggaagagg

SEQ ID NO: 212844 - DNA, 20 bp, Homo sapiens
atggtggaagaggttctcag

SEQ ID NO: 212845 - DNA, 21 bp, Homo sapiens
atggtggaagaggttctcagc

SEQ ID NO: 212846 - DNA, 22 bp, Homo sapiens
atggtggaagaggttctcagca

SEQ ID NO: 212847 - DNA, 21 bp, Homo sapiens
atggtggcgctttctcctgtg

SEQ ID NO: 212848 - DNA, 23 bp, Homo sapiens
atggtggcgctttctcctgtgcc

SEQ ID NO: 212849 - DNA, 20 bp, Homo sapiens
atggtgggctccagagtagg

SEQ ID NO: 212850 - DNA, 16 bp, Homo sapiens
atggtgtagctgtcct

SEQ ID NO: 212851 - DNA, 17 bp, Homo sapiens
atggtgtagctgtcctc

SEQ ID NO: 212852 - DNA, 17 bp, Homo sapiens
atggtgtgccacaggct

SEQ ID NO: 212853 - DNA, 16 bp, Homo sapiens
atggttaataaaactg

SEQ ID NO: 212854 - DNA, 18 bp, Homo sapiens
atggttaataaaactgca

SEQ ID NO: 212855 - DNA, 16 bp, Homo sapiens
atggttccatgcctga

SEQ ID NO: 212856 - DNA, 18 bp, Homo sapiens
atggttcccaataaaagt

SEQ ID NO: 212857 - DNA, 19 bp, Homo sapiens
atggttcccctgttcactc

SEQ ID NO: 212858 - DNA, 19 bp, Homo sapiens
atggttccttccctgggaa

SEQ ID NO: 212859 - DNA, 16 bp, Homo sapiens
atggttgagaaatgaa

SEQ ID NO: 212860 - DNA, 15 bp, Homo sapiens
atggttgggacaatg

SEQ ID NO: 212861 - DNA, 14 bp, Homo sapiens
atggtttactgctg

SEQ ID NO: 212862 - DNA, 15 bp, Homo sapiens
atggtttactgctgt

SEQ ID NO: 212863 - DNA, 18 bp, Homo sapiens
atggtttactgctgtcat

SEQ ID NO: 212864 - DNA, 15 bp, Homo sapiens
atggtttgtcctgat

SEQ ID NO: 212865 - DNA, 19 bp, Homo sapiens
atgtaaaaaagaaaaacac

SEQ ID NO: 212866 - DNA, 20 bp, Homo sapiens
atgtaaaaatatatatgtat

SEQ ID NO: 212867 - DNA, 17 bp, Homo sapiens
atgtaaaatcttcagct

SEQ ID NO: 212868 - DNA, 24 bp, Homo sapiens
atgtaaaatcttcagctggtggat

SEQ ID NO: 212869 - DNA, 23 bp, Homo sapiens
atgtaaaatcttgtcatgtgtat

SEQ ID NO: 212870 - DNA, 13 bp, Homo sapiens
atgtaaacattca

SEQ ID NO: 212871 - DNA, 21 bp, Homo sapiens
atgtaaacattcatatttgca

SEQ ID NO: 212872 - DNA, 13 bp, Homo sapiens
atgtaaagacaaa

SEQ ID NO: 212873 - DNA, 17 bp, Homo sapiens
atgtaaagtatgtaaac

SEQ ID NO: 212874 - DNA, 22 bp, Homo sapiens
atgtaaagttgttaagagacat

SEQ ID NO: 212875 - DNA, 12 bp, Homo sapiens
atgtaaatattc

SEQ ID NO: 212876 - DNA, 15 bp, Homo sapiens
atgtaaatattctat

SEQ ID NO: 212877 - DNA, 16 bp, Homo sapiens
atgtaaattattgtaa

SEQ ID NO: 212878 - DNA, 14 bp, Homo sapiens
atgtaaatttgtac

SEQ ID NO: 212879 - DNA, 17 bp, Homo sapiens
atgtaaatttgtactat

SEQ ID NO: 212880 - DNA, 18 bp, Homo sapiens
atgtaacagttggtgatt

SEQ ID NO: 212881 - DNA, 15 bp, Homo sapiens
atgtaaccaagctgt

SEQ ID NO: 212882 - DNA, 21 bp, Homo sapiens
atgtaagaaaacaaaatctaa

SEQ ID NO: 212883 - DNA, 14 bp, Homo sapiens
atgtaagaaataag

SEQ ID NO: 212884 - DNA, 17 bp, Homo sapiens
atgtaagtaaatgtctg

SEQ ID NO: 212885 - DNA, 17 bp, Homo sapiens
atgtaataactgtgaag

SEQ ID NO: 212886 - DNA, 18 bp, Homo sapiens
ccaggccgccccagcctc

SEQ ID NO: 212887 - DNA, 15 bp, Homo sapiens
ccaggccgtcctccc

SEQ ID NO: 212888 - DNA, 22 bp, Homo sapiens
ccaggccgtcctcccgggccct

SEQ ID NO: 212889 - DNA, 20 bp, Homo sapiens
ccaggccgttccccttggct

SEQ ID NO: 212890 - DNA, 16 bp, Homo sapiens
ccaggcctccagcctc

SEQ ID NO: 212891 - DNA, 19 bp, Homo sapiens
ccaggcctccagcctctcc

SEQ ID NO: 212892 - DNA, 13 bp, Homo sapiens
ccaggcctcccgc

SEQ ID NO: 212893 - DNA, 14 bp, Homo sapiens
ccaggcctcccgca

SEQ ID NO: 212894 - DNA, 16 bp, Homo sapiens
ccaggcctgaggctgc

SEQ ID NO: 212895 - DNA, 17 bp, Homo sapiens
ccaggcctgaggctgct

SEQ ID NO: 212896 - DNA, 13 bp, Homo sapiens
ccaggcctggagc

SEQ ID NO: 212897 - DNA, 14 bp, Homo sapiens
ccaggcctggagcg

SEQ ID NO: 212898 - DNA, 19 bp, Homo sapiens
ccaggcctgggtctgtgtc

SEQ ID NO: 212899 - DNA, 15 bp, Homo sapiens
ccaggcggaggggct

SEQ ID NO: 212900 - DNA, 15 bp, Homo sapiens
ccaggcgggcggcac

SEQ ID NO: 212901 - DNA, 15 bp, Homo sapiens
ccaggcgtagggcca

SEQ ID NO: 212902 - DNA, 18 bp, Homo sapiens
ccaggcgtagggccaggg

SEQ ID NO: 212903 - DNA, 19 bp, Homo sapiens
ccaggcgtagggccagggc

SEQ ID NO: 212904 - DNA, 19 bp, Homo sapiens
ccaggctagtccggaccca

SEQ ID NO: 212905 - DNA, 12 bp, Homo sapiens
ccaggctccagg

SEQ ID NO: 212906 - DNA, 17 bp, Homo sapiens
ccaggctccaggctgac

SEQ ID NO: 212907 - DNA, 15 bp, Homo sapiens
ccaggctctccctct

SEQ ID NO: 212908 - DNA, 19 bp, Homo sapiens
ccaggctctccctctctgc

SEQ ID NO: 212909 - DNA, 12 bp, Homo sapiens
ccaggctcttcc

SEQ ID NO: 212910 - DNA, 22 bp, Homo sapiens
ccaggctcttcctggacctgag

SEQ ID NO: 212911 - DNA, 23 bp, Homo sapiens
ccaggctcttcctggacctgagt

SEQ ID NO: 212912 - DNA, 23 bp, Homo sapiens
ccaggctgactgggggcctctgc

SEQ ID NO: 212913 - DNA, 16 bp, Homo sapiens
ccaggctgcactgcag

SEQ ID NO: 212914 - DNA, 19 bp, Homo sapiens
ccaggctgcactgcagtga

SEQ ID NO: 212915 - DNA, 13 bp, Homo sapiens
ccaggctgccaag

SEQ ID NO: 212916 - DNA, 17 bp, Homo sapiens
ccaggctgcgcctgccc

SEQ ID NO: 212917 - DNA, 24 bp, Homo sapiens
ccaggctgcggtgggcagccatga

SEQ ID NO: 212918 - DNA, 14 bp, Homo sapiens
ccaggctgctggac

SEQ ID NO: 212919 - DNA, 16 bp, Homo sapiens
ccaggctggagtgcag

SEQ ID NO: 212920 - DNA, 18 bp, Homo sapiens
ccaggctggagtgcagtg

SEQ ID NO: 212921 - DNA, 14 bp, Homo sapiens
ccaggctggggcct

SEQ ID NO: 212922 - DNA, 20 bp, Homo sapiens
ccaggctggtctcaaacttc

SEQ ID NO: 212923 - DNA, 21 bp, Homo sapiens
ccaggctggttcttgggctag

SEQ ID NO: 212924 - DNA, 17 bp, Homo sapiens
ccagggaagctggccga

SEQ ID NO: 212925 - DNA, 17 bp, Homo sapiens
ccagggaagctgtccct

SEQ ID NO: 212926 - DNA, 17 bp, Homo sapiens
ccagggagaggccatga

SEQ ID NO: 212927 - DNA, 18 bp, Homo sapiens
ccagggagcccggggcag

SEQ ID NO: 212928 - DNA, 20 bp, Homo sapiens
ccagggagcccggggcagag

SEQ ID NO: 212929 - DNA, 19 bp, Homo sapiens
ccagggatggggccacagc

SEQ ID NO: 212930 - DNA, 22 bp, Homo sapiens
ccagggcaccaagcccacaggt

SEQ ID NO: 212931 - DNA, 15 bp, Homo sapiens
ccagggcagcagccg

SEQ ID NO: 212932 - DNA, 21 bp, Homo sapiens
ccagggcagggtgggcagcct

SEQ ID NO: 212933 - DNA, 22 bp, Homo sapiens
ccagggcagtgctagtgagctg

SEQ ID NO: 212934 - DNA, 18 bp, Homo sapiens
ccagggccatgaactttg

SEQ ID NO: 212935 - DNA, 16 bp, Homo sapiens
ccagggcccccaccga

SEQ ID NO: 212936 - DNA, 22 bp, Homo sapiens
ccagggcccctcaccctgcctt

SEQ ID NO: 212937 - DNA, 19 bp, Homo sapiens
ccagggcccctccctctgc

SEQ ID NO: 212938 - DNA, 23 bp, Homo sapiens
ccagggcccctccctctgcccca

SEQ ID NO: 212939 - DNA, 23 bp, Homo sapiens
ccagggcccgagcgcgtgccttc

SEQ ID NO: 212940 - DNA, 12 bp, Homo sapiens
ccagggccctgc

SEQ ID NO: 212941 - DNA, 17 bp, Homo sapiens
ccagggccctgctcagg

SEQ ID NO: 212942 - DNA, 13 bp, Homo sapiens
ccagggcctgggg

SEQ ID NO: 212943 - DNA, 13 bp, Homo sapiens
ccagggctcagct

SEQ ID NO: 212944 - DNA, 16 bp, Homo sapiens
ccagggctcagctcct

SEQ ID NO: 212945 - DNA, 18 bp, Homo sapiens
ccagggctccctcctgga

SEQ ID NO: 212946 - DNA, 14 bp, Homo sapiens
ccagggctctggca

SEQ ID NO: 212947 - DNA, 15 bp, Homo sapiens
ccagggctctggcag

SEQ ID NO: 212948 - DNA, 16 bp, Homo sapiens
ccagggctgcccctgt

SEQ ID NO: 212949 - DNA, 14 bp, Homo sapiens
ccagggctgtcctt

SEQ ID NO: 212950 - DNA, 17 bp, Homo sapiens
ccagggctgtccttaga

SEQ ID NO: 212951 - DNA, 20 bp, Homo sapiens
ccagggcttacctgtacact

SEQ ID NO: 212952 - DNA, 22 bp, Homo sapiens
ccaggggcatgtattggcctgg

SEQ ID NO: 212953 - DNA, 22 bp, Homo sapiens
ccaggggctttggtggcccctc

SEQ ID NO: 212954 - DNA, 20 bp, Homo sapiens
ccagggggcctgcaggcccc

SEQ ID NO: 212955 - DNA, 17 bp, Homo sapiens
ccaggggtcccagccac

SEQ ID NO: 212956 - DNA, 18 bp, Homo sapiens
ccaggggtctccctgagc

SEQ ID NO: 212957 - DNA, 19 bp, Homo sapiens
ccagggtagacttggagct

SEQ ID NO: 212958 - DNA, 14 bp, Homo sapiens
ccagggtccgcacc

SEQ ID NO: 212959 - DNA, 19 bp, Homo sapiens
ccagggtccgcaccagctg

SEQ ID NO: 212960 - DNA, 21 bp, Homo sapiens
ccagggtccgcaccagctgct

SEQ ID NO: 212961 - DNA, 22 bp, Homo sapiens
ccagggtccgcaccagctgctc

SEQ ID NO: 212962 - DNA, 20 bp, Homo sapiens
ccagggtctcgtcaggaggt

SEQ ID NO: 212963 - DNA, 19 bp, Homo sapiens
ccagggtcttgggctactg

SEQ ID NO: 212964 - DNA, 13 bp, Homo sapiens
ccagggtctttac

SEQ ID NO: 212965 - DNA, 17 bp, Homo sapiens
ccagggtgagcagggcc

SEQ ID NO: 212966 - DNA, 18 bp, Homo sapiens
ccagggtgagcagggccc

SEQ ID NO: 212967 - DNA, 20 bp, Homo sapiens
ccagggttaaagaaaggcag

SEQ ID NO: 212968 - DNA, 14 bp, Homo sapiens
ccagggttccccca

SEQ ID NO: 212969 - DNA, 20 bp, Homo sapiens
ccagggttcccccagccctg

SEQ ID NO: 212970 - DNA, 21 bp, Homo sapiens
ccagggttcccccagccctgt

SEQ ID NO: 212971 - DNA, 22 bp, Homo sapiens
ccagggttcccccagccctgtg

SEQ ID NO: 212972 - DNA, 15 bp, Homo sapiens
ccagggttctgtatt

SEQ ID NO: 212973 - DNA, 16 bp, Homo sapiens
ccagggttctgtattg

SEQ ID NO: 212974 - DNA, 19 bp, Homo sapiens
ccaggtaccacccttcaga

SEQ ID NO: 212975 - DNA, 20 bp, Homo sapiens
ccaggtaccacccttcagac

SEQ ID NO: 212976 - DNA, 22 bp, Homo sapiens
ccaggtaccacccttcagaccc

SEQ ID NO: 212977 - DNA, 20 bp, Homo sapiens
ccaggtcaccctttgctgtg

SEQ ID NO: 212978 - DNA, 14 bp, Homo sapiens
ccaggtcccagtgc

SEQ ID NO: 212979 - DNA, 17 bp, Homo sapiens
ccaggtccctggaccag

SEQ ID NO: 212980 - DNA, 14 bp, Homo sapiens
ccaggtcctttcct

SEQ ID NO: 212981 - DNA, 18 bp, Homo sapiens
ccaggtcctttctcctga

SEQ ID NO: 212982 - DNA, 20 bp, Homo sapiens
ccaggtcctttctcctgata

SEQ ID NO: 212983 - DNA, 15 bp, Homo sapiens
ccaggtctcactgct

SEQ ID NO: 212984 - DNA, 18 bp, Homo sapiens
ccaggtctcactgctttg

SEQ ID NO: 212985 - DNA, 21 bp, Homo sapiens
ccaggtgaacgctcagcgctg

SEQ ID NO: 212986 - DNA, 14 bp, Homo sapiens
ccaggtgagtgtga

SEQ ID NO: 212987 - DNA, 19 bp, Homo sapiens
ccaggtgagtgtgagggca

SEQ ID NO: 212988 - DNA, 20 bp, Homo sapiens
ccaggtgagtgtgagggcag

SEQ ID NO: 212989 - DNA, 16 bp, Homo sapiens
ccaggtgcacagacgt

SEQ ID NO: 212990 - DNA, 16 bp, Homo sapiens
ccaggtgccaccaata

SEQ ID NO: 212991 - DNA, 18 bp, Homo sapiens
ccaggtgccaccaataaa

SEQ ID NO: 212992 - DNA, 21 bp, Homo sapiens
ccaggtgccaccaataaaaat

SEQ ID NO: 212993 - DNA, 16 bp, Homo sapiens
ccaggtgccctgtggg

SEQ ID NO: 212994 - DNA, 20 bp, Homo sapiens
ccaggtgccctgtgggagag

SEQ ID NO: 212995 - DNA, 18 bp, Homo sapiens
ccaggtgctggaggcaga

SEQ ID NO: 212996 - DNA, 20 bp, Homo sapiens
ccaggtgctggaggcagact

SEQ ID NO: 212997 - DNA, 21 bp, Homo sapiens
ccaggtggccactccagaccc

SEQ ID NO: 212998 - DNA, 15 bp, Homo sapiens
ccaggtgtctagagg

SEQ ID NO: 212999 - DNA, 23 bp, Homo sapiens
ccaggtgttaaaaaccattataa

SEQ ID NO: 213000 - DNA, 12 bp, Homo sapiens
ccaggttacctc

SEQ ID NO: 213001 - DNA, 15 bp, Homo sapiens
ccaggttgcagctgc

SEQ ID NO: 213002 - DNA, 23 bp, Homo sapiens
ccaggttggaaaagaaatcaatt

SEQ ID NO: 213003 - DNA, 14 bp, Homo sapiens
ccaggttggaggcc

SEQ ID NO: 213004 - DNA, 16 bp, Homo sapiens
ccaggttggaggccct

SEQ ID NO: 213005 - DNA, 20 bp, Homo sapiens
ccaggttggaggccctaggc

SEQ ID NO: 213006 - DNA, 16 bp, Homo sapiens
ccagtacctccaagca

SEQ ID NO: 213007 - DNA, 17 bp, Homo sapiens
ccagtacctttgtcaca

SEQ ID NO: 213008 - DNA, 19 bp, Homo sapiens
ccagtacgtcccgctgctg

SEQ ID NO: 213009 - DNA, 20 bp, Homo sapiens
ccagtacgtcccgctgctgt

SEQ ID NO: 213010 - DNA, 13 bp, Homo sapiens
ccagtactgggaa

SEQ ID NO: 213011 - DNA, 20 bp, Homo sapiens
ccagtagccattttgtaact

SEQ ID NO: 213012 - DNA, 21 bp, Homo sapiens
ccagtagccattttgtaactg

SEQ ID NO: 213013 - DNA, 13 bp, Homo sapiens
ccagtagctgcca

SEQ ID NO: 213014 - DNA, 21 bp, Homo sapiens
ccagtataaaattacagtgga

SEQ ID NO: 213015 - DNA, 23 bp, Homo sapiens
ccagtatcctgctggttcactct

SEQ ID NO: 213016 - DNA, 22 bp, Homo sapiens
ccagtattctaggtagtgccct

SEQ ID NO: 213017 - DNA, 13 bp, Homo sapiens
ccagtcacagcca

SEQ ID NO: 213018 - DNA, 13 bp, Homo sapiens
ccagtcagggaca

SEQ ID NO: 213019 - DNA, 15 bp, Homo sapiens
atgtaatcaatgttt

SEQ ID NO: 213020 - DNA, 21 bp, Homo sapiens
atgtaatgcttatgtgttgca

SEQ ID NO: 213021 - DNA, 18 bp, Homo sapiens
atgtaatgtagttctttg

SEQ ID NO: 213022 - DNA, 20 bp, Homo sapiens
atgtaattgtttgtctttaa

SEQ ID NO: 213023 - DNA, 16 bp, Homo sapiens
atgtacaaagatactt

SEQ ID NO: 213024 - DNA, 17 bp, Homo sapiens
atgtacaaggtatgtac

SEQ ID NO: 213025 - DNA, 22 bp, Homo sapiens
atgtacaagttttgtataaata

SEQ ID NO: 213026 - DNA, 22 bp, Homo sapiens
atgtacacagtttaaacacatc

SEQ ID NO: 213027 - DNA, 17 bp, Homo sapiens
atgtacagtctgtcatg

SEQ ID NO: 213028 - DNA, 16 bp, Homo sapiens
atgtaccagtgtactg

SEQ ID NO: 213029 - DNA, 17 bp, Homo sapiens
atgtaccatgttaaaga

SEQ ID NO: 213030 - DNA, 17 bp, Homo sapiens
atgtaccttttgataga

SEQ ID NO: 213031 - DNA, 19 bp, Homo sapiens
atgtactctacgccaaagt

SEQ ID NO: 213032 - DNA, 20 bp, Homo sapiens
atgtactctacgccaaagtg

SEQ ID NO: 213033 - DNA, 13 bp, Homo sapiens
atgtactgagagg

SEQ ID NO: 213034 - DNA, 18 bp, Homo sapiens
atgtactgagccttgtaa

SEQ ID NO: 213035 - DNA, 18 bp, Homo sapiens
atgtacttaagagtggca

SEQ ID NO: 213036 - DNA, 16 bp, Homo sapiens
atgtacttaatccttt

SEQ ID NO: 213037 - DNA, 20 bp, Homo sapiens
atgtactttatattttctat

SEQ ID NO: 213038 - DNA, 22 bp, Homo sapiens
atgtactttatattttctatat

SEQ ID NO: 213039 - DNA, 18 bp, Homo sapiens
atgtagaactcagcagtt

SEQ ID NO: 213040 - DNA, 14 bp, Homo sapiens
atgtagaactgttc

SEQ ID NO: 213041 - DNA, 15 bp, Homo sapiens
atgtagaactgttca

SEQ ID NO: 213042 - DNA, 17 bp, Homo sapiens
atgtagaactgttcatt

SEQ ID NO: 213043 - DNA, 21 bp, Homo sapiens
atgtagaactgttcatttcca

SEQ ID NO: 213044 - DNA, 17 bp, Homo sapiens
atgtagaagaaagcaaa

SEQ ID NO: 213045 - DNA, 20 bp, Homo sapiens
atgtagaagaaagcaaaaaa

SEQ ID NO: 213046 - DNA, 19 bp, Homo sapiens
atgtagaagagggagaagg

SEQ ID NO: 213047 - DNA, 23 bp, Homo sapiens
atgtagatattgtgaagtacata

SEQ ID NO: 213048 - DNA, 17 bp, Homo sapiens
atgtagatgtgcatttt

SEQ ID NO: 213049 - DNA, 15 bp, Homo sapiens
atgtagcatataaat

SEQ ID NO: 213050 - DNA, 24 bp, Homo sapiens
atgtagcattgttccacacattta

SEQ ID NO: 213051 - DNA, 14 bp, Homo sapiens
atgtagctgaaaca

SEQ ID NO: 213052 - DNA, 15 bp, Homo sapiens
atgtagctggtttcc

SEQ ID NO: 213053 - DNA, 16 bp, Homo sapiens
atgtaggactgtatag

SEQ ID NO: 213054 - DNA, 12 bp, Homo sapiens
atgtagtgcagt

SEQ ID NO: 213055 - DNA, 22 bp, Homo sapiens
atgtagttctttgttcctgctt

SEQ ID NO: 213056 - DNA, 16 bp, Homo sapiens
atgtagttttcttttt

SEQ ID NO: 213057 - DNA, 19 bp, Homo sapiens
atgtagttttcttttttaa

SEQ ID NO: 213058 - DNA, 21 bp, Homo sapiens
atgtagttttcttttttaaat

SEQ ID NO: 213059 - DNA, 13 bp, Homo sapiens
atgtatattactg

SEQ ID NO: 213060 - DNA, 21 bp, Homo sapiens
atgtatcccttctcacagcac

SEQ ID NO: 213061 - DNA, 20 bp, Homo sapiens
atgtatctaaatgaaaagag

SEQ ID NO: 213062 - DNA, 16 bp, Homo sapiens
atgtatctatttatta

SEQ ID NO: 213063 - DNA, 17 bp, Homo sapiens
atgtatctctaatgaaa

SEQ ID NO: 213064 - DNA, 21 bp, Homo sapiens
atgtatctctaatgaaattgt

SEQ ID NO: 213065 - DNA, 15 bp, Homo sapiens
atgtatctgagcagg

SEQ ID NO: 213066 - DNA, 16 bp, Homo sapiens
atgtatcttatttata

SEQ ID NO: 213067 - DNA, 20 bp, Homo sapiens
atgtatcttatttatatatg

SEQ ID NO: 213068 - DNA, 22 bp, Homo sapiens
atgtatgtgaaagtgtaaaata

SEQ ID NO: 213069 - DNA, 16 bp, Homo sapiens
atgtatgtgcactgtc

SEQ ID NO: 213070 - DNA, 19 bp, Homo sapiens
atgtatgtgccaattttgt

SEQ ID NO: 213071 - DNA, 11 bp, Homo sapiens
atgtatgtgta

SEQ ID NO: 213072 - DNA, 14 bp, Homo sapiens
atgtatgtttacat

SEQ ID NO: 213073 - DNA, 16 bp, Homo sapiens
atgtattaccagcccc

SEQ ID NO: 213074 - DNA, 23 bp, Homo sapiens
atgtattaccagccccccacccc

SEQ ID NO: 213075 - DNA, 18 bp, Homo sapiens
atgtattagccagtcatt

SEQ ID NO: 213076 - DNA, 18 bp, Homo sapiens
atgtattagtagagcaac

SEQ ID NO: 213077 - DNA, 14 bp, Homo sapiens
atgtattattctgc

SEQ ID NO: 213078 - DNA, 17 bp, Homo sapiens
atgtattattctgcagc

SEQ ID NO: 213079 - DNA, 21 bp, Homo sapiens
atgtattgcagtgcggctcac

SEQ ID NO: 213080 - DNA, 21 bp, Homo sapiens
atgtattggcatttatttatg

SEQ ID NO: 213081 - DNA, 13 bp, Homo sapiens
atgtattggcctg

SEQ ID NO: 213082 - DNA, 12 bp, Homo sapiens
atgtatttaaga

SEQ ID NO: 213083 - DNA, 14 bp, Homo sapiens
atgtatttcattgc

SEQ ID NO: 213084 - DNA, 18 bp, Homo sapiens
ccagttgaataaaagtgc

SEQ ID NO: 213085 - DNA, 21 bp, Homo sapiens
ccagttgcacttggcctctgg

SEQ ID NO: 213086 - DNA, 18 bp, Homo sapiens
ccagttgcgtgtctgttt

SEQ ID NO: 213087 - DNA, 21 bp, Homo sapiens
ccagttgtagcaggtttcact

SEQ ID NO: 213088 - DNA, 19 bp, Homo sapiens
ccataaaccaataaaacaa

SEQ ID NO: 213089 - DNA, 13 bp, Homo sapiens
ccataacacttga

SEQ ID NO: 213090 - DNA, 15 bp, Homo sapiens
ccataactaccagga

SEQ ID NO: 213091 - DNA, 13 bp, Homo sapiens
ccataacttgaaa

SEQ ID NO: 213092 - DNA, 14 bp, Homo sapiens
ccataatctggact

SEQ ID NO: 213093 - DNA, 17 bp, Homo sapiens
ccataattttcttcatg

SEQ ID NO: 213094 - DNA, 21 bp, Homo sapiens
ccataattttcttcatgcaat

SEQ ID NO: 213095 - DNA, 23 bp, Homo sapiens
ccataattttcttcatgcaatga

SEQ ID NO: 213096 - DNA, 14 bp, Homo sapiens
ccatacagcctcta

SEQ ID NO: 213097 - DNA, 18 bp, Homo sapiens
ccataccccctgccccag

SEQ ID NO: 213098 - DNA, 13 bp, Homo sapiens
ccataccttgaga

SEQ ID NO: 213099 - DNA, 18 bp, Homo sapiens
ccatacttttgagagggg

SEQ ID NO: 213100 - DNA, 21 bp, Homo sapiens
ccatagagatatttaaaagac

SEQ ID NO: 213101 - DNA, 22 bp, Homo sapiens
ccatagagcccctcctggttga

SEQ ID NO: 213102 - DNA, 20 bp, Homo sapiens
ccatagatcttctgaaatga

SEQ ID NO: 213103 - DNA, 21 bp, Homo sapiens
ccatagatcttctgaaatgaa

SEQ ID NO: 213104 - DNA, 15 bp, Homo sapiens
ccatagctactatat

SEQ ID NO: 213105 - DNA, 17 bp, Homo sapiens
ccatatataaattatta

SEQ ID NO: 213106 - DNA, 22 bp, Homo sapiens
ccatatataaattattacttta

SEQ ID NO: 213107 - DNA, 23 bp, Homo sapiens
ccatatataaattattactttaa

SEQ ID NO: 213108 - DNA, 17 bp, Homo sapiens
ccatatgattgaaaaga

SEQ ID NO: 213109 - DNA, 22 bp, Homo sapiens
ccatatggattttctattgtta

SEQ ID NO: 213110 - DNA, 15 bp, Homo sapiens
ccatattcacacctc

SEQ ID NO: 213111 - DNA, 14 bp, Homo sapiens
ccatatttgtgttc

SEQ ID NO: 213112 - DNA, 22 bp, Homo sapiens
ccatatttgtgttcagttccag

SEQ ID NO: 213113 - DNA, 17 bp, Homo sapiens
ccatcaattttaacatt

SEQ ID NO: 213114 - DNA, 16 bp, Homo sapiens
ccatcacagccagccc

SEQ ID NO: 213115 - DNA, 14 bp, Homo sapiens
ccatcacagcttgt

SEQ ID NO: 213116 - DNA, 13 bp, Homo sapiens
ccatcacagggtt

SEQ ID NO: 213117 - DNA, 13 bp, Homo sapiens
ccatcagcagtga

SEQ ID NO: 213118 - DNA, 12 bp, Homo sapiens
ccatcagctccc

SEQ ID NO: 213119 - DNA, 13 bp, Homo sapiens
ccatcagctccct

SEQ ID NO: 213120 - DNA, 17 bp, Homo sapiens
ccatcaggttccatccc

SEQ ID NO: 213121 - DNA, 21 bp, Homo sapiens
ccatcagttcccccagtacct

SEQ ID NO: 213122 - DNA, 18 bp, Homo sapiens
ccatcatctctgcctttg

SEQ ID NO: 213123 - DNA, 18 bp, Homo sapiens
ccatccacagttgtcagt

SEQ ID NO: 213124 - DNA, 16 bp, Homo sapiens
ccatccactctaccct

SEQ ID NO: 213125 - DNA, 15 bp, Homo sapiens
ccatccagcatgtgt

SEQ ID NO: 213126 - DNA, 21 bp, Homo sapiens
ccatccataaatccagttcta

SEQ ID NO: 213127 - DNA, 16 bp, Homo sapiens
ccatccatcagctccc

SEQ ID NO: 213128 - DNA, 16 bp, Homo sapiens
ccatccatctccaggg

SEQ ID NO: 213129 - DNA, 12 bp, Homo sapiens
ccatcccacacc

SEQ ID NO: 213130 - DNA, 14 bp, Homo sapiens
ccatcccacaccct

SEQ ID NO: 213131 - DNA, 16 bp, Homo sapiens
ccatccccaccagctc

SEQ ID NO: 213132 - DNA, 17 bp, Homo sapiens
ccatccccatcctccag

SEQ ID NO: 213133 - DNA, 18 bp, Homo sapiens
ccatccccatcctccagc

SEQ ID NO: 213134 - DNA, 22 bp, Homo sapiens
ccatccccatcctccagcttct

SEQ ID NO: 213135 - DNA, 21 bp, Homo sapiens
ccatcccctccctgcctgctc

SEQ ID NO: 213136 - DNA, 17 bp, Homo sapiens
ccatcccgacatggacc

SEQ ID NO: 213137 - DNA, 22 bp, Homo sapiens
ccatcccgacatggacccggag

SEQ ID NO: 213138 - DNA, 23 bp, Homo sapiens
ccatccctgcttgcccgctccca

SEQ ID NO: 213139 - DNA, 15 bp, Homo sapiens
ccatcctaaaagcca

SEQ ID NO: 213140 - DNA, 19 bp, Homo sapiens
ccatcctaccaatgcatgc

SEQ ID NO: 213141 - DNA, 20 bp, Homo sapiens
ccatcctaccaatgcatgca

SEQ ID NO: 213142 - DNA, 17 bp, Homo sapiens
ccatcctccagcttctg

SEQ ID NO: 213143 - DNA, 12 bp, Homo sapiens
ccatcctgccag

SEQ ID NO: 213144 - DNA, 15 bp, Homo sapiens
ccatcctgccaggag

SEQ ID NO: 213145 - DNA, 16 bp, Homo sapiens
ccatcctgccaggagc

SEQ ID NO: 213146 - DNA, 17 bp, Homo sapiens
ccatcctgccaggagca

SEQ ID NO: 213147 - DNA, 22 bp, Homo sapiens
ccatcctgtacaagtgctcagt

SEQ ID NO: 213148 - DNA, 18 bp, Homo sapiens
ccatccttcccgcagcac

SEQ ID NO: 213149 - DNA, 16 bp, Homo sapiens
ccatcggtcctgtctc

SEQ ID NO: 213150 - DNA, 18 bp, Homo sapiens
ccatcgtataaggaaatc

SEQ ID NO: 213151 - DNA, 14 bp, Homo sapiens
ccatctcagcctcc

SEQ ID NO: 213152 - DNA, 21 bp, Homo sapiens
ccatctcagcctcctgagcct

SEQ ID NO: 213153 - DNA, 22 bp, Homo sapiens
ccatctcagcctcctgagcctg

SEQ ID NO: 213154 - DNA, 21 bp, Homo sapiens
ccatctcaggccacctgcccc

SEQ ID NO: 213155 - DNA, 22 bp, Homo sapiens
ccatctcaggccacctgccccc

SEQ ID NO: 213156 - DNA, 21 bp, Homo sapiens
atgtgaagcatgctttgctgc

SEQ ID NO: 213157 - DNA, 14 bp, Homo sapiens
atgtgaagttttct

SEQ ID NO: 213158 - DNA, 23 bp, Homo sapiens
atgtgaatcgcaaggcctgtgct

SEQ ID NO: 213159 - DNA, 19 bp, Homo sapiens
atgtgacaacctttgtgta

SEQ ID NO: 213160 - DNA, 19 bp, Homo sapiens
atgtgacccaccagtgcct

SEQ ID NO: 213161 - DNA, 11 bp, Homo sapiens
atgtgagacag

SEQ ID NO: 213162 - DNA, 19 bp, Homo sapiens
atgtgagccaccgctgcca

SEQ ID NO: 213163 - DNA, 22 bp, Homo sapiens
atgtgagccaccgctgccagca

SEQ ID NO: 213164 - DNA, 16 bp, Homo sapiens
atgtgatatgtgtaat

SEQ ID NO: 213165 - DNA, 18 bp, Homo sapiens
atgtgatatgtgtaatat

SEQ ID NO: 213166 - DNA, 19 bp, Homo sapiens
atgtgatatgtgtaatatc

SEQ ID NO: 213167 - DNA, 13 bp, Homo sapiens
atgtgatcactga

SEQ ID NO: 213168 - DNA, 18 bp, Homo sapiens
atgtgatggaacacacac

SEQ ID NO: 213169 - DNA, 14 bp, Homo sapiens
atgtgatttttctg

SEQ ID NO: 213170 - DNA, 15 bp, Homo sapiens
atgtgcaactcttgt

SEQ ID NO: 213171 - DNA, 17 bp, Homo sapiens
atgtgcaactcttgtat

SEQ ID NO: 213172 - DNA, 21 bp, Homo sapiens
atgtgcaaggtgataggaaaa

SEQ ID NO: 213173 - DNA, 18 bp, Homo sapiens
atgtgcactgtcactttg

SEQ ID NO: 213174 - DNA, 20 bp, Homo sapiens
atgtgcagtgtcttgtaaca

SEQ ID NO: 213175 - DNA, 18 bp, Homo sapiens
atgtgcatttcacctgtg

SEQ ID NO: 213176 - DNA, 23 bp, Homo sapiens
atgtgcatttcacctgtgacaaa

SEQ ID NO: 213177 - DNA, 20 bp, Homo sapiens
atgtgcatttttgtgaaatg

SEQ ID NO: 213178 - DNA, 16 bp, Homo sapiens
atgtgccaattttgtc

SEQ ID NO: 213179 - DNA, 15 bp, Homo sapiens
atgtgccaccaacat

SEQ ID NO: 213180 - DNA, 22 bp, Homo sapiens
atgtgccaccaacataaaacaa

SEQ ID NO: 213181 - DNA, 19 bp, Homo sapiens
atgtgccatctgtacatat

SEQ ID NO: 213182 - DNA, 13 bp, Homo sapiens
atgtgcccagagt

SEQ ID NO: 213183 - DNA, 18 bp, Homo sapiens
atgtgccccatgtccaag

SEQ ID NO: 213184 - DNA, 14 bp, Homo sapiens
atgtgcccctggcc

SEQ ID NO: 213185 - DNA, 18 bp, Homo sapiens
atgtgccgaatgtgcagg

SEQ ID NO: 213186 - DNA, 14 bp, Homo sapiens
atgtgccgtctttg

SEQ ID NO: 213187 - DNA, 23 bp, Homo sapiens
atgtgccgtctttggttcctcat

SEQ ID NO: 213188 - DNA, 22 bp, Homo sapiens
atgtgcctgcaccaggagacag

SEQ ID NO: 213189 - DNA, 22 bp, Homo sapiens
atgtgcctttttgtttttgtaa

SEQ ID NO: 213190 - DNA, 15 bp, Homo sapiens
atgtgcgtgctgtct

SEQ ID NO: 213191 - DNA, 17 bp, Homo sapiens
atgtgcgtgctgtctgt

SEQ ID NO: 213192 - DNA, 15 bp, Homo sapiens
atgtgcgtgtgtgca

SEQ ID NO: 213193 - DNA, 20 bp, Homo sapiens
atgtgcgtgtgtgcaagtgt

SEQ ID NO: 213194 - DNA, 14 bp, Homo sapiens
atgtgctgcaaaga

SEQ ID NO: 213195 - DNA, 14 bp, Homo sapiens
atgtgctgctgtgg

SEQ ID NO: 213196 - DNA, 18 bp, Homo sapiens
atgtgctgtgaccattta

SEQ ID NO: 213197 - DNA, 16 bp, Homo sapiens
atgtgctttgtagctt

SEQ ID NO: 213198 - DNA, 22 bp, Homo sapiens
atgtgctttgtagcttaaaaaa

SEQ ID NO: 213199 - DNA, 20 bp, Homo sapiens
atgtgcttttccatctaaaa

SEQ ID NO: 213200 - DNA, 21 bp, Homo sapiens
atgtgcttttccatctaaaat

SEQ ID NO: 213201 - DNA, 15 bp, Homo sapiens
atgtggaaagtgaat

SEQ ID NO: 213202 - DNA, 15 bp, Homo sapiens
atgtggaattacata

SEQ ID NO: 213203 - DNA, 11 bp, Homo sapiens
atgtggcagct

SEQ ID NO: 213204 - DNA, 12 bp, Homo sapiens
atgtggcagctg

SEQ ID NO: 213205 - DNA, 13 bp, Homo sapiens
atgtggcagctgg

SEQ ID NO: 213206 - DNA, 24 bp, Homo sapiens
atgtggcagctggggagcagctga

SEQ ID NO: 213207 - DNA, 22 bp, Homo sapiens
atgtggccaagggctccagggc

SEQ ID NO: 213208 - DNA, 16 bp, Homo sapiens
atgtggccccaggtgc

SEQ ID NO: 213209 - DNA, 16 bp, Homo sapiens
atgtggccgaggactt

SEQ ID NO: 213210 - DNA, 17 bp, Homo sapiens
atgtggccgaggacttt

SEQ ID NO: 213211 - DNA, 18 bp, Homo sapiens
atgtggccgaggactttg

SEQ ID NO: 213212 - DNA, 14 bp, Homo sapiens
atgtggctgaagac

SEQ ID NO: 213213 - DNA, 16 bp, Homo sapiens
atgtggcttcttcaac

SEQ ID NO: 213214 - DNA, 21 bp, Homo sapiens
ccatgcacacaaacacctcct

SEQ ID NO: 213215 - DNA, 12 bp, Homo sapiens
ccatgcaccaaa

SEQ ID NO: 213216 - DNA, 19 bp, Homo sapiens
ccatgcacccctgatgttc

SEQ ID NO: 213217 - DNA, 17 bp, Homo sapiens
ccatgcactcaataaag

SEQ ID NO: 213218 - DNA, 15 bp, Homo sapiens
ccatgcatggcctcc

SEQ ID NO: 213219 - DNA, 16 bp, Homo sapiens
ccatgcatggcctccc

SEQ ID NO: 213220 - DNA, 18 bp, Homo sapiens
ccatgcatggcctcccag

SEQ ID NO: 213221 - DNA, 21 bp, Homo sapiens
ccatgcatggcctcccagcca

SEQ ID NO: 213222 - DNA, 22 bp, Homo sapiens
ccatgcatggcctcccagccac

SEQ ID NO: 213223 - DNA, 23 bp, Homo sapiens
ccatgcatggcctcccagccacc

SEQ ID NO: 213224 - DNA, 20 bp, Homo sapiens
ccatgccaccacccacccca

SEQ ID NO: 213225 - DNA, 14 bp, Homo sapiens
ccatgccactgcca

SEQ ID NO: 213226 - DNA, 17 bp, Homo sapiens
ccatgcccacctgccca

SEQ ID NO: 213227 - DNA, 18 bp, Homo sapiens
ccatgcccagctcagagg

SEQ ID NO: 213228 - DNA, 18 bp, Homo sapiens
ccatgccctccgtcctgg

SEQ ID NO: 213229 - DNA, 22 bp, Homo sapiens
ccatgccctccgtcctggcagg

SEQ ID NO: 213230 - DNA, 23 bp, Homo sapiens
ccatgccctgccaagcctggagc

SEQ ID NO: 213231 - DNA, 15 bp, Homo sapiens
ccatgcctacagata

SEQ ID NO: 213232 - DNA, 13 bp, Homo sapiens
ccatgcctcatgc

SEQ ID NO: 213233 - DNA, 14 bp, Homo sapiens
ccatgcctgagggt

SEQ ID NO: 213234 - DNA, 13 bp, Homo sapiens
ccatgcctgtcca

SEQ ID NO: 213235 - DNA, 17 bp, Homo sapiens
ccatgcctgtccagcct

SEQ ID NO: 213236 - DNA, 18 bp, Homo sapiens
ccatgcctgtccagcctg

SEQ ID NO: 213237 - DNA, 15 bp, Homo sapiens
ccatgcctgtctctg

SEQ ID NO: 213238 - DNA, 17 bp, Homo sapiens
ccatgctcaacccccct

SEQ ID NO: 213239 - DNA, 20 bp, Homo sapiens
ccatgctcaacccccctccc

SEQ ID NO: 213240 - DNA, 21 bp, Homo sapiens
ccatgctcaacccccctccca

SEQ ID NO: 213241 - DNA, 15 bp, Homo sapiens
ccatgctcctcacct

SEQ ID NO: 213242 - DNA, 16 bp, Homo sapiens
ccatgctcctcactgc

SEQ ID NO: 213243 - DNA, 19 bp, Homo sapiens
ccatgctctgccccaagcc

SEQ ID NO: 213244 - DNA, 22 bp, Homo sapiens
ccatgctgctttttggcacagt

SEQ ID NO: 213245 - DNA, 17 bp, Homo sapiens
ccatggaagctggcagg

SEQ ID NO: 213246 - DNA, 22 bp, Homo sapiens
ccatggactctacactgtgaac

SEQ ID NO: 213247 - DNA, 21 bp, Homo sapiens
ccatggatgtttcttctttga

SEQ ID NO: 213248 - DNA, 20 bp, Homo sapiens
ccatggattcccctggacat

SEQ ID NO: 213249 - DNA, 18 bp, Homo sapiens
ccatggcaccagccccct

SEQ ID NO: 213250 - DNA, 19 bp, Homo sapiens
ccatggcaccagccccctg

SEQ ID NO: 213251 - DNA, 13 bp, Homo sapiens
ccatggcaggaag

SEQ ID NO: 213252 - DNA, 15 bp, Homo sapiens
ccatggcaggaaggc

SEQ ID NO: 213253 - DNA, 13 bp, Homo sapiens
ccatggccacccc

SEQ ID NO: 213254 - DNA, 16 bp, Homo sapiens
ccatggcccagcagct

SEQ ID NO: 213255 - DNA, 18 bp, Homo sapiens
ccatggccccagctggct

SEQ ID NO: 213256 - DNA, 15 bp, Homo sapiens
ccatggcctgtgctg

SEQ ID NO: 213257 - DNA, 15 bp, Homo sapiens
ccatggccttccctc

SEQ ID NO: 213258 - DNA, 21 bp, Homo sapiens
ccatggccttccctccccaca

SEQ ID NO: 213259 - DNA, 20 bp, Homo sapiens
ccatggctaaggcaccagcc

SEQ ID NO: 213260 - DNA, 14 bp, Homo sapiens
ccatggctcaggca

SEQ ID NO: 213261 - DNA, 20 bp, Homo sapiens
ccatggctttcatcctgtgt

SEQ ID NO: 213262 - DNA, 14 bp, Homo sapiens
ccatgggatatgtg

SEQ ID NO: 213263 - DNA, 20 bp, Homo sapiens
ccatgggcagaagatagaga

SEQ ID NO: 213264 - DNA, 11 bp, Homo sapiens
ccatgggcctg

SEQ ID NO: 213265 - DNA, 12 bp, Homo sapiens
ccatgggcctgc

SEQ ID NO: 213266 - DNA, 15 bp, Homo sapiens
ccatgggcctgctgc

SEQ ID NO: 213267 - DNA, 18 bp, Homo sapiens
ccatgggcctgggcctgc

SEQ ID NO: 213268 - DNA, 20 bp, Homo sapiens
ccatgggctagtgtgagtgg

SEQ ID NO: 213269 - DNA, 11 bp, Homo sapiens
ccatgggcttg

SEQ ID NO: 213270 - DNA, 22 bp, Homo sapiens
ccatgggcttggacttcctggg

SEQ ID NO: 213271 - DNA, 18 bp, Homo sapiens
ccatgggggcccctcggc

SEQ ID NO: 213272 - DNA, 17 bp, Homo sapiens
ccatggggttcgagact

SEQ ID NO: 213273 - DNA, 20 bp, Homo sapiens
ccatggtaatgtaacttaat

SEQ ID NO: 213274 - DNA, 14 bp, Homo sapiens
ccatggtcacagag

SEQ ID NO: 213275 - DNA, 15 bp, Homo sapiens
ccatggtcacagaga

SEQ ID NO: 213276 - DNA, 13 bp, Homo sapiens
ccatggtgcagtg

SEQ ID NO: 213277 - DNA, 14 bp, Homo sapiens
ccatggtgcagtga

SEQ ID NO: 213278 - DNA, 22 bp, Homo sapiens
ccatggtggtttcagaaagggc

SEQ ID NO: 213279 - DNA, 20 bp, Homo sapiens
ccatgtaaataccagactgc

SEQ ID NO: 213280 - DNA, 22 bp, Homo sapiens
ccatgtaccagtgtactgcttt

SEQ ID NO: 213281 - DNA, 14 bp, Homo sapiens
ccatgtactgtagt

SEQ ID NO: 213282 - DNA, 15 bp, Homo sapiens
ccatgtactgtagtt

SEQ ID NO: 213283 - DNA, 21 bp, Homo sapiens
ccatgtccaagttcttcacct

SEQ ID NO: 213284 - DNA, 22 bp, Homo sapiens
ccatgtcctaggggccgaggga

SEQ ID NO: 213285 - DNA, 15 bp, Homo sapiens
ccatgtcgcctctgc

SEQ ID NO: 213286 - DNA, 22 bp, Homo sapiens
ccatgtgccatctgtacatatt

SEQ ID NO: 213287 - DNA, 17 bp, Homo sapiens
ccatgtgcctgcaccag

SEQ ID NO: 213288 - DNA, 19 bp, Homo sapiens
ccatgtgcctgcaccagga

SEQ ID NO: 213289 - DNA, 22 bp, Homo sapiens
ccatgtgcctgtcacgctctgg

SEQ ID NO: 213290 - DNA, 12 bp, Homo sapiens
ccatgtgctgct

SEQ ID NO: 213291 - DNA, 15 bp, Homo sapiens
ccatgtgctgctgtg

SEQ ID NO: 213292 - DNA, 21 bp, Homo sapiens
ccatgtggcagaagtgctctt

SEQ ID NO: 213293 - DNA, 11 bp, Homo sapiens
atgttggtttt

SEQ ID NO: 213294 - DNA, 15 bp, Homo sapiens
atgttgtagatacaa

SEQ ID NO: 213295 - DNA, 17 bp, Homo sapiens
atgttgtcctgtgtcat

SEQ ID NO: 213296 - DNA, 18 bp, Homo sapiens
atgttgtcctgtgtcatc

SEQ ID NO: 213297 - DNA, 14 bp, Homo sapiens
atgttgtgaagatg

SEQ ID NO: 213298 - DNA, 21 bp, Homo sapiens
atgttgtgattaacatcatca

SEQ ID NO: 213299 - DNA, 16 bp, Homo sapiens
atgttgtggtttgttg

SEQ ID NO: 213300 - DNA, 17 bp, Homo sapiens
atgttgtgttgttatca

SEQ ID NO: 213301 - DNA, 16 bp, Homo sapiens
atgttgttatgctatt

SEQ ID NO: 213302 - DNA, 15 bp, Homo sapiens
atgtttaagtgcttg

SEQ ID NO: 213303 - DNA, 21 bp, Homo sapiens
atgtttacactctttgtaaga

SEQ ID NO: 213304 - DNA, 21 bp, Homo sapiens
atgtttagtagctgataaaga

SEQ ID NO: 213305 - DNA, 22 bp, Homo sapiens
atgtttatatactgggttcttg

SEQ ID NO: 213306 - DNA, 22 bp, Homo sapiens
atgtttcagctgcagttgaaga

SEQ ID NO: 213307 - DNA, 18 bp, Homo sapiens
atgtttcattattctttc

SEQ ID NO: 213308 - DNA, 16 bp, Homo sapiens
atgtttccagctgcca

SEQ ID NO: 213309 - DNA, 15 bp, Homo sapiens
atgtttgaggttaaa

SEQ ID NO: 213310 - DNA, 22 bp, Homo sapiens
atgtttgctcagaacacattct

SEQ ID NO: 213311 - DNA, 13 bp, Homo sapiens
atgtttggctgaa

SEQ ID NO: 213312 - DNA, 18 bp, Homo sapiens
atgtttgtacacaacacc

SEQ ID NO: 213313 - DNA, 21 bp, Homo sapiens
atgtttgtacacaacacctaa

SEQ ID NO: 213314 - DNA, 14 bp, Homo sapiens
atgtttgtgcatgt

SEQ ID NO: 213315 - DNA, 17 bp, Homo sapiens
atgtttgtgcatgtata

SEQ ID NO: 213316 - DNA, 21 bp, Homo sapiens
atgtttgtgctgcagacaaaa

SEQ ID NO: 213317 - DNA, 21 bp, Homo sapiens
atgtttgttttcaaaatactt

SEQ ID NO: 213318 - DNA, 16 bp, Homo sapiens
atgttttaaaagtttg

SEQ ID NO: 213319 - DNA, 14 bp, Homo sapiens
atgttttgaatgat

SEQ ID NO: 213320 - DNA, 17 bp, Homo sapiens
atgttttggagagagca

SEQ ID NO: 213321 - DNA, 19 bp, Homo sapiens
atgttttggagagagcaat

SEQ ID NO: 213322 - DNA, 22 bp, Homo sapiens
atgttttggagagagcaatctt

SEQ ID NO: 213323 - DNA, 21 bp, Homo sapiens
atgttttgtgactatatagag

SEQ ID NO: 213324 - DNA, 14 bp, Homo sapiens
atgttttgtttctg

SEQ ID NO: 213325 - DNA, 23 bp, Homo sapiens
atgtttttaaaagtttcaatgtg

SEQ ID NO: 213326 - DNA, 17 bp, Homo sapiens
attaaaaaaaaaacttc

SEQ ID NO: 213327 - DNA, 14 bp, Homo sapiens
attaaaaaaataat

SEQ ID NO: 213328 - DNA, 21 bp, Homo sapiens
attaaaaacacctaagtgact

SEQ ID NO: 213329 - DNA, 18 bp, Homo sapiens
attaaaaatataaacaat

SEQ ID NO: 213330 - DNA, 21 bp, Homo sapiens
attaaaaatatggaacttcta

SEQ ID NO: 213331 - DNA, 13 bp, Homo sapiens
attaaaacaaaat

SEQ ID NO: 213332 - DNA, 23 bp, Homo sapiens
attaaaacacaacatctttttct

SEQ ID NO: 213333 - DNA, 14 bp, Homo sapiens
attaaaactgcttt

SEQ ID NO: 213334 - DNA, 22 bp, Homo sapiens
attaaaacttaaccgcatcaga

SEQ ID NO: 213335 - DNA, 17 bp, Homo sapiens
attaaaatccagcatcc

SEQ ID NO: 213336 - DNA, 18 bp, Homo sapiens
attaaaatgattgtaaaa

SEQ ID NO: 213337 - DNA, 22 bp, Homo sapiens
attaaaatgtcggatttatctt

SEQ ID NO: 213338 - DNA, 16 bp, Homo sapiens
attaaaattaaggtct

SEQ ID NO: 213339 - DNA, 13 bp, Homo sapiens
attaaaattagtg

SEQ ID NO: 213340 - DNA, 11 bp, Homo sapiens
attaaacaatt

SEQ ID NO: 213341 - DNA, 19 bp, Homo sapiens
attaaacaatttattttat

SEQ ID NO: 213342 - DNA, 12 bp, Homo sapiens
attaaacacctg

SEQ ID NO: 213343 - DNA, 13 bp, Homo sapiens
attaaacacctga

SEQ ID NO: 213344 - DNA, 16 bp, Homo sapiens
cgtagctgcaaaggac

SEQ ID NO: 213345 - DNA, 20 bp, Homo sapiens
cgtaggcagcctctctgcta

SEQ ID NO: 213346 - DNA, 21 bp, Homo sapiens
cgtaggcagcctctctgctat

SEQ ID NO: 213347 - DNA, 17 bp, Homo sapiens
cgtagggagtacctgct

SEQ ID NO: 213348 - DNA, 20 bp, Homo sapiens
cgtagggagtacctgctgcc

SEQ ID NO: 213349 - DNA, 16 bp, Homo sapiens
cgtagggccagggctc

SEQ ID NO: 213350 - DNA, 17 bp, Homo sapiens
cgtagtagggtcaggcc

SEQ ID NO: 213351 - DNA, 21 bp, Homo sapiens
cgtagtgtagatttgttttgt

SEQ ID NO: 213352 - DNA, 16 bp, Homo sapiens
cgtatagaaaaagcac

SEQ ID NO: 213353 - DNA, 16 bp, Homo sapiens
cgtatgtctgttacca

SEQ ID NO: 213354 - DNA, 15 bp, Homo sapiens
cgtattgtgaaattt

SEQ ID NO: 213355 - DNA, 21 bp, Homo sapiens
cgtcacagcagtacttgctca

SEQ ID NO: 213356 - DNA, 17 bp, Homo sapiens
cgtcaccagaattagtc

SEQ ID NO: 213357 - DNA, 20 bp, Homo sapiens
cgtcaccatctcaggccacc

SEQ ID NO: 213358 - DNA, 14 bp, Homo sapiens
cgtcacccttggta

SEQ ID NO: 213359 - DNA, 18 bp, Homo sapiens
cgtcacccttggtagagt

SEQ ID NO: 213360 - DNA, 13 bp, Homo sapiens
cgtcactccattc

SEQ ID NO: 213361 - DNA, 13 bp, Homo sapiens
cgtcactgccaga

SEQ ID NO: 213362 - DNA, 17 bp, Homo sapiens
cgtcagaagcacccagg

SEQ ID NO: 213363 - DNA, 23 bp, Homo sapiens
cgtcagccaaatgacttcatttc

SEQ ID NO: 213364 - DNA, 16 bp, Homo sapiens
cgtcaggaggtgcctg

SEQ ID NO: 213365 - DNA, 19 bp, Homo sapiens
cgtcatcacttttcagtga

SEQ ID NO: 213366 - DNA, 20 bp, Homo sapiens
cgtcatggctcaaggattca

SEQ ID NO: 213367 - DNA, 19 bp, Homo sapiens
cgtcatggcttaatgttta

SEQ ID NO: 213368 - DNA, 21 bp, Homo sapiens
cgtccaaaggagtgcatggcc

SEQ ID NO: 213369 - DNA, 22 bp, Homo sapiens
cgtccaaaggagtgcatggcca

SEQ ID NO: 213370 - DNA, 16 bp, Homo sapiens
cgtccaaccccggggc

SEQ ID NO: 213371 - DNA, 20 bp, Homo sapiens
cgtccacaggggcaggcctg

SEQ ID NO: 213372 - DNA, 22 bp, Homo sapiens
cgtccacaggggcaggcctggg

SEQ ID NO: 213373 - DNA, 20 bp, Homo sapiens
cgtccacccaggctgcactg

SEQ ID NO: 213374 - DNA, 23 bp, Homo sapiens
cgtccacccaggctgcactgcag

SEQ ID NO: 213375 - DNA, 13 bp, Homo sapiens
cgtccactttccc

SEQ ID NO: 213376 - DNA, 14 bp, Homo sapiens
cgtccatctctctc

SEQ ID NO: 213377 - DNA, 16 bp, Homo sapiens
cgtccatctctctccc

SEQ ID NO: 213378 - DNA, 17 bp, Homo sapiens
cgtccatctctctccct

SEQ ID NO: 213379 - DNA, 15 bp, Homo sapiens
cgtccatggcaccag

SEQ ID NO: 213380 - DNA, 18 bp, Homo sapiens
cgtccatggcaccagccc

SEQ ID NO: 213381 - DNA, 19 bp, Homo sapiens
cgtccatggcaccagcccc

SEQ ID NO: 213382 - DNA, 13 bp, Homo sapiens
cgtccccagggtg

SEQ ID NO: 213383 - DNA, 16 bp, Homo sapiens
cgtccccctccagtgc

SEQ ID NO: 213384 - DNA, 18 bp, Homo sapiens
cgtcccctccgccgtgcc

SEQ ID NO: 213385 - DNA, 21 bp, Homo sapiens
cgtcccctccgccgtgccggc

SEQ ID NO: 213386 - DNA, 17 bp, Homo sapiens
cgtcccctgggccaccc

SEQ ID NO: 213387 - DNA, 21 bp, Homo sapiens
cgtcccgctgctgtgctctgg

SEQ ID NO: 213388 - DNA, 22 bp, Homo sapiens
cgtcccgctgctgtgctctggg

SEQ ID NO: 213389 - DNA, 12 bp, Homo sapiens
cgtcccggcccc

SEQ ID NO: 213390 - DNA, 14 bp, Homo sapiens
cgtcccgttctcca

SEQ ID NO: 213391 - DNA, 14 bp, Homo sapiens
cgtccgcccgccca

SEQ ID NO: 213392 - DNA, 14 bp, Homo sapiens
cgtccggcctgcag

SEQ ID NO: 213393 - DNA, 15 bp, Homo sapiens
cgtccggcctgcagc

SEQ ID NO: 213394 - DNA, 20 bp, Homo sapiens
cgtccggggtggtggacagg

SEQ ID NO: 213395 - DNA, 21 bp, Homo sapiens
cgtccggggtggtggacaggg

SEQ ID NO: 213396 - DNA, 16 bp, Homo sapiens
cgtccgtccgcccgcc

SEQ ID NO: 213397 - DNA, 14 bp, Homo sapiens
cgtcctcccgggcc

SEQ ID NO: 213398 - DNA, 16 bp, Homo sapiens
cgtcctcccgggccct

SEQ ID NO: 213399 - DNA, 18 bp, Homo sapiens
cgtcctcccgggccctcc

SEQ ID NO: 213400 - DNA, 23 bp, Homo sapiens
cgtcctcgtggcggggcagcagg

SEQ ID NO: 213401 - DNA, 12 bp, Homo sapiens
cgtcctgaggaa

SEQ ID NO: 213402 - DNA, 14 bp, Homo sapiens
cgtcctgcagagga

SEQ ID NO: 213403 - DNA, 13 bp, Homo sapiens
cgtcctgccacct

SEQ ID NO: 213404 - DNA, 20 bp, Homo sapiens
cgtcctgccacctggggcag

SEQ ID NO: 213405 - DNA, 21 bp, Homo sapiens
cgtcctggaatgaagcatgta

SEQ ID NO: 213406 - DNA, 14 bp, Homo sapiens
cgtccttttggttt

SEQ ID NO: 213407 - DNA, 15 bp, Homo sapiens
cgtctccctggccac

SEQ ID NO: 213408 - DNA, 20 bp, Homo sapiens
cgtctccctggccacccttg

SEQ ID NO: 213409 - DNA, 13 bp, Homo sapiens
cgtctcccttggc

SEQ ID NO: 213410 - DNA, 20 bp, Homo sapiens
cgtctcccttggccacggcc

SEQ ID NO: 213411 - DNA, 13 bp, Homo sapiens
cgtctcctccctc

SEQ ID NO: 213412 - DNA, 12 bp, Homo sapiens
cgtctcctctcc

SEQ ID NO: 213413 - DNA, 19 bp, Homo sapiens
cgtctgactccagagtctg

SEQ ID NO: 213414 - DNA, 23 bp, Homo sapiens
cgtctgactccagagtctgagcc

SEQ ID NO: 213415 - DNA, 17 bp, Homo sapiens
cgtctgagcggccgcct

SEQ ID NO: 213416 - DNA, 23 bp, Homo sapiens
cgtctgagcggccgcctgtcctt

SEQ ID NO: 213417 - DNA, 16 bp, Homo sapiens
cgtctgatgttttgat

SEQ ID NO: 213418 - DNA, 12 bp, Homo sapiens
cgtctgccaggc

SEQ ID NO: 213419 - DNA, 15 bp, Homo sapiens
cgtctgccccaccct

SEQ ID NO: 213420 - DNA, 16 bp, Homo sapiens
cgtctgccccaccctc

SEQ ID NO: 213421 - DNA, 20 bp, Homo sapiens
cgtctgcctaggagctggct

SEQ ID NO: 213422 - DNA, 14 bp, Homo sapiens
cgtctggggtgtgg

SEQ ID NO: 213423 - DNA, 23 bp, Homo sapiens
cgtcttggtgccttttgtgtgat

SEQ ID NO: 213424 - DNA, 18 bp, Homo sapiens
cgtctttggttcctcatg

SEQ ID NO: 213425 - DNA, 19 bp, Homo sapiens
cgtctttggttcctcatgg

SEQ ID NO: 213426 - DNA, 12 bp, Homo sapiens
cgtgaaacacac

SEQ ID NO: 213427 - DNA, 16 bp, Homo sapiens
cgtgaaacacaccagg

SEQ ID NO: 213428 - DNA, 20 bp, Homo sapiens
cgtgaaacacaccaggctgt

SEQ ID NO: 213429 - DNA, 15 bp, Homo sapiens
cgtgaagcagtgcct

SEQ ID NO: 213430 - DNA, 22 bp, Homo sapiens
cgtgaagcagtgcctcgaggca

SEQ ID NO: 213431 - DNA, 22 bp, Homo sapiens
cgtgaataagttgattctgtcc

SEQ ID NO: 213432 - DNA, 16 bp, Homo sapiens
cgtgacagtgcctggg

SEQ ID NO: 213433 - DNA, 14 bp, Homo sapiens
cgtgacccagtggc

SEQ ID NO: 213434 - DNA, 14 bp, Homo sapiens
cgtgacccttcagg

SEQ ID NO: 213435 - DNA, 15 bp, Homo sapiens
cgtgaccggcccgcc

SEQ ID NO: 213436 - DNA, 23 bp, Homo sapiens
cgtgactgtattatacatgggta

SEQ ID NO: 213437 - DNA, 18 bp, Homo sapiens
cgtgagagaatctgcctg

SEQ ID NO: 213438 - DNA, 21 bp, Homo sapiens
cgtgagagcccaatcactgcc

SEQ ID NO: 213439 - DNA, 21 bp, Homo sapiens
cgtgagcaggaaggcctgggt

SEQ ID NO: 213440 - DNA, 13 bp, Homo sapiens
cgtgagcaggctt

SEQ ID NO: 213441 - DNA, 19 bp, Homo sapiens
cgtgagcagtgtgtctcct

SEQ ID NO: 213442 - DNA, 14 bp, Homo sapiens
cgtgagccaccgcg

SEQ ID NO: 213443 - DNA, 15 bp, Homo sapiens
cgtgagcgccccgcc

SEQ ID NO: 213444 - DNA, 15 bp, Homo sapiens
cgtgagggggagctg

SEQ ID NO: 213445 - DNA, 22 bp, Homo sapiens
cgtgatccatccatctccaggg

SEQ ID NO: 213446 - DNA, 15 bp, Homo sapiens
cgtgattctgttcta

SEQ ID NO: 213447 - DNA, 23 bp, Homo sapiens
cgtgatttggaagagaggcacct

SEQ ID NO: 213448 - DNA, 17 bp, Homo sapiens
cgtgcacgtggagagct

SEQ ID NO: 213449 - DNA, 20 bp, Homo sapiens
cgtgcacgtggagagctggt

SEQ ID NO: 213450 - DNA, 18 bp, Homo sapiens
cgtgcactctgctaatca

SEQ ID NO: 213451 - DNA, 17 bp, Homo sapiens
cgtgcagactggagggg

SEQ ID NO: 213452 - DNA, 22 bp, Homo sapiens
cgtgcatggctcctgtctggct

SEQ ID NO: 213453 - DNA, 22 bp, Homo sapiens
cgtgcattggaagaccccaccc

SEQ ID NO: 213454 - DNA, 17 bp, Homo sapiens
cgtgccaaatcctgggc

SEQ ID NO: 213455 - DNA, 19 bp, Homo sapiens
cgtgccaggagcaatggga

SEQ ID NO: 213456 - DNA, 22 bp, Homo sapiens
cgtgccattgtactccagcctg

SEQ ID NO: 213457 - DNA, 17 bp, Homo sapiens
cgtgccattgtctttcc

SEQ ID NO: 213458 - DNA, 14 bp, Homo sapiens
cgtgcccccctcct

SEQ ID NO: 213459 - DNA, 17 bp, Homo sapiens
cgtgcccccctcctcca

SEQ ID NO: 213460 - DNA, 19 bp, Homo sapiens
cgtgcccccctcctccagt

SEQ ID NO: 213461 - DNA, 16 bp, Homo sapiens
cgtgcccgcccacctc

SEQ ID NO: 213462 - DNA, 19 bp, Homo sapiens
cgtgcccgcccacctctgc

SEQ ID NO: 213463 - DNA, 10 bp, Homo sapiens
cgtgccctct

SEQ ID NO: 213464 - DNA, 22 bp, Homo sapiens
cgtgccggcggcagccccactt

SEQ ID NO: 213465 - DNA, 20 bp, Homo sapiens
cgtgcctccttccacctccc

SEQ ID NO: 213466 - DNA, 22 bp, Homo sapiens
cgtgcctcgtgggttcttcctc

SEQ ID NO: 213467 - DNA, 16 bp, Homo sapiens
cgtgcctgtagtccca

SEQ ID NO: 213468 - DNA, 17 bp, Homo sapiens
cgtgcgaccagaggtgg

SEQ ID NO: 213469 - DNA, 21 bp, Homo sapiens
cgtgcgcagccgcgctctgcc

SEQ ID NO: 213470 - DNA, 21 bp, Homo sapiens
cgtgcggcccgtgcgcagccg

SEQ ID NO: 213471 - DNA, 22 bp, Homo sapiens
cgtgcggcccgtgcgcagccgc

SEQ ID NO: 213472 - DNA, 18 bp, Homo sapiens
cgtgctccttttctcttt

SEQ ID NO: 213473 - DNA, 14 bp, Homo sapiens
cgtgctgggacagc

SEQ ID NO: 213474 - DNA, 16 bp, Homo sapiens
cgtgctgtctcctttg

SEQ ID NO: 213475 - DNA, 16 bp, Homo sapiens
cgtgcttcctcctgac

SEQ ID NO: 213476 - DNA, 21 bp, Homo sapiens
cgtggaaagggtgctgcttcc

SEQ ID NO: 213477 - DNA, 22 bp, Homo sapiens
tacttgtgtttgcttaaacaaa

SEQ ID NO: 213478 - DNA, 17 bp, Homo sapiens
tacttgttcatttctgt

SEQ ID NO: 213479 - DNA, 17 bp, Homo sapiens
tacttgttcttttctgg

SEQ ID NO: 213480 - DNA, 15 bp, Homo sapiens
tactttaaatcctac

SEQ ID NO: 213481 - DNA, 17 bp, Homo sapiens
tactttaaattatatga

SEQ ID NO: 213482 - DNA, 13 bp, Homo sapiens
tactttaacatgc

SEQ ID NO: 213483 - DNA, 14 bp, Homo sapiens
tactttaacatgcc

SEQ ID NO: 213484 - DNA, 17 bp, Homo sapiens
tactttacatatgcttt

SEQ ID NO: 213485 - DNA, 12 bp, Homo sapiens
tactttattctt

SEQ ID NO: 213486 - DNA, 13 bp, Homo sapiens
tactttatttctg

SEQ ID NO: 213487 - DNA, 14 bp, Homo sapiens
tactttatttctga

SEQ ID NO: 213488 - DNA, 22 bp, Homo sapiens
tactttcctattttcttttcca

SEQ ID NO: 213489 - DNA, 19 bp, Homo sapiens
tactttctttcagatgttt

SEQ ID NO: 213490 - DNA, 23 bp, Homo sapiens
tactttgatattttcaacgcagc

SEQ ID NO: 213491 - DNA, 12 bp, Homo sapiens
tactttgtactt

SEQ ID NO: 213492 - DNA, 20 bp, Homo sapiens
tactttgtagatgtattttc

SEQ ID NO: 213493 - DNA, 20 bp, Homo sapiens
tactttgtttttccatgtgt

SEQ ID NO: 213494 - DNA, 22 bp, Homo sapiens
tacttttaacgtatgtatttca

SEQ ID NO: 213495 - DNA, 23 bp, Homo sapiens
tacttttaacgtatgtatttcat

SEQ ID NO: 213496 - DNA, 13 bp, Homo sapiens
tacttttgtaaat

SEQ ID NO: 213497 - DNA, 16 bp, Homo sapiens
tactttttaaaatgtt

SEQ ID NO: 213498 - DNA, 16 bp, Homo sapiens
tagaaaaaaacaaact

SEQ ID NO: 213499 - DNA, 18 bp, Homo sapiens
tagaaaaagcacagctct

SEQ ID NO: 213500 - DNA, 20 bp, Homo sapiens
tagaaaacaatgcaaaacct

SEQ ID NO: 213501 - DNA, 22 bp, Homo sapiens
tagaaaacaggaaaaaaacttt

SEQ ID NO: 213502 - DNA, 17 bp, Homo sapiens
tagaaaattatgcagct

SEQ ID NO: 213503 - DNA, 20 bp, Homo sapiens
tagaaacacacttttgcaca

SEQ ID NO: 213504 - DNA, 23 bp, Homo sapiens
tagaaacatggttttgaaatgct

SEQ ID NO: 213505 - DNA, 21 bp, Homo sapiens
tagaaactgaaaactgtaaat

SEQ ID NO: 213506 - DNA, 19 bp, Homo sapiens
tagaaagaaaagaccctga

SEQ ID NO: 213507 - DNA, 22 bp, Homo sapiens
tagaaagaaaagaccctgagac

SEQ ID NO: 213508 - DNA, 15 bp, Homo sapiens
ggatttggttgttta

SEQ ID NO: 213509 - DNA, 22 bp, Homo sapiens
ggattttctattgttactctgg

SEQ ID NO: 213510 - DNA, 12 bp, Homo sapiens
ggattttgagta

SEQ ID NO: 213511 - DNA, 16 bp, Homo sapiens
ggcaaaaatgtgccct

SEQ ID NO: 213512 - DNA, 19 bp, Homo sapiens
ggcaaaacacgcaagggca

SEQ ID NO: 213513 - DNA, 23 bp, Homo sapiens
ggcaaaaccttgtgactcagtgt

SEQ ID NO: 213514 - DNA, 12 bp, Homo sapiens
ggcaaaagacat

SEQ ID NO: 213515 - DNA, 12 bp, Homo sapiens
ggcaaacaatcc

SEQ ID NO: 213516 - DNA, 12 bp, Homo sapiens
ggcaaacattta

SEQ ID NO: 213517 - DNA, 16 bp, Homo sapiens
ggcaaagaactgcccc

SEQ ID NO: 213518 - DNA, 22 bp, Homo sapiens
ggcaaagccacaaggctggcca

SEQ ID NO: 213519 - DNA, 23 bp, Homo sapiens
ggcaaagccacaaggctggccag

SEQ ID NO: 213520 - DNA, 20 bp, Homo sapiens
ggcaaattaacttgagtttt

SEQ ID NO: 213521 - DNA, 20 bp, Homo sapiens
ggcaacagagcaagactctg

SEQ ID NO: 213522 - DNA, 18 bp, Homo sapiens
ggcaacagtgttctgagc

SEQ ID NO: 213523 - DNA, 21 bp, Homo sapiens
ggcaaccccctcggagcctgt

SEQ ID NO: 213524 - DNA, 20 bp, Homo sapiens
ggcaacgaagaaaaaaaata

SEQ ID NO: 213525 - DNA, 18 bp, Homo sapiens
ggcaagaaattcattaaa

SEQ ID NO: 213526 - DNA, 20 bp, Homo sapiens
ggcaagagaaatgaggaaga

SEQ ID NO: 213527 - DNA, 18 bp, Homo sapiens
ggcaagagctcaggagaa

SEQ ID NO: 213528 - DNA, 20 bp, Homo sapiens
ggcaagagctcaggagaagg

SEQ ID NO: 213529 - DNA, 22 bp, Homo sapiens
ggcaagagctcaggagaaggcc

SEQ ID NO: 213530 - DNA, 13 bp, Homo sapiens
ggcaagcagggaa

SEQ ID NO: 213531 - DNA, 18 bp, Homo sapiens
ggcaaggatgaaagacaa

SEQ ID NO: 213532 - DNA, 20 bp, Homo sapiens
ggcaaggtgggggagcctgg

SEQ ID NO: 213533 - DNA, 19 bp, Homo sapiens
ggcaaggttggcgactgtc

SEQ ID NO: 213534 - DNA, 20 bp, Homo sapiens
ggcaaggttggcgactgtca

SEQ ID NO: 213535 - DNA, 16 bp, Homo sapiens
ggcaagtgaggcaaga

SEQ ID NO: 213536 - DNA, 11 bp, Homo sapiens
ggcaataaatg

SEQ ID NO: 213537 - DNA, 20 bp, Homo sapiens
ggcaataaatggctcgtggg

SEQ ID NO: 213538 - DNA, 23 bp, Homo sapiens
ggcaataaatggctcgtgggctc

SEQ ID NO: 213539 - DNA, 21 bp, Homo sapiens
ggcaataaatgtcccaaataa

SEQ ID NO: 213540 - DNA, 19 bp, Homo sapiens
ggcacaatctcacacagct

SEQ ID NO: 213541 - DNA, 13 bp, Homo sapiens
ggcacaccactgc

SEQ ID NO: 213542 - DNA, 14 bp, Homo sapiens
ggcacaccactgcc

SEQ ID NO: 213543 - DNA, 16 bp, Homo sapiens
ggcacaccactgccct

SEQ ID NO: 213544 - DNA, 19 bp, Homo sapiens
ggcacactacagagcagct

SEQ ID NO: 213545 - DNA, 20 bp, Homo sapiens
ggcacactacagagcagctc

SEQ ID NO: 213546 - DNA, 14 bp, Homo sapiens
ggcacagacgactg

SEQ ID NO: 213547 - DNA, 15 bp, Homo sapiens
ggcacagccagaaac

SEQ ID NO: 213548 - DNA, 20 bp, Homo sapiens
ggcacagccggggcctgcct

SEQ ID NO: 213549 - DNA, 21 bp, Homo sapiens
ggcacagccggggcctgccta

SEQ ID NO: 213550 - DNA, 15 bp, Homo sapiens
ggcacagcctagggt

SEQ ID NO: 213551 - DNA, 18 bp, Homo sapiens
ggcacagcggggccccag

SEQ ID NO: 213552 - DNA, 18 bp, Homo sapiens
ggcacagctgctgtgcca

SEQ ID NO: 213553 - DNA, 12 bp, Homo sapiens
ggcacaggctcc

SEQ ID NO: 213554 - DNA, 16 bp, Homo sapiens
ggcacaggctcctgta

SEQ ID NO: 213555 - DNA, 14 bp, Homo sapiens
ggcacaggctgccc

SEQ ID NO: 213556 - DNA, 21 bp, Homo sapiens
ggcacaggctgccccacccct

SEQ ID NO: 213557 - DNA, 18 bp, Homo sapiens
ggcacagggtctgctctt

SEQ ID NO: 213558 - DNA, 23 bp, Homo sapiens
ggcacagttgtctattctgagcc

SEQ ID NO: 213559 - DNA, 16 bp, Homo sapiens
ggcacatttccccaga

SEQ ID NO: 213560 - DNA, 20 bp, Homo sapiens
ggcaccaaagatgcagccgc

SEQ ID NO: 213561 - DNA, 16 bp, Homo sapiens
ggcaccaagcccacag

SEQ ID NO: 213562 - DNA, 18 bp, Homo sapiens
ggcaccagccggggaaga

SEQ ID NO: 213563 - DNA, 14 bp, Homo sapiens
ggcaccagctctgt

SEQ ID NO: 213564 - DNA, 16 bp, Homo sapiens
ggcacccacccagcac

SEQ ID NO: 213565 - DNA, 16 bp, Homo sapiens
ggcacccccatgctgc

SEQ ID NO: 213566 - DNA, 17 bp, Homo sapiens
ggcacccccatgctgcc

SEQ ID NO: 213567 - DNA, 21 bp, Homo sapiens
ggcacccctccgtgtggagca

SEQ ID NO: 213568 - DNA, 12 bp, Homo sapiens
ggcaccctccca

SEQ ID NO: 213569 - DNA, 14 bp, Homo sapiens
ggcaccgcccaccc

SEQ ID NO: 213570 - DNA, 15 bp, Homo sapiens
ggcaccgcccaccca

SEQ ID NO: 213571 - DNA, 12 bp, Homo sapiens
ggcacctggcct

SEQ ID NO: 213572 - DNA, 17 bp, Homo sapiens
ggcacctggcctgctgg

SEQ ID NO: 213573 - DNA, 18 bp, Homo sapiens
ggcacctggcctgctggg

SEQ ID NO: 213574 - DNA, 11 bp, Homo sapiens
ggcacctgtat

SEQ ID NO: 213575 - DNA, 12 bp, Homo sapiens
ggcacctgtggc

SEQ ID NO: 213576 - DNA, 23 bp, Homo sapiens
ggcacctgtggccagagcacctc

SEQ ID NO: 213577 - DNA, 16 bp, Homo sapiens
ggcacgatctcagctc

SEQ ID NO: 213578 - DNA, 13 bp, Homo sapiens
ggcacgctgtggg

SEQ ID NO: 213579 - DNA, 21 bp, Homo sapiens
ggcacgcttgcgtatgtctgt

SEQ ID NO: 213580 - DNA, 15 bp, Homo sapiens
ggcacgggagagcgc

SEQ ID NO: 213581 - DNA, 14 bp, Homo sapiens
ggcacgtcctccac

SEQ ID NO: 213582 - DNA, 16 bp, Homo sapiens
ggcacgtcctccaccg

SEQ ID NO: 213583 - DNA, 13 bp, Homo sapiens
ggcactggctgct

SEQ ID NO: 213584 - DNA, 15 bp, Homo sapiens
ggcactgggccggca

SEQ ID NO: 213585 - DNA, 21 bp, Homo sapiens
ggcactgggccggcagcctgg

SEQ ID NO: 213586 - DNA, 22 bp, Homo sapiens
ggcactgggccggcagcctggt

SEQ ID NO: 213587 - DNA, 24 bp, Homo sapiens
ggcactgtactaggcgtgagaagc

SEQ ID NO: 213588 - DNA, 12 bp, Homo sapiens
cgcctggcaggt

SEQ ID NO: 213589 - DNA, 15 bp, Homo sapiens
cgcctggctccaggc

SEQ ID NO: 213590 - DNA, 16 bp, Homo sapiens
cgcctggctccaggct

SEQ ID NO: 213591 - DNA, 17 bp, Homo sapiens
cgcctgtaatcccagca

SEQ ID NO: 213592 - DNA, 17 bp, Homo sapiens
cgcctgtaatcccagct

SEQ ID NO: 213593 - DNA, 17 bp, Homo sapiens
cgcctgtgcccttgctg

SEQ ID NO: 213594 - DNA, 20 bp, Homo sapiens
cgcctgtgcccttgctgggt

SEQ ID NO: 213595 - DNA, 18 bp, Homo sapiens
cgccttccctcactcttc

SEQ ID NO: 213596 - DNA, 17 bp, Homo sapiens
cgccttccgctcccacc

SEQ ID NO: 213597 - DNA, 18 bp, Homo sapiens
cgcgagactgagaggcag

SEQ ID NO: 213598 - DNA, 18 bp, Homo sapiens
cgcggctcaaaaggaaac

SEQ ID NO: 213599 - DNA, 22 bp, Homo sapiens
cgcggctcccggggcagggcag

SEQ ID NO: 213600 - DNA, 22 bp, Homo sapiens
cgcgggcagtgacgtgagtggg

SEQ ID NO: 213601 - DNA, 17 bp, Homo sapiens
cgcgggcggccaggcaa

SEQ ID NO: 213602 - DNA, 14 bp, Homo sapiens
cgcgggggacagga

SEQ ID NO: 213603 - DNA, 15 bp, Homo sapiens
cgcgtccaaccccgg

SEQ ID NO: 213604 - DNA, 14 bp, Homo sapiens
cgcgtgacggacat

SEQ ID NO: 213605 - DNA, 21 bp, Homo sapiens
cgcgtgccttccccgtgcggc

SEQ ID NO: 213606 - DNA, 14 bp, Homo sapiens
cgctattacaaata

SEQ ID NO: 213607 - DNA, 15 bp, Homo sapiens
cgctcaacctctcag

SEQ ID NO: 213608 - DNA, 14 bp, Homo sapiens
cgctcacctgcagc

SEQ ID NO: 213609 - DNA, 16 bp, Homo sapiens
cgctcagccctccctg

SEQ ID NO: 213610 - DNA, 21 bp, Homo sapiens
cgctcagccctccctgcccct

SEQ ID NO: 213611 - DNA, 14 bp, Homo sapiens
cgctcaggacccag

SEQ ID NO: 213612 - DNA, 20 bp, Homo sapiens
cgctcaggacccaggccctc

SEQ ID NO: 213613 - DNA, 16 bp, Homo sapiens
cgctcatcttgcaaag

SEQ ID NO: 213614 - DNA, 20 bp, Homo sapiens
cgctcatgggcccctctgac

SEQ ID NO: 213615 - DNA, 19 bp, Homo sapiens
cgctcccaacacaaggtgg

SEQ ID NO: 213616 - DNA, 18 bp, Homo sapiens
cgctcccacagcttcctg

SEQ ID NO: 213617 - DNA, 18 bp, Homo sapiens
cgctcccccgcagtcccc

SEQ ID NO: 213618 - DNA, 22 bp, Homo sapiens
cgctcccccgcagtccccagcc

SEQ ID NO: 213619 - DNA, 15 bp, Homo sapiens
cgctccctgtcgcct

SEQ ID NO: 213620 - DNA, 20 bp, Homo sapiens
cgctccggcagaggcagggc

SEQ ID NO: 213621 - DNA, 23 bp, Homo sapiens
cgctcctctgcagcctgagctcc

SEQ ID NO: 213622 - DNA, 13 bp, Homo sapiens
cgctcctctgcct

SEQ ID NO: 213623 - DNA, 15 bp, Homo sapiens
cgctcctctgttcag

SEQ ID NO: 213624 - DNA, 23 bp, Homo sapiens
cgctctgaggcaaccccctcgga

SEQ ID NO: 213625 - DNA, 14 bp, Homo sapiens
cgctctgcccctcc

SEQ ID NO: 213626 - DNA, 19 bp, Homo sapiens
cgctctgttgcccaggctg

SEQ ID NO: 213627 - DNA, 21 bp, Homo sapiens
cgctcttagctttctcagggg

SEQ ID NO: 213628 - DNA, 13 bp, Homo sapiens
cgctcttcaccag

SEQ ID NO: 213629 - DNA, 15 bp, Homo sapiens
cgctcttcaccagga

SEQ ID NO: 213630 - DNA, 16 bp, Homo sapiens
cgctcttcaccaggaa

SEQ ID NO: 213631 - DNA, 18 bp, Homo sapiens
cgctcttcaccaggaaga

SEQ ID NO: 213632 - DNA, 16 bp, Homo sapiens
cgctcttggtccctgg

SEQ ID NO: 213633 - DNA, 23 bp, Homo sapiens
cgctgacaaccaccgctccccag

SEQ ID NO: 213634 - DNA, 23 bp, Homo sapiens
cgctgagggcagggttctagaag

SEQ ID NO: 213635 - DNA, 18 bp, Homo sapiens
cgctgccaccacgtctgc

SEQ ID NO: 213636 - DNA, 20 bp, Homo sapiens
cgctgccaccacgtctgcca

SEQ ID NO: 213637 - DNA, 22 bp, Homo sapiens
cgctgccaccacgtctgccagg

SEQ ID NO: 213638 - DNA, 10 bp, Homo sapiens
cggccaccct

SEQ ID NO: 213639 - DNA, 15 bp, Homo sapiens
cggccactccctgcc

SEQ ID NO: 213640 - DNA, 17 bp, Homo sapiens
cggccactccctgccaa

SEQ ID NO: 213641 - DNA, 11 bp, Homo sapiens
cggccactgca

SEQ ID NO: 213642 - DNA, 13 bp, Homo sapiens
cggccactgcagt

SEQ ID NO: 213643 - DNA, 14 bp, Homo sapiens
cggccactgcagtc

SEQ ID NO: 213644 - DNA, 17 bp, Homo sapiens
cggccagagctcccagg

SEQ ID NO: 213645 - DNA, 13 bp, Homo sapiens
cggccagctcccc

SEQ ID NO: 213646 - DNA, 23 bp, Homo sapiens
cggccagctcccccttgcccgcc

SEQ ID NO: 213647 - DNA, 15 bp, Homo sapiens
cggccaggcgggaga

SEQ ID NO: 213648 - DNA, 22 bp, Homo sapiens
cggccatgaccactttccccgt

SEQ ID NO: 213649 - DNA, 15 bp, Homo sapiens
cggcccacgcagagc

SEQ ID NO: 213650 - DNA, 16 bp, Homo sapiens
cggcccacgcagagcc

SEQ ID NO: 213651 - DNA, 18 bp, Homo sapiens
cggcccacgcagagcccc

SEQ ID NO: 213652 - DNA, 23 bp, Homo sapiens
cggcccacgcagagccccggagc

SEQ ID NO: 213653 - DNA, 15 bp, Homo sapiens
cggcccagccatggg

SEQ ID NO: 213654 - DNA, 19 bp, Homo sapiens
cggcccagccatgggccct

SEQ ID NO: 213655 - DNA, 18 bp, Homo sapiens
cggcccccgccctctgcc

SEQ ID NO: 213656 - DNA, 21 bp, Homo sapiens
cggcccccgccctctgccccc

SEQ ID NO: 213657 - DNA, 17 bp, Homo sapiens
cggccccctccatcggg

SEQ ID NO: 213658 - DNA, 22 bp, Homo sapiens
cggccccgcgcgtgcccccagc

SEQ ID NO: 213659 - DNA, 18 bp, Homo sapiens
cggcccgccgtgcctgca

SEQ ID NO: 213660 - DNA, 22 bp, Homo sapiens
cggccctgcaatgtatcccttc

SEQ ID NO: 213661 - DNA, 13 bp, Homo sapiens
cggccctgcccaa

SEQ ID NO: 213662 - DNA, 20 bp, Homo sapiens
cggccctggctggggacttg

SEQ ID NO: 213663 - DNA, 20 bp, Homo sapiens
cggcccttcctgcagcgcct

SEQ ID NO: 213664 - DNA, 18 bp, Homo sapiens
cggccgatgggagtctcc

SEQ ID NO: 213665 - DNA, 20 bp, Homo sapiens
cggccgatgggagtctccct

SEQ ID NO: 213666 - DNA, 16 bp, Homo sapiens
cggccgcccagacacc

SEQ ID NO: 213667 - DNA, 18 bp, Homo sapiens
cggccgccccgccccaga

SEQ ID NO: 213668 - DNA, 20 bp, Homo sapiens
cggccgccccgccccagagc

SEQ ID NO: 213669 - DNA, 15 bp, Homo sapiens
cggccgcctgtcctt

SEQ ID NO: 213670 - DNA, 13 bp, Homo sapiens
cggccggcctggg

SEQ ID NO: 213671 - DNA, 12 bp, Homo sapiens
cggcctccactc

SEQ ID NO: 213672 - DNA, 14 bp, Homo sapiens
cggcctccactccc

SEQ ID NO: 213673 - DNA, 21 bp, Homo sapiens
cggcctccactcccccacctg

SEQ ID NO: 213674 - DNA, 22 bp, Homo sapiens
cggcctccactcccccacctga

SEQ ID NO: 213675 - DNA, 12 bp, Homo sapiens
cggcctccaggc

SEQ ID NO: 213676 - DNA, 19 bp, Homo sapiens
cggcctcccaaagtgctgg

SEQ ID NO: 213677 - DNA, 15 bp, Homo sapiens
cggcctccgaggctc

SEQ ID NO: 213678 - DNA, 16 bp, Homo sapiens
cggcctccgaggctcc

SEQ ID NO: 213679 - DNA, 13 bp, Homo sapiens
cggcctcttccac

SEQ ID NO: 213680 - DNA, 17 bp, Homo sapiens
cggcctcttccacccat

SEQ ID NO: 213681 - DNA, 19 bp, Homo sapiens
cggcctgctcccagcagcc

SEQ ID NO: 213682 - DNA, 22 bp, Homo sapiens
cggcctggggccgggctggctt

SEQ ID NO: 213683 - DNA, 21 bp, Homo sapiens
cggcctgtgcgttcccttcag

SEQ ID NO: 213684 - DNA, 13 bp, Homo sapiens
cggcgccaccatc

SEQ ID NO: 213685 - DNA, 17 bp, Homo sapiens
cggcgcccccagtgtgc

SEQ ID NO: 213686 - DNA, 22 bp, Homo sapiens
cggctaccccccgtctcctgcc

SEQ ID NO: 213687 - DNA, 21 bp, Homo sapiens
cggctaggccggccagctccc

SEQ ID NO: 213688 - DNA, 15 bp, Homo sapiens
cggctccccctgcca

SEQ ID NO: 213689 - DNA, 16 bp, Homo sapiens
cggctccccctgccag

SEQ ID NO: 213690 - DNA, 17 bp, Homo sapiens
cggctccccctgccagc

SEQ ID NO: 213691 - DNA, 21 bp, Homo sapiens
cggctcccggggcagggcagc

SEQ ID NO: 213692 - DNA, 20 bp, Homo sapiens
cggctccgagggcggccagg

SEQ ID NO: 213693 - DNA, 14 bp, Homo sapiens
cggctcctccccga

SEQ ID NO: 213694 - DNA, 16 bp, Homo sapiens
cggctctcgtccctct

SEQ ID NO: 213695 - DNA, 11 bp, Homo sapiens
cggctctgccg

SEQ ID NO: 213696 - DNA, 11 bp, Homo sapiens
cggctgagagc

SEQ ID NO: 213697 - DNA, 14 bp, Homo sapiens
cggctgagagcccc

SEQ ID NO: 213698 - DNA, 15 bp, Homo sapiens
cggctgagagcccca

SEQ ID NO: 213699 - DNA, 16 bp, Homo sapiens
cggctgagagccccag

SEQ ID NO: 213700 - DNA, 17 bp, Homo sapiens
cggctgagagccccagc

SEQ ID NO: 213701 - DNA, 20 bp, Homo sapiens
cggctgagagccccagctga

SEQ ID NO: 213702 - DNA, 23 bp, Homo sapiens
cggctgaggacggggcagagctg

SEQ ID NO: 213703 - DNA, 11 bp, Homo sapiens
cggctgcctgc

SEQ ID NO: 213704 - DNA, 13 bp, Homo sapiens
cggctgcctgccg

SEQ ID NO: 213705 - DNA, 14 bp, Homo sapiens
cggctggaaagagg

SEQ ID NO: 213706 - DNA, 19 bp, Homo sapiens
cggctggaaagaggagaag

SEQ ID NO: 213707 - DNA, 23 bp, Homo sapiens
cggctggaaagaggagaaggaga

SEQ ID NO: 213708 - DNA, 20 bp, Homo sapiens
cggctggacttttgcagctt

SEQ ID NO: 213709 - DNA, 21 bp, Homo sapiens
cggctgggagcctcgcccctc

SEQ ID NO: 213710 - DNA, 22 bp, Homo sapiens
cggctgggagcctcgcccctcc

SEQ ID NO: 213711 - DNA, 17 bp, Homo sapiens
cggctgggcagggccgc

SEQ ID NO: 213712 - DNA, 20 bp, Homo sapiens
cggctgggcagggccgcagg

SEQ ID NO: 213713 - DNA, 21 bp, Homo sapiens
cggctgggtcggccctgccca

SEQ ID NO: 213714 - DNA, 22 bp, Homo sapiens
cggctgggtcggccctgcccaa

SEQ ID NO: 213715 - DNA, 15 bp, Homo sapiens
cggcttcctgtccac

SEQ ID NO: 213716 - DNA, 16 bp, Homo sapiens
cggcttgtgggctggt

SEQ ID NO: 213717 - DNA, 22 bp, Homo sapiens
cgggaaagccagtgactccagg

SEQ ID NO: 213718 - DNA, 13 bp, Homo sapiens
cgggaaattctgc

SEQ ID NO: 213719 - DNA, 12 bp, Homo sapiens
cgggaagagagg

SEQ ID NO: 213720 - DNA, 19 bp, Homo sapiens
cgggaagagaggagttcaa

SEQ ID NO: 213721 - DNA, 24 bp, Homo sapiens
cgggaagagaggagttcaatgatc

SEQ ID NO: 213722 - DNA, 13 bp, Homo sapiens
cgggacagcggcc

SEQ ID NO: 213723 - DNA, 24 bp, Homo sapiens
cgggaccacagctgctggccaggg

SEQ ID NO: 213724 - DNA, 17 bp, Homo sapiens
cgggaccattgacctca

SEQ ID NO: 213725 - DNA, 19 bp, Homo sapiens
cgggaccattgacctcagc

SEQ ID NO: 213726 - DNA, 20 bp, Homo sapiens
cgggacccccggcctccagg

SEQ ID NO: 213727 - DNA, 21 bp, Homo sapiens
cgggagaatcatgtgaacccg

SEQ ID NO: 213728 - DNA, 16 bp, Homo sapiens
cgggagacctgtgcta

SEQ ID NO: 213729 - DNA, 13 bp, Homo sapiens
cgggagagagtga

SEQ ID NO: 213730 - DNA, 20 bp, Homo sapiens
cgggagagagtgagagagag

SEQ ID NO: 213731 - DNA, 18 bp, Homo sapiens
cgggagagcgccacccgc

SEQ ID NO: 213732 - DNA, 15 bp, Homo sapiens
cgggagatccgccct

SEQ ID NO: 213733 - DNA, 20 bp, Homo sapiens
cgggagatccgccctgggct

SEQ ID NO: 213734 - DNA, 21 bp, Homo sapiens
cgggagatccgccctgggctc

SEQ ID NO: 213735 - DNA, 22 bp, Homo sapiens
cgggagatggacccctcccttg

SEQ ID NO: 213736 - DNA, 15 bp, Homo sapiens
cgggagcagtgtctt

SEQ ID NO: 213737 - DNA, 23 bp, Homo sapiens
cgggagcagtgtcttccataatg

SEQ ID NO: 213738 - DNA, 21 bp, Homo sapiens
cgggagcctgcgtggcctggg

SEQ ID NO: 213739 - DNA, 16 bp, Homo sapiens
cgggaggcaccagctc

SEQ ID NO: 213740 - DNA, 20 bp, Homo sapiens
cgggaggcaccagctctgtg

SEQ ID NO: 213741 - DNA, 23 bp, Homo sapiens
cgggaggccacgggggaggccga

SEQ ID NO: 213742 - DNA, 18 bp, Homo sapiens
cgggcacagctgtggtga

SEQ ID NO: 213743 - DNA, 17 bp, Homo sapiens
cgggcagcccctgctgg

SEQ ID NO: 213744 - DNA, 12 bp, Homo sapiens
cgggccaaggac

SEQ ID NO: 213745 - DNA, 21 bp, Homo sapiens
cgggcccgctcaacctctcag

SEQ ID NO: 213746 - DNA, 11 bp, Homo sapiens
cgggccctccc

SEQ ID NO: 213747 - DNA, 13 bp, Homo sapiens
cgggccctctgcc

SEQ ID NO: 213748 - DNA, 23 bp, Homo sapiens
cgggcctccccgggggtccccgg

SEQ ID NO: 213749 - DNA, 20 bp, Homo sapiens
cgggcctggagaactagaga

SEQ ID NO: 213750 - DNA, 12 bp, Homo sapiens
cgggcgcctgcg

SEQ ID NO: 213751 - DNA, 14 bp, Homo sapiens
cgggcgcctgcgct

SEQ ID NO: 213752 - DNA, 16 bp, Homo sapiens
cgggcgcctgcgctcc

SEQ ID NO: 213753 - DNA, 17 bp, Homo sapiens
cgggcgcctgcgctcct

SEQ ID NO: 213754 - DNA, 20 bp, Homo sapiens
cgggcgcctgcgctcctctg

SEQ ID NO: 213755 - DNA, 23 bp, Homo sapiens
cgggcgcctgcgctcctctgcag

SEQ ID NO: 213756 - DNA, 16 bp, Homo sapiens
cgggctctggccaccc

SEQ ID NO: 213757 - DNA, 17 bp, Homo sapiens
cgggctctggccaccct

SEQ ID NO: 213758 - DNA, 13 bp, Homo sapiens
cgggctggcttct

SEQ ID NO: 213759 - DNA, 20 bp, Homo sapiens
cgggctgggagctctgcaga

SEQ ID NO: 213760 - DNA, 20 bp, Homo sapiens
cgggctttccagaaggccac

SEQ ID NO: 213761 - DNA, 22 bp, Homo sapiens
cggggaaggtttttatgtgcct

SEQ ID NO: 213762 - DNA, 18 bp, Homo sapiens
cggggaggagccttggag

SEQ ID NO: 213763 - DNA, 23 bp, Homo sapiens
cggggaggccaagtgcaggctgg

SEQ ID NO: 213764 - DNA, 19 bp, Homo sapiens
cggggagtgagactcctga

SEQ ID NO: 213765 - DNA, 15 bp, Homo sapiens
cggggcaagagggaa

SEQ ID NO: 213766 - DNA, 16 bp, Homo sapiens
cggggcaaggtctcct

SEQ ID NO: 213767 - DNA, 13 bp, Homo sapiens
cggggcagctggc

SEQ ID NO: 213768 - DNA, 23 bp, Homo sapiens
ggaaagctcagctactgattttt

SEQ ID NO: 213769 - DNA, 15 bp, Homo sapiens
ggaaaggacccaccc

SEQ ID NO: 213770 - DNA, 16 bp, Homo sapiens
ggaaaggcatctaaga

SEQ ID NO: 213771 - DNA, 15 bp, Homo sapiens
ggaaaggggcgagca

SEQ ID NO: 213772 - DNA, 20 bp, Homo sapiens
ggaaagggtgctgcttccct

SEQ ID NO: 213773 - DNA, 23 bp, Homo sapiens
ggaaaggtcattgtggctatctg

SEQ ID NO: 213774 - DNA, 18 bp, Homo sapiens
ggaaagtgaatttgaatg

SEQ ID NO: 213775 - DNA, 19 bp, Homo sapiens
ggaaagtgaatttgaatga

SEQ ID NO: 213776 - DNA, 16 bp, Homo sapiens
ggaaataacagtattt

SEQ ID NO: 213777 - DNA, 20 bp, Homo sapiens
ggaaataatgggaaaggttg

SEQ ID NO: 213778 - DNA, 21 bp, Homo sapiens
ggaaatacactacaaatgtta

SEQ ID NO: 213779 - DNA, 12 bp, Homo sapiens
ggaaatattaaa

SEQ ID NO: 213780 - DNA, 22 bp, Homo sapiens
ggaaatgctattgttgtgggct

SEQ ID NO: 213781 - DNA, 14 bp, Homo sapiens
ggaaattctgctgc

SEQ ID NO: 213782 - DNA, 16 bp, Homo sapiens
ggaaattctgctgctt

SEQ ID NO: 213783 - DNA, 15 bp, Homo sapiens
ggaaattgcaaagaa

SEQ ID NO: 213784 - DNA, 15 bp, Homo sapiens
ggaacaaggcaaggc

SEQ ID NO: 213785 - DNA, 17 bp, Homo sapiens
ggaacaaggcaaggctg

SEQ ID NO: 213786 - DNA, 21 bp, Homo sapiens
ggaacaaggcaaggctgtcaa

SEQ ID NO: 213787 - DNA, 15 bp, Homo sapiens
ggaacaagtgtacag

SEQ ID NO: 213788 - DNA, 17 bp, Homo sapiens
ggaacaagtgtacagaa

SEQ ID NO: 213789 - DNA, 19 bp, Homo sapiens
ggaacaagtgtacagaaga

SEQ ID NO: 213790 - DNA, 18 bp, Homo sapiens
ggaacaatcacaaaagct

SEQ ID NO: 213791 - DNA, 12 bp, Homo sapiens
ggaacacacaca

SEQ ID NO: 213792 - DNA, 16 bp, Homo sapiens
ggaacacccagcccca

SEQ ID NO: 213793 - DNA, 16 bp, Homo sapiens
ggaacacccggaaaga

SEQ ID NO: 213794 - DNA, 13 bp, Homo sapiens
ggaacacctcctc

SEQ ID NO: 213795 - DNA, 20 bp, Homo sapiens
ggaacagctatgggagcccc

SEQ ID NO: 213796 - DNA, 16 bp, Homo sapiens
ggaacaggaaactgat

SEQ ID NO: 213797 - DNA, 23 bp, Homo sapiens
ggaacaggaggaactggtccagg

SEQ ID NO: 213798 - DNA, 14 bp, Homo sapiens
ggaacagtggctgg

SEQ ID NO: 213799 - DNA, 23 bp, Homo sapiens
ggaacatgtcggagtagaaattg

SEQ ID NO: 213800 - DNA, 17 bp, Homo sapiens
ggaaccagccctccaga

SEQ ID NO: 213801 - DNA, 19 bp, Homo sapiens
ggaaccccgcagcccgtga

SEQ ID NO: 213802 - DNA, 17 bp, Homo sapiens
ggaacccgactgtgaaa

SEQ ID NO: 213803 - DNA, 16 bp, Homo sapiens
ggaacccggtcccagg

SEQ ID NO: 213804 - DNA, 18 bp, Homo sapiens
ggaacccggtcccaggcc

SEQ ID NO: 213805 - DNA, 22 bp, Homo sapiens
ggaacctccctgggcctgtctc

SEQ ID NO: 213806 - DNA, 18 bp, Homo sapiens
ggaacctgacgtagctgc

SEQ ID NO: 213807 - DNA, 18 bp, Homo sapiens
ggaacctggaccaaagct

SEQ ID NO: 213808 - DNA, 13 bp, Homo sapiens
ggaacctggctgc

SEQ ID NO: 213809 - DNA, 20 bp, Homo sapiens
ggaacgtggttcagagactg

SEQ ID NO: 213810 - DNA, 23 bp, Homo sapiens
ggaactaaagggtgtgggtcagg

SEQ ID NO: 213811 - DNA, 14 bp, Homo sapiens
ggaactccactctc

SEQ ID NO: 213812 - DNA, 15 bp, Homo sapiens
ggaactccttggcct

SEQ ID NO: 213813 - DNA, 16 bp, Homo sapiens
ggaactccttggccta

SEQ ID NO: 213814 - DNA, 18 bp, Homo sapiens
ggaactctaccctggtag

SEQ ID NO: 213815 - DNA, 18 bp, Homo sapiens
ggaactctatctgggcct

SEQ ID NO: 213816 - DNA, 21 bp, Homo sapiens
ggaactctatctgggcctggg

SEQ ID NO: 213817 - DNA, 21 bp, Homo sapiens
ggaactctcctgctcctcagg

SEQ ID NO: 213818 - DNA, 16 bp, Homo sapiens
ggaactctgtgcaggt

SEQ ID NO: 213819 - DNA, 17 bp, Homo sapiens
ggaactgggaagatgct

SEQ ID NO: 213820 - DNA, 17 bp, Homo sapiens
ggaactggtccaggcca

SEQ ID NO: 213821 - DNA, 18 bp, Homo sapiens
ggaactggtccaggccag

SEQ ID NO: 213822 - DNA, 23 bp, Homo sapiens
ggaactggtccaggccaggcctc

SEQ ID NO: 213823 - DNA, 13 bp, Homo sapiens
ggaagaacagtac

SEQ ID NO: 213824 - DNA, 17 bp, Homo sapiens
ggaagaaggcccgggag

SEQ ID NO: 213825 - DNA, 17 bp, Homo sapiens
ggaagaataaaaaagaa

SEQ ID NO: 213826 - DNA, 21 bp, Homo sapiens
ggaagaccaaggcctcggcag

SEQ ID NO: 213827 - DNA, 15 bp, Homo sapiens
ggaagaccccaccca

SEQ ID NO: 213828 - DNA, 14 bp, Homo sapiens
ggaagactggagac

SEQ ID NO: 213829 - DNA, 14 bp, Homo sapiens
ggaagagagcctgc

SEQ ID NO: 213830 - DNA, 15 bp, Homo sapiens
ggaagagagcctgcc

SEQ ID NO: 213831 - DNA, 19 bp, Homo sapiens
ggaagagaggagttcaatg

SEQ ID NO: 213832 - DNA, 21 bp, Homo sapiens
ggaagagaggcacctgctgga

SEQ ID NO: 213833 - DNA, 15 bp, Homo sapiens
ggaagagcagcctga

SEQ ID NO: 213834 - DNA, 14 bp, Homo sapiens
ggaagaggccttgg

SEQ ID NO: 213835 - DNA, 23 bp, Homo sapiens
ggaagaggccttgggggtctgct

SEQ ID NO: 213836 - DNA, 16 bp, Homo sapiens
ggaagagggctgagct

SEQ ID NO: 213837 - DNA, 23 bp, Homo sapiens
ggaagaggttctcagcaagtgta

SEQ ID NO: 213838 - DNA, 22 bp, Homo sapiens
ggaagatcttaaattttgtgat

SEQ ID NO: 213839 - DNA, 23 bp, Homo sapiens
ggaagatcttaaattttgtgata

SEQ ID NO: 213840 - DNA, 14 bp, Homo sapiens
ggaagatgctggcc

SEQ ID NO: 213841 - DNA, 21 bp, Homo sapiens
ggaagatttaccttttctgtt

SEQ ID NO: 213842 - DNA, 22 bp, Homo sapiens
ggaagcacaagaagtgggagtg

SEQ ID NO: 213843 - DNA, 15 bp, Homo sapiens
ggaagcacaggccag

SEQ ID NO: 213844 - DNA, 15 bp, Homo sapiens
ggaagcagagcactg

SEQ ID NO: 213845 - DNA, 17 bp, Homo sapiens
ggaagcagggacacccc

SEQ ID NO: 213846 - DNA, 19 bp, Homo sapiens
ggaagcagtgccttccata

SEQ ID NO: 213847 - DNA, 20 bp, Homo sapiens
ggaagcagtgccttccataa

SEQ ID NO: 213848 - DNA, 21 bp, Homo sapiens
ggaagcagtgccttccataat

SEQ ID NO: 213849 - DNA, 14 bp, Homo sapiens
ggaagcccacccgc

SEQ ID NO: 213850 - DNA, 22 bp, Homo sapiens
ggaagccgtctgactccagagt

SEQ ID NO: 213851 - DNA, 15 bp, Homo sapiens
ggaagcctcctgctg

SEQ ID NO: 213852 - DNA, 19 bp, Homo sapiens
ggaagcctcctgctgagtg

SEQ ID NO: 213853 - DNA, 11 bp, Homo sapiens
ggaagcctgtc

SEQ ID NO: 213854 - DNA, 14 bp, Homo sapiens
ggaagcctgtcctc

SEQ ID NO: 213855 - DNA, 13 bp, Homo sapiens
ggaagctgaggcg

SEQ ID NO: 213856 - DNA, 14 bp, Homo sapiens
ggaagctgcagctt

SEQ ID NO: 213857 - DNA, 15 bp, Homo sapiens
ggaagctgcagcttg

SEQ ID NO: 213858 - DNA, 16 bp, Homo sapiens
ggaagctgcagcttgg

SEQ ID NO: 213859 - DNA, 16 bp, Homo sapiens
ggaagctggagtgctg

SEQ ID NO: 213860 - DNA, 19 bp, Homo sapiens
ggaagctgtactcagagca

SEQ ID NO: 213861 - DNA, 16 bp, Homo sapiens
cctggagttctggttc

SEQ ID NO: 213862 - DNA, 21 bp, Homo sapiens
cctggatggatctgctccatg

SEQ ID NO: 213863 - DNA, 23 bp, Homo sapiens
cctggatggatctgctccatgca

SEQ ID NO: 213864 - DNA, 20 bp, Homo sapiens
cctggatgggcattgggctg

SEQ ID NO: 213865 - DNA, 17 bp, Homo sapiens
cctggatgtgtggggca

SEQ ID NO: 213866 - DNA, 20 bp, Homo sapiens
cctggattttctttctatgt

SEQ ID NO: 213867 - DNA, 19 bp, Homo sapiens
cctggcaatagtgtgttct

SEQ ID NO: 213868 - DNA, 19 bp, Homo sapiens
cctggcacagaaagggcag

SEQ ID NO: 213869 - DNA, 20 bp, Homo sapiens
cctggcacagaaagggcagc

SEQ ID NO: 213870 - DNA, 13 bp, Homo sapiens
cctggcagaactg

SEQ ID NO: 213871 - DNA, 14 bp, Homo sapiens
cctggcagaactga

SEQ ID NO: 213872 - DNA, 21 bp, Homo sapiens
cctggcagccgtgccttcagc

SEQ ID NO: 213873 - DNA, 20 bp, Homo sapiens
cctggcagggaggtcaggcc

SEQ ID NO: 213874 - DNA, 23 bp, Homo sapiens
cctggcagggaggtcaggccctg

SEQ ID NO: 213875 - DNA, 13 bp, Homo sapiens
cctggcagggcag

SEQ ID NO: 213876 - DNA, 21 bp, Homo sapiens
cctggcagggcaggcagagct

SEQ ID NO: 213877 - DNA, 22 bp, Homo sapiens
cctggcagggcaggcagagctc

SEQ ID NO: 213878 - DNA, 13 bp, Homo sapiens
cctggcatgggaa

SEQ ID NO: 213879 - DNA, 13 bp, Homo sapiens
cctggccagaggc

SEQ ID NO: 213880 - DNA, 14 bp, Homo sapiens
cctggccagaggct

SEQ ID NO: 213881 - DNA, 13 bp, Homo sapiens
cctggccaggagc

SEQ ID NO: 213882 - DNA, 13 bp, Homo sapiens
cctggccatctct

SEQ ID NO: 213883 - DNA, 19 bp, Homo sapiens
cctggcccagagctggaac

SEQ ID NO: 213884 - DNA, 13 bp, Homo sapiens
cctggcccagcca

SEQ ID NO: 213885 - DNA, 15 bp, Homo sapiens
cctggcccagccagc

SEQ ID NO: 213886 - DNA, 20 bp, Homo sapiens
cctggcccagcggcccctcc

SEQ ID NO: 213887 - DNA, 14 bp, Homo sapiens
cctggcccatctca

SEQ ID NO: 213888 - DNA, 19 bp, Homo sapiens
cctggcccatctcagcctc

SEQ ID NO: 213889 - DNA, 22 bp, Homo sapiens
cctggcccatctcagcctcctg

SEQ ID NO: 213890 - DNA, 14 bp, Homo sapiens
cctggcccccagct

SEQ ID NO: 213891 - DNA, 17 bp, Homo sapiens
cctggcccccctccagg

SEQ ID NO: 213892 - DNA, 18 bp, Homo sapiens
cctggcccccctccaggc

SEQ ID NO: 213893 - DNA, 19 bp, Homo sapiens
cctggcccccctccaggca

SEQ ID NO: 213894 - DNA, 15 bp, Homo sapiens
cctggcccctcccac

SEQ ID NO: 213895 - DNA, 19 bp, Homo sapiens
cctggcccctcccacatcc

SEQ ID NO: 213896 - DNA, 15 bp, Homo sapiens
cctggcccgcccctc

SEQ ID NO: 213897 - DNA, 15 bp, Homo sapiens
cctggccctctgtgt

SEQ ID NO: 213898 - DNA, 12 bp, Homo sapiens
cctggccctgcc

SEQ ID NO: 213899 - DNA, 18 bp, Homo sapiens
cctggccgggtcaccctg

SEQ ID NO: 213900 - DNA, 17 bp, Homo sapiens
cctggcctcactggctg

SEQ ID NO: 213901 - DNA, 12 bp, Homo sapiens
cctggcctcagc

SEQ ID NO: 213902 - DNA, 15 bp, Homo sapiens
cctggcctcccctgc

SEQ ID NO: 213903 - DNA, 16 bp, Homo sapiens
cctggcctcccctgcg

SEQ ID NO: 213904 - DNA, 21 bp, Homo sapiens
cctggcctcggggcagggcag

SEQ ID NO: 213905 - DNA, 15 bp, Homo sapiens
cctggcctgagctgg

SEQ ID NO: 213906 - DNA, 17 bp, Homo sapiens
cctggcctgagctgggg

SEQ ID NO: 213907 - DNA, 16 bp, Homo sapiens
cctggcctggccctgc

SEQ ID NO: 213908 - DNA, 17 bp, Homo sapiens
cctggcctggccctgcc

SEQ ID NO: 213909 - DNA, 20 bp, Homo sapiens
cctggcctggccctgccctg

SEQ ID NO: 213910 - DNA, 12 bp, Homo sapiens
cctggcctgggt

SEQ ID NO: 213911 - DNA, 13 bp, Homo sapiens
cctggcctggtcc

SEQ ID NO: 213912 - DNA, 16 bp, Homo sapiens
cctggcctggtccagg

SEQ ID NO: 213913 - DNA, 11 bp, Homo sapiens
cctggcctgtt

SEQ ID NO: 213914 - DNA, 16 bp, Homo sapiens
cctggcgggcagcccc

SEQ ID NO: 213915 - DNA, 19 bp, Homo sapiens
cctggcgggcagcccctgc

SEQ ID NO: 213916 - DNA, 23 bp, Homo sapiens
cctggcgggcagcccctgctgga

SEQ ID NO: 213917 - DNA, 14 bp, Homo sapiens
cctggctacatccc

SEQ ID NO: 213918 - DNA, 12 bp, Homo sapiens
cctggctcacag

SEQ ID NO: 213919 - DNA, 22 bp, Homo sapiens
cctggctcacagccaccacctg

SEQ ID NO: 213920 - DNA, 19 bp, Homo sapiens
cctggctccaggctccagg

SEQ ID NO: 213921 - DNA, 17 bp, Homo sapiens
cctggctcccaggacac

SEQ ID NO: 213922 - DNA, 15 bp, Homo sapiens
cctggctcccatgac

SEQ ID NO: 213923 - DNA, 16 bp, Homo sapiens
cctggctccccacgag

SEQ ID NO: 213924 - DNA, 21 bp, Homo sapiens
cctggctccccacgagtcacc

SEQ ID NO: 213925 - DNA, 23 bp, Homo sapiens
cctggctccccacgagtcacctg

SEQ ID NO: 213926 - DNA, 22 bp, Homo sapiens
cctggctctgtcaccgccatgc

SEQ ID NO: 213927 - DNA, 20 bp, Homo sapiens
cctggctctgtggcttgcta

SEQ ID NO: 213928 - DNA, 16 bp, Homo sapiens
cctggctgccaggcgt

SEQ ID NO: 213929 - DNA, 20 bp, Homo sapiens
cctggctgcgaactgtgcag

SEQ ID NO: 213930 - DNA, 21 bp, Homo sapiens
cctggctggggacttggccgc

SEQ ID NO: 213931 - DNA, 22 bp, Homo sapiens
cctggctggtaagggccaagtc

SEQ ID NO: 213932 - DNA, 12 bp, Homo sapiens
cctggctgtaaa

SEQ ID NO: 213933 - DNA, 16 bp, Homo sapiens
cctggctgtgagcagc

SEQ ID NO: 213934 - DNA, 19 bp, Homo sapiens
cctggctgtgagcagcctc

SEQ ID NO: 213935 - DNA, 12 bp, Homo sapiens
cctggctgtgca

SEQ ID NO: 213936 - DNA, 21 bp, Homo sapiens
cctggctgtgcacattctccc

SEQ ID NO: 213937 - DNA, 15 bp, Homo sapiens
cctggctgtggaggc

SEQ ID NO: 213938 - DNA, 14 bp, Homo sapiens
cctggcttcccagg

SEQ ID NO: 213939 - DNA, 22 bp, Homo sapiens
cctggcttcccaggaccctggg

SEQ ID NO: 213940 - DNA, 22 bp, Homo sapiens
cctggcttctttctctcagcct

SEQ ID NO: 213941 - DNA, 14 bp, Homo sapiens
cctggcttgctcca

SEQ ID NO: 213942 - DNA, 18 bp, Homo sapiens
cctggcttgctccagggt

SEQ ID NO: 213943 - DNA, 19 bp, Homo sapiens
cctggcttgctccagggtc

SEQ ID NO: 213944 - DNA, 15 bp, Homo sapiens
cctggctttgcccaa

SEQ ID NO: 213945 - DNA, 20 bp, Homo sapiens
cctggctttgcccaacctca

SEQ ID NO: 213946 - DNA, 20 bp, Homo sapiens
cctggcttttcactgctggc

SEQ ID NO: 213947 - DNA, 23 bp, Homo sapiens
cctggcttttcactgctggctgc

SEQ ID NO: 213948 - DNA, 24 bp, Homo sapiens
cctggcttttcactgctggctgcc

SEQ ID NO: 213949 - DNA, 15 bp, Homo sapiens
cctgggaaaggaccc

SEQ ID NO: 213950 - DNA, 18 bp, Homo sapiens
cctgggaaaggacccacc

SEQ ID NO: 213951 - DNA, 20 bp, Homo sapiens
cctgggaaccttcctgtctt

SEQ ID NO: 213952 - DNA, 21 bp, Homo sapiens
cctgggaacggggtggacgag

SEQ ID NO: 213953 - DNA, 20 bp, Homo sapiens
cctgggaaggagggagctgc

SEQ ID NO: 213954 - DNA, 21 bp, Homo sapiens
cctgggaaggagggagctgct

SEQ ID NO: 213955 - DNA, 23 bp, Homo sapiens
cctgggaaggagggagctgctca

SEQ ID NO: 213956 - DNA, 21 bp, Homo sapiens
cctgggaaggctactcacctt

SEQ ID NO: 213957 - DNA, 14 bp, Homo sapiens
cctgggaagtggag

SEQ ID NO: 213958 - DNA, 12 bp, Homo sapiens
cctgggacccag

SEQ ID NO: 213959 - DNA, 13 bp, Homo sapiens
cctgggacccagc

SEQ ID NO: 213960 - DNA, 14 bp, Homo sapiens
cctgggacccagct

SEQ ID NO: 213961 - DNA, 15 bp, Homo sapiens
cctgggacccagcta

SEQ ID NO: 213962 - DNA, 18 bp, Homo sapiens
cctgggacccagctactc

SEQ ID NO: 213963 - DNA, 15 bp, Homo sapiens
cctgggactcccagt

SEQ ID NO: 213964 - DNA, 14 bp, Homo sapiens
cctgggagagtgag

SEQ ID NO: 213965 - DNA, 20 bp, Homo sapiens
cctgggagggcaagggtcct

SEQ ID NO: 213966 - DNA, 21 bp, Homo sapiens
cctgggagggtggttcctgtt

SEQ ID NO: 213967 - DNA, 18 bp, Homo sapiens
gcgtgtgcgtgcatgtgc

SEQ ID NO: 213968 - DNA, 16 bp, Homo sapiens
gcgtgtggccctgtgg

SEQ ID NO: 213969 - DNA, 21 bp, Homo sapiens
gcgtgtggctcacgtgtgtga

SEQ ID NO: 213970 - DNA, 18 bp, Homo sapiens
gcgtgtgtccatgtgtgt

SEQ ID NO: 213971 - DNA, 13 bp, Homo sapiens
gcgtgtgtccctg

SEQ ID NO: 213972 - DNA, 17 bp, Homo sapiens
gcgtgtgtccctgtggt

SEQ ID NO: 213973 - DNA, 20 bp, Homo sapiens
gcgttaacacagtaaaatat

SEQ ID NO: 213974 - DNA, 21 bp, Homo sapiens
gcgttcctgccaggctctccc

SEQ ID NO: 213975 - DNA, 15 bp, Homo sapiens
gcgttggagccactc

SEQ ID NO: 213976 - DNA, 21 bp, Homo sapiens
gcgttggagccactcctgtcc

SEQ ID NO: 213977 - DNA, 23 bp, Homo sapiens
gcgttggatttaaaaatgccaaa

SEQ ID NO: 213978 - DNA, 16 bp, Homo sapiens
gcgttgttacaggaag

SEQ ID NO: 213979 - DNA, 12 bp, Homo sapiens
gcgttttagagt

SEQ ID NO: 213980 - DNA, 16 bp, Homo sapiens
gctaaagaggtggggt

SEQ ID NO: 213981 - DNA, 23 bp, Homo sapiens
gctaaagaggtggggtgaagctg

SEQ ID NO: 213982 - DNA, 18 bp, Homo sapiens
gctaaaggggagaaactg

SEQ ID NO: 213983 - DNA, 20 bp, Homo sapiens
gctaaatttacgtatatttc

SEQ ID NO: 213984 - DNA, 16 bp, Homo sapiens
gctaacactggcccct

SEQ ID NO: 213985 - DNA, 17 bp, Homo sapiens
gctaacactggccccta

SEQ ID NO: 213986 - DNA, 18 bp, Homo sapiens
gctaacatggaagtacta

SEQ ID NO: 213987 - DNA, 13 bp, Homo sapiens
gctaacattttaa

SEQ ID NO: 213988 - DNA, 17 bp, Homo sapiens
gctaacattttaaataa

SEQ ID NO: 213989 - DNA, 21 bp, Homo sapiens
gctaacattttaaataaaaga

SEQ ID NO: 213990 - DNA, 23 bp, Homo sapiens
gctaacattttaaataaaagaaa

SEQ ID NO: 213991 - DNA, 22 bp, Homo sapiens
gcccatttcacacctgaaaatg

SEQ ID NO: 213992 - DNA, 15 bp, Homo sapiens
gccccaaaaccacag

SEQ ID NO: 213993 - DNA, 22 bp, Homo sapiens
gccccaaaaccacagccctgtc

SEQ ID NO: 213994 - DNA, 17 bp, Homo sapiens
gccccaaacaaatatgc

SEQ ID NO: 213995 - DNA, 18 bp, Homo sapiens
gccccaaacaaatatgca

SEQ ID NO: 213996 - DNA, 14 bp, Homo sapiens
gccccaaagcccag

SEQ ID NO: 213997 - DNA, 18 bp, Homo sapiens
gccccaaagcccagcccg

SEQ ID NO: 213998 - DNA, 19 bp, Homo sapiens
gccccaactccaggggcac

SEQ ID NO: 213999 - DNA, 17 bp, Homo sapiens
gccccaagaaggctggg

SEQ ID NO: 214000 - DNA, 21 bp, Homo sapiens
gccccaagaaggctggggcta

SEQ ID NO: 214001 - DNA, 22 bp, Homo sapiens
gccccaagaggctagccccagg

SEQ ID NO: 214002 - DNA, 14 bp, Homo sapiens
gccccaagccctgc

SEQ ID NO: 214003 - DNA, 21 bp, Homo sapiens
gccccaatatggtggccctgg

SEQ ID NO: 214004 - DNA, 23 bp, Homo sapiens
gccccaatatggtggccctgggg

SEQ ID NO: 214005 - DNA, 14 bp, Homo sapiens
gccccacacaggcc

SEQ ID NO: 214006 - DNA, 15 bp, Homo sapiens
gccccacacaggcct

SEQ ID NO: 214007 - DNA, 18 bp, Homo sapiens
gccccacacaggcctggc

SEQ ID NO: 214008 - DNA, 23 bp, Homo sapiens
gccccacacggactcccgggcca

SEQ ID NO: 214009 - DNA, 10 bp, Homo sapiens
gccccacagc

SEQ ID NO: 214010 - DNA, 14 bp, Homo sapiens
gccccacagctacc

SEQ ID NO: 214011 - DNA, 17 bp, Homo sapiens
gccccacagctacctga

SEQ ID NO: 214012 - DNA, 21 bp, Homo sapiens
gccccacagctacctgagacg

SEQ ID NO: 214013 - DNA, 19 bp, Homo sapiens
gccccacaggccacacgct

SEQ ID NO: 214014 - DNA, 17 bp, Homo sapiens
gccccacccaccctctg

SEQ ID NO: 214015 - DNA, 15 bp, Homo sapiens
gccccacccagggct

SEQ ID NO: 214016 - DNA, 23 bp, Homo sapiens
gccccacccagggctccctcctg

SEQ ID NO: 214017 - DNA, 20 bp, Homo sapiens
gccccacccctaagtgccca

SEQ ID NO: 214018 - DNA, 23 bp, Homo sapiens
gccccacccctaagtgcccaaag

SEQ ID NO: 214019 - DNA, 21 bp, Homo sapiens
gccccaccctcaaaccctgtg

SEQ ID NO: 214020 - DNA, 22 bp, Homo sapiens
gccccaccctcgtggacacctg

SEQ ID NO: 214021 - DNA, 23 bp, Homo sapiens
gccccaccctcgtggacacctgc

SEQ ID NO: 214022 - DNA, 11 bp, Homo sapiens
gccccacctgc

SEQ ID NO: 214023 - DNA, 20 bp, Homo sapiens
gccccacctgccactaggct

SEQ ID NO: 214024 - DNA, 23 bp, Homo sapiens
gccccacctgccactaggctggg

SEQ ID NO: 214025 - DNA, 14 bp, Homo sapiens
gccccacttcaccc

SEQ ID NO: 214026 - DNA, 19 bp, Homo sapiens
gccccacttcacccccaac

SEQ ID NO: 214027 - DNA, 16 bp, Homo sapiens
gccccagaaaggggaa

SEQ ID NO: 214028 - DNA, 20 bp, Homo sapiens
gccccagaaatgccgctgtg

SEQ ID NO: 214029 - DNA, 17 bp, Homo sapiens
gccccagaccccagggc

SEQ ID NO: 214030 - DNA, 19 bp, Homo sapiens
gccccagaccccagggcag

SEQ ID NO: 214031 - DNA, 17 bp, Homo sapiens
gccccagagactcagag

SEQ ID NO: 214032 - DNA, 12 bp, Homo sapiens
gccccagagctg

SEQ ID NO: 214033 - DNA, 13 bp, Homo sapiens
gccccagagctgt

SEQ ID NO: 214034 - DNA, 19 bp, Homo sapiens
gccccagataccagcccct

SEQ ID NO: 214035 - DNA, 18 bp, Homo sapiens
gccccagatcaccagccc

SEQ ID NO: 214036 - DNA, 19 bp, Homo sapiens
gccccagatctgcctgggc

SEQ ID NO: 214037 - DNA, 20 bp, Homo sapiens
gccccagatctgcctgggcc

SEQ ID NO: 214038 - DNA, 21 bp, Homo sapiens
gccccagccagcccttcccag

SEQ ID NO: 214039 - DNA, 21 bp, Homo sapiens
gccccagcgagtctggagacc

SEQ ID NO: 214040 - DNA, 17 bp, Homo sapiens
gccccagctgacatgga

SEQ ID NO: 214041 - DNA, 13 bp, Homo sapiens
gccccagctggct

SEQ ID NO: 214042 - DNA, 15 bp, Homo sapiens
gccccagctggctgg

SEQ ID NO: 214043 - DNA, 19 bp, Homo sapiens
gccccagctggctgggtcg

SEQ ID NO: 214044 - DNA, 22 bp, Homo sapiens
gccccagctggctgggtcgccc

SEQ ID NO: 214045 - DNA, 16 bp, Homo sapiens
gccccaggcggagggg

SEQ ID NO: 214046 - DNA, 22 bp, Homo sapiens
gccccaggcggaggggcttgga

SEQ ID NO: 214047 - DNA, 15 bp, Homo sapiens
gccccaggctcccct

SEQ ID NO: 214048 - DNA, 18 bp, Homo sapiens
gccccaggctcccctggt

SEQ ID NO: 214049 - DNA, 19 bp, Homo sapiens
gccccagggccctgctcag

SEQ ID NO: 214050 - DNA, 13 bp, Homo sapiens
gccccagggcctg

SEQ ID NO: 214051 - DNA, 16 bp, Homo sapiens
gccccagggctaccct

SEQ ID NO: 214052 - DNA, 18 bp, Homo sapiens
gccccagggctaccctcc

SEQ ID NO: 214053 - DNA, 17 bp, Homo sapiens
gccccagggctgtgggt

SEQ ID NO: 214054 - DNA, 16 bp, Homo sapiens
gccccagggtcttccc

SEQ ID NO: 214055 - DNA, 23 bp, Homo sapiens
gccccaggtgccaccaataaaaa

SEQ ID NO: 214056 - DNA, 15 bp, Homo sapiens
gccccatagaaaaca

SEQ ID NO: 214057 - DNA, 17 bp, Homo sapiens
gccccatccagcatgtg

SEQ ID NO: 214058 - DNA, 19 bp, Homo sapiens
gccccatccttcccgcagc

SEQ ID NO: 214059 - DNA, 21 bp, Homo sapiens
gccccatccttcccgcagcac

SEQ ID NO: 214060 - DNA, 16 bp, Homo sapiens
gccccatctcctccca

SEQ ID NO: 214061 - DNA, 17 bp, Homo sapiens
gccccatgataaaataa

SEQ ID NO: 214062 - DNA, 17 bp, Homo sapiens
gccccatgcctgtccag

SEQ ID NO: 214063 - DNA, 20 bp, Homo sapiens
gccccatgcctgtccagcct

SEQ ID NO: 214064 - DNA, 17 bp, Homo sapiens
gccccatgctctgcccc

SEQ ID NO: 214065 - DNA, 22 bp, Homo sapiens
gccccatgctctgccccaagcc

SEQ ID NO: 214066 - DNA, 11 bp, Homo sapiens
gccccattcag

SEQ ID NO: 214067 - DNA, 19 bp, Homo sapiens
gcccccaaattgccttcag

SEQ ID NO: 214068 - DNA, 23 bp, Homo sapiens
gcccccaaattgccttcagccct

SEQ ID NO: 214069 - DNA, 14 bp, Homo sapiens
gcccccaccagcag

SEQ ID NO: 214070 - DNA, 23 bp, Homo sapiens
gcccccaccagcagcacaattct

SEQ ID NO: 214071 - DNA, 16 bp, Homo sapiens
gcccccacccctacag

SEQ ID NO: 214072 - DNA, 20 bp, Homo sapiens
gcccccacccctacagcctg

SEQ ID NO: 214073 - DNA, 20 bp, Homo sapiens
gcccccaccgaggttcccag

SEQ ID NO: 214074 - DNA, 21 bp, Homo sapiens
gcccccaccgaggttcccagg

SEQ ID NO: 214075 - DNA, 15 bp, Homo sapiens
gcccccactcagcat

SEQ ID NO: 214076 - DNA, 12 bp, Homo sapiens
gcccccagacgc

SEQ ID NO: 214077 - DNA, 22 bp, Homo sapiens
gcccccagatagagctgggtgg

SEQ ID NO: 214078 - DNA, 16 bp, Homo sapiens
gcccccagctgctcct

SEQ ID NO: 214079 - DNA, 17 bp, Homo sapiens
gcccccaggctgctgga

SEQ ID NO: 214080 - DNA, 19 bp, Homo sapiens
gccaggcccatctcaggtg

SEQ ID NO: 214081 - DNA, 23 bp, Homo sapiens
gccaggcccatctcaggtgccac

SEQ ID NO: 214082 - DNA, 18 bp, Homo sapiens
gccaggccctcctgctgg

SEQ ID NO: 214083 - DNA, 13 bp, Homo sapiens
gccaggccgggcc

SEQ ID NO: 214084 - DNA, 15 bp, Homo sapiens
gccaggcctcatcct

SEQ ID NO: 214085 - DNA, 14 bp, Homo sapiens
gccaggcctcccgc

SEQ ID NO: 214086 - DNA, 19 bp, Homo sapiens
gccaggcctgccagcccct

SEQ ID NO: 214087 - DNA, 20 bp, Homo sapiens
gccaggcctgtatgaggctt

SEQ ID NO: 214088 - DNA, 18 bp, Homo sapiens
gccaggcgttggtgccac

SEQ ID NO: 214089 - DNA, 16 bp, Homo sapiens
gccaggctagaatgga

SEQ ID NO: 214090 - DNA, 15 bp, Homo sapiens
gccaggctgtaagca

SEQ ID NO: 214091 - DNA, 21 bp, Homo sapiens
gccagggatggggccacagcc

SEQ ID NO: 214092 - DNA, 18 bp, Homo sapiens
gccagggcagtgctagtg

SEQ ID NO: 214093 - DNA, 13 bp, Homo sapiens
gccagggctgtcc

SEQ ID NO: 214094 - DNA, 20 bp, Homo sapiens
gccagggtagacttggagct

SEQ ID NO: 214095 - DNA, 21 bp, Homo sapiens
gccagggtagacttggagctg

SEQ ID NO: 214096 - DNA, 22 bp, Homo sapiens
gccagggtagacttggagctgt

SEQ ID NO: 214097 - DNA, 15 bp, Homo sapiens
tatagaaaaagcaca

SEQ ID NO: 214098 - DNA, 13 bp, Homo sapiens
tatagaagtttag

SEQ ID NO: 214099 - DNA, 15 bp, Homo sapiens
tatagaatatttatt

SEQ ID NO: 214100 - DNA, 18 bp, Homo sapiens
tatagaatttttaatgtt

SEQ ID NO: 214101 - DNA, 17 bp, Homo sapiens
tatagacctatgataaa

SEQ ID NO: 214102 - DNA, 18 bp, Homo sapiens
tatagagagggggctctc

SEQ ID NO: 214103 - DNA, 22 bp, Homo sapiens
tatagagatgtttttaaaagtt

SEQ ID NO: 214104 - DNA, 14 bp, Homo sapiens
tatagatataaata

SEQ ID NO: 214105 - DNA, 15 bp, Homo sapiens
tatagcatgtaatat

SEQ ID NO: 214106 - DNA, 21 bp, Homo sapiens
tatagctattaaaaaaaatca

SEQ ID NO: 214107 - DNA, 21 bp, Homo sapiens
tatagctctacacaacatgta

SEQ ID NO: 214108 - DNA, 12 bp, Homo sapiens
tatagcttgaaa

SEQ ID NO: 214109 - DNA, 16 bp, Homo sapiens
tatagcttgaaacata

SEQ ID NO: 214110 - DNA, 19 bp, Homo sapiens
tataggattatagatactt

SEQ ID NO: 214111 - DNA, 17 bp, Homo sapiens
tataggtcactcctggg

SEQ ID NO: 214112 - DNA, 17 bp, Homo sapiens
tataggttactcataag

SEQ ID NO: 214113 - DNA, 20 bp, Homo sapiens
tataggttactcataaggca

SEQ ID NO: 214114 - DNA, 21 bp, Homo sapiens
tataggttactcataaggcat

SEQ ID NO: 214115 - DNA, 22 bp, Homo sapiens
tataggttgtgcaaattaacag

SEQ ID NO: 214116 - DNA, 20 bp, Homo sapiens
tataggttgttcttaatttt

SEQ ID NO: 214117 - DNA, 16 bp, Homo sapiens
tatagtatagaatgaa

SEQ ID NO: 214118 - DNA, 22 bp, Homo sapiens
tatagtgcctaaaattgtatga

SEQ ID NO: 214119 - DNA, 18 bp, Homo sapiens
tatagtgtaaaataagaa

SEQ ID NO: 214120 - DNA, 19 bp, Homo sapiens
tatagtgtataccacctgt

SEQ ID NO: 214121 - DNA, 22 bp, Homo sapiens
tatagtgtataccacctgtaca

SEQ ID NO: 214122 - DNA, 23 bp, Homo sapiens
tatagtgtataccacctgtacat

SEQ ID NO: 214123 - DNA, 15 bp, Homo sapiens
tatagttgatatgta

SEQ ID NO: 214124 - DNA, 19 bp, Homo sapiens
tatagttgtctttctttgc

SEQ ID NO: 214125 - DNA, 20 bp, Homo sapiens
tatagttgtctttctttgct

SEQ ID NO: 214126 - DNA, 14 bp, Homo sapiens
tatagtttaaaaca

SEQ ID NO: 214127 - DNA, 18 bp, Homo sapiens
tatagtttaaaacacatt

SEQ ID NO: 214128 - DNA, 19 bp, Homo sapiens
tatagtttaaaacacattg

SEQ ID NO: 214129 - DNA, 13 bp, Homo sapiens
tatataaaataaa

SEQ ID NO: 214130 - DNA, 18 bp, Homo sapiens
tatataaaatgtattcaa

SEQ ID NO: 214131 - DNA, 19 bp, Homo sapiens
tatataaataaagcaaata

SEQ ID NO: 214132 - DNA, 19 bp, Homo sapiens
tatataaatatctatttat

SEQ ID NO: 214133 - DNA, 12 bp, Homo sapiens
tatataaatggt

SEQ ID NO: 214134 - DNA, 18 bp, Homo sapiens
tatataaatgtaaaaata

SEQ ID NO: 214135 - DNA, 14 bp, Homo sapiens
tatataaattatta

SEQ ID NO: 214136 - DNA, 15 bp, Homo sapiens
tatataaattattac

SEQ ID NO: 214137 - DNA, 15 bp, Homo sapiens
tatataagctgttta

SEQ ID NO: 214138 - DNA, 14 bp, Homo sapiens
tatataataaagta

SEQ ID NO: 214139 - DNA, 15 bp, Homo sapiens
tatataataaatggg

SEQ ID NO: 214140 - DNA, 21 bp, Homo sapiens
tatataataaatgggaaatgt

SEQ ID NO: 214141 - DNA, 22 bp, Homo sapiens
tatataatggtttactgctgtc

SEQ ID NO: 214142 - DNA, 18 bp, Homo sapiens
tatatacatgtatagtga

SEQ ID NO: 214143 - DNA, 19 bp, Homo sapiens
tatatactgggttcttgtt

SEQ ID NO: 214144 - DNA, 14 bp, Homo sapiens
tatatagagatgtt

SEQ ID NO: 214145 - DNA, 16 bp, Homo sapiens
tatatagagatgtttt

SEQ ID NO: 214146 - DNA, 17 bp, Homo sapiens
tatataggttgtgcaaa

SEQ ID NO: 214147 - DNA, 16 bp, Homo sapiens
tatatataaaataaat

SEQ ID NO: 214148 - DNA, 22 bp, Homo sapiens
tatatataaaataaatatacta

SEQ ID NO: 214149 - DNA, 14 bp, Homo sapiens
tatatataaatatc

SEQ ID NO: 214150 - DNA, 12 bp, Homo sapiens
tatatatacata

SEQ ID NO: 214151 - DNA, 14 bp, Homo sapiens
tatatatacatgta

SEQ ID NO: 214152 - DNA, 23 bp, Homo sapiens
tatatatgaagtaagttctgaaa

SEQ ID NO: 214153 - DNA, 13 bp, Homo sapiens
tatatatgtacag

SEQ ID NO: 214154 - DNA, 15 bp, Homo sapiens
tatatatgtacagtt

SEQ ID NO: 214155 - DNA, 17 bp, Homo sapiens
tatatatttgaaagaag

SEQ ID NO: 214156 - DNA, 17 bp, Homo sapiens
tatatattttgaaagga

SEQ ID NO: 214157 - DNA, 20 bp, Homo sapiens
tatatatttttggttgtcaa

SEQ ID NO: 214158 - DNA, 21 bp, Homo sapiens
tatatcagactgctttgagaa

SEQ ID NO: 214159 - DNA, 21 bp, Homo sapiens
tatatcatacattgttttcaa

SEQ ID NO: 214160 - DNA, 16 bp, Homo sapiens
tatatccatgtactgt

SEQ ID NO: 214161 - DNA, 16 bp, Homo sapiens
tatatctgcttcagtg

SEQ ID NO: 214162 - DNA, 21 bp, Homo sapiens
tatatctgtaaatttaactgc

SEQ ID NO: 214163 - DNA, 18 bp, Homo sapiens
tatatctttaataagtaa

SEQ ID NO: 214164 - DNA, 16 bp, Homo sapiens
tatatctttatactta

SEQ ID NO: 214165 - DNA, 15 bp, Homo sapiens
tatgcagtgctgctt

SEQ ID NO: 214166 - DNA, 15 bp, Homo sapiens
tatgcatagatatat

SEQ ID NO: 214167 - DNA, 18 bp, Homo sapiens
tatgcatgagaactaaat

SEQ ID NO: 214168 - DNA, 12 bp, Homo sapiens
tatgcatgccag

SEQ ID NO: 214169 - DNA, 15 bp, Homo sapiens
tatgcatgtagcata

SEQ ID NO: 214170 - DNA, 14 bp, Homo sapiens
tatgcatttatgca

SEQ ID NO: 214171 - DNA, 16 bp, Homo sapiens
tatgcatttatgcatg

SEQ ID NO: 214172 - DNA, 14 bp, Homo sapiens
tatgccaaacagtt

SEQ ID NO: 214173 - DNA, 16 bp, Homo sapiens
tatgccacctgcagcg

SEQ ID NO: 214174 - DNA, 22 bp, Homo sapiens
tatgccacgggaagtttagaga

SEQ ID NO: 214175 - DNA, 18 bp, Homo sapiens
tatgcccaggtaccaccc

SEQ ID NO: 214176 - DNA, 21 bp, Homo sapiens
tatgcctgtatttccaacaaa

SEQ ID NO: 214177 - DNA, 21 bp, Homo sapiens
tatgcgccctggtatgtgcct

SEQ ID NO: 214178 - DNA, 22 bp, Homo sapiens
tatgcgccctggtatgtgcctg

SEQ ID NO: 214179 - DNA, 14 bp, Homo sapiens
tatgctaaatgtta

SEQ ID NO: 214180 - DNA, 20 bp, Homo sapiens
tatgctagtttattggaagt

SEQ ID NO: 214181 - DNA, 15 bp, Homo sapiens
tatgctgcaatacat

SEQ ID NO: 214182 - DNA, 13 bp, Homo sapiens
tatgctgctgtga

SEQ ID NO: 214183 - DNA, 18 bp, Homo sapiens
tatgctgctgtgaatttt

SEQ ID NO: 214184 - DNA, 15 bp, Homo sapiens
tatgctgttcattga

SEQ ID NO: 214185 - DNA, 15 bp, Homo sapiens
tatgcttatacactt

SEQ ID NO: 214186 - DNA, 15 bp, Homo sapiens
tatgcttctagaaag

SEQ ID NO: 214187 - DNA, 16 bp, Homo sapiens
tatgctttacactcat

SEQ ID NO: 214188 - DNA, 15 bp, Homo sapiens
tatggaacttctaat

SEQ ID NO: 214189 - DNA, 17 bp, Homo sapiens
tatggaacttctaatat

SEQ ID NO: 214190 - DNA, 19 bp, Homo sapiens
tatggaagggtttgtggct

SEQ ID NO: 214191 - DNA, 18 bp, Homo sapiens
tatggagccctgtaattt

SEQ ID NO: 214192 - DNA, 22 bp, Homo sapiens
tatggaggattctttccccaga

SEQ ID NO: 214193 - DNA, 14 bp, Homo sapiens
tatggagtgcctgt

SEQ ID NO: 214194 - DNA, 15 bp, Homo sapiens
tatggatatgtgtaa

SEQ ID NO: 214195 - DNA, 20 bp, Homo sapiens
tatggatatttttaatttat

SEQ ID NO: 214196 - DNA, 14 bp, Homo sapiens
tatggattcacttc

SEQ ID NO: 214197 - DNA, 20 bp, Homo sapiens
tatggattcacttctattta

SEQ ID NO: 214198 - DNA, 23 bp, Homo sapiens
tatggcaagtttttggtaatgat

SEQ ID NO: 214199 - DNA, 21 bp, Homo sapiens
tatggcacttattatgaggct

SEQ ID NO: 214200 - DNA, 13 bp, Homo sapiens
tatggcccagcct

SEQ ID NO: 214201 - DNA, 22 bp, Homo sapiens
tatggcccagtgtcaagttgtg

SEQ ID NO: 214202 - DNA, 23 bp, Homo sapiens
tatggcctcagctgcctcacttc

SEQ ID NO: 214203 - DNA, 16 bp, Homo sapiens
tatggcggaggccatg

SEQ ID NO: 214204 - DNA, 16 bp, Homo sapiens
tatggctctaacatta

SEQ ID NO: 214205 - DNA, 22 bp, Homo sapiens
tatggctttgtgcttgttcttc

SEQ ID NO: 214206 - DNA, 17 bp, Homo sapiens
tatgggaacaagtgtac

SEQ ID NO: 214207 - DNA, 13 bp, Homo sapiens
tatgggaagccat

SEQ ID NO: 214208 - DNA, 16 bp, Homo sapiens
tatgggaagctctgtg

SEQ ID NO: 214209 - DNA, 17 bp, Homo sapiens
tatgggaagctctgtgt

SEQ ID NO: 214210 - DNA, 15 bp, Homo sapiens
tatgggagccccagg

SEQ ID NO: 214211 - DNA, 21 bp, Homo sapiens
tatgggcttccgcacatgccg

SEQ ID NO: 214212 - DNA, 19 bp, Homo sapiens
tatgggctttctctttggt

SEQ ID NO: 214213 - DNA, 16 bp, Homo sapiens
tatggggagagggcat

SEQ ID NO: 214214 - DNA, 23 bp, Homo sapiens
tatggggggccaacaccagggat

SEQ ID NO: 214215 - DNA, 13 bp, Homo sapiens
tatggtattttcg

SEQ ID NO: 214216 - DNA, 12 bp, Homo sapiens
tatggtggaaga

SEQ ID NO: 214217 - DNA, 14 bp, Homo sapiens
tatggtggccctgg

SEQ ID NO: 214218 - DNA, 15 bp, Homo sapiens
tatggtggccctggg

SEQ ID NO: 214219 - DNA, 21 bp, Homo sapiens
tatggttcccaataaaagtga

SEQ ID NO: 214220 - DNA, 22 bp, Homo sapiens
tatggttcccaataaaagtgac

SEQ ID NO: 214221 - DNA, 15 bp, Homo sapiens
tatgtaaacaggaga

SEQ ID NO: 214222 - DNA, 15 bp, Homo sapiens
tatgtaaattattgt

SEQ ID NO: 214223 - DNA, 17 bp, Homo sapiens
tatgtaaattattgtaa

SEQ ID NO: 214224 - DNA, 14 bp, Homo sapiens
tatgtaatgcaaaa

SEQ ID NO: 214225 - DNA, 19 bp, Homo sapiens
tatgtacagttcataaatt

SEQ ID NO: 214226 - DNA, 23 bp, Homo sapiens
tatgtacagttcataaatttgtt

SEQ ID NO: 214227 - DNA, 14 bp, Homo sapiens
tatgtacatatata

SEQ ID NO: 214228 - DNA, 14 bp, Homo sapiens
tatgtagaaatatt

SEQ ID NO: 214229 - DNA, 18 bp, Homo sapiens
tatgtagaaatattataa

SEQ ID NO: 214230 - DNA, 12 bp, Homo sapiens
tatgtatataaa

SEQ ID NO: 214231 - DNA, 14 bp, Homo sapiens
tatgtatgtaaaaa

SEQ ID NO: 214232 - DNA, 19 bp, Homo sapiens
tatgtatgtgccaattttg

SEQ ID NO: 214233 - DNA, 12 bp, Homo sapiens
tatgtattcttt

SEQ ID NO: 214234 - DNA, 17 bp, Homo sapiens
tatgtcaactttatgca

SEQ ID NO: 214235 - DNA, 13 bp, Homo sapiens
tatgtcagcagct

SEQ ID NO: 214236 - DNA, 22 bp, Homo sapiens
tatgtccccccctaactttctt

SEQ ID NO: 214237 - DNA, 11 bp, Homo sapiens
tatgtctgtga

SEQ ID NO: 214238 - DNA, 19 bp, Homo sapiens
tatgtcttactactttaaa

SEQ ID NO: 214239 - DNA, 22 bp, Homo sapiens
tatgtcttataagaaaacatgt

SEQ ID NO: 214240 - DNA, 16 bp, Homo sapiens
tatgtgaaagtgtaaa

SEQ ID NO: 214241 - DNA, 21 bp, Homo sapiens
tatgtgaaagtgtaaaataga

SEQ ID NO: 214242 - DNA, 12 bp, Homo sapiens
tatgtgcactgt

SEQ ID NO: 214243 - DNA, 17 bp, Homo sapiens
tatgtgcactgtcactt

SEQ ID NO: 214244 - DNA, 20 bp, Homo sapiens
tatgtgcctgcgttctgata

SEQ ID NO: 214245 - DNA, 15 bp, Homo sapiens
tatgtggatacagtc

SEQ ID NO: 214246 - DNA, 20 bp, Homo sapiens
tatgtggcttttatttcagt

SEQ ID NO: 214247 - DNA, 14 bp, Homo sapiens
tatgtgtaaaatgt

SEQ ID NO: 214248 - DNA, 17 bp, Homo sapiens
tatgtgtaaaatgtgaa

SEQ ID NO: 214249 - DNA, 14 bp, Homo sapiens
tatgtgtaatatca

SEQ ID NO: 214250 - DNA, 15 bp, Homo sapiens
tatgtgtaatatcat

SEQ ID NO: 214251 - DNA, 20 bp, Homo sapiens
tatgtgtagtgtgtttgtga

SEQ ID NO: 214252 - DNA, 15 bp, Homo sapiens
tatgtgtgaggagct

SEQ ID NO: 214253 - DNA, 19 bp, Homo sapiens
tatgtgtgtgtatgtttgc

SEQ ID NO: 214254 - DNA, 18 bp, Homo sapiens
tatgtgttttttaatata

SEQ ID NO: 214255 - DNA, 18 bp, Homo sapiens
tatgttaagctctttatg

SEQ ID NO: 214256 - DNA, 16 bp, Homo sapiens
tatgttacttaaacat

SEQ ID NO: 214257 - DNA, 14 bp, Homo sapiens
tatgttatatcaac

SEQ ID NO: 214258 - DNA, 16 bp, Homo sapiens
tatgttcaaagtcaaa

SEQ ID NO: 214259 - DNA, 17 bp, Homo sapiens
tatgttgagtgttcatt

SEQ ID NO: 214260 - DNA, 16 bp, Homo sapiens
tatgttgctgaaacac

SEQ ID NO: 214261 - DNA, 20 bp, Homo sapiens
tatgttgtaataaaacttat

SEQ ID NO: 214262 - DNA, 16 bp, Homo sapiens
tatgttgtgaagatgt

SEQ ID NO: 214263 - DNA, 12 bp, Homo sapiens
tatgtttaagtg

SEQ ID NO: 214264 - DNA, 12 bp, Homo sapiens
tatgtttgcatt

SEQ ID NO: 214265 - DNA, 20 bp, Homo sapiens
tatgtttggctgaaattatg

SEQ ID NO: 214266 - DNA, 16 bp, Homo sapiens
tatgttttgagaaaaa

SEQ ID NO: 214267 - DNA, 18 bp, Homo sapiens
tatgttttgtttctgaaa

SEQ ID NO: 214268 - DNA, 12 bp, Homo sapiens
tattaaactctc

SEQ ID NO: 214269 - DNA, 22 bp, Homo sapiens
tattaacactaataatagtact

SEQ ID NO: 214270 - DNA, 16 bp, Homo sapiens
tattaacctcagcatt

SEQ ID NO: 214271 - DNA, 17 bp, Homo sapiens
tattaacctcagcattt

SEQ ID NO: 214272 - DNA, 16 bp, Homo sapiens
tattaactacatttat

SEQ ID NO: 214273 - DNA, 18 bp, Homo sapiens
tattaagaatagtctctg

SEQ ID NO: 214274 - DNA, 18 bp, Homo sapiens
tattaagatggattctca

SEQ ID NO: 214275 - DNA, 19 bp, Homo sapiens
tattaagatggattctcag

SEQ ID NO: 214276 - DNA, 21 bp, Homo sapiens
tattaagcaaccttaaagcaa

SEQ ID NO: 214277 - DNA, 16 bp, Homo sapiens
tattaatccacaaata

SEQ ID NO: 214278 - DNA, 14 bp, Homo sapiens
tattaatcttcagc

SEQ ID NO: 214279 - DNA, 16 bp, Homo sapiens
tattaatgaactgtga

SEQ ID NO: 214280 - DNA, 22 bp, Homo sapiens
tattaatgaactgtgacaggaa

SEQ ID NO: 214281 - DNA, 18 bp, Homo sapiens
tattaatggcatgtaata

SEQ ID NO: 214282 - DNA, 13 bp, Homo sapiens
tattacactgtat

SEQ ID NO: 214283 - DNA, 14 bp, Homo sapiens
tattacataaataa

SEQ ID NO: 214284 - DNA, 13 bp, Homo sapiens
tattacatcttta

SEQ ID NO: 214285 - DNA, 13 bp, Homo sapiens
tattacattgcat

SEQ ID NO: 214286 - DNA, 22 bp, Homo sapiens
tattacattgcattcaaaatct

SEQ ID NO: 214287 - DNA, 16 bp, Homo sapiens
tattaccagcaagaat

SEQ ID NO: 214288 - DNA, 19 bp, Homo sapiens
tattaccagcaagaataaa

SEQ ID NO: 214289 - DNA, 14 bp, Homo sapiens
tattaccagccccc

SEQ ID NO: 214290 - DNA, 22 bp, Homo sapiens
tattaccatcttaatctttatt

SEQ ID NO: 214291 - DNA, 11 bp, Homo sapiens
tattacctctg

SEQ ID NO: 214292 - DNA, 13 bp, Homo sapiens
tattacctctgat

SEQ ID NO: 214293 - DNA, 16 bp, Homo sapiens
tattactctgacataa

SEQ ID NO: 214294 - DNA, 18 bp, Homo sapiens
tattactctgacataaac

SEQ ID NO: 214295 - DNA, 23 bp, Homo sapiens
tattactgtctggttttaacaat

SEQ ID NO: 214296 - DNA, 16 bp, Homo sapiens
tattgttacagctgaa

SEQ ID NO: 214297 - DNA, 15 bp, Homo sapiens
tattgttataaataa

SEQ ID NO: 214298 - DNA, 13 bp, Homo sapiens
tattgttccaaga

SEQ ID NO: 214299 - DNA, 17 bp, Homo sapiens
tattgttccaagacatt

SEQ ID NO: 214300 - DNA, 21 bp, Homo sapiens
tattgttccaagacattgtca

SEQ ID NO: 214301 - DNA, 13 bp, Homo sapiens
tattgttcctctt

SEQ ID NO: 214302 - DNA, 21 bp, Homo sapiens
tattgttcttgtaaaactgtg

SEQ ID NO: 214303 - DNA, 15 bp, Homo sapiens
tattgttttctgtaa

SEQ ID NO: 214304 - DNA, 17 bp, Homo sapiens
tattgttttctgtaaat

SEQ ID NO: 214305 - DNA, 20 bp, Homo sapiens
tattgttttctgtaaataac

SEQ ID NO: 214306 - DNA, 22 bp, Homo sapiens
tatttaaaaaatgaatagtaca

SEQ ID NO: 214307 - DNA, 23 bp, Homo sapiens
tatttaaaaatgcatgataatga

SEQ ID NO: 214308 - DNA, 13 bp, Homo sapiens
tatttaaaagaca

SEQ ID NO: 214309 - DNA, 17 bp, Homo sapiens
tatttaaaagacaaaca

SEQ ID NO: 214310 - DNA, 12 bp, Homo sapiens
tatttaaactat

SEQ ID NO: 214311 - DNA, 15 bp, Homo sapiens
tatttaaactattca

SEQ ID NO: 214312 - DNA, 16 bp, Homo sapiens
tatttaaacttataaa

SEQ ID NO: 214313 - DNA, 17 bp, Homo sapiens
tatttaacccattattc

SEQ ID NO: 214314 - DNA, 20 bp, Homo sapiens
tatttaactaattaaaaaat

SEQ ID NO: 214315 - DNA, 20 bp, Homo sapiens
tatttaagaaaatacaataa

SEQ ID NO: 214316 - DNA, 22 bp, Homo sapiens
tatttaagaaaatacaataaac

SEQ ID NO: 214317 - DNA, 20 bp, Homo sapiens
tatttaagataattataata

SEQ ID NO: 214318 - DNA, 17 bp, Homo sapiens
tatttaagcaacatctt

SEQ ID NO: 214319 - DNA, 20 bp, Homo sapiens
tatttaagcaacatcttttt

SEQ ID NO: 214320 - DNA, 21 bp, Homo sapiens
tatttaagcaacatcttttta

SEQ ID NO: 214321 - DNA, 10 bp, Homo sapiens
tatttaagcc

SEQ ID NO: 214322 - DNA, 11 bp, Homo sapiens
tatttaagccc

SEQ ID NO: 214323 - DNA, 16 bp, Homo sapiens
tatttaagccccctct

SEQ ID NO: 214324 - DNA, 20 bp, Homo sapiens
tatttaagttatcaacttta

SEQ ID NO: 214325 - DNA, 17 bp, Homo sapiens
tatttaataacaattgt

SEQ ID NO: 214326 - DNA, 20 bp, Homo sapiens
tatttaatatgcatctttga

SEQ ID NO: 214327 - DNA, 21 bp, Homo sapiens
tatttaatatgcatctttgag

SEQ ID NO: 214328 - DNA, 18 bp, Homo sapiens
tatttaatgatttttgtg

SEQ ID NO: 214329 - DNA, 14 bp, Homo sapiens
tatttaattattaa

SEQ ID NO: 214330 - DNA, 13 bp, Homo sapiens
tatttaatttcat

SEQ ID NO: 214331 - DNA, 15 bp, Homo sapiens
tatttaatttcataa

SEQ ID NO: 214332 - DNA, 19 bp, Homo sapiens
tatttaatttcataaattg

SEQ ID NO: 214333 - DNA, 15 bp, Homo sapiens
tatttacaaataaaa

SEQ ID NO: 214334 - DNA, 21 bp, Homo sapiens
tatttacatgaattgcatttt

SEQ ID NO: 214335 - DNA, 23 bp, Homo sapiens
tatttactgagcttctctgtgaa

SEQ ID NO: 214336 - DNA, 18 bp, Homo sapiens
tatttacttcttatacat

SEQ ID NO: 214337 - DNA, 18 bp, Homo sapiens
tatttagatataacacta

SEQ ID NO: 214338 - DNA, 11 bp, Homo sapiens
tatttagcatg

SEQ ID NO: 214339 - DNA, 17 bp, Homo sapiens
tatttaggcagattgaa

SEQ ID NO: 214340 - DNA, 19 bp, Homo sapiens
tatttataaatatatttaa

SEQ ID NO: 214341 - DNA, 20 bp, Homo sapiens
tatttataacaacctaaatt

SEQ ID NO: 214342 - DNA, 15 bp, Homo sapiens
tatttataacattgt

SEQ ID NO: 214343 - DNA, 13 bp, Homo sapiens
tatttataactca

SEQ ID NO: 214344 - DNA, 21 bp, Homo sapiens
tatttataactcatcataaaa

SEQ ID NO: 214345 - DNA, 23 bp, Homo sapiens
tatttataactcatcataaaata

SEQ ID NO: 214346 - DNA, 23 bp, Homo sapiens
tatttatataattatgttattga

SEQ ID NO: 214347 - DNA, 14 bp, Homo sapiens
tatttatatatatt

SEQ ID NO: 214348 - DNA, 16 bp, Homo sapiens
tatttatatatgtatt

SEQ ID NO: 214349 - DNA, 19 bp, Homo sapiens
tatttatatatttataact

SEQ ID NO: 214350 - DNA, 15 bp, Homo sapiens
tatttatattagagt

SEQ ID NO: 214351 - DNA, 23 bp, Homo sapiens
tatttatattcagagatgtacca

SEQ ID NO: 214352 - DNA, 22 bp, Homo sapiens
tatttatattcatcaaataaac

SEQ ID NO: 214353 - DNA, 15 bp, Homo sapiens
tatttatatttcact

SEQ ID NO: 214354 - DNA, 17 bp, Homo sapiens
tatttatcgaaagtaaa

SEQ ID NO: 214355 - DNA, 19 bp, Homo sapiens
tatttatctgtctgagccc

SEQ ID NO: 214356 - DNA, 14 bp, Homo sapiens
tatttatgacctca

SEQ ID NO: 214357 - DNA, 19 bp, Homo sapiens
tatttatgtttaagtgctt

SEQ ID NO: 214358 - DNA, 21 bp, Homo sapiens
tatttattaaacttcagcaac

SEQ ID NO: 214359 - DNA, 15 bp, Homo sapiens
tatttattaaatttt

SEQ ID NO: 214360 - DNA, 21 bp, Homo sapiens
tatttattcagcttcatttgt

SEQ ID NO: 214361 - DNA, 24 bp, Homo sapiens
tatttattcagcttcatttgtgtc

SEQ ID NO: 214362 - DNA, 22 bp, Homo sapiens
tatttattgtatatatggatat

SEQ ID NO: 214363 - DNA, 12 bp, Homo sapiens
tatttatttaat

SEQ ID NO: 214364 - DNA, 11 bp, Homo sapiens
tatttatttct

SEQ ID NO: 214365 - DNA, 18 bp, Homo sapiens
tatttatttttgtactgt

SEQ ID NO: 214366 - DNA, 23 bp, Homo sapiens
tatttcaagggttgcttctgagt

SEQ ID NO: 214367 - DNA, 23 bp, Homo sapiens
tatttcaggcacatcattggaat

SEQ ID NO: 214368 - DNA, 20 bp, Homo sapiens
tatttcataaacaacttaat

SEQ ID NO: 214369 - DNA, 14 bp, Homo sapiens
tatttcatcatgac

SEQ ID NO: 214370 - DNA, 14 bp, Homo sapiens
tatttccaacaaac

SEQ ID NO: 214371 - DNA, 21 bp, Homo sapiens
tatttccattccagaatatct

SEQ ID NO: 214372 - DNA, 21 bp, Homo sapiens
tatttccccaggggaaaatga

SEQ ID NO: 214373 - DNA, 21 bp, Homo sapiens
tatttcccctttccaattcca

SEQ ID NO: 214374 - DNA, 15 bp, Homo sapiens
tatttccctaaaata

SEQ ID NO: 214375 - DNA, 19 bp, Homo sapiens
tatttccctaaaatacatt

SEQ ID NO: 214376 - DNA, 21 bp, Homo sapiens
tatttccctaaaatacattta

SEQ ID NO: 214377 - DNA, 18 bp, Homo sapiens
tcaacaaagcacagtgtt

SEQ ID NO: 214378 - DNA, 19 bp, Homo sapiens
tcaacaacaagttgtttca

SEQ ID NO: 214379 - DNA, 19 bp, Homo sapiens
tcaacaagggagagacctc

SEQ ID NO: 214380 - DNA, 20 bp, Homo sapiens
tcaacaagggagagacctca

SEQ ID NO: 214381 - DNA, 14 bp, Homo sapiens
tcaacactcttctt

SEQ ID NO: 214382 - DNA, 16 bp, Homo sapiens
tcaacactcttcttga

SEQ ID NO: 214383 - DNA, 21 bp, Homo sapiens
tcaacactcttcttgagcaga

SEQ ID NO: 214384 - DNA, 23 bp, Homo sapiens
tcaacacttaagggttttagaaa

SEQ ID NO: 214385 - DNA, 16 bp, Homo sapiens
tcaacacttattttct

SEQ ID NO: 214386 - DNA, 19 bp, Homo sapiens
tcaacacttattttctgaa

SEQ ID NO: 214387 - DNA, 20 bp, Homo sapiens
tcaacacttattttctgaat

SEQ ID NO: 214388 - DNA, 15 bp, Homo sapiens
tcaacagcatgtcta

SEQ ID NO: 214389 - DNA, 19 bp, Homo sapiens
tcaacatgttactgaccag

SEQ ID NO: 214390 - DNA, 20 bp, Homo sapiens
tcaacatgttactgaccagc

SEQ ID NO: 214391 - DNA, 15 bp, Homo sapiens
tcaacccagaaacac

SEQ ID NO: 214392 - DNA, 12 bp, Homo sapiens
tcaacccccctc

SEQ ID NO: 214393 - DNA, 16 bp, Homo sapiens
tcaacccccctcccag

SEQ ID NO: 214394 - DNA, 17 bp, Homo sapiens
tcaacccccctcccaga

SEQ ID NO: 214395 - DNA, 20 bp, Homo sapiens
tcaacccccctcccagacag

SEQ ID NO: 214396 - DNA, 19 bp, Homo sapiens
tcaacccgctgcttccagg

SEQ ID NO: 214397 - DNA, 14 bp, Homo sapiens
tcaaccctgccctg

SEQ ID NO: 214398 - DNA, 17 bp, Homo sapiens
tcaacctctcagatccc

SEQ ID NO: 214399 - DNA, 13 bp, Homo sapiens
tcaacctgtaaat

SEQ ID NO: 214400 - DNA, 16 bp, Homo sapiens
tcaacctgtaaattat

SEQ ID NO: 214401 - DNA, 19 bp, Homo sapiens
tcaacctgtaaattatttt

SEQ ID NO: 214402 - DNA, 16 bp, Homo sapiens
tcaaccttgagacagc

SEQ ID NO: 214403 - DNA, 20 bp, Homo sapiens
tcaaccttgtgtgagtgtga

SEQ ID NO: 214404 - DNA, 18 bp, Homo sapiens
tcaacgcagccctgcttt

SEQ ID NO: 214405 - DNA, 13 bp, Homo sapiens
tcaactccaaggc

SEQ ID NO: 214406 - DNA, 15 bp, Homo sapiens
tcaactccaggactt

SEQ ID NO: 214407 - DNA, 15 bp, Homo sapiens
tcaacttaaatcact

SEQ ID NO: 214408 - DNA, 16 bp, Homo sapiens
tcaacttaattctgtt

SEQ ID NO: 214409 - DNA, 14 bp, Homo sapiens
tcaactttcatttg

SEQ ID NO: 214410 - DNA, 13 bp, Homo sapiens
tcaactttttcct

SEQ ID NO: 214411 - DNA, 17 bp, Homo sapiens
tcaagaaagatatctat

SEQ ID NO: 214412 - DNA, 16 bp, Homo sapiens
tcaagaacaaacagaa

SEQ ID NO: 214413 - DNA, 19 bp, Homo sapiens
tcaagaagtcagagaaaac

SEQ ID NO: 214414 - DNA, 13 bp, Homo sapiens
tcaagatcttcaa

SEQ ID NO: 214415 - DNA, 16 bp, Homo sapiens
tcaagatgcctcttct

SEQ ID NO: 214416 - DNA, 21 bp, Homo sapiens
tcaagattcccggctggactt

SEQ ID NO: 214417 - DNA, 16 bp, Homo sapiens
tcaagattttgaatgc

SEQ ID NO: 214418 - DNA, 14 bp, Homo sapiens
tcaagcaaggaagc

SEQ ID NO: 214419 - DNA, 19 bp, Homo sapiens
tcaagcaatcctcctgagt

SEQ ID NO: 214420 - DNA, 16 bp, Homo sapiens
tcaagcccaggaggac

SEQ ID NO: 214421 - DNA, 15 bp, Homo sapiens
tcaagccccctttga

SEQ ID NO: 214422 - DNA, 15 bp, Homo sapiens
tcaagcccctgtcta

SEQ ID NO: 214423 - DNA, 16 bp, Homo sapiens
tcaagcccctgtctaa

SEQ ID NO: 214424 - DNA, 13 bp, Homo sapiens
tcaagctaataaa

SEQ ID NO: 214425 - DNA, 14 bp, Homo sapiens
tcaagctgcttgga

SEQ ID NO: 214426 - DNA, 20 bp, Homo sapiens
tcaagctgtcccctctgtca

SEQ ID NO: 214427 - DNA, 11 bp, Homo sapiens
tcaagcttgtg

SEQ ID NO: 214428 - DNA, 14 bp, Homo sapiens
tcaagcttgtgtac

SEQ ID NO: 214429 - DNA, 19 bp, Homo sapiens
tcaaggacttgaaagcatc

SEQ ID NO: 214430 - DNA, 18 bp, Homo sapiens
tcaaggagtgaagtaatt

SEQ ID NO: 214431 - DNA, 23 bp, Homo sapiens
tcaaggattcaatgcatttttaa

SEQ ID NO: 214432 - DNA, 17 bp, Homo sapiens
tcaaggcaccgcagcct

SEQ ID NO: 214433 - DNA, 15 bp, Homo sapiens
tcaaggcctgtccct

SEQ ID NO: 214434 - DNA, 18 bp, Homo sapiens
tcaaggcctgtccctggc

SEQ ID NO: 214435 - DNA, 12 bp, Homo sapiens
tcaaggctgcct

SEQ ID NO: 214436 - DNA, 15 bp, Homo sapiens
tcaaggctgcctgga

SEQ ID NO: 214437 - DNA, 17 bp, Homo sapiens
tcaagggactgggggtg

SEQ ID NO: 214438 - DNA, 16 bp, Homo sapiens
tcaagggggactgtct

SEQ ID NO: 214439 - DNA, 13 bp, Homo sapiens
tcaagggtagggt

SEQ ID NO: 214440 - DNA, 15 bp, Homo sapiens
tcaaggtcgtttttt

SEQ ID NO: 214441 - DNA, 15 bp, Homo sapiens
tcaagtcccgaggca

SEQ ID NO: 214442 - DNA, 18 bp, Homo sapiens
tcaagtccttacctcttc

SEQ ID NO: 214443 - DNA, 22 bp, Homo sapiens
tcaagtccttacctcttccgga

SEQ ID NO: 214444 - DNA, 20 bp, Homo sapiens
tcaagtcggatctagtccag

SEQ ID NO: 214445 - DNA, 19 bp, Homo sapiens
tcaagtctctgctggccca

SEQ ID NO: 214446 - DNA, 16 bp, Homo sapiens
tcaagtgtctcagtcc

SEQ ID NO: 214447 - DNA, 14 bp, Homo sapiens
tcaagttaaagtga

SEQ ID NO: 214448 - DNA, 16 bp, Homo sapiens
tcaagttaacaaggaa

SEQ ID NO: 214449 - DNA, 19 bp, Homo sapiens
tcaagttaacaaggaatgc

SEQ ID NO: 214450 - DNA, 20 bp, Homo sapiens
tcaagtttgggtctgtgctg

SEQ ID NO: 214451 - DNA, 13 bp, Homo sapiens
tcaataaaatgtg

SEQ ID NO: 214452 - DNA, 23 bp, Homo sapiens
tcaataaacagcttcatgccttt

SEQ ID NO: 214453 - DNA, 12 bp, Homo sapiens
tcaataaagaaa

SEQ ID NO: 214454 - DNA, 21 bp, Homo sapiens
tcaataaagaaaaaaatagtt

SEQ ID NO: 214455 - DNA, 15 bp, Homo sapiens
tcaataaaggtcata

SEQ ID NO: 214456 - DNA, 15 bp, Homo sapiens
tcaataaagtaccct

SEQ ID NO: 214457 - DNA, 12 bp, Homo sapiens
tcaataaatctt

SEQ ID NO: 214458 - DNA, 21 bp, Homo sapiens
tcaataattgtggagaggaga

SEQ ID NO: 214459 - DNA, 16 bp, Homo sapiens
tcaatacccttggcac

SEQ ID NO: 214460 - DNA, 17 bp, Homo sapiens
tcaatacttgaatatgg

SEQ ID NO: 214461 - DNA, 21 bp, Homo sapiens
tcaatacttttgtgtattctg

SEQ ID NO: 214462 - DNA, 15 bp, Homo sapiens
tcaatagaaagtcat

SEQ ID NO: 214463 - DNA, 19 bp, Homo sapiens
tcaatatataataaatggg

SEQ ID NO: 214464 - DNA, 20 bp, Homo sapiens
tcaatatataataaatggga

SEQ ID NO: 214465 - DNA, 21 bp, Homo sapiens
tcaatatatagagacttctaa

SEQ ID NO: 214466 - DNA, 22 bp, Homo sapiens
tcaatatatagagacttctaaa

SEQ ID NO: 214467 - DNA, 14 bp, Homo sapiens
tcaatattaaatac

SEQ ID NO: 214468 - DNA, 21 bp, Homo sapiens
tcaccggccttgtgacattca

SEQ ID NO: 214469 - DNA, 16 bp, Homo sapiens
tcacctaattaatttc

SEQ ID NO: 214470 - DNA, 18 bp, Homo sapiens
tcacctaccctcaaagta

SEQ ID NO: 214471 - DNA, 14 bp, Homo sapiens
tcacctagctgctc

SEQ ID NO: 214472 - DNA, 20 bp, Homo sapiens
tcacctcaggaccccagagg

SEQ ID NO: 214473 - DNA, 17 bp, Homo sapiens
tcacctcccctccttgc

SEQ ID NO: 214474 - DNA, 11 bp, Homo sapiens
tcacctcctcc

SEQ ID NO: 214475 - DNA, 19 bp, Homo sapiens
tcacctcctccactcactc

SEQ ID NO: 214476 - DNA, 21 bp, Homo sapiens
tcacctcctccactcactcca

SEQ ID NO: 214477 - DNA, 12 bp, Homo sapiens
tcacctctatcc

SEQ ID NO: 214478 - DNA, 18 bp, Homo sapiens
tcacctgacctctgaaga

SEQ ID NO: 214479 - DNA, 21 bp, Homo sapiens
tcacctgagcccggatgcttc

SEQ ID NO: 214480 - DNA, 11 bp, Homo sapiens
tcacctgctgg

SEQ ID NO: 214481 - DNA, 23 bp, Homo sapiens
tcacctgctggttgttgccaggt

SEQ ID NO: 214482 - DNA, 16 bp, Homo sapiens
tcacctggcttcccag

SEQ ID NO: 214483 - DNA, 20 bp, Homo sapiens
tcacctggcttcccaggacc

SEQ ID NO: 214484 - DNA, 14 bp, Homo sapiens
tcacctgggcacct

SEQ ID NO: 214485 - DNA, 16 bp, Homo sapiens
tcacctgggcctttcc

SEQ ID NO: 214486 - DNA, 13 bp, Homo sapiens
tcacctgtaaaac

SEQ ID NO: 214487 - DNA, 14 bp, Homo sapiens
tcacctgtaaaact

SEQ ID NO: 214488 - DNA, 20 bp, Homo sapiens
tcacctgtttttaagctgtt

SEQ ID NO: 214489 - DNA, 19 bp, Homo sapiens
tcaccttccctagttcttt

SEQ ID NO: 214490 - DNA, 13 bp, Homo sapiens
tcaccttcctggg

SEQ ID NO: 214491 - DNA, 14 bp, Homo sapiens
tcaccttcctgggc

SEQ ID NO: 214492 - DNA, 17 bp, Homo sapiens
tcaccttcctgggcagc

SEQ ID NO: 214493 - DNA, 20 bp, Homo sapiens
tcaccttcctgggcagccca

SEQ ID NO: 214494 - DNA, 20 bp, Homo sapiens
tcaccttgccgagagaggcg

SEQ ID NO: 214495 - DNA, 15 bp, Homo sapiens
tcaccttggtttatg

SEQ ID NO: 214496 - DNA, 15 bp, Homo sapiens
tcaccttttctaaaa

SEQ ID NO: 214497 - DNA, 17 bp, Homo sapiens
tcacgccattctcctgc

SEQ ID NO: 214498 - DNA, 14 bp, Homo sapiens
tcacgcctgtaatc

SEQ ID NO: 214499 - DNA, 20 bp, Homo sapiens
tcacgcctgtaatcccagca

SEQ ID NO: 214500 - DNA, 20 bp, Homo sapiens
tcacgctcccccgcagtccc

SEQ ID NO: 214501 - DNA, 16 bp, Homo sapiens
tcacgctctggacatg

SEQ ID NO: 214502 - DNA, 14 bp, Homo sapiens
tcacgctttcatga

SEQ ID NO: 214503 - DNA, 16 bp, Homo sapiens
tcacgctttcatgacc

SEQ ID NO: 214504 - DNA, 16 bp, Homo sapiens
tcacggacaggaagca

SEQ ID NO: 214505 - DNA, 19 bp, Homo sapiens
tcacggacaggaagcacag

SEQ ID NO: 214506 - DNA, 13 bp, Homo sapiens
tcacggcatgttt

SEQ ID NO: 214507 - DNA, 22 bp, Homo sapiens
tcacgggagatttcttgttgct

SEQ ID NO: 214508 - DNA, 13 bp, Homo sapiens
tcacggggcctcc

SEQ ID NO: 214509 - DNA, 14 bp, Homo sapiens
tcacggggcctcca

SEQ ID NO: 214510 - DNA, 18 bp, Homo sapiens
tcacggtttcacttttaa

SEQ ID NO: 214511 - DNA, 17 bp, Homo sapiens
tcacgtaagatacaagt

SEQ ID NO: 214512 - DNA, 16 bp, Homo sapiens
tcacgtgtgtgactca

SEQ ID NO: 214513 - DNA, 17 bp, Homo sapiens
tcacgtgtgtgactcag

SEQ ID NO: 214514 - DNA, 13 bp, Homo sapiens
tcactaaacttta

SEQ ID NO: 214515 - DNA, 17 bp, Homo sapiens
tcactaaatttctcagt

SEQ ID NO: 214516 - DNA, 17 bp, Homo sapiens
tcactacaacctccacc

SEQ ID NO: 214517 - DNA, 18 bp, Homo sapiens
tcactacaacctccacct

SEQ ID NO: 214518 - DNA, 12 bp, Homo sapiens
tcactactgcag

SEQ ID NO: 214519 - DNA, 14 bp, Homo sapiens
tcactactgcagtc

SEQ ID NO: 214520 - DNA, 13 bp, Homo sapiens
tcactactggtct

SEQ ID NO: 214521 - DNA, 14 bp, Homo sapiens
tcactactggtctg

SEQ ID NO: 214522 - DNA, 21 bp, Homo sapiens
tcactataaccatcagttact

SEQ ID NO: 214523 - DNA, 13 bp, Homo sapiens
tcactatgcattt

SEQ ID NO: 214524 - DNA, 18 bp, Homo sapiens
tcactattcaagtattag

SEQ ID NO: 214525 - DNA, 16 bp, Homo sapiens
tcactattcttaagca

SEQ ID NO: 214526 - DNA, 18 bp, Homo sapiens
tcactattcttaagcact

SEQ ID NO: 214527 - DNA, 14 bp, Homo sapiens
tcactcaattgttt

SEQ ID NO: 214528 - DNA, 12 bp, Homo sapiens
tcactcataaag

SEQ ID NO: 214529 - DNA, 16 bp, Homo sapiens
tcactccactcccctc

SEQ ID NO: 214530 - DNA, 18 bp, Homo sapiens
tcactccactcccctcat

SEQ ID NO: 214531 - DNA, 23 bp, Homo sapiens
tcactccaggaaggggctggact

SEQ ID NO: 214532 - DNA, 16 bp, Homo sapiens
tcactccaggttcgta

SEQ ID NO: 214533 - DNA, 17 bp, Homo sapiens
tcactccaggttcgtat

SEQ ID NO: 214534 - DNA, 11 bp, Homo sapiens
tcactccccag

SEQ ID NO: 214535 - DNA, 14 bp, Homo sapiens
tcactccccagccc

SEQ ID NO: 214536 - DNA, 17 bp, Homo sapiens
tcactcccctcctttcc

SEQ ID NO: 214537 - DNA, 18 bp, Homo sapiens
tcactccctaaagccctc

SEQ ID NO: 214538 - DNA, 22 bp, Homo sapiens
tcactccctaaagccctcttca

SEQ ID NO: 214539 - DNA, 19 bp, Homo sapiens
tcactccctttgtggactt

SEQ ID NO: 214540 - DNA, 23 bp, Homo sapiens
tcactccctttgtggactttatt

SEQ ID NO: 214541 - DNA, 15 bp, Homo sapiens
tcactcctacctggt

SEQ ID NO: 214542 - DNA, 11 bp, Homo sapiens
tcactcctggg

SEQ ID NO: 214543 - DNA, 13 bp, Homo sapiens
tcactcctggggc

SEQ ID NO: 214544 - DNA, 20 bp, Homo sapiens
tcactcctggggcctcttgg

SEQ ID NO: 214545 - DNA, 20 bp, Homo sapiens
tcactcctgttacttaccta

SEQ ID NO: 214546 - DNA, 21 bp, Homo sapiens
tcactctaattggtcattcct

SEQ ID NO: 214547 - DNA, 17 bp, Homo sapiens
tcactctacccccaaca

SEQ ID NO: 214548 - DNA, 17 bp, Homo sapiens
tcactctcccagaggct

SEQ ID NO: 214549 - DNA, 22 bp, Homo sapiens
tcactctcccagaggctcctgg

SEQ ID NO: 214550 - DNA, 13 bp, Homo sapiens
tcactctgacctt

SEQ ID NO: 214551 - DNA, 14 bp, Homo sapiens
tcactctgccaggg

SEQ ID NO: 214552 - DNA, 17 bp, Homo sapiens
tcactcttcctcatcct

SEQ ID NO: 214553 - DNA, 23 bp, Homo sapiens
tcactcttcctcatcctgcttct

SEQ ID NO: 214554 - DNA, 16 bp, Homo sapiens
tcactctttcccccaa

SEQ ID NO: 214555 - DNA, 16 bp, Homo sapiens
tcactgaagcttttta

SEQ ID NO: 214556 - DNA, 15 bp, Homo sapiens
tcactgaagtgaata

SEQ ID NO: 214557 - DNA, 22 bp, Homo sapiens
tcactgacactgcgaactctca

SEQ ID NO: 214558 - DNA, 15 bp, Homo sapiens
tcactgagtttgtgg

SEQ ID NO: 214559 - DNA, 18 bp, Homo sapiens
tcactgcaacctctgcct

SEQ ID NO: 214560 - DNA, 18 bp, Homo sapiens
tcactgcaagctccaact

SEQ ID NO: 214561 - DNA, 15 bp, Homo sapiens
tcactgcacagtgca

SEQ ID NO: 214562 - DNA, 13 bp, Homo sapiens
tcactgcagcctc

SEQ ID NO: 214563 - DNA, 15 bp, Homo sapiens
tcactgcagcctcga

SEQ ID NO: 214564 - DNA, 18 bp, Homo sapiens
tcactgcagcctctgcct

SEQ ID NO: 214565 - DNA, 23 bp, Homo sapiens
tcactgcatttggggcctttccc

SEQ ID NO: 214566 - DNA, 18 bp, Homo sapiens
tcactgcccgcacaccct

SEQ ID NO: 214567 - DNA, 17 bp, Homo sapiens
tcactgccctccctcgg

SEQ ID NO: 214568 - DNA, 22 bp, Homo sapiens
tcactgctggctgccttagaac

SEQ ID NO: 214569 - DNA, 16 bp, Homo sapiens
tcactgctgtccctcc

SEQ ID NO: 214570 - DNA, 20 bp, Homo sapiens
tcactgctgtccctcctgag

SEQ ID NO: 214571 - DNA, 16 bp, Homo sapiens
tcactgcttctgcttt

SEQ ID NO: 214572 - DNA, 17 bp, Homo sapiens
tcactgcttctgctttt

SEQ ID NO: 214573 - DNA, 18 bp, Homo sapiens
tcactgcttctgcttttt

SEQ ID NO: 214574 - DNA, 18 bp, Homo sapiens
tcactgctttgcaccgtg

SEQ ID NO: 214575 - DNA, 19 bp, Homo sapiens
tcaggctgctggaggaaaa

SEQ ID NO: 214576 - DNA, 23 bp, Homo sapiens
tcagggaccaaggacccctcacc

SEQ ID NO: 214577 - DNA, 13 bp, Homo sapiens
tcagggagccctg

SEQ ID NO: 214578 - DNA, 14 bp, Homo sapiens
tcagggaggggctg

SEQ ID NO: 214579 - DNA, 19 bp, Homo sapiens
tcagggatcttctccctcc

SEQ ID NO: 214580 - DNA, 21 bp, Homo sapiens
tcagggatgtgggaatctccc

SEQ ID NO: 214581 - DNA, 16 bp, Homo sapiens
tcagggcagggctctg

SEQ ID NO: 214582 - DNA, 16 bp, Homo sapiens
tcagggccagaaggag

SEQ ID NO: 214583 - DNA, 19 bp, Homo sapiens
tcagggccagaaggagggc

SEQ ID NO: 214584 - DNA, 14 bp, Homo sapiens
tcagggcccacctc

SEQ ID NO: 214585 - DNA, 15 bp, Homo sapiens
tcagggccttggccc

SEQ ID NO: 214586 - DNA, 23 bp, Homo sapiens
tcagggctggagtgcgctcttgg

SEQ ID NO: 214587 - DNA, 14 bp, Homo sapiens
tcagggctggcccg

SEQ ID NO: 214588 - DNA, 13 bp, Homo sapiens
tcagggcttcctt

SEQ ID NO: 214589 - DNA, 13 bp, Homo sapiens
tcaggggctttgg

SEQ ID NO: 214590 - DNA, 13 bp, Homo sapiens
tcagggggccagg

SEQ ID NO: 214591 - DNA, 22 bp, Homo sapiens
tcagggggcctttaaagactta

SEQ ID NO: 214592 - DNA, 14 bp, Homo sapiens
tcaggggtcacctc

SEQ ID NO: 214593 - DNA, 22 bp, Homo sapiens
tcagggtacaggaaaaaacatt

SEQ ID NO: 214594 - DNA, 22 bp, Homo sapiens
tcagggtgctccctcctcagtc

SEQ ID NO: 214595 - DNA, 16 bp, Homo sapiens
tcaggtagccaccacc

SEQ ID NO: 214596 - DNA, 19 bp, Homo sapiens
tcaggtgccactccctgag

SEQ ID NO: 214597 - DNA, 20 bp, Homo sapiens
tcaggtgccactccctgagc

SEQ ID NO: 214598 - DNA, 22 bp, Homo sapiens
tcaggtggaacaggaggaactg

SEQ ID NO: 214599 - DNA, 22 bp, Homo sapiens
tcaggtggggagtccagggctc

SEQ ID NO: 214600 - DNA, 15 bp, Homo sapiens
tcaggtggtgtcctt

SEQ ID NO: 214601 - DNA, 19 bp, Homo sapiens
tcaggtggtgtccttcttc

SEQ ID NO: 214602 - DNA, 22 bp, Homo sapiens
tcaggtggtgtccttcttcctc

SEQ ID NO: 214603 - DNA, 13 bp, Homo sapiens
tcaggttccagaa

SEQ ID NO: 214604 - DNA, 14 bp, Homo sapiens
tcaggttgttctgt

SEQ ID NO: 214605 - DNA, 15 bp, Homo sapiens
tcaggttgttctgta

SEQ ID NO: 214606 - DNA, 21 bp, Homo sapiens
tcaggtttccggctactgaca

SEQ ID NO: 214607 - DNA, 14 bp, Homo sapiens
tcagtaaataatga

SEQ ID NO: 214608 - DNA, 17 bp, Homo sapiens
tcagtaagtataacaaa

SEQ ID NO: 214609 - DNA, 12 bp, Homo sapiens
tcagtaataaaa

SEQ ID NO: 214610 - DNA, 19 bp, Homo sapiens
tcagtaataaactgtgttt

SEQ ID NO: 214611 - DNA, 22 bp, Homo sapiens
tcagtacaattctttgttgctt

SEQ ID NO: 214612 - DNA, 22 bp, Homo sapiens
tcagtacacttggtgtactggg

SEQ ID NO: 214613 - DNA, 12 bp, Homo sapiens
tcagtaccaaag

SEQ ID NO: 214614 - DNA, 21 bp, Homo sapiens
tcagtaccaaagaaacaccac

SEQ ID NO: 214615 - DNA, 15 bp, Homo sapiens
tcagtacccacctga

SEQ ID NO: 214616 - DNA, 19 bp, Homo sapiens
tcagtactttatgaaaaaa

SEQ ID NO: 214617 - DNA, 19 bp, Homo sapiens
tcagtaggtccaagggcca

SEQ ID NO: 214618 - DNA, 16 bp, Homo sapiens
tcagtagtgcctgtga

SEQ ID NO: 214619 - DNA, 15 bp, Homo sapiens
tcagtatcaaggctg

SEQ ID NO: 214620 - DNA, 19 bp, Homo sapiens
tcagtatcaaggctgcctg

SEQ ID NO: 214621 - DNA, 13 bp, Homo sapiens
tcagtatcaggcc

SEQ ID NO: 214622 - DNA, 24 bp, Homo sapiens
tcagtatctgtatctctctctctt

SEQ ID NO: 214623 - DNA, 21 bp, Homo sapiens
tcagtattaaaggggggaggg

SEQ ID NO: 214624 - DNA, 14 bp, Homo sapiens
tcagtattgagaca

SEQ ID NO: 214625 - DNA, 15 bp, Homo sapiens
tcagtattgagacac

SEQ ID NO: 214626 - DNA, 14 bp, Homo sapiens
tcagtattgtgtaa

SEQ ID NO: 214627 - DNA, 16 bp, Homo sapiens
tcagtattgtgtaaag

SEQ ID NO: 214628 - DNA, 23 bp, Homo sapiens
tcagtcagttcccggagcacagc

SEQ ID NO: 214629 - DNA, 15 bp, Homo sapiens
tcagtcatgcgtcca

SEQ ID NO: 214630 - DNA, 22 bp, Homo sapiens
tcagtccacccccattgtgaat

SEQ ID NO: 214631 - DNA, 22 bp, Homo sapiens
tcagtccctccctcctggctca

SEQ ID NO: 214632 - DNA, 14 bp, Homo sapiens
tcagtctccctttc

SEQ ID NO: 214633 - DNA, 18 bp, Homo sapiens
tcagtgaagcccaggagg

SEQ ID NO: 214634 - DNA, 16 bp, Homo sapiens
tcagtgagcccctccc

SEQ ID NO: 214635 - DNA, 18 bp, Homo sapiens
tcagtgagcccctcccca

SEQ ID NO: 214636 - DNA, 19 bp, Homo sapiens
tcagtgagcccctccccag

SEQ ID NO: 214637 - DNA, 14 bp, Homo sapiens
tcagtgaggcccag

SEQ ID NO: 214638 - DNA, 18 bp, Homo sapiens
tcagtgaggcccagggag

SEQ ID NO: 214639 - DNA, 16 bp, Homo sapiens
tcagtgccaaaaacaa

SEQ ID NO: 214640 - DNA, 23 bp, Homo sapiens
tcagtgccacctatgcctgtggt

SEQ ID NO: 214641 - DNA, 14 bp, Homo sapiens
tcagtgccacttga

SEQ ID NO: 214642 - DNA, 20 bp, Homo sapiens
tcagtgccacttgacattcc

SEQ ID NO: 214643 - DNA, 16 bp, Homo sapiens
tcagtgcctcctggcc

SEQ ID NO: 214644 - DNA, 23 bp, Homo sapiens
tcagtgctttctcaaaatttgat

SEQ ID NO: 214645 - DNA, 19 bp, Homo sapiens
tcagtggactttccacccc

SEQ ID NO: 214646 - DNA, 20 bp, Homo sapiens
tcagtggcatggctccagtc

SEQ ID NO: 214647 - DNA, 17 bp, Homo sapiens
tcagtgggcaggataaa

SEQ ID NO: 214648 - DNA, 17 bp, Homo sapiens
tcagtggggccccaaag

SEQ ID NO: 214649 - DNA, 19 bp, Homo sapiens
tcagtggggccccaaagcc

SEQ ID NO: 214650 - DNA, 23 bp, Homo sapiens
tcagtggggccccaaagcccagc

SEQ ID NO: 214651 - DNA, 16 bp, Homo sapiens
tcagtgtcctcatcta

SEQ ID NO: 214652 - DNA, 12 bp, Homo sapiens
tcagtgtgaagc

SEQ ID NO: 214653 - DNA, 19 bp, Homo sapiens
tcagtgtggactgggaagc

SEQ ID NO: 214654 - DNA, 19 bp, Homo sapiens
tcagtgtgtctaaatttga

SEQ ID NO: 214655 - DNA, 13 bp, Homo sapiens
tcagtgttaaaaa

SEQ ID NO: 214656 - DNA, 22 bp, Homo sapiens
tcagttaggattaggtttagaa

SEQ ID NO: 214657 - DNA, 13 bp, Homo sapiens
tcagttattaaat

SEQ ID NO: 214658 - DNA, 13 bp, Homo sapiens
tcagttattcatt

SEQ ID NO: 214659 - DNA, 15 bp, Homo sapiens
tcagttcccggagca

SEQ ID NO: 214660 - DNA, 21 bp, Homo sapiens
tcagttcccggagcacagccc

SEQ ID NO: 214661 - DNA, 16 bp, Homo sapiens
tcagttcccttggcct

SEQ ID NO: 214662 - DNA, 20 bp, Homo sapiens
tcagttcccttggcctcaga

SEQ ID NO: 214663 - DNA, 17 bp, Homo sapiens
tcagttcctctttgcat

SEQ ID NO: 214664 - DNA, 18 bp, Homo sapiens
tcagttctctcccttcct

SEQ ID NO: 214665 - DNA, 19 bp, Homo sapiens
tcagttctctcccttcctc

SEQ ID NO: 214666 - DNA, 22 bp, Homo sapiens
tcagttgacaaaatatataatg

SEQ ID NO: 214667 - DNA, 19 bp, Homo sapiens
tcagttggaatcattgcta

SEQ ID NO: 214668 - DNA, 13 bp, Homo sapiens
tcagttggagaaa

SEQ ID NO: 214669 - DNA, 13 bp, Homo sapiens
tcagttgtacttt

SEQ ID NO: 214670 - DNA, 12 bp, Homo sapiens
tcagttgttttc

SEQ ID NO: 214671 - DNA, 20 bp, Homo sapiens
tcagtttgaaaatattttgt

SEQ ID NO: 214672 - DNA, 20 bp, Homo sapiens
tcagtttgaaggctgcacac

SEQ ID NO: 214673 - DNA, 21 bp, Homo sapiens
tcagtttggctgtaatttaat

SEQ ID NO: 214674 - DNA, 12 bp, Homo sapiens
tcagtttgtgaa

SEQ ID NO: 214675 - DNA, 21 bp, Homo sapiens
tcagttttgtgtacagtatgt

SEQ ID NO: 214676 - DNA, 23 bp, Homo sapiens
tcagttttgtgtacagtatgtgt

SEQ ID NO: 214677 - DNA, 19 bp, Homo sapiens
tcagtttttgtttttactt

SEQ ID NO: 214678 - DNA, 23 bp, Homo sapiens
tcagttttttatctgggttctct

SEQ ID NO: 214679 - DNA, 14 bp, Homo sapiens
tcataaaaataacc

SEQ ID NO: 214680 - DNA, 21 bp, Homo sapiens
tcataaaataaagtatatata

SEQ ID NO: 214681 - DNA, 18 bp, Homo sapiens
tcataaattatttctaaa

SEQ ID NO: 214682 - DNA, 21 bp, Homo sapiens
tcataaattatttctaaaaca

SEQ ID NO: 214683 - DNA, 13 bp, Homo sapiens
tcataaattcaaa

SEQ ID NO: 214684 - DNA, 20 bp, Homo sapiens
tcataaattggctcctttcc

SEQ ID NO: 214685 - DNA, 17 bp, Homo sapiens
tcataacaatgtatgtg

SEQ ID NO: 214686 - DNA, 16 bp, Homo sapiens
tcataagatattcttt

SEQ ID NO: 214687 - DNA, 17 bp, Homo sapiens
tcataagatattcttta

SEQ ID NO: 214688 - DNA, 19 bp, Homo sapiens
tcataaggcctgccctccc

SEQ ID NO: 214689 - DNA, 13 bp, Homo sapiens
tcataatgactta

SEQ ID NO: 214690 - DNA, 21 bp, Homo sapiens
tcataattgtcaaaaaccaga

SEQ ID NO: 214691 - DNA, 16 bp, Homo sapiens
tcatacagaaggtggg

SEQ ID NO: 214692 - DNA, 15 bp, Homo sapiens
tcataccacaataaa

SEQ ID NO: 214693 - DNA, 15 bp, Homo sapiens
tcatacctccctcct

SEQ ID NO: 214694 - DNA, 20 bp, Homo sapiens
tcatactatctactctcctc

SEQ ID NO: 214695 - DNA, 13 bp, Homo sapiens
tcatactctgtgt

SEQ ID NO: 214696 - DNA, 18 bp, Homo sapiens
tcatactctgttgcctcc

SEQ ID NO: 214697 - DNA, 18 bp, Homo sapiens
tcatactgtcatataatg

SEQ ID NO: 214698 - DNA, 16 bp, Homo sapiens
tcatagaatagcatgt

SEQ ID NO: 214699 - DNA, 18 bp, Homo sapiens
tcatagaatagcatgttg

SEQ ID NO: 214700 - DNA, 22 bp, Homo sapiens
tcatagaatagcatgttgtaga

SEQ ID NO: 214701 - DNA, 20 bp, Homo sapiens
tcatagataccattttgaaa

SEQ ID NO: 214702 - DNA, 18 bp, Homo sapiens
tcatagcatcctgattat

SEQ ID NO: 214703 - DNA, 14 bp, Homo sapiens
tcatgtgctttgta

SEQ ID NO: 214704 - DNA, 15 bp, Homo sapiens
tcatgtgctttgtag

SEQ ID NO: 214705 - DNA, 22 bp, Homo sapiens
tcatgtgggtgagccagtggaa

SEQ ID NO: 214706 - DNA, 12 bp, Homo sapiens
tcatgtgtatga

SEQ ID NO: 214707 - DNA, 13 bp, Homo sapiens
tcatgtgtatgag

SEQ ID NO: 214708 - DNA, 19 bp, Homo sapiens
tcatgtgtatgagaagtac

SEQ ID NO: 214709 - DNA, 23 bp, Homo sapiens
tcatgtgttgcaaattattctag

SEQ ID NO: 214710 - DNA, 22 bp, Homo sapiens
tcatgttaatcctagctgtgtg

SEQ ID NO: 214711 - DNA, 10 bp, Homo sapiens
tcatgttctc

SEQ ID NO: 214712 - DNA, 16 bp, Homo sapiens
actgaggccttctcaa

SEQ ID NO: 214713 - DNA, 17 bp, Homo sapiens
actgaggcttagagaga

SEQ ID NO: 214714 - DNA, 21 bp, Homo sapiens
actgagggaccaactgggccc

SEQ ID NO: 214715 - DNA, 22 bp, Homo sapiens
actgagtctcattcctctgtcc

SEQ ID NO: 214716 - DNA, 13 bp, Homo sapiens
actgagtgcctgc

SEQ ID NO: 214717 - DNA, 20 bp, Homo sapiens
actgagtgcctgcagcatct

SEQ ID NO: 214718 - DNA, 21 bp, Homo sapiens
actgagtgttcaaactactgt

SEQ ID NO: 214719 - DNA, 22 bp, Homo sapiens
actgatatcacgggcccgctca

SEQ ID NO: 214720 - DNA, 18 bp, Homo sapiens
actgatcatgcattgttg

SEQ ID NO: 214721 - DNA, 18 bp, Homo sapiens
actgatcatttgcagctg

SEQ ID NO: 214722 - DNA, 20 bp, Homo sapiens
actgatcatttgcagctgct

SEQ ID NO: 214723 - DNA, 21 bp, Homo sapiens
actgatcctgaacaagaaaga

SEQ ID NO: 214724 - DNA, 13 bp, Homo sapiens
actgatctctcgt

SEQ ID NO: 214725 - DNA, 19 bp, Homo sapiens
actgatgagacaacacaca

SEQ ID NO: 214726 - DNA, 19 bp, Homo sapiens
actgatgatagacttcgaa

SEQ ID NO: 214727 - DNA, 16 bp, Homo sapiens
actgatgctgagattc

SEQ ID NO: 214728 - DNA, 23 bp, Homo sapiens
actgatggaccgggtgggcctgg

SEQ ID NO: 214729 - DNA, 15 bp, Homo sapiens
actgatgggtcctgc

SEQ ID NO: 214730 - DNA, 14 bp, Homo sapiens
actgatgtcatctt

SEQ ID NO: 214731 - DNA, 16 bp, Homo sapiens
actgatgttaggctgg

SEQ ID NO: 214732 - DNA, 18 bp, Homo sapiens
actgatgttaggctgggc

SEQ ID NO: 214733 - DNA, 21 bp, Homo sapiens
actgatgttaggctgggccca

SEQ ID NO: 214734 - DNA, 23 bp, Homo sapiens
actgatgttaggctgggcccaga

SEQ ID NO: 214735 - DNA, 13 bp, Homo sapiens
actgatttccttt

SEQ ID NO: 214736 - DNA, 22 bp, Homo sapiens
actgattttgttatttttatat

SEQ ID NO: 214737 - DNA, 14 bp, Homo sapiens
actgcaaacaataa

SEQ ID NO: 214738 - DNA, 16 bp, Homo sapiens
actgcaaacaataaac

SEQ ID NO: 214739 - DNA, 19 bp, Homo sapiens
actgcaaacaataaacatc

SEQ ID NO: 214740 - DNA, 11 bp, Homo sapiens
actgcaacagg

SEQ ID NO: 214741 - DNA, 15 bp, Homo sapiens
actgcaacaggaact

SEQ ID NO: 214742 - DNA, 17 bp, Homo sapiens
actgcaacctctgcctc

SEQ ID NO: 214743 - DNA, 20 bp, Homo sapiens
actgcaagtgagcaaacctg

SEQ ID NO: 214744 - DNA, 13 bp, Homo sapiens
actgcaatatcaa

SEQ ID NO: 214745 - DNA, 14 bp, Homo sapiens
actgcaatttccat

SEQ ID NO: 214746 - DNA, 15 bp, Homo sapiens
actgcaatttccatt

SEQ ID NO: 214747 - DNA, 22 bp, Homo sapiens
actgcacagtgcatctcagccc

SEQ ID NO: 214748 - DNA, 23 bp, Homo sapiens
actgcacagtgcatctcagccca

SEQ ID NO: 214749 - DNA, 15 bp, Homo sapiens
actgcacagtgctgt

SEQ ID NO: 214750 - DNA, 20 bp, Homo sapiens
actgcacttggtgctgcttt

SEQ ID NO: 214751 - DNA, 21 bp, Homo sapiens
actgcagaggagccacctggg

SEQ ID NO: 214752 - DNA, 16 bp, Homo sapiens
actgcagccctctcca

SEQ ID NO: 214753 - DNA, 23 bp, Homo sapiens
actgcagccctctccaccctccg

SEQ ID NO: 214754 - DNA, 12 bp, Homo sapiens
actgcagggaca

SEQ ID NO: 214755 - DNA, 18 bp, Homo sapiens
actgcagggactgccagt

SEQ ID NO: 214756 - DNA, 18 bp, Homo sapiens
actgcaggttggacccca

SEQ ID NO: 214757 - DNA, 19 bp, Homo sapiens
actgcaggttggaccccag

SEQ ID NO: 214758 - DNA, 23 bp, Homo sapiens
actgcatatcctggtgtctagtt

SEQ ID NO: 214759 - DNA, 22 bp, Homo sapiens
actgcatcaagatgtgacatgt

SEQ ID NO: 214760 - DNA, 14 bp, Homo sapiens
actgcatccaggcc

SEQ ID NO: 214761 - DNA, 19 bp, Homo sapiens
actgcatccaggcctgagg

SEQ ID NO: 214762 - DNA, 16 bp, Homo sapiens
actgcatcctactcct

SEQ ID NO: 214763 - DNA, 21 bp, Homo sapiens
actgcatcctactcctacctg

SEQ ID NO: 214764 - DNA, 17 bp, Homo sapiens
actgcatggtaatttat

SEQ ID NO: 214765 - DNA, 18 bp, Homo sapiens
actgccagaagtgtgttt

SEQ ID NO: 214766 - DNA, 13 bp, Homo sapiens
actgccagagcta

SEQ ID NO: 214767 - DNA, 12 bp, Homo sapiens
actgccaggcac

SEQ ID NO: 214768 - DNA, 18 bp, Homo sapiens
actgccaggcacctggcc

SEQ ID NO: 214769 - DNA, 21 bp, Homo sapiens
actgccaggcacctggcctgc

SEQ ID NO: 214770 - DNA, 22 bp, Homo sapiens
actgccaggcacctggcctgct

SEQ ID NO: 214771 - DNA, 19 bp, Homo sapiens
actgccagtccccctgccc

SEQ ID NO: 214772 - DNA, 11 bp, Homo sapiens
actgcccaccc

SEQ ID NO: 214773 - DNA, 12 bp, Homo sapiens
actgcccaccct

SEQ ID NO: 214774 - DNA, 14 bp, Homo sapiens
actgcccaccctgg

SEQ ID NO: 214775 - DNA, 20 bp, Homo sapiens
actgccccacggccctgtca

SEQ ID NO: 214776 - DNA, 12 bp, Homo sapiens
actgcccccaga

SEQ ID NO: 214777 - DNA, 13 bp, Homo sapiens
actgcccccagaa

SEQ ID NO: 214778 - DNA, 14 bp, Homo sapiens
actgcccgagctgg

SEQ ID NO: 214779 - DNA, 21 bp, Homo sapiens
actgcccgagctggtgcatta

SEQ ID NO: 214780 - DNA, 17 bp, Homo sapiens
actgcccggggcagctg

SEQ ID NO: 214781 - DNA, 11 bp, Homo sapiens
actgccctctg

SEQ ID NO: 214782 - DNA, 14 bp, Homo sapiens
actgccctctgttc

SEQ ID NO: 214783 - DNA, 15 bp, Homo sapiens
actgccctgcctgcc

SEQ ID NO: 214784 - DNA, 23 bp, Homo sapiens
actgccctgcctgcccacttagc

SEQ ID NO: 214785 - DNA, 23 bp, Homo sapiens
actgccgaccgaggctggagctg

SEQ ID NO: 214786 - DNA, 19 bp, Homo sapiens
actgcctaccagtcgccct

SEQ ID NO: 214787 - DNA, 14 bp, Homo sapiens
actgcctccctctc

SEQ ID NO: 214788 - DNA, 13 bp, Homo sapiens
actgcctctgcca

SEQ ID NO: 214789 - DNA, 15 bp, Homo sapiens
actgcctctgccaca

SEQ ID NO: 214790 - DNA, 15 bp, Homo sapiens
actgcctctgcctta

SEQ ID NO: 214791 - DNA, 14 bp, Homo sapiens
actgcctcttcctc

SEQ ID NO: 214792 - DNA, 9 bp, Homo sapiens
actgcctgc

SEQ ID NO: 214793 - DNA, 19 bp, Homo sapiens
actgcctgcccacccgtgg

SEQ ID NO: 214794 - DNA, 15 bp, Homo sapiens
actgccttaaaactt

SEQ ID NO: 214795 - DNA, 22 bp, Homo sapiens
actgccttcagtatcaaggctg

SEQ ID NO: 214796 - DNA, 21 bp, Homo sapiens
actgccttctcctctctgggc

SEQ ID NO: 214797 - DNA, 14 bp, Homo sapiens
actgcgaactctca

SEQ ID NO: 214798 - DNA, 17 bp, Homo sapiens
actgcgcccgggcaaga

SEQ ID NO: 214799 - DNA, 20 bp, Homo sapiens
actgcggaaaaggaaggaaa

SEQ ID NO: 214800 - DNA, 12 bp, Homo sapiens
actgctaataaa

SEQ ID NO: 214801 - DNA, 13 bp, Homo sapiens
actgctaataaat

SEQ ID NO: 214802 - DNA, 15 bp, Homo sapiens
actgctaataaatga

SEQ ID NO: 214803 - DNA, 18 bp, Homo sapiens
actgctaataaatgacca

SEQ ID NO: 214804 - DNA, 21 bp, Homo sapiens
actgctaataaatgaccagtt

SEQ ID NO: 214805 - DNA, 23 bp, Homo sapiens
actgctaataaatgaccagttta

SEQ ID NO: 214806 - DNA, 21 bp, Homo sapiens
actgctaattacacacgtgtg

SEQ ID NO: 214807 - DNA, 16 bp, Homo sapiens
actgctaggtgggcca

SEQ ID NO: 214808 - DNA, 23 bp, Homo sapiens
actgctaggtgggccagcccctc

SEQ ID NO: 214809 - DNA, 16 bp, Homo sapiens
actgctcaagaagaca

SEQ ID NO: 214810 - DNA, 15 bp, Homo sapiens
actgctcttttacta

SEQ ID NO: 214811 - DNA, 12 bp, Homo sapiens
actgctgagcca

SEQ ID NO: 214812 - DNA, 14 bp, Homo sapiens
actgctgagccact

SEQ ID NO: 214813 - DNA, 16 bp, Homo sapiens
actgctgagccactcg

SEQ ID NO: 214814 - DNA, 22 bp, Homo sapiens
actgctgatgctgaaataaact

SEQ ID NO: 214815 - DNA, 20 bp, Homo sapiens
actgctgccatttttgcaaa

SEQ ID NO: 214816 - DNA, 16 bp, Homo sapiens
actgctgcccagcctc

SEQ ID NO: 214817 - DNA, 16 bp, Homo sapiens
actgctgctccccacc

SEQ ID NO: 214818 - DNA, 17 bp, Homo sapiens
actgctgctccccaccc

SEQ ID NO: 214819 - DNA, 13 bp, Homo sapiens
actgctgctcctc

SEQ ID NO: 214820 - DNA, 19 bp, Homo sapiens
actgctgctcctctttccc

SEQ ID NO: 214821 - DNA, 17 bp, Homo sapiens
actgctgggaagtggct

SEQ ID NO: 214822 - DNA, 16 bp, Homo sapiens
actgctggggagtccc

SEQ ID NO: 214823 - DNA, 15 bp, Homo sapiens
actgctgtcattgtc

SEQ ID NO: 214824 - DNA, 16 bp, Homo sapiens
actgctgtcattgtcc

SEQ ID NO: 214825 - DNA, 19 bp, Homo sapiens
actgctgtccctcctgagg

SEQ ID NO: 214826 - DNA, 16 bp, Homo sapiens
actgctgtgaacaagt

SEQ ID NO: 214827 - DNA, 23 bp, Homo sapiens
actgctgtgaacaagtgaacaca

SEQ ID NO: 214828 - DNA, 15 bp, Homo sapiens
actgctgttttatgt

SEQ ID NO: 214829 - DNA, 23 bp, Homo sapiens
actgcttcacggactctttgctg

SEQ ID NO: 214830 - DNA, 19 bp, Homo sapiens
actgcttgcatttctttat

SEQ ID NO: 214831 - DNA, 13 bp, Homo sapiens
actgcttgcccag

SEQ ID NO: 214832 - DNA, 21 bp, Homo sapiens
actgcttgtgaaaggaaagag

SEQ ID NO: 214833 - DNA, 20 bp, Homo sapiens
tccaacgttaaaagacagtg

SEQ ID NO: 214834 - DNA, 16 bp, Homo sapiens
tccaactatgtccaga

SEQ ID NO: 214835 - DNA, 16 bp, Homo sapiens
tccaactattaagata

SEQ ID NO: 214836 - DNA, 15 bp, Homo sapiens
tccaactgcatccag

SEQ ID NO: 214837 - DNA, 20 bp, Homo sapiens
tccaactgcatccaggcctg

SEQ ID NO: 214838 - DNA, 15 bp, Homo sapiens
tccaacttttcatcc

SEQ ID NO: 214839 - DNA, 14 bp, Homo sapiens
tccaagaagccctc

SEQ ID NO: 214840 - DNA, 16 bp, Homo sapiens
tccaagaagccctcct

SEQ ID NO: 214841 - DNA, 19 bp, Homo sapiens
tccaagaatacagaaaatg

SEQ ID NO: 214842 - DNA, 16 bp, Homo sapiens
tccaagaatgttttgc

SEQ ID NO: 214843 - DNA, 19 bp, Homo sapiens
tccaagcctgcctcccaag

SEQ ID NO: 214844 - DNA, 13 bp, Homo sapiens
tccaagcctgggc

SEQ ID NO: 214845 - DNA, 19 bp, Homo sapiens
tccaagcctgggccactgg

SEQ ID NO: 214846 - DNA, 18 bp, Homo sapiens
tccaagctccatctccac

SEQ ID NO: 214847 - DNA, 21 bp, Homo sapiens
tccaaggcaaatgtccaagca

SEQ ID NO: 214848 - DNA, 20 bp, Homo sapiens
tccaagggtatgggaagcca

SEQ ID NO: 214849 - DNA, 16 bp, Homo sapiens
tccaagtaccaatgct

SEQ ID NO: 214850 - DNA, 17 bp, Homo sapiens
actccaggatcctcctg

SEQ ID NO: 214851 - DNA, 21 bp, Homo sapiens
actccagggttaaagaaaggc

SEQ ID NO: 214852 - DNA, 19 bp, Homo sapiens
actccagtgttcccttctg

SEQ ID NO: 214853 - DNA, 15 bp, Homo sapiens
actccatacagcctc

SEQ ID NO: 214854 - DNA, 18 bp, Homo sapiens
actccatatttatttaaa

SEQ ID NO: 214855 - DNA, 20 bp, Homo sapiens
actccatgcctatttactgg

SEQ ID NO: 214856 - DNA, 13 bp, Homo sapiens
actccatggccac

SEQ ID NO: 214857 - DNA, 15 bp, Homo sapiens
actccatggccaccc

SEQ ID NO: 214858 - DNA, 23 bp, Homo sapiens
actccatggccaccccgtgccac

SEQ ID NO: 214859 - DNA, 15 bp, Homo sapiens
actccatggcccttc

SEQ ID NO: 214860 - DNA, 19 bp, Homo sapiens
actccatggcccttcctgg

SEQ ID NO: 214861 - DNA, 13 bp, Homo sapiens
actcccaagaaca

SEQ ID NO: 214862 - DNA, 14 bp, Homo sapiens
actcccaagaacag

SEQ ID NO: 214863 - DNA, 19 bp, Homo sapiens
actcccaagaacagcaggc

SEQ ID NO: 214864 - DNA, 21 bp, Homo sapiens
actcccagccaccaccactgt

SEQ ID NO: 214865 - DNA, 12 bp, Homo sapiens
actcccagggcc

SEQ ID NO: 214866 - DNA, 13 bp, Homo sapiens
actcccagggccc

SEQ ID NO: 214867 - DNA, 14 bp, Homo sapiens
actcccccacctga

SEQ ID NO: 214868 - DNA, 13 bp, Homo sapiens
actcccccagccc

SEQ ID NO: 214869 - DNA, 14 bp, Homo sapiens
actcccctgatccc

SEQ ID NO: 214870 - DNA, 15 bp, Homo sapiens
actccccttgagctg

SEQ ID NO: 214871 - DNA, 20 bp, Homo sapiens
actccccttgagctgagatg

SEQ ID NO: 214872 - DNA, 17 bp, Homo sapiens
actcccgggccacgccc

SEQ ID NO: 214873 - DNA, 18 bp, Homo sapiens
actcccgggccacgcccc

SEQ ID NO: 214874 - DNA, 22 bp, Homo sapiens
actcccgggccacgccccagcc

SEQ ID NO: 214875 - DNA, 19 bp, Homo sapiens
actccctaaagccctcttc

SEQ ID NO: 214876 - DNA, 20 bp, Homo sapiens
actccctaaagccctcttca

SEQ ID NO: 214877 - DNA, 12 bp, Homo sapiens
actccctagtta

SEQ ID NO: 214878 - DNA, 14 bp, Homo sapiens
actccctccatgtg

SEQ ID NO: 214879 - DNA, 23 bp, Homo sapiens
actccctccatgtggccccaggt

SEQ ID NO: 214880 - DNA, 12 bp, Homo sapiens
actccctcccca

SEQ ID NO: 214881 - DNA, 13 bp, Homo sapiens
actccctccccac

SEQ ID NO: 214882 - DNA, 22 bp, Homo sapiens
actccctcctcacctctggact

SEQ ID NO: 214883 - DNA, 22 bp, Homo sapiens
actccctgccaactccatgacc

SEQ ID NO: 214884 - DNA, 15 bp, Homo sapiens
actccctgccaccgt

SEQ ID NO: 214885 - DNA, 19 bp, Homo sapiens
actccctgccaccgtcaca

SEQ ID NO: 214886 - DNA, 23 bp, Homo sapiens
actccctgccaccgtcacacagt

SEQ ID NO: 214887 - DNA, 16 bp, Homo sapiens
actccctgctccacga

SEQ ID NO: 214888 - DNA, 19 bp, Homo sapiens
actccctgtccatccccag

SEQ ID NO: 214889 - DNA, 20 bp, Homo sapiens
actccctgtccatccccagt

SEQ ID NO: 214890 - DNA, 11 bp, Homo sapiens
actcccttcct

SEQ ID NO: 214891 - DNA, 16 bp, Homo sapiens
actcccttcctggcct

SEQ ID NO: 214892 - DNA, 18 bp, Homo sapiens
actcccttcctggcctca

SEQ ID NO: 214893 - DNA, 16 bp, Homo sapiens
actccctttcccctct

SEQ ID NO: 214894 - DNA, 16 bp, Homo sapiens
actccgcccagcctct

SEQ ID NO: 214895 - DNA, 21 bp, Homo sapiens
actccggattccggccctggc

SEQ ID NO: 214896 - DNA, 20 bp, Homo sapiens
actcctacaagatttagaaa

SEQ ID NO: 214897 - DNA, 14 bp, Homo sapiens
actcctacctggta

SEQ ID NO: 214898 - DNA, 14 bp, Homo sapiens
actcctactgcttc

SEQ ID NO: 214899 - DNA, 15 bp, Homo sapiens
actcctaggagagcc

SEQ ID NO: 214900 - DNA, 21 bp, Homo sapiens
actcctaggagagccaacctc

SEQ ID NO: 214901 - DNA, 20 bp, Homo sapiens
actcctcaactgatgataga

SEQ ID NO: 214902 - DNA, 19 bp, Homo sapiens
actcctcagatctgaacac

SEQ ID NO: 214903 - DNA, 19 bp, Homo sapiens
actcctcattgtaaacaaa

SEQ ID NO: 214904 - DNA, 20 bp, Homo sapiens
actcctcccaactctggcct

SEQ ID NO: 214905 - DNA, 20 bp, Homo sapiens
actcctcccttccccactct

SEQ ID NO: 214906 - DNA, 22 bp, Homo sapiens
actcctcccttccccactctgc

SEQ ID NO: 214907 - DNA, 14 bp, Homo sapiens
actcctcctccagc

SEQ ID NO: 214908 - DNA, 23 bp, Homo sapiens
actcctcctccagcccacccaac

SEQ ID NO: 214909 - DNA, 15 bp, Homo sapiens
actcctcgggcaagg

SEQ ID NO: 214910 - DNA, 20 bp, Homo sapiens
actcctctgcagtgccttgg

SEQ ID NO: 214911 - DNA, 16 bp, Homo sapiens
actcctcttatttgct

SEQ ID NO: 214912 - DNA, 15 bp, Homo sapiens
actcctgacagtctt

SEQ ID NO: 214913 - DNA, 18 bp, Homo sapiens
actcctgacatcaggtga

SEQ ID NO: 214914 - DNA, 17 bp, Homo sapiens
actcctgagtggggcca

SEQ ID NO: 214915 - DNA, 23 bp, Homo sapiens
actcctgattgctctggaagcct

SEQ ID NO: 214916 - DNA, 15 bp, Homo sapiens
actcctgattttgta

SEQ ID NO: 214917 - DNA, 10 bp, Homo sapiens
actcctgcct

SEQ ID NO: 214918 - DNA, 18 bp, Homo sapiens
actcctgcctgtgtttgt

SEQ ID NO: 214919 - DNA, 12 bp, Homo sapiens
actcctggcctc

SEQ ID NO: 214920 - DNA, 15 bp, Homo sapiens
actcctgggctcaag

SEQ ID NO: 214921 - DNA, 21 bp, Homo sapiens
actcctggggcctcttgggtc

SEQ ID NO: 214922 - DNA, 17 bp, Homo sapiens
actcctgtacactgaat

SEQ ID NO: 214923 - DNA, 22 bp, Homo sapiens
actcctgttccttgctagccct

SEQ ID NO: 214924 - DNA, 23 bp, Homo sapiens
actccttaatatgatctgtggag

SEQ ID NO: 214925 - DNA, 14 bp, Homo sapiens
actccttcctcttt

SEQ ID NO: 214926 - DNA, 13 bp, Homo sapiens
actccttcctgcc

SEQ ID NO: 214927 - DNA, 17 bp, Homo sapiens
actccttggatttgcat

SEQ ID NO: 214928 - DNA, 18 bp, Homo sapiens
actccttggcctagccca

SEQ ID NO: 214929 - DNA, 20 bp, Homo sapiens
actcctttcctgcatctttc

SEQ ID NO: 214930 - DNA, 15 bp, Homo sapiens
actcgaaaagagcac

SEQ ID NO: 214931 - DNA, 16 bp, Homo sapiens
actcgactctgctgct

SEQ ID NO: 214932 - DNA, 22 bp, Homo sapiens
actcgagaccatcctggcccct

SEQ ID NO: 214933 - DNA, 18 bp, Homo sapiens
actcgagagggctgagcc

SEQ ID NO: 214934 - DNA, 19 bp, Homo sapiens
actcgagagggctgagccc

SEQ ID NO: 214935 - DNA, 16 bp, Homo sapiens
actcgatgcactgacc

SEQ ID NO: 214936 - DNA, 14 bp, Homo sapiens
actcgcactgcaaa

SEQ ID NO: 214937 - DNA, 19 bp, Homo sapiens
actcgcccgcccactgtcc

SEQ ID NO: 214938 - DNA, 21 bp, Homo sapiens
actcgcccgcccactgtcctg

SEQ ID NO: 214939 - DNA, 19 bp, Homo sapiens
actcgcttagctgaaacct

SEQ ID NO: 214940 - DNA, 21 bp, Homo sapiens
actcgggagcattctgcctgc

SEQ ID NO: 214941 - DNA, 21 bp, Homo sapiens
actcgggctaagtccagctct

SEQ ID NO: 214942 - DNA, 21 bp, Homo sapiens
actcgtgtgcatgagaatgtc

SEQ ID NO: 214943 - DNA, 22 bp, Homo sapiens
actcgtgtgcatgagaatgtca

SEQ ID NO: 214944 - DNA, 13 bp, Homo sapiens
actctaaatgcag

SEQ ID NO: 214945 - DNA, 23 bp, Homo sapiens
actctaagaaatggctttccaca

SEQ ID NO: 214946 - DNA, 20 bp, Homo sapiens
actctaattcccattttgca

SEQ ID NO: 214947 - DNA, 21 bp, Homo sapiens
actctaattcccattttgcaa

SEQ ID NO: 214948 - DNA, 18 bp, Homo sapiens
actctacccccaacacca

SEQ ID NO: 214949 - DNA, 14 bp, Homo sapiens
actctacccctgct

SEQ ID NO: 214950 - DNA, 23 bp, Homo sapiens
actctacccctgctcccattcct

SEQ ID NO: 214951 - DNA, 13 bp, Homo sapiens
actctaccctccc

SEQ ID NO: 214952 - DNA, 16 bp, Homo sapiens
actctaccctcccacc

SEQ ID NO: 214953 - DNA, 19 bp, Homo sapiens
actctaccctcccaccccc

SEQ ID NO: 214954 - DNA, 22 bp, Homo sapiens
actctaccctggtaggaaagca

SEQ ID NO: 214955 - DNA, 21 bp, Homo sapiens
actctacttagcatgtcccta

SEQ ID NO: 214956 - DNA, 13 bp, Homo sapiens
actctagcctggg

SEQ ID NO: 214957 - DNA, 17 bp, Homo sapiens
actctagcctgggccag

SEQ ID NO: 214958 - DNA, 18 bp, Homo sapiens
actctagtgacttcctgg

SEQ ID NO: 214959 - DNA, 14 bp, Homo sapiens
actctagttctaga

SEQ ID NO: 214960 - DNA, 15 bp, Homo sapiens
actctagttctagat

SEQ ID NO: 214961 - DNA, 16 bp, Homo sapiens
actctagttctagatg

SEQ ID NO: 214962 - DNA, 16 bp, Homo sapiens
actctatctgggcctg

SEQ ID NO: 214963 - DNA, 20 bp, Homo sapiens
actctcagagactcccagga

SEQ ID NO: 214964 - DNA, 15 bp, Homo sapiens
actctcagtgcttct

SEQ ID NO: 214965 - DNA, 19 bp, Homo sapiens
actctccaatgttctatta

SEQ ID NO: 214966 - DNA, 19 bp, Homo sapiens
actctcccagaggctcctg

SEQ ID NO: 214967 - DNA, 20 bp, Homo sapiens
actctcccagaggctcctgg

SEQ ID NO: 214968 - DNA, 16 bp, Homo sapiens
actgtcggagaggctg

SEQ ID NO: 214969 - DNA, 20 bp, Homo sapiens
actgtcggagaggctgtctg

SEQ ID NO: 214970 - DNA, 14 bp, Homo sapiens
actgtctaagaata

SEQ ID NO: 214971 - DNA, 22 bp, Homo sapiens
actgtctaagaataatgacgta

SEQ ID NO: 214972 - DNA, 12 bp, Homo sapiens
actgtctccttc

SEQ ID NO: 214973 - DNA, 18 bp, Homo sapiens
actgtctccttcccactg

SEQ ID NO: 214974 - DNA, 15 bp, Homo sapiens
actgtctgtagtgtt

SEQ ID NO: 214975 - DNA, 19 bp, Homo sapiens
actgtcttcaaccctgccc

SEQ ID NO: 214976 - DNA, 14 bp, Homo sapiens
actgtcttgagaaa

SEQ ID NO: 214977 - DNA, 15 bp, Homo sapiens
actgtcttgtctcac

SEQ ID NO: 214978 - DNA, 15 bp, Homo sapiens
actgtctttattctt

SEQ ID NO: 214979 - DNA, 12 bp, Homo sapiens
actgtctttcct

SEQ ID NO: 214980 - DNA, 23 bp, Homo sapiens
actgtgaatgtaaaacagagcca

SEQ ID NO: 214981 - DNA, 23 bp, Homo sapiens
actgtgacaactgtctaacttta

SEQ ID NO: 214982 - DNA, 14 bp, Homo sapiens
actgtgacattcca

SEQ ID NO: 214983 - DNA, 17 bp, Homo sapiens
actgtgacattccacag

SEQ ID NO: 214984 - DNA, 21 bp, Homo sapiens
actgtgaccaccttctgtccc

SEQ ID NO: 214985 - DNA, 12 bp, Homo sapiens
actgtgacctgt

SEQ ID NO: 214986 - DNA, 16 bp, Homo sapiens
actgtgagataaatat

SEQ ID NO: 214987 - DNA, 22 bp, Homo sapiens
actgtgatgccacacagagtgg

SEQ ID NO: 214988 - DNA, 13 bp, Homo sapiens
actgtgatttatt

SEQ ID NO: 214989 - DNA, 12 bp, Homo sapiens
actgtgcagtta

SEQ ID NO: 214990 - DNA, 21 bp, Homo sapiens
actgtgcatcaaccaggaaga

SEQ ID NO: 214991 - DNA, 16 bp, Homo sapiens
actgtgcctagttcct

SEQ ID NO: 214992 - DNA, 16 bp, Homo sapiens
actgtgctcagataca

SEQ ID NO: 214993 - DNA, 21 bp, Homo sapiens
actgtgctgattcaataaaat

SEQ ID NO: 214994 - DNA, 21 bp, Homo sapiens
actgtggatacccttaccctt

SEQ ID NO: 214995 - DNA, 15 bp, Homo sapiens
actgtggccagagct

SEQ ID NO: 214996 - DNA, 17 bp, Homo sapiens
actgtggccagagctgg

SEQ ID NO: 214997 - DNA, 18 bp, Homo sapiens
actgtggcctcaggaggc

SEQ ID NO: 214998 - DNA, 17 bp, Homo sapiens
cttcccacggccactgc

SEQ ID NO: 214999 - DNA, 18 bp, Homo sapiens
cttcccaggaccctgggt

SEQ ID NO: 215000 - DNA, 19 bp, Homo sapiens
cttcccaggaccctgggtc

SEQ ID NO: 215001 - DNA, 18 bp, Homo sapiens
cttcccaggccagcgagg

SEQ ID NO: 215002 - DNA, 21 bp, Homo sapiens
cttcccatgcctgtctctgtt

SEQ ID NO: 215003 - DNA, 18 bp, Homo sapiens
cttcccattgtggctcct

SEQ ID NO: 215004 - DNA, 15 bp, Homo sapiens
cttcccatttctcta

SEQ ID NO: 215005 - DNA, 18 bp, Homo sapiens
cttcccatttctctacac

SEQ ID NO: 215006 - DNA, 22 bp, Homo sapiens
cttcccatttctctacactaag

SEQ ID NO: 215007 - DNA, 14 bp, Homo sapiens
cttcccatttgtaa

SEQ ID NO: 215008 - DNA, 15 bp, Homo sapiens
cttcccatttgtaat

SEQ ID NO: 215009 - DNA, 15 bp, Homo sapiens
cttccccaccttccc

SEQ ID NO: 215010 - DNA, 10 bp, Homo sapiens
cttccccact

SEQ ID NO: 215011 - DNA, 22 bp, Homo sapiens
cttccccactctgctcccagcc

SEQ ID NO: 215012 - DNA, 11 bp, Homo sapiens
cttccccactg

SEQ ID NO: 215013 - DNA, 13 bp, Homo sapiens
cttcccccagccc

SEQ ID NO: 215014 - DNA, 14 bp, Homo sapiens
cttcccccagccca

SEQ ID NO: 215015 - DNA, 17 bp, Homo sapiens
cttcccccagcccaata

SEQ ID NO: 215016 - DNA, 17 bp, Homo sapiens
cttcccccatgtgcctg

SEQ ID NO: 215017 - DNA, 20 bp, Homo sapiens
cttcccccgcaatgtgcccc

SEQ ID NO: 215018 - DNA, 13 bp, Homo sapiens
cttccccctccat

SEQ ID NO: 215019 - DNA, 16 bp, Homo sapiens
cttccccctctcccag

SEQ ID NO: 215020 - DNA, 13 bp, Homo sapiens
cttcccccttccc

SEQ ID NO: 215021 - DNA, 18 bp, Homo sapiens
cttccccgtgcggcccgt

SEQ ID NO: 215022 - DNA, 19 bp, Homo sapiens
cttccccgtgcggcccgtg

SEQ ID NO: 215023 - DNA, 19 bp, Homo sapiens
cttcccctctaatgctcac

SEQ ID NO: 215024 - DNA, 21 bp, Homo sapiens
cttcccctgaggacctttctg

SEQ ID NO: 215025 - DNA, 19 bp, Homo sapiens
cttcccctgcgccctccct

SEQ ID NO: 215026 - DNA, 21 bp, Homo sapiens
cttcccctgcgccctccctcc

SEQ ID NO: 215027 - DNA, 22 bp, Homo sapiens
cttcccctgcgccctccctccc

SEQ ID NO: 215028 - DNA, 16 bp, Homo sapiens
cttcccctgctgacct

SEQ ID NO: 215029 - DNA, 17 bp, Homo sapiens
cttccccttttgcctgg

SEQ ID NO: 215030 - DNA, 16 bp, Homo sapiens
cttcccgcagcaccag

SEQ ID NO: 215031 - DNA, 18 bp, Homo sapiens
cttcccgcctcagcctct

SEQ ID NO: 215032 - DNA, 19 bp, Homo sapiens
cttccctacccacagggcc

SEQ ID NO: 215033 - DNA, 13 bp, Homo sapiens
cttccctacctca

SEQ ID NO: 215034 - DNA, 17 bp, Homo sapiens
cttccctacctcaggca

SEQ ID NO: 215035 - DNA, 20 bp, Homo sapiens
cttccctacctcaggcagga

SEQ ID NO: 215036 - DNA, 20 bp, Homo sapiens
cttccctagaagtcttcatg

SEQ ID NO: 215037 - DNA, 22 bp, Homo sapiens
cttccctagatggttccctttg

SEQ ID NO: 215038 - DNA, 18 bp, Homo sapiens
cttccctagggctgggtg

SEQ ID NO: 215039 - DNA, 19 bp, Homo sapiens
cttccctagggctgggtgt

SEQ ID NO: 215040 - DNA, 16 bp, Homo sapiens
cttccctcatgttctc

SEQ ID NO: 215041 - DNA, 13 bp, Homo sapiens
cttccctccacct

SEQ ID NO: 215042 - DNA, 19 bp, Homo sapiens
cttccctccacctgcttgt

SEQ ID NO: 215043 - DNA, 19 bp, Homo sapiens
cttccctccccacagtcct

SEQ ID NO: 215044 - DNA, 15 bp, Homo sapiens
cttccctccctatct

SEQ ID NO: 215045 - DNA, 23 bp, Homo sapiens
cttccctctcgctcccctctgcc

SEQ ID NO: 215046 - DNA, 11 bp, Homo sapiens
cttccctctgc

SEQ ID NO: 215047 - DNA, 17 bp, Homo sapiens
cttccctgacttgcttt

SEQ ID NO: 215048 - DNA, 12 bp, Homo sapiens
cttccctgcttc

SEQ ID NO: 215049 - DNA, 15 bp, Homo sapiens
cttccctggccccgc

SEQ ID NO: 215050 - DNA, 19 bp, Homo sapiens
cttccctgggaaggctaag

SEQ ID NO: 215051 - DNA, 13 bp, Homo sapiens
cttccctgggggt

SEQ ID NO: 215052 - DNA, 20 bp, Homo sapiens
cttccctgggggtcccagga

SEQ ID NO: 215053 - DNA, 22 bp, Homo sapiens
cttccctgggggtcccaggatc

SEQ ID NO: 215054 - DNA, 18 bp, Homo sapiens
cttccctggtccagattg

SEQ ID NO: 215055 - DNA, 22 bp, Homo sapiens
cttccctggtccccccaaatct

SEQ ID NO: 215056 - DNA, 16 bp, Homo sapiens
cttcccttagcctctc

SEQ ID NO: 215057 - DNA, 17 bp, Homo sapiens
cttcccttagcctctcc

SEQ ID NO: 215058 - DNA, 21 bp, Homo sapiens
cttcccttagcctctcccacc

SEQ ID NO: 215059 - DNA, 21 bp, Homo sapiens
cttcccttatttttatttatt

SEQ ID NO: 215060 - DNA, 20 bp, Homo sapiens
cttcccttccactgcctctg

SEQ ID NO: 215061 - DNA, 22 bp, Homo sapiens
cttcccttctctctctctcaaa

SEQ ID NO: 215062 - DNA, 15 bp, Homo sapiens
cttccgctctgaggc

SEQ ID NO: 215063 - DNA, 16 bp, Homo sapiens
cttccgctctgaggca

SEQ ID NO: 215064 - DNA, 19 bp, Homo sapiens
cttccgctgcgggcccagc

SEQ ID NO: 215065 - DNA, 17 bp, Homo sapiens
cttccgctgtcacccag

SEQ ID NO: 215066 - DNA, 19 bp, Homo sapiens
cttccgctgtcacccagca

SEQ ID NO: 215067 - DNA, 15 bp, Homo sapiens
cttccgggagctggt

SEQ ID NO: 215068 - DNA, 16 bp, Homo sapiens
cttccgggagctggtg

SEQ ID NO: 215069 - DNA, 18 bp, Homo sapiens
cttccgtcacccttggta

SEQ ID NO: 215070 - DNA, 18 bp, Homo sapiens
cttccgtgagacacaaga

SEQ ID NO: 215071 - DNA, 22 bp, Homo sapiens
cttccgtgggtcatcccagcac

SEQ ID NO: 215072 - DNA, 12 bp, Homo sapiens
cttcctaaatat

SEQ ID NO: 215073 - DNA, 18 bp, Homo sapiens
cttcctacaagagcagcc

SEQ ID NO: 215074 - DNA, 12 bp, Homo sapiens
cttcctagctta

SEQ ID NO: 215075 - DNA, 16 bp, Homo sapiens
cttcctagcttatctc

SEQ ID NO: 215076 - DNA, 17 bp, Homo sapiens
cttcctagcttatctcc

SEQ ID NO: 215077 - DNA, 18 bp, Homo sapiens
cttcctagcttatctccc

SEQ ID NO: 215078 - DNA, 22 bp, Homo sapiens
cttcctagcttatctccctgct

SEQ ID NO: 215079 - DNA, 16 bp, Homo sapiens
cttcctcaagtcttga

SEQ ID NO: 215080 - DNA, 14 bp, Homo sapiens
cttcctccagagga

SEQ ID NO: 215081 - DNA, 18 bp, Homo sapiens
cttcctccagtctgttct

SEQ ID NO: 215082 - DNA, 19 bp, Homo sapiens
cttcctccagtctgttctc

SEQ ID NO: 215083 - DNA, 15 bp, Homo sapiens
cttcctccctcattc

SEQ ID NO: 215084 - DNA, 20 bp, Homo sapiens
cttcctccgtccacccaggc

SEQ ID NO: 215085 - DNA, 21 bp, Homo sapiens
cttcctccgtccacccaggct

SEQ ID NO: 215086 - DNA, 22 bp, Homo sapiens
cttcctccgtccacccaggctg

SEQ ID NO: 215087 - DNA, 24 bp, Homo sapiens
cttcctccgtccacccaggctgca

SEQ ID NO: 215088 - DNA, 13 bp, Homo sapiens
cttcctcctccac

SEQ ID NO: 215089 - DNA, 15 bp, Homo sapiens
cttcctcctcctcct

SEQ ID NO: 215090 - DNA, 13 bp, Homo sapiens
cttcctcctgatg

SEQ ID NO: 215091 - DNA, 22 bp, Homo sapiens
cttcctcctgatggccaagagc

SEQ ID NO: 215092 - DNA, 13 bp, Homo sapiens
cttcctcctggtg

SEQ ID NO: 215093 - DNA, 14 bp, Homo sapiens
cttcctctccactg

SEQ ID NO: 215094 - DNA, 23 bp, Homo sapiens
cttcctctcggctggaagaacat

SEQ ID NO: 215095 - DNA, 15 bp, Homo sapiens
cttcctctctcctta

SEQ ID NO: 215096 - DNA, 11 bp, Homo sapiens
cttcctctgct

SEQ ID NO: 215097 - DNA, 13 bp, Homo sapiens
cttcctctgctga

SEQ ID NO: 215098 - DNA, 20 bp, Homo sapiens
cttcctctggagctttgcag

SEQ ID NO: 215099 - DNA, 15 bp, Homo sapiens
cttcctctggggctc

SEQ ID NO: 215100 - DNA, 14 bp, Homo sapiens
cttcctctttgctt

SEQ ID NO: 215101 - DNA, 23 bp, Homo sapiens
cttcctgagaaacgtccatctct

SEQ ID NO: 215102 - DNA, 20 bp, Homo sapiens
cttcctgagaaagcccacct

SEQ ID NO: 215103 - DNA, 22 bp, Homo sapiens
cttcctgagaaagcccacctgg

SEQ ID NO: 215104 - DNA, 15 bp, Homo sapiens
cttcctgcaattttc

SEQ ID NO: 215105 - DNA, 17 bp, Homo sapiens
cttcctgcaattttcta

SEQ ID NO: 215106 - DNA, 19 bp, Homo sapiens
cttcctgccctacagaggt

SEQ ID NO: 215107 - DNA, 13 bp, Homo sapiens
cttcctgccctgt

SEQ ID NO: 215108 - DNA, 14 bp, Homo sapiens
cttcctgctgctgt

SEQ ID NO: 215109 - DNA, 15 bp, Homo sapiens
cttcctgctgctgta

SEQ ID NO: 215110 - DNA, 22 bp, Homo sapiens
cttcctgctgctgtaactgctg

SEQ ID NO: 215111 - DNA, 22 bp, Homo sapiens
cttcctggactggcccttgccc

SEQ ID NO: 215112 - DNA, 18 bp, Homo sapiens
cttcctggcctcactggc

SEQ ID NO: 215113 - DNA, 19 bp, Homo sapiens
cttcctggcctcactggct

SEQ ID NO: 215114 - DNA, 22 bp, Homo sapiens
cttcctggggccccgctgggat

SEQ ID NO: 215115 - DNA, 22 bp, Homo sapiens
cttcctggtgaggcccagcctg

SEQ ID NO: 215116 - DNA, 21 bp, Homo sapiens
cttcctgtagtgcccctccca

SEQ ID NO: 215117 - DNA, 17 bp, Homo sapiens
cttcctgtccagagaga

SEQ ID NO: 215118 - DNA, 15 bp, Homo sapiens
cttcctgtccgccct

SEQ ID NO: 215119 - DNA, 22 bp, Homo sapiens
cttcctgtccgccctcttcccc

SEQ ID NO: 215120 - DNA, 14 bp, Homo sapiens
cttcctgttctgaa

SEQ ID NO: 215121 - DNA, 16 bp, Homo sapiens
cttccttaccgtgggc

SEQ ID NO: 215122 - DNA, 16 bp, Homo sapiens
cttccttcacatctcc

SEQ ID NO: 215123 - DNA, 17 bp, Homo sapiens
cttccttccgctctgag

SEQ ID NO: 215124 - DNA, 13 bp, Homo sapiens
cttccttctctac

SEQ ID NO: 215125 - DNA, 21 bp, Homo sapiens
cttccttctctactcatgcca

SEQ ID NO: 215126 - DNA, 14 bp, Homo sapiens
cttccttgctctcc

SEQ ID NO: 215127 - DNA, 23 bp, Homo sapiens
cttcctttgtcttacattggctt

SEQ ID NO: 215128 - DNA, 13 bp, Homo sapiens
gaacagggcccag

SEQ ID NO: 215129 - DNA, 18 bp, Homo sapiens
gaacagggcccaggcctg

SEQ ID NO: 215130 - DNA, 18 bp, Homo sapiens
gaacaggttctccaggtg

SEQ ID NO: 215131 - DNA, 13 bp, Homo sapiens
gaacagtggctgg

SEQ ID NO: 215132 - DNA, 17 bp, Homo sapiens
gaacagtggctgggtgg

SEQ ID NO: 215133 - DNA, 22 bp, Homo sapiens
gaacagtggctgggtgggccca

SEQ ID NO: 215134 - DNA, 16 bp, Homo sapiens
gaacagtgtttcccat

SEQ ID NO: 215135 - DNA, 21 bp, Homo sapiens
gaacagttaagcagccgccac

SEQ ID NO: 215136 - DNA, 15 bp, Homo sapiens
gaacatcaagatacc

SEQ ID NO: 215137 - DNA, 18 bp, Homo sapiens
gaacatctgccttgctgc

SEQ ID NO: 215138 - DNA, 16 bp, Homo sapiens
gaacatcttcatataa

SEQ ID NO: 215139 - DNA, 16 bp, Homo sapiens
gaacatgagtgctgat

SEQ ID NO: 215140 - DNA, 21 bp, Homo sapiens
gaacatgagtttatgggaatg

SEQ ID NO: 215141 - DNA, 19 bp, Homo sapiens
gaacatgcagctctgcagc

SEQ ID NO: 215142 - DNA, 21 bp, Homo sapiens
gaacatgcagttcattatttt

SEQ ID NO: 215143 - DNA, 22 bp, Homo sapiens
gaacatggtgtgtgtctctgac

SEQ ID NO: 215144 - DNA, 20 bp, Homo sapiens
gaacatgtcggagtagaaat

SEQ ID NO: 215145 - DNA, 22 bp, Homo sapiens
gaacatttctaactaaggacag

SEQ ID NO: 215146 - DNA, 12 bp, Homo sapiens
gaacatttctca

SEQ ID NO: 215147 - DNA, 18 bp, Homo sapiens
gaacatttgggagactga

SEQ ID NO: 215148 - DNA, 20 bp, Homo sapiens
gaaccaaaacattccgttta

SEQ ID NO: 215149 - DNA, 15 bp, Homo sapiens
gaaccaactgcctta

SEQ ID NO: 215150 - DNA, 17 bp, Homo sapiens
gaaccaagcttgtcttt

SEQ ID NO: 215151 - DNA, 14 bp, Homo sapiens
gaaccaaggcagcc

SEQ ID NO: 215152 - DNA, 17 bp, Homo sapiens
gaaccaaggcagcctcc

SEQ ID NO: 215153 - DNA, 20 bp, Homo sapiens
gaaccaaggcagcctccaga

SEQ ID NO: 215154 - DNA, 23 bp, Homo sapiens
gaaccaaggcagcctccagagcc

SEQ ID NO: 215155 - DNA, 24 bp, Homo sapiens
gaaccaagtggaccttgagaccac

SEQ ID NO: 215156 - DNA, 15 bp, Homo sapiens
gaaccaccctttatt

SEQ ID NO: 215157 - DNA, 19 bp, Homo sapiens
gaaccactacatgcagccc

SEQ ID NO: 215158 - DNA, 13 bp, Homo sapiens
gaaccagagccac

SEQ ID NO: 215159 - DNA, 15 bp, Homo sapiens
gaaccagcactccca

SEQ ID NO: 215160 - DNA, 18 bp, Homo sapiens
gaaccagcactcccaggg

SEQ ID NO: 215161 - DNA, 20 bp, Homo sapiens
gaaccagcactcccagggcc

SEQ ID NO: 215162 - DNA, 21 bp, Homo sapiens
gaaccagcactcccagggccc

SEQ ID NO: 215163 - DNA, 22 bp, Homo sapiens
gaaccagcactcccagggcccg

SEQ ID NO: 215164 - DNA, 13 bp, Homo sapiens
gaaccagccctcc

SEQ ID NO: 215165 - DNA, 17 bp, Homo sapiens
gaaccagccctccagag

SEQ ID NO: 215166 - DNA, 19 bp, Homo sapiens
gaaccagccctccagagca

SEQ ID NO: 215167 - DNA, 21 bp, Homo sapiens
gaaccagccctccagagcagg

SEQ ID NO: 215168 - DNA, 15 bp, Homo sapiens
gaaccagctcatctc

SEQ ID NO: 215169 - DNA, 19 bp, Homo sapiens
gaaccagctcatctccaag

SEQ ID NO: 215170 - DNA, 15 bp, Homo sapiens
gaaccaggccttctg

SEQ ID NO: 215171 - DNA, 16 bp, Homo sapiens
gaaccaggccttctga

SEQ ID NO: 215172 - DNA, 17 bp, Homo sapiens
gaaccagggaggagagg

SEQ ID NO: 215173 - DNA, 20 bp, Homo sapiens
gaaccatcattataaacgtg

SEQ ID NO: 215174 - DNA, 17 bp, Homo sapiens
gaacccaggacgcttct

SEQ ID NO: 215175 - DNA, 22 bp, Homo sapiens
gaacccatttgccatgctgcta

SEQ ID NO: 215176 - DNA, 15 bp, Homo sapiens
gaaccccatgggctt

SEQ ID NO: 215177 - DNA, 17 bp, Homo sapiens
gaaccccatgggcttgg

SEQ ID NO: 215178 - DNA, 15 bp, Homo sapiens
gaaccccccactccc

SEQ ID NO: 215179 - DNA, 15 bp, Homo sapiens
gaacccggtcccagg

SEQ ID NO: 215180 - DNA, 22 bp, Homo sapiens
gaaccctggtgaggaagctcca

SEQ ID NO: 215181 - DNA, 23 bp, Homo sapiens
gaaccctggtgaggaagctccag

SEQ ID NO: 215182 - DNA, 12 bp, Homo sapiens
gaacccttctgc

SEQ ID NO: 215183 - DNA, 15 bp, Homo sapiens
gaacccttctgcttt

SEQ ID NO: 215184 - DNA, 15 bp, Homo sapiens
gaacccttgtgcttg

SEQ ID NO: 215185 - DNA, 18 bp, Homo sapiens
gaacccttttggcccccg

SEQ ID NO: 215186 - DNA, 19 bp, Homo sapiens
gaaccgagcaaagatcaaa

SEQ ID NO: 215187 - DNA, 12 bp, Homo sapiens
gaacctccctgg

SEQ ID NO: 215188 - DNA, 15 bp, Homo sapiens
gaacctccctgggcc

SEQ ID NO: 215189 - DNA, 15 bp, Homo sapiens
gaacctcctatttta

SEQ ID NO: 215190 - DNA, 17 bp, Homo sapiens
gaacctcttccccagaa

SEQ ID NO: 215191 - DNA, 18 bp, Homo sapiens
gaacctggaccaaagctg

SEQ ID NO: 215192 - DNA, 19 bp, Homo sapiens
gaacctggatgtacttaag

SEQ ID NO: 215193 - DNA, 22 bp, Homo sapiens
gaacctggctgcgaactgtgca

SEQ ID NO: 215194 - DNA, 17 bp, Homo sapiens
gaacctggtggctggag

SEQ ID NO: 215195 - DNA, 20 bp, Homo sapiens
gaacctggtggctggaggca

SEQ ID NO: 215196 - DNA, 22 bp, Homo sapiens
gaaccttttgagtgccttacac

SEQ ID NO: 215197 - DNA, 18 bp, Homo sapiens
gaacgagcactggccaga

SEQ ID NO: 215198 - DNA, 15 bp, Homo sapiens
gaacgcaccccactg

SEQ ID NO: 215199 - DNA, 20 bp, Homo sapiens
gaacgcaccccactgggaga

SEQ ID NO: 215200 - DNA, 16 bp, Homo sapiens
gaacgccagtctccca

SEQ ID NO: 215201 - DNA, 13 bp, Homo sapiens
gaacgctcttagc

SEQ ID NO: 215202 - DNA, 21 bp, Homo sapiens
gaacgctcttagctttctcag

SEQ ID NO: 215203 - DNA, 19 bp, Homo sapiens
gaacggaacgttggacttt

SEQ ID NO: 215204 - DNA, 20 bp, Homo sapiens
gaacgtggttcagagactgg

SEQ ID NO: 215205 - DNA, 19 bp, Homo sapiens
gaactaagttttgtgtgta

SEQ ID NO: 215206 - DNA, 19 bp, Homo sapiens
gaactagactgcctgggtt

SEQ ID NO: 215207 - DNA, 16 bp, Homo sapiens
gaactcaactttgaca

SEQ ID NO: 215208 - DNA, 16 bp, Homo sapiens
gaactcacgagccttg

SEQ ID NO: 215209 - DNA, 17 bp, Homo sapiens
gaactcacgagccttgc

SEQ ID NO: 215210 - DNA, 17 bp, Homo sapiens
gaactcagcagttgaca

SEQ ID NO: 215211 - DNA, 16 bp, Homo sapiens
gaactccatacagcct

SEQ ID NO: 215212 - DNA, 17 bp, Homo sapiens
gaactccatacagcctc

SEQ ID NO: 215213 - DNA, 17 bp, Homo sapiens
gaactccttattttgta

SEQ ID NO: 215214 - DNA, 13 bp, Homo sapiens
gaactccttggcc

SEQ ID NO: 215215 - DNA, 15 bp, Homo sapiens
gaactccttggccta

SEQ ID NO: 215216 - DNA, 15 bp, Homo sapiens
gaactcgatgcactg

SEQ ID NO: 215217 - DNA, 21 bp, Homo sapiens
gaactctatctgggcctgggc

SEQ ID NO: 215218 - DNA, 22 bp, Homo sapiens
gaactctatctgggcctgggct

SEQ ID NO: 215219 - DNA, 20 bp, Homo sapiens
gaactctctagttccctcag

SEQ ID NO: 215220 - DNA, 16 bp, Homo sapiens
gaactctgcaactgaa

SEQ ID NO: 215221 - DNA, 14 bp, Homo sapiens
gaactctgtgcagg

SEQ ID NO: 215222 - DNA, 18 bp, Homo sapiens
gaactctgtgcaggtgct

SEQ ID NO: 215223 - DNA, 16 bp, Homo sapiens
gaactctgttccccca

SEQ ID NO: 215224 - DNA, 20 bp, Homo sapiens
gaactcttaatcaaatagca

SEQ ID NO: 215225 - DNA, 22 bp, Homo sapiens
gaactctttctggcctgccttc

SEQ ID NO: 215226 - DNA, 13 bp, Homo sapiens
gaactgaaaacat

SEQ ID NO: 215227 - DNA, 16 bp, Homo sapiens
gaactgaaaacataaa

SEQ ID NO: 215228 - DNA, 17 bp, Homo sapiens
gaactgaagtttcacat

SEQ ID NO: 215229 - DNA, 14 bp, Homo sapiens
gaactgactttctc

SEQ ID NO: 215230 - DNA, 11 bp, Homo sapiens
gaactgagccg

SEQ ID NO: 215231 - DNA, 17 bp, Homo sapiens
gaactgagctcctctgg

SEQ ID NO: 215232 - DNA, 21 bp, Homo sapiens
gaactgagctcctctgggcag

SEQ ID NO: 215233 - DNA, 17 bp, Homo sapiens
gaactgcatgtataaat

SEQ ID NO: 215234 - DNA, 19 bp, Homo sapiens
gaactgctaccatgaagtg

SEQ ID NO: 215235 - DNA, 13 bp, Homo sapiens
gaactgctgctgg

SEQ ID NO: 215236 - DNA, 22 bp, Homo sapiens
gaactgctgctggtcaccccca

SEQ ID NO: 215237 - DNA, 18 bp, Homo sapiens
gaactgggaaaacagtga

SEQ ID NO: 215238 - DNA, 20 bp, Homo sapiens
gaactgggaagatgctggcc

SEQ ID NO: 215239 - DNA, 18 bp, Homo sapiens
gaactggtccaggccagg

SEQ ID NO: 215240 - DNA, 20 bp, Homo sapiens
gaactgtcccacaaaatatt

SEQ ID NO: 215241 - DNA, 21 bp, Homo sapiens
gaactgtctagatggatgaat

SEQ ID NO: 215242 - DNA, 15 bp, Homo sapiens
gaactgtgacaggaa

SEQ ID NO: 215243 - DNA, 18 bp, Homo sapiens
gaactgtgacaggaagcc

SEQ ID NO: 215244 - DNA, 18 bp, Homo sapiens
gaactgtgcatcaaccag

SEQ ID NO: 215245 - DNA, 23 bp, Homo sapiens
gaactgtgcatcaaccaggaaga

SEQ ID NO: 215246 - DNA, 12 bp, Homo sapiens
gaactgtgctct

SEQ ID NO: 215247 - DNA, 17 bp, Homo sapiens
gaactgttagatgctga

SEQ ID NO: 215248 - DNA, 21 bp, Homo sapiens
gaacttcgaccctttctctga

SEQ ID NO: 215249 - DNA, 13 bp, Homo sapiens
gaacttgaggaca

SEQ ID NO: 215250 - DNA, 14 bp, Homo sapiens
gaacttgaggacac

SEQ ID NO: 215251 - DNA, 16 bp, Homo sapiens
gaacttgatttgcatg

SEQ ID NO: 215252 - DNA, 15 bp, Homo sapiens
gaacttgtaactaaa

SEQ ID NO: 215253 - DNA, 17 bp, Homo sapiens
gaactttagggggtggg

SEQ ID NO: 215254 - DNA, 14 bp, Homo sapiens
tagctccttgaaga

SEQ ID NO: 215255 - DNA, 16 bp, Homo sapiens
tagctccttgaagaca

SEQ ID NO: 215256 - DNA, 18 bp, Homo sapiens
tagctctaggtttcttga

SEQ ID NO: 215257 - DNA, 13 bp, Homo sapiens
tagctctgagccc

SEQ ID NO: 215258 - DNA, 22 bp, Homo sapiens
tagttctttgttcctgctttct

SEQ ID NO: 215259 - DNA, 22 bp, Homo sapiens
tagttgaattttttttaacatt

SEQ ID NO: 215260 - DNA, 21 bp, Homo sapiens
tagttgagtcttcacatttag

SEQ ID NO: 215261 - DNA, 22 bp, Homo sapiens
tagttgatgaccaatctctgtg

SEQ ID NO: 215262 - DNA, 18 bp, Homo sapiens
tagttgcagactcagttt

SEQ ID NO: 215263 - DNA, 23 bp, Homo sapiens
tagttgcagactcagtttgtcag

SEQ ID NO: 215264 - DNA, 22 bp, Homo sapiens
tagttggaatgactgaaagaag

SEQ ID NO: 215265 - DNA, 15 bp, Homo sapiens
tagttggtgttcaaa

SEQ ID NO: 215266 - DNA, 14 bp, Homo sapiens
gaagcttgagcctc

SEQ ID NO: 215267 - DNA, 15 bp, Homo sapiens
gaagcttgagcctcc

SEQ ID NO: 215268 - DNA, 17 bp, Homo sapiens
gaagcttgagcctcccc

SEQ ID NO: 215269 - DNA, 18 bp, Homo sapiens
gaagcttgagcctccccc

SEQ ID NO: 215270 - DNA, 16 bp, Homo sapiens
gaagcttgatttgctt

SEQ ID NO: 215271 - DNA, 17 bp, Homo sapiens
gaagcttggggaaccca

SEQ ID NO: 215272 - DNA, 19 bp, Homo sapiens
gaagcttggggaacccatg

SEQ ID NO: 215273 - DNA, 21 bp, Homo sapiens
gaagctttctctgcttcagct

SEQ ID NO: 215274 - DNA, 19 bp, Homo sapiens
gaaggaaaaggctggcaag

SEQ ID NO: 215275 - DNA, 14 bp, Homo sapiens
gaaggaaaatgata

SEQ ID NO: 215276 - DNA, 23 bp, Homo sapiens
gaaggaaagcatgtctctgcttc

SEQ ID NO: 215277 - DNA, 16 bp, Homo sapiens
gaaggaaataacattg

SEQ ID NO: 215278 - DNA, 23 bp, Homo sapiens
gaaggaacccggtcccaggccgc

SEQ ID NO: 215279 - DNA, 18 bp, Homo sapiens
gaaggaagatcttgagag

SEQ ID NO: 215280 - DNA, 23 bp, Homo sapiens
gaaggaagatcttgagagctgct

SEQ ID NO: 215281 - DNA, 22 bp, Homo sapiens
gaaggaataaattgctccttga

SEQ ID NO: 215282 - DNA, 18 bp, Homo sapiens
gaaggaatagccagagag

SEQ ID NO: 215283 - DNA, 19 bp, Homo sapiens
gaaggaatagccagagagg

SEQ ID NO: 215284 - DNA, 15 bp, Homo sapiens
gaaggaattgacttc

SEQ ID NO: 215285 - DNA, 22 bp, Homo sapiens
gaaggacccggaggggcctggc

SEQ ID NO: 215286 - DNA, 23 bp, Homo sapiens
gaaggacccggaggggcctggca

SEQ ID NO: 215287 - DNA, 21 bp, Homo sapiens
gaaggacccttcagaggtggc

SEQ ID NO: 215288 - DNA, 15 bp, Homo sapiens
gaaggacctcctgag

SEQ ID NO: 215289 - DNA, 13 bp, Homo sapiens
gaaggactacagg

SEQ ID NO: 215290 - DNA, 15 bp, Homo sapiens
gaaggagagaagggg

SEQ ID NO: 215291 - DNA, 15 bp, Homo sapiens
gaaggagagcccagg

SEQ ID NO: 215292 - DNA, 16 bp, Homo sapiens
gaaggagagcccaggc

SEQ ID NO: 215293 - DNA, 13 bp, Homo sapiens
gaaggagagcctg

SEQ ID NO: 215294 - DNA, 13 bp, Homo sapiens
gaaggagaggagt

SEQ ID NO: 215295 - DNA, 15 bp, Homo sapiens
gaaggagaggagtgc

SEQ ID NO: 215296 - DNA, 19 bp, Homo sapiens
gaaggagcctgcggctgct

SEQ ID NO: 215297 - DNA, 17 bp, Homo sapiens
gaaggaggaagggactg

SEQ ID NO: 215298 - DNA, 21 bp, Homo sapiens
gaaggaggaagggactggtcc

SEQ ID NO: 215299 - DNA, 21 bp, Homo sapiens
gaaggagggcagagccatggg

SEQ ID NO: 215300 - DNA, 17 bp, Homo sapiens
gaaggaggggaagctgc

SEQ ID NO: 215301 - DNA, 20 bp, Homo sapiens
gaaggaggggaagctgcagc

SEQ ID NO: 215302 - DNA, 18 bp, Homo sapiens
gaaggattatatgtatta

SEQ ID NO: 215303 - DNA, 16 bp, Homo sapiens
gaaggcaagattggaa

SEQ ID NO: 215304 - DNA, 21 bp, Homo sapiens
gaaggcaagccaaccttagct

SEQ ID NO: 215305 - DNA, 21 bp, Homo sapiens
gaaggcaagctggcaggaggg

SEQ ID NO: 215306 - DNA, 21 bp, Homo sapiens
gaaggcacccgccctttcctt

SEQ ID NO: 215307 - DNA, 14 bp, Homo sapiens
gaaggcagagaaaa

SEQ ID NO: 215308 - DNA, 15 bp, Homo sapiens
gaaggcagctgctct

SEQ ID NO: 215309 - DNA, 17 bp, Homo sapiens
gaaggcagggcagaggg

SEQ ID NO: 215310 - DNA, 18 bp, Homo sapiens
gaaggcatgcctggacaa

SEQ ID NO: 215311 - DNA, 14 bp, Homo sapiens
gaaggccacagcaa

SEQ ID NO: 215312 - DNA, 18 bp, Homo sapiens
gaaggccacaggccactg

SEQ ID NO: 215313 - DNA, 13 bp, Homo sapiens
gaaggccacctgc

SEQ ID NO: 215314 - DNA, 21 bp, Homo sapiens
gaaggccagccctccctggct

SEQ ID NO: 215315 - DNA, 13 bp, Homo sapiens
gaaggccctgtgc

SEQ ID NO: 215316 - DNA, 21 bp, Homo sapiens
gaaggcctcttgtgctcacgc

SEQ ID NO: 215317 - DNA, 12 bp, Homo sapiens
gaaggcctgagg

SEQ ID NO: 215318 - DNA, 21 bp, Homo sapiens
gaaggcctgagggaagcccac

SEQ ID NO: 215319 - DNA, 16 bp, Homo sapiens
gaaggcctgcccccct

SEQ ID NO: 215320 - DNA, 13 bp, Homo sapiens
gaaggcctggtca

SEQ ID NO: 215321 - DNA, 13 bp, Homo sapiens
gaaggccttgctg

SEQ ID NO: 215322 - DNA, 15 bp, Homo sapiens
gaaggccttgctgtc

SEQ ID NO: 215323 - DNA, 17 bp, Homo sapiens
gaaggccttgctgtcat

SEQ ID NO: 215324 - DNA, 13 bp, Homo sapiens
gaaggcgaggaga

SEQ ID NO: 215325 - DNA, 19 bp, Homo sapiens
gaaggcgatgtggtgaccc

SEQ ID NO: 215326 - DNA, 22 bp, Homo sapiens
gaaggctaaagaagacacacag

SEQ ID NO: 215327 - DNA, 13 bp, Homo sapiens
gaaggctggctga

SEQ ID NO: 215328 - DNA, 15 bp, Homo sapiens
gaagggaaaacagtc

SEQ ID NO: 215329 - DNA, 18 bp, Homo sapiens
gaagggaaagcgggcagc

SEQ ID NO: 215330 - DNA, 15 bp, Homo sapiens
gaagggactggtcca

SEQ ID NO: 215331 - DNA, 16 bp, Homo sapiens
gaagggaggtctcctc

SEQ ID NO: 215332 - DNA, 23 bp, Homo sapiens
gaagggcaggaaggagagcctgc

SEQ ID NO: 215333 - DNA, 11 bp, Homo sapiens
gaagggccagt

SEQ ID NO: 215334 - DNA, 19 bp, Homo sapiens
gaagggccagtcctgcctg

SEQ ID NO: 215335 - DNA, 14 bp, Homo sapiens
gaagggccagtctg

SEQ ID NO: 215336 - DNA, 23 bp, Homo sapiens
gaaggggaggcagccggcaccca

SEQ ID NO: 215337 - DNA, 22 bp, Homo sapiens
gaagggggccatgaggcctcag

SEQ ID NO: 215338 - DNA, 23 bp, Homo sapiens
gaaggggggttgcagtggagagg

SEQ ID NO: 215339 - DNA, 17 bp, Homo sapiens
gaaggggtgggagccaa

SEQ ID NO: 215340 - DNA, 15 bp, Homo sapiens
gaagggtcatttctc

SEQ ID NO: 215341 - DNA, 21 bp, Homo sapiens
gaagggtccttccctctcccc

SEQ ID NO: 215342 - DNA, 23 bp, Homo sapiens
gaaggtaatactataaatatatt

SEQ ID NO: 215343 - DNA, 14 bp, Homo sapiens
gaaggtcggaggct

SEQ ID NO: 215344 - DNA, 14 bp, Homo sapiens
gaaggtgacagcag

SEQ ID NO: 215345 - DNA, 15 bp, Homo sapiens
gaaggtgacagcagt

SEQ ID NO: 215346 - DNA, 16 bp, Homo sapiens
gaaggtgcccaggagc

SEQ ID NO: 215347 - DNA, 19 bp, Homo sapiens
gaaggtgccgtgagcaggc

SEQ ID NO: 215348 - DNA, 14 bp, Homo sapiens
gaaggtgctgagct

SEQ ID NO: 215349 - DNA, 22 bp, Homo sapiens
gaaggtgctgagcttagccttg

SEQ ID NO: 215350 - DNA, 22 bp, Homo sapiens
gaaggtgtctggacattcagaa

SEQ ID NO: 215351 - DNA, 18 bp, Homo sapiens
gaagtaacttttacaaaa

SEQ ID NO: 215352 - DNA, 23 bp, Homo sapiens
gaagtaagttctgaaaactgttt

SEQ ID NO: 215353 - DNA, 13 bp, Homo sapiens
gaagtaatgaatt

SEQ ID NO: 215354 - DNA, 17 bp, Homo sapiens
gaagtacaataagcaga

SEQ ID NO: 215355 - DNA, 22 bp, Homo sapiens
gaagtacaataagcagaggtgg

SEQ ID NO: 215356 - DNA, 19 bp, Homo sapiens
gaagtactaagacccacaa

SEQ ID NO: 215357 - DNA, 13 bp, Homo sapiens
gaagtacttttaa

SEQ ID NO: 215358 - DNA, 14 bp, Homo sapiens
gaagtacttttaac

SEQ ID NO: 215359 - DNA, 20 bp, Homo sapiens
gaagtatccaattatgtgac

SEQ ID NO: 215360 - DNA, 16 bp, Homo sapiens
gaagtatctgtacctg

SEQ ID NO: 215361 - DNA, 21 bp, Homo sapiens
gaagtattcccttctttccta

SEQ ID NO: 215362 - DNA, 19 bp, Homo sapiens
gaagtcaaaccttaagata

SEQ ID NO: 215363 - DNA, 18 bp, Homo sapiens
gaagtcagagaaaacact

SEQ ID NO: 215364 - DNA, 17 bp, Homo sapiens
gaagtcaggagccagca

SEQ ID NO: 215365 - DNA, 18 bp, Homo sapiens
gaagtcagttggagaaaa

SEQ ID NO: 215366 - DNA, 20 bp, Homo sapiens
gaagtcagttggagaaaatg

SEQ ID NO: 215367 - DNA, 16 bp, Homo sapiens
gaagtcatcataaaag

SEQ ID NO: 215368 - DNA, 20 bp, Homo sapiens
gaagtcattgtcgctcagca

SEQ ID NO: 215369 - DNA, 21 bp, Homo sapiens
gaagtcattgtcgctcagcaa

SEQ ID NO: 215370 - DNA, 17 bp, Homo sapiens
gaagtcccttcctgtcc

SEQ ID NO: 215371 - DNA, 18 bp, Homo sapiens
gaagtcccttcctgtcct

SEQ ID NO: 215372 - DNA, 21 bp, Homo sapiens
gaagtcctccctcctgcaggc

SEQ ID NO: 215373 - DNA, 23 bp, Homo sapiens
gaagtcctccctcctgcaggctg

SEQ ID NO: 215374 - DNA, 21 bp, Homo sapiens
gaagtctcaaagatctttcgt

SEQ ID NO: 215375 - DNA, 14 bp, Homo sapiens
gaagtctgcgccct

SEQ ID NO: 215376 - DNA, 23 bp, Homo sapiens
gaagtcttccatcagcagtgatt

SEQ ID NO: 215377 - DNA, 14 bp, Homo sapiens
gaagtctttgtaca

SEQ ID NO: 215378 - DNA, 16 bp, Homo sapiens
gaagtctttgtacaga

SEQ ID NO: 215379 - DNA, 23 bp, Homo sapiens
gaagtgaatacatggtagcaggg

SEQ ID NO: 215380 - DNA, 12 bp, Homo sapiens
gaagtgaggcct

SEQ ID NO: 215381 - DNA, 14 bp, Homo sapiens
gaagtgaggcctgg

SEQ ID NO: 215382 - DNA, 14 bp, Homo sapiens
gaagtgcatttctg

SEQ ID NO: 215383 - DNA, 15 bp, Homo sapiens
gaagtgcccctgctg

SEQ ID NO: 215384 - DNA, 12 bp, Homo sapiens
gaagtggcccct

SEQ ID NO: 215385 - DNA, 14 bp, Homo sapiens
gaagtggcctgaga

SEQ ID NO: 215386 - DNA, 13 bp, Homo sapiens
gaagtgggagtgg

SEQ ID NO: 215387 - DNA, 16 bp, Homo sapiens
gaatggaaagcggagt

SEQ ID NO: 215388 - DNA, 21 bp, Homo sapiens
gaatggaagggttctggctgc

SEQ ID NO: 215389 - DNA, 17 bp, Homo sapiens
gaatggattaaatggca

SEQ ID NO: 215390 - DNA, 24 bp, Homo sapiens
gaatggccctagaactgtgcctag

SEQ ID NO: 215391 - DNA, 23 bp, Homo sapiens
gaatgggaggttgatcagatctg

SEQ ID NO: 215392 - DNA, 17 bp, Homo sapiens
gaatggtaaccgagcca

SEQ ID NO: 215393 - DNA, 16 bp, Homo sapiens
gaatggtgcccttgga

SEQ ID NO: 215394 - DNA, 15 bp, Homo sapiens
gaatggtgggctcca

SEQ ID NO: 215395 - DNA, 19 bp, Homo sapiens
gaatggtgggctccagagt

SEQ ID NO: 215396 - DNA, 18 bp, Homo sapiens
gaatggttaataaaactg

SEQ ID NO: 215397 - DNA, 19 bp, Homo sapiens
gaatggttaataaaactgc

SEQ ID NO: 215398 - DNA, 22 bp, Homo sapiens
gaatggttccatgcctgagggt

SEQ ID NO: 215399 - DNA, 23 bp, Homo sapiens
gaatgtaaaacagagccattccc

SEQ ID NO: 215400 - DNA, 17 bp, Homo sapiens
gaatgtaagaaaacaaa

SEQ ID NO: 215401 - DNA, 13 bp, Homo sapiens
gaatgtacattac

SEQ ID NO: 215402 - DNA, 19 bp, Homo sapiens
gaatgtattattctgcagc

SEQ ID NO: 215403 - DNA, 13 bp, Homo sapiens
gaatgtcagtgtg

SEQ ID NO: 215404 - DNA, 21 bp, Homo sapiens
gaatgtcagtgtgactgatct

SEQ ID NO: 215405 - DNA, 23 bp, Homo sapiens
gaatgtcatttgctaatgaattt

SEQ ID NO: 215406 - DNA, 17 bp, Homo sapiens
gaatgtccccattctat

SEQ ID NO: 215407 - DNA, 19 bp, Homo sapiens
gaatgtccccattctataa

SEQ ID NO: 215408 - DNA, 22 bp, Homo sapiens
aacaacaaagcatgctcagtat

SEQ ID NO: 215409 - DNA, 15 bp, Homo sapiens
aacaacagcaacaac

SEQ ID NO: 215410 - DNA, 12 bp, Homo sapiens
aacaacagtacc

SEQ ID NO: 215411 - DNA, 15 bp, Homo sapiens
aacaacagtcagcca

SEQ ID NO: 215412 - DNA, 18 bp, Homo sapiens
aacaacagtcagccagct

SEQ ID NO: 215413 - DNA, 19 bp, Homo sapiens
aacaaccccccatcacaaa

SEQ ID NO: 215414 - DNA, 21 bp, Homo sapiens
aacaaccctgttgagtatttg

SEQ ID NO: 215415 - DNA, 22 bp, Homo sapiens
aacaaccctgttgagtatttgc

SEQ ID NO: 215416 - DNA, 21 bp, Homo sapiens
aacaactttctcttgtaaacg

SEQ ID NO: 215417 - DNA, 12 bp, Homo sapiens
aacaagaaaaca

SEQ ID NO: 215418 - DNA, 13 bp, Homo sapiens
aacaagaaaccaa

SEQ ID NO: 215419 - DNA, 22 bp, Homo sapiens
aacaagaaaccaagtgggctgg

SEQ ID NO: 215420 - DNA, 12 bp, Homo sapiens
aacaagaaagaa

SEQ ID NO: 215421 - DNA, 20 bp, Homo sapiens
aacaagaggagcaggaagca

SEQ ID NO: 215422 - DNA, 20 bp, Homo sapiens
aacaagatttccctaaaaat

SEQ ID NO: 215423 - DNA, 19 bp, Homo sapiens
aacaaggaatgcctgtgcc

SEQ ID NO: 215424 - DNA, 15 bp, Homo sapiens
aacaaggcaaggctg

SEQ ID NO: 215425 - DNA, 13 bp, Homo sapiens
aacaagtaccaaa

SEQ ID NO: 215426 - DNA, 16 bp, Homo sapiens
aacaagtcacagctgc

SEQ ID NO: 215427 - DNA, 15 bp, Homo sapiens
aacaagtgtacagaa

SEQ ID NO: 215428 - DNA, 18 bp, Homo sapiens
aacaagttggctagaaga

SEQ ID NO: 215429 - DNA, 16 bp, Homo sapiens
aacaagttgtgccttt

SEQ ID NO: 215430 - DNA, 21 bp, Homo sapiens
aacaagtttgctagtgactaa

SEQ ID NO: 215431 - DNA, 17 bp, Homo sapiens
aacaataactactgtgt

SEQ ID NO: 215432 - DNA, 20 bp, Homo sapiens
aacaatatatgatatataaa

SEQ ID NO: 215433 - DNA, 12 bp, Homo sapiens
aacaatatttat

SEQ ID NO: 215434 - DNA, 15 bp, Homo sapiens
aacaatatttattgt

SEQ ID NO: 215435 - DNA, 15 bp, Homo sapiens
aacaatcacaaaagc

SEQ ID NO: 215436 - DNA, 17 bp, Homo sapiens
aacaatcactattctta

SEQ ID NO: 215437 - DNA, 20 bp, Homo sapiens
aacaatcccaatctttctat

SEQ ID NO: 215438 - DNA, 21 bp, Homo sapiens
aacaatcccaatctttctata

SEQ ID NO: 215439 - DNA, 18 bp, Homo sapiens
aacaatgaagataaaaag

SEQ ID NO: 215440 - DNA, 19 bp, Homo sapiens
aacaatgccttgttgtatt

SEQ ID NO: 215441 - DNA, 22 bp, Homo sapiens
aacaatgtcaaggtgctgttgt

SEQ ID NO: 215442 - DNA, 19 bp, Homo sapiens
aacaatttaggaatgctca

SEQ ID NO: 215443 - DNA, 21 bp, Homo sapiens
aacaatttcctttatatttag

SEQ ID NO: 215444 - DNA, 22 bp, Homo sapiens
aacaatttgcataatactaatt

SEQ ID NO: 215445 - DNA, 19 bp, Homo sapiens
aacaatttggtcttagctt

SEQ ID NO: 215446 - DNA, 13 bp, Homo sapiens
aacaattttaatg

SEQ ID NO: 215447 - DNA, 16 bp, Homo sapiens
aacacaagtcctgtga

SEQ ID NO: 215448 - DNA, 22 bp, Homo sapiens
aacacaatatgagtaatgttta

SEQ ID NO: 215449 - DNA, 13 bp, Homo sapiens
aacacacacacac

SEQ ID NO: 215450 - DNA, 21 bp, Homo sapiens
aacacacacacacacaacaaa

SEQ ID NO: 215451 - DNA, 16 bp, Homo sapiens
aacacaccaggctgtg

SEQ ID NO: 215452 - DNA, 13 bp, Homo sapiens
aacacacgctcct

SEQ ID NO: 215453 - DNA, 16 bp, Homo sapiens
aacacacttttgcaca

SEQ ID NO: 215454 - DNA, 14 bp, Homo sapiens
aacacagtaaaata

SEQ ID NO: 215455 - DNA, 20 bp, Homo sapiens
aacacagtcatgtgtcagct

SEQ ID NO: 215456 - DNA, 19 bp, Homo sapiens
aacacagtttagtgcttta

SEQ ID NO: 215457 - DNA, 14 bp, Homo sapiens
aacacagttttgaa

SEQ ID NO: 215458 - DNA, 19 bp, Homo sapiens
aacacatacaaaagaatta

SEQ ID NO: 215459 - DNA, 17 bp, Homo sapiens
aacacatagattcacct

SEQ ID NO: 215460 - DNA, 17 bp, Homo sapiens
aacacatcaaataaact

SEQ ID NO: 215461 - DNA, 14 bp, Homo sapiens
aacacattgcctaa

SEQ ID NO: 215462 - DNA, 18 bp, Homo sapiens
aacacattgtgaatatta

SEQ ID NO: 215463 - DNA, 14 bp, Homo sapiens
aacaccacagaaat

SEQ ID NO: 215464 - DNA, 15 bp, Homo sapiens
aacaccacagacaca

SEQ ID NO: 215465 - DNA, 16 bp, Homo sapiens
aacaccacagacacac

SEQ ID NO: 215466 - DNA, 15 bp, Homo sapiens
aacaccacttaatct

SEQ ID NO: 215467 - DNA, 15 bp, Homo sapiens
aacaccattattcca

SEQ ID NO: 215468 - DNA, 13 bp, Homo sapiens
aacacccagcccc

SEQ ID NO: 215469 - DNA, 20 bp, Homo sapiens
aacacccagtctgttcccca

SEQ ID NO: 215470 - DNA, 22 bp, Homo sapiens
aacacccatcgtataaggaaat

SEQ ID NO: 215471 - DNA, 15 bp, Homo sapiens
aacacctgacacatc

SEQ ID NO: 215472 - DNA, 20 bp, Homo sapiens
aacaccttcttggcttctgg

SEQ ID NO: 215473 - DNA, 19 bp, Homo sapiens
aacactaaacagactattt

SEQ ID NO: 215474 - DNA, 12 bp, Homo sapiens
aacactcagctg

SEQ ID NO: 215475 - DNA, 17 bp, Homo sapiens
aacactcgtgtgcatga

SEQ ID NO: 215476 - DNA, 19 bp, Homo sapiens
aacactcgtgtgcatgaga

SEQ ID NO: 215477 - DNA, 16 bp, Homo sapiens
aacactgaacctctgg

SEQ ID NO: 215478 - DNA, 18 bp, Homo sapiens
aacactgcagccctctcc

SEQ ID NO: 215479 - DNA, 12 bp, Homo sapiens
aacactggcccc

SEQ ID NO: 215480 - DNA, 17 bp, Homo sapiens
aacactggcctgggtct

SEQ ID NO: 215481 - DNA, 17 bp, Homo sapiens
aacactgtattgtaagt

SEQ ID NO: 215482 - DNA, 15 bp, Homo sapiens
aacacttattgcttt

SEQ ID NO: 215483 - DNA, 21 bp, Homo sapiens
aacacttattttctgaattca

SEQ ID NO: 215484 - DNA, 21 bp, Homo sapiens
aacacttgtgttgctttctga

SEQ ID NO: 215485 - DNA, 23 bp, Homo sapiens
aacactttgagcatttttaaggg

SEQ ID NO: 215486 - DNA, 17 bp, Homo sapiens
aacagaaaaaaaacaca

SEQ ID NO: 215487 - DNA, 11 bp, Homo sapiens
aacagaaaaca

SEQ ID NO: 215488 - DNA, 20 bp, Homo sapiens
aacagaaacgagatttgcca

SEQ ID NO: 215489 - DNA, 18 bp, Homo sapiens
aacagaacatttctcatg

SEQ ID NO: 215490 - DNA, 21 bp, Homo sapiens
aacagaactcgatgcactgac

SEQ ID NO: 215491 - DNA, 14 bp, Homo sapiens
aacagaagcttcca

SEQ ID NO: 215492 - DNA, 23 bp, Homo sapiens
aacagaatactgttaaaggaaaa

SEQ ID NO: 215493 - DNA, 18 bp, Homo sapiens
aacagaatattctgtaaa

SEQ ID NO: 215494 - DNA, 18 bp, Homo sapiens
aacagacctaatgctcct

SEQ ID NO: 215495 - DNA, 15 bp, Homo sapiens
aacagaggagaaagg

SEQ ID NO: 215496 - DNA, 13 bp, Homo sapiens
aacagaggatgct

SEQ ID NO: 215497 - DNA, 17 bp, Homo sapiens
aacagaggcctccccca

SEQ ID NO: 215498 - DNA, 13 bp, Homo sapiens
aacagagtatata

SEQ ID NO: 215499 - DNA, 15 bp, Homo sapiens
aacagagtatatatg

SEQ ID NO: 215500 - DNA, 19 bp, Homo sapiens
aacagataagcaagagaga

SEQ ID NO: 215501 - DNA, 23 bp, Homo sapiens
aacagatactggaagttttgcat

SEQ ID NO: 215502 - DNA, 20 bp, Homo sapiens
aacagatagttgtgttttta

SEQ ID NO: 215503 - DNA, 18 bp, Homo sapiens
aacagatattccagacca

SEQ ID NO: 215504 - DNA, 18 bp, Homo sapiens
aacagatctccaaagctt

SEQ ID NO: 215505 - DNA, 20 bp, Homo sapiens
aacagatctccaaagctttc

SEQ ID NO: 215506 - DNA, 23 bp, Homo sapiens
aacagatgagaagactagcagct

SEQ ID NO: 215507 - DNA, 17 bp, Homo sapiens
aacagatggctgtgaaa

SEQ ID NO: 215508 - DNA, 19 bp, Homo sapiens
aacagattgctacacacac

SEQ ID NO: 215509 - DNA, 14 bp, Homo sapiens
aacagcaagggaga

SEQ ID NO: 215510 - DNA, 21 bp, Homo sapiens
aacagcactggctctctccag

SEQ ID NO: 215511 - DNA, 17 bp, Homo sapiens
aacagcaggcccaccta

SEQ ID NO: 215512 - DNA, 22 bp, Homo sapiens
aacagccatgtccaagttcttc

SEQ ID NO: 215513 - DNA, 19 bp, Homo sapiens
aacagccccccccttgaat

SEQ ID NO: 215514 - DNA, 22 bp, Homo sapiens
aacagccgagtggatagatgcc

SEQ ID NO: 215515 - DNA, 22 bp, Homo sapiens
aacagcctgtttgggaggctgg

SEQ ID NO: 215516 - DNA, 15 bp, Homo sapiens
gacagggtcctgcta

SEQ ID NO: 215517 - DNA, 12 bp, Homo sapiens
gacagggtgggg

SEQ ID NO: 215518 - DNA, 22 bp, Homo sapiens
gacagtatgagtcaatgtgcag

SEQ ID NO: 215519 - DNA, 14 bp, Homo sapiens
gacagtattctcag

SEQ ID NO: 215520 - DNA, 19 bp, Homo sapiens
gacagtattgccacctctg

SEQ ID NO: 215521 - DNA, 22 bp, Homo sapiens
gacagtcaaggagtggcttact

SEQ ID NO: 215522 - DNA, 13 bp, Homo sapiens
gacagtcttgtgc

SEQ ID NO: 215523 - DNA, 15 bp, Homo sapiens
gacagtcttgtgctt

SEQ ID NO: 215524 - DNA, 21 bp, Homo sapiens
gacagtgataggcccaaggtc

SEQ ID NO: 215525 - DNA, 21 bp, Homo sapiens
gacagtgatctccatatgtta

SEQ ID NO: 215526 - DNA, 13 bp, Homo sapiens
gacagtgcctggg

SEQ ID NO: 215527 - DNA, 14 bp, Homo sapiens
gacagtgctgaccc

SEQ ID NO: 215528 - DNA, 20 bp, Homo sapiens
gacagtggattgcatttctt

SEQ ID NO: 215529 - DNA, 12 bp, Homo sapiens
gacagtggcagc

SEQ ID NO: 215530 - DNA, 18 bp, Homo sapiens
gacagtggcagcaaagga

SEQ ID NO: 215531 - DNA, 20 bp, Homo sapiens
gacagtggcagcaaaggaag

SEQ ID NO: 215532 - DNA, 15 bp, Homo sapiens
gacagtggctctcca

SEQ ID NO: 215533 - DNA, 17 bp, Homo sapiens
gacagtgggggtgcctg

SEQ ID NO: 215534 - DNA, 22 bp, Homo sapiens
gacagttaagagaaatgagctt

SEQ ID NO: 215535 - DNA, 21 bp, Homo sapiens
gacagttatactgtcggtttt

SEQ ID NO: 215536 - DNA, 18 bp, Homo sapiens
gacagttcacaccctgca

SEQ ID NO: 215537 - DNA, 19 bp, Homo sapiens
gacagttcacaccctgcaa

SEQ ID NO: 215538 - DNA, 15 bp, Homo sapiens
gacagttcatatgta

SEQ ID NO: 215539 - DNA, 17 bp, Homo sapiens
gacagttcatatgtacc

SEQ ID NO: 215540 - DNA, 13 bp, Homo sapiens
gacagttggcaga

SEQ ID NO: 215541 - DNA, 14 bp, Homo sapiens
gacagttggcagag

SEQ ID NO: 215542 - DNA, 15 bp, Homo sapiens
gacagttggcagaga

SEQ ID NO: 215543 - DNA, 19 bp, Homo sapiens
gacagttgggtgagaacaa

SEQ ID NO: 215544 - DNA, 18 bp, Homo sapiens
gacagttgtctagagata

SEQ ID NO: 215545 - DNA, 20 bp, Homo sapiens
gacataaacccatctgtaat

SEQ ID NO: 215546 - DNA, 17 bp, Homo sapiens
gacataaccactgcttc

SEQ ID NO: 215547 - DNA, 15 bp, Homo sapiens
gacatagactgcaaa

SEQ ID NO: 215548 - DNA, 18 bp, Homo sapiens
gacatatcatgtgtgaga

SEQ ID NO: 215549 - DNA, 23 bp, Homo sapiens
gacatcaactgcatcaagatgtg

SEQ ID NO: 215550 - DNA, 20 bp, Homo sapiens
gacatcagaggttctttgag

SEQ ID NO: 215551 - DNA, 15 bp, Homo sapiens
gacatccaagcttcc

SEQ ID NO: 215552 - DNA, 23 bp, Homo sapiens
gacatccatgtttgtaaaactac

SEQ ID NO: 215553 - DNA, 13 bp, Homo sapiens
gacatcctcttct

SEQ ID NO: 215554 - DNA, 16 bp, Homo sapiens
gacatcctcttctgct

SEQ ID NO: 215555 - DNA, 23 bp, Homo sapiens
gacatcctcttctgcttaggaga

SEQ ID NO: 215556 - DNA, 16 bp, Homo sapiens
gacatcgatatgaaaa

SEQ ID NO: 215557 - DNA, 21 bp, Homo sapiens
gacatctcctcaccccagtgc

SEQ ID NO: 215558 - DNA, 16 bp, Homo sapiens
gacatgaacaatgtgt

SEQ ID NO: 215559 - DNA, 12 bp, Homo sapiens
gacatgcacagt

SEQ ID NO: 215560 - DNA, 15 bp, Homo sapiens
gacatgcgggctggg

SEQ ID NO: 215561 - DNA, 20 bp, Homo sapiens
gacatgcgggctgggcagct

SEQ ID NO: 215562 - DNA, 16 bp, Homo sapiens
gacatgctcacctcta

SEQ ID NO: 215563 - DNA, 17 bp, Homo sapiens
gacatggagactcctgc

SEQ ID NO: 215564 - DNA, 19 bp, Homo sapiens
gacatggagactcctgccc

SEQ ID NO: 215565 - DNA, 22 bp, Homo sapiens
gacatggagactcctgccctgt

SEQ ID NO: 215566 - DNA, 19 bp, Homo sapiens
gacatggtgtgccacaggc

SEQ ID NO: 215567 - DNA, 13 bp, Homo sapiens
gacatgtggaaag

SEQ ID NO: 215568 - DNA, 18 bp, Homo sapiens
gacatgtggaaagtgaat

SEQ ID NO: 215569 - DNA, 23 bp, Homo sapiens
gacatgtggaaagtgaatttgaa

SEQ ID NO: 215570 - DNA, 13 bp, Homo sapiens
gacattaaataat

SEQ ID NO: 215571 - DNA, 17 bp, Homo sapiens
gacattaacagttttcc

SEQ ID NO: 215572 - DNA, 14 bp, Homo sapiens
gacattccaacaat

SEQ ID NO: 215573 - DNA, 17 bp, Homo sapiens
gacattccttgtcacca

SEQ ID NO: 215574 - DNA, 16 bp, Homo sapiens
gacattgccccaagat

SEQ ID NO: 215575 - DNA, 13 bp, Homo sapiens
gacattgtcaata

SEQ ID NO: 215576 - DNA, 22 bp, Homo sapiens
gacatttaataactttgctgga

SEQ ID NO: 215577 - DNA, 13 bp, Homo sapiens
gacatttacatgt

SEQ ID NO: 215578 - DNA, 22 bp, Homo sapiens
gacatttcggaagtggtgggga

SEQ ID NO: 215579 - DNA, 22 bp, Homo sapiens
gacatttgtcctgcagagctgg

SEQ ID NO: 215580 - DNA, 23 bp, Homo sapiens
gacatttgtcctgcagagctggg

SEQ ID NO: 215581 - DNA, 14 bp, Homo sapiens
gacattttgtagct

SEQ ID NO: 215582 - DNA, 22 bp, Homo sapiens
gacattttgtagctagtttaaa

SEQ ID NO: 215583 - DNA, 19 bp, Homo sapiens
gaccaaaagtgagatggga

SEQ ID NO: 215584 - DNA, 13 bp, Homo sapiens
gaccaaactgtgg

SEQ ID NO: 215585 - DNA, 23 bp, Homo sapiens
gaccaaactgtgggtattgttaa

SEQ ID NO: 215586 - DNA, 22 bp, Homo sapiens
gaccaacattcaaaagcacaaa

SEQ ID NO: 215587 - DNA, 17 bp, Homo sapiens
gaccaactctctcctgt

SEQ ID NO: 215588 - DNA, 12 bp, Homo sapiens
gaccaagaactg

SEQ ID NO: 215589 - DNA, 17 bp, Homo sapiens
gaccaagccggtgccca

SEQ ID NO: 215590 - DNA, 18 bp, Homo sapiens
gaccaagcttaaggagag

SEQ ID NO: 215591 - DNA, 19 bp, Homo sapiens
gaccaagcttaaggagagg

SEQ ID NO: 215592 - DNA, 20 bp, Homo sapiens
gaccaagcttgtttccctgc

SEQ ID NO: 215593 - DNA, 21 bp, Homo sapiens
gaccaagcttgtttccctgct

SEQ ID NO: 215594 - DNA, 13 bp, Homo sapiens
gaccaaggacccc

SEQ ID NO: 215595 - DNA, 19 bp, Homo sapiens
gaccaaggacccctcacct

SEQ ID NO: 215596 - DNA, 21 bp, Homo sapiens
gaccaaggcctcggcagaact

SEQ ID NO: 215597 - DNA, 21 bp, Homo sapiens
gaccaaggtgcggaccggagc

SEQ ID NO: 215598 - DNA, 14 bp, Homo sapiens
gaccaagttataaa

SEQ ID NO: 215599 - DNA, 14 bp, Homo sapiens
gaccaatgtgaaga

SEQ ID NO: 215600 - DNA, 15 bp, Homo sapiens
gaccaattgccctgc

SEQ ID NO: 215601 - DNA, 16 bp, Homo sapiens
gaccaattgccctgcc

SEQ ID NO: 215602 - DNA, 13 bp, Homo sapiens
gaccacacctccg

SEQ ID NO: 215603 - DNA, 12 bp, Homo sapiens
gaccacacctgc

SEQ ID NO: 215604 - DNA, 23 bp, Homo sapiens
gaccacacttcctgtccagagag

SEQ ID NO: 215605 - DNA, 14 bp, Homo sapiens
gaccacagctgctg

SEQ ID NO: 215606 - DNA, 15 bp, Homo sapiens
gaccacagctgctgg

SEQ ID NO: 215607 - DNA, 19 bp, Homo sapiens
gaccacagctgctggccag

SEQ ID NO: 215608 - DNA, 20 bp, Homo sapiens
gaccacagctgctggccagg

SEQ ID NO: 215609 - DNA, 23 bp, Homo sapiens
gaccacagggttcaaaatgtctg

SEQ ID NO: 215610 - DNA, 21 bp, Homo sapiens
gaccacagtgggtggcacctc

SEQ ID NO: 215611 - DNA, 13 bp, Homo sapiens
gaccaccagcccc

SEQ ID NO: 215612 - DNA, 20 bp, Homo sapiens
gaccaccagccgccccagcc

SEQ ID NO: 215613 - DNA, 22 bp, Homo sapiens
gaccaccagccgccccagcccc

SEQ ID NO: 215614 - DNA, 14 bp, Homo sapiens
gaccacctgcccaa

SEQ ID NO: 215615 - DNA, 20 bp, Homo sapiens
gaccaccttctgtccccagc

SEQ ID NO: 215616 - DNA, 22 bp, Homo sapiens
gaccaccttctgtccccagccc

SEQ ID NO: 215617 - DNA, 17 bp, Homo sapiens
gaccactgggcctgcta

SEQ ID NO: 215618 - DNA, 16 bp, Homo sapiens
gaccagaagccaaaga

SEQ ID NO: 215619 - DNA, 15 bp, Homo sapiens
gaccagagctctgga

SEQ ID NO: 215620 - DNA, 17 bp, Homo sapiens
gaccagagctctggagc

SEQ ID NO: 215621 - DNA, 14 bp, Homo sapiens
gaccagagctgtct

SEQ ID NO: 215622 - DNA, 21 bp, Homo sapiens
gaccagaggtgggaggcccct

SEQ ID NO: 215623 - DNA, 19 bp, Homo sapiens
gaccagcatccttaagtat

SEQ ID NO: 215624 - DNA, 20 bp, Homo sapiens
gaccagcctccatgctgcct

SEQ ID NO: 215625 - DNA, 16 bp, Homo sapiens
gaccaggactccctcc

SEQ ID NO: 215626 - DNA, 15 bp, Homo sapiens
gaccaggagctagcc

SEQ ID NO: 215627 - DNA, 15 bp, Homo sapiens
gaccaggatttctaa

SEQ ID NO: 215628 - DNA, 13 bp, Homo sapiens
gaccaggccacca

SEQ ID NO: 215629 - DNA, 18 bp, Homo sapiens
gaccaggctcacaactgt

SEQ ID NO: 215630 - DNA, 20 bp, Homo sapiens
gaccaggtgtctagaggcaa

SEQ ID NO: 215631 - DNA, 21 bp, Homo sapiens
gaccaggtgtctagaggcaac

SEQ ID NO: 215632 - DNA, 20 bp, Homo sapiens
gaccagtactgggaaggagg

SEQ ID NO: 215633 - DNA, 15 bp, Homo sapiens
gaccagtcacagcca

SEQ ID NO: 215634 - DNA, 20 bp, Homo sapiens
gaccagtcacagccatttca

SEQ ID NO: 215635 - DNA, 23 bp, Homo sapiens
gaccagttgaataaaagtgcaca

SEQ ID NO: 215636 - DNA, 15 bp, Homo sapiens
gaccagttgcacttg

SEQ ID NO: 215637 - DNA, 11 bp, Homo sapiens
gaccagtttac

SEQ ID NO: 215638 - DNA, 20 bp, Homo sapiens
gaccataatgttacattatt

SEQ ID NO: 215639 - DNA, 18 bp, Homo sapiens
gaccatcctggcccctcc

SEQ ID NO: 215640 - DNA, 20 bp, Homo sapiens
gaccatttagtcctcacctt

SEQ ID NO: 215641 - DNA, 19 bp, Homo sapiens
gacccaagtggggcctcct

SEQ ID NO: 215642 - DNA, 13 bp, Homo sapiens
gacccaataaaga

SEQ ID NO: 215643 - DNA, 17 bp, Homo sapiens
gacccacactgctacac

SEQ ID NO: 215644 - DNA, 19 bp, Homo sapiens
gacccaccaaactgcacac

SEQ ID NO: 215645 - DNA, 13 bp, Homo sapiens
gacccaccagtgc

SEQ ID NO: 215646 - DNA, 16 bp, Homo sapiens
aactgaggcccagaga

SEQ ID NO: 215647 - DNA, 17 bp, Homo sapiens
aactgagtccttaaaca

SEQ ID NO: 215648 - DNA, 15 bp, Homo sapiens
aactgagtctgtgga

SEQ ID NO: 215649 - DNA, 21 bp, Homo sapiens
aactgatcatttgcagctgct

SEQ ID NO: 215650 - DNA, 22 bp, Homo sapiens
aactgatcatttgcagctgctg

SEQ ID NO: 215651 - DNA, 16 bp, Homo sapiens
aactgatgctttcaga

SEQ ID NO: 215652 - DNA, 15 bp, Homo sapiens
aactgatggaccggg

SEQ ID NO: 215653 - DNA, 16 bp, Homo sapiens
aactgcaatagagact

SEQ ID NO: 215654 - DNA, 19 bp, Homo sapiens
aactgcacacacagctcct

SEQ ID NO: 215655 - DNA, 20 bp, Homo sapiens
aactgcatccaggcctgagg

SEQ ID NO: 215656 - DNA, 22 bp, Homo sapiens
aactgcatccaggcctgaggct

SEQ ID NO: 215657 - DNA, 14 bp, Homo sapiens
aactgcatgtataa

SEQ ID NO: 215658 - DNA, 19 bp, Homo sapiens
aactgcatgtataaatgaa

SEQ ID NO: 215659 - DNA, 14 bp, Homo sapiens
aactgcccaaagca

SEQ ID NO: 215660 - DNA, 19 bp, Homo sapiens
aactgcctgttccttgaat

SEQ ID NO: 215661 - DNA, 17 bp, Homo sapiens
aactgccttaaaacttt

SEQ ID NO: 215662 - DNA, 13 bp, Homo sapiens
aactgctgcccca

SEQ ID NO: 215663 - DNA, 22 bp, Homo sapiens
aactgctgccccaaaggaagct

SEQ ID NO: 215664 - DNA, 12 bp, Homo sapiens
aactgctgctgg

SEQ ID NO: 215665 - DNA, 15 bp, Homo sapiens
aactgctgttttatg

SEQ ID NO: 215666 - DNA, 22 bp, Homo sapiens
aactggactatagcagggctgg

SEQ ID NO: 215667 - DNA, 19 bp, Homo sapiens
aactggagaggctaacctc

SEQ ID NO: 215668 - DNA, 22 bp, Homo sapiens
aactggccccaggcggaggggc

SEQ ID NO: 215669 - DNA, 23 bp, Homo sapiens
aactggccccaggcggaggggct

SEQ ID NO: 215670 - DNA, 18 bp, Homo sapiens
aactggcttctgcttgtc

SEQ ID NO: 215671 - DNA, 13 bp, Homo sapiens
aactgggaagatg

SEQ ID NO: 215672 - DNA, 18 bp, Homo sapiens
aactgggaagatgctggc

SEQ ID NO: 215673 - DNA, 19 bp, Homo sapiens
aactgggttcaaaaagaaa

SEQ ID NO: 215674 - DNA, 16 bp, Homo sapiens
aactggtccaggccag

SEQ ID NO: 215675 - DNA, 14 bp, Homo sapiens
aactggttcttgcc

SEQ ID NO: 215676 - DNA, 14 bp, Homo sapiens
aactgtaaatacaa

SEQ ID NO: 215677 - DNA, 15 bp, Homo sapiens
aactgtagaaatgat

SEQ ID NO: 215678 - DNA, 15 bp, Homo sapiens
aactgtagtaattgt

SEQ ID NO: 215679 - DNA, 14 bp, Homo sapiens
aactgtatgtgtct

SEQ ID NO: 215680 - DNA, 17 bp, Homo sapiens
aactgtcaagtcatgat

SEQ ID NO: 215681 - DNA, 15 bp, Homo sapiens
aactgtcattacaga

SEQ ID NO: 215682 - DNA, 23 bp, Homo sapiens
aactgtcccacaaaatatttcta

SEQ ID NO: 215683 - DNA, 20 bp, Homo sapiens
aactgtgaataataaataca

SEQ ID NO: 215684 - DNA, 11 bp, Homo sapiens
aactgtgacag

SEQ ID NO: 215685 - DNA, 17 bp, Homo sapiens
aactgtgagataaatat

SEQ ID NO: 215686 - DNA, 18 bp, Homo sapiens
aactgtgagataaatatc

SEQ ID NO: 215687 - DNA, 12 bp, Homo sapiens
aactgtgcagca

SEQ ID NO: 215688 - DNA, 22 bp, Homo sapiens
aactgtgcatcaaccaggaaga

SEQ ID NO: 215689 - DNA, 12 bp, Homo sapiens
aactgtgctctc

SEQ ID NO: 215690 - DNA, 22 bp, Homo sapiens
aactgtggatacccttaccctt

SEQ ID NO: 215691 - DNA, 16 bp, Homo sapiens
aactgtgtgaagaaat

SEQ ID NO: 215692 - DNA, 18 bp, Homo sapiens
aactgtgtggactgtgat

SEQ ID NO: 215693 - DNA, 17 bp, Homo sapiens
aactgttgccagagatg

SEQ ID NO: 215694 - DNA, 18 bp, Homo sapiens
aactgttgccagagatgg

SEQ ID NO: 215695 - DNA, 19 bp, Homo sapiens
aactgttggctgctcccca

SEQ ID NO: 215696 - DNA, 22 bp, Homo sapiens
aactgttgtttgatgtgtatgt

SEQ ID NO: 215697 - DNA, 23 bp, Homo sapiens
gacggctgtgtatttctgtagaa

SEQ ID NO: 215698 - DNA, 22 bp, Homo sapiens
gacgggacagcggcccggccca

SEQ ID NO: 215699 - DNA, 13 bp, Homo sapiens
gacggggcagagc

SEQ ID NO: 215700 - DNA, 19 bp, Homo sapiens
gacggtcctttaggcagcc

SEQ ID NO: 215701 - DNA, 23 bp, Homo sapiens
gacggtcctttaggcagcctgcc

SEQ ID NO: 215702 - DNA, 21 bp, Homo sapiens
gacggtgggcatttgtgaggc

SEQ ID NO: 215703 - DNA, 12 bp, Homo sapiens
gacgtagctgca

SEQ ID NO: 215704 - DNA, 20 bp, Homo sapiens
gacgtccacccgtttccaag

SEQ ID NO: 215705 - DNA, 19 bp, Homo sapiens
gacgtccaccctgcagcca

SEQ ID NO: 215706 - DNA, 23 bp, Homo sapiens
gacgtccaccctgcagccaggac

SEQ ID NO: 215707 - DNA, 12 bp, Homo sapiens
gacgtccctcca

SEQ ID NO: 215708 - DNA, 13 bp, Homo sapiens
gacgtcctgccac

SEQ ID NO: 215709 - DNA, 18 bp, Homo sapiens
gacgtcctgccacctggg

SEQ ID NO: 215710 - DNA, 11 bp, Homo sapiens
gacgtcctgga

SEQ ID NO: 215711 - DNA, 17 bp, Homo sapiens
gacgtctggggtgtggg

SEQ ID NO: 215712 - DNA, 18 bp, Homo sapiens
gacgtgaccaattgccct

SEQ ID NO: 215713 - DNA, 18 bp, Homo sapiens
gacgtggactggggtagg

SEQ ID NO: 215714 - DNA, 18 bp, Homo sapiens
gacgttaggcccgggccc

SEQ ID NO: 215715 - DNA, 10 bp, Homo sapiens
gactaaagag

SEQ ID NO: 215716 - DNA, 14 bp, Homo sapiens
gactaagccctgtc

SEQ ID NO: 215717 - DNA, 22 bp, Homo sapiens
gactaatgaatgcaaaaagata

SEQ ID NO: 215718 - DNA, 20 bp, Homo sapiens
gactacctataaatggactt

SEQ ID NO: 215719 - DNA, 18 bp, Homo sapiens
gactagaaagtgaataaa

SEQ ID NO: 215720 - DNA, 16 bp, Homo sapiens
gactagaggcttgcat

SEQ ID NO: 215721 - DNA, 12 bp, Homo sapiens
gactagcaggca

SEQ ID NO: 215722 - DNA, 13 bp, Homo sapiens
gactaggagacca

SEQ ID NO: 215723 - DNA, 18 bp, Homo sapiens
gactagggattcaggctg

SEQ ID NO: 215724 - DNA, 19 bp, Homo sapiens
gactagggattcaggctgc

SEQ ID NO: 215725 - DNA, 17 bp, Homo sapiens
gactagtacaaattata

SEQ ID NO: 215726 - DNA, 19 bp, Homo sapiens
gactagtgccgtagggagt

SEQ ID NO: 215727 - DNA, 19 bp, Homo sapiens
gactagtgctgaagcttat

SEQ ID NO: 215728 - DNA, 14 bp, Homo sapiens
gactataaacatta

SEQ ID NO: 215729 - DNA, 19 bp, Homo sapiens
gactataaagcagtagaca

SEQ ID NO: 215730 - DNA, 21 bp, Homo sapiens
gactattcttgatgtaaaatc

SEQ ID NO: 215731 - DNA, 22 bp, Homo sapiens
gactattcttgatgtaaaatct

SEQ ID NO: 215732 - DNA, 20 bp, Homo sapiens
gactatttaaacttataaat

SEQ ID NO: 215733 - DNA, 16 bp, Homo sapiens
gactatttaacttgag

SEQ ID NO: 215734 - DNA, 23 bp, Homo sapiens
gactcagacaggaaagggaaggc

SEQ ID NO: 215735 - DNA, 13 bp, Homo sapiens
gactcagccctga

SEQ ID NO: 215736 - DNA, 15 bp, Homo sapiens
gactcagccctgagg

SEQ ID NO: 215737 - DNA, 23 bp, Homo sapiens
gactcaggatttaaaaactggaa

SEQ ID NO: 215738 - DNA, 14 bp, Homo sapiens
gactcaggcctgcc

SEQ ID NO: 215739 - DNA, 17 bp, Homo sapiens
gactcaggcctgccaat

SEQ ID NO: 215740 - DNA, 20 bp, Homo sapiens
gactcaggcctgccaatgcc

SEQ ID NO: 215741 - DNA, 20 bp, Homo sapiens
gactcagggccatgcctgcc

SEQ ID NO: 215742 - DNA, 21 bp, Homo sapiens
gactcagggccatgcctgccc

SEQ ID NO: 215743 - DNA, 18 bp, Homo sapiens
gactcagtgtattttaaa

SEQ ID NO: 215744 - DNA, 18 bp, Homo sapiens
gactcattaatttctctc

SEQ ID NO: 215745 - DNA, 11 bp, Homo sapiens
gactcattcac

SEQ ID NO: 215746 - DNA, 14 bp, Homo sapiens
gactcattcccagt

SEQ ID NO: 215747 - DNA, 23 bp, Homo sapiens
gactccagaatctgctgttgcca

SEQ ID NO: 215748 - DNA, 12 bp, Homo sapiens
gactccagagtc

SEQ ID NO: 215749 - DNA, 19 bp, Homo sapiens
gactccagagtctgagccc

SEQ ID NO: 215750 - DNA, 16 bp, Homo sapiens
gactccaggagaggag

SEQ ID NO: 215751 - DNA, 19 bp, Homo sapiens
gactccaggatcctcctgg

SEQ ID NO: 215752 - DNA, 16 bp, Homo sapiens
gactccatggcccttc

SEQ ID NO: 215753 - DNA, 17 bp, Homo sapiens
gactcccaaagagctgc

SEQ ID NO: 215754 - DNA, 19 bp, Homo sapiens
gactcccaaagagctgcct

SEQ ID NO: 215755 - DNA, 22 bp, Homo sapiens
gactccccgcccgccctcctct

SEQ ID NO: 215756 - DNA, 22 bp, Homo sapiens
gactcccgggccacgccccagc

SEQ ID NO: 215757 - DNA, 23 bp, Homo sapiens
gactcccgggccacgccccagcc

SEQ ID NO: 215758 - DNA, 16 bp, Homo sapiens
gactccctccccaccc

SEQ ID NO: 215759 - DNA, 18 bp, Homo sapiens
gactccctccccacccca

SEQ ID NO: 215760 - DNA, 12 bp, Homo sapiens
gactccctcctc

SEQ ID NO: 215761 - DNA, 13 bp, Homo sapiens
gactccctcctca

SEQ ID NO: 215762 - DNA, 20 bp, Homo sapiens
gactccctcctcacctctgg

SEQ ID NO: 215763 - DNA, 23 bp, Homo sapiens
gactccctcctcacctctggact

SEQ ID NO: 215764 - DNA, 11 bp, Homo sapiens
gactcctccct

SEQ ID NO: 215765 - DNA, 18 bp, Homo sapiens
gactcctcccttccccac

SEQ ID NO: 215766 - DNA, 17 bp, Homo sapiens
gactcctgattgctctg

SEQ ID NO: 215767 - DNA, 18 bp, Homo sapiens
gactcctgattgctctgg

SEQ ID NO: 215768 - DNA, 13 bp, Homo sapiens
gactcctgccctg

SEQ ID NO: 215769 - DNA, 22 bp, Homo sapiens
gactcctggtctgaaaatgttg

SEQ ID NO: 215770 - DNA, 16 bp, Homo sapiens
gactccttctccccaa

SEQ ID NO: 215771 - DNA, 18 bp, Homo sapiens
gactccttctccccaatc

SEQ ID NO: 215772 - DNA, 16 bp, Homo sapiens
gactcgagagggctga

SEQ ID NO: 215773 - DNA, 13 bp, Homo sapiens
gactcgcagcacc

SEQ ID NO: 215774 - DNA, 19 bp, Homo sapiens
gactcgcttagctgaaacc

SEQ ID NO: 215775 - DNA, 19 bp, Homo sapiens
gactcgttctcgtgaccca

SEQ ID NO: 215776 - DNA, 12 bp, Homo sapiens
tatctgcctggc

SEQ ID NO: 215777 - DNA, 14 bp, Homo sapiens
tatctgcctggcct

SEQ ID NO: 215778 - DNA, 19 bp, Homo sapiens
tatctgctgcctctgaaaa

SEQ ID NO: 215779 - DNA, 22 bp, Homo sapiens
tatctgctgcctctgaaaatat

SEQ ID NO: 215780 - DNA, 15 bp, Homo sapiens
tatctgctgtatgtc

SEQ ID NO: 215781 - DNA, 23 bp, Homo sapiens
tatctgggattatggttttgtga

SEQ ID NO: 215782 - DNA, 14 bp, Homo sapiens
tatctgggcctggg

SEQ ID NO: 215783 - DNA, 11 bp, Homo sapiens
tatctggtatc

SEQ ID NO: 215784 - DNA, 24 bp, Homo sapiens
tatctgtacctgcccccactcagc

SEQ ID NO: 215785 - DNA, 17 bp, Homo sapiens
tatctgtctgagccctg

SEQ ID NO: 215786 - DNA, 14 bp, Homo sapiens
tatctgtctttatg

SEQ ID NO: 215787 - DNA, 20 bp, Homo sapiens
tatctgtctttatgatttca

SEQ ID NO: 215788 - DNA, 17 bp, Homo sapiens
tatctgtgcgtgaaaca

SEQ ID NO: 215789 - DNA, 18 bp, Homo sapiens
tatctgtgcgtgaaacac

SEQ ID NO: 215790 - DNA, 20 bp, Homo sapiens
tatctgtgcgtgaaacacac

SEQ ID NO: 215791 - DNA, 15 bp, Homo sapiens
tatctgttaaccaaa

SEQ ID NO: 215792 - DNA, 20 bp, Homo sapiens
tatctgttttactgctttta

SEQ ID NO: 215793 - DNA, 16 bp, Homo sapiens
tatcttaaatctgtga

SEQ ID NO: 215794 - DNA, 19 bp, Homo sapiens
tatcttctgtttttctcaa

SEQ ID NO: 215795 - DNA, 23 bp, Homo sapiens
tatcttctgtttttctcaaataa

SEQ ID NO: 215796 - DNA, 18 bp, Homo sapiens
tatcttgaaaaagtattg

SEQ ID NO: 215797 - DNA, 18 bp, Homo sapiens
tatcttgaagaatattgt

SEQ ID NO: 215798 - DNA, 14 bp, Homo sapiens
tatcttgaagactt

SEQ ID NO: 215799 - DNA, 19 bp, Homo sapiens
tatcttgcatctacctgct

SEQ ID NO: 215800 - DNA, 17 bp, Homo sapiens
tatcttggactgacatt

SEQ ID NO: 215801 - DNA, 15 bp, Homo sapiens
tatctttaaaactta

SEQ ID NO: 215802 - DNA, 16 bp, Homo sapiens
tatctttaaatataat

SEQ ID NO: 215803 - DNA, 12 bp, Homo sapiens
tatctttatact

SEQ ID NO: 215804 - DNA, 20 bp, Homo sapiens
tatctttatacttaaacagc

SEQ ID NO: 215805 - DNA, 16 bp, Homo sapiens
tatctttcagttatta

SEQ ID NO: 215806 - DNA, 20 bp, Homo sapiens
tatcttttattttcctgtct

SEQ ID NO: 215807 - DNA, 15 bp, Homo sapiens
tatcttttcttctcc

SEQ ID NO: 215808 - DNA, 23 bp, Homo sapiens
tatgaaaaaaaaattatttgcct

SEQ ID NO: 215809 - DNA, 16 bp, Homo sapiens
tatgaaacgaatataa

SEQ ID NO: 215810 - DNA, 20 bp, Homo sapiens
tatgaaagatggctgtgcct

SEQ ID NO: 215811 - DNA, 21 bp, Homo sapiens
tatgaaagcaacaactttgtt

SEQ ID NO: 215812 - DNA, 14 bp, Homo sapiens
tatgaacttaacat

SEQ ID NO: 215813 - DNA, 19 bp, Homo sapiens
tatgaacttaacatgctgt

SEQ ID NO: 215814 - DNA, 12 bp, Homo sapiens
tatgaatacagg

SEQ ID NO: 215815 - DNA, 23 bp, Homo sapiens
tatgaatcagtgggcaggataaa

SEQ ID NO: 215816 - DNA, 15 bp, Homo sapiens
tatgaatgatatctt

SEQ ID NO: 215817 - DNA, 16 bp, Homo sapiens
tatgaatgatatcttt

SEQ ID NO: 215818 - DNA, 21 bp, Homo sapiens
tatgaatttaaatataattct

SEQ ID NO: 215819 - DNA, 21 bp, Homo sapiens
tatgacaatttcaaaatgcat

SEQ ID NO: 215820 - DNA, 23 bp, Homo sapiens
tatgacctaaatccattttctaa

SEQ ID NO: 215821 - DNA, 23 bp, Homo sapiens
tatgacgcggctcaaaaggaaac

SEQ ID NO: 215822 - DNA, 14 bp, Homo sapiens
tatgactaaagaga

SEQ ID NO: 215823 - DNA, 15 bp, Homo sapiens
tatgactaaagagag

SEQ ID NO: 215824 - DNA, 17 bp, Homo sapiens
tatgacttcttgttcat

SEQ ID NO: 215825 - DNA, 20 bp, Homo sapiens
tatgacttcttgttcatgtt

SEQ ID NO: 215826 - DNA, 17 bp, Homo sapiens
tatgagaaaaaaacagc

SEQ ID NO: 215827 - DNA, 14 bp, Homo sapiens
tatgagaacatggt

SEQ ID NO: 215828 - DNA, 18 bp, Homo sapiens
tatgagatggccatgctc

SEQ ID NO: 215829 - DNA, 22 bp, Homo sapiens
tatgagattggaaaaaattaga

SEQ ID NO: 215830 - DNA, 21 bp, Homo sapiens
tatgagcttccttctgtgaaa

SEQ ID NO: 215831 - DNA, 17 bp, Homo sapiens
tatgaggaataattatt

SEQ ID NO: 215832 - DNA, 14 bp, Homo sapiens
tatgaggtgaaatg

SEQ ID NO: 215833 - DNA, 18 bp, Homo sapiens
tatgagtaactattatta

SEQ ID NO: 215834 - DNA, 21 bp, Homo sapiens
tatgagtatctttaaatataa

SEQ ID NO: 215835 - DNA, 15 bp, Homo sapiens
tatgagtcaatgtgc

SEQ ID NO: 215836 - DNA, 23 bp, Homo sapiens
tatgataaaaaagtgtcctataa

SEQ ID NO: 215837 - DNA, 14 bp, Homo sapiens
tatgataaaaggaa

SEQ ID NO: 215838 - DNA, 13 bp, Homo sapiens
tatgataaatttg

SEQ ID NO: 215839 - DNA, 14 bp, Homo sapiens
tatgatatataaac

SEQ ID NO: 215840 - DNA, 13 bp, Homo sapiens
tatgatatgcatg

SEQ ID NO: 215841 - DNA, 19 bp, Homo sapiens
tatgatatttcttgctttc

SEQ ID NO: 215842 - DNA, 21 bp, Homo sapiens
tatgatgactcccttaaaata

SEQ ID NO: 215843 - DNA, 20 bp, Homo sapiens
tatgatggcaggagaatcag

SEQ ID NO: 215844 - DNA, 17 bp, Homo sapiens
aagaagggtccttccct

SEQ ID NO: 215845 - DNA, 18 bp, Homo sapiens
aagaagtagcaagatctt

SEQ ID NO: 215846 - DNA, 14 bp, Homo sapiens
aagaagtcaaatga

SEQ ID NO: 215847 - DNA, 17 bp, Homo sapiens
aagaagtcaaatgaatg

SEQ ID NO: 215848 - DNA, 18 bp, Homo sapiens
aagaagtcagagaaaaca

SEQ ID NO: 215849 - DNA, 21 bp, Homo sapiens
aagaagtcagagaaaacactt

SEQ ID NO: 215850 - DNA, 19 bp, Homo sapiens
aagaagtgggagtgggaga

SEQ ID NO: 215851 - DNA, 15 bp, Homo sapiens
aagaatagcttatct

SEQ ID NO: 215852 - DNA, 13 bp, Homo sapiens
aagaatataaata

SEQ ID NO: 215853 - DNA, 22 bp, Homo sapiens
aagaatcattatttattaaatt

SEQ ID NO: 215854 - DNA, 16 bp, Homo sapiens
aagaatcggcatgtat

SEQ ID NO: 215855 - DNA, 14 bp, Homo sapiens
aagaatgagaaaga

SEQ ID NO: 215856 - DNA, 23 bp, Homo sapiens
aagaatgagaaagaaaaggaatg

SEQ ID NO: 215857 - DNA, 22 bp, Homo sapiens
aagaatgcagattcctgggcct

SEQ ID NO: 215858 - DNA, 15 bp, Homo sapiens
aagaatgcattcaaa

SEQ ID NO: 215859 - DNA, 15 bp, Homo sapiens
aagaatgctggtttt

SEQ ID NO: 215860 - DNA, 18 bp, Homo sapiens
aagaatgctggttttcct

SEQ ID NO: 215861 - DNA, 22 bp, Homo sapiens
aagaatgctggttttcctaaat

SEQ ID NO: 215862 - DNA, 18 bp, Homo sapiens
aagaatggtgtgtttccc

SEQ ID NO: 215863 - DNA, 15 bp, Homo sapiens
aagaatgtttatagc

SEQ ID NO: 215864 - DNA, 14 bp, Homo sapiens
aagaattatttttg

SEQ ID NO: 215865 - DNA, 22 bp, Homo sapiens
aagaattatttttgtgtttcta

SEQ ID NO: 215866 - DNA, 17 bp, Homo sapiens
aagaattcctacaatat

SEQ ID NO: 215867 - DNA, 23 bp, Homo sapiens
aagaattcctacaatatatattc

SEQ ID NO: 215868 - DNA, 22 bp, Homo sapiens
aagaattgtttttgaatttaaa

SEQ ID NO: 215869 - DNA, 13 bp, Homo sapiens
aagaatttttaaa

SEQ ID NO: 215870 - DNA, 18 bp, Homo sapiens
aagaattttttttttaag

SEQ ID NO: 215871 - DNA, 20 bp, Homo sapiens
aagacaaacaccttatttgt

SEQ ID NO: 215872 - DNA, 17 bp, Homo sapiens
aagacaaagaaggaaaa

SEQ ID NO: 215873 - DNA, 14 bp, Homo sapiens
aagacaaatgggac

SEQ ID NO: 215874 - DNA, 12 bp, Homo sapiens
aagacacacagc

SEQ ID NO: 215875 - DNA, 19 bp, Homo sapiens
aagacacacagcctttctg

SEQ ID NO: 215876 - DNA, 22 bp, Homo sapiens
aagacacacagcctttctgtat

SEQ ID NO: 215877 - DNA, 20 bp, Homo sapiens
aagacactagtagagcaaag

SEQ ID NO: 215878 - DNA, 24 bp, Homo sapiens
aagacactgtcaatgaggttatga

SEQ ID NO: 215879 - DNA, 22 bp, Homo sapiens
aagacacttcaatgggagtgaa

SEQ ID NO: 215880 - DNA, 16 bp, Homo sapiens
aagacagagacgcagg

SEQ ID NO: 215881 - DNA, 23 bp, Homo sapiens
aagacagagcagatcagtctttg

SEQ ID NO: 215882 - DNA, 23 bp, Homo sapiens
aagacagatactcctccaaggtt

SEQ ID NO: 215883 - DNA, 16 bp, Homo sapiens
aagacagatgccccag

SEQ ID NO: 215884 - DNA, 17 bp, Homo sapiens
aagacagatgccccaga

SEQ ID NO: 215885 - DNA, 22 bp, Homo sapiens
aagacagatgccccagagctgt

SEQ ID NO: 215886 - DNA, 14 bp, Homo sapiens
aagacatatcatgt

SEQ ID NO: 215887 - DNA, 13 bp, Homo sapiens
aagacatgaacca

SEQ ID NO: 215888 - DNA, 14 bp, Homo sapiens
aagacattcaccaa

SEQ ID NO: 215889 - DNA, 19 bp, Homo sapiens
aagacattcaccaacaaca

SEQ ID NO: 215890 - DNA, 14 bp, Homo sapiens
aagacattgtcaat

SEQ ID NO: 215891 - DNA, 17 bp, Homo sapiens
aagacattgtcaataaa

SEQ ID NO: 215892 - DNA, 14 bp, Homo sapiens
aagacatttcaaat

SEQ ID NO: 215893 - DNA, 14 bp, Homo sapiens
aagaccaaattttg

SEQ ID NO: 215894 - DNA, 23 bp, Homo sapiens
aagaccaaggcctcggcagaact

SEQ ID NO: 215895 - DNA, 15 bp, Homo sapiens
aagaccagcctggcc

SEQ ID NO: 215896 - DNA, 16 bp, Homo sapiens
aagaccagtcacagcc

SEQ ID NO: 215897 - DNA, 17 bp, Homo sapiens
aagaccagtcacagcca

SEQ ID NO: 215898 - DNA, 12 bp, Homo sapiens
aagaccagtcca

SEQ ID NO: 215899 - DNA, 17 bp, Homo sapiens
aagacccccatctctgc

SEQ ID NO: 215900 - DNA, 13 bp, Homo sapiens
aagaccctgagac

SEQ ID NO: 215901 - DNA, 20 bp, Homo sapiens
aagacccttttgggtttctg

SEQ ID NO: 215902 - DNA, 19 bp, Homo sapiens
aagacctacattccctctc

SEQ ID NO: 215903 - DNA, 20 bp, Homo sapiens
aagaccttctgaagatctca

SEQ ID NO: 215904 - DNA, 21 bp, Homo sapiens
aagacctttggagcaaagctg

SEQ ID NO: 215905 - DNA, 15 bp, Homo sapiens
tatggcccagccttg

SEQ ID NO: 215906 - DNA, 12 bp, Homo sapiens
tatggcctcagc

SEQ ID NO: 215907 - DNA, 15 bp, Homo sapiens
tatggctgtattttt

SEQ ID NO: 215908 - DNA, 19 bp, Homo sapiens
tatggcttgtagggtgagg

SEQ ID NO: 215909 - DNA, 15 bp, Homo sapiens
tatggctttgtgctt

SEQ ID NO: 215910 - DNA, 17 bp, Homo sapiens
tatggctttgtgcttgt

SEQ ID NO: 215911 - DNA, 20 bp, Homo sapiens
tatgggaacaagtgtacaga

SEQ ID NO: 215912 - DNA, 16 bp, Homo sapiens
tatgggagccccaggg

SEQ ID NO: 215913 - DNA, 14 bp, Homo sapiens
tatgggaggaacaa

SEQ ID NO: 215914 - DNA, 17 bp, Homo sapiens
tatgggcattgtagtta

SEQ ID NO: 215915 - DNA, 23 bp, Homo sapiens
tatggggagaggaactccttggc

SEQ ID NO: 215916 - DNA, 11 bp, Homo sapiens
tatgggtcaca

SEQ ID NO: 215917 - DNA, 15 bp, Homo sapiens
tatggtaaagatatt

SEQ ID NO: 215918 - DNA, 22 bp, Homo sapiens
tatggtagcttttactttttat

SEQ ID NO: 215919 - DNA, 20 bp, Homo sapiens
tatggtattttcgtgcattt

SEQ ID NO: 215920 - DNA, 22 bp, Homo sapiens
tatggtcaacacttaagggttt

SEQ ID NO: 215921 - DNA, 17 bp, Homo sapiens
tatggtggccctgggga

SEQ ID NO: 215922 - DNA, 18 bp, Homo sapiens
tatggtggccctggggaa

SEQ ID NO: 215923 - DNA, 16 bp, Homo sapiens
tatggttcccaataaa

SEQ ID NO: 215924 - DNA, 20 bp, Homo sapiens
tatggttcccaataaaagtg

SEQ ID NO: 215925 - DNA, 19 bp, Homo sapiens
tatgtaaagtatgtaaaca

SEQ ID NO: 215926 - DNA, 14 bp, Homo sapiens
tatgtaaattattg

SEQ ID NO: 215927 - DNA, 15 bp, Homo sapiens
tatgtaatgcaaaat

SEQ ID NO: 215928 - DNA, 16 bp, Homo sapiens
tatgtaatgcttatgt

SEQ ID NO: 215929 - DNA, 14 bp, Homo sapiens
tatgtacagttata

SEQ ID NO: 215930 - DNA, 17 bp, Homo sapiens
tatgtacagttatacat

SEQ ID NO: 215931 - DNA, 18 bp, Homo sapiens
tatgtacagttcataaat

SEQ ID NO: 215932 - DNA, 16 bp, Homo sapiens
tatgtaccatgtacat

SEQ ID NO: 215933 - DNA, 21 bp, Homo sapiens
tatgtactcctctttacactg

SEQ ID NO: 215934 - DNA, 23 bp, Homo sapiens
tatgtactttgatttacagtgcc

SEQ ID NO: 215935 - DNA, 13 bp, Homo sapiens
tatgtagaaatat

SEQ ID NO: 215936 - DNA, 14 bp, Homo sapiens
tatgtagaactgtt

SEQ ID NO: 215937 - DNA, 15 bp, Homo sapiens
tatgtagaactgttc

SEQ ID NO: 215938 - DNA, 17 bp, Homo sapiens
tatgtagatgtgcattt

SEQ ID NO: 215939 - DNA, 15 bp, Homo sapiens
tatgtataatttcac

SEQ ID NO: 215940 - DNA, 20 bp, Homo sapiens
tatgtatgtgccaattttgt

SEQ ID NO: 215941 - DNA, 12 bp, Homo sapiens
tatgtatgtgta

SEQ ID NO: 215942 - DNA, 17 bp, Homo sapiens
tatgtatgtgtagtgtg

SEQ ID NO: 215943 - DNA, 16 bp, Homo sapiens
tatgtatgtttacata

SEQ ID NO: 215944 - DNA, 16 bp, Homo sapiens
tatgtattaccagccc

SEQ ID NO: 215945 - DNA, 18 bp, Homo sapiens
tatgtattgtaaacatgt

SEQ ID NO: 215946 - DNA, 14 bp, Homo sapiens
tatgtatttcattg

SEQ ID NO: 215947 - DNA, 22 bp, Homo sapiens
tatgtatttcattgctgtgtca

SEQ ID NO: 215948 - DNA, 17 bp, Homo sapiens
tatgtcagtccaataaa

SEQ ID NO: 215949 - DNA, 16 bp, Homo sapiens
tatgtcatactctgtg

SEQ ID NO: 215950 - DNA, 23 bp, Homo sapiens
tatgtcctccaccacaagagctc

SEQ ID NO: 215951 - DNA, 12 bp, Homo sapiens
tatgtctgtgat

SEQ ID NO: 215952 - DNA, 21 bp, Homo sapiens
tatgtcttcataatataacaa

SEQ ID NO: 215953 - DNA, 21 bp, Homo sapiens
tatgtcttgcaaagcctttaa

SEQ ID NO: 215954 - DNA, 19 bp, Homo sapiens
tatgtgaattgaagtcatc

SEQ ID NO: 215955 - DNA, 17 bp, Homo sapiens
tatgtgacaacctttgt

SEQ ID NO: 215956 - DNA, 17 bp, Homo sapiens
tatgtgagcatgaaact

SEQ ID NO: 215957 - DNA, 17 bp, Homo sapiens
tatgtgagcgagcaagc

SEQ ID NO: 215958 - DNA, 19 bp, Homo sapiens
tatgtgagtgaaagtactt

SEQ ID NO: 215959 - DNA, 13 bp, Homo sapiens
tatgtgagtgtgt

SEQ ID NO: 215960 - DNA, 20 bp, Homo sapiens
tatgtgcactgtcactttgc

SEQ ID NO: 215961 - DNA, 21 bp, Homo sapiens
tatgtgcactgtcactttgct

SEQ ID NO: 215962 - DNA, 17 bp, Homo sapiens
tatgtgccaattttgtc

SEQ ID NO: 215963 - DNA, 19 bp, Homo sapiens
tatgtgccaattttgtcac

SEQ ID NO: 215964 - DNA, 13 bp, Homo sapiens
tatgtggctttta

SEQ ID NO: 215965 - DNA, 12 bp, Homo sapiens
tatgtgtcatga

SEQ ID NO: 215966 - DNA, 16 bp, Homo sapiens
tatgtgtgaggagctg

SEQ ID NO: 215967 - DNA, 13 bp, Homo sapiens
tatgtgtgtttaa

SEQ ID NO: 215968 - DNA, 14 bp, Homo sapiens
tatgtgtgtttaaa

SEQ ID NO: 215969 - DNA, 17 bp, Homo sapiens
tatgtgtgtttaaataa

SEQ ID NO: 215970 - DNA, 20 bp, Homo sapiens
tatgtgtgtttaaataaagt

SEQ ID NO: 215971 - DNA, 18 bp, Homo sapiens
tatgtgttgcataaacaa

SEQ ID NO: 215972 - DNA, 15 bp, Homo sapiens
tatgtgttgccaaag

SEQ ID NO: 215973 - DNA, 19 bp, Homo sapiens
tatgttaacctcagtgtca

SEQ ID NO: 215974 - DNA, 20 bp, Homo sapiens
tatgttaacctcagtgtcat

SEQ ID NO: 215975 - DNA, 22 bp, Homo sapiens
tatgttaacctcagtgtcattt

SEQ ID NO: 215976 - DNA, 19 bp, Homo sapiens
tatgttaagctctttatga

SEQ ID NO: 215977 - DNA, 12 bp, Homo sapiens
tatgttacttaa

SEQ ID NO: 215978 - DNA, 19 bp, Homo sapiens
tatgttacttaaacatcat

SEQ ID NO: 215979 - DNA, 13 bp, Homo sapiens
tatgttagagagg

SEQ ID NO: 215980 - DNA, 14 bp, Homo sapiens
tatgttattgaaaa

SEQ ID NO: 215981 - DNA, 20 bp, Homo sapiens
tatgttcaccaggagattac

SEQ ID NO: 215982 - DNA, 14 bp, Homo sapiens
tatgttgctcagtc

SEQ ID NO: 215983 - DNA, 14 bp, Homo sapiens
tatgttgtaataaa

SEQ ID NO: 215984 - DNA, 15 bp, Homo sapiens
tatgttgtatagatt

SEQ ID NO: 215985 - DNA, 20 bp, Homo sapiens
tatgttgtgaagatgtttgc

SEQ ID NO: 215986 - DNA, 14 bp, Homo sapiens
tatgttgtgtaagt

SEQ ID NO: 215987 - DNA, 16 bp, Homo sapiens
tatgtttacctcactg

SEQ ID NO: 215988 - DNA, 18 bp, Homo sapiens
tatgtttatttactaatt

SEQ ID NO: 215989 - DNA, 14 bp, Homo sapiens
tatgtttgcacact

SEQ ID NO: 215990 - DNA, 22 bp, Homo sapiens
tatgtttgcattaaatgctttg

SEQ ID NO: 215991 - DNA, 17 bp, Homo sapiens
tatgtttggctgaaatt

SEQ ID NO: 215992 - DNA, 12 bp, Homo sapiens
tatgtttgtaca

SEQ ID NO: 215993 - DNA, 14 bp, Homo sapiens
tatgttttagcatg

SEQ ID NO: 215994 - DNA, 13 bp, Homo sapiens
tatgttttgagaa

SEQ ID NO: 215995 - DNA, 14 bp, Homo sapiens
tatgttttgagaaa

SEQ ID NO: 215996 - DNA, 15 bp, Homo sapiens
tatgttttgtttctg

SEQ ID NO: 215997 - DNA, 14 bp, Homo sapiens
tattaaaaatataa

SEQ ID NO: 215998 - DNA, 20 bp, Homo sapiens
tattaaaaatatggaacttc

SEQ ID NO: 215999 - DNA, 17 bp, Homo sapiens
tattaaaaattatagac

SEQ ID NO: 216000 - DNA, 22 bp, Homo sapiens
tattaaaatatggctataaata

SEQ ID NO: 216001 - DNA, 18 bp, Homo sapiens
tattaaaatgattgtaaa

SEQ ID NO: 216002 - DNA, 19 bp, Homo sapiens
tattaaaatgattgtaaaa

SEQ ID NO: 216003 - DNA, 20 bp, Homo sapiens
tattaaaatgattgtaaaat

SEQ ID NO: 216004 - DNA, 20 bp, Homo sapiens
tattaaaccataagatggca

SEQ ID NO: 216005 - DNA, 17 bp, Homo sapiens
tattaaactctcctttg

SEQ ID NO: 216006 - DNA, 12 bp, Homo sapiens
tattaaacttga

SEQ ID NO: 216007 - DNA, 13 bp, Homo sapiens
tattaaacttgaa

SEQ ID NO: 216008 - DNA, 17 bp, Homo sapiens
tattaaacttgtcagaa

SEQ ID NO: 216009 - DNA, 18 bp, Homo sapiens
tattaaagggtctggaaa

SEQ ID NO: 216010 - DNA, 13 bp, Homo sapiens
tattaaatacaga

SEQ ID NO: 216011 - DNA, 17 bp, Homo sapiens
tattaaatacagacact

SEQ ID NO: 216012 - DNA, 20 bp, Homo sapiens
tattaaattttttaaaaagc

SEQ ID NO: 216013 - DNA, 22 bp, Homo sapiens
tattaaattttttaaaaagcaa

SEQ ID NO: 216014 - DNA, 23 bp, Homo sapiens
tattaacaacaataacactgtct

SEQ ID NO: 216015 - DNA, 20 bp, Homo sapiens
tattaacatatattgttatt

SEQ ID NO: 216016 - DNA, 12 bp, Homo sapiens
tattaactacat

SEQ ID NO: 216017 - DNA, 20 bp, Homo sapiens
tattaagaaacaatttaaat

SEQ ID NO: 216018 - DNA, 21 bp, Homo sapiens
tattaagaatagtctctgggt

SEQ ID NO: 216019 - DNA, 16 bp, Homo sapiens
tattaagatggattct

SEQ ID NO: 216020 - DNA, 20 bp, Homo sapiens
tattaagatggattctcaga

SEQ ID NO: 216021 - DNA, 17 bp, Homo sapiens
tattaatccacaaatat

SEQ ID NO: 216022 - DNA, 12 bp, Homo sapiens
tattaatgctaa

SEQ ID NO: 216023 - DNA, 15 bp, Homo sapiens
tattaatgctaaggg

SEQ ID NO: 216024 - DNA, 19 bp, Homo sapiens
tattaatggcatgtaatat

SEQ ID NO: 216025 - DNA, 21 bp, Homo sapiens
tattaattgttttgcactttt

SEQ ID NO: 216026 - DNA, 19 bp, Homo sapiens
tattacaaattttcactgc

SEQ ID NO: 216027 - DNA, 21 bp, Homo sapiens
tattacactgtatttgtatct

SEQ ID NO: 216028 - DNA, 14 bp, Homo sapiens
tattacatctaatg

SEQ ID NO: 216029 - DNA, 17 bp, Homo sapiens
tattacatctaatgctt

SEQ ID NO: 216030 - DNA, 15 bp, Homo sapiens
tattaccatcttaat

SEQ ID NO: 216031 - DNA, 13 bp, Homo sapiens
tattactagtact

SEQ ID NO: 216032 - DNA, 18 bp, Homo sapiens
tattactgtttatttctg

SEQ ID NO: 216033 - DNA, 21 bp, Homo sapiens
tattactgtttatttctgttt

SEQ ID NO: 216034 - DNA, 15 bp, Homo sapiens
tattactttaaatta

SEQ ID NO: 216035 - DNA, 15 bp, Homo sapiens
tattacttttctgca

SEQ ID NO: 216036 - DNA, 18 bp, Homo sapiens
tatttaaatgtaaagaca

SEQ ID NO: 216037 - DNA, 11 bp, Homo sapiens
tatttaactga

SEQ ID NO: 216038 - DNA, 14 bp, Homo sapiens
tatttaacttgagg

SEQ ID NO: 216039 - DNA, 19 bp, Homo sapiens
tatttaagttatcaacttt

SEQ ID NO: 216040 - DNA, 17 bp, Homo sapiens
tatttaatgatttttgt

SEQ ID NO: 216041 - DNA, 22 bp, Homo sapiens
tatttactgagcttctctgtga

SEQ ID NO: 216042 - DNA, 13 bp, Homo sapiens
tatttactgtact

SEQ ID NO: 216043 - DNA, 23 bp, Homo sapiens
tatttacttttaccactatttaa

SEQ ID NO: 216044 - DNA, 13 bp, Homo sapiens
tatttagtatctg

SEQ ID NO: 216045 - DNA, 17 bp, Homo sapiens
tatttagttatagtttc

SEQ ID NO: 216046 - DNA, 20 bp, Homo sapiens
tatttagttatagtttcaga

SEQ ID NO: 216047 - DNA, 14 bp, Homo sapiens
tatttagttggaat

SEQ ID NO: 216048 - DNA, 16 bp, Homo sapiens
tatttataaatatatt

SEQ ID NO: 216049 - DNA, 18 bp, Homo sapiens
tatttataacagcattct

SEQ ID NO: 216050 - DNA, 22 bp, Homo sapiens
tatttataactcatcataaaat

SEQ ID NO: 216051 - DNA, 15 bp, Homo sapiens
tatttatagggcttt

SEQ ID NO: 216052 - DNA, 13 bp, Homo sapiens
tatttatataatt

SEQ ID NO: 216053 - DNA, 19 bp, Homo sapiens
tatttatattcatcaaata

SEQ ID NO: 216054 - DNA, 16 bp, Homo sapiens
tatttatatttcacta

SEQ ID NO: 216055 - DNA, 15 bp, Homo sapiens
tatttatcagtgaca

SEQ ID NO: 216056 - DNA, 17 bp, Homo sapiens
tatttatcatatttaat

SEQ ID NO: 216057 - DNA, 22 bp, Homo sapiens
tatttatctccgcaggctattt

SEQ ID NO: 216058 - DNA, 14 bp, Homo sapiens
tatttatgtttaag

SEQ ID NO: 216059 - DNA, 12 bp, Homo sapiens
tatttattaaac

SEQ ID NO: 216060 - DNA, 14 bp, Homo sapiens
tatttattaaactt

SEQ ID NO: 216061 - DNA, 18 bp, Homo sapiens
tatttattaaacttcagc

SEQ ID NO: 216062 - DNA, 14 bp, Homo sapiens
tatttattaaattt

SEQ ID NO: 216063 - DNA, 15 bp, Homo sapiens
tatttattacctctg

SEQ ID NO: 216064 - DNA, 19 bp, Homo sapiens
tatttattattttcacctg

SEQ ID NO: 216065 - DNA, 19 bp, Homo sapiens
tatttattgaattattttg

SEQ ID NO: 216066 - DNA, 21 bp, Homo sapiens
tatttattgtatatatggata

SEQ ID NO: 216067 - DNA, 17 bp, Homo sapiens
tatttatttactgagct

SEQ ID NO: 216068 - DNA, 11 bp, Homo sapiens
tatttatttat

SEQ ID NO: 216069 - DNA, 21 bp, Homo sapiens
tatttatttgttttggaatcc

SEQ ID NO: 216070 - DNA, 23 bp, Homo sapiens
tatttattttcagtatactgtgt

SEQ ID NO: 216071 - DNA, 17 bp, Homo sapiens
tatttattttcctcccc

SEQ ID NO: 216072 - DNA, 19 bp, Homo sapiens
tatttatttttgtactgtg

SEQ ID NO: 216073 - DNA, 20 bp, Homo sapiens
tatttcaaaatatacattca

SEQ ID NO: 216074 - DNA, 19 bp, Homo sapiens
tatttcaagggttgcttct

SEQ ID NO: 216075 - DNA, 11 bp, Homo sapiens
tatttccatgg

SEQ ID NO: 216076 - DNA, 15 bp, Homo sapiens
tatttccttaaactg

SEQ ID NO: 216077 - DNA, 20 bp, Homo sapiens
tatttctaagcttatttcta

SEQ ID NO: 216078 - DNA, 20 bp, Homo sapiens
tatttctacctttctgagtc

SEQ ID NO: 216079 - DNA, 14 bp, Homo sapiens
tatttctatgtaaa

SEQ ID NO: 216080 - DNA, 15 bp, Homo sapiens
tatttctatgtaaat

SEQ ID NO: 216081 - DNA, 21 bp, Homo sapiens
tatttctccatcccctccctg

SEQ ID NO: 216082 - DNA, 13 bp, Homo sapiens
tatttctctcccc

SEQ ID NO: 216083 - DNA, 13 bp, Homo sapiens
tatttctgtagaa

SEQ ID NO: 216084 - DNA, 20 bp, Homo sapiens
tatttctgtagaatgctgta

SEQ ID NO: 216085 - DNA, 20 bp, Homo sapiens
tatttctgtggaaaacaatt

SEQ ID NO: 216086 - DNA, 16 bp, Homo sapiens
tatttctgtttctcat

SEQ ID NO: 216087 - DNA, 21 bp, Homo sapiens
tatttctttaatctgttgttt

SEQ ID NO: 216088 - DNA, 13 bp, Homo sapiens
tatttcttttata

SEQ ID NO: 216089 - DNA, 20 bp, Homo sapiens
tatttgaaaacactgctgtt

SEQ ID NO: 216090 - DNA, 17 bp, Homo sapiens
tatttgaaactgctaat

SEQ ID NO: 216091 - DNA, 13 bp, Homo sapiens
tatttgaatgact

SEQ ID NO: 216092 - DNA, 22 bp, Homo sapiens
tatttgactgcttcacggactc

SEQ ID NO: 216093 - DNA, 19 bp, Homo sapiens
tatttgagagagagaacct

SEQ ID NO: 216094 - DNA, 19 bp, Homo sapiens
tatttgagtttgacattta

SEQ ID NO: 216095 - DNA, 17 bp, Homo sapiens
tatttgcaacatttaca

SEQ ID NO: 216096 - DNA, 15 bp, Homo sapiens
tatttgctttttgct

SEQ ID NO: 216097 - DNA, 16 bp, Homo sapiens
tatttggagtggaggc

SEQ ID NO: 216098 - DNA, 18 bp, Homo sapiens
tatttggagtggaggcat

SEQ ID NO: 216099 - DNA, 15 bp, Homo sapiens
tatttggatatctgt

SEQ ID NO: 216100 - DNA, 15 bp, Homo sapiens
tatttggcaattcac

SEQ ID NO: 216101 - DNA, 22 bp, Homo sapiens
tatttggtaacttgctgtgaaa

SEQ ID NO: 216102 - DNA, 17 bp, Homo sapiens
tatttggtactgtattt

SEQ ID NO: 216103 - DNA, 16 bp, Homo sapiens
tatttgtactttgttt

SEQ ID NO: 216104 - DNA, 21 bp, Homo sapiens
tatttgtagctagaatatcct

SEQ ID NO: 216105 - DNA, 12 bp, Homo sapiens
tatttgtatctc

SEQ ID NO: 216106 - DNA, 20 bp, Homo sapiens
tatttgtcagtgtagatcaa

SEQ ID NO: 216107 - DNA, 14 bp, Homo sapiens
tatttgtgtaatag

SEQ ID NO: 216108 - DNA, 12 bp, Homo sapiens
tatttgtgttca

SEQ ID NO: 216109 - DNA, 15 bp, Homo sapiens
tatttgtgttcagtt

SEQ ID NO: 216110 - DNA, 17 bp, Homo sapiens
tatttgttattttcagt

SEQ ID NO: 216111 - DNA, 19 bp, Homo sapiens
tatttgttgtttttaacaa

SEQ ID NO: 216112 - DNA, 13 bp, Homo sapiens
tatttgttttcat

SEQ ID NO: 216113 - DNA, 20 bp, Homo sapiens
tattttaaagtaaaagtcta

SEQ ID NO: 216114 - DNA, 18 bp, Homo sapiens
tattttaaattataagga

SEQ ID NO: 216115 - DNA, 22 bp, Homo sapiens
tattttaaattataaggactgc

SEQ ID NO: 216116 - DNA, 18 bp, Homo sapiens
tattttaccactgctgtg

SEQ ID NO: 216117 - DNA, 19 bp, Homo sapiens
tattttactttgtgcaata

SEQ ID NO: 216118 - DNA, 18 bp, Homo sapiens
tattttaggcagggattt

SEQ ID NO: 216119 - DNA, 22 bp, Homo sapiens
tattttaggcagggatttgagg

SEQ ID NO: 216120 - DNA, 21 bp, Homo sapiens
tattttatataataaagtatt

SEQ ID NO: 216121 - DNA, 17 bp, Homo sapiens
tattttatttttttcta

SEQ ID NO: 216122 - DNA, 15 bp, Homo sapiens
tattttcaagcaaat

SEQ ID NO: 216123 - DNA, 22 bp, Homo sapiens
tattttcaataaagaaaaaaat

SEQ ID NO: 216124 - DNA, 18 bp, Homo sapiens
gagaaatgaggaaaagaa

SEQ ID NO: 216125 - DNA, 14 bp, Homo sapiens
gagaaattctgtgg

SEQ ID NO: 216126 - DNA, 15 bp, Homo sapiens
gagaacacatttcta

SEQ ID NO: 216127 - DNA, 20 bp, Homo sapiens
gagaacagatctccaaagct

SEQ ID NO: 216128 - DNA, 21 bp, Homo sapiens
gagaacagatctccaaagctt

SEQ ID NO: 216129 - DNA, 24 bp, Homo sapiens
gagaacatctgccttgctgcacct

SEQ ID NO: 216130 - DNA, 22 bp, Homo sapiens
gagaacgccagtctcccaggcc

SEQ ID NO: 216131 - DNA, 22 bp, Homo sapiens
gagaactagtggtggctctgag

SEQ ID NO: 216132 - DNA, 14 bp, Homo sapiens
gagaactggttctt

SEQ ID NO: 216133 - DNA, 13 bp, Homo sapiens
gagaactgtgctc

SEQ ID NO: 216134 - DNA, 18 bp, Homo sapiens
gagaactgttctcatgga

SEQ ID NO: 216135 - DNA, 20 bp, Homo sapiens
gagaacttttcatagatgaa

SEQ ID NO: 216136 - DNA, 12 bp, Homo sapiens
gagaagaggagc

SEQ ID NO: 216137 - DNA, 15 bp, Homo sapiens
gagaagagggcctgt

SEQ ID NO: 216138 - DNA, 16 bp, Homo sapiens
gagaagagggcctgtg

SEQ ID NO: 216139 - DNA, 15 bp, Homo sapiens
gagaagcaccccacc

SEQ ID NO: 216140 - DNA, 19 bp, Homo sapiens
gagaagcctcagtccctcc

SEQ ID NO: 216141 - DNA, 21 bp, Homo sapiens
gagaagcttttgaataaaaac

SEQ ID NO: 216142 - DNA, 13 bp, Homo sapiens
gagaaggaaaagg

SEQ ID NO: 216143 - DNA, 20 bp, Homo sapiens
gagaaggacccggaggggcc

SEQ ID NO: 216144 - DNA, 22 bp, Homo sapiens
gagaaggagagggagtacaaag

SEQ ID NO: 216145 - DNA, 22 bp, Homo sapiens
gagaaggagatgtaatgacaga

SEQ ID NO: 216146 - DNA, 22 bp, Homo sapiens
gagaaggcctgccccccttccc

SEQ ID NO: 216147 - DNA, 23 bp, Homo sapiens
gagaaggcctgccccccttccca

SEQ ID NO: 216148 - DNA, 15 bp, Homo sapiens
gagaaggggaggagg

SEQ ID NO: 216149 - DNA, 14 bp, Homo sapiens
gagaaggtgcttgg

SEQ ID NO: 216150 - DNA, 23 bp, Homo sapiens
gagaagtatccaattatgtgaca

SEQ ID NO: 216151 - DNA, 18 bp, Homo sapiens
gagaagtcaaacatttca

SEQ ID NO: 216152 - DNA, 13 bp, Homo sapiens
gagaagtggcccc

SEQ ID NO: 216153 - DNA, 18 bp, Homo sapiens
gagaataagaataataat

SEQ ID NO: 216154 - DNA, 17 bp, Homo sapiens
gagaataattgtgtaca

SEQ ID NO: 216155 - DNA, 19 bp, Homo sapiens
gagaatagatcagtatttc

SEQ ID NO: 216156 - DNA, 15 bp, Homo sapiens
gagaatattaattgt

SEQ ID NO: 216157 - DNA, 21 bp, Homo sapiens
gagaatattataaaaatatca

SEQ ID NO: 216158 - DNA, 22 bp, Homo sapiens
gagaatattataaaaatatcaa

SEQ ID NO: 216159 - DNA, 14 bp, Homo sapiens
gagaatcaaggccg

SEQ ID NO: 216160 - DNA, 12 bp, Homo sapiens
gagaatccaagc

SEQ ID NO: 216161 - DNA, 19 bp, Homo sapiens
gagaatcgcttgaacctgg

SEQ ID NO: 216162 - DNA, 13 bp, Homo sapiens
gagaatctgaggg

SEQ ID NO: 216163 - DNA, 22 bp, Homo sapiens
gagaatctggctcctgtttcca

SEQ ID NO: 216164 - DNA, 23 bp, Homo sapiens
gagaatctggctcctgtttccat

SEQ ID NO: 216165 - DNA, 14 bp, Homo sapiens
gagaatgccagccc

SEQ ID NO: 216166 - DNA, 19 bp, Homo sapiens
gagaggagcgggacctgtg

SEQ ID NO: 216167 - DNA, 17 bp, Homo sapiens
gagaggaggcagccccc

SEQ ID NO: 216168 - DNA, 21 bp, Homo sapiens
gagaggaggcagccccctcca

SEQ ID NO: 216169 - DNA, 15 bp, Homo sapiens
gagaggaggggtaaa

SEQ ID NO: 216170 - DNA, 18 bp, Homo sapiens
gagaggaggggtaaatat

SEQ ID NO: 216171 - DNA, 19 bp, Homo sapiens
gagaggaggggtaaatata

SEQ ID NO: 216172 - DNA, 22 bp, Homo sapiens
gagaggaggggtaaatatatgt

SEQ ID NO: 216173 - DNA, 13 bp, Homo sapiens
gagaggagttcaa

SEQ ID NO: 216174 - DNA, 12 bp, Homo sapiens
gagaggatgaat

SEQ ID NO: 216175 - DNA, 17 bp, Homo sapiens
gagaggcacctgctgga

SEQ ID NO: 216176 - DNA, 15 bp, Homo sapiens
gagaggcagaaaggg

SEQ ID NO: 216177 - DNA, 13 bp, Homo sapiens
gagaggcagagtg

SEQ ID NO: 216178 - DNA, 18 bp, Homo sapiens
gagaggccttttgtttaa

SEQ ID NO: 216179 - DNA, 23 bp, Homo sapiens
gagaggcgcgtctgccccaccct

SEQ ID NO: 216180 - DNA, 22 bp, Homo sapiens
gagaggcgttagtgggcaggtg

SEQ ID NO: 216181 - DNA, 15 bp, Homo sapiens
gagagggaatgtgaa

SEQ ID NO: 216182 - DNA, 9 bp, Homo sapiens
gagagggag

SEQ ID NO: 216183 - DNA, 13 bp, Homo sapiens
gagagggagcaag

SEQ ID NO: 216184 - DNA, 16 bp, Homo sapiens
gagagggagcaagcct

SEQ ID NO: 216185 - DNA, 18 bp, Homo sapiens
gagagggagcaagccttc

SEQ ID NO: 216186 - DNA, 13 bp, Homo sapiens
gagagggagtcag

SEQ ID NO: 216187 - DNA, 15 bp, Homo sapiens
gagagggcccagctg

SEQ ID NO: 216188 - DNA, 16 bp, Homo sapiens
gagagggcccagctgt

SEQ ID NO: 216189 - DNA, 11 bp, Homo sapiens
gagagggctga

SEQ ID NO: 216190 - DNA, 15 bp, Homo sapiens
gagagggctgagccc

SEQ ID NO: 216191 - DNA, 19 bp, Homo sapiens
gagagggctgagcccctcc

SEQ ID NO: 216192 - DNA, 17 bp, Homo sapiens
gagaggggaagggccag

SEQ ID NO: 216193 - DNA, 18 bp, Homo sapiens
gagaggggaagggccagt

SEQ ID NO: 216194 - DNA, 15 bp, Homo sapiens
gagaggggacttgga

SEQ ID NO: 216195 - DNA, 22 bp, Homo sapiens
gagaggggacttggataggagc

SEQ ID NO: 216196 - DNA, 13 bp, Homo sapiens
gagaggggtgaga

SEQ ID NO: 216197 - DNA, 16 bp, Homo sapiens
gagaggtagcgagctg

SEQ ID NO: 216198 - DNA, 15 bp, Homo sapiens
gagaggtctcaggtt

SEQ ID NO: 216199 - DNA, 16 bp, Homo sapiens
gagaggttaaggtgca

SEQ ID NO: 216200 - DNA, 19 bp, Homo sapiens
gagaggttataggtcactc

SEQ ID NO: 216201 - DNA, 17 bp, Homo sapiens
gagaggtttctggggcc

SEQ ID NO: 216202 - DNA, 14 bp, Homo sapiens
gagagtaccatgct

SEQ ID NO: 216203 - DNA, 19 bp, Homo sapiens
gagagtcccagagcaggag

SEQ ID NO: 216204 - DNA, 21 bp, Homo sapiens
gagagtgagagcacaaagata

SEQ ID NO: 216205 - DNA, 21 bp, Homo sapiens
gagagtgcagatctgtgctca

SEQ ID NO: 216206 - DNA, 13 bp, Homo sapiens
gagagtggctcct

SEQ ID NO: 216207 - DNA, 21 bp, Homo sapiens
gagagtggctcctcccggtgc

SEQ ID NO: 216208 - DNA, 17 bp, Homo sapiens
gagagttgctcctcagg

SEQ ID NO: 216209 - DNA, 19 bp, Homo sapiens
gagatacccacagagtgtg

SEQ ID NO: 216210 - DNA, 14 bp, Homo sapiens
gagatacccagaga

SEQ ID NO: 216211 - DNA, 17 bp, Homo sapiens
gagatacccagagagaa

SEQ ID NO: 216212 - DNA, 23 bp, Homo sapiens
gagatacccagagagaaaaagag

SEQ ID NO: 216213 - DNA, 21 bp, Homo sapiens
gagatagcaccattgcactcc

SEQ ID NO: 216214 - DNA, 19 bp, Homo sapiens
gagatagttggttctttta

SEQ ID NO: 216215 - DNA, 13 bp, Homo sapiens
gagatataaaatc

SEQ ID NO: 216216 - DNA, 16 bp, Homo sapiens
gagatatgcagaagga

SEQ ID NO: 216217 - DNA, 19 bp, Homo sapiens
gagatatttaaaagacaaa

SEQ ID NO: 216218 - DNA, 18 bp, Homo sapiens
gagatattttccatttta

SEQ ID NO: 216219 - DNA, 16 bp, Homo sapiens
gagatcacagcctcca

SEQ ID NO: 216220 - DNA, 19 bp, Homo sapiens
gagatcacagcctccaggg

SEQ ID NO: 216221 - DNA, 22 bp, Homo sapiens
gagatccttcacaggcagtgca

SEQ ID NO: 216222 - DNA, 21 bp, Homo sapiens
gagatcggggtggcagaaatc

SEQ ID NO: 216223 - DNA, 22 bp, Homo sapiens
gagatctccttgccctagatga

SEQ ID NO: 216224 - DNA, 12 bp, Homo sapiens
gagatcttcctt

SEQ ID NO: 216225 - DNA, 12 bp, Homo sapiens
gagatgaaaacc

SEQ ID NO: 216226 - DNA, 18 bp, Homo sapiens
gagatgagaaatgatgaa

SEQ ID NO: 216227 - DNA, 15 bp, Homo sapiens
gagatgcatggcctc

SEQ ID NO: 216228 - DNA, 16 bp, Homo sapiens
gagatgcatggcctct

SEQ ID NO: 216229 - DNA, 12 bp, Homo sapiens
gagatgcctccc

SEQ ID NO: 216230 - DNA, 22 bp, Homo sapiens
gagatggacccctcccttgctc

SEQ ID NO: 216231 - DNA, 14 bp, Homo sapiens
gagatggaggagga

SEQ ID NO: 216232 - DNA, 15 bp, Homo sapiens
gagatggaggaggag

SEQ ID NO: 216233 - DNA, 23 bp, Homo sapiens
gagatggtcagtgtggagagggg

SEQ ID NO: 216234 - DNA, 18 bp, Homo sapiens
gagatggtgccccctggg

SEQ ID NO: 216235 - DNA, 16 bp, Homo sapiens
gagatgtaatgacaga

SEQ ID NO: 216236 - DNA, 18 bp, Homo sapiens
gagatgtaccatgttaaa

SEQ ID NO: 216237 - DNA, 15 bp, Homo sapiens
gagatgtagcaaaac

SEQ ID NO: 216238 - DNA, 16 bp, Homo sapiens
gagatgtatgaaggct

SEQ ID NO: 216239 - DNA, 12 bp, Homo sapiens
gagatgtcttcg

SEQ ID NO: 216240 - DNA, 16 bp, Homo sapiens
gagatgtgacccacca

SEQ ID NO: 216241 - DNA, 18 bp, Homo sapiens
gagatgtttttaaaagtt

SEQ ID NO: 216242 - DNA, 15 bp, Homo sapiens
gagattatgttcttt

SEQ ID NO: 216243 - DNA, 23 bp, Homo sapiens
gagattcaaaaaaaaaatataag

SEQ ID NO: 216244 - DNA, 16 bp, Homo sapiens
gagattctgggaaagg

SEQ ID NO: 216245 - DNA, 20 bp, Homo sapiens
gagattctgggaaaggtgct

SEQ ID NO: 216246 - DNA, 21 bp, Homo sapiens
gagattcttagctcttgggat

SEQ ID NO: 216247 - DNA, 17 bp, Homo sapiens
gagattggaaaaaatta

SEQ ID NO: 216248 - DNA, 17 bp, Homo sapiens
gagattggtcattaaat

SEQ ID NO: 216249 - DNA, 14 bp, Homo sapiens
gagatttatataaa

SEQ ID NO: 216250 - DNA, 15 bp, Homo sapiens
gagatttgccagcac

SEQ ID NO: 216251 - DNA, 22 bp, Homo sapiens
gagatttgccagcacaggggcc

SEQ ID NO: 216252 - DNA, 13 bp, Homo sapiens
gagatttgtattt

SEQ ID NO: 216253 - DNA, 16 bp, Homo sapiens
gagatttgtatttata

SEQ ID NO: 216254 - DNA, 12 bp, Homo sapiens
gagattttcctt

SEQ ID NO: 216255 - DNA, 22 bp, Homo sapiens
gagcaaaatatgccccttcttg

SEQ ID NO: 216256 - DNA, 13 bp, Homo sapiens
gagcaaacctgcc

SEQ ID NO: 216257 - DNA, 20 bp, Homo sapiens
gagcaaactgaagcccacag

SEQ ID NO: 216258 - DNA, 18 bp, Homo sapiens
gagcaaagatcaaaataa

SEQ ID NO: 216259 - DNA, 17 bp, Homo sapiens
gagcaaagatggcttcc

SEQ ID NO: 216260 - DNA, 13 bp, Homo sapiens
gagcaaagctgat

SEQ ID NO: 216261 - DNA, 19 bp, Homo sapiens
gagcaaagtctaaagttta

SEQ ID NO: 216262 - DNA, 18 bp, Homo sapiens
gagcaaagtgcaggttat

SEQ ID NO: 216263 - DNA, 22 bp, Homo sapiens
gagcaaatttcatctttccaaa

SEQ ID NO: 216264 - DNA, 15 bp, Homo sapiens
gagcaactctccact

SEQ ID NO: 216265 - DNA, 16 bp, Homo sapiens
tcaacatcaatgttca

SEQ ID NO: 216266 - DNA, 23 bp, Homo sapiens
tcaacatcaatgttcattgtaat

SEQ ID NO: 216267 - DNA, 15 bp, Homo sapiens
tcaacatcttttaca

SEQ ID NO: 216268 - DNA, 20 bp, Homo sapiens
tcaacatctttttcctccct

SEQ ID NO: 216269 - DNA, 21 bp, Homo sapiens
tcaacatgttactgaccagca

SEQ ID NO: 216270 - DNA, 14 bp, Homo sapiens
tcaacccagaaaca

SEQ ID NO: 216271 - DNA, 13 bp, Homo sapiens
tcaacccccctcc

SEQ ID NO: 216272 - DNA, 15 bp, Homo sapiens
tcaacccgctgcttc

SEQ ID NO: 216273 - DNA, 16 bp, Homo sapiens
tcaacccgctgcttcc

SEQ ID NO: 216274 - DNA, 20 bp, Homo sapiens
tcaacccgctgcttccaggt

SEQ ID NO: 216275 - DNA, 21 bp, Homo sapiens
tcaaccctccctcagcccctc

SEQ ID NO: 216276 - DNA, 13 bp, Homo sapiens
tcaaccctgccct

SEQ ID NO: 216277 - DNA, 12 bp, Homo sapiens
tcaacctgtaaa

SEQ ID NO: 216278 - DNA, 15 bp, Homo sapiens
tcaacctgtaaatta

SEQ ID NO: 216279 - DNA, 17 bp, Homo sapiens
tcaacctgtaaattatt

SEQ ID NO: 216280 - DNA, 15 bp, Homo sapiens
tcaacctgtgatgag

SEQ ID NO: 216281 - DNA, 17 bp, Homo sapiens
tcaactaatacatggtt

SEQ ID NO: 216282 - DNA, 20 bp, Homo sapiens
tcaactccaaggcaaatgtc

SEQ ID NO: 216283 - DNA, 21 bp, Homo sapiens
tcaactccaaggcaaatgtcc

SEQ ID NO: 216284 - DNA, 17 bp, Homo sapiens
tcaactctacccctgct

SEQ ID NO: 216285 - DNA, 18 bp, Homo sapiens
tcaactctacccctgctc

SEQ ID NO: 216286 - DNA, 24 bp, Homo sapiens
tcaactgaccagcctccatgctgc

SEQ ID NO: 216287 - DNA, 19 bp, Homo sapiens
tcaactgatgatagacttc

SEQ ID NO: 216288 - DNA, 22 bp, Homo sapiens
tcaactgtctcctacctctgct

SEQ ID NO: 216289 - DNA, 16 bp, Homo sapiens
tcaacttctggctcct

SEQ ID NO: 216290 - DNA, 20 bp, Homo sapiens
tcaacttgagcatgttactg

SEQ ID NO: 216291 - DNA, 16 bp, Homo sapiens
tcaactttcatttgaa

SEQ ID NO: 216292 - DNA, 14 bp, Homo sapiens
tcaacttttgaaat

SEQ ID NO: 216293 - DNA, 17 bp, Homo sapiens
tcaagaaaacaacttca

SEQ ID NO: 216294 - DNA, 16 bp, Homo sapiens
tcaagaaaacagcaag

SEQ ID NO: 216295 - DNA, 21 bp, Homo sapiens
tcaagaaagatatctatgact

SEQ ID NO: 216296 - DNA, 15 bp, Homo sapiens
tcaagaaattttcaa

SEQ ID NO: 216297 - DNA, 13 bp, Homo sapiens
tcacaatacagat

SEQ ID NO: 216298 - DNA, 14 bp, Homo sapiens
tcacaatacagata

SEQ ID NO: 216299 - DNA, 18 bp, Homo sapiens
tcacaatagacagaaaca

SEQ ID NO: 216300 - DNA, 17 bp, Homo sapiens
tcacaatgtactatatg

SEQ ID NO: 216301 - DNA, 13 bp, Homo sapiens
tcacacacacagc

SEQ ID NO: 216302 - DNA, 15 bp, Homo sapiens
tcacacacacagctg

SEQ ID NO: 216303 - DNA, 19 bp, Homo sapiens
tcacacacacagctgggca

SEQ ID NO: 216304 - DNA, 13 bp, Homo sapiens
tcacacacagcct

SEQ ID NO: 216305 - DNA, 19 bp, Homo sapiens
tcacacacagcctggcctc

SEQ ID NO: 216306 - DNA, 24 bp, Homo sapiens
tcacacagcacctcctctctgctg

SEQ ID NO: 216307 - DNA, 20 bp, Homo sapiens
tcacacagctaacaagtagc

SEQ ID NO: 216308 - DNA, 21 bp, Homo sapiens
tcacacagtagctccaacact

SEQ ID NO: 216309 - DNA, 18 bp, Homo sapiens
tcacacagtggcactagc

SEQ ID NO: 216310 - DNA, 21 bp, Homo sapiens
tcacacagtggcactagcatt

SEQ ID NO: 216311 - DNA, 16 bp, Homo sapiens
tcacacattatagaaa

SEQ ID NO: 216312 - DNA, 19 bp, Homo sapiens
tcacacattatagaaatta

SEQ ID NO: 216313 - DNA, 21 bp, Homo sapiens
tcacaccagtcacacattata

SEQ ID NO: 216314 - DNA, 12 bp, Homo sapiens
tcacaccctgca

SEQ ID NO: 216315 - DNA, 17 bp, Homo sapiens
tcacaccctgcaaggcc

SEQ ID NO: 216316 - DNA, 21 bp, Homo sapiens
tcacaccctgcaaggcccaca

SEQ ID NO: 216317 - DNA, 22 bp, Homo sapiens
tcacacctctgggcttcagggt

SEQ ID NO: 216318 - DNA, 18 bp, Homo sapiens
tcacactctcttcttact

SEQ ID NO: 216319 - DNA, 14 bp, Homo sapiens
tcacactctgtgtt

SEQ ID NO: 216320 - DNA, 19 bp, Homo sapiens
tcacactgctgggaagtgg

SEQ ID NO: 216321 - DNA, 21 bp, Homo sapiens
tcacactgtgcgttttagagt

SEQ ID NO: 216322 - DNA, 16 bp, Homo sapiens
tcacacttctgtgaga

SEQ ID NO: 216323 - DNA, 14 bp, Homo sapiens
tcacagaaatcaga

SEQ ID NO: 216324 - DNA, 14 bp, Homo sapiens
tcacagactggaga

SEQ ID NO: 216325 - DNA, 16 bp, Homo sapiens
tcacagactggagaca

SEQ ID NO: 216326 - DNA, 12 bp, Homo sapiens
tcacagaggcag

SEQ ID NO: 216327 - DNA, 16 bp, Homo sapiens
tcacagaggcagtggc

SEQ ID NO: 216328 - DNA, 18 bp, Homo sapiens
tcacagaggcagtggcag

SEQ ID NO: 216329 - DNA, 22 bp, Homo sapiens
tcacagatgggtattaaacttg

SEQ ID NO: 216330 - DNA, 17 bp, Homo sapiens
tcacagatgtgcccaga

SEQ ID NO: 216331 - DNA, 17 bp, Homo sapiens
tcacagcacatgctggc

SEQ ID NO: 216332 - DNA, 20 bp, Homo sapiens
tcacagcacatgctggccag

SEQ ID NO: 216333 - DNA, 21 bp, Homo sapiens
tcacagcacatgctggccagc

SEQ ID NO: 216334 - DNA, 17 bp, Homo sapiens
tcacagcagtacttgct

SEQ ID NO: 216335 - DNA, 11 bp, Homo sapiens
tcacagccagc

SEQ ID NO: 216336 - DNA, 14 bp, Homo sapiens
tcacagccatttca

SEQ ID NO: 216337 - DNA, 15 bp, Homo sapiens
tcacagccatttcaa

SEQ ID NO: 216338 - DNA, 16 bp, Homo sapiens
tcacagccgtttgaat

SEQ ID NO: 216339 - DNA, 20 bp, Homo sapiens
tcacagcctaggaccagttt

SEQ ID NO: 216340 - DNA, 13 bp, Homo sapiens
tcacagcctctcc

SEQ ID NO: 216341 - DNA, 16 bp, Homo sapiens
tcacagctcttgtttg

SEQ ID NO: 216342 - DNA, 11 bp, Homo sapiens
tcacagctgca

SEQ ID NO: 216343 - DNA, 16 bp, Homo sapiens
tcacagctgcagctgg

SEQ ID NO: 216344 - DNA, 16 bp, Homo sapiens
tcacagctttcccagg

SEQ ID NO: 216345 - DNA, 18 bp, Homo sapiens
tcacaggactctgcctcc

SEQ ID NO: 216346 - DNA, 19 bp, Homo sapiens
tcacaggactctgcctcct

SEQ ID NO: 216347 - DNA, 23 bp, Homo sapiens
tcacaggactctgcctcctcttc

SEQ ID NO: 216348 - DNA, 13 bp, Homo sapiens
tcacaggcagtgc

SEQ ID NO: 216349 - DNA, 19 bp, Homo sapiens
tcacaggcagtgcatgtga

SEQ ID NO: 216350 - DNA, 20 bp, Homo sapiens
tcacaggcagtgcatgtgaa

SEQ ID NO: 216351 - DNA, 19 bp, Homo sapiens
tcacaggggcggggcagga

SEQ ID NO: 216352 - DNA, 14 bp, Homo sapiens
tcacagggttgggc

SEQ ID NO: 216353 - DNA, 23 bp, Homo sapiens
tcacagggttgggcccagatctg

SEQ ID NO: 216354 - DNA, 21 bp, Homo sapiens
tcacagtgaacataactgtaa

SEQ ID NO: 216355 - DNA, 20 bp, Homo sapiens
tcacagttctctccttcttc

SEQ ID NO: 216356 - DNA, 22 bp, Homo sapiens
tcacagttgccatgtagacccc

SEQ ID NO: 216357 - DNA, 17 bp, Homo sapiens
tcacatagatgtccctt

SEQ ID NO: 216358 - DNA, 14 bp, Homo sapiens
tcacatagctggga

SEQ ID NO: 216359 - DNA, 21 bp, Homo sapiens
tcacatatcaagtcccgaggc

SEQ ID NO: 216360 - DNA, 16 bp, Homo sapiens
tcacatatgtcttact

SEQ ID NO: 216361 - DNA, 17 bp, Homo sapiens
tcacatcagataagaca

SEQ ID NO: 216362 - DNA, 21 bp, Homo sapiens
tcacatgcccgctgtcccagg

SEQ ID NO: 216363 - DNA, 22 bp, Homo sapiens
tcacatgcccgctgtcccaggg

SEQ ID NO: 216364 - DNA, 14 bp, Homo sapiens
tcacatgctggaca

SEQ ID NO: 216365 - DNA, 23 bp, Homo sapiens
tcacatgctggacaggtctggga

SEQ ID NO: 216366 - DNA, 16 bp, Homo sapiens
tcacattatttgcatg

SEQ ID NO: 216367 - DNA, 13 bp, Homo sapiens
tcacattccctct

SEQ ID NO: 216368 - DNA, 14 bp, Homo sapiens
tcacattccctctc

SEQ ID NO: 216369 - DNA, 17 bp, Homo sapiens
tcacattccctctcatc

SEQ ID NO: 216370 - DNA, 19 bp, Homo sapiens
tcacatttccagggcagca

SEQ ID NO: 216371 - DNA, 18 bp, Homo sapiens
tcacatttgtaaatgtct

SEQ ID NO: 216372 - DNA, 17 bp, Homo sapiens
tcacattttgcctttct

SEQ ID NO: 216373 - DNA, 18 bp, Homo sapiens
tcaccaaacaacttggtt

SEQ ID NO: 216374 - DNA, 22 bp, Homo sapiens
tcaccaacaacagtcagccagc

SEQ ID NO: 216375 - DNA, 23 bp, Homo sapiens
tcaccaacaacagtcagccagct

SEQ ID NO: 216376 - DNA, 17 bp, Homo sapiens
tcaccaataacttcaga

SEQ ID NO: 216377 - DNA, 21 bp, Homo sapiens
tcaccacaagccaccttttgt

SEQ ID NO: 216378 - DNA, 22 bp, Homo sapiens
tcaccaccccagtgaggacctc

SEQ ID NO: 216379 - DNA, 18 bp, Homo sapiens
tcaccaccccctgtccca

SEQ ID NO: 216380 - DNA, 20 bp, Homo sapiens
tcaccagaattagtcctcac

SEQ ID NO: 216381 - DNA, 23 bp, Homo sapiens
tcaccagaattagtcctcacagc

SEQ ID NO: 216382 - DNA, 19 bp, Homo sapiens
tcaccagcccggcctgctc

SEQ ID NO: 216383 - DNA, 15 bp, Homo sapiens
tcaccagctcagccc

SEQ ID NO: 216384 - DNA, 23 bp, Homo sapiens
tcaccaggaagaaggcccgggag

SEQ ID NO: 216385 - DNA, 17 bp, Homo sapiens
tcaccaggacttggggt

SEQ ID NO: 216386 - DNA, 20 bp, Homo sapiens
tcaccaggacttggggtcag

SEQ ID NO: 216387 - DNA, 21 bp, Homo sapiens
tcaccagggtccgcaccagct

SEQ ID NO: 216388 - DNA, 23 bp, Homo sapiens
tcaccagggtccgcaccagctgc

SEQ ID NO: 216389 - DNA, 14 bp, Homo sapiens
tcaccagttaaaag

SEQ ID NO: 216390 - DNA, 20 bp, Homo sapiens
tcaccagttaaaagcatttt

SEQ ID NO: 216391 - DNA, 14 bp, Homo sapiens
tcaccatctcaggc

SEQ ID NO: 216392 - DNA, 15 bp, Homo sapiens
tcaccatctcaggcc

SEQ ID NO: 216393 - DNA, 21 bp, Homo sapiens
tcaccatctcaggccacctgc

SEQ ID NO: 216394 - DNA, 23 bp, Homo sapiens
tcaccatctcaggccacctgccc

SEQ ID NO: 216395 - DNA, 16 bp, Homo sapiens
tcaccatctttctaat

SEQ ID NO: 216396 - DNA, 21 bp, Homo sapiens
tcaccatgttggccaggctgg

SEQ ID NO: 216397 - DNA, 21 bp, Homo sapiens
tcaccatttaatcatttccag

SEQ ID NO: 216398 - DNA, 23 bp, Homo sapiens
tcaccatttaatcatttccagca

SEQ ID NO: 216399 - DNA, 12 bp, Homo sapiens
tcaccatttcat

SEQ ID NO: 216400 - DNA, 15 bp, Homo sapiens
tcacccacgcatata

SEQ ID NO: 216401 - DNA, 14 bp, Homo sapiens
tcacccagcaaggc

SEQ ID NO: 216402 - DNA, 16 bp, Homo sapiens
tcacccattgtctcat

SEQ ID NO: 216403 - DNA, 18 bp, Homo sapiens
tcacccattgtctcattg

SEQ ID NO: 216404 - DNA, 16 bp, Homo sapiens
tcaccccagtgcctgt

SEQ ID NO: 216405 - DNA, 19 bp, Homo sapiens
tcaccccatcccacaccct

SEQ ID NO: 216406 - DNA, 13 bp, Homo sapiens
gagcccttagcct

SEQ ID NO: 216407 - DNA, 22 bp, Homo sapiens
gagcccttagccttgctgtaga

SEQ ID NO: 216408 - DNA, 15 bp, Homo sapiens
gagcccttcactgcc

SEQ ID NO: 216409 - DNA, 16 bp, Homo sapiens
gagcccttcactgcca

SEQ ID NO: 216410 - DNA, 20 bp, Homo sapiens
gagcccttgcacaggccact

SEQ ID NO: 216411 - DNA, 21 bp, Homo sapiens
gagccgagctctcctgggcca

SEQ ID NO: 216412 - DNA, 21 bp, Homo sapiens
gagccgccccgtgtcccccca

SEQ ID NO: 216413 - DNA, 13 bp, Homo sapiens
gagccgggcctgg

SEQ ID NO: 216414 - DNA, 14 bp, Homo sapiens
gagccgggcctggg

SEQ ID NO: 216415 - DNA, 23 bp, Homo sapiens
gagccgttcctgggactgtcaga

SEQ ID NO: 216416 - DNA, 16 bp, Homo sapiens
gagcctaatgaaaggg

SEQ ID NO: 216417 - DNA, 20 bp, Homo sapiens
gagcctactgtctccttccc

SEQ ID NO: 216418 - DNA, 22 bp, Homo sapiens
gagcctactgtctccttcccac

SEQ ID NO: 216419 - DNA, 12 bp, Homo sapiens
gagcctccccca

SEQ ID NO: 216420 - DNA, 22 bp, Homo sapiens
gagcctcctctctcaaactggg

SEQ ID NO: 216421 - DNA, 14 bp, Homo sapiens
gagcctcgcccctc

SEQ ID NO: 216422 - DNA, 13 bp, Homo sapiens
gagcctctccttg

SEQ ID NO: 216423 - DNA, 12 bp, Homo sapiens
gagcctcttagt

SEQ ID NO: 216424 - DNA, 16 bp, Homo sapiens
gagcctgagtcagggc

SEQ ID NO: 216425 - DNA, 21 bp, Homo sapiens
gagcctgccccagctgggctg

SEQ ID NO: 216426 - DNA, 22 bp, Homo sapiens
tcacttaagcccaggagtctga

SEQ ID NO: 216427 - DNA, 11 bp, Homo sapiens
tcacttaaggg

SEQ ID NO: 216428 - DNA, 13 bp, Homo sapiens
tcacttataccaa

SEQ ID NO: 216429 - DNA, 19 bp, Homo sapiens
tcacttcctagagcatctg

SEQ ID NO: 216430 - DNA, 23 bp, Homo sapiens
tcacttcctagagcatctgtccc

SEQ ID NO: 216431 - DNA, 20 bp, Homo sapiens
tcacttcctcgctctcctaa

SEQ ID NO: 216432 - DNA, 23 bp, Homo sapiens
tcacttcgcgtgccctcgctgct

SEQ ID NO: 216433 - DNA, 13 bp, Homo sapiens
tcacttgaatgtg

SEQ ID NO: 216434 - DNA, 14 bp, Homo sapiens
tcacttgagcccag

SEQ ID NO: 216435 - DNA, 15 bp, Homo sapiens
tcacttgagcccagg

SEQ ID NO: 216436 - DNA, 22 bp, Homo sapiens
tcacttgaggccagtgagctgt

SEQ ID NO: 216437 - DNA, 13 bp, Homo sapiens
tcacttgtgtttg

SEQ ID NO: 216438 - DNA, 20 bp, Homo sapiens
tcacttgtgtttgtatataa

SEQ ID NO: 216439 - DNA, 16 bp, Homo sapiens
tcactttaataataaa

SEQ ID NO: 216440 - DNA, 14 bp, Homo sapiens
tcactttgctctga

SEQ ID NO: 216441 - DNA, 17 bp, Homo sapiens
tcactttgctctgggtg

SEQ ID NO: 216442 - DNA, 15 bp, Homo sapiens
tcactttggtctcca

SEQ ID NO: 216443 - DNA, 17 bp, Homo sapiens
tcactttggttggaact

SEQ ID NO: 216444 - DNA, 14 bp, Homo sapiens
tcactttgtattct

SEQ ID NO: 216445 - DNA, 20 bp, Homo sapiens
tcactttgtattctctgtcc

SEQ ID NO: 216446 - DNA, 22 bp, Homo sapiens
tcactttgtattctctgtccag

SEQ ID NO: 216447 - DNA, 15 bp, Homo sapiens
tcacttttcacttgt

SEQ ID NO: 216448 - DNA, 17 bp, Homo sapiens
tcacttttttcctgtca

SEQ ID NO: 216449 - DNA, 22 bp, Homo sapiens
tcacttttttcctgtcaatata

SEQ ID NO: 216450 - DNA, 16 bp, Homo sapiens
tcagaaaacagaaaaa

SEQ ID NO: 216451 - DNA, 20 bp, Homo sapiens
tcagaaaacagaaaaaaaac

SEQ ID NO: 216452 - DNA, 24 bp, Homo sapiens
tcagaaacaaagcatttgactttc

SEQ ID NO: 216453 - DNA, 13 bp, Homo sapiens
tcagaaaccagtt

SEQ ID NO: 216454 - DNA, 22 bp, Homo sapiens
tcagaaaccagttatgtgaatg

SEQ ID NO: 216455 - DNA, 18 bp, Homo sapiens
tcagaaacttgtgaagtg

SEQ ID NO: 216456 - DNA, 19 bp, Homo sapiens
tcagaaagggcagcccctc

SEQ ID NO: 216457 - DNA, 20 bp, Homo sapiens
tcagaaagtcaccaggactt

SEQ ID NO: 216458 - DNA, 23 bp, Homo sapiens
tcagaaagtgtgctttatgctga

SEQ ID NO: 216459 - DNA, 14 bp, Homo sapiens
tcagaaatgctgcc

SEQ ID NO: 216460 - DNA, 15 bp, Homo sapiens
tcagaaatgctgcct

SEQ ID NO: 216461 - DNA, 17 bp, Homo sapiens
tcagaaatgctgcctgc

SEQ ID NO: 216462 - DNA, 17 bp, Homo sapiens
tcagaaatttttatcag

SEQ ID NO: 216463 - DNA, 22 bp, Homo sapiens
tcagaaatttttatcagtttcc

SEQ ID NO: 216464 - DNA, 18 bp, Homo sapiens
tcagaacctcttccccag

SEQ ID NO: 216465 - DNA, 15 bp, Homo sapiens
tcagaactctcagac

SEQ ID NO: 216466 - DNA, 22 bp, Homo sapiens
tcagaactctcagactctaaac

SEQ ID NO: 216467 - DNA, 14 bp, Homo sapiens
tcagaagataactt

SEQ ID NO: 216468 - DNA, 21 bp, Homo sapiens
tcagaagccccatttgcacag

SEQ ID NO: 216469 - DNA, 22 bp, Homo sapiens
tcagaagcctccaagcctgcct

SEQ ID NO: 216470 - DNA, 17 bp, Homo sapiens
tcagaatattaataaaa

SEQ ID NO: 216471 - DNA, 22 bp, Homo sapiens
tcagaattatacagacctaata

SEQ ID NO: 216472 - DNA, 17 bp, Homo sapiens
tcagaattgtttttaga

SEQ ID NO: 216473 - DNA, 21 bp, Homo sapiens
tcagacatccatgtttgtaaa

SEQ ID NO: 216474 - DNA, 22 bp, Homo sapiens
tcagacatccatgtttgtaaaa

SEQ ID NO: 216475 - DNA, 15 bp, Homo sapiens
tcagacattccaagg

SEQ ID NO: 216476 - DNA, 18 bp, Homo sapiens
tcagaccagtactgggaa

SEQ ID NO: 216477 - DNA, 23 bp, Homo sapiens
tcagaccataatgttacattatt

SEQ ID NO: 216478 - DNA, 15 bp, Homo sapiens
tcagaccccagttct

SEQ ID NO: 216479 - DNA, 22 bp, Homo sapiens
tcagaccccagttctaggggag

SEQ ID NO: 216480 - DNA, 14 bp, Homo sapiens
tcagacccctgcct

SEQ ID NO: 216481 - DNA, 12 bp, Homo sapiens
tcagacctctga

SEQ ID NO: 216482 - DNA, 13 bp, Homo sapiens
tcagacctctgat

SEQ ID NO: 216483 - DNA, 23 bp, Homo sapiens
tcagacctgtcttccaaggagac

SEQ ID NO: 216484 - DNA, 23 bp, Homo sapiens
tcagacgagacaccctaactctt

SEQ ID NO: 216485 - DNA, 16 bp, Homo sapiens
tcagactctctcctct

SEQ ID NO: 216486 - DNA, 20 bp, Homo sapiens
tcagactctttagttgattt

SEQ ID NO: 216487 - DNA, 17 bp, Homo sapiens
tcagactttaaagaata

SEQ ID NO: 216488 - DNA, 23 bp, Homo sapiens
tcagactttaaagaataatatgc

SEQ ID NO: 216489 - DNA, 13 bp, Homo sapiens
tcagagaagtcag

SEQ ID NO: 216490 - DNA, 21 bp, Homo sapiens
tcagagacagcgcgagtagca

SEQ ID NO: 216491 - DNA, 18 bp, Homo sapiens
tcagagaccgtgagcgcc

SEQ ID NO: 216492 - DNA, 15 bp, Homo sapiens
tcagagactcccagg

SEQ ID NO: 216493 - DNA, 19 bp, Homo sapiens
tcagagagaatggctttgg

SEQ ID NO: 216494 - DNA, 14 bp, Homo sapiens
tcagagagctggta

SEQ ID NO: 216495 - DNA, 16 bp, Homo sapiens
tcagagagtgtacatc

SEQ ID NO: 216496 - DNA, 22 bp, Homo sapiens
tcagagatggtaatctacagct

SEQ ID NO: 216497 - DNA, 19 bp, Homo sapiens
tcagagatttatataaatg

SEQ ID NO: 216498 - DNA, 14 bp, Homo sapiens
tcagagcagcctct

SEQ ID NO: 216499 - DNA, 21 bp, Homo sapiens
tcagagcagtgattctctctt

SEQ ID NO: 216500 - DNA, 17 bp, Homo sapiens
tcagagcatgtgtcaga

SEQ ID NO: 216501 - DNA, 13 bp, Homo sapiens
tcagagccaagtc

SEQ ID NO: 216502 - DNA, 18 bp, Homo sapiens
tcagagccaagtcctccc

SEQ ID NO: 216503 - DNA, 21 bp, Homo sapiens
tcagagccacccctaaagaga

SEQ ID NO: 216504 - DNA, 15 bp, Homo sapiens
tcagagccagtgaag

SEQ ID NO: 216505 - DNA, 12 bp, Homo sapiens
tcagagccctgc

SEQ ID NO: 216506 - DNA, 20 bp, Homo sapiens
tcagagccctggctgggttc

SEQ ID NO: 216507 - DNA, 19 bp, Homo sapiens
tcagagctcttcaagctgt

SEQ ID NO: 216508 - DNA, 22 bp, Homo sapiens
tcagagctcttcaagctgtccc

SEQ ID NO: 216509 - DNA, 15 bp, Homo sapiens
tcagagctgggaggg

SEQ ID NO: 216510 - DNA, 20 bp, Homo sapiens
tcagagcttgattagaagcc

SEQ ID NO: 216511 - DNA, 21 bp, Homo sapiens
tcagaggagtgattgaaccag

SEQ ID NO: 216512 - DNA, 19 bp, Homo sapiens
tcagagggactgtcagctg

SEQ ID NO: 216513 - DNA, 14 bp, Homo sapiens
tcagagggaggaat

SEQ ID NO: 216514 - DNA, 17 bp, Homo sapiens
tcagaggttctttgagg

SEQ ID NO: 216515 - DNA, 19 bp, Homo sapiens
tcagagtaagctgcttttg

SEQ ID NO: 216516 - DNA, 14 bp, Homo sapiens
tcagagtccaggcc

SEQ ID NO: 216517 - DNA, 17 bp, Homo sapiens
tcagagtccaggcccca

SEQ ID NO: 216518 - DNA, 20 bp, Homo sapiens
tcagagtctggcctgccagg

SEQ ID NO: 216519 - DNA, 13 bp, Homo sapiens
tcagatatttata

SEQ ID NO: 216520 - DNA, 21 bp, Homo sapiens
tcagatatttatatttttatt

SEQ ID NO: 216521 - DNA, 22 bp, Homo sapiens
tcagatccctcggtcagcaccg

SEQ ID NO: 216522 - DNA, 14 bp, Homo sapiens
tcagatcctacccc

SEQ ID NO: 216523 - DNA, 20 bp, Homo sapiens
tcagatcctgctgccgcgtg

SEQ ID NO: 216524 - DNA, 17 bp, Homo sapiens
tcagatgaaaataaaat

SEQ ID NO: 216525 - DNA, 14 bp, Homo sapiens
tcagatgagcaagg

SEQ ID NO: 216526 - DNA, 17 bp, Homo sapiens
tcagatgtcttctgcct

SEQ ID NO: 216527 - DNA, 21 bp, Homo sapiens
tcagatgtcttctgcctgtta

SEQ ID NO: 216528 - DNA, 14 bp, Homo sapiens
tcagattgcttttg

SEQ ID NO: 216529 - DNA, 18 bp, Homo sapiens
tcagattggacataactg

SEQ ID NO: 216530 - DNA, 16 bp, Homo sapiens
tcagattgtaaaggta

SEQ ID NO: 216531 - DNA, 22 bp, Homo sapiens
tcagattgtaaaggtaggtgca

SEQ ID NO: 216532 - DNA, 23 bp, Homo sapiens
tcagatttaccataatgttcctt

SEQ ID NO: 216533 - DNA, 21 bp, Homo sapiens
tcagatttgaactcttcaatc

SEQ ID NO: 216534 - DNA, 18 bp, Homo sapiens
tcagcaaccctacagtat

SEQ ID NO: 216535 - DNA, 19 bp, Homo sapiens
tcagcaactgttagctggg

SEQ ID NO: 216536 - DNA, 23 bp, Homo sapiens
tcagcaaggtgagagaggtaccc

SEQ ID NO: 216537 - DNA, 18 bp, Homo sapiens
tcagcaatagggtgcagt

SEQ ID NO: 216538 - DNA, 22 bp, Homo sapiens
tcagcacagcctcacccctgca

SEQ ID NO: 216539 - DNA, 18 bp, Homo sapiens
tcagcacatgcactactg

SEQ ID NO: 216540 - DNA, 23 bp, Homo sapiens
tcagcaccaccctagtcccttcc

SEQ ID NO: 216541 - DNA, 13 bp, Homo sapiens
tcagcacccccac

SEQ ID NO: 216542 - DNA, 23 bp, Homo sapiens
tcagcaccgtggtgtgaggcccc

SEQ ID NO: 216543 - DNA, 18 bp, Homo sapiens
tcagcagaaacccccagg

SEQ ID NO: 216544 - DNA, 20 bp, Homo sapiens
tcagcagaaacccccaggag

SEQ ID NO: 216545 - DNA, 15 bp, Homo sapiens
tcagcagagccgccc

SEQ ID NO: 216546 - DNA, 17 bp, Homo sapiens
tcagcagttgacatcca

SEQ ID NO: 216547 - DNA, 23 bp, Homo sapiens
tcagcatcaaacatgaaaacatt

SEQ ID NO: 216548 - DNA, 18 bp, Homo sapiens
tcagcatcctcagttcct

SEQ ID NO: 216549 - DNA, 20 bp, Homo sapiens
tcagcatgaaaatgtgtgtt

SEQ ID NO: 216550 - DNA, 13 bp, Homo sapiens
gaggcctgatgct

SEQ ID NO: 216551 - DNA, 14 bp, Homo sapiens
gaggcctgatgctg

SEQ ID NO: 216552 - DNA, 14 bp, Homo sapiens
gaggcctgggaggg

SEQ ID NO: 216553 - DNA, 21 bp, Homo sapiens
gaggccttcagaaaagacact

SEQ ID NO: 216554 - DNA, 13 bp, Homo sapiens
gaggcgaggctgc

SEQ ID NO: 216555 - DNA, 22 bp, Homo sapiens
gatacagatccgcatgtgtctg

SEQ ID NO: 216556 - DNA, 21 bp, Homo sapiens
gatacagtattatagatataa

SEQ ID NO: 216557 - DNA, 18 bp, Homo sapiens
gatacatatgagtgtgga

SEQ ID NO: 216558 - DNA, 16 bp, Homo sapiens
gatacatttatcttct

SEQ ID NO: 216559 - DNA, 18 bp, Homo sapiens
gatacatttatcttctgt

SEQ ID NO: 216560 - DNA, 19 bp, Homo sapiens
gatacatttatcttctgtt

SEQ ID NO: 216561 - DNA, 22 bp, Homo sapiens
gatacatttatcttctgttttt

SEQ ID NO: 216562 - DNA, 23 bp, Homo sapiens
gatacatttatcttctgtttttc

SEQ ID NO: 216563 - DNA, 21 bp, Homo sapiens
gatacccagagagaaaaagag

SEQ ID NO: 216564 - DNA, 19 bp, Homo sapiens
gatactaatagagtactta

SEQ ID NO: 216565 - DNA, 20 bp, Homo sapiens
gatactgggtacaagagcca

SEQ ID NO: 216566 - DNA, 17 bp, Homo sapiens
gatacttgatgcactta

SEQ ID NO: 216567 - DNA, 13 bp, Homo sapiens
gatactttacatg

SEQ ID NO: 216568 - DNA, 17 bp, Homo sapiens
gatagagattcccctgg

SEQ ID NO: 216569 - DNA, 20 bp, Homo sapiens
tcataggttgccaataatac

SEQ ID NO: 216570 - DNA, 18 bp, Homo sapiens
tcatagtcaatcaaacag

SEQ ID NO: 216571 - DNA, 14 bp, Homo sapiens
tcatagtgcctttt

SEQ ID NO: 216572 - DNA, 15 bp, Homo sapiens
tcatagtgccttttt

SEQ ID NO: 216573 - DNA, 14 bp, Homo sapiens
tcatagttctgtta

SEQ ID NO: 216574 - DNA, 22 bp, Homo sapiens
tcatatatggggggccaacacc

SEQ ID NO: 216575 - DNA, 15 bp, Homo sapiens
tcatatccagctgag

SEQ ID NO: 216576 - DNA, 12 bp, Homo sapiens
tcatatctgtat

SEQ ID NO: 216577 - DNA, 19 bp, Homo sapiens
tcatatgaattagccaaaa

SEQ ID NO: 216578 - DNA, 21 bp, Homo sapiens
tcatatgagtatctttaaata

SEQ ID NO: 216579 - DNA, 18 bp, Homo sapiens
tcatatggcccagtgtca

SEQ ID NO: 216580 - DNA, 19 bp, Homo sapiens
tcatatgtgaagacagagc

SEQ ID NO: 216581 - DNA, 14 bp, Homo sapiens
tcatatgttgctca

SEQ ID NO: 216582 - DNA, 19 bp, Homo sapiens
tcatatgttgctcagtctc

SEQ ID NO: 216583 - DNA, 20 bp, Homo sapiens
tcatatgttgctcagtctcc

SEQ ID NO: 216584 - DNA, 13 bp, Homo sapiens
tcatattcctgcc

SEQ ID NO: 216585 - DNA, 16 bp, Homo sapiens
tcatattgatgaaaag

SEQ ID NO: 216586 - DNA, 21 bp, Homo sapiens
tcatattgatgaaaagattta

SEQ ID NO: 216587 - DNA, 21 bp, Homo sapiens
tcatatttacttcttatacat

SEQ ID NO: 216588 - DNA, 17 bp, Homo sapiens
tcatatttgcaataaaa

SEQ ID NO: 216589 - DNA, 15 bp, Homo sapiens
tcatattttgtatat

SEQ ID NO: 216590 - DNA, 23 bp, Homo sapiens
tcatattttgtatatatctgctt

SEQ ID NO: 216591 - DNA, 20 bp, Homo sapiens
tcatcaagtagcgttggaga

SEQ ID NO: 216592 - DNA, 23 bp, Homo sapiens
tcatcaatacttttgtgtattct

SEQ ID NO: 216593 - DNA, 21 bp, Homo sapiens
tcatcaatccaggatgttatt

SEQ ID NO: 216594 - DNA, 14 bp, Homo sapiens
tcatcaatttaaaa

SEQ ID NO: 216595 - DNA, 14 bp, Homo sapiens
tcatcactccctgg

SEQ ID NO: 216596 - DNA, 22 bp, Homo sapiens
tcatcactggatgaagattctc

SEQ ID NO: 216597 - DNA, 20 bp, Homo sapiens
tcatcagatggaaatatttt

SEQ ID NO: 216598 - DNA, 22 bp, Homo sapiens
tcatcagatggaaatattttga

SEQ ID NO: 216599 - DNA, 14 bp, Homo sapiens
tcatcaggatgaac

SEQ ID NO: 216600 - DNA, 22 bp, Homo sapiens
tcatcaggatgaacccaggacg

SEQ ID NO: 216601 - DNA, 19 bp, Homo sapiens
tcatcagtattgtgtaaag

SEQ ID NO: 216602 - DNA, 20 bp, Homo sapiens
tcatcatctttttgtgtgca

SEQ ID NO: 216603 - DNA, 14 bp, Homo sapiens
tcatccaacctctt

SEQ ID NO: 216604 - DNA, 18 bp, Homo sapiens
tcatccaatcctcactgg

SEQ ID NO: 216605 - DNA, 18 bp, Homo sapiens
tcatccaggtcctttcct

SEQ ID NO: 216606 - DNA, 19 bp, Homo sapiens
tcatccaggtcctttcctt

SEQ ID NO: 216607 - DNA, 16 bp, Homo sapiens
tcatccatagacacag

SEQ ID NO: 216608 - DNA, 20 bp, Homo sapiens
tcatcccaacagccaagacc

SEQ ID NO: 216609 - DNA, 18 bp, Homo sapiens
tcatcccacgcactccat

SEQ ID NO: 216610 - DNA, 14 bp, Homo sapiens
tcatcccagcacct

SEQ ID NO: 216611 - DNA, 17 bp, Homo sapiens
tcatcccagcacctgcc

SEQ ID NO: 216612 - DNA, 19 bp, Homo sapiens
tcatcccagcacctgccag

SEQ ID NO: 216613 - DNA, 12 bp, Homo sapiens
tcatccccaggg

SEQ ID NO: 216614 - DNA, 20 bp, Homo sapiens
tcatccccaggggtcccagc

SEQ ID NO: 216615 - DNA, 16 bp, Homo sapiens
tcatcccggggccatg

SEQ ID NO: 216616 - DNA, 12 bp, Homo sapiens
tcatcctgcttc

SEQ ID NO: 216617 - DNA, 16 bp, Homo sapiens
tcatcctggcctcctt

SEQ ID NO: 216618 - DNA, 12 bp, Homo sapiens
tcatcctgtgtc

SEQ ID NO: 216619 - DNA, 13 bp, Homo sapiens
tcatcctgtgtcc

SEQ ID NO: 216620 - DNA, 17 bp, Homo sapiens
tcatcctgttggctgct

SEQ ID NO: 216621 - DNA, 21 bp, Homo sapiens
tcatccttttttctcttctgt

SEQ ID NO: 216622 - DNA, 22 bp, Homo sapiens
tcatctaccattttctggttct

SEQ ID NO: 216623 - DNA, 20 bp, Homo sapiens
tcatctagttaagtcgctga

SEQ ID NO: 216624 - DNA, 17 bp, Homo sapiens
tcatctataaaatgagg

SEQ ID NO: 216625 - DNA, 16 bp, Homo sapiens
tcatctcagtcctcaa

SEQ ID NO: 216626 - DNA, 22 bp, Homo sapiens
tcatctccaaggatcctctcca

SEQ ID NO: 216627 - DNA, 13 bp, Homo sapiens
tcatctctgcctt

SEQ ID NO: 216628 - DNA, 14 bp, Homo sapiens
tcatctctgccttt

SEQ ID NO: 216629 - DNA, 15 bp, Homo sapiens
tcatctctgcctttg

SEQ ID NO: 216630 - DNA, 16 bp, Homo sapiens
tcatctctgcctttga

SEQ ID NO: 216631 - DNA, 17 bp, Homo sapiens
tcatctctgcctttgag

SEQ ID NO: 216632 - DNA, 18 bp, Homo sapiens
tcatctgaggagtccaaa

SEQ ID NO: 216633 - DNA, 18 bp, Homo sapiens
tcatctgggctggcagag

SEQ ID NO: 216634 - DNA, 13 bp, Homo sapiens
tcatctgtagata

SEQ ID NO: 216635 - DNA, 18 bp, Homo sapiens
tcatcttctctttttcca

SEQ ID NO: 216636 - DNA, 19 bp, Homo sapiens
tcatcttgaattgtaagga

SEQ ID NO: 216637 - DNA, 16 bp, Homo sapiens
tcatctttcctttgct

SEQ ID NO: 216638 - DNA, 19 bp, Homo sapiens
tcatcttttagagtaaact

SEQ ID NO: 216639 - DNA, 16 bp, Homo sapiens
tcatgaaaatcctacc

SEQ ID NO: 216640 - DNA, 13 bp, Homo sapiens
tcatgaagccttg

SEQ ID NO: 216641 - DNA, 14 bp, Homo sapiens
tcatgaagccttgc

SEQ ID NO: 216642 - DNA, 18 bp, Homo sapiens
tcatgaagccttgctgaa

SEQ ID NO: 216643 - DNA, 20 bp, Homo sapiens
tcatgaagctcagtttggct

SEQ ID NO: 216644 - DNA, 22 bp, Homo sapiens
tcatgaattagaagaaaatgga

SEQ ID NO: 216645 - DNA, 14 bp, Homo sapiens
tcatgaattttaca

SEQ ID NO: 216646 - DNA, 16 bp, Homo sapiens
tcatgaattttacatg

SEQ ID NO: 216647 - DNA, 23 bp, Homo sapiens
tcatgacaaagttacaaattcaa

SEQ ID NO: 216648 - DNA, 15 bp, Homo sapiens
tcatgacatttctca

SEQ ID NO: 216649 - DNA, 18 bp, Homo sapiens
tcatgaccactgggcctg

SEQ ID NO: 216650 - DNA, 19 bp, Homo sapiens
tcatgaccactgggcctgc

SEQ ID NO: 216651 - DNA, 19 bp, Homo sapiens
tcatgactgagtctggcaa

SEQ ID NO: 216652 - DNA, 21 bp, Homo sapiens
tcatgatccacccacctcagc

SEQ ID NO: 216653 - DNA, 14 bp, Homo sapiens
tcatgatgtctgca

SEQ ID NO: 216654 - DNA, 17 bp, Homo sapiens
tcatgatttcatttcaa

SEQ ID NO: 216655 - DNA, 15 bp, Homo sapiens
tcatgcaatgacatc

SEQ ID NO: 216656 - DNA, 19 bp, Homo sapiens
tcatgccaccatggccagc

SEQ ID NO: 216657 - DNA, 14 bp, Homo sapiens
tcatgccagcagca

SEQ ID NO: 216658 - DNA, 21 bp, Homo sapiens
tcatgccattccgaccttcac

SEQ ID NO: 216659 - DNA, 15 bp, Homo sapiens
tcatgccccctttca

SEQ ID NO: 216660 - DNA, 18 bp, Homo sapiens
tcatgccccctttcagat

SEQ ID NO: 216661 - DNA, 21 bp, Homo sapiens
tcatgccccctttcagatgtc

SEQ ID NO: 216662 - DNA, 13 bp, Homo sapiens
tcatgcctttgta

SEQ ID NO: 216663 - DNA, 17 bp, Homo sapiens
tcatgcctttgtaagtt

SEQ ID NO: 216664 - DNA, 13 bp, Homo sapiens
tcatgcggcccag

SEQ ID NO: 216665 - DNA, 22 bp, Homo sapiens
tcatgcgtccactttcccttcc

SEQ ID NO: 216666 - DNA, 14 bp, Homo sapiens
tcatgcttttctca

SEQ ID NO: 216667 - DNA, 20 bp, Homo sapiens
tcatggaagtggcagtgaaa

SEQ ID NO: 216668 - DNA, 20 bp, Homo sapiens
tcatggcgtaatgggcctgc

SEQ ID NO: 216669 - DNA, 22 bp, Homo sapiens
tcatggcgtaatgggcctgccc

SEQ ID NO: 216670 - DNA, 23 bp, Homo sapiens
tcatggctaagcttaaaaaaaac

SEQ ID NO: 216671 - DNA, 15 bp, Homo sapiens
tcatggctgttatct

SEQ ID NO: 216672 - DNA, 14 bp, Homo sapiens
tcatggcttaatgt

SEQ ID NO: 216673 - DNA, 15 bp, Homo sapiens
tcatggcttaatgtt

SEQ ID NO: 216674 - DNA, 17 bp, Homo sapiens
tcatgggttatgtgtat

SEQ ID NO: 216675 - DNA, 19 bp, Homo sapiens
tcatggtgaaaatgtactg

SEQ ID NO: 216676 - DNA, 22 bp, Homo sapiens
tcatggtgaggcttaacaatgt

SEQ ID NO: 216677 - DNA, 14 bp, Homo sapiens
tcatggtgatgcaa

SEQ ID NO: 216678 - DNA, 19 bp, Homo sapiens
tcatggtgatgcaagtcac

SEQ ID NO: 216679 - DNA, 23 bp, Homo sapiens
tcatggtgggttcaggggactca

SEQ ID NO: 216680 - DNA, 13 bp, Homo sapiens
tcatgtaaatgct

SEQ ID NO: 216681 - DNA, 15 bp, Homo sapiens
tcatgtaccatcaat

SEQ ID NO: 216682 - DNA, 18 bp, Homo sapiens
tcatgtaggttgtctaaa

SEQ ID NO: 216683 - DNA, 16 bp, Homo sapiens
tcatgtcatttctcat

SEQ ID NO: 216684 - DNA, 17 bp, Homo sapiens
tcatgtgctttgtagct

SEQ ID NO: 216685 - DNA, 20 bp, Homo sapiens
gatgctcactgcttctgctt

SEQ ID NO: 216686 - DNA, 21 bp, Homo sapiens
gatgctcaggcttgaaatgca

SEQ ID NO: 216687 - DNA, 20 bp, Homo sapiens
gatgctcattcatattcctg

SEQ ID NO: 216688 - DNA, 21 bp, Homo sapiens
gatgctccctcccctgccctg

SEQ ID NO: 216689 - DNA, 21 bp, Homo sapiens
gatgctgaaacaggagagaaa

SEQ ID NO: 216690 - DNA, 16 bp, Homo sapiens
gatgctgaagtacagt

SEQ ID NO: 216691 - DNA, 20 bp, Homo sapiens
gatgctgactgtactcctcc

SEQ ID NO: 216692 - DNA, 20 bp, Homo sapiens
gatgctgctggaggaatcag

SEQ ID NO: 216693 - DNA, 15 bp, Homo sapiens
gatgctggagaggtt

SEQ ID NO: 216694 - DNA, 16 bp, Homo sapiens
gatgctggagaggtta

SEQ ID NO: 216695 - DNA, 23 bp, Homo sapiens
gatgctggccccaaaagccttac

SEQ ID NO: 216696 - DNA, 16 bp, Homo sapiens
gatgctgtgctatgaa

SEQ ID NO: 216697 - DNA, 24 bp, Homo sapiens
gatgcttgcctagggcctggtcca

SEQ ID NO: 216698 - DNA, 16 bp, Homo sapiens
gatgcttttgtctaat

SEQ ID NO: 216699 - DNA, 18 bp, Homo sapiens
gatggaaaaaaaaaacaa

SEQ ID NO: 216700 - DNA, 20 bp, Homo sapiens
gatggaaaaaaaaaacaaaa

SEQ ID NO: 216701 - DNA, 15 bp, Homo sapiens
gatggaaaaggaaga

SEQ ID NO: 216702 - DNA, 15 bp, Homo sapiens
gatggaaagaaagca

SEQ ID NO: 216703 - DNA, 15 bp, Homo sapiens
gatggaacacacaca

SEQ ID NO: 216704 - DNA, 14 bp, Homo sapiens
gatggacccctccc

SEQ ID NO: 216705 - DNA, 21 bp, Homo sapiens
gatggaccgggtgggcctggc

SEQ ID NO: 216706 - DNA, 22 bp, Homo sapiens
gatggaccgggtgggcctggcc

SEQ ID NO: 216707 - DNA, 13 bp, Homo sapiens
gatggagaaggaa

SEQ ID NO: 216708 - DNA, 16 bp, Homo sapiens
gatggagaaggaaaag

SEQ ID NO: 216709 - DNA, 21 bp, Homo sapiens
gatggagaaggaaaaggctgg

SEQ ID NO: 216710 - DNA, 18 bp, Homo sapiens
gatggagaatgccagccc

SEQ ID NO: 216711 - DNA, 20 bp, Homo sapiens
gatggagaatgccagcccaa

SEQ ID NO: 216712 - DNA, 23 bp, Homo sapiens
gatggagactggtcctgtgtgca

SEQ ID NO: 216713 - DNA, 18 bp, Homo sapiens
gatggagcccccagatag

SEQ ID NO: 216714 - DNA, 17 bp, Homo sapiens
tccaatttacatactct

SEQ ID NO: 216715 - DNA, 12 bp, Homo sapiens
tccacaaatgtc

SEQ ID NO: 216716 - DNA, 13 bp, Homo sapiens
tccacaaatgtcc

SEQ ID NO: 216717 - DNA, 17 bp, Homo sapiens
tccacaagttaaataaa

SEQ ID NO: 216718 - DNA, 16 bp, Homo sapiens
tccacaatgactgctt

SEQ ID NO: 216719 - DNA, 13 bp, Homo sapiens
tccacacaacacc

SEQ ID NO: 216720 - DNA, 15 bp, Homo sapiens
tccacacaacaccag

SEQ ID NO: 216721 - DNA, 13 bp, Homo sapiens
tccacacagcctg

SEQ ID NO: 216722 - DNA, 14 bp, Homo sapiens
tccacacaggccca

SEQ ID NO: 216723 - DNA, 18 bp, Homo sapiens
tccacacccatgactgcc

SEQ ID NO: 216724 - DNA, 15 bp, Homo sapiens
tccacacctccaccc

SEQ ID NO: 216725 - DNA, 19 bp, Homo sapiens
tccacagaacctttgtcaa

SEQ ID NO: 216726 - DNA, 22 bp, Homo sapiens
tccacagaagacacgtgttttt

SEQ ID NO: 216727 - DNA, 15 bp, Homo sapiens
tccacagaggccagg

SEQ ID NO: 216728 - DNA, 21 bp, Homo sapiens
tccacagagtttgtagtaaat

SEQ ID NO: 216729 - DNA, 21 bp, Homo sapiens
tccacagggacacagtctggt

SEQ ID NO: 216730 - DNA, 23 bp, Homo sapiens
tccacagggacacagtctggtgc

SEQ ID NO: 216731 - DNA, 15 bp, Homo sapiens
tccacaggggcaggc

SEQ ID NO: 216732 - DNA, 20 bp, Homo sapiens
tccacaggggcaggcctggg

SEQ ID NO: 216733 - DNA, 24 bp, Homo sapiens
tccacaggggctatcccttctcag

SEQ ID NO: 216734 - DNA, 21 bp, Homo sapiens
tccacagggtgggatgagcct

SEQ ID NO: 216735 - DNA, 12 bp, Homo sapiens
tccacagtattg

SEQ ID NO: 216736 - DNA, 17 bp, Homo sapiens
tccacagtattgttctt

SEQ ID NO: 216737 - DNA, 22 bp, Homo sapiens
tccacagtattgttcttgtaaa

SEQ ID NO: 216738 - DNA, 22 bp, Homo sapiens
tccacagtgctgcttctcttgg

SEQ ID NO: 216739 - DNA, 16 bp, Homo sapiens
tccacataggtttaga

SEQ ID NO: 216740 - DNA, 19 bp, Homo sapiens
tccacatcccagcagccca

SEQ ID NO: 216741 - DNA, 17 bp, Homo sapiens
tccacatccccaccctc

SEQ ID NO: 216742 - DNA, 15 bp, Homo sapiens
tccacatccccacct

SEQ ID NO: 216743 - DNA, 19 bp, Homo sapiens
tccacatccccaccttcca

SEQ ID NO: 216744 - DNA, 19 bp, Homo sapiens
tccacattctacttcagct

SEQ ID NO: 216745 - DNA, 21 bp, Homo sapiens
tccacattctgctgcccccag

SEQ ID NO: 216746 - DNA, 23 bp, Homo sapiens
tccacattctgctgcccccagac

SEQ ID NO: 216747 - DNA, 23 bp, Homo sapiens
tccacattgcataagtggaccca

SEQ ID NO: 216748 - DNA, 15 bp, Homo sapiens
tccacattttaacag

SEQ ID NO: 216749 - DNA, 22 bp, Homo sapiens
tccacattttaacagtacctgt

SEQ ID NO: 216750 - DNA, 13 bp, Homo sapiens
tccaccaagttct

SEQ ID NO: 216751 - DNA, 17 bp, Homo sapiens
tccaccacaagagctcc

SEQ ID NO: 216752 - DNA, 21 bp, Homo sapiens
tccaccacaagagctccttga

SEQ ID NO: 216753 - DNA, 13 bp, Homo sapiens
tccaccaccttgc

SEQ ID NO: 216754 - DNA, 13 bp, Homo sapiens
tccaccattcctt

SEQ ID NO: 216755 - DNA, 22 bp, Homo sapiens
tccaccattcctttaaattctc

SEQ ID NO: 216756 - DNA, 12 bp, Homo sapiens
tccacccaccag

SEQ ID NO: 216757 - DNA, 15 bp, Homo sapiens
tccacccacctcagc

SEQ ID NO: 216758 - DNA, 17 bp, Homo sapiens
tccacccaccttggcct

SEQ ID NO: 216759 - DNA, 22 bp, Homo sapiens
tccacccacttagtccactctg

SEQ ID NO: 216760 - DNA, 12 bp, Homo sapiens
tccacccaggct

SEQ ID NO: 216761 - DNA, 17 bp, Homo sapiens
tccacccaggctgcact

SEQ ID NO: 216762 - DNA, 24 bp, Homo sapiens
tccacccaggctgcactgcagtga

SEQ ID NO: 216763 - DNA, 18 bp, Homo sapiens
tccacccagtgctgccat

SEQ ID NO: 216764 - DNA, 19 bp, Homo sapiens
tccacccagtgctgccatg

SEQ ID NO: 216765 - DNA, 20 bp, Homo sapiens
tccacccagtgctgccatgc

SEQ ID NO: 216766 - DNA, 18 bp, Homo sapiens
tccaccccaattaactga

SEQ ID NO: 216767 - DNA, 15 bp, Homo sapiens
tccaccccagtcccc

SEQ ID NO: 216768 - DNA, 17 bp, Homo sapiens
tccacccccaccactct

SEQ ID NO: 216769 - DNA, 21 bp, Homo sapiens
tccacccccgccacggccacc

SEQ ID NO: 216770 - DNA, 18 bp, Homo sapiens
tccaccccctccctggcc

SEQ ID NO: 216771 - DNA, 21 bp, Homo sapiens
tccaccccctccctggcctgt

SEQ ID NO: 216772 - DNA, 23 bp, Homo sapiens
tccaccccggctccccctgccag

SEQ ID NO: 216773 - DNA, 15 bp, Homo sapiens
tccacccctcaagcc

SEQ ID NO: 216774 - DNA, 18 bp, Homo sapiens
tccacccctccttccctg

SEQ ID NO: 216775 - DNA, 21 bp, Homo sapiens
tccacccctccttccctggtc

SEQ ID NO: 216776 - DNA, 12 bp, Homo sapiens
tccacctccccc

SEQ ID NO: 216777 - DNA, 14 bp, Homo sapiens
tccacctcccccaa

SEQ ID NO: 216778 - DNA, 15 bp, Homo sapiens
tccacctcctctctt

SEQ ID NO: 216779 - DNA, 21 bp, Homo sapiens
tccacctgggagatgctggga

SEQ ID NO: 216780 - DNA, 17 bp, Homo sapiens
tccacctgtctcagcct

SEQ ID NO: 216781 - DNA, 15 bp, Homo sapiens
tccaccttcccatgc

SEQ ID NO: 216782 - DNA, 22 bp, Homo sapiens
tccaccttggcgcgcagcccgg

SEQ ID NO: 216783 - DNA, 23 bp, Homo sapiens
tccaccttggcgcgcagcccggg

SEQ ID NO: 216784 - DNA, 13 bp, Homo sapiens
tccacgccctggg

SEQ ID NO: 216785 - DNA, 16 bp, Homo sapiens
tccacgccctggggag

SEQ ID NO: 216786 - DNA, 15 bp, Homo sapiens
tccacgctcatcttg

SEQ ID NO: 216787 - DNA, 15 bp, Homo sapiens
tccacgctgtctcca

SEQ ID NO: 216788 - DNA, 18 bp, Homo sapiens
tccacgctgtctccagac

SEQ ID NO: 216789 - DNA, 15 bp, Homo sapiens
tccacggaaacagaa

SEQ ID NO: 216790 - DNA, 17 bp, Homo sapiens
tccacggaaacagaact

SEQ ID NO: 216791 - DNA, 18 bp, Homo sapiens
tccacggaaacagaactc

SEQ ID NO: 216792 - DNA, 20 bp, Homo sapiens
tccacggtgcgtggctgtgg

SEQ ID NO: 216793 - DNA, 16 bp, Homo sapiens
tccacgtaattcaatt

SEQ ID NO: 216794 - DNA, 16 bp, Homo sapiens
tccacgtccccctggg

SEQ ID NO: 216795 - DNA, 13 bp, Homo sapiens
tccacgtgtatgc

SEQ ID NO: 216796 - DNA, 18 bp, Homo sapiens
tccactaatactggttat

SEQ ID NO: 216797 - DNA, 17 bp, Homo sapiens
tccactaccctccctcg

SEQ ID NO: 216798 - DNA, 21 bp, Homo sapiens
tccactaccctccctcgcatc

SEQ ID NO: 216799 - DNA, 17 bp, Homo sapiens
tccactaggtgcccagt

SEQ ID NO: 216800 - DNA, 16 bp, Homo sapiens
tccactcactccagcc

SEQ ID NO: 216801 - DNA, 18 bp, Homo sapiens
tccactcactccagccca

SEQ ID NO: 216802 - DNA, 14 bp, Homo sapiens
tccactcagcttgg

SEQ ID NO: 216803 - DNA, 17 bp, Homo sapiens
tccactccacctccacc

SEQ ID NO: 216804 - DNA, 16 bp, Homo sapiens
tccactcccccacctg

SEQ ID NO: 216805 - DNA, 15 bp, Homo sapiens
tccactcccctcatc

SEQ ID NO: 216806 - DNA, 16 bp, Homo sapiens
tccactccctgctcca

SEQ ID NO: 216807 - DNA, 12 bp, Homo sapiens
tccactcctccc

SEQ ID NO: 216808 - DNA, 13 bp, Homo sapiens
tccactcctccca

SEQ ID NO: 216809 - DNA, 17 bp, Homo sapiens
tccactctaccctccca

SEQ ID NO: 216810 - DNA, 18 bp, Homo sapiens
tccactctaccctcccac

SEQ ID NO: 216811 - DNA, 21 bp, Homo sapiens
tccactctaccctcccacccc

SEQ ID NO: 216812 - DNA, 23 bp, Homo sapiens
tccactctaccctcccaccccct

SEQ ID NO: 216813 - DNA, 14 bp, Homo sapiens
tccactctagttct

SEQ ID NO: 216814 - DNA, 17 bp, Homo sapiens
gattttaacaataacta

SEQ ID NO: 216815 - DNA, 23 bp, Homo sapiens
gattttaacaataactactgtgt

SEQ ID NO: 216816 - DNA, 17 bp, Homo sapiens
gattttatttaaactat

SEQ ID NO: 216817 - DNA, 20 bp, Homo sapiens
gattttattttcaagcaaat

SEQ ID NO: 216818 - DNA, 16 bp, Homo sapiens
gattttcaataataga

SEQ ID NO: 216819 - DNA, 22 bp, Homo sapiens
gattttctattgttactctggt

SEQ ID NO: 216820 - DNA, 13 bp, Homo sapiens
gatttttaaagtt

SEQ ID NO: 216821 - DNA, 19 bp, Homo sapiens
gatttttaaagtttaaata

SEQ ID NO: 216822 - DNA, 23 bp, Homo sapiens
gatttttttttagaacagaaaac

SEQ ID NO: 216823 - DNA, 23 bp, Homo sapiens
gattttttttttttggtaattat

SEQ ID NO: 216824 - DNA, 16 bp, Homo sapiens
gcaaaaagaggatccg

SEQ ID NO: 216825 - DNA, 17 bp, Homo sapiens
gcaaaaatgccaggcag

SEQ ID NO: 216826 - DNA, 15 bp, Homo sapiens
gcaaaaccattgctt

SEQ ID NO: 216827 - DNA, 16 bp, Homo sapiens
gcaaaaccattgcttc

SEQ ID NO: 216828 - DNA, 18 bp, Homo sapiens
gcaaaaccggcaacctgt

SEQ ID NO: 216829 - DNA, 20 bp, Homo sapiens
gcaaaacgcatggagtgtgt

SEQ ID NO: 216830 - DNA, 21 bp, Homo sapiens
gcaaaactgcaaattgtagcc

SEQ ID NO: 216831 - DNA, 20 bp, Homo sapiens
gcaaaactgcctgaaagcaa

SEQ ID NO: 216832 - DNA, 16 bp, Homo sapiens
gcaaaagactaattta

SEQ ID NO: 216833 - DNA, 16 bp, Homo sapiens
gcaaaaggcagctcac

SEQ ID NO: 216834 - DNA, 21 bp, Homo sapiens
gcaaaaggcagtggggctggg

SEQ ID NO: 216835 - DNA, 17 bp, Homo sapiens
gcaaaaggttaagccat

SEQ ID NO: 216836 - DNA, 18 bp, Homo sapiens
gcaaaaggttaagccata

SEQ ID NO: 216837 - DNA, 20 bp, Homo sapiens
gcaaaaggttcactaaagca

SEQ ID NO: 216838 - DNA, 21 bp, Homo sapiens
gcaaaaggttcactaaagcag

SEQ ID NO: 216839 - DNA, 18 bp, Homo sapiens
gcaaaatacatgatgatt

SEQ ID NO: 216840 - DNA, 15 bp, Homo sapiens
gcaaacatcaaataa

SEQ ID NO: 216841 - DNA, 13 bp, Homo sapiens
gcaaacctgcccc

SEQ ID NO: 216842 - DNA, 21 bp, Homo sapiens
gcaaagaaaattctcaagtga

SEQ ID NO: 216843 - DNA, 22 bp, Homo sapiens
gcaaagaatttcaatttgttca

SEQ ID NO: 216844 - DNA, 15 bp, Homo sapiens
gcaaagatggcttcc

SEQ ID NO: 216845 - DNA, 21 bp, Homo sapiens
gcaaagcatgccaatttctct

SEQ ID NO: 216846 - DNA, 23 bp, Homo sapiens
gcaaagccacaaggctggccagc

SEQ ID NO: 216847 - DNA, 23 bp, Homo sapiens
gcaaaggactgttttttcctgag

SEQ ID NO: 216848 - DNA, 18 bp, Homo sapiens
gcaaaggagacaaagcag

SEQ ID NO: 216849 - DNA, 19 bp, Homo sapiens
gcaaaggagacaaagcagg

SEQ ID NO: 216850 - DNA, 20 bp, Homo sapiens
gcaaaggagacaaagcagga

SEQ ID NO: 216851 - DNA, 15 bp, Homo sapiens
gcaaaggggcaatgg

SEQ ID NO: 216852 - DNA, 14 bp, Homo sapiens
gcaaagtctaaagt

SEQ ID NO: 216853 - DNA, 15 bp, Homo sapiens
gcaaagtctaaagtt

SEQ ID NO: 216854 - DNA, 16 bp, Homo sapiens
gcaaagtctaaagttt

SEQ ID NO: 216855 - DNA, 21 bp, Homo sapiens
gcaaagtctaaagtttacagt

SEQ ID NO: 216856 - DNA, 23 bp, Homo sapiens
gcaaagtgttttctcagaacagc

SEQ ID NO: 216857 - DNA, 23 bp, Homo sapiens
gcaaagttccctacttcctgtga

SEQ ID NO: 216858 - DNA, 14 bp, Homo sapiens
gcaaagtttccatg

SEQ ID NO: 216859 - DNA, 22 bp, Homo sapiens
tccagtgcttggctgccccaca

SEQ ID NO: 216860 - DNA, 19 bp, Homo sapiens
tccagtggaagaagaaaac

SEQ ID NO: 216861 - DNA, 15 bp, Homo sapiens
tccagtgttgcctcc

SEQ ID NO: 216862 - DNA, 19 bp, Homo sapiens
tccagtgttgcctcctccc

SEQ ID NO: 216863 - DNA, 14 bp, Homo sapiens
tccagttctgatga

SEQ ID NO: 216864 - DNA, 17 bp, Homo sapiens
tccagttggactgtggc

SEQ ID NO: 216865 - DNA, 15 bp, Homo sapiens
tccagtttgcccacc

SEQ ID NO: 216866 - DNA, 14 bp, Homo sapiens
tccataaagtgtaa

SEQ ID NO: 216867 - DNA, 20 bp, Homo sapiens
tccataacctctatatcttt

SEQ ID NO: 216868 - DNA, 22 bp, Homo sapiens
tccataatctggactcctctgt

SEQ ID NO: 216869 - DNA, 12 bp, Homo sapiens
tccataatgtat

SEQ ID NO: 216870 - DNA, 20 bp, Homo sapiens
tccataatgtataaagaaca

SEQ ID NO: 216871 - DNA, 17 bp, Homo sapiens
tccataattatgacagt

SEQ ID NO: 216872 - DNA, 14 bp, Homo sapiens
tccatacagcctct

SEQ ID NO: 216873 - DNA, 13 bp, Homo sapiens
tccatacagctct

SEQ ID NO: 216874 - DNA, 17 bp, Homo sapiens
tccataccccctgcccc

SEQ ID NO: 216875 - DNA, 16 bp, Homo sapiens
tccatagacacagtat

SEQ ID NO: 216876 - DNA, 20 bp, Homo sapiens
tccatagctactatatgcat

SEQ ID NO: 216877 - DNA, 23 bp, Homo sapiens
tccatatcagacctctgatccct

SEQ ID NO: 216878 - DNA, 23 bp, Homo sapiens
tccatatcttaaagaaacagctt

SEQ ID NO: 216879 - DNA, 13 bp, Homo sapiens
tccatcacagcca

SEQ ID NO: 216880 - DNA, 15 bp, Homo sapiens
tccatcacagccagc

SEQ ID NO: 216881 - DNA, 19 bp, Homo sapiens
tccatcacagccagcccag

SEQ ID NO: 216882 - DNA, 13 bp, Homo sapiens
tccatcagctccc

SEQ ID NO: 216883 - DNA, 18 bp, Homo sapiens
tccatcaggttccatccc

SEQ ID NO: 216884 - DNA, 13 bp, Homo sapiens
tccatcatttctg

SEQ ID NO: 216885 - DNA, 14 bp, Homo sapiens
tccatcatttctgt

SEQ ID NO: 216886 - DNA, 22 bp, Homo sapiens
tccatcatttctgtctttaaga

SEQ ID NO: 216887 - DNA, 14 bp, Homo sapiens
tccatccaccacct

SEQ ID NO: 216888 - DNA, 17 bp, Homo sapiens
tccatccaccaccttgc

SEQ ID NO: 216889 - DNA, 22 bp, Homo sapiens
tccatccccagttggggctgcg

SEQ ID NO: 216890 - DNA, 13 bp, Homo sapiens
tccatcccctccc

SEQ ID NO: 216891 - DNA, 12 bp, Homo sapiens
tccatcctgcca

SEQ ID NO: 216892 - DNA, 16 bp, Homo sapiens
tccatcctgtacaagt

SEQ ID NO: 216893 - DNA, 23 bp, Homo sapiens
tccatcctgtacaagtgctcagt

SEQ ID NO: 216894 - DNA, 18 bp, Homo sapiens
tccatccttgcatcactg

SEQ ID NO: 216895 - DNA, 12 bp, Homo sapiens
tccatctgtctg

SEQ ID NO: 216896 - DNA, 17 bp, Homo sapiens
tccatctgtttgataca

SEQ ID NO: 216897 - DNA, 19 bp, Homo sapiens
tccatgaaaacgttttatt

SEQ ID NO: 216898 - DNA, 22 bp, Homo sapiens
tccatgaaaacgttttattgtg

SEQ ID NO: 216899 - DNA, 15 bp, Homo sapiens
tccatgaatgtatca

SEQ ID NO: 216900 - DNA, 23 bp, Homo sapiens
tccatgacagtagcatactgatg

SEQ ID NO: 216901 - DNA, 15 bp, Homo sapiens
tccatgaccaggcca

SEQ ID NO: 216902 - DNA, 17 bp, Homo sapiens
tccatgactgcatttta

SEQ ID NO: 216903 - DNA, 15 bp, Homo sapiens
tccatgactggctgt

SEQ ID NO: 216904 - DNA, 19 bp, Homo sapiens
tccatgagcaccccaaggc

SEQ ID NO: 216905 - DNA, 18 bp, Homo sapiens
tccatgagtttgccctgg

SEQ ID NO: 216906 - DNA, 23 bp, Homo sapiens
tccatgagttttttctcttgggc

SEQ ID NO: 216907 - DNA, 20 bp, Homo sapiens
tccatgattccaagggccca

SEQ ID NO: 216908 - DNA, 22 bp, Homo sapiens
tccatgattccaagggcccaga

SEQ ID NO: 216909 - DNA, 23 bp, Homo sapiens
tccatgattccaagggcccagag

SEQ ID NO: 216910 - DNA, 18 bp, Homo sapiens
tccatgcagatctagcca

SEQ ID NO: 216911 - DNA, 22 bp, Homo sapiens
tccatgcagatctagccaggcc

SEQ ID NO: 216912 - DNA, 12 bp, Homo sapiens
tccatgcctgag

SEQ ID NO: 216913 - DNA, 15 bp, Homo sapiens
tccatgcctgagggt

SEQ ID NO: 216914 - DNA, 18 bp, Homo sapiens
tccatgcggccggcctgg

SEQ ID NO: 216915 - DNA, 20 bp, Homo sapiens
tccatgctcctcactgcccg

SEQ ID NO: 216916 - DNA, 15 bp, Homo sapiens
tccatggcaccagcc

SEQ ID NO: 216917 - DNA, 16 bp, Homo sapiens
tccatggcaccagccc

SEQ ID NO: 216918 - DNA, 14 bp, Homo sapiens
tccatggcaggaag

SEQ ID NO: 216919 - DNA, 12 bp, Homo sapiens
tccatggccacc

SEQ ID NO: 216920 - DNA, 21 bp, Homo sapiens
tccatggccaccccgtgccac

SEQ ID NO: 216921 - DNA, 12 bp, Homo sapiens
tccatggccctt

SEQ ID NO: 216922 - DNA, 20 bp, Homo sapiens
tccatgggctagtgtgagtg

SEQ ID NO: 216923 - DNA, 17 bp, Homo sapiens
tccatggtgcctctgga

SEQ ID NO: 216924 - DNA, 13 bp, Homo sapiens
tccatggtggttt

SEQ ID NO: 216925 - DNA, 20 bp, Homo sapiens
tccatgtactgtagtttttc

SEQ ID NO: 216926 - DNA, 21 bp, Homo sapiens
tccatgtactgtagtttttct

SEQ ID NO: 216927 - DNA, 16 bp, Homo sapiens
tccatgtcgcctctgc

SEQ ID NO: 216928 - DNA, 17 bp, Homo sapiens
tccatgtcgcctctgca

SEQ ID NO: 216929 - DNA, 16 bp, Homo sapiens
tccatgtgaaatttac

SEQ ID NO: 216930 - DNA, 13 bp, Homo sapiens
tccatgtgtgtgc

SEQ ID NO: 216931 - DNA, 14 bp, Homo sapiens
tccatgtgtgtgca

SEQ ID NO: 216932 - DNA, 19 bp, Homo sapiens
tccatgtgttttgctttta

SEQ ID NO: 216933 - DNA, 16 bp, Homo sapiens
tccatgtttgtaaaac

SEQ ID NO: 216934 - DNA, 19 bp, Homo sapiens
tccatgtttgtaaaactac

SEQ ID NO: 216935 - DNA, 13 bp, Homo sapiens
tccattaaatggt

SEQ ID NO: 216936 - DNA, 18 bp, Homo sapiens
tccattaatttcaacata

SEQ ID NO: 216937 - DNA, 16 bp, Homo sapiens
tccattatctgctgtt

SEQ ID NO: 216938 - DNA, 17 bp, Homo sapiens
tccattatctgctgttc

SEQ ID NO: 216939 - DNA, 18 bp, Homo sapiens
tccattattcaagaaaga

SEQ ID NO: 216940 - DNA, 18 bp, Homo sapiens
tccattcagtctgcagct

SEQ ID NO: 216941 - DNA, 12 bp, Homo sapiens
tccattccagaa

SEQ ID NO: 216942 - DNA, 19 bp, Homo sapiens
tccattcccatcactgctg

SEQ ID NO: 216943 - DNA, 22 bp, Homo sapiens
ggaataatgatacctcccaccc

SEQ ID NO: 216944 - DNA, 20 bp, Homo sapiens
ggaatactcttggtcacctc

SEQ ID NO: 216945 - DNA, 14 bp, Homo sapiens
ggaatagccagaga

SEQ ID NO: 216946 - DNA, 15 bp, Homo sapiens
ggaatagccagagag

SEQ ID NO: 216947 - DNA, 17 bp, Homo sapiens
ggaatagccagagagga

SEQ ID NO: 216948 - DNA, 23 bp, Homo sapiens
ggaatataaggaaagcaataaat

SEQ ID NO: 216949 - DNA, 17 bp, Homo sapiens
ggaatcagcttttaata

SEQ ID NO: 216950 - DNA, 20 bp, Homo sapiens
ggaatccagctccctagact

SEQ ID NO: 216951 - DNA, 23 bp, Homo sapiens
ggaatccagctccctagactgca

SEQ ID NO: 216952 - DNA, 16 bp, Homo sapiens
ggaatcccagctccgc

SEQ ID NO: 216953 - DNA, 20 bp, Homo sapiens
ggaatcgaggaaccagagcc

SEQ ID NO: 216954 - DNA, 22 bp, Homo sapiens
ggaatctcccagacttgtttcc

SEQ ID NO: 216955 - DNA, 23 bp, Homo sapiens
ggaatctcccagacttgtttcct

SEQ ID NO: 216956 - DNA, 22 bp, Homo sapiens
ggaatctgatcccataaagaaa

SEQ ID NO: 216957 - DNA, 15 bp, Homo sapiens
ggaatgaagcatgta

SEQ ID NO: 216958 - DNA, 12 bp, Homo sapiens
ggaatgcaggga

SEQ ID NO: 216959 - DNA, 21 bp, Homo sapiens
ggaatgcagggaagagggcag

SEQ ID NO: 216960 - DNA, 23 bp, Homo sapiens
ggaatgcagtgggtggggctgta

SEQ ID NO: 216961 - DNA, 22 bp, Homo sapiens
ggaatgcgctcttcaccaggaa

SEQ ID NO: 216962 - DNA, 12 bp, Homo sapiens
ggaatgctcaat

SEQ ID NO: 216963 - DNA, 18 bp, Homo sapiens
ggaatgctctgtgccaga

SEQ ID NO: 216964 - DNA, 15 bp, Homo sapiens
ggaatggaaggcttt

SEQ ID NO: 216965 - DNA, 19 bp, Homo sapiens
ggaatggaaggctttgcca

SEQ ID NO: 216966 - DNA, 17 bp, Homo sapiens
ggaatggatggggagaa

SEQ ID NO: 216967 - DNA, 20 bp, Homo sapiens
ggaatggtaaccgagccagc

SEQ ID NO: 216968 - DNA, 18 bp, Homo sapiens
ggaatgttccctgcaccc

SEQ ID NO: 216969 - DNA, 21 bp, Homo sapiens
ggaattacctgataagggaga

SEQ ID NO: 216970 - DNA, 18 bp, Homo sapiens
ggaattattttgaatgtc

SEQ ID NO: 216971 - DNA, 16 bp, Homo sapiens
ggaattcagcaccctg

SEQ ID NO: 216972 - DNA, 20 bp, Homo sapiens
ggaattcagcaccctgggtg

SEQ ID NO: 216973 - DNA, 20 bp, Homo sapiens
ggaattgacttcgactgtga

SEQ ID NO: 216974 - DNA, 17 bp, Homo sapiens
ggaatttgtaacctcag

SEQ ID NO: 216975 - DNA, 19 bp, Homo sapiens
ggaatttgtaagtttatgt

SEQ ID NO: 216976 - DNA, 21 bp, Homo sapiens
ggacaaacagtgaatttaagc

SEQ ID NO: 216977 - DNA, 15 bp, Homo sapiens
ggacaaacccttctt

SEQ ID NO: 216978 - DNA, 19 bp, Homo sapiens
ggacaacctgcccctcccc

SEQ ID NO: 216979 - DNA, 23 bp, Homo sapiens
ggacaagccaacttgtaaataca

SEQ ID NO: 216980 - DNA, 23 bp, Homo sapiens
ggacacatcccggcctcttccac

SEQ ID NO: 216981 - DNA, 14 bp, Homo sapiens
ggacacccctgctc

SEQ ID NO: 216982 - DNA, 14 bp, Homo sapiens
ggacacctgccctg

SEQ ID NO: 216983 - DNA, 15 bp, Homo sapiens
ggacacctgccctgc

SEQ ID NO: 216984 - DNA, 19 bp, Homo sapiens
ggacactgaaccttgttga

SEQ ID NO: 216985 - DNA, 21 bp, Homo sapiens
ggacagagggagaagggagaa

SEQ ID NO: 216986 - DNA, 18 bp, Homo sapiens
ggacagatcaatggcgca

SEQ ID NO: 216987 - DNA, 19 bp, Homo sapiens
ggacagatcaatggcgcag

SEQ ID NO: 216988 - DNA, 19 bp, Homo sapiens
ggacagatccagggactga

SEQ ID NO: 216989 - DNA, 15 bp, Homo sapiens
ggacagcaaaaccat

SEQ ID NO: 216990 - DNA, 14 bp, Homo sapiens
ggacagcccactga

SEQ ID NO: 216991 - DNA, 15 bp, Homo sapiens
ggacagcggcccggc

SEQ ID NO: 216992 - DNA, 20 bp, Homo sapiens
ggacagcggcccggcccacg

SEQ ID NO: 216993 - DNA, 11 bp, Homo sapiens
ggacagctgca

SEQ ID NO: 216994 - DNA, 17 bp, Homo sapiens
ggacagctgcaggtgcc

SEQ ID NO: 216995 - DNA, 17 bp, Homo sapiens
ggacagctttcctgggt

SEQ ID NO: 216996 - DNA, 21 bp, Homo sapiens
ggacaggaacacccagcccca

SEQ ID NO: 216997 - DNA, 13 bp, Homo sapiens
ggacaggaagcac

SEQ ID NO: 216998 - DNA, 14 bp, Homo sapiens
ggacaggaagcaca

SEQ ID NO: 216999 - DNA, 22 bp, Homo sapiens
ggacagggcatggccaggtggc

SEQ ID NO: 217000 - DNA, 11 bp, Homo sapiens
ggacagggcca

SEQ ID NO: 217001 - DNA, 15 bp, Homo sapiens
ggacagggccagggt

SEQ ID NO: 217002 - DNA, 17 bp, Homo sapiens
ggacagggccagggttg

SEQ ID NO: 217003 - DNA, 22 bp, Homo sapiens
ggacaggggcatctctgggctg

SEQ ID NO: 217004 - DNA, 15 bp, Homo sapiens
ggacaggtctgggag

SEQ ID NO: 217005 - DNA, 17 bp, Homo sapiens
ggacagtaagattttat

SEQ ID NO: 217006 - DNA, 17 bp, Homo sapiens
ggacagtattctcagtg

SEQ ID NO: 217007 - DNA, 22 bp, Homo sapiens
ggacagtgataggcccaaggtc

SEQ ID NO: 217008 - DNA, 18 bp, Homo sapiens
ggacagtgctgaccccag

SEQ ID NO: 217009 - DNA, 23 bp, Homo sapiens
ggacagtggtctaattcaactct

SEQ ID NO: 217010 - DNA, 16 bp, Homo sapiens
ggacagttcacaccct

SEQ ID NO: 217011 - DNA, 18 bp, Homo sapiens
ggacagttcacaccctgc

SEQ ID NO: 217012 - DNA, 19 bp, Homo sapiens
ggacagttttgatacaaac

SEQ ID NO: 217013 - DNA, 14 bp, Homo sapiens
ggacatcctcttct

SEQ ID NO: 217014 - DNA, 16 bp, Homo sapiens
ggacatgctcacctct

SEQ ID NO: 217015 - DNA, 17 bp, Homo sapiens
ggacatgctcacctcta

SEQ ID NO: 217016 - DNA, 19 bp, Homo sapiens
ggacatggtgtgccacagg

SEQ ID NO: 217017 - DNA, 19 bp, Homo sapiens
ggacatggtgtttaaaatt

SEQ ID NO: 217018 - DNA, 21 bp, Homo sapiens
ggacatgttcccttctccttc

SEQ ID NO: 217019 - DNA, 21 bp, Homo sapiens
ggaccaagcttaaggagagga

SEQ ID NO: 217020 - DNA, 16 bp, Homo sapiens
ggaccacagctgctgg

SEQ ID NO: 217021 - DNA, 21 bp, Homo sapiens
ggaccacagctgctggccagg

SEQ ID NO: 217022 - DNA, 22 bp, Homo sapiens
ggaccacagctgctggccaggg

SEQ ID NO: 217023 - DNA, 13 bp, Homo sapiens
ggaccaccagccc

SEQ ID NO: 217024 - DNA, 15 bp, Homo sapiens
ggaccaccagcccca

SEQ ID NO: 217025 - DNA, 17 bp, Homo sapiens
ggaccaccagccccagc

SEQ ID NO: 217026 - DNA, 19 bp, Homo sapiens
ggaccattgacctcagctg

SEQ ID NO: 217027 - DNA, 20 bp, Homo sapiens
ggagaaggaaaaggctggca

SEQ ID NO: 217028 - DNA, 22 bp, Homo sapiens
ggagaaggaaaaggctggcaag

SEQ ID NO: 217029 - DNA, 16 bp, Homo sapiens
ggagaaggcctgcccc

SEQ ID NO: 217030 - DNA, 17 bp, Homo sapiens
ggagaagggcttttctt

SEQ ID NO: 217031 - DNA, 22 bp, Homo sapiens
ggagaaggtgcttgggcttctg

SEQ ID NO: 217032 - DNA, 14 bp, Homo sapiens
ggagaagtggcccc

SEQ ID NO: 217033 - DNA, 21 bp, Homo sapiens
ggagaagttcttgattcagcc

SEQ ID NO: 217034 - DNA, 20 bp, Homo sapiens
ggagaatcgcttgaacctgg

SEQ ID NO: 217035 - DNA, 14 bp, Homo sapiens
ggagaatgccagcc

SEQ ID NO: 217036 - DNA, 16 bp, Homo sapiens
ggagaatggctctggc

SEQ ID NO: 217037 - DNA, 17 bp, Homo sapiens
ggagaattaaactccta

SEQ ID NO: 217038 - DNA, 16 bp, Homo sapiens
ggagacaaagcaggag

SEQ ID NO: 217039 - DNA, 19 bp, Homo sapiens
ggagacaatgcagatgcca

SEQ ID NO: 217040 - DNA, 20 bp, Homo sapiens
ggagacacagatggcacctg

SEQ ID NO: 217041 - DNA, 14 bp, Homo sapiens
ggagacacctcaga

SEQ ID NO: 217042 - DNA, 22 bp, Homo sapiens
ggagacataaccactgcttcca

SEQ ID NO: 217043 - DNA, 21 bp, Homo sapiens
ggagaccaggactctgccttc

SEQ ID NO: 217044 - DNA, 12 bp, Homo sapiens
ggagaccctgga

SEQ ID NO: 217045 - DNA, 14 bp, Homo sapiens
ggagacctgtgcta

SEQ ID NO: 217046 - DNA, 10 bp, Homo sapiens
ggagactaga

SEQ ID NO: 217047 - DNA, 15 bp, Homo sapiens
ggagactatgtgtca

SEQ ID NO: 217048 - DNA, 14 bp, Homo sapiens
ggagactcaggccc

SEQ ID NO: 217049 - DNA, 15 bp, Homo sapiens
ggagactcaggccca

SEQ ID NO: 217050 - DNA, 12 bp, Homo sapiens
ggagactcctgc

SEQ ID NO: 217051 - DNA, 21 bp, Homo sapiens
ggagactgggtgaaagtgact

SEQ ID NO: 217052 - DNA, 20 bp, Homo sapiens
ggagactggtcctgtgtgca

SEQ ID NO: 217053 - DNA, 16 bp, Homo sapiens
ggagactgtctcaaga

SEQ ID NO: 217054 - DNA, 20 bp, Homo sapiens
ggagagaaggggaggagggc

SEQ ID NO: 217055 - DNA, 18 bp, Homo sapiens
ggagagaatgagagagtg

SEQ ID NO: 217056 - DNA, 17 bp, Homo sapiens
ggagagaccagcctttc

SEQ ID NO: 217057 - DNA, 15 bp, Homo sapiens
ggagagacctcatca

SEQ ID NO: 217058 - DNA, 20 bp, Homo sapiens
ggagagacggtgttgggagc

SEQ ID NO: 217059 - DNA, 18 bp, Homo sapiens
ggagagactgtgaggcgg

SEQ ID NO: 217060 - DNA, 18 bp, Homo sapiens
ggagagagagagagaaag

SEQ ID NO: 217061 - DNA, 22 bp, Homo sapiens
ggagagagatgctgctcccgcc

SEQ ID NO: 217062 - DNA, 23 bp, Homo sapiens
ggagagagcaatcttgctgtgaa

SEQ ID NO: 217063 - DNA, 12 bp, Homo sapiens
ggagagaggttg

SEQ ID NO: 217064 - DNA, 14 bp, Homo sapiens
ggagagaggttgag

SEQ ID NO: 217065 - DNA, 13 bp, Homo sapiens
ggagagagtgaga

SEQ ID NO: 217066 - DNA, 12 bp, Homo sapiens
ggagagcagctg

SEQ ID NO: 217067 - DNA, 14 bp, Homo sapiens
ggagagccaacctc

SEQ ID NO: 217068 - DNA, 16 bp, Homo sapiens
ggagagcccaggcctg

SEQ ID NO: 217069 - DNA, 17 bp, Homo sapiens
ggagagcccaggcctgc

SEQ ID NO: 217070 - DNA, 13 bp, Homo sapiens
ggagagcccccac

SEQ ID NO: 217071 - DNA, 15 bp, Homo sapiens
ggagagcgccacccg

SEQ ID NO: 217072 - DNA, 15 bp, Homo sapiens
ggagagcggctgccc

SEQ ID NO: 217073 - DNA, 17 bp, Homo sapiens
ggagagctggtgcccgg

SEQ ID NO: 217074 - DNA, 15 bp, Homo sapiens
ggagaggaaaagcca

SEQ ID NO: 217075 - DNA, 12 bp, Homo sapiens
ggagaggaagca

SEQ ID NO: 217076 - DNA, 17 bp, Homo sapiens
ggagaggagagaatgag

SEQ ID NO: 217077 - DNA, 12 bp, Homo sapiens
ggagaggcagaa

SEQ ID NO: 217078 - DNA, 19 bp, Homo sapiens
ggagaggctctgaaagctg

SEQ ID NO: 217079 - DNA, 14 bp, Homo sapiens
ggagaggctgtctg

SEQ ID NO: 217080 - DNA, 19 bp, Homo sapiens
ggagaggctgtctggggcc

SEQ ID NO: 217081 - DNA, 21 bp, Homo sapiens
ggagagggatgaggtgctggg

SEQ ID NO: 217082 - DNA, 24 bp, Homo sapiens
ggagagggatgaggtgctgggagg

SEQ ID NO: 217083 - DNA, 18 bp, Homo sapiens
ggagaggggaagggccag

SEQ ID NO: 217084 - DNA, 16 bp, Homo sapiens
ccttgtgagagcccat

SEQ ID NO: 217085 - DNA, 13 bp, Homo sapiens
ccttgtgccctgc

SEQ ID NO: 217086 - DNA, 14 bp, Homo sapiens
ccttgtgccctgcc

SEQ ID NO: 217087 - DNA, 15 bp, Homo sapiens
ccttgtgtgctggct

SEQ ID NO: 217088 - DNA, 14 bp, Homo sapiens
ccttgttgatgcca

SEQ ID NO: 217089 - DNA, 15 bp, Homo sapiens
ccttgttgatgccag

SEQ ID NO: 217090 - DNA, 17 bp, Homo sapiens
ccttgttggagcctgca

SEQ ID NO: 217091 - DNA, 19 bp, Homo sapiens
ccttgttggagcctgcagg

SEQ ID NO: 217092 - DNA, 15 bp, Homo sapiens
ccttgtttctttctg

SEQ ID NO: 217093 - DNA, 20 bp, Homo sapiens
ccttgttttgtgacattttt

SEQ ID NO: 217094 - DNA, 16 bp, Homo sapiens
ccttgtttttgatgtg

SEQ ID NO: 217095 - DNA, 15 bp, Homo sapiens
cctttaaatatcatt

SEQ ID NO: 217096 - DNA, 22 bp, Homo sapiens
cctttaaatatcattctttgta

SEQ ID NO: 217097 - DNA, 12 bp, Homo sapiens
cctttaactctg

SEQ ID NO: 217098 - DNA, 22 bp, Homo sapiens
cctttaactgtatccttaacca

SEQ ID NO: 217099 - DNA, 14 bp, Homo sapiens
cctttaagagaaat

SEQ ID NO: 217100 - DNA, 15 bp, Homo sapiens
cctttacttgacctc

SEQ ID NO: 217101 - DNA, 17 bp, Homo sapiens
cctttaggcagcctgcc

SEQ ID NO: 217102 - DNA, 18 bp, Homo sapiens
cctttaggcagcctgccg

SEQ ID NO: 217103 - DNA, 13 bp, Homo sapiens
cctttaggcagga

SEQ ID NO: 217104 - DNA, 19 bp, Homo sapiens
cctttatatttagtgaact

SEQ ID NO: 217105 - DNA, 22 bp, Homo sapiens
cctttatcaaaaaaagactcag

SEQ ID NO: 217106 - DNA, 15 bp, Homo sapiens
cctttatccctgctt

SEQ ID NO: 217107 - DNA, 18 bp, Homo sapiens
cctttatttattaaactt

SEQ ID NO: 217108 - DNA, 19 bp, Homo sapiens
cctttatttattaaacttc

SEQ ID NO: 217109 - DNA, 20 bp, Homo sapiens
cctttatttattaaacttca

SEQ ID NO: 217110 - DNA, 16 bp, Homo sapiens
cctttcaaatttcaca

SEQ ID NO: 217111 - DNA, 16 bp, Homo sapiens
cctttcactgaagtga

SEQ ID NO: 217112 - DNA, 13 bp, Homo sapiens
cctttcagatgtc

SEQ ID NO: 217113 - DNA, 22 bp, Homo sapiens
cctttcagatgtcttctgcctg

SEQ ID NO: 217114 - DNA, 12 bp, Homo sapiens
cctttcagctgt

SEQ ID NO: 217115 - DNA, 15 bp, Homo sapiens
cctttcagctgtgaa

SEQ ID NO: 217116 - DNA, 16 bp, Homo sapiens
cctttcatcctcagca

SEQ ID NO: 217117 - DNA, 22 bp, Homo sapiens
cctttccaattccaaaattcca

SEQ ID NO: 217118 - DNA, 22 bp, Homo sapiens
cctttcccaacacttcagactg

SEQ ID NO: 217119 - DNA, 13 bp, Homo sapiens
cctttcccacagt

SEQ ID NO: 217120 - DNA, 19 bp, Homo sapiens
cctttcccatcaccccttc

SEQ ID NO: 217121 - DNA, 22 bp, Homo sapiens
cctttcccatcaccccttcccc

SEQ ID NO: 217122 - DNA, 15 bp, Homo sapiens
cctttcccatttcgt

SEQ ID NO: 217123 - DNA, 12 bp, Homo sapiens
cctttccctcca

SEQ ID NO: 217124 - DNA, 17 bp, Homo sapiens
cctttccctgcatccct

SEQ ID NO: 217125 - DNA, 18 bp, Homo sapiens
cctttccctgcatccctt

SEQ ID NO: 217126 - DNA, 11 bp, Homo sapiens
cctttccctgg

SEQ ID NO: 217127 - DNA, 12 bp, Homo sapiens
cctttcccttct

SEQ ID NO: 217128 - DNA, 15 bp, Homo sapiens
cctttcccttcttgg

SEQ ID NO: 217129 - DNA, 19 bp, Homo sapiens
cctttcctgtgccaacctg

SEQ ID NO: 217130 - DNA, 18 bp, Homo sapiens
cctttccttccatcccta

SEQ ID NO: 217131 - DNA, 12 bp, Homo sapiens
cctttccttctc

SEQ ID NO: 217132 - DNA, 14 bp, Homo sapiens
cctttccttctcgt

SEQ ID NO: 217133 - DNA, 20 bp, Homo sapiens
cctttctaaggatagccttt

SEQ ID NO: 217134 - DNA, 22 bp, Homo sapiens
cctttctaaggatagcctttgt

SEQ ID NO: 217135 - DNA, 22 bp, Homo sapiens
cctttctccagccagcaatgat

SEQ ID NO: 217136 - DNA, 13 bp, Homo sapiens
cctttctccaggc

SEQ ID NO: 217137 - DNA, 16 bp, Homo sapiens
cctttctccaggccct

SEQ ID NO: 217138 - DNA, 19 bp, Homo sapiens
cctttctccaggccctcag

SEQ ID NO: 217139 - DNA, 22 bp, Homo sapiens
cctttctcgtggtagaagccag

SEQ ID NO: 217140 - DNA, 11 bp, Homo sapiens
cctttctgagt

SEQ ID NO: 217141 - DNA, 16 bp, Homo sapiens
cctttctgtaccattt

SEQ ID NO: 217142 - DNA, 23 bp, Homo sapiens
cctttctgtatcaagcccctgtc

SEQ ID NO: 217143 - DNA, 13 bp, Homo sapiens
cctttctgtgtgc

SEQ ID NO: 217144 - DNA, 11 bp, Homo sapiens
cctttcttcct

SEQ ID NO: 217145 - DNA, 14 bp, Homo sapiens
cctttcttgacaaa

SEQ ID NO: 217146 - DNA, 13 bp, Homo sapiens
cctttcttggcca

SEQ ID NO: 217147 - DNA, 12 bp, Homo sapiens
cctttctttaaa

SEQ ID NO: 217148 - DNA, 19 bp, Homo sapiens
cctttcttttgaaatgcca

SEQ ID NO: 217149 - DNA, 15 bp, Homo sapiens
cctttctttttcttc

SEQ ID NO: 217150 - DNA, 20 bp, Homo sapiens
cctttgacttcagctgcctg

SEQ ID NO: 217151 - DNA, 14 bp, Homo sapiens
cctttgagaaagaa

SEQ ID NO: 217152 - DNA, 22 bp, Homo sapiens
cctttgagcccacaaagcctta

SEQ ID NO: 217153 - DNA, 22 bp, Homo sapiens
cctttgagggcagtggggagca

SEQ ID NO: 217154 - DNA, 14 bp, Homo sapiens
cctttgcactgagg

SEQ ID NO: 217155 - DNA, 17 bp, Homo sapiens
cctttgcactgagggcc

SEQ ID NO: 217156 - DNA, 18 bp, Homo sapiens
cctttgcaggcccagcag

SEQ ID NO: 217157 - DNA, 22 bp, Homo sapiens
cctttgcagttggactctcagg

SEQ ID NO: 217158 - DNA, 19 bp, Homo sapiens
cgaggctgcctctgggtga

SEQ ID NO: 217159 - DNA, 13 bp, Homo sapiens
cgaggctgggcca

SEQ ID NO: 217160 - DNA, 14 bp, Homo sapiens
cgaggctgggccaa

SEQ ID NO: 217161 - DNA, 17 bp, Homo sapiens
cgaggctgggccaagcc

SEQ ID NO: 217162 - DNA, 16 bp, Homo sapiens
cgagggaggggaggtg

SEQ ID NO: 217163 - DNA, 17 bp, Homo sapiens
cgagggaggggaggtgg

SEQ ID NO: 217164 - DNA, 17 bp, Homo sapiens
cgagggatgtggagcac

SEQ ID NO: 217165 - DNA, 13 bp, Homo sapiens
cgagggcggccag

SEQ ID NO: 217166 - DNA, 17 bp, Homo sapiens
cgagggcggccagggac

SEQ ID NO: 217167 - DNA, 18 bp, Homo sapiens
cgaggggagggtggcagg

SEQ ID NO: 217168 - DNA, 14 bp, Homo sapiens
cgagggtcctggct

SEQ ID NO: 217169 - DNA, 15 bp, Homo sapiens
cgagggtcctggctc

SEQ ID NO: 217170 - DNA, 15 bp, Homo sapiens
cgagggttccaggct

SEQ ID NO: 217171 - DNA, 14 bp, Homo sapiens
cgaggtcaaggaga

SEQ ID NO: 217172 - DNA, 16 bp, Homo sapiens
cgaggtgtcaccctgc

SEQ ID NO: 217173 - DNA, 21 bp, Homo sapiens
cgaggtgtcaccctgcagagc

SEQ ID NO: 217174 - DNA, 12 bp, Homo sapiens
cgagtaccccag

SEQ ID NO: 217175 - DNA, 20 bp, Homo sapiens
cgagtcacctgcaagcccca

SEQ ID NO: 217176 - DNA, 14 bp, Homo sapiens
cgagtcaccttcca

SEQ ID NO: 217177 - DNA, 16 bp, Homo sapiens
cgagtcaccttccagg

SEQ ID NO: 217178 - DNA, 13 bp, Homo sapiens
cgagtccaggagc

SEQ ID NO: 217179 - DNA, 22 bp, Homo sapiens
cgagtccaggagccccagccag

SEQ ID NO: 217180 - DNA, 23 bp, Homo sapiens
cgagtccaggagccccagccagc

SEQ ID NO: 217181 - DNA, 19 bp, Homo sapiens
cgagtcccggagccccacc

SEQ ID NO: 217182 - DNA, 16 bp, Homo sapiens
cgagtctcttctccac

SEQ ID NO: 217183 - DNA, 18 bp, Homo sapiens
cgagtctcttctccactg

SEQ ID NO: 217184 - DNA, 15 bp, Homo sapiens
cgagtgtggagctgc

SEQ ID NO: 217185 - DNA, 11 bp, Homo sapiens
cgagtgtgtgc

SEQ ID NO: 217186 - DNA, 18 bp, Homo sapiens
cgagtgtgtgcatgtgtg

SEQ ID NO: 217187 - DNA, 17 bp, Homo sapiens
cgagttacagacaaagc

SEQ ID NO: 217188 - DNA, 18 bp, Homo sapiens
cgagttacagacaaagcg

SEQ ID NO: 217189 - DNA, 16 bp, Homo sapiens
cgagttggcaaaatgg

SEQ ID NO: 217190 - DNA, 21 bp, Homo sapiens
cgatacaccgggcctggagaa

SEQ ID NO: 217191 - DNA, 13 bp, Homo sapiens
cgatatacagatg

SEQ ID NO: 217192 - DNA, 18 bp, Homo sapiens
cgatatacagatgaaaat

SEQ ID NO: 217193 - DNA, 18 bp, Homo sapiens
cgatatgaaaaataaata

SEQ ID NO: 217194 - DNA, 15 bp, Homo sapiens
cgatatgagagggat

SEQ ID NO: 217195 - DNA, 20 bp, Homo sapiens
cgatgatgcttgtaacaaga

SEQ ID NO: 217196 - DNA, 22 bp, Homo sapiens
cgatgatgcttgtaacaagaaa

SEQ ID NO: 217197 - DNA, 14 bp, Homo sapiens
cgatgcactgacct

SEQ ID NO: 217198 - DNA, 17 bp, Homo sapiens
cgatgcctttgctgttt

SEQ ID NO: 217199 - DNA, 19 bp, Homo sapiens
cgatgggggatgcttcatg

SEQ ID NO: 217200 - DNA, 19 bp, Homo sapiens
cgatgtggtgaccccaccc

SEQ ID NO: 217201 - DNA, 18 bp, Homo sapiens
cgattaacctgcatgcag

SEQ ID NO: 217202 - DNA, 21 bp, Homo sapiens
cgattccgatcgactgccaag

SEQ ID NO: 217203 - DNA, 13 bp, Homo sapiens
cgattggctttaa

SEQ ID NO: 217204 - DNA, 15 bp, Homo sapiens
cgattggctttaaac

SEQ ID NO: 217205 - DNA, 19 bp, Homo sapiens
cgatttcagcacatgcact

SEQ ID NO: 217206 - DNA, 13 bp, Homo sapiens
cgatttcctaagc

SEQ ID NO: 217207 - DNA, 15 bp, Homo sapiens
cgatttcctaagctg

SEQ ID NO: 217208 - DNA, 21 bp, Homo sapiens
cgatttcctaagctgttggaa

SEQ ID NO: 217209 - DNA, 13 bp, Homo sapiens
cgatttttgtatg

SEQ ID NO: 217210 - DNA, 22 bp, Homo sapiens
cgatttttgtatgttatgaaca

SEQ ID NO: 217211 - DNA, 18 bp, Homo sapiens
cgcaaggcctgtgctgca

SEQ ID NO: 217212 - DNA, 16 bp, Homo sapiens
cgcaagggcatcaggc

SEQ ID NO: 217213 - DNA, 21 bp, Homo sapiens
cgcaatatgggaggaacaaag

SEQ ID NO: 217214 - DNA, 20 bp, Homo sapiens
cgcaatgtgcccccagacgc

SEQ ID NO: 217215 - DNA, 13 bp, Homo sapiens
cgcacaaggacat

SEQ ID NO: 217216 - DNA, 15 bp, Homo sapiens
cgcacacacacacac

SEQ ID NO: 217217 - DNA, 12 bp, Homo sapiens
cgcacacagctt

SEQ ID NO: 217218 - DNA, 20 bp, Homo sapiens
cgcacaccctcactctgcca

SEQ ID NO: 217219 - DNA, 18 bp, Homo sapiens
cgcaccagctgctctgcc

SEQ ID NO: 217220 - DNA, 19 bp, Homo sapiens
cgcaccagctgctctgccc

SEQ ID NO: 217221 - DNA, 19 bp, Homo sapiens
cgcacccccaccctttggg

SEQ ID NO: 217222 - DNA, 18 bp, Homo sapiens
cgcacccggcagcccccc

SEQ ID NO: 217223 - DNA, 13 bp, Homo sapiens
cgcaccgcccaac

SEQ ID NO: 217224 - DNA, 19 bp, Homo sapiens
cgcacctgtagtcccagct

SEQ ID NO: 217225 - DNA, 16 bp, Homo sapiens
cgcaccttttatacca

SEQ ID NO: 217226 - DNA, 16 bp, Homo sapiens
cgcacgcacacacaca

SEQ ID NO: 217227 - DNA, 17 bp, Homo sapiens
cgcacttcccatttgtg

SEQ ID NO: 217228 - DNA, 20 bp, Homo sapiens
ggaggctggaggaagggggg

SEQ ID NO: 217229 - DNA, 16 bp, Homo sapiens
ggaggcttgtcagagc

SEQ ID NO: 217230 - DNA, 20 bp, Homo sapiens
ggaggcttgtcagagctggg

SEQ ID NO: 217231 - DNA, 22 bp, Homo sapiens
ggaggcttgtcagagctgggag

SEQ ID NO: 217232 - DNA, 19 bp, Homo sapiens
ggagggaaacccggggaac

SEQ ID NO: 217233 - DNA, 15 bp, Homo sapiens
ggagggaattgaggt

SEQ ID NO: 217234 - DNA, 19 bp, Homo sapiens
ggagggaattgaggtctgc

SEQ ID NO: 217235 - DNA, 12 bp, Homo sapiens
ggagggagctgc

SEQ ID NO: 217236 - DNA, 20 bp, Homo sapiens
ggagggcgaggcgggggagc

SEQ ID NO: 217237 - DNA, 21 bp, Homo sapiens
ggagggcgaggcgggggagcc

SEQ ID NO: 217238 - DNA, 13 bp, Homo sapiens
ggaggggaggcag

SEQ ID NO: 217239 - DNA, 20 bp, Homo sapiens
ggaggggcatggccagcagc

SEQ ID NO: 217240 - DNA, 21 bp, Homo sapiens
ggaggggcctggcagccgtgc

SEQ ID NO: 217241 - DNA, 16 bp, Homo sapiens
ggaggggcctggcctg

SEQ ID NO: 217242 - DNA, 17 bp, Homo sapiens
ggagggggcccttccag

SEQ ID NO: 217243 - DNA, 16 bp, Homo sapiens
ggagggggttacaaac

SEQ ID NO: 217244 - DNA, 23 bp, Homo sapiens
ggaggggtaaatatatgttttga

SEQ ID NO: 217245 - DNA, 19 bp, Homo sapiens
ggaggggtcagctctggcc

SEQ ID NO: 217246 - DNA, 11 bp, Homo sapiens
ggaggggtctg

SEQ ID NO: 217247 - DNA, 14 bp, Homo sapiens
ggaggggtctgcct

SEQ ID NO: 217248 - DNA, 16 bp, Homo sapiens
ggaggggtctgcctcc

SEQ ID NO: 217249 - DNA, 12 bp, Homo sapiens
ggagggtcagtg

SEQ ID NO: 217250 - DNA, 20 bp, Homo sapiens
ggagggtggcacttcgtgga

SEQ ID NO: 217251 - DNA, 14 bp, Homo sapiens
ggaggtcccaggaa

SEQ ID NO: 217252 - DNA, 16 bp, Homo sapiens
ggaggtcccaggaagt

SEQ ID NO: 217253 - DNA, 18 bp, Homo sapiens
ggaggtgatagcattgct

SEQ ID NO: 217254 - DNA, 20 bp, Homo sapiens
ggaggtggaggttgccgtga

SEQ ID NO: 217255 - DNA, 23 bp, Homo sapiens
ggaggtggccgtcgagttgacct

SEQ ID NO: 217256 - DNA, 12 bp, Homo sapiens
ggaggtgggcat

SEQ ID NO: 217257 - DNA, 19 bp, Homo sapiens
ggaggtgtgatagagcctt

SEQ ID NO: 217258 - DNA, 21 bp, Homo sapiens
ggaggtgtgatagagcctttg

SEQ ID NO: 217259 - DNA, 15 bp, Homo sapiens
ggaggttctcagagc

SEQ ID NO: 217260 - DNA, 20 bp, Homo sapiens
ggagtagacccctggctggt

SEQ ID NO: 217261 - DNA, 13 bp, Homo sapiens
ggagtatctggga

SEQ ID NO: 217262 - DNA, 16 bp, Homo sapiens
ggagtcaagtgtgcct

SEQ ID NO: 217263 - DNA, 16 bp, Homo sapiens
ggagtcagagccctgg

SEQ ID NO: 217264 - DNA, 22 bp, Homo sapiens
ggagtcagatgagcaaggacat

SEQ ID NO: 217265 - DNA, 21 bp, Homo sapiens
ggagtcagtaggtccaagggc

SEQ ID NO: 217266 - DNA, 14 bp, Homo sapiens
ggagtccactttcc

SEQ ID NO: 217267 - DNA, 15 bp, Homo sapiens
ggagtccactttcct

SEQ ID NO: 217268 - DNA, 21 bp, Homo sapiens
ggagtccaggccatggaggca

SEQ ID NO: 217269 - DNA, 22 bp, Homo sapiens
ggagtcggatctagccatggct

SEQ ID NO: 217270 - DNA, 21 bp, Homo sapiens
ggagtctccctccgactccag

SEQ ID NO: 217271 - DNA, 16 bp, Homo sapiens
ggagtctgaaggagag

SEQ ID NO: 217272 - DNA, 21 bp, Homo sapiens
ggagtgagtgtggctcccctc

SEQ ID NO: 217273 - DNA, 19 bp, Homo sapiens
ggagtgatgatttggggga

SEQ ID NO: 217274 - DNA, 20 bp, Homo sapiens
ggagtgcaatgacacagtct

SEQ ID NO: 217275 - DNA, 21 bp, Homo sapiens
ggagtgcagaacacctggccg

SEQ ID NO: 217276 - DNA, 15 bp, Homo sapiens
ggagtgcatggccac

SEQ ID NO: 217277 - DNA, 20 bp, Homo sapiens
ggagtgcatggccacagcca

SEQ ID NO: 217278 - DNA, 13 bp, Homo sapiens
ggagtgctggctc

SEQ ID NO: 217279 - DNA, 14 bp, Homo sapiens
ggagtggaaacaaa

SEQ ID NO: 217280 - DNA, 13 bp, Homo sapiens
ggagtggaaggtg

SEQ ID NO: 217281 - DNA, 11 bp, Homo sapiens
ggagtggaggc

SEQ ID NO: 217282 - DNA, 13 bp, Homo sapiens
ggagtggaggcat

SEQ ID NO: 217283 - DNA, 21 bp, Homo sapiens
ggagtggaggggtcagcaggg

SEQ ID NO: 217284 - DNA, 12 bp, Homo sapiens
ggagtgggacag

SEQ ID NO: 217285 - DNA, 17 bp, Homo sapiens
ggagtgggacagagtct

SEQ ID NO: 217286 - DNA, 13 bp, Homo sapiens
ggagtgggcacct

SEQ ID NO: 217287 - DNA, 15 bp, Homo sapiens
ggagtggggcagtag

SEQ ID NO: 217288 - DNA, 17 bp, Homo sapiens
ggagtgggtggaggcag

SEQ ID NO: 217289 - DNA, 19 bp, Homo sapiens
gggctcctggctgccaggc

SEQ ID NO: 217290 - DNA, 20 bp, Homo sapiens
gggctcctggctgccaggcg

SEQ ID NO: 217291 - DNA, 20 bp, Homo sapiens
gggctcctttctccagccag

SEQ ID NO: 217292 - DNA, 21 bp, Homo sapiens
gggctcgagtgcccctgcagg

SEQ ID NO: 217293 - DNA, 18 bp, Homo sapiens
gggctcgccccacccagg

SEQ ID NO: 217294 - DNA, 19 bp, Homo sapiens
gggctctccaaaggggctg

SEQ ID NO: 217295 - DNA, 23 bp, Homo sapiens
gggctctccaaaggggctgctgg

SEQ ID NO: 217296 - DNA, 15 bp, Homo sapiens
gggctctgccaccct

SEQ ID NO: 217297 - DNA, 21 bp, Homo sapiens
gggctctgccctccctccttc

SEQ ID NO: 217298 - DNA, 22 bp, Homo sapiens
gggctctgccctccctccttcc

SEQ ID NO: 217299 - DNA, 13 bp, Homo sapiens
gggctctgcgtcc

SEQ ID NO: 217300 - DNA, 19 bp, Homo sapiens
gggctctgcttcctcagcc

SEQ ID NO: 217301 - DNA, 16 bp, Homo sapiens
gggctctggccaccct

SEQ ID NO: 217302 - DNA, 13 bp, Homo sapiens
gggctctggctcc

SEQ ID NO: 217303 - DNA, 13 bp, Homo sapiens
gggctctgggttc

SEQ ID NO: 217304 - DNA, 17 bp, Homo sapiens
gggctctgtcttcctgg

SEQ ID NO: 217305 - DNA, 20 bp, Homo sapiens
gggctgacacctaccatgct

SEQ ID NO: 217306 - DNA, 23 bp, Homo sapiens
gggctgacacctaccatgctgct

SEQ ID NO: 217307 - DNA, 21 bp, Homo sapiens
gggctgagagggctgtggctg

SEQ ID NO: 217308 - DNA, 11 bp, Homo sapiens
gggctgagccc

SEQ ID NO: 217309 - DNA, 15 bp, Homo sapiens
gggctgagcccctac

SEQ ID NO: 217310 - DNA, 16 bp, Homo sapiens
gggctgagctgcctgt

SEQ ID NO: 217311 - DNA, 12 bp, Homo sapiens
gggctgaggggc

SEQ ID NO: 217312 - DNA, 12 bp, Homo sapiens
gggctgagtctg

SEQ ID NO: 217313 - DNA, 18 bp, Homo sapiens
gggctgagtctggctagg

SEQ ID NO: 217314 - DNA, 19 bp, Homo sapiens
gggctgagtgcagaggctg

SEQ ID NO: 217315 - DNA, 21 bp, Homo sapiens
gggctgagtgcagaggctgag

SEQ ID NO: 217316 - DNA, 21 bp, Homo sapiens
gggctgcatcctcagccccag

SEQ ID NO: 217317 - DNA, 22 bp, Homo sapiens
gggctgcatcctcagccccagg

SEQ ID NO: 217318 - DNA, 21 bp, Homo sapiens
gggctggactggaggtgggca

SEQ ID NO: 217319 - DNA, 17 bp, Homo sapiens
gggctggactggctgtc

SEQ ID NO: 217320 - DNA, 13 bp, Homo sapiens
gggctggccctgc

SEQ ID NO: 217321 - DNA, 16 bp, Homo sapiens
gggctggccctgccct

SEQ ID NO: 217322 - DNA, 21 bp, Homo sapiens
gggctggccctgccctccccc

SEQ ID NO: 217323 - DNA, 23 bp, Homo sapiens
gggctggccctgccctcccccac

SEQ ID NO: 217324 - DNA, 17 bp, Homo sapiens
gggctggcttctccctg

SEQ ID NO: 217325 - DNA, 21 bp, Homo sapiens
gggctgggagaaggtgcttgg

SEQ ID NO: 217326 - DNA, 13 bp, Homo sapiens
gggctgggcagct

SEQ ID NO: 217327 - DNA, 17 bp, Homo sapiens
gggctgggcaggtcctg

SEQ ID NO: 217328 - DNA, 19 bp, Homo sapiens
gggctgggcaggtcctggg

SEQ ID NO: 217329 - DNA, 15 bp, Homo sapiens
gggctgggctctgtc

SEQ ID NO: 217330 - DNA, 18 bp, Homo sapiens
gggctggtattctctcta

SEQ ID NO: 217331 - DNA, 16 bp, Homo sapiens
gggctggtgccccaca

SEQ ID NO: 217332 - DNA, 23 bp, Homo sapiens
gggctgtccttagactccttctc

SEQ ID NO: 217333 - DNA, 17 bp, Homo sapiens
gggctgtggctgggtgg

SEQ ID NO: 217334 - DNA, 17 bp, Homo sapiens
gggctgtgggtggggaa

SEQ ID NO: 217335 - DNA, 17 bp, Homo sapiens
gggctgtgttgactgct

SEQ ID NO: 217336 - DNA, 21 bp, Homo sapiens
gggctgtgttgactgctgctc

SEQ ID NO: 217337 - DNA, 16 bp, Homo sapiens
gggcttagaatggggc

SEQ ID NO: 217338 - DNA, 16 bp, Homo sapiens
gggcttatctagccaa

SEQ ID NO: 217339 - DNA, 14 bp, Homo sapiens
gggcttccctctgc

SEQ ID NO: 217340 - DNA, 13 bp, Homo sapiens
gggcttctcctga

SEQ ID NO: 217341 - DNA, 16 bp, Homo sapiens
gggcttctcctgaccc

SEQ ID NO: 217342 - DNA, 21 bp, Homo sapiens
gggcttctgcggtgaggcagg

SEQ ID NO: 217343 - DNA, 19 bp, Homo sapiens
gggcttgcaagtatgtttt

SEQ ID NO: 217344 - DNA, 16 bp, Homo sapiens
gggcttggaagggcgc

SEQ ID NO: 217345 - DNA, 18 bp, Homo sapiens
gggcttggacttcctggg

SEQ ID NO: 217346 - DNA, 18 bp, Homo sapiens
gggctttgcaggctctgg

SEQ ID NO: 217347 - DNA, 11 bp, Homo sapiens
ggggaactcaa

SEQ ID NO: 217348 - DNA, 13 bp, Homo sapiens
ggggaagagagcc

SEQ ID NO: 217349 - DNA, 15 bp, Homo sapiens
ggggaagaggccttg

SEQ ID NO: 217350 - DNA, 22 bp, Homo sapiens
ggggaagcaagacgtcctggaa

SEQ ID NO: 217351 - DNA, 15 bp, Homo sapiens
ggggaagctgcagct

SEQ ID NO: 217352 - DNA, 19 bp, Homo sapiens
ggggaagctgcagcttggg

SEQ ID NO: 217353 - DNA, 22 bp, Homo sapiens
ggggaagggccagtctgggctg

SEQ ID NO: 217354 - DNA, 22 bp, Homo sapiens
ggggacaggaacacccagcccc

SEQ ID NO: 217355 - DNA, 18 bp, Homo sapiens
ggggacagttggcagaga

SEQ ID NO: 217356 - DNA, 21 bp, Homo sapiens
ggggacgctggtagagatgga

SEQ ID NO: 217357 - DNA, 14 bp, Homo sapiens
ggggactcagccct

SEQ ID NO: 217358 - DNA, 14 bp, Homo sapiens
ctccccagcccttt

SEQ ID NO: 217359 - DNA, 14 bp, Homo sapiens
ctccccaggcctcc

SEQ ID NO: 217360 - DNA, 15 bp, Homo sapiens
ctccccagtgcctgc

SEQ ID NO: 217361 - DNA, 19 bp, Homo sapiens
ctccccagtgcctgccact

SEQ ID NO: 217362 - DNA, 20 bp, Homo sapiens
ctccccagtgcctgccactc

SEQ ID NO: 217363 - DNA, 21 bp, Homo sapiens
ctccccagtgcctgccactct

SEQ ID NO: 217364 - DNA, 22 bp, Homo sapiens
ctccccagtgcctgccactctc

SEQ ID NO: 217365 - DNA, 15 bp, Homo sapiens
ctccccatatataaa

SEQ ID NO: 217366 - DNA, 21 bp, Homo sapiens
ctccccatatataaattatta

SEQ ID NO: 217367 - DNA, 15 bp, Homo sapiens
ctccccatggtgcag

SEQ ID NO: 217368 - DNA, 17 bp, Homo sapiens
ctcccccaaaccctgct

SEQ ID NO: 217369 - DNA, 13 bp, Homo sapiens
ctcccccacctga

SEQ ID NO: 217370 - DNA, 14 bp, Homo sapiens
ctcccccagccagg

SEQ ID NO: 217371 - DNA, 13 bp, Homo sapiens
ctcccccaggctg

SEQ ID NO: 217372 - DNA, 18 bp, Homo sapiens
ctcccccaggctgcgcct

SEQ ID NO: 217373 - DNA, 18 bp, Homo sapiens
ctcccccgcagtccccag

SEQ ID NO: 217374 - DNA, 21 bp, Homo sapiens
ctcccccgcagtccccagccc

SEQ ID NO: 217375 - DNA, 13 bp, Homo sapiens
ctcccccgccacc

SEQ ID NO: 217376 - DNA, 15 bp, Homo sapiens
ctcccccgccacctg

SEQ ID NO: 217377 - DNA, 12 bp, Homo sapiens
ctccccctcaac

SEQ ID NO: 217378 - DNA, 13 bp, Homo sapiens
ctccccctcaacc

SEQ ID NO: 217379 - DNA, 19 bp, Homo sapiens
ctccccctcaacctcacca

SEQ ID NO: 217380 - DNA, 19 bp, Homo sapiens
ctcccccttgcccgccagc

SEQ ID NO: 217381 - DNA, 17 bp, Homo sapiens
ctccccgatccccgaca

SEQ ID NO: 217382 - DNA, 24 bp, Homo sapiens
ctccccgatccccgacagtggctc

SEQ ID NO: 217383 - DNA, 19 bp, Homo sapiens
ctccccgcccgccctcctc

SEQ ID NO: 217384 - DNA, 14 bp, Homo sapiens
ctccccgcctccac

SEQ ID NO: 217385 - DNA, 15 bp, Homo sapiens
ctccccgcctccact

SEQ ID NO: 217386 - DNA, 14 bp, Homo sapiens
ctccccgctctgga

SEQ ID NO: 217387 - DNA, 14 bp, Homo sapiens
ctccccgcttctgc

SEQ ID NO: 217388 - DNA, 14 bp, Homo sapiens
ctccccggccctac

SEQ ID NO: 217389 - DNA, 15 bp, Homo sapiens
ctccccgtagccact

SEQ ID NO: 217390 - DNA, 15 bp, Homo sapiens
ctcccctaatgcctg

SEQ ID NO: 217391 - DNA, 22 bp, Homo sapiens
ctcccctcacccgctgcccagc

SEQ ID NO: 217392 - DNA, 13 bp, Homo sapiens
ctcccctccaagt

SEQ ID NO: 217393 - DNA, 12 bp, Homo sapiens
ctcccctccaga

SEQ ID NO: 217394 - DNA, 13 bp, Homo sapiens
ctcccctccagac

SEQ ID NO: 217395 - DNA, 16 bp, Homo sapiens
ctcccctccagacccc

SEQ ID NO: 217396 - DNA, 20 bp, Homo sapiens
ctcccctccagacccctacc

SEQ ID NO: 217397 - DNA, 12 bp, Homo sapiens
ctcccctcccag

SEQ ID NO: 217398 - DNA, 16 bp, Homo sapiens
ctcccctcccctgggg

SEQ ID NO: 217399 - DNA, 15 bp, Homo sapiens
ctcccctcctcttcc

SEQ ID NO: 217400 - DNA, 19 bp, Homo sapiens
ctcccctccttgcctcctg

SEQ ID NO: 217401 - DNA, 22 bp, Homo sapiens
ctcccctctcgccccatccctg

SEQ ID NO: 217402 - DNA, 13 bp, Homo sapiens
ctcccctctgctg

SEQ ID NO: 217403 - DNA, 15 bp, Homo sapiens
ctcccctctgctggc

SEQ ID NO: 217404 - DNA, 13 bp, Homo sapiens
ctcccctcttcct

SEQ ID NO: 217405 - DNA, 15 bp, Homo sapiens
ctcccctgccccgtc

SEQ ID NO: 217406 - DNA, 12 bp, Homo sapiens
ctcccctgccct

SEQ ID NO: 217407 - DNA, 13 bp, Homo sapiens
ctcccctgccctg

SEQ ID NO: 217408 - DNA, 18 bp, Homo sapiens
ctcccctggagccagcag

SEQ ID NO: 217409 - DNA, 18 bp, Homo sapiens
ctccccttaaaatgtcta

SEQ ID NO: 217410 - DNA, 15 bp, Homo sapiens
ctccccttccctgca

SEQ ID NO: 217411 - DNA, 16 bp, Homo sapiens
ctccccttccctgcaa

SEQ ID NO: 217412 - DNA, 14 bp, Homo sapiens
ctccccttgagctg

SEQ ID NO: 217413 - DNA, 12 bp, Homo sapiens
ctccccttttcc

SEQ ID NO: 217414 - DNA, 15 bp, Homo sapiens
ctcccgaatcctgag

SEQ ID NO: 217415 - DNA, 18 bp, Homo sapiens
ctcccgcatgctgcctgc

SEQ ID NO: 217416 - DNA, 22 bp, Homo sapiens
ctcccgcatgctgcctgcctcc

SEQ ID NO: 217417 - DNA, 16 bp, Homo sapiens
ctcccgccacacgctc

SEQ ID NO: 217418 - DNA, 20 bp, Homo sapiens
ctcccgccgcctcgggccgc

SEQ ID NO: 217419 - DNA, 22 bp, Homo sapiens
ctcccgccgcctcgggccgcct

SEQ ID NO: 217420 - DNA, 18 bp, Homo sapiens
ctgctcccagcctcttgc

SEQ ID NO: 217421 - DNA, 15 bp, Homo sapiens
ctgctcccagcctgc

SEQ ID NO: 217422 - DNA, 18 bp, Homo sapiens
ctgctcccagcctgctga

SEQ ID NO: 217423 - DNA, 20 bp, Homo sapiens
ctgctccccacccctaccga

SEQ ID NO: 217424 - DNA, 17 bp, Homo sapiens
ctgctccccacccgcct

SEQ ID NO: 217425 - DNA, 14 bp, Homo sapiens
ctgctccgccagga

SEQ ID NO: 217426 - DNA, 16 bp, Homo sapiens
ctgctccgccaggaaa

SEQ ID NO: 217427 - DNA, 17 bp, Homo sapiens
ctgctccgtgtgtctca

SEQ ID NO: 217428 - DNA, 15 bp, Homo sapiens
ctgctcctcaccccc

SEQ ID NO: 217429 - DNA, 13 bp, Homo sapiens
ctgctcctcagga

SEQ ID NO: 217430 - DNA, 15 bp, Homo sapiens
ctgctcctcctgccc

SEQ ID NO: 217431 - DNA, 17 bp, Homo sapiens
ctgctcctcggccagag

SEQ ID NO: 217432 - DNA, 19 bp, Homo sapiens
ctgctcctggagcctttga

SEQ ID NO: 217433 - DNA, 20 bp, Homo sapiens
ctgctcctggagcctttgaa

SEQ ID NO: 217434 - DNA, 12 bp, Homo sapiens
ctgctccttggc

SEQ ID NO: 217435 - DNA, 18 bp, Homo sapiens
ctgctccttggcaccccc

SEQ ID NO: 217436 - DNA, 22 bp, Homo sapiens
ctgctccttggcacccccatgc

SEQ ID NO: 217437 - DNA, 13 bp, Homo sapiens
ctgctcgggaagg

SEQ ID NO: 217438 - DNA, 17 bp, Homo sapiens
ctgctcgggaaggcctg

SEQ ID NO: 217439 - DNA, 17 bp, Homo sapiens
ctgctctaagcacacgg

SEQ ID NO: 217440 - DNA, 19 bp, Homo sapiens
ctgctctacccatgagcct

SEQ ID NO: 217441 - DNA, 17 bp, Homo sapiens
ctgctctagccaggagt

SEQ ID NO: 217442 - DNA, 14 bp, Homo sapiens
ctgctctagctggc

SEQ ID NO: 217443 - DNA, 18 bp, Homo sapiens
ctgctctagctggcagga

SEQ ID NO: 217444 - DNA, 13 bp, Homo sapiens
ctgctctatatta

SEQ ID NO: 217445 - DNA, 18 bp, Homo sapiens
ctgctctccttcactctg

SEQ ID NO: 217446 - DNA, 16 bp, Homo sapiens
ctgctctctacccagc

SEQ ID NO: 217447 - DNA, 20 bp, Homo sapiens
ctgctctctacccagcccat

SEQ ID NO: 217448 - DNA, 22 bp, Homo sapiens
ctgctctctacccagcccatct

SEQ ID NO: 217449 - DNA, 19 bp, Homo sapiens
ctgctctgaacacgaagct

SEQ ID NO: 217450 - DNA, 23 bp, Homo sapiens
ctgctctgcagcccacagaggac

SEQ ID NO: 217451 - DNA, 18 bp, Homo sapiens
ctgctctgcccagagctg

SEQ ID NO: 217452 - DNA, 13 bp, Homo sapiens
ctgctctgcccct

SEQ ID NO: 217453 - DNA, 15 bp, Homo sapiens
ctgctctgtcttggt

SEQ ID NO: 217454 - DNA, 17 bp, Homo sapiens
ctgctctgtgcctggga

SEQ ID NO: 217455 - DNA, 18 bp, Homo sapiens
ctgctctgtgcctgggat

SEQ ID NO: 217456 - DNA, 15 bp, Homo sapiens
ctgctcttagtgccc

SEQ ID NO: 217457 - DNA, 22 bp, Homo sapiens
ctgctctttctacatgactggg

SEQ ID NO: 217458 - DNA, 16 bp, Homo sapiens
ctgctctttctctgcc

SEQ ID NO: 217459 - DNA, 19 bp, Homo sapiens
ctgctctttctctgccagt

SEQ ID NO: 217460 - DNA, 20 bp, Homo sapiens
ctgctctttctctgccagtg

SEQ ID NO: 217461 - DNA, 22 bp, Homo sapiens
ctgctctttctctgccagtgac

SEQ ID NO: 217462 - DNA, 17 bp, Homo sapiens
ctgctctttcttcttcc

SEQ ID NO: 217463 - DNA, 18 bp, Homo sapiens
ctgctcttttactaagac

SEQ ID NO: 217464 - DNA, 20 bp, Homo sapiens
ctgctgaaaaccatctggcc

SEQ ID NO: 217465 - DNA, 17 bp, Homo sapiens
ctgctgaaggaataaat

SEQ ID NO: 217466 - DNA, 14 bp, Homo sapiens
ctgctgagccactc

SEQ ID NO: 217467 - DNA, 19 bp, Homo sapiens
ctgctgagctctgacctgc

SEQ ID NO: 217468 - DNA, 19 bp, Homo sapiens
ctgctgagggaccttggag

SEQ ID NO: 217469 - DNA, 23 bp, Homo sapiens
ctgctgagggaccttggagagct

SEQ ID NO: 217470 - DNA, 14 bp, Homo sapiens
ctgctgagtgaatg

SEQ ID NO: 217471 - DNA, 13 bp, Homo sapiens
ctgctgatttcta

SEQ ID NO: 217472 - DNA, 16 bp, Homo sapiens
ctgctgcaccaacctc

SEQ ID NO: 217473 - DNA, 14 bp, Homo sapiens
ctgctgcaccagag

SEQ ID NO: 217474 - DNA, 16 bp, Homo sapiens
ctgctgcaccagagtg

SEQ ID NO: 217475 - DNA, 21 bp, Homo sapiens
ctgctgcaccagagtgaaagg

SEQ ID NO: 217476 - DNA, 18 bp, Homo sapiens
ctgctgccaccaaatctg

SEQ ID NO: 217477 - DNA, 21 bp, Homo sapiens
ctgctgccaccaaatctgtct

SEQ ID NO: 217478 - DNA, 23 bp, Homo sapiens
ctgctgccaccaaatctgtctag

SEQ ID NO: 217479 - DNA, 17 bp, Homo sapiens
ctgctgccatgattttg

SEQ ID NO: 217480 - DNA, 15 bp, Homo sapiens
ctgctgcccacggcc

SEQ ID NO: 217481 - DNA, 16 bp, Homo sapiens
ctgctgcccacggcca

SEQ ID NO: 217482 - DNA, 19 bp, Homo sapiens
ctgctgcccacggccaccc

SEQ ID NO: 217483 - DNA, 20 bp, Homo sapiens
ctgctgcccacggccaccca

SEQ ID NO: 217484 - DNA, 13 bp, Homo sapiens
ctgctgccccagc

SEQ ID NO: 217485 - DNA, 15 bp, Homo sapiens
ctgctgcccccagac

SEQ ID NO: 217486 - DNA, 21 bp, Homo sapiens
ctgctgcccccagaccccatc

SEQ ID NO: 217487 - DNA, 19 bp, Homo sapiens
ctgctgccgccactggctg

SEQ ID NO: 217488 - DNA, 15 bp, Homo sapiens
gtgccgtgagcaggc

SEQ ID NO: 217489 - DNA, 19 bp, Homo sapiens
gtgcctagttcctgtggcc

SEQ ID NO: 217490 - DNA, 22 bp, Homo sapiens
gtgcctcccaagctcagagcag

SEQ ID NO: 217491 - DNA, 16 bp, Homo sapiens
gtgcctccccccagac

SEQ ID NO: 217492 - DNA, 21 bp, Homo sapiens
gtgcctccccccagaccccgc

SEQ ID NO: 217493 - DNA, 15 bp, Homo sapiens
gtgcctcccttccca

SEQ ID NO: 217494 - DNA, 18 bp, Homo sapiens
gtgcctcccttcccagtg

SEQ ID NO: 217495 - DNA, 13 bp, Homo sapiens
gtgcctcctggcc

SEQ ID NO: 217496 - DNA, 22 bp, Homo sapiens
gtgcctccttccacctccctcc

SEQ ID NO: 217497 - DNA, 22 bp, Homo sapiens
gtgcctctggaggcctctgggc

SEQ ID NO: 217498 - DNA, 16 bp, Homo sapiens
gtgcctcttgggagac

SEQ ID NO: 217499 - DNA, 12 bp, Homo sapiens
gtgcctgagagt

SEQ ID NO: 217500 - DNA, 17 bp, Homo sapiens
gtgcctgcaccaggaga

SEQ ID NO: 217501 - DNA, 18 bp, Homo sapiens
gtgcctgcaccaggagac

SEQ ID NO: 217502 - DNA, 21 bp, Homo sapiens
gtgcctgcattcgcagcagct

SEQ ID NO: 217503 - DNA, 15 bp, Homo sapiens
gtgcctgcgttctga

SEQ ID NO: 217504 - DNA, 16 bp, Homo sapiens
gtgcctgctagagcaa

SEQ ID NO: 217505 - DNA, 18 bp, Homo sapiens
gtgcctgctagagcaacc

SEQ ID NO: 217506 - DNA, 16 bp, Homo sapiens
gtgcctgctatccagc

SEQ ID NO: 217507 - DNA, 17 bp, Homo sapiens
gtgcctgctatccagcc

SEQ ID NO: 217508 - DNA, 18 bp, Homo sapiens
gtgcctggagctcctggg

SEQ ID NO: 217509 - DNA, 14 bp, Homo sapiens
gtgcctggcaaggc

SEQ ID NO: 217510 - DNA, 23 bp, Homo sapiens
gtgcctgggaaccttcctgtctt

SEQ ID NO: 217511 - DNA, 11 bp, Homo sapiens
gtgcctgggat

SEQ ID NO: 217512 - DNA, 17 bp, Homo sapiens
gtgcctgtacaagctga

SEQ ID NO: 217513 - DNA, 17 bp, Homo sapiens
gtgcctgtcactactgg

SEQ ID NO: 217514 - DNA, 17 bp, Homo sapiens
gtgccttccataattat

SEQ ID NO: 217515 - DNA, 14 bp, Homo sapiens
gtgccttccccgtg

SEQ ID NO: 217516 - DNA, 21 bp, Homo sapiens
gtgccttggggacaagagcag

SEQ ID NO: 217517 - DNA, 18 bp, Homo sapiens
gtgcgcccctccccaccc

SEQ ID NO: 217518 - DNA, 19 bp, Homo sapiens
gtgcgctagagcattctgg

SEQ ID NO: 217519 - DNA, 18 bp, Homo sapiens
gtgcgctcttggtccctg

SEQ ID NO: 217520 - DNA, 22 bp, Homo sapiens
gtgcgctgacaaccaccgctcc

SEQ ID NO: 217521 - DNA, 13 bp, Homo sapiens
gtgcgctgtgctc

SEQ ID NO: 217522 - DNA, 18 bp, Homo sapiens
gtgcgctgtgctccagca

SEQ ID NO: 217523 - DNA, 17 bp, Homo sapiens
gtgcggaccggagcggc

SEQ ID NO: 217524 - DNA, 19 bp, Homo sapiens
gtgcggcccgtgcgcagcc

SEQ ID NO: 217525 - DNA, 21 bp, Homo sapiens
gtgcggcccgtgcgcagccgc

SEQ ID NO: 217526 - DNA, 20 bp, Homo sapiens
gtgcggcttttcagaagaaa

SEQ ID NO: 217527 - DNA, 18 bp, Homo sapiens
gtgcggtaggtgctggcc

SEQ ID NO: 217528 - DNA, 14 bp, Homo sapiens
gtgcgtgaaacaca

SEQ ID NO: 217529 - DNA, 22 bp, Homo sapiens
gtgcgtgaccggcccgccacct

SEQ ID NO: 217530 - DNA, 13 bp, Homo sapiens
gtgcgtgctgtct

SEQ ID NO: 217531 - DNA, 13 bp, Homo sapiens
gtgcgtggctgtg

SEQ ID NO: 217532 - DNA, 14 bp, Homo sapiens
gtgcgtgggtgaag

SEQ ID NO: 217533 - DNA, 12 bp, Homo sapiens
gtgcgtgtggcc

SEQ ID NO: 217534 - DNA, 13 bp, Homo sapiens
gtgcgtgtgtcca

SEQ ID NO: 217535 - DNA, 15 bp, Homo sapiens
gtgctaaaaggaata

SEQ ID NO: 217536 - DNA, 16 bp, Homo sapiens
gtgctaatttctgtcc

SEQ ID NO: 217537 - DNA, 16 bp, Homo sapiens
gtgctagggtgcctgc

SEQ ID NO: 217538 - DNA, 17 bp, Homo sapiens
gtgctagggtgcctgct

SEQ ID NO: 217539 - DNA, 21 bp, Homo sapiens
gtgctattttgtttgttttgt

SEQ ID NO: 217540 - DNA, 19 bp, Homo sapiens
gtgctcaaagatgtactga

SEQ ID NO: 217541 - DNA, 22 bp, Homo sapiens
gtgctcaaagatgtactgagag

SEQ ID NO: 217542 - DNA, 20 bp, Homo sapiens
gtgctcacccattgtctcat

SEQ ID NO: 217543 - DNA, 18 bp, Homo sapiens
gtgctcacgactcttcct

SEQ ID NO: 217544 - DNA, 20 bp, Homo sapiens
gtgctcacgactcttcctgc

SEQ ID NO: 217545 - DNA, 14 bp, Homo sapiens
gtgctcacgctccc

SEQ ID NO: 217546 - DNA, 17 bp, Homo sapiens
gtgctcacgctcccccg

SEQ ID NO: 217547 - DNA, 20 bp, Homo sapiens
gtgctcacgctcccccgcag

SEQ ID NO: 217548 - DNA, 21 bp, Homo sapiens
gtgctcacgctcccccgcagt

SEQ ID NO: 217549 - DNA, 14 bp, Homo sapiens
gtgctcagttccaa

SEQ ID NO: 217550 - DNA, 13 bp, Homo sapiens
ctgcttccaggta

SEQ ID NO: 217551 - DNA, 14 bp, Homo sapiens
ctgcttccatggct

SEQ ID NO: 217552 - DNA, 22 bp, Homo sapiens
ctgcttccatggcttcctgaga

SEQ ID NO: 217553 - DNA, 20 bp, Homo sapiens
ctgcttcccaaactcccagg

SEQ ID NO: 217554 - DNA, 20 bp, Homo sapiens
ctgcttcccacctccctgcc

SEQ ID NO: 217555 - DNA, 18 bp, Homo sapiens
ctgcttccctctgcctgt

SEQ ID NO: 217556 - DNA, 21 bp, Homo sapiens
ctgcttccctctgcctgtccc

SEQ ID NO: 217557 - DNA, 23 bp, Homo sapiens
ctgcttccctctgcctgtccctc

SEQ ID NO: 217558 - DNA, 13 bp, Homo sapiens
ctgcttcctaact

SEQ ID NO: 217559 - DNA, 21 bp, Homo sapiens
ctgcttctcggaggccaggcc

SEQ ID NO: 217560 - DNA, 23 bp, Homo sapiens
ctgcttctcggaggccaggccct

SEQ ID NO: 217561 - DNA, 22 bp, Homo sapiens
ctgcttctcttttcctcgcaga

SEQ ID NO: 217562 - DNA, 13 bp, Homo sapiens
ctgcttctgtgca

SEQ ID NO: 217563 - DNA, 16 bp, Homo sapiens
ctgcttcttccccagg

SEQ ID NO: 217564 - DNA, 18 bp, Homo sapiens
ctgcttgccgactggctg

SEQ ID NO: 217565 - DNA, 22 bp, Homo sapiens
ctgcttggacctcgtgctttaa

SEQ ID NO: 217566 - DNA, 18 bp, Homo sapiens
ctgcttggatccatacaa

SEQ ID NO: 217567 - DNA, 19 bp, Homo sapiens
ctgcttggggcctggcgtg

SEQ ID NO: 217568 - DNA, 18 bp, Homo sapiens
ctgcttgtactaagccag

SEQ ID NO: 217569 - DNA, 14 bp, Homo sapiens
ctgcttgtgcctcc

SEQ ID NO: 217570 - DNA, 19 bp, Homo sapiens
ctgcttgtgcctcccttcc

SEQ ID NO: 217571 - DNA, 18 bp, Homo sapiens
ctgcttgtgttgggcccc

SEQ ID NO: 217572 - DNA, 21 bp, Homo sapiens
ctgcttgtgttgggccccagg

SEQ ID NO: 217573 - DNA, 13 bp, Homo sapiens
ctgctttcaactt

SEQ ID NO: 217574 - DNA, 15 bp, Homo sapiens
ctgctttcaacttaa

SEQ ID NO: 217575 - DNA, 23 bp, Homo sapiens
ctgctttcaacttaaatcactga

SEQ ID NO: 217576 - DNA, 18 bp, Homo sapiens
ctgctttctctttcagta

SEQ ID NO: 217577 - DNA, 21 bp, Homo sapiens
ctgctttgactgagcagactg

SEQ ID NO: 217578 - DNA, 21 bp, Homo sapiens
ctgctttgggctgccctggtg

SEQ ID NO: 217579 - DNA, 17 bp, Homo sapiens
ctgctttgttaatgaaa

SEQ ID NO: 217580 - DNA, 19 bp, Homo sapiens
ctgctttgttaatgaaaat

SEQ ID NO: 217581 - DNA, 19 bp, Homo sapiens
ctgctttgttaccttaaaa

SEQ ID NO: 217582 - DNA, 17 bp, Homo sapiens
ctgcttttaggtcatcc

SEQ ID NO: 217583 - DNA, 14 bp, Homo sapiens
ctgcttttccagga

SEQ ID NO: 217584 - DNA, 16 bp, Homo sapiens
ctgcttttccaggatc

SEQ ID NO: 217585 - DNA, 19 bp, Homo sapiens
ctgcttttccaggatcctg

SEQ ID NO: 217586 - DNA, 20 bp, Homo sapiens
ctgcttttccaggatcctgc

SEQ ID NO: 217587 - DNA, 18 bp, Homo sapiens
ctgcttttgcaaacagaa

SEQ ID NO: 217588 - DNA, 23 bp, Homo sapiens
ctgcttttgtcactcggctttgg

SEQ ID NO: 217589 - DNA, 17 bp, Homo sapiens
ctgctttttggcacagt

SEQ ID NO: 217590 - DNA, 16 bp, Homo sapiens
ctggaaaacatagagt

SEQ ID NO: 217591 - DNA, 19 bp, Homo sapiens
ctggaaaacatagagtaga

SEQ ID NO: 217592 - DNA, 14 bp, Homo sapiens
ctggaaaacctcct

SEQ ID NO: 217593 - DNA, 15 bp, Homo sapiens
ctggaaaactcagga

SEQ ID NO: 217594 - DNA, 17 bp, Homo sapiens
ctggaaaactcaggatt

SEQ ID NO: 217595 - DNA, 20 bp, Homo sapiens
ctggaaacctgttatgccaa

SEQ ID NO: 217596 - DNA, 22 bp, Homo sapiens
ctggaaagaggagaaggagagg

SEQ ID NO: 217597 - DNA, 23 bp, Homo sapiens
ctggaaaggatgcttctgctcac

SEQ ID NO: 217598 - DNA, 19 bp, Homo sapiens
ctggaaaggggggagctgg

SEQ ID NO: 217599 - DNA, 17 bp, Homo sapiens
ctggaaattcttatttc

SEQ ID NO: 217600 - DNA, 16 bp, Homo sapiens
ctggaaattcttccct

SEQ ID NO: 217601 - DNA, 18 bp, Homo sapiens
ctggaaattcttccctgg

SEQ ID NO: 217602 - DNA, 22 bp, Homo sapiens
ctggaaccaatcccgtgaaaga

SEQ ID NO: 217603 - DNA, 13 bp, Homo sapiens
ctggaaccaggga

SEQ ID NO: 217604 - DNA, 17 bp, Homo sapiens
ctggaaccagggaggag

SEQ ID NO: 217605 - DNA, 19 bp, Homo sapiens
ctggaaccagggaggagag

SEQ ID NO: 217606 - DNA, 16 bp, Homo sapiens
ctggaacggtgaaggt

SEQ ID NO: 217607 - DNA, 19 bp, Homo sapiens
ctggaactctatctgggcc

SEQ ID NO: 217608 - DNA, 19 bp, Homo sapiens
ctggaagacgtggctctgg

SEQ ID NO: 217609 - DNA, 18 bp, Homo sapiens
ctggaagacttagatctg

SEQ ID NO: 217610 - DNA, 13 bp, Homo sapiens
ctggaagagctgg

SEQ ID NO: 217611 - DNA, 22 bp, Homo sapiens
ctggaagccggcggcccaagcc

SEQ ID NO: 217612 - DNA, 17 bp, Homo sapiens
ctggaaggagtgagagg

SEQ ID NO: 217613 - DNA, 13 bp, Homo sapiens
ctggaaggcaggg

SEQ ID NO: 217614 - DNA, 15 bp, Homo sapiens
ctggaaggcagggca

SEQ ID NO: 217615 - DNA, 19 bp, Homo sapiens
ctggaaggcagggcagagg

SEQ ID NO: 217616 - DNA, 14 bp, Homo sapiens
ctggaaggctggct

SEQ ID NO: 217617 - DNA, 18 bp, Homo sapiens
ctggaaggctggctgagt

SEQ ID NO: 217618 - DNA, 17 bp, Homo sapiens
ctggaagggtccggctt

SEQ ID NO: 217619 - DNA, 17 bp, Homo sapiens
ctggaagttttgcattt

SEQ ID NO: 217620 - DNA, 14 bp, Homo sapiens
ctggaatcccagct

SEQ ID NO: 217621 - DNA, 17 bp, Homo sapiens
ctggaatcccagctccg

SEQ ID NO: 217622 - DNA, 16 bp, Homo sapiens
ctggaatctactagaa

SEQ ID NO: 217623 - DNA, 13 bp, Homo sapiens
ctggaatgaagca

SEQ ID NO: 217624 - DNA, 16 bp, Homo sapiens
ctggaatgaagcatgt

SEQ ID NO: 217625 - DNA, 23 bp, Homo sapiens
gtggacacgcgtgattgaccctt

SEQ ID NO: 217626 - DNA, 14 bp, Homo sapiens
gtggacgagggagt

SEQ ID NO: 217627 - DNA, 15 bp, Homo sapiens
gtggactctgtgctc

SEQ ID NO: 217628 - DNA, 13 bp, Homo sapiens
gtggactgtgtcc

SEQ ID NO: 217629 - DNA, 22 bp, Homo sapiens
gtggactttatttaatttcata

SEQ ID NO: 217630 - DNA, 22 bp, Homo sapiens
gtggactttccaccccctccct

SEQ ID NO: 217631 - DNA, 16 bp, Homo sapiens
gtggagaatctgaggg

SEQ ID NO: 217632 - DNA, 12 bp, Homo sapiens
gtggagagctgg

SEQ ID NO: 217633 - DNA, 16 bp, Homo sapiens
gtggagagctggtgcc

SEQ ID NO: 217634 - DNA, 15 bp, Homo sapiens
gtggagagggaatgt

SEQ ID NO: 217635 - DNA, 14 bp, Homo sapiens
gtggagagtgagaa

SEQ ID NO: 217636 - DNA, 20 bp, Homo sapiens
gtggagatagtgccaggtgg

SEQ ID NO: 217637 - DNA, 15 bp, Homo sapiens
gtggagatgtcttcg

SEQ ID NO: 217638 - DNA, 16 bp, Homo sapiens
gtggagatgtcttcgt

SEQ ID NO: 217639 - DNA, 17 bp, Homo sapiens
gtggagatgtcttcgta

SEQ ID NO: 217640 - DNA, 18 bp, Homo sapiens
gtggagatgtcttcgtac

SEQ ID NO: 217641 - DNA, 19 bp, Homo sapiens
gtggagcaaaaggcagctc

SEQ ID NO: 217642 - DNA, 17 bp, Homo sapiens
gtggagcatgggcctgg

SEQ ID NO: 217643 - DNA, 16 bp, Homo sapiens
gtggaggaaggtgctg

SEQ ID NO: 217644 - DNA, 12 bp, Homo sapiens
gtggaggcctga

SEQ ID NO: 217645 - DNA, 13 bp, Homo sapiens
gtggaggcctgat

SEQ ID NO: 217646 - DNA, 13 bp, Homo sapiens
gtggaggggtcag

SEQ ID NO: 217647 - DNA, 21 bp, Homo sapiens
gtggaggttgagtgagccggg

SEQ ID NO: 217648 - DNA, 22 bp, Homo sapiens
gtggagtcaggcttctcttgct

SEQ ID NO: 217649 - DNA, 15 bp, Homo sapiens
gtggagtggggcagt

SEQ ID NO: 217650 - DNA, 12 bp, Homo sapiens
gtggatgaaaaa

SEQ ID NO: 217651 - DNA, 20 bp, Homo sapiens
gtggatgaaaaaaagggaaa

SEQ ID NO: 217652 - DNA, 12 bp, Homo sapiens
gtggatgctctt

SEQ ID NO: 217653 - DNA, 13 bp, Homo sapiens
gtggatgtcttcc

SEQ ID NO: 217654 - DNA, 16 bp, Homo sapiens
gtggatgtcttccttg

SEQ ID NO: 217655 - DNA, 19 bp, Homo sapiens
gtggatgtcttccttggag

SEQ ID NO: 217656 - DNA, 21 bp, Homo sapiens
gtggattcagcttctgttgga

SEQ ID NO: 217657 - DNA, 13 bp, Homo sapiens
gtggattgagggt

SEQ ID NO: 217658 - DNA, 14 bp, Homo sapiens
gtggcaaagtgctg

SEQ ID NO: 217659 - DNA, 22 bp, Homo sapiens
gtggcacagacttctggaaggc

SEQ ID NO: 217660 - DNA, 13 bp, Homo sapiens
gtggcacctcctg

SEQ ID NO: 217661 - DNA, 20 bp, Homo sapiens
gtggcacctcctgagaaggc

SEQ ID NO: 217662 - DNA, 17 bp, Homo sapiens
gtggcacgatctcagct

SEQ ID NO: 217663 - DNA, 23 bp, Homo sapiens
gtggcacttcgtggatgacctcc

SEQ ID NO: 217664 - DNA, 14 bp, Homo sapiens
gtggcagaaaagag

SEQ ID NO: 217665 - DNA, 24 bp, Homo sapiens
gtggcagaaaagaggagaccctgg

SEQ ID NO: 217666 - DNA, 21 bp, Homo sapiens
gtggcagaaatcccagttcat

SEQ ID NO: 217667 - DNA, 22 bp, Homo sapiens
gtggcagattttacaaaagatg

SEQ ID NO: 217668 - DNA, 13 bp, Homo sapiens
gtggcagccatgc

SEQ ID NO: 217669 - DNA, 16 bp, Homo sapiens
gtggcagccatgcctc

SEQ ID NO: 217670 - DNA, 14 bp, Homo sapiens
gtggcagctgggga

SEQ ID NO: 217671 - DNA, 21 bp, Homo sapiens
gtggcagctggggagcagctg

SEQ ID NO: 217672 - DNA, 21 bp, Homo sapiens
gtggcaggtgaccttctggga

SEQ ID NO: 217673 - DNA, 15 bp, Homo sapiens
gtggcagtggccagg

SEQ ID NO: 217674 - DNA, 17 bp, Homo sapiens
gtggcagtggccaggca

SEQ ID NO: 217675 - DNA, 19 bp, Homo sapiens
gtggcagtggccaggcagg

SEQ ID NO: 217676 - DNA, 18 bp, Homo sapiens
gtggcatctttgccttgg

SEQ ID NO: 217677 - DNA, 23 bp, Homo sapiens
gtggcatgtgggttgtgatattg

SEQ ID NO: 217678 - DNA, 22 bp, Homo sapiens
gtggcatgttcatcgtataaca

SEQ ID NO: 217679 - DNA, 19 bp, Homo sapiens
gtggcatttccgtggacag

SEQ ID NO: 217680 - DNA, 18 bp, Homo sapiens
ctggagcccggcagtgca

SEQ ID NO: 217681 - DNA, 23 bp, Homo sapiens
ctggagcctgagtcagggcccag

SEQ ID NO: 217682 - DNA, 19 bp, Homo sapiens
ctggagcgtttgctgtgcc

SEQ ID NO: 217683 - DNA, 20 bp, Homo sapiens
ctggagcgtttgctgtgcca

SEQ ID NO: 217684 - DNA, 23 bp, Homo sapiens
ctggagcgtttgctgtgccagga

SEQ ID NO: 217685 - DNA, 16 bp, Homo sapiens
ctggagctcctgggaa

SEQ ID NO: 217686 - DNA, 18 bp, Homo sapiens
ctggagctcctgggaagg

SEQ ID NO: 217687 - DNA, 11 bp, Homo sapiens
ctggagctggc

SEQ ID NO: 217688 - DNA, 14 bp, Homo sapiens
ctggaggaaaactg

SEQ ID NO: 217689 - DNA, 19 bp, Homo sapiens
ctggaggaaaactgagact

SEQ ID NO: 217690 - DNA, 23 bp, Homo sapiens
ctggaggaacttgctgctgtgcc

SEQ ID NO: 217691 - DNA, 22 bp, Homo sapiens
ctggaggaaggggggttgcagt

SEQ ID NO: 217692 - DNA, 21 bp, Homo sapiens
ctggaggcattcccagaggtg

SEQ ID NO: 217693 - DNA, 15 bp, Homo sapiens
ctggaggcctctggg

SEQ ID NO: 217694 - DNA, 22 bp, Homo sapiens
ctggaggcctctgggcctcctc

SEQ ID NO: 217695 - DNA, 15 bp, Homo sapiens
ctggaggggacgctg

SEQ ID NO: 217696 - DNA, 15 bp, Homo sapiens
ctggagtcaaaacac

SEQ ID NO: 217697 - DNA, 14 bp, Homo sapiens
ctggagtcagatga

SEQ ID NO: 217698 - DNA, 15 bp, Homo sapiens
ctggagtcctgttct

SEQ ID NO: 217699 - DNA, 17 bp, Homo sapiens
ctggagtcctgttctca

SEQ ID NO: 217700 - DNA, 23 bp, Homo sapiens
ctggagtcggatctagccatggc

SEQ ID NO: 217701 - DNA, 13 bp, Homo sapiens
ctggagtctgaag

SEQ ID NO: 217702 - DNA, 17 bp, Homo sapiens
ctggagtctgaaggaga

SEQ ID NO: 217703 - DNA, 18 bp, Homo sapiens
ctggagtctgaaggagag

SEQ ID NO: 217704 - DNA, 16 bp, Homo sapiens
ctggagtgagcactca

SEQ ID NO: 217705 - DNA, 13 bp, Homo sapiens
ctggagtgaggct

SEQ ID NO: 217706 - DNA, 16 bp, Homo sapiens
ctggagtgaggcttcc

SEQ ID NO: 217707 - DNA, 18 bp, Homo sapiens
ctggagtgaggcttccag

SEQ ID NO: 217708 - DNA, 19 bp, Homo sapiens
ctggagtgaggcttccagg

SEQ ID NO: 217709 - DNA, 21 bp, Homo sapiens
ctggagtgaggcttccaggct

SEQ ID NO: 217710 - DNA, 16 bp, Homo sapiens
ctggagtgctgcttgt

SEQ ID NO: 217711 - DNA, 13 bp, Homo sapiens
ctggagtgctggc

SEQ ID NO: 217712 - DNA, 15 bp, Homo sapiens
ctggagtgctggctc

SEQ ID NO: 217713 - DNA, 15 bp, Homo sapiens
ctggagttctggttc

SEQ ID NO: 217714 - DNA, 17 bp, Homo sapiens
ctggagttctggttcct

SEQ ID NO: 217715 - DNA, 20 bp, Homo sapiens
ctggataaaaaagaaaacat

SEQ ID NO: 217716 - DNA, 13 bp, Homo sapiens
ctggataattttg

SEQ ID NO: 217717 - DNA, 19 bp, Homo sapiens
ctggatatcgtcattttgc

SEQ ID NO: 217718 - DNA, 16 bp, Homo sapiens
ctggatattcatgaaa

SEQ ID NO: 217719 - DNA, 21 bp, Homo sapiens
ctggatattttcaaattgtat

SEQ ID NO: 217720 - DNA, 19 bp, Homo sapiens
ctggatccatcaggccact

SEQ ID NO: 217721 - DNA, 18 bp, Homo sapiens
ctggatcccctctgtcta

SEQ ID NO: 217722 - DNA, 13 bp, Homo sapiens
ctggatgagactt

SEQ ID NO: 217723 - DNA, 17 bp, Homo sapiens
ctggatgcacagatgcc

SEQ ID NO: 217724 - DNA, 18 bp, Homo sapiens
ctggatgcacagatgcca

SEQ ID NO: 217725 - DNA, 20 bp, Homo sapiens
ctggatgcacagatgccatg

SEQ ID NO: 217726 - DNA, 19 bp, Homo sapiens
ctggatgccaaggagcccc

SEQ ID NO: 217727 - DNA, 18 bp, Homo sapiens
ctggatggatctgctcca

SEQ ID NO: 217728 - DNA, 19 bp, Homo sapiens
ctggatggccgggctgctg

SEQ ID NO: 217729 - DNA, 21 bp, Homo sapiens
ctggatggccgggctgctgct

SEQ ID NO: 217730 - DNA, 21 bp, Homo sapiens
ctggatgggggtgcaggcagc

SEQ ID NO: 217731 - DNA, 19 bp, Homo sapiens
ctggatgtcccctgtccca

SEQ ID NO: 217732 - DNA, 12 bp, Homo sapiens
ctggattggcca

SEQ ID NO: 217733 - DNA, 12 bp, Homo sapiens
ctggatttaact

SEQ ID NO: 217734 - DNA, 19 bp, Homo sapiens
ctggatttgggagctctgc

SEQ ID NO: 217735 - DNA, 19 bp, Homo sapiens
ctggcaaacaccattattc

SEQ ID NO: 217736 - DNA, 22 bp, Homo sapiens
ctggcaacatagtgagatccca

SEQ ID NO: 217737 - DNA, 17 bp, Homo sapiens
ctggcaagcagggaaag

SEQ ID NO: 217738 - DNA, 21 bp, Homo sapiens
ctggcacagaaagggcagctt

SEQ ID NO: 217739 - DNA, 17 bp, Homo sapiens
ctggcacatttccccag

SEQ ID NO: 217740 - DNA, 17 bp, Homo sapiens
ctggcaccgccttctct

SEQ ID NO: 217741 - DNA, 16 bp, Homo sapiens
ctggcacgtcctccac

SEQ ID NO: 217742 - DNA, 18 bp, Homo sapiens
ctggcacgtcctccaccg

SEQ ID NO: 217743 - DNA, 17 bp, Homo sapiens
ctggcagaactgagctc

SEQ ID NO: 217744 - DNA, 14 bp, Homo sapiens
ctggcagagaagag

SEQ ID NO: 217745 - DNA, 19 bp, Homo sapiens
ctggcagaggggacagagt

SEQ ID NO: 217746 - DNA, 12 bp, Homo sapiens
ctggcagccagg

SEQ ID NO: 217747 - DNA, 18 bp, Homo sapiens
ctggcagccgtgccttca

SEQ ID NO: 217748 - DNA, 19 bp, Homo sapiens
ctggcagccgtgccttcag

SEQ ID NO: 217749 - DNA, 20 bp, Homo sapiens
ctggcagccgtgccttcagc

SEQ ID NO: 217750 - DNA, 16 bp, Homo sapiens
ctggcagctcctctcc

SEQ ID NO: 217751 - DNA, 18 bp, Homo sapiens
ctggcagctcctctcctt

SEQ ID NO: 217752 - DNA, 14 bp, Homo sapiens
ctggcagctctcca

SEQ ID NO: 217753 - DNA, 17 bp, Homo sapiens
ctggcagctctccagtc

SEQ ID NO: 217754 - DNA, 18 bp, Homo sapiens
ctggcagctctccagtca

SEQ ID NO: 217755 - DNA, 23 bp, Homo sapiens
ctggcaggacacatcccggcctc

SEQ ID NO: 217756 - DNA, 13 bp, Homo sapiens
ctggcaggagaca

SEQ ID NO: 217757 - DNA, 20 bp, Homo sapiens
ctggcaggagagagccttgg

SEQ ID NO: 217758 - DNA, 17 bp, Homo sapiens
ctggcagggaggtcagg

SEQ ID NO: 217759 - DNA, 21 bp, Homo sapiens
ctggcagggaggtcaggccct

SEQ ID NO: 217760 - DNA, 22 bp, Homo sapiens
ctggcagggaggtcaggccctg

SEQ ID NO: 217761 - DNA, 23 bp, Homo sapiens
ctggcagggaggtcaggccctgg

SEQ ID NO: 217762 - DNA, 18 bp, Homo sapiens
gtggggcccatggcccca

SEQ ID NO: 217763 - DNA, 19 bp, Homo sapiens
gtggggcccatggccccag

SEQ ID NO: 217764 - DNA, 15 bp, Homo sapiens
gtggggccccaaagc

SEQ ID NO: 217765 - DNA, 18 bp, Homo sapiens
gtggggctcgtggccttc

SEQ ID NO: 217766 - DNA, 20 bp, Homo sapiens
gtggggcttagaatggggct

SEQ ID NO: 217767 - DNA, 13 bp, Homo sapiens
gtggggcttggcg

SEQ ID NO: 217768 - DNA, 15 bp, Homo sapiens
gtggggcttggcgtg

SEQ ID NO: 217769 - DNA, 17 bp, Homo sapiens
gtggggcttggcgtgga

SEQ ID NO: 217770 - DNA, 20 bp, Homo sapiens
gtgggggagagcaggctggc

SEQ ID NO: 217771 - DNA, 13 bp, Homo sapiens
gtgggggcctgct

SEQ ID NO: 217772 - DNA, 19 bp, Homo sapiens
gtgggggtagagctgatcc

SEQ ID NO: 217773 - DNA, 21 bp, Homo sapiens
gtgggggtctgggaggcaggt

SEQ ID NO: 217774 - DNA, 19 bp, Homo sapiens
gtgggggttggctgggtac

SEQ ID NO: 217775 - DNA, 17 bp, Homo sapiens
gtggggtgaggaccact

SEQ ID NO: 217776 - DNA, 23 bp, Homo sapiens
gtggggtggagtcgcagaccaga

SEQ ID NO: 217777 - DNA, 19 bp, Homo sapiens
gtggggtgtgcatgccacg

SEQ ID NO: 217778 - DNA, 22 bp, Homo sapiens
gtggggtgtgttccaactgccc

SEQ ID NO: 217779 - DNA, 15 bp, Homo sapiens
gtgggtacagagagg

SEQ ID NO: 217780 - DNA, 18 bp, Homo sapiens
gtgggtcaactccaaggc

SEQ ID NO: 217781 - DNA, 19 bp, Homo sapiens
gtgggtcaactccaaggca

SEQ ID NO: 217782 - DNA, 14 bp, Homo sapiens
gtgggtcacctgac

SEQ ID NO: 217783 - DNA, 16 bp, Homo sapiens
gtgggtccaggaaggc

SEQ ID NO: 217784 - DNA, 21 bp, Homo sapiens
gtgggtccaggaaggcagctg

SEQ ID NO: 217785 - DNA, 22 bp, Homo sapiens
gtgggtccaggaaggcagctgc

SEQ ID NO: 217786 - DNA, 19 bp, Homo sapiens
gtgggtctatgttccccag

SEQ ID NO: 217787 - DNA, 17 bp, Homo sapiens
gtgggtcttcagggggc

SEQ ID NO: 217788 - DNA, 21 bp, Homo sapiens
gtgggtcttcagggggccagg

SEQ ID NO: 217789 - DNA, 16 bp, Homo sapiens
gtgggtgaccaggtcc

SEQ ID NO: 217790 - DNA, 19 bp, Homo sapiens
gtgggtggagtcaggcttc

SEQ ID NO: 217791 - DNA, 15 bp, Homo sapiens
gtgggtggggctgta

SEQ ID NO: 217792 - DNA, 15 bp, Homo sapiens
gtggtaactgccagc

SEQ ID NO: 217793 - DNA, 21 bp, Homo sapiens
gtggtactttattcttgctgg

SEQ ID NO: 217794 - DNA, 14 bp, Homo sapiens
gtggtagaagccag

SEQ ID NO: 217795 - DNA, 15 bp, Homo sapiens
gtggtagctctgagc

SEQ ID NO: 217796 - DNA, 18 bp, Homo sapiens
gtggtagctctgagccct

SEQ ID NO: 217797 - DNA, 22 bp, Homo sapiens
gtggtatagtattagtggaaag

SEQ ID NO: 217798 - DNA, 19 bp, Homo sapiens
gtggtatctttaattgtat

SEQ ID NO: 217799 - DNA, 21 bp, Homo sapiens
gtggtattggccgatgagctg

SEQ ID NO: 217800 - DNA, 23 bp, Homo sapiens
gtggtcacaggattctcttctca

SEQ ID NO: 217801 - DNA, 15 bp, Homo sapiens
gtggtcagggcaggg

SEQ ID NO: 217802 - DNA, 18 bp, Homo sapiens
gtggtccacattctgctg

SEQ ID NO: 217803 - DNA, 22 bp, Homo sapiens
gtggtccacattctgctgcccc

SEQ ID NO: 217804 - DNA, 20 bp, Homo sapiens
gtggtccctccactaggagt

SEQ ID NO: 217805 - DNA, 12 bp, Homo sapiens
gtggtcctgact

SEQ ID NO: 217806 - DNA, 20 bp, Homo sapiens
gtggtctcctctcagcttct

SEQ ID NO: 217807 - DNA, 23 bp, Homo sapiens
gtggtctgaatgttctgacatta

SEQ ID NO: 217808 - DNA, 16 bp, Homo sapiens
gtggtcttggagagga

SEQ ID NO: 217809 - DNA, 13 bp, Homo sapiens
ctggcccctcacc

SEQ ID NO: 217810 - DNA, 23 bp, Homo sapiens
ctggcccctccagaccctgcctg

SEQ ID NO: 217811 - DNA, 13 bp, Homo sapiens
ctggccctctgtg

SEQ ID NO: 217812 - DNA, 15 bp, Homo sapiens
ctggccctgccctcc

SEQ ID NO: 217813 - DNA, 16 bp, Homo sapiens
ctggccctgccctgag

SEQ ID NO: 217814 - DNA, 12 bp, Homo sapiens
ctggccctgttg

SEQ ID NO: 217815 - DNA, 16 bp, Homo sapiens
ctggcccttgcccaac

SEQ ID NO: 217816 - DNA, 16 bp, Homo sapiens
ctggccgggcacagct

SEQ ID NO: 217817 - DNA, 17 bp, Homo sapiens
ctggccggggcccctca

SEQ ID NO: 217818 - DNA, 18 bp, Homo sapiens
ctggccgggtcaccctgt

SEQ ID NO: 217819 - DNA, 20 bp, Homo sapiens
ctggccgggtcaccctgtga

SEQ ID NO: 217820 - DNA, 21 bp, Homo sapiens
ctggccgggtcaccctgtgac

SEQ ID NO: 217821 - DNA, 15 bp, Homo sapiens
ctggccggtccaccc

SEQ ID NO: 217822 - DNA, 14 bp, Homo sapiens
ctggcctatttaag

SEQ ID NO: 217823 - DNA, 17 bp, Homo sapiens
ctggcctcaagccatct

SEQ ID NO: 217824 - DNA, 18 bp, Homo sapiens
ctggcctcaagccatctt

SEQ ID NO: 217825 - DNA, 18 bp, Homo sapiens
ctggcctcactggctggg

SEQ ID NO: 217826 - DNA, 19 bp, Homo sapiens
ctggcctcactggctgggg

SEQ ID NO: 217827 - DNA, 18 bp, Homo sapiens
ctggcctcccaataaagc

SEQ ID NO: 217828 - DNA, 19 bp, Homo sapiens
ctggcctcggggcagggca

SEQ ID NO: 217829 - DNA, 14 bp, Homo sapiens
ctggcctcttcctc

SEQ ID NO: 217830 - DNA, 13 bp, Homo sapiens
ctggcctgagctg

SEQ ID NO: 217831 - DNA, 14 bp, Homo sapiens
ctggcctgagctgg

SEQ ID NO: 217832 - DNA, 13 bp, Homo sapiens
ctggcctgccagg

SEQ ID NO: 217833 - DNA, 12 bp, Homo sapiens
ctggcctgctgg

SEQ ID NO: 217834 - DNA, 15 bp, Homo sapiens
ctggcctgctgggaa

SEQ ID NO: 217835 - DNA, 14 bp, Homo sapiens
ctggcctggatctc

SEQ ID NO: 217836 - DNA, 21 bp, Homo sapiens
ctggcctggatctccccactc

SEQ ID NO: 217837 - DNA, 11 bp, Homo sapiens
ctggcctggcc

SEQ ID NO: 217838 - DNA, 15 bp, Homo sapiens
ctggcctggccctgc

SEQ ID NO: 217839 - DNA, 12 bp, Homo sapiens
ctggcctggctc

SEQ ID NO: 217840 - DNA, 13 bp, Homo sapiens
ctggcctggctcc

SEQ ID NO: 217841 - DNA, 23 bp, Homo sapiens
ctggcctgggtctccctggtggg

SEQ ID NO: 217842 - DNA, 16 bp, Homo sapiens
ctggcctggtccaggc

SEQ ID NO: 217843 - DNA, 17 bp, Homo sapiens
ctggccttggttcctcc

SEQ ID NO: 217844 - DNA, 22 bp, Homo sapiens
ctggccttggttcctccagcaa

SEQ ID NO: 217845 - DNA, 13 bp, Homo sapiens
ctggcgagccctt

SEQ ID NO: 217846 - DNA, 16 bp, Homo sapiens
ctggcgagcccttagc

SEQ ID NO: 217847 - DNA, 18 bp, Homo sapiens
ctggcgagcccttagcct

SEQ ID NO: 217848 - DNA, 15 bp, Homo sapiens
ctggcgcctccgagg

SEQ ID NO: 217849 - DNA, 14 bp, Homo sapiens
ctggcggaacctgg

SEQ ID NO: 217850 - DNA, 20 bp, Homo sapiens
ctggcggcttcctgtccact

SEQ ID NO: 217851 - DNA, 15 bp, Homo sapiens
ctggcgggcagcccc

SEQ ID NO: 217852 - DNA, 16 bp, Homo sapiens
ctggcgggcagcccct

SEQ ID NO: 217853 - DNA, 15 bp, Homo sapiens
ctggcgtctgtcttc

SEQ ID NO: 217854 - DNA, 19 bp, Homo sapiens
ctggcgtggggggagctct

SEQ ID NO: 217855 - DNA, 20 bp, Homo sapiens
ctggcgtggggggagctctg

SEQ ID NO: 217856 - DNA, 13 bp, Homo sapiens
ctggcgtgtgggt

SEQ ID NO: 217857 - DNA, 12 bp, Homo sapiens
ctggctacatcc

SEQ ID NO: 217858 - DNA, 22 bp, Homo sapiens
ctggctagaggccagccccacc

SEQ ID NO: 217859 - DNA, 13 bp, Homo sapiens
ctggctcacagcc

SEQ ID NO: 217860 - DNA, 17 bp, Homo sapiens
ctggctcacagccacca

SEQ ID NO: 217861 - DNA, 12 bp, Homo sapiens
ctggctcaggga

SEQ ID NO: 217862 - DNA, 13 bp, Homo sapiens
ctggctcagggat

SEQ ID NO: 217863 - DNA, 14 bp, Homo sapiens
ctggctcagggatc

SEQ ID NO: 217864 - DNA, 22 bp, Homo sapiens
ctggctcagggatcttctccct

SEQ ID NO: 217865 - DNA, 20 bp, Homo sapiens
ctggctcagggcccacctcc

SEQ ID NO: 217866 - DNA, 19 bp, Homo sapiens
ctggctcatattcctgcag

SEQ ID NO: 217867 - DNA, 21 bp, Homo sapiens
ctggctcatattcctgcagcc

SEQ ID NO: 217868 - DNA, 24 bp, Homo sapiens
ctggctcatattcctgcagcctgg

SEQ ID NO: 217869 - DNA, 18 bp, Homo sapiens
ctggctccacgccctggg

SEQ ID NO: 217870 - DNA, 23 bp, Homo sapiens
ctggctccacgccctggggagtg

SEQ ID NO: 217871 - DNA, 17 bp, Homo sapiens
ctggctccaggctccag

SEQ ID NO: 217872 - DNA, 19 bp, Homo sapiens
ctggctccaggctccaggc

SEQ ID NO: 217873 - DNA, 17 bp, Homo sapiens
ctggctcccaagggagg

SEQ ID NO: 217874 - DNA, 18 bp, Homo sapiens
ctggctcccaagggaggc

SEQ ID NO: 217875 - DNA, 22 bp, Homo sapiens
ctggctcccacaggcccttcct

SEQ ID NO: 217876 - DNA, 14 bp, Homo sapiens
ctggctcccaggac

SEQ ID NO: 217877 - DNA, 14 bp, Homo sapiens
ctggctccccaaag

SEQ ID NO: 217878 - DNA, 14 bp, Homo sapiens
ctggctcctgaggg

SEQ ID NO: 217879 - DNA, 15 bp, Homo sapiens
ctggctcctgagggg

SEQ ID NO: 217880 - DNA, 17 bp, Homo sapiens
ctggctcctgaggggca

SEQ ID NO: 217881 - DNA, 11 bp, Homo sapiens
ctggctcctgt

SEQ ID NO: 217882 - DNA, 17 bp, Homo sapiens
ctggctccttcagcagc

SEQ ID NO: 217883 - DNA, 14 bp, Homo sapiens
ctggctctccacct

SEQ ID NO: 217884 - DNA, 15 bp, Homo sapiens
ctggctctccacctt

SEQ ID NO: 217885 - DNA, 13 bp, Homo sapiens
ctggctctctcca

SEQ ID NO: 217886 - DNA, 14 bp, Homo sapiens
ctggctctctccag

SEQ ID NO: 217887 - DNA, 15 bp, Homo sapiens
ctggctgaaaatcac

SEQ ID NO: 217888 - DNA, 16 bp, Homo sapiens
ctggctgaaaatcact

SEQ ID NO: 217889 - DNA, 17 bp, Homo sapiens
ctggctgaaaatcacta

SEQ ID NO: 217890 - DNA, 21 bp, Homo sapiens
ctggctgaggcttgggcccag

SEQ ID NO: 217891 - DNA, 24 bp, Homo sapiens
ctggctgagtggaatgcagggaag

SEQ ID NO: 217892 - DNA, 22 bp, Homo sapiens
ctggctgcacagcccaaccagg

SEQ ID NO: 217893 - DNA, 18 bp, Homo sapiens
ctggctgccaggcgttgg

SEQ ID NO: 217894 - DNA, 17 bp, Homo sapiens
ctggctgcctggcccag

SEQ ID NO: 217895 - DNA, 18 bp, Homo sapiens
ctggctgcgaactgtgca

SEQ ID NO: 217896 - DNA, 12 bp, Homo sapiens
ctggctggcagg

SEQ ID NO: 217897 - DNA, 14 bp, Homo sapiens
ctggctggcaggtg

SEQ ID NO: 217898 - DNA, 15 bp, Homo sapiens
ctggctggcaggtgt

SEQ ID NO: 217899 - DNA, 20 bp, Homo sapiens
ctggctggggacttggccgc

SEQ ID NO: 217900 - DNA, 13 bp, Homo sapiens
ctggctggggcag

SEQ ID NO: 217901 - DNA, 20 bp, Homo sapiens
gtgtctctcccaccccggcc

SEQ ID NO: 217902 - DNA, 13 bp, Homo sapiens
gtgtctctgtata

SEQ ID NO: 217903 - DNA, 22 bp, Homo sapiens
gtgtctgaaccaccctggaaat

SEQ ID NO: 217904 - DNA, 16 bp, Homo sapiens
gtgtctgatgtgtgcc

SEQ ID NO: 217905 - DNA, 19 bp, Homo sapiens
gtgtctgatgtgtgcccag

SEQ ID NO: 217906 - DNA, 20 bp, Homo sapiens
gtgtctgcattgttattgtg

SEQ ID NO: 217907 - DNA, 22 bp, Homo sapiens
gtgtctggacattcagaacacc

SEQ ID NO: 217908 - DNA, 20 bp, Homo sapiens
gtgtctgtattcatacagca

SEQ ID NO: 217909 - DNA, 20 bp, Homo sapiens
gtgtctgtccatctgtctgt

SEQ ID NO: 217910 - DNA, 15 bp, Homo sapiens
gtgtctgtgccatgg

SEQ ID NO: 217911 - DNA, 20 bp, Homo sapiens
gtgtctgtttccttctcttt

SEQ ID NO: 217912 - DNA, 20 bp, Homo sapiens
gtgtcttacaaggcaggcct

SEQ ID NO: 217913 - DNA, 15 bp, Homo sapiens
gtgtcttccataatg

SEQ ID NO: 217914 - DNA, 21 bp, Homo sapiens
gtgtcttttgttctctcttgg

SEQ ID NO: 217915 - DNA, 19 bp, Homo sapiens
gtgtctttttttacttatg

SEQ ID NO: 217916 - DNA, 13 bp, Homo sapiens
gtgtgaagaaatg

SEQ ID NO: 217917 - DNA, 14 bp, Homo sapiens
gtgtgaatgctgta

SEQ ID NO: 217918 - DNA, 17 bp, Homo sapiens
gtgtgaatgctgtacct

SEQ ID NO: 217919 - DNA, 17 bp, Homo sapiens
gtgtgaattctgcaact

SEQ ID NO: 217920 - DNA, 15 bp, Homo sapiens
gtgtgacatcagtgg

SEQ ID NO: 217921 - DNA, 18 bp, Homo sapiens
gtgtgactttgaacacat

SEQ ID NO: 217922 - DNA, 18 bp, Homo sapiens
gtgtgaggagctgctggc

SEQ ID NO: 217923 - DNA, 13 bp, Homo sapiens
gtgtgagggcagc

SEQ ID NO: 217924 - DNA, 17 bp, Homo sapiens
gtgtgagtaagagctgg

SEQ ID NO: 217925 - DNA, 14 bp, Homo sapiens
gtgtgagtggcagc

SEQ ID NO: 217926 - DNA, 16 bp, Homo sapiens
gtgtgagtggcagcca

SEQ ID NO: 217927 - DNA, 18 bp, Homo sapiens
gtgtgagtggcagccatg

SEQ ID NO: 217928 - DNA, 17 bp, Homo sapiens
gtgtgagtgggaggaga

SEQ ID NO: 217929 - DNA, 23 bp, Homo sapiens
gtgtgagtgtgacgggggttggg

SEQ ID NO: 217930 - DNA, 14 bp, Homo sapiens
gtgtgagtgtgtgc

SEQ ID NO: 217931 - DNA, 14 bp, Homo sapiens
gtgtgcactccagc

SEQ ID NO: 217932 - DNA, 12 bp, Homo sapiens
gtgtgcagtggc

SEQ ID NO: 217933 - DNA, 17 bp, Homo sapiens
gtgtgccaccctctgca

SEQ ID NO: 217934 - DNA, 14 bp, Homo sapiens
gtgtgccctggctc

SEQ ID NO: 217935 - DNA, 19 bp, Homo sapiens
gtgtgcctgctatccagcc

SEQ ID NO: 217936 - DNA, 20 bp, Homo sapiens
gtgtggagagggaatgtgaa

SEQ ID NO: 217937 - DNA, 14 bp, Homo sapiens
gtgtggagaggggt

SEQ ID NO: 217938 - DNA, 12 bp, Homo sapiens
gtgtggagcacg

SEQ ID NO: 217939 - DNA, 13 bp, Homo sapiens
gtgtggagtggag

SEQ ID NO: 217940 - DNA, 23 bp, Homo sapiens
gtgtggccctgtgggagtccact

SEQ ID NO: 217941 - DNA, 16 bp, Homo sapiens
gttaggaaataaaacc

SEQ ID NO: 217942 - DNA, 21 bp, Homo sapiens
gttaggaaataaaacctttca

SEQ ID NO: 217943 - DNA, 19 bp, Homo sapiens
gttaggaataacactgcag

SEQ ID NO: 217944 - DNA, 15 bp, Homo sapiens
gttaggatttaacag

SEQ ID NO: 217945 - DNA, 21 bp, Homo sapiens
gttaggcccgggcccctggca

SEQ ID NO: 217946 - DNA, 22 bp, Homo sapiens
gttagtcatttgctgagcatgt

SEQ ID NO: 217947 - DNA, 15 bp, Homo sapiens
gttagtgggaagagc

SEQ ID NO: 217948 - DNA, 15 bp, Homo sapiens
gttagtgggcaggtg

SEQ ID NO: 217949 - DNA, 23 bp, Homo sapiens
gttagtgtctgtccatctgtctg

SEQ ID NO: 217950 - DNA, 19 bp, Homo sapiens
gttagttctgtgtgtctgg

SEQ ID NO: 217951 - DNA, 13 bp, Homo sapiens
gttataaaatctg

SEQ ID NO: 217952 - DNA, 21 bp, Homo sapiens
gttataaaatctgtattgcta

SEQ ID NO: 217953 - DNA, 12 bp, Homo sapiens
gttataaataaa

SEQ ID NO: 217954 - DNA, 22 bp, Homo sapiens
gttatactaggttaacatttgt

SEQ ID NO: 217955 - DNA, 15 bp, Homo sapiens
gttatagtatatctg

SEQ ID NO: 217956 - DNA, 12 bp, Homo sapiens
gttatataaaaa

SEQ ID NO: 217957 - DNA, 16 bp, Homo sapiens
gttatataaaaaaatt

SEQ ID NO: 217958 - DNA, 14 bp, Homo sapiens
gttatatcatcaat

SEQ ID NO: 217959 - DNA, 22 bp, Homo sapiens
gttatcagtacaattctttgtt

SEQ ID NO: 217960 - DNA, 14 bp, Homo sapiens
gttatccaactatt

SEQ ID NO: 217961 - DNA, 16 bp, Homo sapiens
gttatctgcctggcct

SEQ ID NO: 217962 - DNA, 17 bp, Homo sapiens
gttatgatggaaaggaa

SEQ ID NO: 217963 - DNA, 23 bp, Homo sapiens
gttatgcaagtcgccaggcagga

SEQ ID NO: 217964 - DNA, 17 bp, Homo sapiens
gttatgccaaacagttg

SEQ ID NO: 217965 - DNA, 23 bp, Homo sapiens
gttatggaaactgttgccagaga

SEQ ID NO: 217966 - DNA, 23 bp, Homo sapiens
gttatgtcagcagctctgagaca

SEQ ID NO: 217967 - DNA, 18 bp, Homo sapiens
gttatgtgtatgtgccat

SEQ ID NO: 217968 - DNA, 20 bp, Homo sapiens
gttatgtgtatgtgccattt

SEQ ID NO: 217969 - DNA, 17 bp, Homo sapiens
gttattagcaaggctgg

SEQ ID NO: 217970 - DNA, 22 bp, Homo sapiens
gttattcattctgtgatcattt

SEQ ID NO: 217971 - DNA, 13 bp, Homo sapiens
gttatttaaagaa

SEQ ID NO: 217972 - DNA, 14 bp, Homo sapiens
gttatttaagaatg

SEQ ID NO: 217973 - DNA, 14 bp, Homo sapiens
gttatttgtacagt

SEQ ID NO: 217974 - DNA, 18 bp, Homo sapiens
gttattttaggagacagt

SEQ ID NO: 217975 - DNA, 19 bp, Homo sapiens
gttattttaggagacagtc

SEQ ID NO: 217976 - DNA, 14 bp, Homo sapiens
gttattttattatt

SEQ ID NO: 217977 - DNA, 12 bp, Homo sapiens
gttattttcagt

SEQ ID NO: 217978 - DNA, 13 bp, Homo sapiens
gttatttttgtct

SEQ ID NO: 217979 - DNA, 22 bp, Homo sapiens
gttatttttgtttcttccaaag

SEQ ID NO: 217980 - DNA, 16 bp, Homo sapiens
gttattttttaattat

SEQ ID NO: 217981 - DNA, 13 bp, Homo sapiens
gttcaaaaagaaa

SEQ ID NO: 217982 - DNA, 15 bp, Homo sapiens
gttcaaaatgttaat

SEQ ID NO: 217983 - DNA, 17 bp, Homo sapiens
gttcaaagcaaccacct

SEQ ID NO: 217984 - DNA, 19 bp, Homo sapiens
gttcaaattcctgcaaaat

SEQ ID NO: 217985 - DNA, 22 bp, Homo sapiens
gttcaatctgtgaagcctttat

SEQ ID NO: 217986 - DNA, 22 bp, Homo sapiens
gttcaccgtagtaacacataaa

SEQ ID NO: 217987 - DNA, 22 bp, Homo sapiens
gttcaccttgaagaacctctca

SEQ ID NO: 217988 - DNA, 21 bp, Homo sapiens
gttcacgtaagatacaagttt

SEQ ID NO: 217989 - DNA, 11 bp, Homo sapiens
gttcacttccc

SEQ ID NO: 217990 - DNA, 23 bp, Homo sapiens
gttcacttcctagagcatctgtc

SEQ ID NO: 217991 - DNA, 17 bp, Homo sapiens
gttcagaaatgctgcct

SEQ ID NO: 217992 - DNA, 19 bp, Homo sapiens
gttcagaaatgctgcctgc

SEQ ID NO: 217993 - DNA, 12 bp, Homo sapiens
gttcagaagacc

SEQ ID NO: 217994 - DNA, 17 bp, Homo sapiens
gttcagagactggcagc

SEQ ID NO: 217995 - DNA, 20 bp, Homo sapiens
gttcagagactggcagccag

SEQ ID NO: 217996 - DNA, 14 bp, Homo sapiens
gttcagatgtgcat

SEQ ID NO: 217997 - DNA, 16 bp, Homo sapiens
gttcagcactgtccct

SEQ ID NO: 217998 - DNA, 21 bp, Homo sapiens
gttcaggatttggtttttctc

SEQ ID NO: 217999 - DNA, 19 bp, Homo sapiens
gttcaggggactcagccct

SEQ ID NO: 218000 - DNA, 22 bp, Homo sapiens
gttcagtaacagggccttgcta

SEQ ID NO: 218001 - DNA, 13 bp, Homo sapiens
gttcagtctttca

SEQ ID NO: 218002 - DNA, 18 bp, Homo sapiens
gttcagttccagcttttg

SEQ ID NO: 218003 - DNA, 23 bp, Homo sapiens
gttcataaatttgttgtcatgtg

SEQ ID NO: 218004 - DNA, 18 bp, Homo sapiens
gttcatagggtctcttca

SEQ ID NO: 218005 - DNA, 15 bp, Homo sapiens
gttcatagtttctgt

SEQ ID NO: 218006 - DNA, 20 bp, Homo sapiens
gttcatagtttctgtaattg

SEQ ID NO: 218007 - DNA, 21 bp, Homo sapiens
gttcatcagtgttaaaaaatt

SEQ ID NO: 218008 - DNA, 22 bp, Homo sapiens
gttcatcatgagccgttgctaa

SEQ ID NO: 218009 - DNA, 19 bp, Homo sapiens
gttcatccaatcctcactg

SEQ ID NO: 218010 - DNA, 20 bp, Homo sapiens
gttcatccaatcctcactgg

SEQ ID NO: 218011 - DNA, 22 bp, Homo sapiens
gttcatccaatcctcactgggt

SEQ ID NO: 218012 - DNA, 17 bp, Homo sapiens
gttcatcctattgttga

SEQ ID NO: 218013 - DNA, 18 bp, Homo sapiens
gttcatctgaggagtcca

SEQ ID NO: 218014 - DNA, 13 bp, Homo sapiens
gttcatcttgaat

SEQ ID NO: 218015 - DNA, 16 bp, Homo sapiens
gttcatggtgatcagt

SEQ ID NO: 218016 - DNA, 19 bp, Homo sapiens
gttcatgttttgctaatgc

SEQ ID NO: 218017 - DNA, 22 bp, Homo sapiens
gttcattattggaattaacctg

SEQ ID NO: 218018 - DNA, 20 bp, Homo sapiens
gttcattccgaaaaaaaaat

SEQ ID NO: 218019 - DNA, 20 bp, Homo sapiens
gttcattctatgacaataaa

SEQ ID NO: 218020 - DNA, 20 bp, Homo sapiens
gttcattgtaatgttactga

SEQ ID NO: 218021 - DNA, 12 bp, Homo sapiens
gttcattttagt

SEQ ID NO: 218022 - DNA, 11 bp, Homo sapiens
gttccaagtgt

SEQ ID NO: 218023 - DNA, 20 bp, Homo sapiens
gttccaatgtgcccagtcat

SEQ ID NO: 218024 - DNA, 14 bp, Homo sapiens
gttccactggagaa

SEQ ID NO: 218025 - DNA, 17 bp, Homo sapiens
gttccagaacagccctc

SEQ ID NO: 218026 - DNA, 21 bp, Homo sapiens
gttccagaacagccctcggcc

SEQ ID NO: 218027 - DNA, 19 bp, Homo sapiens
gttccagacagagtggatc

SEQ ID NO: 218028 - DNA, 12 bp, Homo sapiens
gttccagacagg

SEQ ID NO: 218029 - DNA, 18 bp, Homo sapiens
gttccagactcaggttcc

SEQ ID NO: 218030 - DNA, 16 bp, Homo sapiens
gttccagctctttgaa

SEQ ID NO: 218031 - DNA, 11 bp, Homo sapiens
gttccagctga

SEQ ID NO: 218032 - DNA, 20 bp, Homo sapiens
gttccagggactgtacctgt

SEQ ID NO: 218033 - DNA, 17 bp, Homo sapiens
gttccatccaccacctt

SEQ ID NO: 218034 - DNA, 21 bp, Homo sapiens
gttccatcctgtacaagtgct

SEQ ID NO: 218035 - DNA, 15 bp, Homo sapiens
gttccatgcctgagg

SEQ ID NO: 218036 - DNA, 18 bp, Homo sapiens
gttcccaataaaagtgac

SEQ ID NO: 218037 - DNA, 19 bp, Homo sapiens
gttcccactgccctgggca

SEQ ID NO: 218038 - DNA, 21 bp, Homo sapiens
gttcccagtgacacttcagag

SEQ ID NO: 218039 - DNA, 16 bp, Homo sapiens
gttcccatttgctcct

SEQ ID NO: 218040 - DNA, 20 bp, Homo sapiens
gttcccatttgctcctttct

SEQ ID NO: 218041 - DNA, 20 bp, Homo sapiens
gttcccccagccctgtggaa

SEQ ID NO: 218042 - DNA, 18 bp, Homo sapiens
aaagggagctatcaggaa

SEQ ID NO: 218043 - DNA, 17 bp, Homo sapiens
aaaggggagaaactgaa

SEQ ID NO: 218044 - DNA, 19 bp, Homo sapiens
aaaggggagttgagtcaca

SEQ ID NO: 218045 - DNA, 14 bp, Homo sapiens
aaaggggggagggg

SEQ ID NO: 218046 - DNA, 18 bp, Homo sapiens
aaaggggggagggggagg

SEQ ID NO: 218047 - DNA, 23 bp, Homo sapiens
aaagggtctgataaacacagagg

SEQ ID NO: 218048 - DNA, 18 bp, Homo sapiens
aaagggtgctgcttccct

SEQ ID NO: 218049 - DNA, 17 bp, Homo sapiens
aaagggtgtgggtcagg

SEQ ID NO: 218050 - DNA, 18 bp, Homo sapiens
aaaggtattttgaatacc

SEQ ID NO: 218051 - DNA, 17 bp, Homo sapiens
aaaggtcattgtggcta

SEQ ID NO: 218052 - DNA, 19 bp, Homo sapiens
aaaggtcattgtggctatc

SEQ ID NO: 218053 - DNA, 18 bp, Homo sapiens
aaaggtcccaaggcaagg

SEQ ID NO: 218054 - DNA, 16 bp, Homo sapiens
aaaggtgaaacacaca

SEQ ID NO: 218055 - DNA, 14 bp, Homo sapiens
aaaggtgatatcca

SEQ ID NO: 218056 - DNA, 12 bp, Homo sapiens
aaaggtgattaa

SEQ ID NO: 218057 - DNA, 13 bp, Homo sapiens
aaaggtgctcaaa

SEQ ID NO: 218058 - DNA, 17 bp, Homo sapiens
aaaggttaacagtaaaa

SEQ ID NO: 218059 - DNA, 15 bp, Homo sapiens
aaaggttaagccata

SEQ ID NO: 218060 - DNA, 15 bp, Homo sapiens
aaaggttgaattaat

SEQ ID NO: 218061 - DNA, 23 bp, Homo sapiens
aaagtaaaacagatttgttcatt

SEQ ID NO: 218062 - DNA, 12 bp, Homo sapiens
aaagtaaagcta

SEQ ID NO: 218063 - DNA, 20 bp, Homo sapiens
aaagtaaatgctacctctga

SEQ ID NO: 218064 - DNA, 22 bp, Homo sapiens
aaagtaagtggagcatttggaa

SEQ ID NO: 218065 - DNA, 12 bp, Homo sapiens
aaagtacattta

SEQ ID NO: 218066 - DNA, 15 bp, Homo sapiens
aaagtacatttaata

SEQ ID NO: 218067 - DNA, 20 bp, Homo sapiens
aaagtaccaactgagccaaa

SEQ ID NO: 218068 - DNA, 17 bp, Homo sapiens
aaagtactactgtagaa

SEQ ID NO: 218069 - DNA, 15 bp, Homo sapiens
aaagtagagaagtat

SEQ ID NO: 218070 - DNA, 20 bp, Homo sapiens
aaagtagagaagtatccaat

SEQ ID NO: 218071 - DNA, 11 bp, Homo sapiens
gttgcctcctc

SEQ ID NO: 218072 - DNA, 22 bp, Homo sapiens
gttgcctcctctctccctgcct

SEQ ID NO: 218073 - DNA, 20 bp, Homo sapiens
gttgcgacggagagaaaaaa

SEQ ID NO: 218074 - DNA, 22 bp, Homo sapiens
gttgcgtgtctgtttccttctc

SEQ ID NO: 218075 - DNA, 22 bp, Homo sapiens
gttgctaagaagcgagcactga

SEQ ID NO: 218076 - DNA, 18 bp, Homo sapiens
gttgctcaaaaaatgagc

SEQ ID NO: 218077 - DNA, 15 bp, Homo sapiens
gttgctcagaagaga

SEQ ID NO: 218078 - DNA, 23 bp, Homo sapiens
gttgctgatgaactcttaatcaa

SEQ ID NO: 218079 - DNA, 22 bp, Homo sapiens
gttgctgggcctcattctagca

SEQ ID NO: 218080 - DNA, 21 bp, Homo sapiens
gttgctgtgccccatcagcag

SEQ ID NO: 218081 - DNA, 17 bp, Homo sapiens
gttgcttaatctagagc

SEQ ID NO: 218082 - DNA, 23 bp, Homo sapiens
gttgcttagatgagggtgactgt

SEQ ID NO: 218083 - DNA, 17 bp, Homo sapiens
gttgctttctgactgat

SEQ ID NO: 218084 - DNA, 23 bp, Homo sapiens
gttgctttttcactgtttcctat

SEQ ID NO: 218085 - DNA, 18 bp, Homo sapiens
gttggaactgctgccatg

SEQ ID NO: 218086 - DNA, 14 bp, Homo sapiens
gttggaccccagag

SEQ ID NO: 218087 - DNA, 16 bp, Homo sapiens
gttggactctcaggga

SEQ ID NO: 218088 - DNA, 14 bp, Homo sapiens
gttggactgtggcc

SEQ ID NO: 218089 - DNA, 17 bp, Homo sapiens
gttggactgtggcctca

SEQ ID NO: 218090 - DNA, 12 bp, Homo sapiens
gttggagccact

SEQ ID NO: 218091 - DNA, 21 bp, Homo sapiens
gttggagccactcctgtcccg

SEQ ID NO: 218092 - DNA, 16 bp, Homo sapiens
gttggagcctgcaggg

SEQ ID NO: 218093 - DNA, 13 bp, Homo sapiens
gttggaggcctgg

SEQ ID NO: 218094 - DNA, 19 bp, Homo sapiens
gttggaggcctggtctgga

SEQ ID NO: 218095 - DNA, 18 bp, Homo sapiens
gttggagtactatattta

SEQ ID NO: 218096 - DNA, 14 bp, Homo sapiens
gttggcagagaagg

SEQ ID NO: 218097 - DNA, 15 bp, Homo sapiens
gttggccaggctggt

SEQ ID NO: 218098 - DNA, 22 bp, Homo sapiens
gttggcccttccagtgggatta

SEQ ID NO: 218099 - DNA, 15 bp, Homo sapiens
gttggccggctggcc

SEQ ID NO: 218100 - DNA, 13 bp, Homo sapiens
gttggcctccggc

SEQ ID NO: 218101 - DNA, 18 bp, Homo sapiens
gttggcctgtcagagctt

SEQ ID NO: 218102 - DNA, 21 bp, Homo sapiens
gttggctagaagaaagtaaaa

SEQ ID NO: 218103 - DNA, 12 bp, Homo sapiens
gttggctgctcc

SEQ ID NO: 218104 - DNA, 14 bp, Homo sapiens
gttggctgggccca

SEQ ID NO: 218105 - DNA, 11 bp, Homo sapiens
gttggctgggt

SEQ ID NO: 218106 - DNA, 17 bp, Homo sapiens
gttggctgttccagact

SEQ ID NO: 218107 - DNA, 18 bp, Homo sapiens
gttgggaaaaactggctt

SEQ ID NO: 218108 - DNA, 16 bp, Homo sapiens
gttgggacctgctgct

SEQ ID NO: 218109 - DNA, 15 bp, Homo sapiens
gttgggcccagatct

SEQ ID NO: 218110 - DNA, 13 bp, Homo sapiens
gttgggttccaga

SEQ ID NO: 218111 - DNA, 19 bp, Homo sapiens
gttgggttccagacagagt

SEQ ID NO: 218112 - DNA, 11 bp, Homo sapiens
gttggtgactg

SEQ ID NO: 218113 - DNA, 16 bp, Homo sapiens
gttggtggtgcagccc

SEQ ID NO: 218114 - DNA, 17 bp, Homo sapiens
gttgtacatagtggtca

SEQ ID NO: 218115 - DNA, 21 bp, Homo sapiens
gttgtaccactgctaataaat

SEQ ID NO: 218116 - DNA, 22 bp, Homo sapiens
gttgtcaagtctctgctggccc

SEQ ID NO: 218117 - DNA, 19 bp, Homo sapiens
gttgtcaatattaaataca

SEQ ID NO: 218118 - DNA, 15 bp, Homo sapiens
gttgtcatgtgtatg

SEQ ID NO: 218119 - DNA, 15 bp, Homo sapiens
gttgtcattgcttta

SEQ ID NO: 218120 - DNA, 15 bp, Homo sapiens
gttgtctaaaaataa

SEQ ID NO: 218121 - DNA, 18 bp, Homo sapiens
gttgtctattctgagcct

SEQ ID NO: 218122 - DNA, 22 bp, Homo sapiens
gttgtctgaagtcactgcacag

SEQ ID NO: 218123 - DNA, 22 bp, Homo sapiens
gttgtctttctttgctgctgtg

SEQ ID NO: 218124 - DNA, 19 bp, Homo sapiens
gttgtgaaccaactgcctt

SEQ ID NO: 218125 - DNA, 17 bp, Homo sapiens
gttgtgaagatgtttgc

SEQ ID NO: 218126 - DNA, 21 bp, Homo sapiens
gttgtgatagctaacatttta

SEQ ID NO: 218127 - DNA, 18 bp, Homo sapiens
gttgtgattccccggagc

SEQ ID NO: 218128 - DNA, 14 bp, Homo sapiens
gttgtgcagtgtgc

SEQ ID NO: 218129 - DNA, 16 bp, Homo sapiens
gttgtgctaatttctg

SEQ ID NO: 218130 - DNA, 20 bp, Homo sapiens
gttgtggcccccgccccctc

SEQ ID NO: 218131 - DNA, 22 bp, Homo sapiens
gttgtggcccccgccccctccc

SEQ ID NO: 218132 - DNA, 12 bp, Homo sapiens
gttgtgggcttt

SEQ ID NO: 218133 - DNA, 14 bp, Homo sapiens
gttgtggttaatct

SEQ ID NO: 218134 - DNA, 14 bp, Homo sapiens
gttgtgtaagagaa

SEQ ID NO: 218135 - DNA, 14 bp, Homo sapiens
gttgtgtatagatg

SEQ ID NO: 218136 - DNA, 19 bp, Homo sapiens
gttgttaatactatattgc

SEQ ID NO: 218137 - DNA, 19 bp, Homo sapiens
gttgttaatgaaaatgtca

SEQ ID NO: 218138 - DNA, 16 bp, Homo sapiens
gttgttcagaagttgt

SEQ ID NO: 218139 - DNA, 23 bp, Homo sapiens
gttgttgccaggttgcagctgct

SEQ ID NO: 218140 - DNA, 16 bp, Homo sapiens
gttgttgttttacatc

SEQ ID NO: 218141 - DNA, 21 bp, Homo sapiens
gttgtttcttttatgtggtgg

SEQ ID NO: 218142 - DNA, 15 bp, Homo sapiens
gttgtttgtaaataa

SEQ ID NO: 218143 - DNA, 20 bp, Homo sapiens
gttgtttgtaaataagagat

SEQ ID NO: 218144 - DNA, 19 bp, Homo sapiens
gttgtttttaagtcctgta

SEQ ID NO: 218145 - DNA, 22 bp, Homo sapiens
gttgttttttcatagtgccttt

SEQ ID NO: 218146 - DNA, 14 bp, Homo sapiens
gtttaaaaaaataa

SEQ ID NO: 218147 - DNA, 19 bp, Homo sapiens
gtttaaaaaaataacatct

SEQ ID NO: 218148 - DNA, 16 bp, Homo sapiens
gtttaaagaataaagt

SEQ ID NO: 218149 - DNA, 15 bp, Homo sapiens
gtttaaagagaggtt

SEQ ID NO: 218150 - DNA, 23 bp, Homo sapiens
gtttaaataaagtatcatgcatt

SEQ ID NO: 218151 - DNA, 19 bp, Homo sapiens
gtttaaataccagtacttg

SEQ ID NO: 218152 - DNA, 14 bp, Homo sapiens
gtttaacaaatcta

SEQ ID NO: 218153 - DNA, 13 bp, Homo sapiens
gtttaatatctga

SEQ ID NO: 218154 - DNA, 16 bp, Homo sapiens
gtttacaagtgtatat

SEQ ID NO: 218155 - DNA, 16 bp, Homo sapiens
gtttacactctttgta

SEQ ID NO: 218156 - DNA, 19 bp, Homo sapiens
gtttacagtaaataaattg

SEQ ID NO: 218157 - DNA, 11 bp, Homo sapiens
gtttacatgta

SEQ ID NO: 218158 - DNA, 17 bp, Homo sapiens
gtttaccctccctgtcc

SEQ ID NO: 218159 - DNA, 18 bp, Homo sapiens
gtttaccctccctgtccc

SEQ ID NO: 218160 - DNA, 17 bp, Homo sapiens
gtttacctcactggtgc

SEQ ID NO: 218161 - DNA, 21 bp, Homo sapiens
gtttacctcactggtgcattt

SEQ ID NO: 218162 - DNA, 15 bp, Homo sapiens
gtttacctggggatc

SEQ ID NO: 218163 - DNA, 14 bp, Homo sapiens
gtttactgaaattt

SEQ ID NO: 218164 - DNA, 19 bp, Homo sapiens
gtttactgctgtcattgtc

SEQ ID NO: 218165 - DNA, 19 bp, Homo sapiens
gtttacttggtgaggagga

SEQ ID NO: 218166 - DNA, 14 bp, Homo sapiens
gtttagaaataaat

SEQ ID NO: 218167 - DNA, 17 bp, Homo sapiens
gtttagaaattacaagt

SEQ ID NO: 218168 - DNA, 22 bp, Homo sapiens
gtttagaaattacaagtttcag

SEQ ID NO: 218169 - DNA, 14 bp, Homo sapiens
gtttagaagctgag

SEQ ID NO: 218170 - DNA, 15 bp, Homo sapiens
gtttagaagctgaga

SEQ ID NO: 218171 - DNA, 15 bp, Homo sapiens
gtttagaatgtcagt

SEQ ID NO: 218172 - DNA, 15 bp, Homo sapiens
gtttagcttcctcca

SEQ ID NO: 218173 - DNA, 23 bp, Homo sapiens
gtttagcttcctccagaggaggg

SEQ ID NO: 218174 - DNA, 18 bp, Homo sapiens
gtttagtaactgtttttt

SEQ ID NO: 218175 - DNA, 20 bp, Homo sapiens
gtttagtttctagaggcctc

SEQ ID NO: 218176 - DNA, 22 bp, Homo sapiens
gtttatatacagtacacagata

SEQ ID NO: 218177 - DNA, 23 bp, Homo sapiens
gtttatatactgggttcttgttt

SEQ ID NO: 218178 - DNA, 13 bp, Homo sapiens
gtttatgagccag

SEQ ID NO: 218179 - DNA, 16 bp, Homo sapiens
gtttatggcagaaggg

SEQ ID NO: 218180 - DNA, 22 bp, Homo sapiens
gtttatggtattttcgtgcatt

SEQ ID NO: 218181 - DNA, 13 bp, Homo sapiens
gtttattgtcaaa

SEQ ID NO: 218182 - DNA, 16 bp, Homo sapiens
gtttatttatcagtga

SEQ ID NO: 218183 - DNA, 19 bp, Homo sapiens
gtttatttatcagtgacag

SEQ ID NO: 218184 - DNA, 12 bp, Homo sapiens
gtttatttccaa

SEQ ID NO: 218185 - DNA, 19 bp, Homo sapiens
gtttatttctgtttctcat

SEQ ID NO: 218186 - DNA, 18 bp, Homo sapiens
gtttatttttcatattgt

SEQ ID NO: 218187 - DNA, 12 bp, Homo sapiens
gtttcaaaagtg

SEQ ID NO: 218188 - DNA, 13 bp, Homo sapiens
gtttcaatgtgat

SEQ ID NO: 218189 - DNA, 17 bp, Homo sapiens
ctggtcccttgcagcta

SEQ ID NO: 218190 - DNA, 19 bp, Homo sapiens
ctggtcctggccgtcccta

SEQ ID NO: 218191 - DNA, 17 bp, Homo sapiens
ctggtccttctgacccc

SEQ ID NO: 218192 - DNA, 19 bp, Homo sapiens
ctggtccttctgaccccac

SEQ ID NO: 218193 - DNA, 14 bp, Homo sapiens
ctggtctcagagga

SEQ ID NO: 218194 - DNA, 12 bp, Homo sapiens
ctggtctggagc

SEQ ID NO: 218195 - DNA, 16 bp, Homo sapiens
ctggtctggagcccct

SEQ ID NO: 218196 - DNA, 20 bp, Homo sapiens
ctggtctggagcccctatcc

SEQ ID NO: 218197 - DNA, 14 bp, Homo sapiens
ctggtcttgagatg

SEQ ID NO: 218198 - DNA, 15 bp, Homo sapiens
ctggtgacaggcaga

SEQ ID NO: 218199 - DNA, 23 bp, Homo sapiens
ctggtgacaggcagacacatgct

SEQ ID NO: 218200 - DNA, 22 bp, Homo sapiens
ctggtgagatacccagagagaa

SEQ ID NO: 218201 - DNA, 19 bp, Homo sapiens
taaaatactattggacaga

SEQ ID NO: 218202 - DNA, 21 bp, Homo sapiens
taaaatactattggacagaca

SEQ ID NO: 218203 - DNA, 22 bp, Homo sapiens
taaaatactattggacagacac

SEQ ID NO: 218204 - DNA, 23 bp, Homo sapiens
taaaatactctagcctgggccag

SEQ ID NO: 218205 - DNA, 13 bp, Homo sapiens
taaaatacttctt

SEQ ID NO: 218206 - DNA, 14 bp, Homo sapiens
ctgtctcagcctcc

SEQ ID NO: 218207 - DNA, 16 bp, Homo sapiens
ctgtctcagcctccca

SEQ ID NO: 218208 - DNA, 17 bp, Homo sapiens
ctgtctcatccccaggg

SEQ ID NO: 218209 - DNA, 21 bp, Homo sapiens
ctgtctcatccccaggggtcc

SEQ ID NO: 218210 - DNA, 20 bp, Homo sapiens
ctgtctccaagaatgttttg

SEQ ID NO: 218211 - DNA, 13 bp, Homo sapiens
ctgtctccagacc

SEQ ID NO: 218212 - DNA, 15 bp, Homo sapiens
ctgtctccagacccc

SEQ ID NO: 218213 - DNA, 17 bp, Homo sapiens
ctgtctcccctaccagg

SEQ ID NO: 218214 - DNA, 15 bp, Homo sapiens
ctgtctcccctctgc

SEQ ID NO: 218215 - DNA, 12 bp, Homo sapiens
ctgtctcctctg

SEQ ID NO: 218216 - DNA, 14 bp, Homo sapiens
ctgtctccttccca

SEQ ID NO: 218217 - DNA, 16 bp, Homo sapiens
ctgtctctaacttatt

SEQ ID NO: 218218 - DNA, 20 bp, Homo sapiens
ctgtctctaacttattttat

SEQ ID NO: 218219 - DNA, 22 bp, Homo sapiens
ctgtctctacaaaaaaaatcaa

SEQ ID NO: 218220 - DNA, 13 bp, Homo sapiens
ctgtctctccatc

SEQ ID NO: 218221 - DNA, 17 bp, Homo sapiens
ctgtctctccctaccct

SEQ ID NO: 218222 - DNA, 21 bp, Homo sapiens
ctgtctctccctaccctcttc

SEQ ID NO: 218223 - DNA, 12 bp, Homo sapiens
ctgtctctctct

SEQ ID NO: 218224 - DNA, 15 bp, Homo sapiens
ctgtctctttccact

SEQ ID NO: 218225 - DNA, 20 bp, Homo sapiens
ctgtctgacaacctcttggt

SEQ ID NO: 218226 - DNA, 12 bp, Homo sapiens
ctgtctgagccc

SEQ ID NO: 218227 - DNA, 18 bp, Homo sapiens
ctgtctgagccctgccct

SEQ ID NO: 218228 - DNA, 19 bp, Homo sapiens
ctgtctgagccctgccctc

SEQ ID NO: 218229 - DNA, 20 bp, Homo sapiens
ctgtctgagccctgccctca

SEQ ID NO: 218230 - DNA, 16 bp, Homo sapiens
ctgtctgcctgtattt

SEQ ID NO: 218231 - DNA, 23 bp, Homo sapiens
ctgtctggaagacgtggctctgg

SEQ ID NO: 218232 - DNA, 12 bp, Homo sapiens
ctgtctggccca

SEQ ID NO: 218233 - DNA, 16 bp, Homo sapiens
ctgtctggctgtacgt

SEQ ID NO: 218234 - DNA, 13 bp, Homo sapiens
ctgtctggggcct

SEQ ID NO: 218235 - DNA, 16 bp, Homo sapiens
ctgtctggttttaaca

SEQ ID NO: 218236 - DNA, 18 bp, Homo sapiens
ctgtctgtaagagaattc

SEQ ID NO: 218237 - DNA, 12 bp, Homo sapiens
ctgtctgtccta

SEQ ID NO: 218238 - DNA, 13 bp, Homo sapiens
ctgtctgtcctat

SEQ ID NO: 218239 - DNA, 15 bp, Homo sapiens
ctgtctgtccttcct

SEQ ID NO: 218240 - DNA, 16 bp, Homo sapiens
ctgtctgtctctccat

SEQ ID NO: 218241 - DNA, 14 bp, Homo sapiens
ctgtctgtctgtcc

SEQ ID NO: 218242 - DNA, 15 bp, Homo sapiens
ctgtcttccaaggag

SEQ ID NO: 218243 - DNA, 16 bp, Homo sapiens
ctgtcttctctccact

SEQ ID NO: 218244 - DNA, 20 bp, Homo sapiens
ctgtcttctctccacttctg

SEQ ID NO: 218245 - DNA, 17 bp, Homo sapiens
ctgtcttctttctcctg

SEQ ID NO: 218246 - DNA, 16 bp, Homo sapiens
ctgtcttgtcatcttt

SEQ ID NO: 218247 - DNA, 17 bp, Homo sapiens
ctgtctttatgatttca

SEQ ID NO: 218248 - DNA, 14 bp, Homo sapiens
ctgtctttattctt

SEQ ID NO: 218249 - DNA, 20 bp, Homo sapiens
ctgtctttcagatacatggt

SEQ ID NO: 218250 - DNA, 11 bp, Homo sapiens
ctgtctttcct

SEQ ID NO: 218251 - DNA, 13 bp, Homo sapiens
ctgtctttcctag

SEQ ID NO: 218252 - DNA, 14 bp, Homo sapiens
ctgtctttcctaga

SEQ ID NO: 218253 - DNA, 23 bp, Homo sapiens
ctgtctttgctgtttatatatat

SEQ ID NO: 218254 - DNA, 14 bp, Homo sapiens
ctgtctttttcctt

SEQ ID NO: 218255 - DNA, 15 bp, Homo sapiens
ctgtctttttccttc

SEQ ID NO: 218256 - DNA, 23 bp, Homo sapiens
ctgtgaaaattacacccatgcac

SEQ ID NO: 218257 - DNA, 12 bp, Homo sapiens
ctgtgaaacagt

SEQ ID NO: 218258 - DNA, 16 bp, Homo sapiens
ctgtgaaatgactgca

SEQ ID NO: 218259 - DNA, 18 bp, Homo sapiens
ctgtgaacatggactctt

SEQ ID NO: 218260 - DNA, 18 bp, Homo sapiens
ctgtgaacgatttagaaa

SEQ ID NO: 218261 - DNA, 22 bp, Homo sapiens
ctgtgaacgatttagaaagaag

SEQ ID NO: 218262 - DNA, 16 bp, Homo sapiens
ctgtgaacttggggaa

SEQ ID NO: 218263 - DNA, 16 bp, Homo sapiens
ctgtgaagaatgaagt

SEQ ID NO: 218264 - DNA, 19 bp, Homo sapiens
ctgtgaagaatgaagtgga

SEQ ID NO: 218265 - DNA, 12 bp, Homo sapiens
ctgtgaatacaa

SEQ ID NO: 218266 - DNA, 17 bp, Homo sapiens
ctgtgaatacaattaaa

SEQ ID NO: 218267 - DNA, 14 bp, Homo sapiens
ctgtgaattcagat

SEQ ID NO: 218268 - DNA, 15 bp, Homo sapiens
ctgtgaattcagatt

SEQ ID NO: 218269 - DNA, 21 bp, Homo sapiens
ctgtgacaaaggatgaagaac

SEQ ID NO: 218270 - DNA, 23 bp, Homo sapiens
ctgtgacaaaggatgaagaacac

SEQ ID NO: 218271 - DNA, 16 bp, Homo sapiens
ctgtgacaataagttt

SEQ ID NO: 218272 - DNA, 22 bp, Homo sapiens
ctgtgacaggaagcccaaggca

SEQ ID NO: 218273 - DNA, 17 bp, Homo sapiens
ctgtgaccaccttctgt

SEQ ID NO: 218274 - DNA, 19 bp, Homo sapiens
ctgtgaccaccttctgtcc

SEQ ID NO: 218275 - DNA, 14 bp, Homo sapiens
ctgtgaccagcact

SEQ ID NO: 218276 - DNA, 15 bp, Homo sapiens
ctgtgaccctctcac

SEQ ID NO: 218277 - DNA, 13 bp, Homo sapiens
ctgtgacctgtgg

SEQ ID NO: 218278 - DNA, 17 bp, Homo sapiens
ctgtgactcgcttagct

SEQ ID NO: 218279 - DNA, 22 bp, Homo sapiens
ctgtgactgatgttaggctggg

SEQ ID NO: 218280 - DNA, 17 bp, Homo sapiens
ctgtgacttcagctctg

SEQ ID NO: 218281 - DNA, 13 bp, Homo sapiens
ctgtgagaaaacg

SEQ ID NO: 218282 - DNA, 15 bp, Homo sapiens
ctgtgagaataaagc

SEQ ID NO: 218283 - DNA, 16 bp, Homo sapiens
ctgtgagacccccaca

SEQ ID NO: 218284 - DNA, 17 bp, Homo sapiens
ctgtgagacccccacac

SEQ ID NO: 218285 - DNA, 20 bp, Homo sapiens
ctgtgagacccccacacctc

SEQ ID NO: 218286 - DNA, 14 bp, Homo sapiens
ctgtgagagagttg

SEQ ID NO: 218287 - DNA, 16 bp, Homo sapiens
ctgtgagcagcctcca

SEQ ID NO: 218288 - DNA, 19 bp, Homo sapiens
ctgtgagcagcctccactg

SEQ ID NO: 218289 - DNA, 21 bp, Homo sapiens
ctgtgagcagcctccactgtg

SEQ ID NO: 218290 - DNA, 13 bp, Homo sapiens
ctgtgagcatcct

SEQ ID NO: 218291 - DNA, 19 bp, Homo sapiens
ctgtgaggaatgctctgtg

SEQ ID NO: 218292 - DNA, 15 bp, Homo sapiens
ctgtgaggcggcagc

SEQ ID NO: 218293 - DNA, 12 bp, Homo sapiens
ctgtgaggctgt

SEQ ID NO: 218294 - DNA, 16 bp, Homo sapiens
ctgtgaggctgtcctg

SEQ ID NO: 218295 - DNA, 16 bp, Homo sapiens
ctgtgagtctgtcctt

SEQ ID NO: 218296 - DNA, 20 bp, Homo sapiens
ctgtgagtctgtcctttccc

SEQ ID NO: 218297 - DNA, 14 bp, Homo sapiens
ctgtgagtgtaagt

SEQ ID NO: 218298 - DNA, 21 bp, Homo sapiens
ctgtgagtgtaagtgtgagta

SEQ ID NO: 218299 - DNA, 19 bp, Homo sapiens
ctgtgatcatttattttaa

SEQ ID NO: 218300 - DNA, 19 bp, Homo sapiens
ctgtgatcgtgtgttgcca

SEQ ID NO: 218301 - DNA, 13 bp, Homo sapiens
ctgtgatgcatga

SEQ ID NO: 218302 - DNA, 15 bp, Homo sapiens
ctgtgatgcatgagc

SEQ ID NO: 218303 - DNA, 21 bp, Homo sapiens
ctgtgatgcatgagctccctc

SEQ ID NO: 218304 - DNA, 16 bp, Homo sapiens
ctgtgatgccacacag

SEQ ID NO: 218305 - DNA, 15 bp, Homo sapiens
ctgtgatgcctgaca

SEQ ID NO: 218306 - DNA, 21 bp, Homo sapiens
ctgtgatggatggacacaaaa

SEQ ID NO: 218307 - DNA, 21 bp, Homo sapiens
ctgtgatgttgggaagctatt

SEQ ID NO: 218308 - DNA, 16 bp, Homo sapiens
ctgtgatttatttgga

SEQ ID NO: 218309 - DNA, 17 bp, Homo sapiens
ctgtgatttatttggag

SEQ ID NO: 218310 - DNA, 16 bp, Homo sapiens
ctgtgcaaacagtgta

SEQ ID NO: 218311 - DNA, 18 bp, Homo sapiens
ctgtgcaaacagtgtaag

SEQ ID NO: 218312 - DNA, 15 bp, Homo sapiens
ctgtgcagagacttt

SEQ ID NO: 218313 - DNA, 13 bp, Homo sapiens
ctgtgcagcaccc

SEQ ID NO: 218314 - DNA, 14 bp, Homo sapiens
ctgtgcagcagccc

SEQ ID NO: 218315 - DNA, 18 bp, Homo sapiens
ctgtgcagcagcccagct

SEQ ID NO: 218316 - DNA, 22 bp, Homo sapiens
ctgtgcagcagcccagcttcct

SEQ ID NO: 218317 - DNA, 12 bp, Homo sapiens
ctgtgcaggtgc

SEQ ID NO: 218318 - DNA, 19 bp, Homo sapiens
ctgtgcaggtgctgccttg

SEQ ID NO: 218319 - DNA, 14 bp, Homo sapiens
ctgtgcatgacctg

SEQ ID NO: 218320 - DNA, 14 bp, Homo sapiens
ctgtgcatgggtga

SEQ ID NO: 218321 - DNA, 17 bp, Homo sapiens
ctgtgcatgggtgaagg

SEQ ID NO: 218322 - DNA, 16 bp, Homo sapiens
ctgtgccaacctgatg

SEQ ID NO: 218323 - DNA, 13 bp, Homo sapiens
ctgtgccacccac

SEQ ID NO: 218324 - DNA, 23 bp, Homo sapiens
ctgtgccagaaacagtgggagcc

SEQ ID NO: 218325 - DNA, 17 bp, Homo sapiens
ctgtgccaggactgtga

SEQ ID NO: 218326 - DNA, 15 bp, Homo sapiens
ctgtgccatgtgttt

SEQ ID NO: 218327 - DNA, 18 bp, Homo sapiens
ctgtgcccacatcccagg

SEQ ID NO: 218328 - DNA, 19 bp, Homo sapiens
ctgtgcccacatcccaggc

SEQ ID NO: 218329 - DNA, 23 bp, Homo sapiens
ctgtgcccacatcccaggcttca

SEQ ID NO: 218330 - DNA, 12 bp, Homo sapiens
ctgtgcccagct

SEQ ID NO: 218331 - DNA, 13 bp, Homo sapiens
ctgtgcccagctc

SEQ ID NO: 218332 - DNA, 19 bp, Homo sapiens
taaatctgtctgattctat

SEQ ID NO: 218333 - DNA, 18 bp, Homo sapiens
taaatctgttgccaagct

SEQ ID NO: 218334 - DNA, 21 bp, Homo sapiens
taaatctttcagcctgcttct

SEQ ID NO: 218335 - DNA, 22 bp, Homo sapiens
taaatgaaaagagaattactta

SEQ ID NO: 218336 - DNA, 13 bp, Homo sapiens
taaatgaaagaag

SEQ ID NO: 218337 - DNA, 13 bp, Homo sapiens
taaatgaaatact

SEQ ID NO: 218338 - DNA, 14 bp, Homo sapiens
taaatgaaatactt

SEQ ID NO: 218339 - DNA, 18 bp, Homo sapiens
taaatgaacacatggcag

SEQ ID NO: 218340 - DNA, 19 bp, Homo sapiens
taaatgaacacatggcaga

SEQ ID NO: 218341 - DNA, 12 bp, Homo sapiens
taaatgaatgaa

SEQ ID NO: 218342 - DNA, 13 bp, Homo sapiens
taaatgaccagtt

SEQ ID NO: 218343 - DNA, 17 bp, Homo sapiens
taaatgaccagtttacc

SEQ ID NO: 218344 - DNA, 19 bp, Homo sapiens
taaatgaccagtttacctg

SEQ ID NO: 218345 - DNA, 15 bp, Homo sapiens
taaatgacttattga

SEQ ID NO: 218346 - DNA, 14 bp, Homo sapiens
taaatgattatctt

SEQ ID NO: 218347 - DNA, 15 bp, Homo sapiens
taaatgattatcttg

SEQ ID NO: 218348 - DNA, 12 bp, Homo sapiens
taaatgattcca

SEQ ID NO: 218349 - DNA, 14 bp, Homo sapiens
taaatgattccaaa

SEQ ID NO: 218350 - DNA, 21 bp, Homo sapiens
taaatgcatatcctgagccat

SEQ ID NO: 218351 - DNA, 15 bp, Homo sapiens
taaatgctacctctg

SEQ ID NO: 218352 - DNA, 21 bp, Homo sapiens
taaatgctttgtgtgattgaa

SEQ ID NO: 218353 - DNA, 17 bp, Homo sapiens
taaatggacttgcttct

SEQ ID NO: 218354 - DNA, 22 bp, Homo sapiens
aaataaggaagagggctgagct

SEQ ID NO: 218355 - DNA, 16 bp, Homo sapiens
aaataagtaacatata

SEQ ID NO: 218356 - DNA, 13 bp, Homo sapiens
aaataagtgaatc

SEQ ID NO: 218357 - DNA, 15 bp, Homo sapiens
aaataataaattaac

SEQ ID NO: 218358 - DNA, 16 bp, Homo sapiens
aaataataaattaaca

SEQ ID NO: 218359 - DNA, 19 bp, Homo sapiens
aaataataatagtactatt

SEQ ID NO: 218360 - DNA, 15 bp, Homo sapiens
aaataataatattta

SEQ ID NO: 218361 - DNA, 21 bp, Homo sapiens
aaataatacatctttatcatt

SEQ ID NO: 218362 - DNA, 12 bp, Homo sapiens
aaataatatgca

SEQ ID NO: 218363 - DNA, 16 bp, Homo sapiens
aaataatattatattg

SEQ ID NO: 218364 - DNA, 16 bp, Homo sapiens
aaataatcttagaaca

SEQ ID NO: 218365 - DNA, 12 bp, Homo sapiens
aaataatgattt

SEQ ID NO: 218366 - DNA, 22 bp, Homo sapiens
aaataatttaagccaataaata

SEQ ID NO: 218367 - DNA, 13 bp, Homo sapiens
aaataattttaca

SEQ ID NO: 218368 - DNA, 15 bp, Homo sapiens
aaataattttatgaa

SEQ ID NO: 218369 - DNA, 23 bp, Homo sapiens
aaataattttatgaactgcatgt

SEQ ID NO: 218370 - DNA, 21 bp, Homo sapiens
aaatacaaaataaaattatgg

SEQ ID NO: 218371 - DNA, 21 bp, Homo sapiens
aaatacaagttaaggtatctg

SEQ ID NO: 218372 - DNA, 16 bp, Homo sapiens
aaatacaagttctatt

SEQ ID NO: 218373 - DNA, 17 bp, Homo sapiens
aaatacaagttctattt

SEQ ID NO: 218374 - DNA, 21 bp, Homo sapiens
aaatacaatggtttctgaaag

SEQ ID NO: 218375 - DNA, 18 bp, Homo sapiens
aaatacacatagcatgta

SEQ ID NO: 218376 - DNA, 21 bp, Homo sapiens
aaatacaccacctcactcctg

SEQ ID NO: 218377 - DNA, 15 bp, Homo sapiens
aaatacactacaaat

SEQ ID NO: 218378 - DNA, 17 bp, Homo sapiens
aaatacactacaaatgt

SEQ ID NO: 218379 - DNA, 14 bp, Homo sapiens
aaatacagacacta

SEQ ID NO: 218380 - DNA, 16 bp, Homo sapiens
aaatacagacactaag

SEQ ID NO: 218381 - DNA, 17 bp, Homo sapiens
aaatacagacactaagt

SEQ ID NO: 218382 - DNA, 22 bp, Homo sapiens
aaatacagacactaagttatag

SEQ ID NO: 218383 - DNA, 16 bp, Homo sapiens
aaatacagtgctttat

SEQ ID NO: 218384 - DNA, 14 bp, Homo sapiens
aaatacatgatgat

SEQ ID NO: 218385 - DNA, 18 bp, Homo sapiens
aaatacatttaaaactta

SEQ ID NO: 218386 - DNA, 16 bp, Homo sapiens
aaataccaaagcagtt

SEQ ID NO: 218387 - DNA, 16 bp, Homo sapiens
aaataccagtacttga

SEQ ID NO: 218388 - DNA, 22 bp, Homo sapiens
aaatactatgtatgtaaaatat

SEQ ID NO: 218389 - DNA, 18 bp, Homo sapiens
aaatactcaccaaaatat

SEQ ID NO: 218390 - DNA, 16 bp, Homo sapiens
aaatactcagcaactg

SEQ ID NO: 218391 - DNA, 13 bp, Homo sapiens
aaatacttgacaa

SEQ ID NO: 218392 - DNA, 21 bp, Homo sapiens
aaatagaatgttactttggaa

SEQ ID NO: 218393 - DNA, 19 bp, Homo sapiens
aaatagagatgagctttct

SEQ ID NO: 218394 - DNA, 16 bp, Homo sapiens
aaatagatttttagat

SEQ ID NO: 218395 - DNA, 17 bp, Homo sapiens
aaatagatttttagatt

SEQ ID NO: 218396 - DNA, 15 bp, Homo sapiens
aaatagcaacatgct

SEQ ID NO: 218397 - DNA, 23 bp, Homo sapiens
aaatagctaaatggcaacaaaca

SEQ ID NO: 218398 - DNA, 14 bp, Homo sapiens
aaatagctataaat

SEQ ID NO: 218399 - DNA, 20 bp, Homo sapiens
aaatagctataaatagtgaa

SEQ ID NO: 218400 - DNA, 21 bp, Homo sapiens
aaatagctataaatagtgaaa

SEQ ID NO: 218401 - DNA, 20 bp, Homo sapiens
aaatagggtggacagaagct

SEQ ID NO: 218402 - DNA, 19 bp, Homo sapiens
aaatagtcctccaaaacac

SEQ ID NO: 218403 - DNA, 13 bp, Homo sapiens
aaatagtgaaaag

SEQ ID NO: 218404 - DNA, 13 bp, Homo sapiens
aaatagtgaaaat

SEQ ID NO: 218405 - DNA, 19 bp, Homo sapiens
aaatagtggttcttggaaa

SEQ ID NO: 218406 - DNA, 21 bp, Homo sapiens
aaatagtggttcttggaaaaa

SEQ ID NO: 218407 - DNA, 18 bp, Homo sapiens
aaatagtgtgtccatgca

SEQ ID NO: 218408 - DNA, 15 bp, Homo sapiens
aaatagttattttaa

SEQ ID NO: 218409 - DNA, 18 bp, Homo sapiens
aaatagttctatttctat

SEQ ID NO: 218410 - DNA, 17 bp, Homo sapiens
aaatagtttcaaatgag

SEQ ID NO: 218411 - DNA, 18 bp, Homo sapiens
aaatagtttcaaatgagt

SEQ ID NO: 218412 - DNA, 12 bp, Homo sapiens
aaatagttttac

SEQ ID NO: 218413 - DNA, 13 bp, Homo sapiens
aaatagttttaca

SEQ ID NO: 218414 - DNA, 15 bp, Homo sapiens
aaatataaaaataat

SEQ ID NO: 218415 - DNA, 15 bp, Homo sapiens
aaatataaacaatgt

SEQ ID NO: 218416 - DNA, 17 bp, Homo sapiens
aaatataaacaatgttc

SEQ ID NO: 218417 - DNA, 19 bp, Homo sapiens
aaatataaatctgatcacc

SEQ ID NO: 218418 - DNA, 16 bp, Homo sapiens
aaatataaatgtttaa

SEQ ID NO: 218419 - DNA, 20 bp, Homo sapiens
aaatataaattaagacttta

SEQ ID NO: 218420 - DNA, 14 bp, Homo sapiens
aaatataagatttt

SEQ ID NO: 218421 - DNA, 19 bp, Homo sapiens
aaatataagctgggaaaaa

SEQ ID NO: 218422 - DNA, 13 bp, Homo sapiens
aaatataattctg

SEQ ID NO: 218423 - DNA, 19 bp, Homo sapiens
aaatataattctgtaaatg

SEQ ID NO: 218424 - DNA, 19 bp, Homo sapiens
aaatatacaactttggaat

SEQ ID NO: 218425 - DNA, 13 bp, Homo sapiens
aaatatactaata

SEQ ID NO: 218426 - DNA, 16 bp, Homo sapiens
aaatatataatggttt

SEQ ID NO: 218427 - DNA, 15 bp, Homo sapiens
aaatatatattgtat

SEQ ID NO: 218428 - DNA, 12 bp, Homo sapiens
aaatatatgtat

SEQ ID NO: 218429 - DNA, 14 bp, Homo sapiens
aaatatatgtatgt

SEQ ID NO: 218430 - DNA, 16 bp, Homo sapiens
aaatatatgtatgtaa

SEQ ID NO: 218431 - DNA, 11 bp, Homo sapiens
aaatatatgtt

SEQ ID NO: 218432 - DNA, 16 bp, Homo sapiens
aaatatatgttttgag

SEQ ID NO: 218433 - DNA, 18 bp, Homo sapiens
aaatatatgttttgagaa

SEQ ID NO: 218434 - DNA, 19 bp, Homo sapiens
aaatatatgttttgagaaa

SEQ ID NO: 218435 - DNA, 21 bp, Homo sapiens
aaatatatgttttgagaaaaa

SEQ ID NO: 218436 - DNA, 21 bp, Homo sapiens
aaatatatttaagataattat

SEQ ID NO: 218437 - DNA, 14 bp, Homo sapiens
aaatatatttaatg

SEQ ID NO: 218438 - DNA, 20 bp, Homo sapiens
aaatatatttttccctgttt

SEQ ID NO: 218439 - DNA, 14 bp, Homo sapiens
aaatatcattcagc

SEQ ID NO: 218440 - DNA, 17 bp, Homo sapiens
aaatatcattcagcaac

SEQ ID NO: 218441 - DNA, 17 bp, Homo sapiens
aaatatccaaagactgt

SEQ ID NO: 218442 - DNA, 19 bp, Homo sapiens
aaatatccaaagactgtac

SEQ ID NO: 218443 - DNA, 13 bp, Homo sapiens
aaatatcccagag

SEQ ID NO: 218444 - DNA, 21 bp, Homo sapiens
aaatatccctttttcacatat

SEQ ID NO: 218445 - DNA, 16 bp, Homo sapiens
aaatatgatatatatg

SEQ ID NO: 218446 - DNA, 21 bp, Homo sapiens
aaatatgatgtttaaaagcat

SEQ ID NO: 218447 - DNA, 13 bp, Homo sapiens
aaatatgattgat

SEQ ID NO: 218448 - DNA, 20 bp, Homo sapiens
aaatatgcactttccctaga

SEQ ID NO: 218449 - DNA, 21 bp, Homo sapiens
aaatatgcactttccctagaa

SEQ ID NO: 218450 - DNA, 17 bp, Homo sapiens
aaatatgcatgtacttt

SEQ ID NO: 218451 - DNA, 23 bp, Homo sapiens
aaatatgccccttcttgggcccc

SEQ ID NO: 218452 - DNA, 19 bp, Homo sapiens
aaatatgtattatacatct

SEQ ID NO: 218453 - DNA, 13 bp, Homo sapiens
aaatattactgat

SEQ ID NO: 218454 - DNA, 18 bp, Homo sapiens
aaatattatgattttatt

SEQ ID NO: 218455 - DNA, 15 bp, Homo sapiens
aaatattcctgcatt

SEQ ID NO: 218456 - DNA, 20 bp, Homo sapiens
aaatattcctgcatttgtga

SEQ ID NO: 218457 - DNA, 13 bp, Homo sapiens
aaatattctatat

SEQ ID NO: 218458 - DNA, 19 bp, Homo sapiens
aaatatttaaaaaaaaaca

SEQ ID NO: 218459 - DNA, 14 bp, Homo sapiens
aaatatttccttaa

SEQ ID NO: 218460 - DNA, 21 bp, Homo sapiens
aaatatttctatgtaaattat

SEQ ID NO: 218461 - DNA, 16 bp, Homo sapiens
aaatatttgcttattt

SEQ ID NO: 218462 - DNA, 16 bp, Homo sapiens
aaatattttagaagct

SEQ ID NO: 218463 - DNA, 13 bp, Homo sapiens
taactttcagaag

SEQ ID NO: 218464 - DNA, 18 bp, Homo sapiens
taagaaaaacatgtcatg

SEQ ID NO: 218465 - DNA, 14 bp, Homo sapiens
taagaaaaaggaaa

SEQ ID NO: 218466 - DNA, 21 bp, Homo sapiens
taagaaaagatacgactttat

SEQ ID NO: 218467 - DNA, 16 bp, Homo sapiens
taagaaacaatttaaa

SEQ ID NO: 218468 - DNA, 19 bp, Homo sapiens
taagaagagactgggaaga

SEQ ID NO: 218469 - DNA, 23 bp, Homo sapiens
taagaagatgttttgaaatgtac

SEQ ID NO: 218470 - DNA, 22 bp, Homo sapiens
taagaagtagagaacccagatg

SEQ ID NO: 218471 - DNA, 17 bp, Homo sapiens
taagaataaataaagaa

SEQ ID NO: 218472 - DNA, 20 bp, Homo sapiens
taagaataaataaagaagaa

SEQ ID NO: 218473 - DNA, 20 bp, Homo sapiens
taagaatagtctctgggttt

SEQ ID NO: 218474 - DNA, 21 bp, Homo sapiens
taagaatagtctctgggttta

SEQ ID NO: 218475 - DNA, 15 bp, Homo sapiens
taagaatgctggttt

SEQ ID NO: 218476 - DNA, 13 bp, Homo sapiens
taagacaaatggg

SEQ ID NO: 218477 - DNA, 17 bp, Homo sapiens
taagacaaatgggactg

SEQ ID NO: 218478 - DNA, 14 bp, Homo sapiens
taagacaacaggca

SEQ ID NO: 218479 - DNA, 16 bp, Homo sapiens
taagaccctaattctt

SEQ ID NO: 218480 - DNA, 23 bp, Homo sapiens
taagactaaatctgtaagctctt

SEQ ID NO: 218481 - DNA, 15 bp, Homo sapiens
taagactgtgtattc

SEQ ID NO: 218482 - DNA, 17 bp, Homo sapiens
taagacttgtttctttc

SEQ ID NO: 218483 - DNA, 18 bp, Homo sapiens
taagacttttctttcctt

SEQ ID NO: 218484 - DNA, 20 bp, Homo sapiens
taagagaaatggtagaagat

SEQ ID NO: 218485 - DNA, 22 bp, Homo sapiens
taagagaattctaagattgtac

SEQ ID NO: 218486 - DNA, 14 bp, Homo sapiens
taagagagagagcc

SEQ ID NO: 218487 - DNA, 12 bp, Homo sapiens
taagagccacaa

SEQ ID NO: 218488 - DNA, 22 bp, Homo sapiens
taagagccatttaggggccact

SEQ ID NO: 218489 - DNA, 22 bp, Homo sapiens
taagagggagccggtttgggag

SEQ ID NO: 218490 - DNA, 23 bp, Homo sapiens
taagataatagtttacatgtagt

SEQ ID NO: 218491 - DNA, 21 bp, Homo sapiens
taagataatggataatcttcg

SEQ ID NO: 218492 - DNA, 17 bp, Homo sapiens
taagataattaaatgaa

SEQ ID NO: 218493 - DNA, 21 bp, Homo sapiens
taagataattaaatgaaatac

SEQ ID NO: 218494 - DNA, 13 bp, Homo sapiens
taagataattata

SEQ ID NO: 218495 - DNA, 22 bp, Homo sapiens
taagatacaagtttcagacagg

SEQ ID NO: 218496 - DNA, 23 bp, Homo sapiens
taagatactgctgatgctgaaat

SEQ ID NO: 218497 - DNA, 14 bp, Homo sapiens
taagatatgtgaga

SEQ ID NO: 218498 - DNA, 16 bp, Homo sapiens
taagatattctttaca

SEQ ID NO: 218499 - DNA, 13 bp, Homo sapiens
taagatgaaattg

SEQ ID NO: 218500 - DNA, 15 bp, Homo sapiens
taagatgaggaaata

SEQ ID NO: 218501 - DNA, 19 bp, Homo sapiens
taagatggcaggtgatgtc

SEQ ID NO: 218502 - DNA, 23 bp, Homo sapiens
taagatgtattaacctacctgtg

SEQ ID NO: 218503 - DNA, 14 bp, Homo sapiens
cttaacggctccag

SEQ ID NO: 218504 - DNA, 12 bp, Homo sapiens
cttaactaattt

SEQ ID NO: 218505 - DNA, 15 bp, Homo sapiens
cttaactaatttgaa

SEQ ID NO: 218506 - DNA, 20 bp, Homo sapiens
cttaactgtgtgaagaaatg

SEQ ID NO: 218507 - DNA, 19 bp, Homo sapiens
cttaagaaagctatatatg

SEQ ID NO: 218508 - DNA, 19 bp, Homo sapiens
cttaagacaaatgggactg

SEQ ID NO: 218509 - DNA, 13 bp, Homo sapiens
cttaagacactag

SEQ ID NO: 218510 - DNA, 16 bp, Homo sapiens
cttaagagagagagcc

SEQ ID NO: 218511 - DNA, 23 bp, Homo sapiens
cttaagataatggataatcttcg

SEQ ID NO: 218512 - DNA, 17 bp, Homo sapiens
cttaagattacaagata

SEQ ID NO: 218513 - DNA, 12 bp, Homo sapiens
cttaagcacttt

SEQ ID NO: 218514 - DNA, 18 bp, Homo sapiens
cttaagcactttgaaaat

SEQ ID NO: 218515 - DNA, 13 bp, Homo sapiens
cttaagcccagga

SEQ ID NO: 218516 - DNA, 16 bp, Homo sapiens
cttaagcctgtgtata

SEQ ID NO: 218517 - DNA, 20 bp, Homo sapiens
cttaagcctgtgtataaaaa

SEQ ID NO: 218518 - DNA, 21 bp, Homo sapiens
cttaaggaattgacttcagca

SEQ ID NO: 218519 - DNA, 21 bp, Homo sapiens
cttaaggatggagccagctct

SEQ ID NO: 218520 - DNA, 18 bp, Homo sapiens
cttaagggttgaaggcag

SEQ ID NO: 218521 - DNA, 19 bp, Homo sapiens
cttaagggttgaaggcagt

SEQ ID NO: 218522 - DNA, 23 bp, Homo sapiens
cttaagggttgaaggcagtctga

SEQ ID NO: 218523 - DNA, 12 bp, Homo sapiens
cttaagtttaga

SEQ ID NO: 218524 - DNA, 14 bp, Homo sapiens
cttaagtttagaaa

SEQ ID NO: 218525 - DNA, 16 bp, Homo sapiens
cttaagtttagaaatt

SEQ ID NO: 218526 - DNA, 20 bp, Homo sapiens
cttaagtttagaaattacaa

SEQ ID NO: 218527 - DNA, 21 bp, Homo sapiens
cttaagtttagaaattacaag

SEQ ID NO: 218528 - DNA, 24 bp, Homo sapiens
cttaatagtaatatcaataaatag

SEQ ID NO: 218529 - DNA, 12 bp, Homo sapiens
cttaatatgatc

SEQ ID NO: 218530 - DNA, 10 bp, Homo sapiens
cttaatcttc

SEQ ID NO: 218531 - DNA, 18 bp, Homo sapiens
cttaatcttctctcttga

SEQ ID NO: 218532 - DNA, 19 bp, Homo sapiens
cttaatcttctctcttgat

SEQ ID NO: 218533 - DNA, 20 bp, Homo sapiens
cttaatcttctctcttgatt

SEQ ID NO: 218534 - DNA, 22 bp, Homo sapiens
cttaatcttctctcttgattga

SEQ ID NO: 218535 - DNA, 12 bp, Homo sapiens
cttaatctttat

SEQ ID NO: 218536 - DNA, 13 bp, Homo sapiens
cttaatctttatt

SEQ ID NO: 218537 - DNA, 14 bp, Homo sapiens
cttaatctttgctg

SEQ ID NO: 218538 - DNA, 14 bp, Homo sapiens
cttaatgagatagt

SEQ ID NO: 218539 - DNA, 22 bp, Homo sapiens
cttaatgttctgaataatttct

SEQ ID NO: 218540 - DNA, 16 bp, Homo sapiens
cttaattataagctat

SEQ ID NO: 218541 - DNA, 12 bp, Homo sapiens
cttaattctgtt

SEQ ID NO: 218542 - DNA, 13 bp, Homo sapiens
cttaattctgttc

SEQ ID NO: 218543 - DNA, 22 bp, Homo sapiens
cttaattctgttctgatattaa

SEQ ID NO: 218544 - DNA, 12 bp, Homo sapiens
cttaatttctaa

SEQ ID NO: 218545 - DNA, 16 bp, Homo sapiens
cttacaaggcaggcct

SEQ ID NO: 218546 - DNA, 23 bp, Homo sapiens
cttacaaggcaggcctttcctac

SEQ ID NO: 218547 - DNA, 20 bp, Homo sapiens
cttacaatgtgcactgaatc

SEQ ID NO: 218548 - DNA, 21 bp, Homo sapiens
cttacaattgcactgctgttc

SEQ ID NO: 218549 - DNA, 19 bp, Homo sapiens
cttacacatctcagaccct

SEQ ID NO: 218550 - DNA, 12 bp, Homo sapiens
cttacaggaagc

SEQ ID NO: 218551 - DNA, 16 bp, Homo sapiens
cttacataatttttta

SEQ ID NO: 218552 - DNA, 22 bp, Homo sapiens
cttacataattttttattcaag

SEQ ID NO: 218553 - DNA, 22 bp, Homo sapiens
cttacattggctttttaaattt

SEQ ID NO: 218554 - DNA, 17 bp, Homo sapiens
cttacatttttacaata

SEQ ID NO: 218555 - DNA, 17 bp, Homo sapiens
cttaccaaaacataaga

SEQ ID NO: 218556 - DNA, 15 bp, Homo sapiens
cttaccaactttctg

SEQ ID NO: 218557 - DNA, 22 bp, Homo sapiens
cttaccagatgctactggactt

SEQ ID NO: 218558 - DNA, 13 bp, Homo sapiens
cttaccaggaagc

SEQ ID NO: 218559 - DNA, 18 bp, Homo sapiens
cttaccccgtccctttcc

SEQ ID NO: 218560 - DNA, 12 bp, Homo sapiens
cttaccctactg

SEQ ID NO: 218561 - DNA, 13 bp, Homo sapiens
cttacccttctgt

SEQ ID NO: 218562 - DNA, 23 bp, Homo sapiens
cttacccttctgtgcccagctca

SEQ ID NO: 218563 - DNA, 20 bp, Homo sapiens
cttaccgtgggcactgaagg

SEQ ID NO: 218564 - DNA, 18 bp, Homo sapiens
cttacctaaacagatata

SEQ ID NO: 218565 - DNA, 21 bp, Homo sapiens
cttacctaaacagatataaat

SEQ ID NO: 218566 - DNA, 22 bp, Homo sapiens
cttacctaaacagatataaatg

SEQ ID NO: 218567 - DNA, 16 bp, Homo sapiens
cttacctcatttgcat

SEQ ID NO: 218568 - DNA, 17 bp, Homo sapiens
cttacctcatttgcatc

SEQ ID NO: 218569 - DNA, 14 bp, Homo sapiens
cttacctcccacct

SEQ ID NO: 218570 - DNA, 13 bp, Homo sapiens
cttacctcttccg

SEQ ID NO: 218571 - DNA, 16 bp, Homo sapiens
cttacggttttaaatg

SEQ ID NO: 218572 - DNA, 20 bp, Homo sapiens
cttactacatgtgggagctt

SEQ ID NO: 218573 - DNA, 21 bp, Homo sapiens
cttactattcccactttcatt

SEQ ID NO: 218574 - DNA, 14 bp, Homo sapiens
cttactcaaacatg

SEQ ID NO: 218575 - DNA, 17 bp, Homo sapiens
cttactctgagcccagg

SEQ ID NO: 218576 - DNA, 21 bp, Homo sapiens
cttactctgagcccaggccgt

SEQ ID NO: 218577 - DNA, 16 bp, Homo sapiens
cttactgttttgtgcg

SEQ ID NO: 218578 - DNA, 13 bp, Homo sapiens
cttagaaatactt

SEQ ID NO: 218579 - DNA, 21 bp, Homo sapiens
cttagaacagatggctgtgaa

SEQ ID NO: 218580 - DNA, 20 bp, Homo sapiens
cttagaacccttctgctttc

SEQ ID NO: 218581 - DNA, 20 bp, Homo sapiens
cttagaataaaattgtaaaa

SEQ ID NO: 218582 - DNA, 17 bp, Homo sapiens
cttagaatactgtattg

SEQ ID NO: 218583 - DNA, 21 bp, Homo sapiens
cttagaatctgtagaggagcc

SEQ ID NO: 218584 - DNA, 19 bp, Homo sapiens
cttagaatgagggaaacaa

SEQ ID NO: 218585 - DNA, 17 bp, Homo sapiens
cttagacccgccaggtc

SEQ ID NO: 218586 - DNA, 14 bp, Homo sapiens
cttagactccttct

SEQ ID NO: 218587 - DNA, 15 bp, Homo sapiens
cttagactccttctc

SEQ ID NO: 218588 - DNA, 21 bp, Homo sapiens
cttagactccttctccccaat

SEQ ID NO: 218589 - DNA, 18 bp, Homo sapiens
cttagagagaggaggcag

SEQ ID NO: 218590 - DNA, 13 bp, Homo sapiens
cttagagatgcta

SEQ ID NO: 218591 - DNA, 22 bp, Homo sapiens
cttagagattgccccagagccc

SEQ ID NO: 218592 - DNA, 16 bp, Homo sapiens
cttagatctgagccct

SEQ ID NO: 218593 - DNA, 15 bp, Homo sapiens
gcaccacggggtcgg

SEQ ID NO: 218594 - DNA, 17 bp, Homo sapiens
gcaccagccccctggat

SEQ ID NO: 218595 - DNA, 19 bp, Homo sapiens
gcaccagccccctggatgg

SEQ ID NO: 218596 - DNA, 15 bp, Homo sapiens
gcaccagcccttccc

SEQ ID NO: 218597 - DNA, 16 bp, Homo sapiens
gcaccagcccttccct

SEQ ID NO: 218598 - DNA, 19 bp, Homo sapiens
gcaccagcccttccctgct

SEQ ID NO: 218599 - DNA, 22 bp, Homo sapiens
gcaccagcccttccctgctttg

SEQ ID NO: 218600 - DNA, 15 bp, Homo sapiens
gcaccagcctgagcc

SEQ ID NO: 218601 - DNA, 12 bp, Homo sapiens
gcaccagctctg

SEQ ID NO: 218602 - DNA, 14 bp, Homo sapiens
gcaccagctctgtg

SEQ ID NO: 218603 - DNA, 17 bp, Homo sapiens
gcaccagctctgtggcc

SEQ ID NO: 218604 - DNA, 18 bp, Homo sapiens
gcaccagctctgtggcct

SEQ ID NO: 218605 - DNA, 19 bp, Homo sapiens
gcaccagctctgtggcctg

SEQ ID NO: 218606 - DNA, 16 bp, Homo sapiens
gcaccagctgctctgc

SEQ ID NO: 218607 - DNA, 19 bp, Homo sapiens
gcaccagctgctctgcccc

SEQ ID NO: 218608 - DNA, 12 bp, Homo sapiens
gcaccaggagac

SEQ ID NO: 218609 - DNA, 21 bp, Homo sapiens
gcaccatagaagaacagcaga

SEQ ID NO: 218610 - DNA, 19 bp, Homo sapiens
gcacccacaagtgccactg

SEQ ID NO: 218611 - DNA, 18 bp, Homo sapiens
gcacccacctccaccccc

SEQ ID NO: 218612 - DNA, 18 bp, Homo sapiens
gcacccagctccaggggc

SEQ ID NO: 218613 - DNA, 22 bp, Homo sapiens
gcaccccaccacacacaccctt

SEQ ID NO: 218614 - DNA, 22 bp, Homo sapiens
gcaccccagcattccagctctg

SEQ ID NO: 218615 - DNA, 20 bp, Homo sapiens
gcaccccagctaccccttct

SEQ ID NO: 218616 - DNA, 14 bp, Homo sapiens
gcacccccaccctt

SEQ ID NO: 218617 - DNA, 22 bp, Homo sapiens
gcacccccagcctcccccaggc

SEQ ID NO: 218618 - DNA, 17 bp, Homo sapiens
gcacccccatgctgcct

SEQ ID NO: 218619 - DNA, 20 bp, Homo sapiens
gcacccctccgtgtggagca

SEQ ID NO: 218620 - DNA, 13 bp, Homo sapiens
gcaccctgggtgc

SEQ ID NO: 218621 - DNA, 20 bp, Homo sapiens
gcaccctgtatggagctaga

SEQ ID NO: 218622 - DNA, 17 bp, Homo sapiens
gcaccctttcaccccca

SEQ ID NO: 218623 - DNA, 14 bp, Homo sapiens
gcaccgcagcctgt

SEQ ID NO: 218624 - DNA, 19 bp, Homo sapiens
gcaccgcagcctgtcagcc

SEQ ID NO: 218625 - DNA, 22 bp, Homo sapiens
gcaccgcccaacccccacctcc

SEQ ID NO: 218626 - DNA, 14 bp, Homo sapiens
gcaccgcccaccca

SEQ ID NO: 218627 - DNA, 15 bp, Homo sapiens
gcaccgcccacccac

SEQ ID NO: 218628 - DNA, 19 bp, Homo sapiens
gcaccgcccacccacaccc

SEQ ID NO: 218629 - DNA, 12 bp, Homo sapiens
gcaccggcgctg

SEQ ID NO: 218630 - DNA, 18 bp, Homo sapiens
gcaccggcgctgcaggta

SEQ ID NO: 218631 - DNA, 21 bp, Homo sapiens
gcaccgtcatggcttaatgtt

SEQ ID NO: 218632 - DNA, 23 bp, Homo sapiens
gcacctaaaccaccagtgcccaa

SEQ ID NO: 218633 - DNA, 14 bp, Homo sapiens
gcacctaaagcagc

SEQ ID NO: 218634 - DNA, 18 bp, Homo sapiens
gcacctaaagcagccagc

SEQ ID NO: 218635 - DNA, 21 bp, Homo sapiens
gcacctactacatcgccctcc

SEQ ID NO: 218636 - DNA, 24 bp, Homo sapiens
gcacctcagaaagtcaccaggact

SEQ ID NO: 218637 - DNA, 14 bp, Homo sapiens
gcacctcctaccct

SEQ ID NO: 218638 - DNA, 18 bp, Homo sapiens
gcacctcctaccctccca

SEQ ID NO: 218639 - DNA, 20 bp, Homo sapiens
gcacctcctctctgctgggt

SEQ ID NO: 218640 - DNA, 16 bp, Homo sapiens
gcacctcctgagaagg

SEQ ID NO: 218641 - DNA, 23 bp, Homo sapiens
gcacctctgctgtattgatatca

SEQ ID NO: 218642 - DNA, 20 bp, Homo sapiens
gcacctgaaccccatgggct

SEQ ID NO: 218643 - DNA, 12 bp, Homo sapiens
gcacctgaggcc

SEQ ID NO: 218644 - DNA, 12 bp, Homo sapiens
gcacctgctgga

SEQ ID NO: 218645 - DNA, 17 bp, Homo sapiens
gcacctggagcccacag

SEQ ID NO: 218646 - DNA, 21 bp, Homo sapiens
gcacctggagcccacagagtc

SEQ ID NO: 218647 - DNA, 20 bp, Homo sapiens
gcacctggcctgctgggaac

SEQ ID NO: 218648 - DNA, 16 bp, Homo sapiens
gcacctgggctttctg

SEQ ID NO: 218649 - DNA, 17 bp, Homo sapiens
gcacctgggtgctctgg

SEQ ID NO: 218650 - DNA, 21 bp, Homo sapiens
gcacctgtaatcccagctact

SEQ ID NO: 218651 - DNA, 21 bp, Homo sapiens
gcacctgtggccagagcacct

SEQ ID NO: 218652 - DNA, 15 bp, Homo sapiens
gcacctgtggcctct

SEQ ID NO: 218653 - DNA, 16 bp, Homo sapiens
tccccactgacagcct

SEQ ID NO: 218654 - DNA, 20 bp, Homo sapiens
tccccactgcctgcccaccc

SEQ ID NO: 218655 - DNA, 22 bp, Homo sapiens
tccccactgcctgcccacccgt

SEQ ID NO: 218656 - DNA, 12 bp, Homo sapiens
tccccagagcac

SEQ ID NO: 218657 - DNA, 19 bp, Homo sapiens
tccccagcaggtggggagg

SEQ ID NO: 218658 - DNA, 15 bp, Homo sapiens
tccccagccagccct

SEQ ID NO: 218659 - DNA, 17 bp, Homo sapiens
tccccagccagcccttc

SEQ ID NO: 218660 - DNA, 22 bp, Homo sapiens
tccccagccagcccttccctgg

SEQ ID NO: 218661 - DNA, 19 bp, Homo sapiens
tccccagcccactggatca

SEQ ID NO: 218662 - DNA, 15 bp, Homo sapiens
tccccagcccagggt

SEQ ID NO: 218663 - DNA, 12 bp, Homo sapiens
tccccagccccc

SEQ ID NO: 218664 - DNA, 16 bp, Homo sapiens
tccccagccctgtcct

SEQ ID NO: 218665 - DNA, 12 bp, Homo sapiens
tccccagccctt

SEQ ID NO: 218666 - DNA, 16 bp, Homo sapiens
tccccagcccttctgc

SEQ ID NO: 218667 - DNA, 15 bp, Homo sapiens
tccccaggccaggtc

SEQ ID NO: 218668 - DNA, 15 bp, Homo sapiens
tccccaggcctccag

SEQ ID NO: 218669 - DNA, 21 bp, Homo sapiens
tccccaggcctccagcctctc

SEQ ID NO: 218670 - DNA, 12 bp, Homo sapiens
tccccagggccc

SEQ ID NO: 218671 - DNA, 15 bp, Homo sapiens
tccccagggcccctc

SEQ ID NO: 218672 - DNA, 22 bp, Homo sapiens
tccccagggcccctccctctgc

SEQ ID NO: 218673 - DNA, 18 bp, Homo sapiens
tccccaggggaaaatgaa

SEQ ID NO: 218674 - DNA, 22 bp, Homo sapiens
tccccaggggtcccagccaccc

SEQ ID NO: 218675 - DNA, 18 bp, Homo sapiens
tccccagggttctgtatt

SEQ ID NO: 218676 - DNA, 14 bp, Homo sapiens
tccccagtgaaaac

SEQ ID NO: 218677 - DNA, 14 bp, Homo sapiens
tccccagtgcctgc

SEQ ID NO: 218678 - DNA, 15 bp, Homo sapiens
tccccagtgcctgcc

SEQ ID NO: 218679 - DNA, 16 bp, Homo sapiens
tccccagtgcctgcca

SEQ ID NO: 218680 - DNA, 15 bp, Homo sapiens
tccccatactctgtc

SEQ ID NO: 218681 - DNA, 17 bp, Homo sapiens
tccccatactctgtctc

SEQ ID NO: 218682 - DNA, 18 bp, Homo sapiens
tccccatactctgtctcc

SEQ ID NO: 218683 - DNA, 21 bp, Homo sapiens
tccccatatttgtgttcagtt

SEQ ID NO: 218684 - DNA, 15 bp, Homo sapiens
tccccatccccacca

SEQ ID NO: 218685 - DNA, 16 bp, Homo sapiens
tccccatccccaccag

SEQ ID NO: 218686 - DNA, 18 bp, Homo sapiens
tccccatccccttcctaa

SEQ ID NO: 218687 - DNA, 22 bp, Homo sapiens
tccccatcccgaagccatcact

SEQ ID NO: 218688 - DNA, 18 bp, Homo sapiens
tccccatcctccagcttc

SEQ ID NO: 218689 - DNA, 22 bp, Homo sapiens
tccccatgtgcctgcaccagga

SEQ ID NO: 218690 - DNA, 15 bp, Homo sapiens
tccccattagtatcc

SEQ ID NO: 218691 - DNA, 17 bp, Homo sapiens
tcccccaaagttcacaa

SEQ ID NO: 218692 - DNA, 14 bp, Homo sapiens
tcccccaaccccca

SEQ ID NO: 218693 - DNA, 15 bp, Homo sapiens
tcccccaacccccac

SEQ ID NO: 218694 - DNA, 21 bp, Homo sapiens
tcccccaacccccaccccaca

SEQ ID NO: 218695 - DNA, 12 bp, Homo sapiens
tcccccacctga

SEQ ID NO: 218696 - DNA, 17 bp, Homo sapiens
tcccccacggccgtccc

SEQ ID NO: 218697 - DNA, 23 bp, Homo sapiens
tcccccacgtggactctgtgctc

SEQ ID NO: 218698 - DNA, 15 bp, Homo sapiens
tcccccagagccact

SEQ ID NO: 218699 - DNA, 12 bp, Homo sapiens
tcccccagccca

SEQ ID NO: 218700 - DNA, 16 bp, Homo sapiens
tcccccagcccaataa

SEQ ID NO: 218701 - DNA, 17 bp, Homo sapiens
tcccccagcccaataaa

SEQ ID NO: 218702 - DNA, 12 bp, Homo sapiens
tcccccaggacc

SEQ ID NO: 218703 - DNA, 13 bp, Homo sapiens
tcccccaggctgc

SEQ ID NO: 218704 - DNA, 16 bp, Homo sapiens
tcccccaggctgcgcc

SEQ ID NO: 218705 - DNA, 17 bp, Homo sapiens
tcccccaggctgcgcct

SEQ ID NO: 218706 - DNA, 20 bp, Homo sapiens
tcccccaggctgcgcctgcc

SEQ ID NO: 218707 - DNA, 16 bp, Homo sapiens
tcccccagtacctcca

SEQ ID NO: 218708 - DNA, 17 bp, Homo sapiens
tcccccatcctcccctt

SEQ ID NO: 218709 - DNA, 18 bp, Homo sapiens
tcccccatcctccccttc

SEQ ID NO: 218710 - DNA, 14 bp, Homo sapiens
tcccccatgccacc

SEQ ID NO: 218711 - DNA, 23 bp, Homo sapiens
tccccccaaatctactgagccac

SEQ ID NO: 218712 - DNA, 12 bp, Homo sapiens
tccccccagacc

SEQ ID NO: 218713 - DNA, 21 bp, Homo sapiens
tccccccagaccccgcccctg

SEQ ID NO: 218714 - DNA, 17 bp, Homo sapiens
tcccccccctgtatagt

SEQ ID NO: 218715 - DNA, 20 bp, Homo sapiens
tcccccgacactgctgcacc

SEQ ID NO: 218716 - DNA, 21 bp, Homo sapiens
tcccccgacactgctgcacca

SEQ ID NO: 218717 - DNA, 21 bp, Homo sapiens
tcccccgcaatgtgcccccag

SEQ ID NO: 218718 - DNA, 22 bp, Homo sapiens
tcccccgcaggttatgtcagca

SEQ ID NO: 218719 - DNA, 17 bp, Homo sapiens
tcccccgcagtccccag

SEQ ID NO: 218720 - DNA, 17 bp, Homo sapiens
tccccctcccctcccag

SEQ ID NO: 218721 - DNA, 12 bp, Homo sapiens
tccccctgccag

SEQ ID NO: 218722 - DNA, 22 bp, Homo sapiens
tccccctgctccatgggcacct

SEQ ID NO: 218723 - DNA, 18 bp, Homo sapiens
aagccgtctgactccaga

SEQ ID NO: 218724 - DNA, 15 bp, Homo sapiens
aagccgtggcttccc

SEQ ID NO: 218725 - DNA, 14 bp, Homo sapiens
aagcctaagaaaaa

SEQ ID NO: 218726 - DNA, 15 bp, Homo sapiens
aagcctaagaaaaag

SEQ ID NO: 218727 - DNA, 20 bp, Homo sapiens
aagcctaagaaaaaggaaat

SEQ ID NO: 218728 - DNA, 18 bp, Homo sapiens
aagcctattgtaaataca

SEQ ID NO: 218729 - DNA, 22 bp, Homo sapiens
aagcctcaactagtcatttttt

SEQ ID NO: 218730 - DNA, 19 bp, Homo sapiens
aagcctccaagcctgcctc

SEQ ID NO: 218731 - DNA, 22 bp, Homo sapiens
aagcctccatttagttctttgt

SEQ ID NO: 218732 - DNA, 16 bp, Homo sapiens
aagcctcctgccccct

SEQ ID NO: 218733 - DNA, 14 bp, Homo sapiens
aagcctctgccctg

SEQ ID NO: 218734 - DNA, 17 bp, Homo sapiens
aagcctgcaatttcata

SEQ ID NO: 218735 - DNA, 22 bp, Homo sapiens
aagcctgcaatttcatatgctg

SEQ ID NO: 218736 - DNA, 13 bp, Homo sapiens
aagcctgcctccc

SEQ ID NO: 218737 - DNA, 13 bp, Homo sapiens
aagcctgctgatt

SEQ ID NO: 218738 - DNA, 18 bp, Homo sapiens
aagcctgggcagaaatgt

SEQ ID NO: 218739 - DNA, 16 bp, Homo sapiens
aagcctgggccactgg

SEQ ID NO: 218740 - DNA, 11 bp, Homo sapiens
aagcctgtcct

SEQ ID NO: 218741 - DNA, 19 bp, Homo sapiens
aagcctgtcgtgttctctc

SEQ ID NO: 218742 - DNA, 23 bp, Homo sapiens
aagcctgtgaataaaaaccctgt

SEQ ID NO: 218743 - DNA, 14 bp, Homo sapiens
aagccttaagccat

SEQ ID NO: 218744 - DNA, 14 bp, Homo sapiens
aagccttgcccagc

SEQ ID NO: 218745 - DNA, 13 bp, Homo sapiens
aagcctttaaatt

SEQ ID NO: 218746 - DNA, 22 bp, Homo sapiens
aagcctttcataccagtcagta

SEQ ID NO: 218747 - DNA, 13 bp, Homo sapiens
aagcgaacatctt

SEQ ID NO: 218748 - DNA, 14 bp, Homo sapiens
aagcgaacatcttc

SEQ ID NO: 218749 - DNA, 22 bp, Homo sapiens
aagcgaacatcttcatataaac

SEQ ID NO: 218750 - DNA, 22 bp, Homo sapiens
aagcgaagtctttgccttctct

SEQ ID NO: 218751 - DNA, 18 bp, Homo sapiens
aagcgagcacagtattat

SEQ ID NO: 218752 - DNA, 21 bp, Homo sapiens
aagcgatatacagatgaaaat

SEQ ID NO: 218753 - DNA, 21 bp, Homo sapiens
aagcggagttcctaacaggat

SEQ ID NO: 218754 - DNA, 12 bp, Homo sapiens
aagcgggcagcc

SEQ ID NO: 218755 - DNA, 13 bp, Homo sapiens
aagcggggggagg

SEQ ID NO: 218756 - DNA, 15 bp, Homo sapiens
aagcgtctcccttgg

SEQ ID NO: 218757 - DNA, 19 bp, Homo sapiens
aagcgtctcccttggccac

SEQ ID NO: 218758 - DNA, 11 bp, Homo sapiens
aagctaaagag

SEQ ID NO: 218759 - DNA, 21 bp, Homo sapiens
aagctaaatcctttactgtta

SEQ ID NO: 218760 - DNA, 17 bp, Homo sapiens
aagctaataaaatatca

SEQ ID NO: 218761 - DNA, 21 bp, Homo sapiens
aagctaataaaatatcattca

SEQ ID NO: 218762 - DNA, 18 bp, Homo sapiens
aagctagacaaaggccca

SEQ ID NO: 218763 - DNA, 22 bp, Homo sapiens
aagctagacgagcaggcttctt

SEQ ID NO: 218764 - DNA, 18 bp, Homo sapiens
aagctagtggcttcaaaa

SEQ ID NO: 218765 - DNA, 15 bp, Homo sapiens
aagctatatatgaat

SEQ ID NO: 218766 - DNA, 18 bp, Homo sapiens
aagctatgagaataactt

SEQ ID NO: 218767 - DNA, 14 bp, Homo sapiens
aagctatgtcacta

SEQ ID NO: 218768 - DNA, 13 bp, Homo sapiens
aagctatttcctt

SEQ ID NO: 218769 - DNA, 15 bp, Homo sapiens
aagctcaaggctgca

SEQ ID NO: 218770 - DNA, 13 bp, Homo sapiens
aagctcagagcag

SEQ ID NO: 218771 - DNA, 14 bp, Homo sapiens
aagctcagagcagc

SEQ ID NO: 218772 - DNA, 15 bp, Homo sapiens
aagctcagcccaccc

SEQ ID NO: 218773 - DNA, 12 bp, Homo sapiens
aagctcatattt

SEQ ID NO: 218774 - DNA, 23 bp, Homo sapiens
aagctcatattttgtatatatct

SEQ ID NO: 218775 - DNA, 19 bp, Homo sapiens
aagctccacggtgcgtggc

SEQ ID NO: 218776 - DNA, 19 bp, Homo sapiens
aagctccttcagtttgaag

SEQ ID NO: 218777 - DNA, 22 bp, Homo sapiens
aagctctcttgccgaggagcca

SEQ ID NO: 218778 - DNA, 13 bp, Homo sapiens
aagctgaatattt

SEQ ID NO: 218779 - DNA, 14 bp, Homo sapiens
aagctgaggcggga

SEQ ID NO: 218780 - DNA, 16 bp, Homo sapiens
aagctgattactgtca

SEQ ID NO: 218781 - DNA, 23 bp, Homo sapiens
aagctgattactgtcaataaaca

SEQ ID NO: 218782 - DNA, 18 bp, Homo sapiens
aagctgattcccagagca

SEQ ID NO: 218783 - DNA, 13 bp, Homo sapiens
aagctgcagcttg

SEQ ID NO: 218784 - DNA, 22 bp, Homo sapiens
aagctgcctctgacagcagcct

SEQ ID NO: 218785 - DNA, 16 bp, Homo sapiens
aagctgcctgtagtta

SEQ ID NO: 218786 - DNA, 21 bp, Homo sapiens
aagctgcctgtagttaggaaa

SEQ ID NO: 218787 - DNA, 18 bp, Homo sapiens
aagctgcttctgggggat

SEQ ID NO: 218788 - DNA, 17 bp, Homo sapiens
aagctggacaagaagct

SEQ ID NO: 218789 - DNA, 20 bp, Homo sapiens
aagctggagccaatggtgag

SEQ ID NO: 218790 - DNA, 17 bp, Homo sapiens
aagctggagtgctgctt

SEQ ID NO: 218791 - DNA, 22 bp, Homo sapiens
aagctgggaaaaaagttttgat

SEQ ID NO: 218792 - DNA, 22 bp, Homo sapiens
aagctgggactcattcacattt

SEQ ID NO: 218793 - DNA, 23 bp, Homo sapiens
aagctgtagtagccctttctgtg

SEQ ID NO: 218794 - DNA, 12 bp, Homo sapiens
aagctgtcccct

SEQ ID NO: 218795 - DNA, 14 bp, Homo sapiens
aagctgtgaaattg

SEQ ID NO: 218796 - DNA, 15 bp, Homo sapiens
aagctgtttccatag

SEQ ID NO: 218797 - DNA, 15 bp, Homo sapiens
aagcttaaaaaaaac

SEQ ID NO: 218798 - DNA, 13 bp, Homo sapiens
aagcttaaaataa

SEQ ID NO: 218799 - DNA, 18 bp, Homo sapiens
aagcttaaaataagtgaa

SEQ ID NO: 218800 - DNA, 16 bp, Homo sapiens
aagcttaaggagagga

SEQ ID NO: 218801 - DNA, 14 bp, Homo sapiens
aagcttagaagcca

SEQ ID NO: 218802 - DNA, 20 bp, Homo sapiens
aagcttagaagccaccatgt

SEQ ID NO: 218803 - DNA, 14 bp, Homo sapiens
tccgggcaggggag

SEQ ID NO: 218804 - DNA, 15 bp, Homo sapiens
tccggggtctgtgct

SEQ ID NO: 218805 - DNA, 18 bp, Homo sapiens
tccggggtctgtgctgtg

SEQ ID NO: 218806 - DNA, 18 bp, Homo sapiens
tccggggtggtggacagg

SEQ ID NO: 218807 - DNA, 18 bp, Homo sapiens
tccggtggaaggccttct

SEQ ID NO: 218808 - DNA, 20 bp, Homo sapiens
tccgtaccatcggtcagcag

SEQ ID NO: 218809 - DNA, 18 bp, Homo sapiens
tccgtatttattttttta

SEQ ID NO: 218810 - DNA, 20 bp, Homo sapiens
tccgtcaccagaattagtcc

SEQ ID NO: 218811 - DNA, 20 bp, Homo sapiens
tccgtcacccttggtagagt

SEQ ID NO: 218812 - DNA, 17 bp, Homo sapiens
tccgtccacccaggctg

SEQ ID NO: 218813 - DNA, 20 bp, Homo sapiens
tccgtccacccaggctgcac

SEQ ID NO: 218814 - DNA, 22 bp, Homo sapiens
tccgtccacccaggctgcactg

SEQ ID NO: 218815 - DNA, 13 bp, Homo sapiens
tccgtccccaggg

SEQ ID NO: 218816 - DNA, 17 bp, Homo sapiens
tccgtccgcccgcccac

SEQ ID NO: 218817 - DNA, 17 bp, Homo sapiens
tccgtctcctctccagc

SEQ ID NO: 218818 - DNA, 20 bp, Homo sapiens
tccgtctcctctccagccct

SEQ ID NO: 218819 - DNA, 20 bp, Homo sapiens
tccgtgatccatccatctcc

SEQ ID NO: 218820 - DNA, 14 bp, Homo sapiens
tccgtgtggagcac

SEQ ID NO: 218821 - DNA, 16 bp, Homo sapiens
tccgttcatctgagga

SEQ ID NO: 218822 - DNA, 21 bp, Homo sapiens
tccgttcccacctctgaggac

SEQ ID NO: 218823 - DNA, 19 bp, Homo sapiens
tccgtttccaggtgtttat

SEQ ID NO: 218824 - DNA, 21 bp, Homo sapiens
tcctaaaaatctgtggcaagc

SEQ ID NO: 218825 - DNA, 15 bp, Homo sapiens
tcctaaaacaaatag

SEQ ID NO: 218826 - DNA, 17 bp, Homo sapiens
tcctaaagaaaaagata

SEQ ID NO: 218827 - DNA, 23 bp, Homo sapiens
tcctaaataatatcctgaataac

SEQ ID NO: 218828 - DNA, 13 bp, Homo sapiens
tcctaaatatcca

SEQ ID NO: 218829 - DNA, 18 bp, Homo sapiens
tcctaaatattggtttgt

SEQ ID NO: 218830 - DNA, 15 bp, Homo sapiens
tcctaaatgcagtga

SEQ ID NO: 218831 - DNA, 17 bp, Homo sapiens
tcctaaatgtcagctgt

SEQ ID NO: 218832 - DNA, 16 bp, Homo sapiens
tcctaacacagcatgt

SEQ ID NO: 218833 - DNA, 16 bp, Homo sapiens
tcctaagcaaaaggga

SEQ ID NO: 218834 - DNA, 13 bp, Homo sapiens
tcctaagcctgtt

SEQ ID NO: 218835 - DNA, 12 bp, Homo sapiens
tcctaaggacac

SEQ ID NO: 218836 - DNA, 18 bp, Homo sapiens
tcctaaggacacactaat

SEQ ID NO: 218837 - DNA, 22 bp, Homo sapiens
tcctaatcagaaatttttatca

SEQ ID NO: 218838 - DNA, 13 bp, Homo sapiens
tcctaatgcatta

SEQ ID NO: 218839 - DNA, 19 bp, Homo sapiens
tcctacaagagcagcctgt

SEQ ID NO: 218840 - DNA, 17 bp, Homo sapiens
tcctacagccccttttt

SEQ ID NO: 218841 - DNA, 19 bp, Homo sapiens
tcctacaggcgctccaggc

SEQ ID NO: 218842 - DNA, 18 bp, Homo sapiens
tcctacatacttctttca

SEQ ID NO: 218843 - DNA, 13 bp, Homo sapiens
tcctaccaatgca

SEQ ID NO: 218844 - DNA, 23 bp, Homo sapiens
tcctaccccacctcatgcctggc

SEQ ID NO: 218845 - DNA, 20 bp, Homo sapiens
tcctacccctgtcctggggc

SEQ ID NO: 218846 - DNA, 17 bp, Homo sapiens
tcctaccctcccaccag

SEQ ID NO: 218847 - DNA, 19 bp, Homo sapiens
tcctaccctcttattgttc

SEQ ID NO: 218848 - DNA, 12 bp, Homo sapiens
tcctacctggtc

SEQ ID NO: 218849 - DNA, 21 bp, Homo sapiens
tcctaccttttgataaaatgt

SEQ ID NO: 218850 - DNA, 18 bp, Homo sapiens
tcctactttacatatgct

SEQ ID NO: 218851 - DNA, 18 bp, Homo sapiens
tcctagaggtgggcagct

SEQ ID NO: 218852 - DNA, 20 bp, Homo sapiens
tcctagaggtgggcagctgg

SEQ ID NO: 218853 - DNA, 17 bp, Homo sapiens
gcactccatggccaccc

SEQ ID NO: 218854 - DNA, 15 bp, Homo sapiens
gcactcccagggccc

SEQ ID NO: 218855 - DNA, 18 bp, Homo sapiens
gcactcccagggcccgag

SEQ ID NO: 218856 - DNA, 18 bp, Homo sapiens
gcactcgagaccatcctg

SEQ ID NO: 218857 - DNA, 19 bp, Homo sapiens
gcactctctgccagctcca

SEQ ID NO: 218858 - DNA, 11 bp, Homo sapiens
gcactctgctg

SEQ ID NO: 218859 - DNA, 12 bp, Homo sapiens
gcactgaaaacc

SEQ ID NO: 218860 - DNA, 19 bp, Homo sapiens
gcactgaatcgtttcatgt

SEQ ID NO: 218861 - DNA, 21 bp, Homo sapiens
gcactgaatcgtttcatgtaa

SEQ ID NO: 218862 - DNA, 21 bp, Homo sapiens
gcactgacctgctccgccagg

SEQ ID NO: 218863 - DNA, 15 bp, Homo sapiens
gcactgagggccaca

SEQ ID NO: 218864 - DNA, 16 bp, Homo sapiens
gcactgagggccacac

SEQ ID NO: 218865 - DNA, 20 bp, Homo sapiens
gcactgatttcacaacagat

SEQ ID NO: 218866 - DNA, 14 bp, Homo sapiens
gcactgcagtgatg

SEQ ID NO: 218867 - DNA, 13 bp, Homo sapiens
gcactgccttctc

SEQ ID NO: 218868 - DNA, 17 bp, Homo sapiens
gcactgcgccacctgct

SEQ ID NO: 218869 - DNA, 20 bp, Homo sapiens
gcactgctgcccagcctcca

SEQ ID NO: 218870 - DNA, 12 bp, Homo sapiens
gcactgctgttc

SEQ ID NO: 218871 - DNA, 14 bp, Homo sapiens
gcactggagtgcag

SEQ ID NO: 218872 - DNA, 15 bp, Homo sapiens
gcactggagtgcagg

SEQ ID NO: 218873 - DNA, 12 bp, Homo sapiens
gcactggccaga

SEQ ID NO: 218874 - DNA, 18 bp, Homo sapiens
gcactggccagagagggc

SEQ ID NO: 218875 - DNA, 22 bp, Homo sapiens
gcactggccagagagggcccag

SEQ ID NO: 218876 - DNA, 23 bp, Homo sapiens
gcactggccagagagggcccagc

SEQ ID NO: 218877 - DNA, 15 bp, Homo sapiens
gcactggccccaccc

SEQ ID NO: 218878 - DNA, 16 bp, Homo sapiens
gcactggctctctcca

SEQ ID NO: 218879 - DNA, 19 bp, Homo sapiens
gcactggctctctccagga

SEQ ID NO: 218880 - DNA, 22 bp, Homo sapiens
gcactgggctaatttgtatgtt

SEQ ID NO: 218881 - DNA, 15 bp, Homo sapiens
gcactggtttgtttc

SEQ ID NO: 218882 - DNA, 12 bp, Homo sapiens
gcactgtaaaat

SEQ ID NO: 218883 - DNA, 13 bp, Homo sapiens
gcactgtaaaatg

SEQ ID NO: 218884 - DNA, 23 bp, Homo sapiens
gcactgtaaaatgtgggattatg

SEQ ID NO: 218885 - DNA, 17 bp, Homo sapiens
gcactgtcccttgcctc

SEQ ID NO: 218886 - DNA, 14 bp, Homo sapiens
gcactgtggccttg

SEQ ID NO: 218887 - DNA, 19 bp, Homo sapiens
gcactgtgtaaccagcagt

SEQ ID NO: 218888 - DNA, 20 bp, Homo sapiens
gcactgtgtttatatgtctt

SEQ ID NO: 218889 - DNA, 13 bp, Homo sapiens
gcactgtttcttc

SEQ ID NO: 218890 - DNA, 23 bp, Homo sapiens
gcacttattatgaggctattaaa

SEQ ID NO: 218891 - DNA, 20 bp, Homo sapiens
gcacttattttttaatgtga

SEQ ID NO: 218892 - DNA, 21 bp, Homo sapiens
gcacttgcacgcccatgtgtg

SEQ ID NO: 218893 - DNA, 17 bp, Homo sapiens
gcacttgcgtcctgcag

SEQ ID NO: 218894 - DNA, 18 bp, Homo sapiens
gcacttgcgtcctgcaga

SEQ ID NO: 218895 - DNA, 20 bp, Homo sapiens
gcacttgcgtcctgcagagg

SEQ ID NO: 218896 - DNA, 18 bp, Homo sapiens
gcacttggagacttgtat

SEQ ID NO: 218897 - DNA, 20 bp, Homo sapiens
gcactttagtgattgctttt

SEQ ID NO: 218898 - DNA, 21 bp, Homo sapiens
gcactttgaaaatatttctat

SEQ ID NO: 218899 - DNA, 16 bp, Homo sapiens
gcactttgggaggcct

SEQ ID NO: 218900 - DNA, 15 bp, Homo sapiens
gcactttttcacata

SEQ ID NO: 218901 - DNA, 20 bp, Homo sapiens
gcagaaaaaaaaaaagaaac

SEQ ID NO: 218902 - DNA, 15 bp, Homo sapiens
gcagaaaagaggaga

SEQ ID NO: 218903 - DNA, 19 bp, Homo sapiens
gcagaaaagaggagaccct

SEQ ID NO: 218904 - DNA, 21 bp, Homo sapiens
gcagaaaccttgtttgtttta

SEQ ID NO: 218905 - DNA, 13 bp, Homo sapiens
gcagaaagcagag

SEQ ID NO: 218906 - DNA, 18 bp, Homo sapiens
gcagaaagcagaggctgg

SEQ ID NO: 218907 - DNA, 13 bp, Homo sapiens
gcagaaaggagat

SEQ ID NO: 218908 - DNA, 17 bp, Homo sapiens
gcagaaagggagcagag

SEQ ID NO: 218909 - DNA, 19 bp, Homo sapiens
gcagaaatgtggatgctct

SEQ ID NO: 218910 - DNA, 15 bp, Homo sapiens
gcagaacacctggcc

SEQ ID NO: 218911 - DNA, 13 bp, Homo sapiens
gcagaacctggtg

SEQ ID NO: 218912 - DNA, 14 bp, Homo sapiens
gcagaacctggtgg

SEQ ID NO: 218913 - DNA, 15 bp, Homo sapiens
gcagaacctggtggc

SEQ ID NO: 218914 - DNA, 14 bp, Homo sapiens
gcagaactctctgt

SEQ ID NO: 218915 - DNA, 16 bp, Homo sapiens
gcagaagcgtctccct

SEQ ID NO: 218916 - DNA, 17 bp, Homo sapiens
gcagaagtgctctttgt

SEQ ID NO: 218917 - DNA, 13 bp, Homo sapiens
gcagacacacaca

SEQ ID NO: 218918 - DNA, 14 bp, Homo sapiens
gcagacacacacac

SEQ ID NO: 218919 - DNA, 17 bp, Homo sapiens
gcagacagacagacaga

SEQ ID NO: 218920 - DNA, 21 bp, Homo sapiens
gcagacaggccatgtgagcca

SEQ ID NO: 218921 - DNA, 14 bp, Homo sapiens
gcagacctgggact

SEQ ID NO: 218922 - DNA, 18 bp, Homo sapiens
gcagactcgttctcgtga

SEQ ID NO: 218923 - DNA, 14 bp, Homo sapiens
gcagactggagggg

SEQ ID NO: 218924 - DNA, 22 bp, Homo sapiens
gcagacttgagtctgaggcccc

SEQ ID NO: 218925 - DNA, 19 bp, Homo sapiens
gcagagacggcagccccat

SEQ ID NO: 218926 - DNA, 19 bp, Homo sapiens
gcagagcaaatgagggagg

SEQ ID NO: 218927 - DNA, 15 bp, Homo sapiens
gcagagccatgggcc

SEQ ID NO: 218928 - DNA, 16 bp, Homo sapiens
gcagagccatgggcct

SEQ ID NO: 218929 - DNA, 17 bp, Homo sapiens
gcagagccatgggcctg

SEQ ID NO: 218930 - DNA, 21 bp, Homo sapiens
gcagagccatgggcctgggcc

SEQ ID NO: 218931 - DNA, 11 bp, Homo sapiens
gcagagccccg

SEQ ID NO: 218932 - DNA, 13 bp, Homo sapiens
gcagagccccgga

SEQ ID NO: 218933 - DNA, 17 bp, Homo sapiens
gcagagccccggagcac

SEQ ID NO: 218934 - DNA, 18 bp, Homo sapiens
gcagagccccggagcacc

SEQ ID NO: 218935 - DNA, 22 bp, Homo sapiens
gcagagcccgcccacctgggcc

SEQ ID NO: 218936 - DNA, 16 bp, Homo sapiens
gcagagccgttcctgg

SEQ ID NO: 218937 - DNA, 18 bp, Homo sapiens
gcagagccgttcctggga

SEQ ID NO: 218938 - DNA, 11 bp, Homo sapiens
gcagagcctgt

SEQ ID NO: 218939 - DNA, 15 bp, Homo sapiens
gcagagctcagagga

SEQ ID NO: 218940 - DNA, 21 bp, Homo sapiens
gcagagctcagaggagtctgg

SEQ ID NO: 218941 - DNA, 16 bp, Homo sapiens
tcctcctgaagcctct

SEQ ID NO: 218942 - DNA, 18 bp, Homo sapiens
tcctcctgaagcctctgc

SEQ ID NO: 218943 - DNA, 21 bp, Homo sapiens
tcctcctgaagcctctgccct

SEQ ID NO: 218944 - DNA, 21 bp, Homo sapiens
tcctcctgacagcgacagaaa

SEQ ID NO: 218945 - DNA, 23 bp, Homo sapiens
tcctcctgatggccaagagcatc

SEQ ID NO: 218946 - DNA, 13 bp, Homo sapiens
tcctcctgccctg

SEQ ID NO: 218947 - DNA, 19 bp, Homo sapiens
tcctcctgccctgtccctg

SEQ ID NO: 218948 - DNA, 14 bp, Homo sapiens
tcctcctggaccca

SEQ ID NO: 218949 - DNA, 16 bp, Homo sapiens
tcctcctggacccagc

SEQ ID NO: 218950 - DNA, 14 bp, Homo sapiens
tcctcctggagcag

SEQ ID NO: 218951 - DNA, 21 bp, Homo sapiens
tcctcctgttcctgccttctc

SEQ ID NO: 218952 - DNA, 22 bp, Homo sapiens
tcctcctgttcctgccttctct

SEQ ID NO: 218953 - DNA, 24 bp, Homo sapiens
tcctccttgcccagactacagggc

SEQ ID NO: 218954 - DNA, 19 bp, Homo sapiens
tcctccttttcacagttct

SEQ ID NO: 218955 - DNA, 16 bp, Homo sapiens
tcctcgcagatgataa

SEQ ID NO: 218956 - DNA, 18 bp, Homo sapiens
tcctcgcctaggcctgtg

SEQ ID NO: 218957 - DNA, 15 bp, Homo sapiens
tcctcgcctgacaac

SEQ ID NO: 218958 - DNA, 13 bp, Homo sapiens
tcctcgctctcct

SEQ ID NO: 218959 - DNA, 13 bp, Homo sapiens
tcctcgctgtgcc

SEQ ID NO: 218960 - DNA, 14 bp, Homo sapiens
tcctcgctgtgcca

SEQ ID NO: 218961 - DNA, 15 bp, Homo sapiens
tcctcggccagagct

SEQ ID NO: 218962 - DNA, 16 bp, Homo sapiens
tcctcggccagagctc

SEQ ID NO: 218963 - DNA, 21 bp, Homo sapiens
tcctcggccagagctcccagg

SEQ ID NO: 218964 - DNA, 22 bp, Homo sapiens
tcctcggccagagctcccagga

SEQ ID NO: 218965 - DNA, 15 bp, Homo sapiens
tcctcgggcgcctgc

SEQ ID NO: 218966 - DNA, 18 bp, Homo sapiens
tcctcgggcgcctgcgct

SEQ ID NO: 218967 - DNA, 20 bp, Homo sapiens
tcctcggtggcatttgctga

SEQ ID NO: 218968 - DNA, 15 bp, Homo sapiens
tcctcgtcccctgcc

SEQ ID NO: 218969 - DNA, 17 bp, Homo sapiens
tcctcgtccggcctgca

SEQ ID NO: 218970 - DNA, 19 bp, Homo sapiens
tcctctacttaatgagata

SEQ ID NO: 218971 - DNA, 11 bp, Homo sapiens
tcctctatttt

SEQ ID NO: 218972 - DNA, 12 bp, Homo sapiens
tcctctattttg

SEQ ID NO: 218973 - DNA, 18 bp, Homo sapiens
tcctctattttgtgatga

SEQ ID NO: 218974 - DNA, 13 bp, Homo sapiens
tcctctccactcc

SEQ ID NO: 218975 - DNA, 16 bp, Homo sapiens
tcctctccactgcctt

SEQ ID NO: 218976 - DNA, 19 bp, Homo sapiens
tcctctccccaacccttcc

SEQ ID NO: 218977 - DNA, 19 bp, Homo sapiens
tcctctcccctctaaggcc

SEQ ID NO: 218978 - DNA, 20 bp, Homo sapiens
tcctctccgcagttcctgtc

SEQ ID NO: 218979 - DNA, 23 bp, Homo sapiens
tcctctcctcgtccggcctgcag

SEQ ID NO: 218980 - DNA, 13 bp, Homo sapiens
tcctctcctgccc

SEQ ID NO: 218981 - DNA, 20 bp, Homo sapiens
tcctctcctgcccagctctg

SEQ ID NO: 218982 - DNA, 21 bp, Homo sapiens
tcctctcctgcccagctctga

SEQ ID NO: 218983 - DNA, 16 bp, Homo sapiens
tcctctccttgggctc

SEQ ID NO: 218984 - DNA, 21 bp, Homo sapiens
gcagcaccctttcacccccaa

SEQ ID NO: 218985 - DNA, 12 bp, Homo sapiens
gcagcagcccag

SEQ ID NO: 218986 - DNA, 16 bp, Homo sapiens
gcagcagctaggactg

SEQ ID NO: 218987 - DNA, 21 bp, Homo sapiens
gcagcagctccgcctggcacc

SEQ ID NO: 218988 - DNA, 15 bp, Homo sapiens
gcagcagctgggacc

SEQ ID NO: 218989 - DNA, 18 bp, Homo sapiens
gcagcagctgggacccct

SEQ ID NO: 218990 - DNA, 23 bp, Homo sapiens
gcagcagctgggacccctcccaa

SEQ ID NO: 218991 - DNA, 13 bp, Homo sapiens
gcagcaggcagag

SEQ ID NO: 218992 - DNA, 15 bp, Homo sapiens
gcagcatcttcaaac

SEQ ID NO: 218993 - DNA, 21 bp, Homo sapiens
gcagcatcttcaaacatgtac

SEQ ID NO: 218994 - DNA, 21 bp, Homo sapiens
gcagcatgtggggaagcaaga

SEQ ID NO: 218995 - DNA, 12 bp, Homo sapiens
gcagccaaggtg

SEQ ID NO: 218996 - DNA, 22 bp, Homo sapiens
gcagccagccgtgagtgcagac

SEQ ID NO: 218997 - DNA, 13 bp, Homo sapiens
gcagccaggctgc

SEQ ID NO: 218998 - DNA, 14 bp, Homo sapiens
gcagccaggctgcc

SEQ ID NO: 218999 - DNA, 16 bp, Homo sapiens
gcagccagggagcccg

SEQ ID NO: 219000 - DNA, 11 bp, Homo sapiens
gcagccatgcc

SEQ ID NO: 219001 - DNA, 16 bp, Homo sapiens
gcagccatgcctcatg

SEQ ID NO: 219002 - DNA, 16 bp, Homo sapiens
gcagcccacagaggac

SEQ ID NO: 219003 - DNA, 15 bp, Homo sapiens
gcagcccagagagac

SEQ ID NO: 219004 - DNA, 23 bp, Homo sapiens
gcagcccagagagaccctgccaa

SEQ ID NO: 219005 - DNA, 19 bp, Homo sapiens
gcagcccagcttcctggtg

SEQ ID NO: 219006 - DNA, 17 bp, Homo sapiens
gcagcccatgcccacct

SEQ ID NO: 219007 - DNA, 18 bp, Homo sapiens
gcagcccatgcccacctg

SEQ ID NO: 219008 - DNA, 21 bp, Homo sapiens
gcagccccatccttcccgcag

SEQ ID NO: 219009 - DNA, 13 bp, Homo sapiens
gcagccccccaga

SEQ ID NO: 219010 - DNA, 21 bp, Homo sapiens
gcagccccgttttggggacgt

SEQ ID NO: 219011 - DNA, 14 bp, Homo sapiens
gcagcccctgctgg

SEQ ID NO: 219012 - DNA, 15 bp, Homo sapiens
gcagcccctgctgga

SEQ ID NO: 219013 - DNA, 18 bp, Homo sapiens
gcagcccctgctggacca

SEQ ID NO: 219014 - DNA, 22 bp, Homo sapiens
gcagcccctgctggaccaaggt

SEQ ID NO: 219015 - DNA, 20 bp, Homo sapiens
gcagcccctggagctcctgc

SEQ ID NO: 219016 - DNA, 22 bp, Homo sapiens
gcagcccctggagctcctgctg

SEQ ID NO: 219017 - DNA, 15 bp, Homo sapiens
gcagcccgcctgccg

SEQ ID NO: 219018 - DNA, 16 bp, Homo sapiens
gcagcccgcctgccgt

SEQ ID NO: 219019 - DNA, 19 bp, Homo sapiens
gcagcccgcctgccgtgca

SEQ ID NO: 219020 - DNA, 20 bp, Homo sapiens
gcagcccgtgaagcagtgcc

SEQ ID NO: 219021 - DNA, 19 bp, Homo sapiens
gcagcccgtgtggcccctt

SEQ ID NO: 219022 - DNA, 20 bp, Homo sapiens
gcagcccgtgtggccccttc

SEQ ID NO: 219023 - DNA, 24 bp, Homo sapiens
gcagccctaaggatctctcaggag

SEQ ID NO: 219024 - DNA, 24 bp, Homo sapiens
gcagccctgctttgggctgccctg

SEQ ID NO: 219025 - DNA, 14 bp, Homo sapiens
gcagcccttgggca

SEQ ID NO: 219026 - DNA, 14 bp, Homo sapiens
gcagccgagctcgt

SEQ ID NO: 219027 - DNA, 14 bp, Homo sapiens
gcagccgccttcct

SEQ ID NO: 219028 - DNA, 16 bp, Homo sapiens
gcagccgccttccttg

SEQ ID NO: 219029 - DNA, 18 bp, Homo sapiens
gcagccgcgctctgcccc

SEQ ID NO: 219030 - DNA, 19 bp, Homo sapiens
gcagccgcgctctgcccct

SEQ ID NO: 219031 - DNA, 16 bp, Homo sapiens
gcagcctcagggcttc

SEQ ID NO: 219032 - DNA, 19 bp, Homo sapiens
gcagcctcagggcttcctt

SEQ ID NO: 219033 - DNA, 20 bp, Homo sapiens
gcagcctcagggcttcctta

SEQ ID NO: 219034 - DNA, 13 bp, Homo sapiens
gcagcctccactg

SEQ ID NO: 219035 - DNA, 13 bp, Homo sapiens
gcagcctccagag

SEQ ID NO: 219036 - DNA, 19 bp, Homo sapiens
gcagcctccagagccagcc

SEQ ID NO: 219037 - DNA, 22 bp, Homo sapiens
gcagcctccagagccagcctgg

SEQ ID NO: 219038 - DNA, 18 bp, Homo sapiens
gcagcctcgaactcctgg

SEQ ID NO: 219039 - DNA, 21 bp, Homo sapiens
gcagcctcgaactcctgggct

SEQ ID NO: 219040 - DNA, 14 bp, Homo sapiens
gcagcctctgccag

SEQ ID NO: 219041 - DNA, 16 bp, Homo sapiens
gcagcctctgccaggc

SEQ ID NO: 219042 - DNA, 11 bp, Homo sapiens
gcagcctgagc

SEQ ID NO: 219043 - DNA, 12 bp, Homo sapiens
gcagcctgagct

SEQ ID NO: 219044 - DNA, 15 bp, Homo sapiens
gcagcctgagctcca

SEQ ID NO: 219045 - DNA, 15 bp, Homo sapiens
gcagcctgatggcca

SEQ ID NO: 219046 - DNA, 21 bp, Homo sapiens
gcagcctgatggccaaggggg

SEQ ID NO: 219047 - DNA, 21 bp, Homo sapiens
gcagcctggctcccaggacac

SEQ ID NO: 219048 - DNA, 18 bp, Homo sapiens
gcagcctggttccctctt

SEQ ID NO: 219049 - DNA, 15 bp, Homo sapiens
gcagcctgtgaggga

SEQ ID NO: 219050 - DNA, 17 bp, Homo sapiens
gcagcctgtgagggagt

SEQ ID NO: 219051 - DNA, 15 bp, Homo sapiens
gcagcctgtgggaga

SEQ ID NO: 219052 - DNA, 20 bp, Homo sapiens
gcagcctgtgggagaaggga

SEQ ID NO: 219053 - DNA, 23 bp, Homo sapiens
gcagcctgtgggagaagggacag

SEQ ID NO: 219054 - DNA, 16 bp, Homo sapiens
gcagccttcccctccc

SEQ ID NO: 219055 - DNA, 21 bp, Homo sapiens
gcagccttcccctccctgtat

SEQ ID NO: 219056 - DNA, 15 bp, Homo sapiens
gcagcctttctgtgg

SEQ ID NO: 219057 - DNA, 18 bp, Homo sapiens
gcagcctttgcctccccg

SEQ ID NO: 219058 - DNA, 17 bp, Homo sapiens
gcagcgcctcccgccgc

SEQ ID NO: 219059 - DNA, 18 bp, Homo sapiens
gcagcgcctcctggacac

SEQ ID NO: 219060 - DNA, 13 bp, Homo sapiens
gcagcggcccaga

SEQ ID NO: 219061 - DNA, 19 bp, Homo sapiens
gcagcggtggaaggagcct

SEQ ID NO: 219062 - DNA, 20 bp, Homo sapiens
gcagcggtggaaggagcctg

SEQ ID NO: 219063 - DNA, 21 bp, Homo sapiens
gcagcgtctgagcggccgcct

SEQ ID NO: 219064 - DNA, 22 bp, Homo sapiens
gcagcgtctgagcggccgcctg

SEQ ID NO: 219065 - DNA, 17 bp, Homo sapiens
gcagctaaggggcagga

SEQ ID NO: 219066 - DNA, 19 bp, Homo sapiens
gcagctagactggagtgag

SEQ ID NO: 219067 - DNA, 21 bp, Homo sapiens
gcagctagactggagtgaggc

SEQ ID NO: 219068 - DNA, 17 bp, Homo sapiens
gcagctaggactgagga

SEQ ID NO: 219069 - DNA, 18 bp, Homo sapiens
gcagctaggactgaggag

SEQ ID NO: 219070 - DNA, 20 bp, Homo sapiens
gcagctaggactgaggagtg

SEQ ID NO: 219071 - DNA, 18 bp, Homo sapiens
gcagctattcacacacac

SEQ ID NO: 219072 - DNA, 22 bp, Homo sapiens
gcagctcaagttagcatttcaa

SEQ ID NO: 219073 - DNA, 15 bp, Homo sapiens
gcagctcacccctgg

SEQ ID NO: 219074 - DNA, 17 bp, Homo sapiens
gcagctcacccctgggc

SEQ ID NO: 219075 - DNA, 19 bp, Homo sapiens
gcagctcacccctgggcag

SEQ ID NO: 219076 - DNA, 15 bp, Homo sapiens
gcagctcaggcgcag

SEQ ID NO: 219077 - DNA, 16 bp, Homo sapiens
gcagctcaggcgcagc

SEQ ID NO: 219078 - DNA, 11 bp, Homo sapiens
tcctgccagct

SEQ ID NO: 219079 - DNA, 14 bp, Homo sapiens
tcctgccagctgcc

SEQ ID NO: 219080 - DNA, 20 bp, Homo sapiens
tcctgccagctgccttcctc

SEQ ID NO: 219081 - DNA, 17 bp, Homo sapiens
tcctgccaggagcagcc

SEQ ID NO: 219082 - DNA, 12 bp, Homo sapiens
tcctgcccagat

SEQ ID NO: 219083 - DNA, 14 bp, Homo sapiens
tcctgcccagctct

SEQ ID NO: 219084 - DNA, 16 bp, Homo sapiens
tcctgcccagctctga

SEQ ID NO: 219085 - DNA, 22 bp, Homo sapiens
tcctgcccagctctgaccctga

SEQ ID NO: 219086 - DNA, 19 bp, Homo sapiens
tcctgcccagtgttgtttg

SEQ ID NO: 219087 - DNA, 14 bp, Homo sapiens
tcctgccccaggcc

SEQ ID NO: 219088 - DNA, 16 bp, Homo sapiens
tcctgccccctgccag

SEQ ID NO: 219089 - DNA, 23 bp, Homo sapiens
tcctgccctacagaggtctctgc

SEQ ID NO: 219090 - DNA, 21 bp, Homo sapiens
tcctgccctgtccctgtcccc

SEQ ID NO: 219091 - DNA, 17 bp, Homo sapiens
tcctgcccttttcctgg

SEQ ID NO: 219092 - DNA, 12 bp, Homo sapiens
tcctgcctcagc

SEQ ID NO: 219093 - DNA, 13 bp, Homo sapiens
tcctgcctcagcc

SEQ ID NO: 219094 - DNA, 14 bp, Homo sapiens
tcctgcctgcccct

SEQ ID NO: 219095 - DNA, 21 bp, Homo sapiens
tcctgctacagtagctgtggg

SEQ ID NO: 219096 - DNA, 19 bp, Homo sapiens
tcctgctatttcccaagct

SEQ ID NO: 219097 - DNA, 19 bp, Homo sapiens
tcctgctccatgactggct

SEQ ID NO: 219098 - DNA, 22 bp, Homo sapiens
tcctgctctctacccagcccat

SEQ ID NO: 219099 - DNA, 19 bp, Homo sapiens
tcctgctgagtggtccaca

SEQ ID NO: 219100 - DNA, 23 bp, Homo sapiens
tcctgctgctgtaactgctgagc

SEQ ID NO: 219101 - DNA, 22 bp, Homo sapiens
tcctgctggctgaggcttgggc

SEQ ID NO: 219102 - DNA, 13 bp, Homo sapiens
tcctgctgtggaa

SEQ ID NO: 219103 - DNA, 21 bp, Homo sapiens
tcctgcttgtactaagccagg

SEQ ID NO: 219104 - DNA, 23 bp, Homo sapiens
tcctgcttgtactaagccaggag

SEQ ID NO: 219105 - DNA, 24 bp, Homo sapiens
tcctgctttacaggatcatgtaaa

SEQ ID NO: 219106 - DNA, 15 bp, Homo sapiens
tcctggaaccaatcc

SEQ ID NO: 219107 - DNA, 17 bp, Homo sapiens
tcctggaatgaagcatg

SEQ ID NO: 219108 - DNA, 15 bp, Homo sapiens
tcctggacccagcag

SEQ ID NO: 219109 - DNA, 14 bp, Homo sapiens
tcctggacctgagt

SEQ ID NO: 219110 - DNA, 12 bp, Homo sapiens
tcctggactgta

SEQ ID NO: 219111 - DNA, 14 bp, Homo sapiens
tcctggagcagcag

SEQ ID NO: 219112 - DNA, 18 bp, Homo sapiens
tcctggagcagcagctga

SEQ ID NO: 219113 - DNA, 16 bp, Homo sapiens
tcctggagcatcccag

SEQ ID NO: 219114 - DNA, 23 bp, Homo sapiens
gcagcttccttccaagtcttcct

SEQ ID NO: 219115 - DNA, 11 bp, Homo sapiens
gcagcttggct

SEQ ID NO: 219116 - DNA, 23 bp, Homo sapiens
gcaggaaaaggtgatatccattc

SEQ ID NO: 219117 - DNA, 22 bp, Homo sapiens
gcaggaaagatcccaagtcaaa

SEQ ID NO: 219118 - DNA, 11 bp, Homo sapiens
gcaggaaatag

SEQ ID NO: 219119 - DNA, 20 bp, Homo sapiens
gcaggaacgagcactggcca

SEQ ID NO: 219120 - DNA, 21 bp, Homo sapiens
gcaggaacgagcactggccag

SEQ ID NO: 219121 - DNA, 19 bp, Homo sapiens
gcaggaactgaaaaccagt

SEQ ID NO: 219122 - DNA, 15 bp, Homo sapiens
gcaggaagcaaggcc

SEQ ID NO: 219123 - DNA, 17 bp, Homo sapiens
gcaggaaggcctgggtg

SEQ ID NO: 219124 - DNA, 17 bp, Homo sapiens
gcaggaaggcgggggat

SEQ ID NO: 219125 - DNA, 16 bp, Homo sapiens
gcaggaagtccctgag

SEQ ID NO: 219126 - DNA, 14 bp, Homo sapiens
gcaggacacagatc

SEQ ID NO: 219127 - DNA, 17 bp, Homo sapiens
gcaggacacatcccggc

SEQ ID NO: 219128 - DNA, 20 bp, Homo sapiens
gcaggacctactaggagagg

SEQ ID NO: 219129 - DNA, 14 bp, Homo sapiens
gcaggacctcagag

SEQ ID NO: 219130 - DNA, 16 bp, Homo sapiens
gcaggacctcagagtc

SEQ ID NO: 219131 - DNA, 22 bp, Homo sapiens
gcaggacctcagagtccaggcc

SEQ ID NO: 219132 - DNA, 18 bp, Homo sapiens
gcaggacgagactcctcg

SEQ ID NO: 219133 - DNA, 13 bp, Homo sapiens
gcaggagagagag

SEQ ID NO: 219134 - DNA, 21 bp, Homo sapiens
gcaggaggatcacttgaggcc

SEQ ID NO: 219135 - DNA, 14 bp, Homo sapiens
gcaggagggtggca

SEQ ID NO: 219136 - DNA, 15 bp, Homo sapiens
gcaggaggtgggtga

SEQ ID NO: 219137 - DNA, 22 bp, Homo sapiens
gcaggagtctctgccacccact

SEQ ID NO: 219138 - DNA, 13 bp, Homo sapiens
gcaggcagagctc

SEQ ID NO: 219139 - DNA, 21 bp, Homo sapiens
gcaggcagagctcagcacagc

SEQ ID NO: 219140 - DNA, 19 bp, Homo sapiens
gcaggccaaggccttctcc

SEQ ID NO: 219141 - DNA, 23 bp, Homo sapiens
gcaggccaaggccttctcctccc

SEQ ID NO: 219142 - DNA, 19 bp, Homo sapiens
gcaggccagcttcgtgctg

SEQ ID NO: 219143 - DNA, 22 bp, Homo sapiens
gcaggcccaaattatcaagcta

SEQ ID NO: 219144 - DNA, 22 bp, Homo sapiens
gcaggcccagctggggcccctc

SEQ ID NO: 219145 - DNA, 13 bp, Homo sapiens
gcaggcctgggac

SEQ ID NO: 219146 - DNA, 14 bp, Homo sapiens
gcaggcctgggacc

SEQ ID NO: 219147 - DNA, 19 bp, Homo sapiens
gcaggcctgggacccagct

SEQ ID NO: 219148 - DNA, 20 bp, Homo sapiens
gcaggcggtatccagaggtg

SEQ ID NO: 219149 - DNA, 14 bp, Homo sapiens
gcaggcgtgcctcg

SEQ ID NO: 219150 - DNA, 22 bp, Homo sapiens
gcaggctcgggctccccagccc

SEQ ID NO: 219151 - DNA, 14 bp, Homo sapiens
gcaggctctgggct

SEQ ID NO: 219152 - DNA, 23 bp, Homo sapiens
gcaggctctgggctcagggctgg

SEQ ID NO: 219153 - DNA, 17 bp, Homo sapiens
gcaggctgcagcaggca

SEQ ID NO: 219154 - DNA, 18 bp, Homo sapiens
gcaggctgcagcaggcag

SEQ ID NO: 219155 - DNA, 18 bp, Homo sapiens
gcaggctggcaccgcctt

SEQ ID NO: 219156 - DNA, 17 bp, Homo sapiens
gcaggctggcagctctc

SEQ ID NO: 219157 - DNA, 22 bp, Homo sapiens
gcaggctggcagctctccagtc

SEQ ID NO: 219158 - DNA, 15 bp, Homo sapiens
gcaggctggctgttg

SEQ ID NO: 219159 - DNA, 15 bp, Homo sapiens
gcagggaaagctcca

SEQ ID NO: 219160 - DNA, 15 bp, Homo sapiens
gcagggaatttctat

SEQ ID NO: 219161 - DNA, 22 bp, Homo sapiens
gcagggacaccccccgcccccc

SEQ ID NO: 219162 - DNA, 19 bp, Homo sapiens
gcagggagcaactctccac

SEQ ID NO: 219163 - DNA, 21 bp, Homo sapiens
gcagggagggaaacccgggga

SEQ ID NO: 219164 - DNA, 16 bp, Homo sapiens
gcagggaggtcaggcc

SEQ ID NO: 219165 - DNA, 16 bp, Homo sapiens
gcagggagtgatgatt

SEQ ID NO: 219166 - DNA, 14 bp, Homo sapiens
gcagggagtgtctg

SEQ ID NO: 219167 - DNA, 17 bp, Homo sapiens
gcagggagtgtctgcag

SEQ ID NO: 219168 - DNA, 19 bp, Homo sapiens
gcagggagtgtctgcagtc

SEQ ID NO: 219169 - DNA, 19 bp, Homo sapiens
gcagggattaacctctgca

SEQ ID NO: 219170 - DNA, 15 bp, Homo sapiens
gcagggcagagggaa

SEQ ID NO: 219171 - DNA, 12 bp, Homo sapiens
gcagggcagcct

SEQ ID NO: 219172 - DNA, 16 bp, Homo sapiens
gcagggcagcctgtgg

SEQ ID NO: 219173 - DNA, 20 bp, Homo sapiens
gcagggcagcctgtgggaga

SEQ ID NO: 219174 - DNA, 21 bp, Homo sapiens
gcagggcagcctgtgggagaa

SEQ ID NO: 219175 - DNA, 15 bp, Homo sapiens
gcagggcatctcctg

SEQ ID NO: 219176 - DNA, 21 bp, Homo sapiens
gcagggcatctcctgtgcatg

SEQ ID NO: 219177 - DNA, 22 bp, Homo sapiens
gcagggcatctcctgtgcatgg

SEQ ID NO: 219178 - DNA, 20 bp, Homo sapiens
gcagggccctggggtctctg

SEQ ID NO: 219179 - DNA, 13 bp, Homo sapiens
gcagggcctggcc

SEQ ID NO: 219180 - DNA, 21 bp, Homo sapiens
gcagggcggccagtgcagtga

SEQ ID NO: 219181 - DNA, 12 bp, Homo sapiens
gcagggctctga

SEQ ID NO: 219182 - DNA, 15 bp, Homo sapiens
gcaggggagccaggg

SEQ ID NO: 219183 - DNA, 20 bp, Homo sapiens
gcaggggagccagggtagag

SEQ ID NO: 219184 - DNA, 21 bp, Homo sapiens
gcaggggagccagggtagagc

SEQ ID NO: 219185 - DNA, 13 bp, Homo sapiens
gcaggggagtctg

SEQ ID NO: 219186 - DNA, 21 bp, Homo sapiens
gcaggggcccctcctctgtgc

SEQ ID NO: 219187 - DNA, 22 bp, Homo sapiens
gcaggggcccctcctctgtgct

SEQ ID NO: 219188 - DNA, 23 bp, Homo sapiens
gcaggggcccctcctctgtgctc

SEQ ID NO: 219189 - DNA, 15 bp, Homo sapiens
gcaggggctgcatcc

SEQ ID NO: 219190 - DNA, 21 bp, Homo sapiens
gcaggggctgcatcctcagcc

SEQ ID NO: 219191 - DNA, 12 bp, Homo sapiens
gcaggggctggg

SEQ ID NO: 219192 - DNA, 14 bp, Homo sapiens
gcaggggctgggca

SEQ ID NO: 219193 - DNA, 12 bp, Homo sapiens
gcaggggtcccc

SEQ ID NO: 219194 - DNA, 15 bp, Homo sapiens
gcaggggttgcagtg

SEQ ID NO: 219195 - DNA, 18 bp, Homo sapiens
gcagggtgggcagcctat

SEQ ID NO: 219196 - DNA, 19 bp, Homo sapiens
gcagggtggtgctgggact

SEQ ID NO: 219197 - DNA, 18 bp, Homo sapiens
gcagggttctagaagggg

SEQ ID NO: 219198 - DNA, 23 bp, Homo sapiens
gcagggttctagaaggggcgagg

SEQ ID NO: 219199 - DNA, 22 bp, Homo sapiens
gcaggtacttcctcctgatggc

SEQ ID NO: 219200 - DNA, 23 bp, Homo sapiens
gcaggtacttcctcctgatggcc

SEQ ID NO: 219201 - DNA, 20 bp, Homo sapiens
gcaggtagatcgcttgagcc

SEQ ID NO: 219202 - DNA, 18 bp, Homo sapiens
gcaggtcccgagccccct

SEQ ID NO: 219203 - DNA, 13 bp, Homo sapiens
gcaggtcctgggg

SEQ ID NO: 219204 - DNA, 16 bp, Homo sapiens
gcaggtcctggggagg

SEQ ID NO: 219205 - DNA, 18 bp, Homo sapiens
gcaggtcctggggaggct

SEQ ID NO: 219206 - DNA, 16 bp, Homo sapiens
gcaggtctgcaggcca

SEQ ID NO: 219207 - DNA, 17 bp, Homo sapiens
gcaggtctgcaggccac

SEQ ID NO: 219208 - DNA, 20 bp, Homo sapiens
gcaggtctgcaggccaccag

SEQ ID NO: 219209 - DNA, 19 bp, Homo sapiens
gcaggtgaccttctgggaa

SEQ ID NO: 219210 - DNA, 15 bp, Homo sapiens
gcaggtgcagatggg

SEQ ID NO: 219211 - DNA, 18 bp, Homo sapiens
gcaggtgcagatgggctg

SEQ ID NO: 219212 - DNA, 15 bp, Homo sapiens
gcaggtggccacagc

SEQ ID NO: 219213 - DNA, 16 bp, Homo sapiens
gcaggtgggagcttga

SEQ ID NO: 219214 - DNA, 17 bp, Homo sapiens
gcaggtggggagggggt

SEQ ID NO: 219215 - DNA, 12 bp, Homo sapiens
tccttagaatga

SEQ ID NO: 219216 - DNA, 13 bp, Homo sapiens
tccttagaatgag

SEQ ID NO: 219217 - DNA, 18 bp, Homo sapiens
tccttagacccgccaggt

SEQ ID NO: 219218 - DNA, 15 bp, Homo sapiens
tccttagcaacagcc

SEQ ID NO: 219219 - DNA, 17 bp, Homo sapiens
tccttagcaaggggctc

SEQ ID NO: 219220 - DNA, 17 bp, Homo sapiens
tccttagcagctcaggc

SEQ ID NO: 219221 - DNA, 18 bp, Homo sapiens
tccttagcagctcaggcg

SEQ ID NO: 219222 - DNA, 17 bp, Homo sapiens
tccttagtcttctcata

SEQ ID NO: 219223 - DNA, 22 bp, Homo sapiens
tccttagtcttctcatagcatt

SEQ ID NO: 219224 - DNA, 18 bp, Homo sapiens
tccttatgatattctcat

SEQ ID NO: 219225 - DNA, 15 bp, Homo sapiens
tccttatgtcctcca

SEQ ID NO: 219226 - DNA, 14 bp, Homo sapiens
tccttatttatcaa

SEQ ID NO: 219227 - DNA, 20 bp, Homo sapiens
tccttatttcaagggttgct

SEQ ID NO: 219228 - DNA, 15 bp, Homo sapiens
tccttcaaaatcctt

SEQ ID NO: 219229 - DNA, 19 bp, Homo sapiens
tccttcaaaatccttccaa

SEQ ID NO: 219230 - DNA, 20 bp, Homo sapiens
tccttcacaggcagtgcatg

SEQ ID NO: 219231 - DNA, 14 bp, Homo sapiens
tccttcacatctcc

SEQ ID NO: 219232 - DNA, 15 bp, Homo sapiens
tccttcacatctccc

SEQ ID NO: 219233 - DNA, 16 bp, Homo sapiens
tccttcacatctccca

SEQ ID NO: 219234 - DNA, 21 bp, Homo sapiens
tccttcagcagctagagctca

SEQ ID NO: 219235 - DNA, 18 bp, Homo sapiens
tccttcagtgagcccctc

SEQ ID NO: 219236 - DNA, 15 bp, Homo sapiens
tccttcatgcttttc

SEQ ID NO: 219237 - DNA, 16 bp, Homo sapiens
tccttcatgcttttct

SEQ ID NO: 219238 - DNA, 18 bp, Homo sapiens
tccttcatgcttttctca

SEQ ID NO: 219239 - DNA, 17 bp, Homo sapiens
tccttccaaaaaattaa

SEQ ID NO: 219240 - DNA, 19 bp, Homo sapiens
tccttccaaaaattattat

SEQ ID NO: 219241 - DNA, 19 bp, Homo sapiens
tccttccagcctgagatgt

SEQ ID NO: 219242 - DNA, 15 bp, Homo sapiens
tccttccatcaaata

SEQ ID NO: 219243 - DNA, 17 bp, Homo sapiens
tccttcccaactcactg

SEQ ID NO: 219244 - DNA, 21 bp, Homo sapiens
gcagtctttgctcagtggatc

SEQ ID NO: 219245 - DNA, 17 bp, Homo sapiens
gcagtgacgtgagtggg

SEQ ID NO: 219246 - DNA, 18 bp, Homo sapiens
gcagtgagtctcttcaga

SEQ ID NO: 219247 - DNA, 14 bp, Homo sapiens
gcagtgatggcgcg

SEQ ID NO: 219248 - DNA, 15 bp, Homo sapiens
gcagtgcatgctgtc

SEQ ID NO: 219249 - DNA, 20 bp, Homo sapiens
gcagtgcatgtgaagcatgc

SEQ ID NO: 219250 - DNA, 22 bp, Homo sapiens
gcagtgcccagtgatggcatta

SEQ ID NO: 219251 - DNA, 17 bp, Homo sapiens
gcagtgcctcgaggcac

SEQ ID NO: 219252 - DNA, 19 bp, Homo sapiens
gcagtgcctcgaggcaccg

SEQ ID NO: 219253 - DNA, 16 bp, Homo sapiens
gcagtgccttccataa

SEQ ID NO: 219254 - DNA, 13 bp, Homo sapiens
gcagtgctgggcc

SEQ ID NO: 219255 - DNA, 14 bp, Homo sapiens
gcagtgctgggccc

SEQ ID NO: 219256 - DNA, 14 bp, Homo sapiens
gcagtggagagggg

SEQ ID NO: 219257 - DNA, 15 bp, Homo sapiens
gcagtggagagggga

SEQ ID NO: 219258 - DNA, 17 bp, Homo sapiens
gcagtggagaggggact

SEQ ID NO: 219259 - DNA, 13 bp, Homo sapiens
gcagtggccaggc

SEQ ID NO: 219260 - DNA, 20 bp, Homo sapiens
gcagtggctggtccagggct

SEQ ID NO: 219261 - DNA, 13 bp, Homo sapiens
gcagtgggaccaa

SEQ ID NO: 219262 - DNA, 15 bp, Homo sapiens
gcagtgggtggggct

SEQ ID NO: 219263 - DNA, 15 bp, Homo sapiens
gcagtggtgatgcct

SEQ ID NO: 219264 - DNA, 21 bp, Homo sapiens
gcagtggtgatgcctaaagga

SEQ ID NO: 219265 - DNA, 16 bp, Homo sapiens
gcagtgtcttccataa

SEQ ID NO: 219266 - DNA, 18 bp, Homo sapiens
gcagtgtgtctcctgcat

SEQ ID NO: 219267 - DNA, 22 bp, Homo sapiens
gcagtgttcctcaccaataact

SEQ ID NO: 219268 - DNA, 23 bp, Homo sapiens
gcagtgttcctcaccaataactt

SEQ ID NO: 219269 - DNA, 20 bp, Homo sapiens
gcagtgttttcacctcatat

SEQ ID NO: 219270 - DNA, 19 bp, Homo sapiens
gcagttagagatgcctccc

SEQ ID NO: 219271 - DNA, 14 bp, Homo sapiens
gcagttcacttcct

SEQ ID NO: 219272 - DNA, 17 bp, Homo sapiens
gcagttcagcaccaccc

SEQ ID NO: 219273 - DNA, 19 bp, Homo sapiens
gcagttctcactcctagga

SEQ ID NO: 219274 - DNA, 22 bp, Homo sapiens
gcagttgaatgacaacagaagc

SEQ ID NO: 219275 - DNA, 16 bp, Homo sapiens
gcagttttccaggagg

SEQ ID NO: 219276 - DNA, 12 bp, Homo sapiens
gcagtttttcag

SEQ ID NO: 219277 - DNA, 23 bp, Homo sapiens
gcagtttttcaggagcgcaagat

SEQ ID NO: 219278 - DNA, 15 bp, Homo sapiens
gcataaaattggatt

SEQ ID NO: 219279 - DNA, 20 bp, Homo sapiens
gcatacaaaaatatattaaa

SEQ ID NO: 219280 - DNA, 17 bp, Homo sapiens
gcatacatttataatgt

SEQ ID NO: 219281 - DNA, 14 bp, Homo sapiens
gcatactctccagg

SEQ ID NO: 219282 - DNA, 14 bp, Homo sapiens
gcatactgatgaga

SEQ ID NO: 219283 - DNA, 23 bp, Homo sapiens
gcataggcctgggtgctggctgc

SEQ ID NO: 219284 - DNA, 23 bp, Homo sapiens
gcatagtattccattgtgtgagt

SEQ ID NO: 219285 - DNA, 22 bp, Homo sapiens
gcatagtgtgctcggacacagt

SEQ ID NO: 219286 - DNA, 11 bp, Homo sapiens
gcatataaatg

SEQ ID NO: 219287 - DNA, 21 bp, Homo sapiens
gcatatactgaagtcttttct

SEQ ID NO: 219288 - DNA, 15 bp, Homo sapiens
gcatatcctgagcca

SEQ ID NO: 219289 - DNA, 14 bp, Homo sapiens
gcatatcgctgggc

SEQ ID NO: 219290 - DNA, 21 bp, Homo sapiens
gcatatgcatgccaggctggg

SEQ ID NO: 219291 - DNA, 13 bp, Homo sapiens
gcatcaaataata

SEQ ID NO: 219292 - DNA, 24 bp, Homo sapiens
gcatcaaccaggaagagttctatc

SEQ ID NO: 219293 - DNA, 16 bp, Homo sapiens
gcatcaagggctttat

SEQ ID NO: 219294 - DNA, 18 bp, Homo sapiens
gcatcaccaccacacccc

SEQ ID NO: 219295 - DNA, 14 bp, Homo sapiens
gcatcagcaagaca

SEQ ID NO: 219296 - DNA, 22 bp, Homo sapiens
gcatcagctttccctggctcag

SEQ ID NO: 219297 - DNA, 12 bp, Homo sapiens
gcatcaggcact

SEQ ID NO: 219298 - DNA, 15 bp, Homo sapiens
gcatcaggcactggt

SEQ ID NO: 219299 - DNA, 18 bp, Homo sapiens
gcatcaggcactggtggc

SEQ ID NO: 219300 - DNA, 19 bp, Homo sapiens
gcatcaggcactggtggca

SEQ ID NO: 219301 - DNA, 18 bp, Homo sapiens
gcatcattctttctgcta

SEQ ID NO: 219302 - DNA, 12 bp, Homo sapiens
gcatccaactga

SEQ ID NO: 219303 - DNA, 17 bp, Homo sapiens
gcatccaaggcaaacaa

SEQ ID NO: 219304 - DNA, 23 bp, Homo sapiens
gcatccacccagtgctgccatgc

SEQ ID NO: 219305 - DNA, 24 bp, Homo sapiens
gcatccacccagtgctgccatgcc

SEQ ID NO: 219306 - DNA, 13 bp, Homo sapiens
gcatccagcctgt

SEQ ID NO: 219307 - DNA, 17 bp, Homo sapiens
gcatccagcctgtgtgt

SEQ ID NO: 219308 - DNA, 16 bp, Homo sapiens
gcatccaggcctgagg

SEQ ID NO: 219309 - DNA, 18 bp, Homo sapiens
gcatccaggcctgaggct

SEQ ID NO: 219310 - DNA, 14 bp, Homo sapiens
gcatcccagtggcc

SEQ ID NO: 219311 - DNA, 15 bp, Homo sapiens
gcatcccagtggcct

SEQ ID NO: 219312 - DNA, 15 bp, Homo sapiens
gcatcccctgtgaac

SEQ ID NO: 219313 - DNA, 16 bp, Homo sapiens
gcatcccctttattaa

SEQ ID NO: 219314 - DNA, 14 bp, Homo sapiens
gcatccctccaccc

SEQ ID NO: 219315 - DNA, 13 bp, Homo sapiens
gcatcccttggcc

SEQ ID NO: 219316 - DNA, 22 bp, Homo sapiens
gcatcccttggcccctctctgt

SEQ ID NO: 219317 - DNA, 18 bp, Homo sapiens
gcatccgcctctgagcca

SEQ ID NO: 219318 - DNA, 21 bp, Homo sapiens
gcatcctatcgatctggaaag

SEQ ID NO: 219319 - DNA, 13 bp, Homo sapiens
gcatcctcagccc

SEQ ID NO: 219320 - DNA, 19 bp, Homo sapiens
gcatcctcagccccagggc

SEQ ID NO: 219321 - DNA, 20 bp, Homo sapiens
gcatcctcagccccagggcc

SEQ ID NO: 219322 - DNA, 22 bp, Homo sapiens
gcatcctcagccccagggccct

SEQ ID NO: 219323 - DNA, 20 bp, Homo sapiens
gcatcctcagttcctgcagc

SEQ ID NO: 219324 - DNA, 18 bp, Homo sapiens
gcatcctccacaatagca

SEQ ID NO: 219325 - DNA, 13 bp, Homo sapiens
gcatccttctgcc

SEQ ID NO: 219326 - DNA, 15 bp, Homo sapiens
gcatccttgaggacc

SEQ ID NO: 219327 - DNA, 12 bp, Homo sapiens
gcatcgcaggag

SEQ ID NO: 219328 - DNA, 23 bp, Homo sapiens
gcatcgttttctttgctgtgcca

SEQ ID NO: 219329 - DNA, 17 bp, Homo sapiens
gcatctacctgctcctt

SEQ ID NO: 219330 - DNA, 15 bp, Homo sapiens
gcatctcagcccaca

SEQ ID NO: 219331 - DNA, 12 bp, Homo sapiens
gcatctccagga

SEQ ID NO: 219332 - DNA, 14 bp, Homo sapiens
gcatctccaggaag

SEQ ID NO: 219333 - DNA, 22 bp, Homo sapiens
gcatctctccccatatataaat

SEQ ID NO: 219334 - DNA, 18 bp, Homo sapiens
gcatctctgggctgagcc

SEQ ID NO: 219335 - DNA, 22 bp, Homo sapiens
gcatctgattgagtcagtgttt

SEQ ID NO: 219336 - DNA, 15 bp, Homo sapiens
gcatctgcccctccc

SEQ ID NO: 219337 - DNA, 17 bp, Homo sapiens
gcatctgcccctccccc

SEQ ID NO: 219338 - DNA, 18 bp, Homo sapiens
gcatctgctaataaaacc

SEQ ID NO: 219339 - DNA, 14 bp, Homo sapiens
gcatctgctcttct

SEQ ID NO: 219340 - DNA, 15 bp, Homo sapiens
gcatctgtcccactg

SEQ ID NO: 219341 - DNA, 16 bp, Homo sapiens
gcatctgtcccactgg

SEQ ID NO: 219342 - DNA, 21 bp, Homo sapiens
gcatctttcatagttctgtta

SEQ ID NO: 219343 - DNA, 19 bp, Homo sapiens
gcatgaaactatgcaccta

SEQ ID NO: 219344 - DNA, 22 bp, Homo sapiens
gcatgaaactatgcacctataa

SEQ ID NO: 219345 - DNA, 20 bp, Homo sapiens
gcatgaaaggtaatctgaaa

SEQ ID NO: 219346 - DNA, 17 bp, Homo sapiens
gcatgacaagccccagg

SEQ ID NO: 219347 - DNA, 14 bp, Homo sapiens
gcatgacactctag

SEQ ID NO: 219348 - DNA, 12 bp, Homo sapiens
gcatgaccctgg

SEQ ID NO: 219349 - DNA, 16 bp, Homo sapiens
gcatgacctgtgacca

SEQ ID NO: 219350 - DNA, 17 bp, Homo sapiens
gcatgacctgtgaccag

SEQ ID NO: 219351 - DNA, 15 bp, Homo sapiens
gcatgacgtttaagg

SEQ ID NO: 219352 - DNA, 17 bp, Homo sapiens
gcatgagaactaaatag

SEQ ID NO: 219353 - DNA, 20 bp, Homo sapiens
tcgattaacctgcatgcagc

SEQ ID NO: 219354 - DNA, 14 bp, Homo sapiens
tcgcacaaggacat

SEQ ID NO: 219355 - DNA, 23 bp, Homo sapiens
tcgcaggagtctctgccacccac

SEQ ID NO: 219356 - DNA, 18 bp, Homo sapiens
tcgcaggatccgctgcca

SEQ ID NO: 219357 - DNA, 20 bp, Homo sapiens
tcgcaggatccgctgccacc

SEQ ID NO: 219358 - DNA, 18 bp, Homo sapiens
tcgcatccgcctctgagc

SEQ ID NO: 219359 - DNA, 23 bp, Homo sapiens
tcgcatccgcctctgagccagga

SEQ ID NO: 219360 - DNA, 15 bp, Homo sapiens
tcgcatttgtcaatg

SEQ ID NO: 219361 - DNA, 11 bp, Homo sapiens
tcgccccaccc

SEQ ID NO: 219362 - DNA, 12 bp, Homo sapiens
tcgccccaccca

SEQ ID NO: 219363 - DNA, 14 bp, Homo sapiens
tcgccccacccagg

SEQ ID NO: 219364 - DNA, 15 bp, Homo sapiens
tcgccccagatcacc

SEQ ID NO: 219365 - DNA, 18 bp, Homo sapiens
tcgccccagatcaccagc

SEQ ID NO: 219366 - DNA, 13 bp, Homo sapiens
tcgccccatccct

SEQ ID NO: 219367 - DNA, 13 bp, Homo sapiens
tcgcccctccagt

SEQ ID NO: 219368 - DNA, 13 bp, Homo sapiens
tcgcccgcccact

SEQ ID NO: 219369 - DNA, 22 bp, Homo sapiens
tcgcccgcccactgtcctgggc

SEQ ID NO: 219370 - DNA, 23 bp, Homo sapiens
tcgcccgcccactgtcctgggcg

SEQ ID NO: 219371 - DNA, 17 bp, Homo sapiens
tcgccctctgtgcctaa

SEQ ID NO: 219372 - DNA, 19 bp, Homo sapiens
tcgccctctgtgcctaata

SEQ ID NO: 219373 - DNA, 14 bp, Homo sapiens
tcgccgtggctgcg

SEQ ID NO: 219374 - DNA, 21 bp, Homo sapiens
tcgcctgcggactccatggcc

SEQ ID NO: 219375 - DNA, 15 bp, Homo sapiens
gcatgcttagagcat

SEQ ID NO: 219376 - DNA, 15 bp, Homo sapiens
gcatggacagggcca

SEQ ID NO: 219377 - DNA, 18 bp, Homo sapiens
gcatggacctaacattcg

SEQ ID NO: 219378 - DNA, 17 bp, Homo sapiens
gcatggacgcctggctc

SEQ ID NO: 219379 - DNA, 20 bp, Homo sapiens
gcatggacgcctggctccag

SEQ ID NO: 219380 - DNA, 20 bp, Homo sapiens
gcatggagtgtgtattgttc

SEQ ID NO: 219381 - DNA, 22 bp, Homo sapiens
gcatggcagaagcgtctccctt

SEQ ID NO: 219382 - DNA, 12 bp, Homo sapiens
gcatggccacag

SEQ ID NO: 219383 - DNA, 16 bp, Homo sapiens
gcatggccacagccac

SEQ ID NO: 219384 - DNA, 19 bp, Homo sapiens
gcatggccacagccacctc

SEQ ID NO: 219385 - DNA, 20 bp, Homo sapiens
gcatggccacagccacctcc

SEQ ID NO: 219386 - DNA, 14 bp, Homo sapiens
gcatggcccagcct

SEQ ID NO: 219387 - DNA, 16 bp, Homo sapiens
gcatggcccctccagg

SEQ ID NO: 219388 - DNA, 21 bp, Homo sapiens
gcatggcccctccaggaacat

SEQ ID NO: 219389 - DNA, 15 bp, Homo sapiens
gcatggcctcccagc

SEQ ID NO: 219390 - DNA, 16 bp, Homo sapiens
gcatggcctcccagcc

SEQ ID NO: 219391 - DNA, 17 bp, Homo sapiens
gcatggcctcccagcca

SEQ ID NO: 219392 - DNA, 21 bp, Homo sapiens
gcatggcctctaagagtgccc

SEQ ID NO: 219393 - DNA, 14 bp, Homo sapiens
gcatggctccagtc

SEQ ID NO: 219394 - DNA, 21 bp, Homo sapiens
gcatggctccagtctgctgcc

SEQ ID NO: 219395 - DNA, 17 bp, Homo sapiens
gcatggctcctgtctgg

SEQ ID NO: 219396 - DNA, 19 bp, Homo sapiens
gcatggctcctgtctggct

SEQ ID NO: 219397 - DNA, 17 bp, Homo sapiens
gcatggctttatttgtt

SEQ ID NO: 219398 - DNA, 22 bp, Homo sapiens
gcatgggcctggccacctctct

SEQ ID NO: 219399 - DNA, 14 bp, Homo sapiens
gcatgggggaggct

SEQ ID NO: 219400 - DNA, 18 bp, Homo sapiens
gcatgggggaggctctga

SEQ ID NO: 219401 - DNA, 19 bp, Homo sapiens
gcatgggggaggctctgaa

SEQ ID NO: 219402 - DNA, 19 bp, Homo sapiens
gcatggtaccagccctggg

SEQ ID NO: 219403 - DNA, 21 bp, Homo sapiens
gcatggttccttccctgggaa

SEQ ID NO: 219404 - DNA, 17 bp, Homo sapiens
gcatgtattggcctgga

SEQ ID NO: 219405 - DNA, 18 bp, Homo sapiens
gcatgtattggcctggag

SEQ ID NO: 219406 - DNA, 13 bp, Homo sapiens
gcatgtctactgc

SEQ ID NO: 219407 - DNA, 14 bp, Homo sapiens
gcatgtctactgct

SEQ ID NO: 219408 - DNA, 17 bp, Homo sapiens
gcatgtctgcatggcag

SEQ ID NO: 219409 - DNA, 17 bp, Homo sapiens
gcatgtgaagcatgctt

SEQ ID NO: 219410 - DNA, 21 bp, Homo sapiens
gcatgtgaagcatgctttgct

SEQ ID NO: 219411 - DNA, 13 bp, Homo sapiens
gcatgtgaattct

SEQ ID NO: 219412 - DNA, 20 bp, Homo sapiens
gcatgtgattggcagcttca

SEQ ID NO: 219413 - DNA, 13 bp, Homo sapiens
gcatgtgccaaga

SEQ ID NO: 219414 - DNA, 21 bp, Homo sapiens
gcatgtgccaagattctactc

SEQ ID NO: 219415 - DNA, 16 bp, Homo sapiens
gcatgtgggggaaggc

SEQ ID NO: 219416 - DNA, 23 bp, Homo sapiens
gcatgtgggggaaggccttgctg

SEQ ID NO: 219417 - DNA, 12 bp, Homo sapiens
gcatgtgtattt

SEQ ID NO: 219418 - DNA, 13 bp, Homo sapiens
gcatgtgtcagag

SEQ ID NO: 219419 - DNA, 12 bp, Homo sapiens
gcatgtgtctgt

SEQ ID NO: 219420 - DNA, 24 bp, Homo sapiens
gcatgtgtctgtattcatacagca

SEQ ID NO: 219421 - DNA, 13 bp, Homo sapiens
gcatgtgtgcctg

SEQ ID NO: 219422 - DNA, 19 bp, Homo sapiens
gcatgtgtgcctgtggcag

SEQ ID NO: 219423 - DNA, 19 bp, Homo sapiens
gcatgtgtgcgagtgtgtg

SEQ ID NO: 219424 - DNA, 13 bp, Homo sapiens
gcatgtgtgtatc

SEQ ID NO: 219425 - DNA, 24 bp, Homo sapiens
gcatgtgtgtatcaccctcagctg

SEQ ID NO: 219426 - DNA, 18 bp, Homo sapiens
gcatgtgtgtgtctctat

SEQ ID NO: 219427 - DNA, 19 bp, Homo sapiens
gcatgttcttgttttgtta

SEQ ID NO: 219428 - DNA, 21 bp, Homo sapiens
gcatgttgttttttcatagtg

SEQ ID NO: 219429 - DNA, 17 bp, Homo sapiens
gcattaaatgctttgat

SEQ ID NO: 219430 - DNA, 13 bp, Homo sapiens
gcattaacttaaa

SEQ ID NO: 219431 - DNA, 14 bp, Homo sapiens
gcattaacttctct

SEQ ID NO: 219432 - DNA, 22 bp, Homo sapiens
gcattaggcttttaagaaacac

SEQ ID NO: 219433 - DNA, 18 bp, Homo sapiens
gcattatctctttctctc

SEQ ID NO: 219434 - DNA, 14 bp, Homo sapiens
gcattattgcatta

SEQ ID NO: 219435 - DNA, 21 bp, Homo sapiens
gcattcaaaatagttctattt

SEQ ID NO: 219436 - DNA, 18 bp, Homo sapiens
gcattcacacacagcctg

SEQ ID NO: 219437 - DNA, 23 bp, Homo sapiens
gcattcacacacagcctggcctc

SEQ ID NO: 219438 - DNA, 12 bp, Homo sapiens
gcattcatgttt

SEQ ID NO: 219439 - DNA, 15 bp, Homo sapiens
gcattcccagaggtg

SEQ ID NO: 219440 - DNA, 19 bp, Homo sapiens
gcattccttagcagctcag

SEQ ID NO: 219441 - DNA, 22 bp, Homo sapiens
gcattccttagcagctcaggcg

SEQ ID NO: 219442 - DNA, 13 bp, Homo sapiens
gcattcctttctt

SEQ ID NO: 219443 - DNA, 14 bp, Homo sapiens
gcattcgcagcagc

SEQ ID NO: 219444 - DNA, 22 bp, Homo sapiens
gcattcgcagcagctccgcctg

SEQ ID NO: 219445 - DNA, 22 bp, Homo sapiens
gcattcgcagtgcccagtgatg

SEQ ID NO: 219446 - DNA, 15 bp, Homo sapiens
gcattctacacctgg

SEQ ID NO: 219447 - DNA, 13 bp, Homo sapiens
gcattctcactcc

SEQ ID NO: 219448 - DNA, 18 bp, Homo sapiens
gcattctcactcctacct

SEQ ID NO: 219449 - DNA, 15 bp, Homo sapiens
gcattctgagctggg

SEQ ID NO: 219450 - DNA, 19 bp, Homo sapiens
gcattctgcctgcctggga

SEQ ID NO: 219451 - DNA, 22 bp, Homo sapiens
gcattctggggtggggcttgga

SEQ ID NO: 219452 - DNA, 16 bp, Homo sapiens
gcattcttttaaagtt

SEQ ID NO: 219453 - DNA, 13 bp, Homo sapiens
gcattgaaataat

SEQ ID NO: 219454 - DNA, 17 bp, Homo sapiens
gcattgcactaaaagtg

SEQ ID NO: 219455 - DNA, 23 bp, Homo sapiens
gcattgcagaacatgagtgctga

SEQ ID NO: 219456 - DNA, 12 bp, Homo sapiens
gcattgcattta

SEQ ID NO: 219457 - DNA, 16 bp, Homo sapiens
gcattgggctgacacc

SEQ ID NO: 219458 - DNA, 20 bp, Homo sapiens
gcattgggctgacacctacc

SEQ ID NO: 219459 - DNA, 23 bp, Homo sapiens
gcattgggtagctatactcatgg

SEQ ID NO: 219460 - DNA, 16 bp, Homo sapiens
gcattgtccctgtgcc

SEQ ID NO: 219461 - DNA, 14 bp, Homo sapiens
gcattgttccacac

SEQ ID NO: 219462 - DNA, 15 bp, Homo sapiens
gcattgttgaggtgg

SEQ ID NO: 219463 - DNA, 14 bp, Homo sapiens
gcatttaaaatgga

SEQ ID NO: 219464 - DNA, 15 bp, Homo sapiens
gcatttaaaatggac

SEQ ID NO: 219465 - DNA, 22 bp, Homo sapiens
gcatttagaactttctgctttg

SEQ ID NO: 219466 - DNA, 13 bp, Homo sapiens
gcatttatgcatg

SEQ ID NO: 219467 - DNA, 22 bp, Homo sapiens
gcatttatgcatgagaactaaa

SEQ ID NO: 219468 - DNA, 23 bp, Homo sapiens
gcatttatgcatgagaactaaat

SEQ ID NO: 219469 - DNA, 24 bp, Homo sapiens
gcatttatgcatgagaactaaata

SEQ ID NO: 219470 - DNA, 24 bp, Homo sapiens
gcatttctttatttctgtctcata

SEQ ID NO: 219471 - DNA, 22 bp, Homo sapiens
gcatttgctgaataacaacaat

SEQ ID NO: 219472 - DNA, 22 bp, Homo sapiens
gcatttggtggcctaatttaca

SEQ ID NO: 219473 - DNA, 15 bp, Homo sapiens
gcatttgtccaccca

SEQ ID NO: 219474 - DNA, 18 bp, Homo sapiens
gcatttgtcttagagaga

SEQ ID NO: 219475 - DNA, 19 bp, Homo sapiens
gcatttgtcttagagagag

SEQ ID NO: 219476 - DNA, 13 bp, Homo sapiens
gcatttgtgaggc

SEQ ID NO: 219477 - DNA, 19 bp, Homo sapiens
gcatttgttccattaaaaa

SEQ ID NO: 219478 - DNA, 12 bp, Homo sapiens
gcattttgaatg

SEQ ID NO: 219479 - DNA, 23 bp, Homo sapiens
gcattttgaatgtgatcatcttt

SEQ ID NO: 219480 - DNA, 14 bp, Homo sapiens
gcatttttaaagga

SEQ ID NO: 219481 - DNA, 20 bp, Homo sapiens
gccaaaaaccttagctccct

SEQ ID NO: 219482 - DNA, 23 bp, Homo sapiens
gccaaacaaaaaggttctcaggt

SEQ ID NO: 219483 - DNA, 16 bp, Homo sapiens
gccaaacattcttatt

SEQ ID NO: 219484 - DNA, 21 bp, Homo sapiens
gccaaacattcttattttaga

SEQ ID NO: 219485 - DNA, 15 bp, Homo sapiens
gccaaaccctgtctg

SEQ ID NO: 219486 - DNA, 17 bp, Homo sapiens
gccaaacctttcctgta

SEQ ID NO: 219487 - DNA, 11 bp, Homo sapiens
gccaaagctgg

SEQ ID NO: 219488 - DNA, 19 bp, Homo sapiens
gccaaagctggctttttgt

SEQ ID NO: 219489 - DNA, 15 bp, Homo sapiens
gccaaagtgcagccc

SEQ ID NO: 219490 - DNA, 20 bp, Homo sapiens
gccaaagtgcagcccttcct

SEQ ID NO: 219491 - DNA, 21 bp, Homo sapiens
tcgttcctatacatttctgtt

SEQ ID NO: 219492 - DNA, 15 bp, Homo sapiens
tcgttcgatttaagc

SEQ ID NO: 219493 - DNA, 15 bp, Homo sapiens
tcgttgacatgcaca

SEQ ID NO: 219494 - DNA, 17 bp, Homo sapiens
tcgttggttgtttctct

SEQ ID NO: 219495 - DNA, 19 bp, Homo sapiens
tcgttggttgtttctctga

SEQ ID NO: 219496 - DNA, 13 bp, Homo sapiens
tcgtttgtttgtt

SEQ ID NO: 219497 - DNA, 15 bp, Homo sapiens
tcgttttctttgctg

SEQ ID NO: 219498 - DNA, 19 bp, Homo sapiens
tcgttttctttgctgtgcc

SEQ ID NO: 219499 - DNA, 16 bp, Homo sapiens
tcgtttttcagcaccc

SEQ ID NO: 219500 - DNA, 17 bp, Homo sapiens
tcgtttttttcattcca

SEQ ID NO: 219501 - DNA, 14 bp, Homo sapiens
tctaaaaagtcaat

SEQ ID NO: 219502 - DNA, 19 bp, Homo sapiens
tctaaaacaaaatctgaac

SEQ ID NO: 219503 - DNA, 21 bp, Homo sapiens
tctaaaactatggttcccaat

SEQ ID NO: 219504 - DNA, 14 bp, Homo sapiens
tctaaaagagaagg

SEQ ID NO: 219505 - DNA, 21 bp, Homo sapiens
gccaactcactcttatgaaat

SEQ ID NO: 219506 - DNA, 18 bp, Homo sapiens
gccaagaaaatgaaggga

SEQ ID NO: 219507 - DNA, 13 bp, Homo sapiens
gccaagaactgaa

SEQ ID NO: 219508 - DNA, 16 bp, Homo sapiens
gccaagacaaggaggt

SEQ ID NO: 219509 - DNA, 18 bp, Homo sapiens
gccaagacagtggcagca

SEQ ID NO: 219510 - DNA, 12 bp, Homo sapiens
gccaagacttgg

SEQ ID NO: 219511 - DNA, 18 bp, Homo sapiens
gccaagacttggcaacag

SEQ ID NO: 219512 - DNA, 19 bp, Homo sapiens
gccaagccagggttccaga

SEQ ID NO: 219513 - DNA, 10 bp, Homo sapiens
gccaagcctg

SEQ ID NO: 219514 - DNA, 11 bp, Homo sapiens
gccaagcctgc

SEQ ID NO: 219515 - DNA, 13 bp, Homo sapiens
gccaagcctggag

SEQ ID NO: 219516 - DNA, 14 bp, Homo sapiens
gccaaggacactga

SEQ ID NO: 219517 - DNA, 16 bp, Homo sapiens
gccaaggacactgatg

SEQ ID NO: 219518 - DNA, 20 bp, Homo sapiens
gccaaggacactgatgggtc

SEQ ID NO: 219519 - DNA, 14 bp, Homo sapiens
gccaaggactgccg

SEQ ID NO: 219520 - DNA, 17 bp, Homo sapiens
gccaaggactgccgacc

SEQ ID NO: 219521 - DNA, 16 bp, Homo sapiens
gccaaggccgcccacc

SEQ ID NO: 219522 - DNA, 21 bp, Homo sapiens
gccaaggcctatgccacctgc

SEQ ID NO: 219523 - DNA, 22 bp, Homo sapiens
gccaaggcctatgccacctgca

SEQ ID NO: 219524 - DNA, 19 bp, Homo sapiens
gccaaggcctcaggagagc

SEQ ID NO: 219525 - DNA, 18 bp, Homo sapiens
gccaaggctctcccctct

SEQ ID NO: 219526 - DNA, 20 bp, Homo sapiens
gccaaggggccagctgcccc

SEQ ID NO: 219527 - DNA, 14 bp, Homo sapiens
gccaaggtgggcgg

SEQ ID NO: 219528 - DNA, 22 bp, Homo sapiens
gccaagtaacaatgcatgcttt

SEQ ID NO: 219529 - DNA, 22 bp, Homo sapiens
gccaagtcagctttgccttcca

SEQ ID NO: 219530 - DNA, 21 bp, Homo sapiens
gccaagtcatggagaatctgc

SEQ ID NO: 219531 - DNA, 17 bp, Homo sapiens
gccaagtcctgcctttg

SEQ ID NO: 219532 - DNA, 16 bp, Homo sapiens
gccaagtgcaggctgg

SEQ ID NO: 219533 - DNA, 20 bp, Homo sapiens
gccaagtgcaggctggcacc

SEQ ID NO: 219534 - DNA, 15 bp, Homo sapiens
gccaagtgccttccg

SEQ ID NO: 219535 - DNA, 23 bp, Homo sapiens
gccaatcactgagtttgtggtga

SEQ ID NO: 219536 - DNA, 19 bp, Homo sapiens
gccaatgaggtctgaaatg

SEQ ID NO: 219537 - DNA, 22 bp, Homo sapiens
gccaatgccacagccaagccca

SEQ ID NO: 219538 - DNA, 19 bp, Homo sapiens
gccaatggagactgtctca

SEQ ID NO: 219539 - DNA, 21 bp, Homo sapiens
gccaatggagactgtctcaag

SEQ ID NO: 219540 - DNA, 20 bp, Homo sapiens
gccaatttctcttaagtact

SEQ ID NO: 219541 - DNA, 22 bp, Homo sapiens
gccacaaatcaaagcaagggct

SEQ ID NO: 219542 - DNA, 15 bp, Homo sapiens
gccacaaatgtgtcc

SEQ ID NO: 219543 - DNA, 14 bp, Homo sapiens
gccacaaattgaaa

SEQ ID NO: 219544 - DNA, 23 bp, Homo sapiens
gccacaagaaatttgatttctat

SEQ ID NO: 219545 - DNA, 18 bp, Homo sapiens
gccacaatcctccccacc

SEQ ID NO: 219546 - DNA, 19 bp, Homo sapiens
gccacaatcctccccacca

SEQ ID NO: 219547 - DNA, 18 bp, Homo sapiens
gccacacaaacgtttact

SEQ ID NO: 219548 - DNA, 19 bp, Homo sapiens
gccacacaaacgtttactt

SEQ ID NO: 219549 - DNA, 22 bp, Homo sapiens
gccacacagtgggccggcccca

SEQ ID NO: 219550 - DNA, 18 bp, Homo sapiens
gccacacccaggaaggga

SEQ ID NO: 219551 - DNA, 15 bp, Homo sapiens
gccacacgctcactc

SEQ ID NO: 219552 - DNA, 16 bp, Homo sapiens
gccacacgctcactcc

SEQ ID NO: 219553 - DNA, 15 bp, Homo sapiens
gccacacgctgccca

SEQ ID NO: 219554 - DNA, 18 bp, Homo sapiens
gccacacgctgcccaggc

SEQ ID NO: 219555 - DNA, 21 bp, Homo sapiens
gccacactttcactggggatc

SEQ ID NO: 219556 - DNA, 16 bp, Homo sapiens
gccacagcagcctctg

SEQ ID NO: 219557 - DNA, 12 bp, Homo sapiens
gccacagccacc

SEQ ID NO: 219558 - DNA, 20 bp, Homo sapiens
gccacagccacctccacccc

SEQ ID NO: 219559 - DNA, 14 bp, Homo sapiens
gccacagccagaac

SEQ ID NO: 219560 - DNA, 16 bp, Homo sapiens
gccacagccagaaccc

SEQ ID NO: 219561 - DNA, 13 bp, Homo sapiens
gccacagcccagc

SEQ ID NO: 219562 - DNA, 18 bp, Homo sapiens
gccacaggacacagtcag

SEQ ID NO: 219563 - DNA, 15 bp, Homo sapiens
gccacagtggggccc

SEQ ID NO: 219564 - DNA, 16 bp, Homo sapiens
gccacagtggggccca

SEQ ID NO: 219565 - DNA, 22 bp, Homo sapiens
gccacagtggggcccatggccc

SEQ ID NO: 219566 - DNA, 16 bp, Homo sapiens
gccacatgagtcccag

SEQ ID NO: 219567 - DNA, 20 bp, Homo sapiens
gccacatgagtcccagtggg

SEQ ID NO: 219568 - DNA, 16 bp, Homo sapiens
gccacattttgcttta

SEQ ID NO: 219569 - DNA, 18 bp, Homo sapiens
gccaccaataaaaatcct

SEQ ID NO: 219570 - DNA, 19 bp, Homo sapiens
gccaccaccagatgagaag

SEQ ID NO: 219571 - DNA, 15 bp, Homo sapiens
gccaccacccacccc

SEQ ID NO: 219572 - DNA, 16 bp, Homo sapiens
gccaccacccacccca

SEQ ID NO: 219573 - DNA, 19 bp, Homo sapiens
gccaccacccctccctctg

SEQ ID NO: 219574 - DNA, 21 bp, Homo sapiens
gccaccacccctccctctgct

SEQ ID NO: 219575 - DNA, 14 bp, Homo sapiens
gccaccacgtccag

SEQ ID NO: 219576 - DNA, 15 bp, Homo sapiens
gccaccacgtctgcc

SEQ ID NO: 219577 - DNA, 18 bp, Homo sapiens
gccaccacgtctgccagg

SEQ ID NO: 219578 - DNA, 17 bp, Homo sapiens
gccaccagctccactgg

SEQ ID NO: 219579 - DNA, 20 bp, Homo sapiens
gccaccagctccactggcct

SEQ ID NO: 219580 - DNA, 16 bp, Homo sapiens
gccaccagctgctgga

SEQ ID NO: 219581 - DNA, 20 bp, Homo sapiens
gccaccatctgtaccctgct

SEQ ID NO: 219582 - DNA, 16 bp, Homo sapiens
gccaccatggccagcc

SEQ ID NO: 219583 - DNA, 18 bp, Homo sapiens
gccacccactcaggattg

SEQ ID NO: 219584 - DNA, 16 bp, Homo sapiens
gccaccccaaacccca

SEQ ID NO: 219585 - DNA, 18 bp, Homo sapiens
gccaccccaaaccccagc

SEQ ID NO: 219586 - DNA, 19 bp, Homo sapiens
gccaccccaaaccccagcc

SEQ ID NO: 219587 - DNA, 21 bp, Homo sapiens
gccacccgtaggcagcctctc

SEQ ID NO: 219588 - DNA, 18 bp, Homo sapiens
gccacccgttctgctggc

SEQ ID NO: 219589 - DNA, 21 bp, Homo sapiens
gccaccctaactgagctgcca

SEQ ID NO: 219590 - DNA, 13 bp, Homo sapiens
gccaccctacctg

SEQ ID NO: 219591 - DNA, 19 bp, Homo sapiens
gccaccctcacacacacag

SEQ ID NO: 219592 - DNA, 17 bp, Homo sapiens
gccaccctctgcagggc

SEQ ID NO: 219593 - DNA, 19 bp, Homo sapiens
gccaccctctgcagggcag

SEQ ID NO: 219594 - DNA, 21 bp, Homo sapiens
gccaccctctgcagggcagcc

SEQ ID NO: 219595 - DNA, 14 bp, Homo sapiens
gccaccctggcccg

SEQ ID NO: 219596 - DNA, 23 bp, Homo sapiens
gccaccctggcccgcccctcgct

SEQ ID NO: 219597 - DNA, 17 bp, Homo sapiens
gccaccgcgcccagcct

SEQ ID NO: 219598 - DNA, 16 bp, Homo sapiens
gccaccgctgccagca

SEQ ID NO: 219599 - DNA, 16 bp, Homo sapiens
gccaccggggcaagag

SEQ ID NO: 219600 - DNA, 16 bp, Homo sapiens
gccacctccaccccca

SEQ ID NO: 219601 - DNA, 23 bp, Homo sapiens
gccacctccacccccaagaaacc

SEQ ID NO: 219602 - DNA, 14 bp, Homo sapiens
gccacctgccccct

SEQ ID NO: 219603 - DNA, 17 bp, Homo sapiens
gccacctgcccccttct

SEQ ID NO: 219604 - DNA, 14 bp, Homo sapiens
gccacctgggctgg

SEQ ID NO: 219605 - DNA, 17 bp, Homo sapiens
gccacctgggctgggag

SEQ ID NO: 219606 - DNA, 12 bp, Homo sapiens
gccacctggggc

SEQ ID NO: 219607 - DNA, 16 bp, Homo sapiens
gccacctggggcagtc

SEQ ID NO: 219608 - DNA, 12 bp, Homo sapiens
gccacctgtctg

SEQ ID NO: 219609 - DNA, 18 bp, Homo sapiens
gccacctgtgtgttcttt

SEQ ID NO: 219610 - DNA, 21 bp, Homo sapiens
gccacctgtgtgttcttttga

SEQ ID NO: 219611 - DNA, 12 bp, Homo sapiens
gccacctttcct

SEQ ID NO: 219612 - DNA, 23 bp, Homo sapiens
gccacgaggtggtagctctgagc

SEQ ID NO: 219613 - DNA, 13 bp, Homo sapiens
gccacgattttaa

SEQ ID NO: 219614 - DNA, 14 bp, Homo sapiens
gccacgcagccagg

SEQ ID NO: 219615 - DNA, 17 bp, Homo sapiens
gccacgcagccaggaca

SEQ ID NO: 219616 - DNA, 12 bp, Homo sapiens
gccacgccccag

SEQ ID NO: 219617 - DNA, 16 bp, Homo sapiens
gccacgccccagcccg

SEQ ID NO: 219618 - DNA, 14 bp, Homo sapiens
gccacgctcctctg

SEQ ID NO: 219619 - DNA, 22 bp, Homo sapiens
gccacggaccgcatcctccagg

SEQ ID NO: 219620 - DNA, 14 bp, Homo sapiens
gccacggccaccct

SEQ ID NO: 219621 - DNA, 11 bp, Homo sapiens
gccacggggga

SEQ ID NO: 219622 - DNA, 22 bp, Homo sapiens
gccacgggggaggccgaggcag

SEQ ID NO: 219623 - DNA, 15 bp, Homo sapiens
gccacgtatagtcct

SEQ ID NO: 219624 - DNA, 17 bp, Homo sapiens
gccacgtgctggagagt

SEQ ID NO: 219625 - DNA, 18 bp, Homo sapiens
gccacgtgctggagagta

SEQ ID NO: 219626 - DNA, 21 bp, Homo sapiens
gccacgtgggcaaacaggcag

SEQ ID NO: 219627 - DNA, 22 bp, Homo sapiens
gccactacctttgtccaggcct

SEQ ID NO: 219628 - DNA, 13 bp, Homo sapiens
gccactaggctgg

SEQ ID NO: 219629 - DNA, 17 bp, Homo sapiens
tctagcatagtaaacta

SEQ ID NO: 219630 - DNA, 20 bp, Homo sapiens
tctagccaggagtctgtgct

SEQ ID NO: 219631 - DNA, 21 bp, Homo sapiens
tctagccaggagtctgtgctc

SEQ ID NO: 219632 - DNA, 11 bp, Homo sapiens
tctagccaggc

SEQ ID NO: 219633 - DNA, 20 bp, Homo sapiens
tctagccaggcctcccgcat

SEQ ID NO: 219634 - DNA, 13 bp, Homo sapiens
tctagccatggct

SEQ ID NO: 219635 - DNA, 18 bp, Homo sapiens
gccactaggtgtccccaa

SEQ ID NO: 219636 - DNA, 20 bp, Homo sapiens
gccactattgttagtctctt

SEQ ID NO: 219637 - DNA, 13 bp, Homo sapiens
gccactcccgcca

SEQ ID NO: 219638 - DNA, 21 bp, Homo sapiens
gccactcccgccacacgctca

SEQ ID NO: 219639 - DNA, 15 bp, Homo sapiens
gccactccctgagct

SEQ ID NO: 219640 - DNA, 16 bp, Homo sapiens
gccactccctgagctt

SEQ ID NO: 219641 - DNA, 16 bp, Homo sapiens
gccactccctgccaac

SEQ ID NO: 219642 - DNA, 14 bp, Homo sapiens
gccactcctgtccc

SEQ ID NO: 219643 - DNA, 17 bp, Homo sapiens
gccactcctgtcccgcc

SEQ ID NO: 219644 - DNA, 19 bp, Homo sapiens
gccactcgcagtcgcagga

SEQ ID NO: 219645 - DNA, 16 bp, Homo sapiens
gccactctcagagact

SEQ ID NO: 219646 - DNA, 21 bp, Homo sapiens
gccactctcagagactcccag

SEQ ID NO: 219647 - DNA, 13 bp, Homo sapiens
gccactctctgcc

SEQ ID NO: 219648 - DNA, 14 bp, Homo sapiens
gccactctctgccc

SEQ ID NO: 219649 - DNA, 15 bp, Homo sapiens
gccactctctgccca

SEQ ID NO: 219650 - DNA, 15 bp, Homo sapiens
gccactctctgggac

SEQ ID NO: 219651 - DNA, 17 bp, Homo sapiens
gccactctgctctgcac

SEQ ID NO: 219652 - DNA, 23 bp, Homo sapiens
gccactctgttcctggctcagcc

SEQ ID NO: 219653 - DNA, 16 bp, Homo sapiens
gccactgacctcccac

SEQ ID NO: 219654 - DNA, 18 bp, Homo sapiens
gccactgactgcagggac

SEQ ID NO: 219655 - DNA, 12 bp, Homo sapiens
gccactgcaaac

SEQ ID NO: 219656 - DNA, 18 bp, Homo sapiens
gccactgcaaaccctgct

SEQ ID NO: 219657 - DNA, 19 bp, Homo sapiens
gccactgcaaaccctgctg

SEQ ID NO: 219658 - DNA, 21 bp, Homo sapiens
gccactgcagtcacccctgtc

SEQ ID NO: 219659 - DNA, 24 bp, Homo sapiens
gccactgcagtcacccctgtctgc

SEQ ID NO: 219660 - DNA, 12 bp, Homo sapiens
gccactgccagg

SEQ ID NO: 219661 - DNA, 14 bp, Homo sapiens
gccactgccaggca

SEQ ID NO: 219662 - DNA, 23 bp, Homo sapiens
gccactgccaggcacctggcctg

SEQ ID NO: 219663 - DNA, 16 bp, Homo sapiens
gccactgcctcttcct

SEQ ID NO: 219664 - DNA, 17 bp, Homo sapiens
gccactgcctcttcctc

SEQ ID NO: 219665 - DNA, 15 bp, Homo sapiens
gccactggctgtgcc

SEQ ID NO: 219666 - DNA, 14 bp, Homo sapiens
gccactgggcccca

SEQ ID NO: 219667 - DNA, 19 bp, Homo sapiens
gccactgggtctcactcct

SEQ ID NO: 219668 - DNA, 14 bp, Homo sapiens
gccactgtggccag

SEQ ID NO: 219669 - DNA, 16 bp, Homo sapiens
gccactgtggccagag

SEQ ID NO: 219670 - DNA, 19 bp, Homo sapiens
gccactgtggccagagctg

SEQ ID NO: 219671 - DNA, 21 bp, Homo sapiens
gccactgtggccagagctgga

SEQ ID NO: 219672 - DNA, 13 bp, Homo sapiens
gccacttctcccc

SEQ ID NO: 219673 - DNA, 19 bp, Homo sapiens
gccacttcttaaaggcctg

SEQ ID NO: 219674 - DNA, 15 bp, Homo sapiens
gccacttgacattcc

SEQ ID NO: 219675 - DNA, 17 bp, Homo sapiens
gccacttgacattcctt

SEQ ID NO: 219676 - DNA, 16 bp, Homo sapiens
gccactttgcagacct

SEQ ID NO: 219677 - DNA, 21 bp, Homo sapiens
gccagaaacagtgggagccct

SEQ ID NO: 219678 - DNA, 22 bp, Homo sapiens
gccagaagtcctccctcctgca

SEQ ID NO: 219679 - DNA, 13 bp, Homo sapiens
gccagaccagagc

SEQ ID NO: 219680 - DNA, 14 bp, Homo sapiens
gccagaccagagct

SEQ ID NO: 219681 - DNA, 15 bp, Homo sapiens
gccagacggcccgcc

SEQ ID NO: 219682 - DNA, 13 bp, Homo sapiens
gccagactggctg

SEQ ID NO: 219683 - DNA, 15 bp, Homo sapiens
gccagactggctgca

SEQ ID NO: 219684 - DNA, 22 bp, Homo sapiens
gccagactggctgcacagccca

SEQ ID NO: 219685 - DNA, 23 bp, Homo sapiens
gccagactggctgcacagcccaa

SEQ ID NO: 219686 - DNA, 16 bp, Homo sapiens
gccagagaagataatg

SEQ ID NO: 219687 - DNA, 20 bp, Homo sapiens
gccagagaatagatcagtat

SEQ ID NO: 219688 - DNA, 23 bp, Homo sapiens
gccagagaatagatcagtatttc

SEQ ID NO: 219689 - DNA, 21 bp, Homo sapiens
gccagagagcctggtgctgct

SEQ ID NO: 219690 - DNA, 15 bp, Homo sapiens
gccagagaggagcac

SEQ ID NO: 219691 - DNA, 15 bp, Homo sapiens
gccagagagggccca

SEQ ID NO: 219692 - DNA, 16 bp, Homo sapiens
gccagagagggcccag

SEQ ID NO: 219693 - DNA, 18 bp, Homo sapiens
gccagagcaaagggccag

SEQ ID NO: 219694 - DNA, 18 bp, Homo sapiens
gccagagcacctcaggac

SEQ ID NO: 219695 - DNA, 21 bp, Homo sapiens
gccagagcacctcaggaccct

SEQ ID NO: 219696 - DNA, 22 bp, Homo sapiens
gccagagcccttcactgccatg

SEQ ID NO: 219697 - DNA, 19 bp, Homo sapiens
gccagagcctggtagagac

SEQ ID NO: 219698 - DNA, 15 bp, Homo sapiens
gccagagctggaagg

SEQ ID NO: 219699 - DNA, 16 bp, Homo sapiens
gccagagctggaaggc

SEQ ID NO: 219700 - DNA, 17 bp, Homo sapiens
gccagagctggaaggca

SEQ ID NO: 219701 - DNA, 14 bp, Homo sapiens
gccagagctgggtg

SEQ ID NO: 219702 - DNA, 11 bp, Homo sapiens
gccagaggcag

SEQ ID NO: 219703 - DNA, 13 bp, Homo sapiens
gccagagtggcct

SEQ ID NO: 219704 - DNA, 18 bp, Homo sapiens
gccagagtggcctggcca

SEQ ID NO: 219705 - DNA, 21 bp, Homo sapiens
gccagatgttgttcctggcta

SEQ ID NO: 219706 - DNA, 15 bp, Homo sapiens
gccagcacaggggcc

SEQ ID NO: 219707 - DNA, 18 bp, Homo sapiens
gccagcagggcgggccag

SEQ ID NO: 219708 - DNA, 23 bp, Homo sapiens
gccagcagggcgggccaggagaa

SEQ ID NO: 219709 - DNA, 18 bp, Homo sapiens
gccagcaggttctctcct

SEQ ID NO: 219710 - DNA, 10 bp, Homo sapiens
gccagccagt

SEQ ID NO: 219711 - DNA, 22 bp, Homo sapiens
gccagccagtcttgcctaggcc

SEQ ID NO: 219712 - DNA, 13 bp, Homo sapiens
gccagcccaaagc

SEQ ID NO: 219713 - DNA, 15 bp, Homo sapiens
gccagcccaggattg

SEQ ID NO: 219714 - DNA, 13 bp, Homo sapiens
gccagccccaccc

SEQ ID NO: 219715 - DNA, 15 bp, Homo sapiens
gccagccccacccag

SEQ ID NO: 219716 - DNA, 11 bp, Homo sapiens
gccagcccctc

SEQ ID NO: 219717 - DNA, 20 bp, Homo sapiens
gccagcccctcccaccacag

SEQ ID NO: 219718 - DNA, 20 bp, Homo sapiens
gccagccctccctggctgtg

SEQ ID NO: 219719 - DNA, 19 bp, Homo sapiens
gccagcccttcccaggcca

SEQ ID NO: 219720 - DNA, 22 bp, Homo sapiens
gccagcccttcccaggccagcg

SEQ ID NO: 219721 - DNA, 15 bp, Homo sapiens
gccagcccttccctg

SEQ ID NO: 219722 - DNA, 20 bp, Homo sapiens
gccagcccttccctggcccc

SEQ ID NO: 219723 - DNA, 18 bp, Homo sapiens
gccagccgtgatgctcag

SEQ ID NO: 219724 - DNA, 20 bp, Homo sapiens
gccagccgtgatgctcaggc

SEQ ID NO: 219725 - DNA, 13 bp, Homo sapiens
gccagcctcagtg

SEQ ID NO: 219726 - DNA, 17 bp, Homo sapiens
gccagcctcagtgccac

SEQ ID NO: 219727 - DNA, 13 bp, Homo sapiens
gccagcctgggac

SEQ ID NO: 219728 - DNA, 14 bp, Homo sapiens
gccagcctggggcc

SEQ ID NO: 219729 - DNA, 18 bp, Homo sapiens
gccagcctggggcctggc

SEQ ID NO: 219730 - DNA, 22 bp, Homo sapiens
gccagccttcctctgcagctga

SEQ ID NO: 219731 - DNA, 13 bp, Homo sapiens
gccagcgcaggcc

SEQ ID NO: 219732 - DNA, 22 bp, Homo sapiens
gccagctcagcagttcacttcc

SEQ ID NO: 219733 - DNA, 23 bp, Homo sapiens
gccagctcccccttgcccgccag

SEQ ID NO: 219734 - DNA, 16 bp, Homo sapiens
gccagctccttttctg

SEQ ID NO: 219735 - DNA, 22 bp, Homo sapiens
gccagctccttttctgtgaagc

SEQ ID NO: 219736 - DNA, 20 bp, Homo sapiens
gccagctgcagctgggctgt

SEQ ID NO: 219737 - DNA, 13 bp, Homo sapiens
gccagctgccttc

SEQ ID NO: 219738 - DNA, 17 bp, Homo sapiens
gccagcttcgtgctgga

SEQ ID NO: 219739 - DNA, 16 bp, Homo sapiens
gccaggaagccccgct

SEQ ID NO: 219740 - DNA, 19 bp, Homo sapiens
gccaggaatgtttcagctg

SEQ ID NO: 219741 - DNA, 15 bp, Homo sapiens
gccaggacaccgggc

SEQ ID NO: 219742 - DNA, 23 bp, Homo sapiens
gccaggacagctgcaggtgccca

SEQ ID NO: 219743 - DNA, 22 bp, Homo sapiens
gccaggacgtctggggtgtggg

SEQ ID NO: 219744 - DNA, 10 bp, Homo sapiens
gccaggagac

SEQ ID NO: 219745 - DNA, 15 bp, Homo sapiens
gccaggagcaatggg

SEQ ID NO: 219746 - DNA, 18 bp, Homo sapiens
gccaggagcaatgggact

SEQ ID NO: 219747 - DNA, 14 bp, Homo sapiens
gccaggagcagcct

SEQ ID NO: 219748 - DNA, 16 bp, Homo sapiens
gccaggagtgggtggg

SEQ ID NO: 219749 - DNA, 19 bp, Homo sapiens
gccaggagtgggtgggaca

SEQ ID NO: 219750 - DNA, 17 bp, Homo sapiens
gccaggatggcgtgtcc

SEQ ID NO: 219751 - DNA, 19 bp, Homo sapiens
gccaggatttggttgttta

SEQ ID NO: 219752 - DNA, 20 bp, Homo sapiens
gccaggattttgtattgcca

SEQ ID NO: 219753 - DNA, 22 bp, Homo sapiens
gccaggcaacttcagtcctggg

SEQ ID NO: 219754 - DNA, 13 bp, Homo sapiens
gccaggcacctgg

SEQ ID NO: 219755 - DNA, 13 bp, Homo sapiens
gccaggcactgcc

SEQ ID NO: 219756 - DNA, 21 bp, Homo sapiens
gccaggcagatctgtgcccca

SEQ ID NO: 219757 - DNA, 22 bp, Homo sapiens
gccaggcatggcccagcctgga

SEQ ID NO: 219758 - DNA, 20 bp, Homo sapiens
gccaggccagtaaaagtata

SEQ ID NO: 219759 - DNA, 21 bp, Homo sapiens
gccaggcccatctcaggtgcc

SEQ ID NO: 219760 - DNA, 22 bp, Homo sapiens
gccaggcccatctcaggtgcca

SEQ ID NO: 219761 - DNA, 19 bp, Homo sapiens
gccaggccctcctgctggc

SEQ ID NO: 219762 - DNA, 23 bp, Homo sapiens
gccaggccctcctgctggctgag

SEQ ID NO: 219763 - DNA, 13 bp, Homo sapiens
gccaggcctgcca

SEQ ID NO: 219764 - DNA, 17 bp, Homo sapiens
gccaggcctgccagccc

SEQ ID NO: 219765 - DNA, 18 bp, Homo sapiens
tctcctgtgcccacatcc

SEQ ID NO: 219766 - DNA, 12 bp, Homo sapiens
tctcctgtggtt

SEQ ID NO: 219767 - DNA, 16 bp, Homo sapiens
tctccttactctgagc

SEQ ID NO: 219768 - DNA, 18 bp, Homo sapiens
tctccttactctgagccc

SEQ ID NO: 219769 - DNA, 18 bp, Homo sapiens
tctccttagtcttctcat

SEQ ID NO: 219770 - DNA, 17 bp, Homo sapiens
tctccttcactctgaca

SEQ ID NO: 219771 - DNA, 14 bp, Homo sapiens
aagcttattaatgc

SEQ ID NO: 219772 - DNA, 15 bp, Homo sapiens
aagcttattaatgct

SEQ ID NO: 219773 - DNA, 17 bp, Homo sapiens
aagcttattaatgctaa

SEQ ID NO: 219774 - DNA, 18 bp, Homo sapiens
aagcttattaatgctaag

SEQ ID NO: 219775 - DNA, 20 bp, Homo sapiens
aagcttattaatgctaaggg

SEQ ID NO: 219776 - DNA, 13 bp, Homo sapiens
aagcttatttcta

SEQ ID NO: 219777 - DNA, 13 bp, Homo sapiens
aagcttgagcctc

SEQ ID NO: 219778 - DNA, 14 bp, Homo sapiens
aagcttggcagccg

SEQ ID NO: 219779 - DNA, 20 bp, Homo sapiens
aagcttgtattatcagtgaa

SEQ ID NO: 219780 - DNA, 14 bp, Homo sapiens
aagcttgtgtactt

SEQ ID NO: 219781 - DNA, 17 bp, Homo sapiens
aagctttaaaaaataaa

SEQ ID NO: 219782 - DNA, 21 bp, Homo sapiens
aagctttccgagtcaagtgat

SEQ ID NO: 219783 - DNA, 12 bp, Homo sapiens
aagctttcctgc

SEQ ID NO: 219784 - DNA, 22 bp, Homo sapiens
aagctttcctgccccaggcctg

SEQ ID NO: 219785 - DNA, 20 bp, Homo sapiens
aaggaaaactcaccatttca

SEQ ID NO: 219786 - DNA, 17 bp, Homo sapiens
aaggaaaatagtaatgt

SEQ ID NO: 219787 - DNA, 19 bp, Homo sapiens
aaggaaacaatggtcacaa

SEQ ID NO: 219788 - DNA, 22 bp, Homo sapiens
aaggaaaccaagtggtcaggag

SEQ ID NO: 219789 - DNA, 15 bp, Homo sapiens
aaggaaaccagtgca

SEQ ID NO: 219790 - DNA, 23 bp, Homo sapiens
aaggaaactgaggcccagagagc

SEQ ID NO: 219791 - DNA, 14 bp, Homo sapiens
aaggaaagcatgtc

SEQ ID NO: 219792 - DNA, 14 bp, Homo sapiens
aaggaaaggaatat

SEQ ID NO: 219793 - DNA, 16 bp, Homo sapiens
aaggaaataacattgc

SEQ ID NO: 219794 - DNA, 18 bp, Homo sapiens
aaggaaatatcataatgt

SEQ ID NO: 219795 - DNA, 19 bp, Homo sapiens
aaggaaatctcctcttttg

SEQ ID NO: 219796 - DNA, 12 bp, Homo sapiens
aaggaaatgtta

SEQ ID NO: 219797 - DNA, 16 bp, Homo sapiens
aaggaacacagagcag

SEQ ID NO: 219798 - DNA, 13 bp, Homo sapiens
aaggaagaaaaat

SEQ ID NO: 219799 - DNA, 15 bp, Homo sapiens
aaggaagaaaaatca

SEQ ID NO: 219800 - DNA, 15 bp, Homo sapiens
aaggaagagggctga

SEQ ID NO: 219801 - DNA, 20 bp, Homo sapiens
aaggaagatcttgagagctg

SEQ ID NO: 219802 - DNA, 22 bp, Homo sapiens
aaggaagatcttgagagctgct

SEQ ID NO: 219803 - DNA, 23 bp, Homo sapiens
aaggaagatcttgagagctgctg

SEQ ID NO: 219804 - DNA, 22 bp, Homo sapiens
aaggaagcacctatgaaagcaa

SEQ ID NO: 219805 - DNA, 19 bp, Homo sapiens
aaggaagctttctctgctt

SEQ ID NO: 219806 - DNA, 14 bp, Homo sapiens
aaggaaggaaacaa

SEQ ID NO: 219807 - DNA, 16 bp, Homo sapiens
aaggaatagccagaga

SEQ ID NO: 219808 - DNA, 18 bp, Homo sapiens
aaggaatagccagagagg

SEQ ID NO: 219809 - DNA, 13 bp, Homo sapiens
aaggaatctggca

SEQ ID NO: 219810 - DNA, 17 bp, Homo sapiens
aaggaatgcctgtgcca

SEQ ID NO: 219811 - DNA, 17 bp, Homo sapiens
aaggaatgcttggaata

SEQ ID NO: 219812 - DNA, 17 bp, Homo sapiens
aaggacaacctgcccct

SEQ ID NO: 219813 - DNA, 21 bp, Homo sapiens
aaggacaacctgcccctcccc

SEQ ID NO: 219814 - DNA, 14 bp, Homo sapiens
aaggacacactaat

SEQ ID NO: 219815 - DNA, 13 bp, Homo sapiens
aaggacactgatg

SEQ ID NO: 219816 - DNA, 20 bp, Homo sapiens
aaggacactgatgggtcctg

SEQ ID NO: 219817 - DNA, 21 bp, Homo sapiens
aaggacagagggttttgattt

SEQ ID NO: 219818 - DNA, 16 bp, Homo sapiens
aaggacaggaggagga

SEQ ID NO: 219819 - DNA, 20 bp, Homo sapiens
aaggacaggaggaggagatg

SEQ ID NO: 219820 - DNA, 16 bp, Homo sapiens
aaggacattgccccaa

SEQ ID NO: 219821 - DNA, 18 bp, Homo sapiens
aaggacattgccccaaga

SEQ ID NO: 219822 - DNA, 19 bp, Homo sapiens
aaggacattgccccaagat

SEQ ID NO: 219823 - DNA, 22 bp, Homo sapiens
aaggaccaacccatgccctgcc

SEQ ID NO: 219824 - DNA, 20 bp, Homo sapiens
aaggaccagtttcttgaagt

SEQ ID NO: 219825 - DNA, 24 bp, Homo sapiens
aaggacccacccatcttcctgctg

SEQ ID NO: 219826 - DNA, 15 bp, Homo sapiens
aaggacccctcacct

SEQ ID NO: 219827 - DNA, 20 bp, Homo sapiens
aaggacccctcaccttgcaa

SEQ ID NO: 219828 - DNA, 13 bp, Homo sapiens
aaggacctcctga

SEQ ID NO: 219829 - DNA, 15 bp, Homo sapiens
aaggactctaaaagg

SEQ ID NO: 219830 - DNA, 21 bp, Homo sapiens
aaggactgcatggtaatttat

SEQ ID NO: 219831 - DNA, 17 bp, Homo sapiens
aaggactggattggcca

SEQ ID NO: 219832 - DNA, 14 bp, Homo sapiens
aaggacttgtgcct

SEQ ID NO: 219833 - DNA, 15 bp, Homo sapiens
aaggacttgtgcctc

SEQ ID NO: 219834 - DNA, 12 bp, Homo sapiens
aaggagaaaaaa

SEQ ID NO: 219835 - DNA, 16 bp, Homo sapiens
aaggagaatatgataa

SEQ ID NO: 219836 - DNA, 19 bp, Homo sapiens
aaggagacaaagcaggagt

SEQ ID NO: 219837 - DNA, 13 bp, Homo sapiens
aaggagagcctgc

SEQ ID NO: 219838 - DNA, 14 bp, Homo sapiens
aaggagagcctgct

SEQ ID NO: 219839 - DNA, 12 bp, Homo sapiens
aaggagaggagt

SEQ ID NO: 219840 - DNA, 21 bp, Homo sapiens
aaggagaggctctgaaagctg

SEQ ID NO: 219841 - DNA, 23 bp, Homo sapiens
aaggagatgtaatgacagagagt

SEQ ID NO: 219842 - DNA, 18 bp, Homo sapiens
aaggagcctgcggctgct

SEQ ID NO: 219843 - DNA, 19 bp, Homo sapiens
aaggagctgatttccaggc

SEQ ID NO: 219844 - DNA, 20 bp, Homo sapiens
aaggagctgatttccaggcc

SEQ ID NO: 219845 - DNA, 15 bp, Homo sapiens
aaggagggagctgct

SEQ ID NO: 219846 - DNA, 16 bp, Homo sapiens
aaggagggagctgctc

SEQ ID NO: 219847 - DNA, 18 bp, Homo sapiens
aaggagggagctgctcag

SEQ ID NO: 219848 - DNA, 17 bp, Homo sapiens
aaggagggcagagccat

SEQ ID NO: 219849 - DNA, 16 bp, Homo sapiens
aaggagggcctctggt

SEQ ID NO: 219850 - DNA, 22 bp, Homo sapiens
aaggagtgcatggccacagcca

SEQ ID NO: 219851 - DNA, 16 bp, Homo sapiens
aaggatctctcaggag

SEQ ID NO: 219852 - DNA, 22 bp, Homo sapiens
aaggatctctcaggagcacagg

SEQ ID NO: 219853 - DNA, 21 bp, Homo sapiens
aaggatggcagcctcagggct

SEQ ID NO: 219854 - DNA, 18 bp, Homo sapiens
aaggatgttctggcttta

SEQ ID NO: 219855 - DNA, 20 bp, Homo sapiens
aaggattaagatacactcct

SEQ ID NO: 219856 - DNA, 17 bp, Homo sapiens
aaggattctaaacagat

SEQ ID NO: 219857 - DNA, 13 bp, Homo sapiens
aaggattgccttt

SEQ ID NO: 219858 - DNA, 16 bp, Homo sapiens
aaggatttactttttg

SEQ ID NO: 219859 - DNA, 15 bp, Homo sapiens
aaggcaaagtttcca

SEQ ID NO: 219860 - DNA, 13 bp, Homo sapiens
aaggcaaatgtcc

SEQ ID NO: 219861 - DNA, 18 bp, Homo sapiens
aaggcaacatttccgaag

SEQ ID NO: 219862 - DNA, 20 bp, Homo sapiens
aaggcaactgaacaaaaaaa

SEQ ID NO: 219863 - DNA, 16 bp, Homo sapiens
aaggcaagaagtggga

SEQ ID NO: 219864 - DNA, 15 bp, Homo sapiens
aaggcaaggctgtca

SEQ ID NO: 219865 - DNA, 18 bp, Homo sapiens
aaggcaaggctgtcaatt

SEQ ID NO: 219866 - DNA, 15 bp, Homo sapiens
aaggcaccagccggg

SEQ ID NO: 219867 - DNA, 13 bp, Homo sapiens
aaggcagaaagga

SEQ ID NO: 219868 - DNA, 24 bp, Homo sapiens
aaggcagagaaaacacacgctcct

SEQ ID NO: 219869 - DNA, 13 bp, Homo sapiens
aaggcagcctcca

SEQ ID NO: 219870 - DNA, 20 bp, Homo sapiens
aaggcagcctccagagccag

SEQ ID NO: 219871 - DNA, 20 bp, Homo sapiens
aaggcagctcacccctgggc

SEQ ID NO: 219872 - DNA, 22 bp, Homo sapiens
aaggcagctcacccctgggcag

SEQ ID NO: 219873 - DNA, 18 bp, Homo sapiens
aaggcagctgaaaagtaa

SEQ ID NO: 219874 - DNA, 20 bp, Homo sapiens
aaggcagctgaaaagtaaat

SEQ ID NO: 219875 - DNA, 13 bp, Homo sapiens
aaggcagctgctc

SEQ ID NO: 219876 - DNA, 22 bp, Homo sapiens
aaggcaggttggatgggagtgg

SEQ ID NO: 219877 - DNA, 23 bp, Homo sapiens
aaggcagtatggcggaggccatg

SEQ ID NO: 219878 - DNA, 23 bp, Homo sapiens
aaggcagtgaacacactcagcag

SEQ ID NO: 219879 - DNA, 23 bp, Homo sapiens
aaggcatgcctggacaaaccctt

SEQ ID NO: 219880 - DNA, 18 bp, Homo sapiens
aaggccaaggcctcagga

SEQ ID NO: 219881 - DNA, 12 bp, Homo sapiens
aaggccacctgc

SEQ ID NO: 219882 - DNA, 24 bp, Homo sapiens
aaggccacgtatagtcctagctga

SEQ ID NO: 219883 - DNA, 23 bp, Homo sapiens
aaggccagagtggcctggccagg

SEQ ID NO: 219884 - DNA, 19 bp, Homo sapiens
aaggccagccacaccacag

SEQ ID NO: 219885 - DNA, 20 bp, Homo sapiens
aaggccagccacaccacagg

SEQ ID NO: 219886 - DNA, 22 bp, Homo sapiens
aaggcccaagagcagagtctgg

SEQ ID NO: 219887 - DNA, 12 bp, Homo sapiens
aaggcccctccc

SEQ ID NO: 219888 - DNA, 22 bp, Homo sapiens
aaggccgaagaagggtccttcc

SEQ ID NO: 219889 - DNA, 14 bp, Homo sapiens
aaggccgcccacct

SEQ ID NO: 219890 - DNA, 18 bp, Homo sapiens
aaggccggtgggaagagg

SEQ ID NO: 219891 - DNA, 16 bp, Homo sapiens
aaggcctatgccacct

SEQ ID NO: 219892 - DNA, 16 bp, Homo sapiens
aaggcctcttgtgctc

SEQ ID NO: 219893 - DNA, 19 bp, Homo sapiens
aaggcctgagggaagccca

SEQ ID NO: 219894 - DNA, 16 bp, Homo sapiens
aaggcctgcccccctt

SEQ ID NO: 219895 - DNA, 21 bp, Homo sapiens
gcccacattgcccacacctgc

SEQ ID NO: 219896 - DNA, 16 bp, Homo sapiens
gcccaccagggactgc

SEQ ID NO: 219897 - DNA, 21 bp, Homo sapiens
gcccacccacaccccgtctgc

SEQ ID NO: 219898 - DNA, 15 bp, Homo sapiens
gcccacccagggccc

SEQ ID NO: 219899 - DNA, 22 bp, Homo sapiens
gcccacccagggcccggcacag

SEQ ID NO: 219900 - DNA, 13 bp, Homo sapiens
gcccacccccctc

SEQ ID NO: 219901 - DNA, 10 bp, Homo sapiens
gcccaccccg

SEQ ID NO: 219902 - DNA, 15 bp, Homo sapiens
gcccaccccgctgcc

SEQ ID NO: 219903 - DNA, 12 bp, Homo sapiens
gcccacccctct

SEQ ID NO: 219904 - DNA, 16 bp, Homo sapiens
gcccacccctcttccc

SEQ ID NO: 219905 - DNA, 19 bp, Homo sapiens
gcccacccctcttccccct

SEQ ID NO: 219906 - DNA, 22 bp, Homo sapiens
gcccacccctcttcccccttcc

SEQ ID NO: 219907 - DNA, 23 bp, Homo sapiens
gcccacccctcttcccccttccc

SEQ ID NO: 219908 - DNA, 18 bp, Homo sapiens
gcccacccgccccagaga

SEQ ID NO: 219909 - DNA, 13 bp, Homo sapiens
aaggctgccggct

SEQ ID NO: 219910 - DNA, 16 bp, Homo sapiens
aaggctgcctggagaa

SEQ ID NO: 219911 - DNA, 20 bp, Homo sapiens
aaggctggccagcaaggcag

SEQ ID NO: 219912 - DNA, 14 bp, Homo sapiens
aaggctggggctat

SEQ ID NO: 219913 - DNA, 21 bp, Homo sapiens
aaggctgggtaatgtgaaggc

SEQ ID NO: 219914 - DNA, 20 bp, Homo sapiens
aaggctgtcaattacaggaa

SEQ ID NO: 219915 - DNA, 23 bp, Homo sapiens
aaggcttctgggacttgaaatca

SEQ ID NO: 219916 - DNA, 22 bp, Homo sapiens
aaggctttcagggcctccagcc

SEQ ID NO: 219917 - DNA, 15 bp, Homo sapiens
aagggaaaagggaga

SEQ ID NO: 219918 - DNA, 14 bp, Homo sapiens
aagggaaacagtca

SEQ ID NO: 219919 - DNA, 20 bp, Homo sapiens
aagggaaagcgggcagcccc

SEQ ID NO: 219920 - DNA, 14 bp, Homo sapiens
aagggaaatatcat

SEQ ID NO: 219921 - DNA, 15 bp, Homo sapiens
aagggaaatatcatt

SEQ ID NO: 219922 - DNA, 14 bp, Homo sapiens
aagggaaccagccc

SEQ ID NO: 219923 - DNA, 20 bp, Homo sapiens
aagggaaccagccctccaga

SEQ ID NO: 219924 - DNA, 17 bp, Homo sapiens
aagggaactgaagacct

SEQ ID NO: 219925 - DNA, 14 bp, Homo sapiens
aagggaattgctca

SEQ ID NO: 219926 - DNA, 15 bp, Homo sapiens
aagggacatgtcttt

SEQ ID NO: 219927 - DNA, 13 bp, Homo sapiens
aagggactggtcc

SEQ ID NO: 219928 - DNA, 15 bp, Homo sapiens
aagggactggtccag

SEQ ID NO: 219929 - DNA, 13 bp, Homo sapiens
aagggagaggagg

SEQ ID NO: 219930 - DNA, 22 bp, Homo sapiens
aagggagagttctttgctgccc

SEQ ID NO: 219931 - DNA, 23 bp, Homo sapiens
aagggagagttctttgctgcccc

SEQ ID NO: 219932 - DNA, 17 bp, Homo sapiens
aagggagccatgctctt

SEQ ID NO: 219933 - DNA, 20 bp, Homo sapiens
aagggagcccctcctctgag

SEQ ID NO: 219934 - DNA, 21 bp, Homo sapiens
aagggatggaaaaggaagact

SEQ ID NO: 219935 - DNA, 14 bp, Homo sapiens
aagggattctggga

SEQ ID NO: 219936 - DNA, 17 bp, Homo sapiens
aagggcagcccctcccc

SEQ ID NO: 219937 - DNA, 22 bp, Homo sapiens
aagggcaggaaggagagcctgc

SEQ ID NO: 219938 - DNA, 17 bp, Homo sapiens
aagggcatcaggcactg

SEQ ID NO: 219939 - DNA, 21 bp, Homo sapiens
aagggcatgttgggataaata

SEQ ID NO: 219940 - DNA, 14 bp, Homo sapiens
aagggccagtcctg

SEQ ID NO: 219941 - DNA, 19 bp, Homo sapiens
aagggcctcacctttccca

SEQ ID NO: 219942 - DNA, 14 bp, Homo sapiens
aagggccttctcca

SEQ ID NO: 219943 - DNA, 22 bp, Homo sapiens
aagggctaaggcctcttgctgg

SEQ ID NO: 219944 - DNA, 13 bp, Homo sapiens
aagggctccagca

SEQ ID NO: 219945 - DNA, 23 bp, Homo sapiens
aagggctccagcatccagcctgt

SEQ ID NO: 219946 - DNA, 21 bp, Homo sapiens
aagggcttacacgtggaggaa

SEQ ID NO: 219947 - DNA, 19 bp, Homo sapiens
aaggggaggacctctgggc

SEQ ID NO: 219948 - DNA, 14 bp, Homo sapiens
aaggggaggcagcc

SEQ ID NO: 219949 - DNA, 22 bp, Homo sapiens
aaggggatgtatccatgggggc

SEQ ID NO: 219950 - DNA, 14 bp, Homo sapiens
aaggggcacaccac

SEQ ID NO: 219951 - DNA, 21 bp, Homo sapiens
aaggggcacaccactgccctg

SEQ ID NO: 219952 - DNA, 21 bp, Homo sapiens
aaggggcaggaatcaaggagc

SEQ ID NO: 219953 - DNA, 18 bp, Homo sapiens
aaggggcagtctggaggg

SEQ ID NO: 219954 - DNA, 20 bp, Homo sapiens
aaggggcagtctggaggggc

SEQ ID NO: 219955 - DNA, 17 bp, Homo sapiens
aaggggccagctgcccc

SEQ ID NO: 219956 - DNA, 14 bp, Homo sapiens
aaggggctgctggg

SEQ ID NO: 219957 - DNA, 15 bp, Homo sapiens
aaggggggagctggg

SEQ ID NO: 219958 - DNA, 13 bp, Homo sapiens
aaggggggagggg

SEQ ID NO: 219959 - DNA, 14 bp, Homo sapiens
aaggggtttctaac

SEQ ID NO: 219960 - DNA, 15 bp, Homo sapiens
aagggtatctgctgc

SEQ ID NO: 219961 - DNA, 14 bp, Homo sapiens
aagggtgtggcttg

SEQ ID NO: 219962 - DNA, 19 bp, Homo sapiens
aagggtgtgggtcagggag

SEQ ID NO: 219963 - DNA, 17 bp, Homo sapiens
aagggttctggctgccc

SEQ ID NO: 219964 - DNA, 20 bp, Homo sapiens
aagggtttgtggctgggggc

SEQ ID NO: 219965 - DNA, 21 bp, Homo sapiens
aaggtaatactataaatatat

SEQ ID NO: 219966 - DNA, 21 bp, Homo sapiens
aaggtaataggaagaacagta

SEQ ID NO: 219967 - DNA, 19 bp, Homo sapiens
aaggtaccaagatcacaaa

SEQ ID NO: 219968 - DNA, 22 bp, Homo sapiens
aaggtagtttttacctaccaca

SEQ ID NO: 219969 - DNA, 13 bp, Homo sapiens
aaggtatctggta

SEQ ID NO: 219970 - DNA, 15 bp, Homo sapiens
aaggtattttgaata

SEQ ID NO: 219971 - DNA, 17 bp, Homo sapiens
aaggtcatctttttccc

SEQ ID NO: 219972 - DNA, 22 bp, Homo sapiens
aaggtcattgtggctatctgca

SEQ ID NO: 219973 - DNA, 18 bp, Homo sapiens
aaggtcgtttttttcatt

SEQ ID NO: 219974 - DNA, 19 bp, Homo sapiens
aaggtctaggtggaggtgg

SEQ ID NO: 219975 - DNA, 12 bp, Homo sapiens
aaggtctattgg

SEQ ID NO: 219976 - DNA, 21 bp, Homo sapiens
aaggtctccttactctgagcc

SEQ ID NO: 219977 - DNA, 22 bp, Homo sapiens
aaggtctccttactctgagccc

SEQ ID NO: 219978 - DNA, 20 bp, Homo sapiens
aaggtctgggagtgttctgt

SEQ ID NO: 219979 - DNA, 18 bp, Homo sapiens
aaggtgattaaatattta

SEQ ID NO: 219980 - DNA, 21 bp, Homo sapiens
aaggtgattttcctgtgtcca

SEQ ID NO: 219981 - DNA, 12 bp, Homo sapiens
aaggtgcccagg

SEQ ID NO: 219982 - DNA, 15 bp, Homo sapiens
aaggtgcccaggagc

SEQ ID NO: 219983 - DNA, 18 bp, Homo sapiens
aaggtgccgtgagcaggc

SEQ ID NO: 219984 - DNA, 20 bp, Homo sapiens
aaggtgccgtgagcaggctt

SEQ ID NO: 219985 - DNA, 17 bp, Homo sapiens
aaggtgctcaaagatgt

SEQ ID NO: 219986 - DNA, 21 bp, Homo sapiens
aaggtgctcaaagatgtactg

SEQ ID NO: 219987 - DNA, 13 bp, Homo sapiens
aaggtgctgagct

SEQ ID NO: 219988 - DNA, 22 bp, Homo sapiens
aaggtgctgttgtcattgcttt

SEQ ID NO: 219989 - DNA, 15 bp, Homo sapiens
aaggtggaaaatgga

SEQ ID NO: 219990 - DNA, 22 bp, Homo sapiens
aaggtggaaaatggactggctt

SEQ ID NO: 219991 - DNA, 12 bp, Homo sapiens
aaggtgggcgga

SEQ ID NO: 219992 - DNA, 21 bp, Homo sapiens
aaggtgggggagcctggagcc

SEQ ID NO: 219993 - DNA, 20 bp, Homo sapiens
aaggtgggggttggctgggt

SEQ ID NO: 219994 - DNA, 22 bp, Homo sapiens
aaggtgggtccaggaaggcagc

SEQ ID NO: 219995 - DNA, 21 bp, Homo sapiens
aaggtgggttccagggactgt

SEQ ID NO: 219996 - DNA, 14 bp, Homo sapiens
aaggtggtcttgga

SEQ ID NO: 219997 - DNA, 20 bp, Homo sapiens
aaggtggtcttggagaggag

SEQ ID NO: 219998 - DNA, 14 bp, Homo sapiens
aaggttaacagtaa

SEQ ID NO: 219999 - DNA, 19 bp, Homo sapiens
aaggttaacagtaaaaatt

SEQ ID NO: 220000 - DNA, 21 bp, Homo sapiens
aaggttaacagtaaaaatttc

SEQ ID NO: 220001 - DNA, 17 bp, Homo sapiens
aaggttcactaaagcag

SEQ ID NO: 220002 - DNA, 17 bp, Homo sapiens
aaggttctggtaacctg

SEQ ID NO: 220003 - DNA, 15 bp, Homo sapiens
aaggttgaattaatt

SEQ ID NO: 220004 - DNA, 20 bp, Homo sapiens
aaggttgattctcatgcact

SEQ ID NO: 220005 - DNA, 19 bp, Homo sapiens
aaggttggcgactgtcatg

SEQ ID NO: 220006 - DNA, 12 bp, Homo sapiens
aaggttgtacat

SEQ ID NO: 220007 - DNA, 13 bp, Homo sapiens
aaggttgtacata

SEQ ID NO: 220008 - DNA, 11 bp, Homo sapiens
aagtaaaaaca

SEQ ID NO: 220009 - DNA, 17 bp, Homo sapiens
aagtaaaaataaactgt

SEQ ID NO: 220010 - DNA, 12 bp, Homo sapiens
aagtaaatgcta

SEQ ID NO: 220011 - DNA, 18 bp, Homo sapiens
aagtaaatgctacctctg

SEQ ID NO: 220012 - DNA, 13 bp, Homo sapiens
aagtaacatataa

SEQ ID NO: 220013 - DNA, 22 bp, Homo sapiens
aagtaaccaactgaacgacaaa

SEQ ID NO: 220014 - DNA, 15 bp, Homo sapiens
aagtaacttttacaa

SEQ ID NO: 220015 - DNA, 13 bp, Homo sapiens
aagtaagaagaca

SEQ ID NO: 220016 - DNA, 20 bp, Homo sapiens
aagtaagaagacatgaacca

SEQ ID NO: 220017 - DNA, 21 bp, Homo sapiens
aagtaagtggagcatttggaa

SEQ ID NO: 220018 - DNA, 15 bp, Homo sapiens
aagtaagttctgaaa

SEQ ID NO: 220019 - DNA, 12 bp, Homo sapiens
aagtaatgaatt

SEQ ID NO: 220020 - DNA, 22 bp, Homo sapiens
aagtaattgacagggaaaatat

SEQ ID NO: 220021 - DNA, 23 bp, Homo sapiens
aagtacagtcccagcacatttcc

SEQ ID NO: 220022 - DNA, 13 bp, Homo sapiens
aagtacatagtga

SEQ ID NO: 220023 - DNA, 15 bp, Homo sapiens
aagtacatagtgaat

SEQ ID NO: 220024 - DNA, 16 bp, Homo sapiens
aagtacatcacccagt

SEQ ID NO: 220025 - DNA, 16 bp, Homo sapiens
tctcttctccactgga

SEQ ID NO: 220026 - DNA, 14 bp, Homo sapiens
tctcttctctcttc

SEQ ID NO: 220027 - DNA, 13 bp, Homo sapiens
tctcttctgctcc

SEQ ID NO: 220028 - DNA, 19 bp, Homo sapiens
tctcttctgctccaccctt

SEQ ID NO: 220029 - DNA, 22 bp, Homo sapiens
tctcttgagggagcttagccaa

SEQ ID NO: 220030 - DNA, 14 bp, Homo sapiens
tctcttgattcata

SEQ ID NO: 220031 - DNA, 17 bp, Homo sapiens
tctcttgattgattttt

SEQ ID NO: 220032 - DNA, 13 bp, Homo sapiens
tctcttgccagca

SEQ ID NO: 220033 - DNA, 21 bp, Homo sapiens
tctcttggactccctccccac

SEQ ID NO: 220034 - DNA, 16 bp, Homo sapiens
tctctttaatcttcag

SEQ ID NO: 220035 - DNA, 17 bp, Homo sapiens
tctctttaatcttcagt

SEQ ID NO: 220036 - DNA, 22 bp, Homo sapiens
tctctttcaattgcagatgcca

SEQ ID NO: 220037 - DNA, 12 bp, Homo sapiens
tctctttcagta

SEQ ID NO: 220038 - DNA, 13 bp, Homo sapiens
tctctttcagtat

SEQ ID NO: 220039 - DNA, 19 bp, Homo sapiens
tctctttcagtattaaact

SEQ ID NO: 220040 - DNA, 16 bp, Homo sapiens
tctctttccactttgt

SEQ ID NO: 220041 - DNA, 23 bp, Homo sapiens
tctctttctccttagtcttctca

SEQ ID NO: 220042 - DNA, 21 bp, Homo sapiens
tctctttcttccactaccctc

SEQ ID NO: 220043 - DNA, 12 bp, Homo sapiens
tctcttttctct

SEQ ID NO: 220044 - DNA, 18 bp, Homo sapiens
tctcttttcttctcagga

SEQ ID NO: 220045 - DNA, 15 bp, Homo sapiens
tctctttttcttttc

SEQ ID NO: 220046 - DNA, 17 bp, Homo sapiens
tctctttttcttttcta

SEQ ID NO: 220047 - DNA, 19 bp, Homo sapiens
tctctttttttggcccagg

SEQ ID NO: 220048 - DNA, 21 bp, Homo sapiens
tctgaaaagcaattgccctgt

SEQ ID NO: 220049 - DNA, 20 bp, Homo sapiens
tctgaaaatatttttttcta

SEQ ID NO: 220050 - DNA, 21 bp, Homo sapiens
tctgaaaatatttttttctag

SEQ ID NO: 220051 - DNA, 17 bp, Homo sapiens
tctgaaacacagtcatg

SEQ ID NO: 220052 - DNA, 22 bp, Homo sapiens
tctgaaacacagtcatgtgtca

SEQ ID NO: 220053 - DNA, 20 bp, Homo sapiens
tctgaaagctgcttctgggg

SEQ ID NO: 220054 - DNA, 15 bp, Homo sapiens
tctgaaatttcccac

SEQ ID NO: 220055 - DNA, 21 bp, Homo sapiens
tctgaactccatacagcctct

SEQ ID NO: 220056 - DNA, 17 bp, Homo sapiens
tctgaactcgcttctct

SEQ ID NO: 220057 - DNA, 13 bp, Homo sapiens
tctgaactttgtt

SEQ ID NO: 220058 - DNA, 19 bp, Homo sapiens
tctgaactttgtttccaga

SEQ ID NO: 220059 - DNA, 12 bp, Homo sapiens
tctgaagcatgt

SEQ ID NO: 220060 - DNA, 18 bp, Homo sapiens
tctgaaggaatagccaga

SEQ ID NO: 220061 - DNA, 20 bp, Homo sapiens
tctgaaggaatagccagaga

SEQ ID NO: 220062 - DNA, 13 bp, Homo sapiens
tctgaaggactgg

SEQ ID NO: 220063 - DNA, 23 bp, Homo sapiens
tctgaaggttggaactgctgcca

SEQ ID NO: 220064 - DNA, 17 bp, Homo sapiens
tctgaagtcccttcctg

SEQ ID NO: 220065 - DNA, 22 bp, Homo sapiens
tctgaagtcccttcctgtcctg

SEQ ID NO: 220066 - DNA, 16 bp, Homo sapiens
tctgaagttggacagc

SEQ ID NO: 220067 - DNA, 13 bp, Homo sapiens
tctgaataacttg

SEQ ID NO: 220068 - DNA, 16 bp, Homo sapiens
tctgaataatttctta

SEQ ID NO: 220069 - DNA, 19 bp, Homo sapiens
tctgaatacctctttgaaa

SEQ ID NO: 220070 - DNA, 20 bp, Homo sapiens
tctgaatctctcaaaatgtg

SEQ ID NO: 220071 - DNA, 23 bp, Homo sapiens
tctgaatgggagccagaattcac

SEQ ID NO: 220072 - DNA, 12 bp, Homo sapiens
tctgaatgttct

SEQ ID NO: 220073 - DNA, 16 bp, Homo sapiens
tctgaatgttctgaca

SEQ ID NO: 220074 - DNA, 19 bp, Homo sapiens
tctgaatgttctgacatta

SEQ ID NO: 220075 - DNA, 13 bp, Homo sapiens
tctgaattattct

SEQ ID NO: 220076 - DNA, 18 bp, Homo sapiens
tctgaattcataaaaata

SEQ ID NO: 220077 - DNA, 17 bp, Homo sapiens
tctgacacttgtggtat

SEQ ID NO: 220078 - DNA, 15 bp, Homo sapiens
tctgacagcagcctg

SEQ ID NO: 220079 - DNA, 18 bp, Homo sapiens
tctgacagcagcctgtga

SEQ ID NO: 220080 - DNA, 22 bp, Homo sapiens
tctgacagcatttcagctgtga

SEQ ID NO: 220081 - DNA, 13 bp, Homo sapiens
tctgacaggaaga

SEQ ID NO: 220082 - DNA, 21 bp, Homo sapiens
tctgacaggaagactggagac

SEQ ID NO: 220083 - DNA, 22 bp, Homo sapiens
tctgacaggaagactggagact

SEQ ID NO: 220084 - DNA, 19 bp, Homo sapiens
tctgacagtattaacatca

SEQ ID NO: 220085 - DNA, 18 bp, Homo sapiens
tctgacagttactcttca

SEQ ID NO: 220086 - DNA, 21 bp, Homo sapiens
tctgacataaacccatctgta

SEQ ID NO: 220087 - DNA, 21 bp, Homo sapiens
tctgacattaacagttttcca

SEQ ID NO: 220088 - DNA, 18 bp, Homo sapiens
tctgaccacacttcctgt

SEQ ID NO: 220089 - DNA, 21 bp, Homo sapiens
tctgaccccacttatgctgct

SEQ ID NO: 220090 - DNA, 21 bp, Homo sapiens
tctgaccctagctctttcctt

SEQ ID NO: 220091 - DNA, 14 bp, Homo sapiens
tctgacctcagcat

SEQ ID NO: 220092 - DNA, 12 bp, Homo sapiens
tctgacctcccc

SEQ ID NO: 220093 - DNA, 20 bp, Homo sapiens
tctgaccttcacagggacag

SEQ ID NO: 220094 - DNA, 21 bp, Homo sapiens
tctgaccttcacagggacaga

SEQ ID NO: 220095 - DNA, 14 bp, Homo sapiens
tctgacggccctgc

SEQ ID NO: 220096 - DNA, 16 bp, Homo sapiens
tctgactccagagtct

SEQ ID NO: 220097 - DNA, 22 bp, Homo sapiens
tctgactccagagtctgagccc

SEQ ID NO: 220098 - DNA, 12 bp, Homo sapiens
tctgagaagatt

SEQ ID NO: 220099 - DNA, 23 bp, Homo sapiens
tctgagaaggggaggacctctgg

SEQ ID NO: 220100 - DNA, 17 bp, Homo sapiens
tctgagagaccatctcc

SEQ ID NO: 220101 - DNA, 18 bp, Homo sapiens
tctgagagaccatctcct

SEQ ID NO: 220102 - DNA, 19 bp, Homo sapiens
tctgagagaccatctccta

SEQ ID NO: 220103 - DNA, 21 bp, Homo sapiens
tctgagagtgaaaccatgact

SEQ ID NO: 220104 - DNA, 18 bp, Homo sapiens
tctgagcaactgtgcagc

SEQ ID NO: 220105 - DNA, 20 bp, Homo sapiens
tctgagcagcctctgccagg

SEQ ID NO: 220106 - DNA, 15 bp, Homo sapiens
tctgagcagtgggga

SEQ ID NO: 220107 - DNA, 17 bp, Homo sapiens
tctgagcagttgttata

SEQ ID NO: 220108 - DNA, 13 bp, Homo sapiens
tctgagccccctg

SEQ ID NO: 220109 - DNA, 17 bp, Homo sapiens
tctgagccccctgtgcc

SEQ ID NO: 220110 - DNA, 18 bp, Homo sapiens
tctgagccccctgtgccc

SEQ ID NO: 220111 - DNA, 17 bp, Homo sapiens
tctgagccctccctctt

SEQ ID NO: 220112 - DNA, 24 bp, Homo sapiens
tctgagccctccctcttcccagca

SEQ ID NO: 220113 - DNA, 16 bp, Homo sapiens
tctgagccctgccctc

SEQ ID NO: 220114 - DNA, 18 bp, Homo sapiens
tctgagccttgagagaaa

SEQ ID NO: 220115 - DNA, 17 bp, Homo sapiens
tctgagcggccgcctgt

SEQ ID NO: 220116 - DNA, 20 bp, Homo sapiens
tctgagcggccgcctgtcct

SEQ ID NO: 220117 - DNA, 22 bp, Homo sapiens
tctgagcggccgcctgtccttg

SEQ ID NO: 220118 - DNA, 19 bp, Homo sapiens
tctgagctgttatcttgtg

SEQ ID NO: 220119 - DNA, 20 bp, Homo sapiens
tctgagctgttatcttgtgt

SEQ ID NO: 220120 - DNA, 20 bp, Homo sapiens
tctgagcttttcatggaagt

SEQ ID NO: 220121 - DNA, 14 bp, Homo sapiens
tctgaggagtccaa

SEQ ID NO: 220122 - DNA, 15 bp, Homo sapiens
tctgaggcaaccccc

SEQ ID NO: 220123 - DNA, 21 bp, Homo sapiens
tctgaggccccttaactcatc

SEQ ID NO: 220124 - DNA, 22 bp, Homo sapiens
tctgagtcatcaaaaagagtct

SEQ ID NO: 220125 - DNA, 18 bp, Homo sapiens
tctgagtccactgctcca

SEQ ID NO: 220126 - DNA, 17 bp, Homo sapiens
tctgagtccagctcccc

SEQ ID NO: 220127 - DNA, 14 bp, Homo sapiens
tctgagtctcttgg

SEQ ID NO: 220128 - DNA, 15 bp, Homo sapiens
tctgagtctcttgga

SEQ ID NO: 220129 - DNA, 14 bp, Homo sapiens
tctgagtttaccat

SEQ ID NO: 220130 - DNA, 15 bp, Homo sapiens
tctgagtttaccatt

SEQ ID NO: 220131 - DNA, 20 bp, Homo sapiens
tctgagtttaccatttgtaa

SEQ ID NO: 220132 - DNA, 21 bp, Homo sapiens
tctgagtttaccatttgtaat

SEQ ID NO: 220133 - DNA, 12 bp, Homo sapiens
tctgataaacac

SEQ ID NO: 220134 - DNA, 14 bp, Homo sapiens
tctgataactagat

SEQ ID NO: 220135 - DNA, 20 bp, Homo sapiens
tctgataactagatggtgct

SEQ ID NO: 220136 - DNA, 21 bp, Homo sapiens
tctgataactagatggtgctg

SEQ ID NO: 220137 - DNA, 21 bp, Homo sapiens
tctgataagactggaaaatag

SEQ ID NO: 220138 - DNA, 21 bp, Homo sapiens
tctgatacttatttataacat

SEQ ID NO: 220139 - DNA, 20 bp, Homo sapiens
tctgatattcaaacacacag

SEQ ID NO: 220140 - DNA, 22 bp, Homo sapiens
tctgatattcaaacacacagta

SEQ ID NO: 220141 - DNA, 17 bp, Homo sapiens
tctgatattccatgaat

SEQ ID NO: 220142 - DNA, 23 bp, Homo sapiens
tctgatattgcagtaatgatatt

SEQ ID NO: 220143 - DNA, 21 bp, Homo sapiens
tctgatattggtgtgaatgct

SEQ ID NO: 220144 - DNA, 19 bp, Homo sapiens
tctgatcacccccctgctt

SEQ ID NO: 220145 - DNA, 18 bp, Homo sapiens
tctgatggaccttctaga

SEQ ID NO: 220146 - DNA, 19 bp, Homo sapiens
tctgatggaccttctagaa

SEQ ID NO: 220147 - DNA, 19 bp, Homo sapiens
tctgatgggaggaaagtag

SEQ ID NO: 220148 - DNA, 15 bp, Homo sapiens
tctgattaaatttaa

SEQ ID NO: 220149 - DNA, 22 bp, Homo sapiens
tctgattctatgcctgtatttc

SEQ ID NO: 220150 - DNA, 15 bp, Homo sapiens
tctgattcttcaaag

SEQ ID NO: 220151 - DNA, 15 bp, Homo sapiens
tctgattggacattt

SEQ ID NO: 220152 - DNA, 22 bp, Homo sapiens
tctgcaaagatgattttgcttt

SEQ ID NO: 220153 - DNA, 20 bp, Homo sapiens
tctgcaaaggagggcctcag

SEQ ID NO: 220154 - DNA, 21 bp, Homo sapiens
gcccatcttgcctccatggtg

SEQ ID NO: 220155 - DNA, 13 bp, Homo sapiens
gcccatgcccacc

SEQ ID NO: 220156 - DNA, 14 bp, Homo sapiens
gcccatgcccacct

SEQ ID NO: 220157 - DNA, 14 bp, Homo sapiens
gcccatgccctccg

SEQ ID NO: 220158 - DNA, 21 bp, Homo sapiens
gcccatgccctccgtcctggc

SEQ ID NO: 220159 - DNA, 14 bp, Homo sapiens
gcccatggccccag

SEQ ID NO: 220160 - DNA, 21 bp, Homo sapiens
gcccatggccccagctggctg

SEQ ID NO: 220161 - DNA, 22 bp, Homo sapiens
gcccatggccccagctggctgg

SEQ ID NO: 220162 - DNA, 17 bp, Homo sapiens
gcccattcgtctgtccc

SEQ ID NO: 220163 - DNA, 18 bp, Homo sapiens
gcccattcgtctgtccca

SEQ ID NO: 220164 - DNA, 21 bp, Homo sapiens
gccccaaaaccacagccctgt

SEQ ID NO: 220165 - DNA, 23 bp, Homo sapiens
gccccaaaaccacagccctgtca

SEQ ID NO: 220166 - DNA, 15 bp, Homo sapiens
gccccaaagcccagc

SEQ ID NO: 220167 - DNA, 15 bp, Homo sapiens
gccccaaaggaagct

SEQ ID NO: 220168 - DNA, 13 bp, Homo sapiens
gccccaacctgct

SEQ ID NO: 220169 - DNA, 14 bp, Homo sapiens
gccccaacctgctg

SEQ ID NO: 220170 - DNA, 18 bp, Homo sapiens
gccccaactccaggggca

SEQ ID NO: 220171 - DNA, 13 bp, Homo sapiens
gccccaagaggct

SEQ ID NO: 220172 - DNA, 16 bp, Homo sapiens
gccccaagaggctagc

SEQ ID NO: 220173 - DNA, 17 bp, Homo sapiens
gccccaagaggctagcc

SEQ ID NO: 220174 - DNA, 18 bp, Homo sapiens
gccccaagaggctagccc

SEQ ID NO: 220175 - DNA, 23 bp, Homo sapiens
gccccaagaggctagccccaggg

SEQ ID NO: 220176 - DNA, 14 bp, Homo sapiens
gccccaagcagcca

SEQ ID NO: 220177 - DNA, 15 bp, Homo sapiens
gccccaagcagccag

SEQ ID NO: 220178 - DNA, 17 bp, Homo sapiens
gccccaagcagccagcc

SEQ ID NO: 220179 - DNA, 18 bp, Homo sapiens
gccccaagcagccagcca

SEQ ID NO: 220180 - DNA, 22 bp, Homo sapiens
gccccaagcagccagccagtct

SEQ ID NO: 220181 - DNA, 22 bp, Homo sapiens
gccccaatatggtggccctggg

SEQ ID NO: 220182 - DNA, 21 bp, Homo sapiens
gccccacacaggcctggccca

SEQ ID NO: 220183 - DNA, 20 bp, Homo sapiens
tctgcagcccttgggcagtt

SEQ ID NO: 220184 - DNA, 14 bp, Homo sapiens
tctgcagcctgagc

SEQ ID NO: 220185 - DNA, 18 bp, Homo sapiens
tctgcagcctgagctcca

SEQ ID NO: 220186 - DNA, 15 bp, Homo sapiens
tctgcaggacacaga

SEQ ID NO: 220187 - DNA, 20 bp, Homo sapiens
tctgcaggacacagatctgg

SEQ ID NO: 220188 - DNA, 16 bp, Homo sapiens
tctgcagggagcaact

SEQ ID NO: 220189 - DNA, 12 bp, Homo sapiens
tctgcagggcag

SEQ ID NO: 220190 - DNA, 14 bp, Homo sapiens
tctgcagtcctggt

SEQ ID NO: 220191 - DNA, 13 bp, Homo sapiens
tctgcagtgcctt

SEQ ID NO: 220192 - DNA, 13 bp, Homo sapiens
tctgcatacacat

SEQ ID NO: 220193 - DNA, 17 bp, Homo sapiens
tctgcatggcagaagcg

SEQ ID NO: 220194 - DNA, 21 bp, Homo sapiens
tctgcatggcagaagcgtctc

SEQ ID NO: 220195 - DNA, 20 bp, Homo sapiens
tctgcatgtaaaatcttcag

SEQ ID NO: 220196 - DNA, 21 bp, Homo sapiens
tctgcatgtaaaatcttcagc

SEQ ID NO: 220197 - DNA, 22 bp, Homo sapiens
tctgcatgtaaaatcttcagct

SEQ ID NO: 220198 - DNA, 16 bp, Homo sapiens
tctgcattctagtact

SEQ ID NO: 220199 - DNA, 20 bp, Homo sapiens
tctgcattgttattgtggaa

SEQ ID NO: 220200 - DNA, 21 bp, Homo sapiens
tctgcattgttattgtggaag

SEQ ID NO: 220201 - DNA, 16 bp, Homo sapiens
tctgcattttctcagg

SEQ ID NO: 220202 - DNA, 17 bp, Homo sapiens
tctgccaccctacctgt

SEQ ID NO: 220203 - DNA, 13 bp, Homo sapiens
tctgccagctcca

SEQ ID NO: 220204 - DNA, 14 bp, Homo sapiens
tctgccaggcccat

SEQ ID NO: 220205 - DNA, 13 bp, Homo sapiens
tctgccaggcctg

SEQ ID NO: 220206 - DNA, 12 bp, Homo sapiens
tctgccagggag

SEQ ID NO: 220207 - DNA, 13 bp, Homo sapiens
tctgccagggagc

SEQ ID NO: 220208 - DNA, 11 bp, Homo sapiens
tctgccagggc

SEQ ID NO: 220209 - DNA, 13 bp, Homo sapiens
tctgccagggcag

SEQ ID NO: 220210 - DNA, 21 bp, Homo sapiens
tctgccagtgacagacaggct

SEQ ID NO: 220211 - DNA, 20 bp, Homo sapiens
tctgccatcagcccctgctg

SEQ ID NO: 220212 - DNA, 22 bp, Homo sapiens
tctgccatcagcccctgctgct

SEQ ID NO: 220213 - DNA, 18 bp, Homo sapiens
tctgcccaaatcccctcc

SEQ ID NO: 220214 - DNA, 19 bp, Homo sapiens
tctgcccagcttgggccca

SEQ ID NO: 220215 - DNA, 12 bp, Homo sapiens
tctgccccaagc

SEQ ID NO: 220216 - DNA, 18 bp, Homo sapiens
tctgccccaagcagccag

SEQ ID NO: 220217 - DNA, 15 bp, Homo sapiens
tctgcccccagctgc

SEQ ID NO: 220218 - DNA, 20 bp, Homo sapiens
tctgcccccagctgctcctc

SEQ ID NO: 220219 - DNA, 21 bp, Homo sapiens
tctgcccccgcgggttctaga

SEQ ID NO: 220220 - DNA, 17 bp, Homo sapiens
tctgccccctcagggat

SEQ ID NO: 220221 - DNA, 17 bp, Homo sapiens
tctgccccttgacccca

SEQ ID NO: 220222 - DNA, 19 bp, Homo sapiens
tctgccccttgaccccaca

SEQ ID NO: 220223 - DNA, 19 bp, Homo sapiens
tctgccccttgggcatcca

SEQ ID NO: 220224 - DNA, 15 bp, Homo sapiens
tctgcccgcagagcc

SEQ ID NO: 220225 - DNA, 14 bp, Homo sapiens
tctgccctgcccac

SEQ ID NO: 220226 - DNA, 19 bp, Homo sapiens
tctgccctgcctccctttc

SEQ ID NO: 220227 - DNA, 20 bp, Homo sapiens
tctgccctgcctccctttct

SEQ ID NO: 220228 - DNA, 16 bp, Homo sapiens
tctgcctaggagctgg

SEQ ID NO: 220229 - DNA, 20 bp, Homo sapiens
tctgcctaggagctggctgg

SEQ ID NO: 220230 - DNA, 14 bp, Homo sapiens
tctgcctccaggag

SEQ ID NO: 220231 - DNA, 20 bp, Homo sapiens
tctgcctccatgctgcagtg

SEQ ID NO: 220232 - DNA, 15 bp, Homo sapiens
tctgcctctaaggcc

SEQ ID NO: 220233 - DNA, 14 bp, Homo sapiens
tctgcctgcctggg

SEQ ID NO: 220234 - DNA, 15 bp, Homo sapiens
tctgcctgcctggga

SEQ ID NO: 220235 - DNA, 16 bp, Homo sapiens
tctgcctgcctgggaa

SEQ ID NO: 220236 - DNA, 14 bp, Homo sapiens
tctgcctggcctgg

SEQ ID NO: 220237 - DNA, 17 bp, Homo sapiens
tctgcctggcctggctc

SEQ ID NO: 220238 - DNA, 18 bp, Homo sapiens
tctgcctggcctggctcc

SEQ ID NO: 220239 - DNA, 19 bp, Homo sapiens
tctgcctggcctggctccc

SEQ ID NO: 220240 - DNA, 15 bp, Homo sapiens
tctgcctgggcctgt

SEQ ID NO: 220241 - DNA, 16 bp, Homo sapiens
tctgcctgggcctgtg

SEQ ID NO: 220242 - DNA, 21 bp, Homo sapiens
tctgcctgggcctgtgcagca

SEQ ID NO: 220243 - DNA, 13 bp, Homo sapiens
tctgcctgtattt

SEQ ID NO: 220244 - DNA, 13 bp, Homo sapiens
tctgcctgtccct

SEQ ID NO: 220245 - DNA, 17 bp, Homo sapiens
tctgcctgtccctctca

SEQ ID NO: 220246 - DNA, 21 bp, Homo sapiens
tctgcctgtccctctcaggca

SEQ ID NO: 220247 - DNA, 12 bp, Homo sapiens
tctgcctgtctc

SEQ ID NO: 220248 - DNA, 22 bp, Homo sapiens
tctgcctgttataactctgcac

SEQ ID NO: 220249 - DNA, 21 bp, Homo sapiens
tctgccttgatggagaaggaa

SEQ ID NO: 220250 - DNA, 23 bp, Homo sapiens
tctgccttgcacaaaaagcacaa

SEQ ID NO: 220251 - DNA, 12 bp, Homo sapiens
tctgccttggac

SEQ ID NO: 220252 - DNA, 15 bp, Homo sapiens
tctgcgccgctgtgc

SEQ ID NO: 220253 - DNA, 15 bp, Homo sapiens
tctgcggtgaggcag

SEQ ID NO: 220254 - DNA, 16 bp, Homo sapiens
tctgcggtgaggcagg

SEQ ID NO: 220255 - DNA, 13 bp, Homo sapiens
tctgcgtcccact

SEQ ID NO: 220256 - DNA, 15 bp, Homo sapiens
tctgcgtttgtccct

SEQ ID NO: 220257 - DNA, 17 bp, Homo sapiens
tctgctatgtctgtgat

SEQ ID NO: 220258 - DNA, 22 bp, Homo sapiens
tctgctcaatgaaaccttcctc

SEQ ID NO: 220259 - DNA, 19 bp, Homo sapiens
tctgctccacccttggcct

SEQ ID NO: 220260 - DNA, 12 bp, Homo sapiens
tctgctccatgc

SEQ ID NO: 220261 - DNA, 22 bp, Homo sapiens
tctgctccatgcagatctagcc

SEQ ID NO: 220262 - DNA, 23 bp, Homo sapiens
tctgctccatgcagatctagcca

SEQ ID NO: 220263 - DNA, 14 bp, Homo sapiens
tctgctcccagccc

SEQ ID NO: 220264 - DNA, 12 bp, Homo sapiens
tctgctccgtgt

SEQ ID NO: 220265 - DNA, 18 bp, Homo sapiens
tctgctccgtgtgtctca

SEQ ID NO: 220266 - DNA, 21 bp, Homo sapiens
tctgctcctcacccccacccc

SEQ ID NO: 220267 - DNA, 18 bp, Homo sapiens
tctgctcctgaaaaatga

SEQ ID NO: 220268 - DNA, 21 bp, Homo sapiens
tctgctcctgaaaaatgactg

SEQ ID NO: 220269 - DNA, 22 bp, Homo sapiens
tctgctcctggagcctttgaat

SEQ ID NO: 220270 - DNA, 15 bp, Homo sapiens
tctgctcggccgtct

SEQ ID NO: 220271 - DNA, 14 bp, Homo sapiens
tctgctctagccag

SEQ ID NO: 220272 - DNA, 13 bp, Homo sapiens
tctgctctgagac

SEQ ID NO: 220273 - DNA, 13 bp, Homo sapiens
tctgctgaacatt

SEQ ID NO: 220274 - DNA, 19 bp, Homo sapiens
tctgctgagctctgacctg

SEQ ID NO: 220275 - DNA, 13 bp, Homo sapiens
tctgctgccccca

SEQ ID NO: 220276 - DNA, 18 bp, Homo sapiens
tctgctgccctccatccc

SEQ ID NO: 220277 - DNA, 22 bp, Homo sapiens
tctgctgcctgcccgcacagca

SEQ ID NO: 220278 - DNA, 14 bp, Homo sapiens
tctgctgctcccag

SEQ ID NO: 220279 - DNA, 15 bp, Homo sapiens
tctgctgctcccagc

SEQ ID NO: 220280 - DNA, 10 bp, Homo sapiens
tctgctgctt

SEQ ID NO: 220281 - DNA, 16 bp, Homo sapiens
tctgctgcttctgggc

SEQ ID NO: 220282 - DNA, 18 bp, Homo sapiens
tctgctgcttctgggcct

SEQ ID NO: 220283 - DNA, 18 bp, Homo sapiens
tctgctggataaaatgag

SEQ ID NO: 220284 - DNA, 14 bp, Homo sapiens
tctgctggcccagc

SEQ ID NO: 220285 - DNA, 13 bp, Homo sapiens
aagtgcaggctgg

SEQ ID NO: 220286 - DNA, 13 bp, Homo sapiens
aagtgcatttctg

SEQ ID NO: 220287 - DNA, 22 bp, Homo sapiens
aagtgcatttctgaatagaaat

SEQ ID NO: 220288 - DNA, 22 bp, Homo sapiens
aagtgcatttttatctgtgagt

SEQ ID NO: 220289 - DNA, 13 bp, Homo sapiens
aagtgcccaaagt

SEQ ID NO: 220290 - DNA, 19 bp, Homo sapiens
aagtgcccctgctgcctcc

SEQ ID NO: 220291 - DNA, 23 bp, Homo sapiens
aagtgcccctgctgcctccccaa

SEQ ID NO: 220292 - DNA, 18 bp, Homo sapiens
aagtgcctacattatcta

SEQ ID NO: 220293 - DNA, 23 bp, Homo sapiens
aagtgcctttctgcagtttttca

SEQ ID NO: 220294 - DNA, 16 bp, Homo sapiens
aagtgctcagttccaa

SEQ ID NO: 220295 - DNA, 14 bp, Homo sapiens
aagtggaaaaaaga

SEQ ID NO: 220296 - DNA, 19 bp, Homo sapiens
aagtggaaaaaagagaaaa

SEQ ID NO: 220297 - DNA, 19 bp, Homo sapiens
aagtggaaaaagaaattct

SEQ ID NO: 220298 - DNA, 13 bp, Homo sapiens
aagtggaaatgtt

SEQ ID NO: 220299 - DNA, 20 bp, Homo sapiens
aagtggaccttgagaccaca

SEQ ID NO: 220300 - DNA, 16 bp, Homo sapiens
aagtggatggaagtgt

SEQ ID NO: 220301 - DNA, 16 bp, Homo sapiens
aagtggattggctttg

SEQ ID NO: 220302 - DNA, 21 bp, Homo sapiens
aagtggcccctcgtgacctac

SEQ ID NO: 220303 - DNA, 21 bp, Homo sapiens
aagtggcctgagaagagtcga

SEQ ID NO: 220304 - DNA, 18 bp, Homo sapiens
aagtggctaattcaattt

SEQ ID NO: 220305 - DNA, 19 bp, Homo sapiens
aagtggctaattcaattta

SEQ ID NO: 220306 - DNA, 15 bp, Homo sapiens
aagtggctgtgatta

SEQ ID NO: 220307 - DNA, 17 bp, Homo sapiens
aagtgggagaagtggcc

SEQ ID NO: 220308 - DNA, 18 bp, Homo sapiens
aagtgggagtgggagagg

SEQ ID NO: 220309 - DNA, 20 bp, Homo sapiens
aagtgggagtgggagaggaa

SEQ ID NO: 220310 - DNA, 15 bp, Homo sapiens
aagtggggtgttgaa

SEQ ID NO: 220311 - DNA, 20 bp, Homo sapiens
aagtggggttgcaaccactg

SEQ ID NO: 220312 - DNA, 17 bp, Homo sapiens
aagtgggttttttagtt

SEQ ID NO: 220313 - DNA, 23 bp, Homo sapiens
aagtggtggggactaagggaaga

SEQ ID NO: 220314 - DNA, 18 bp, Homo sapiens
aagtgtagatgtagcatt

SEQ ID NO: 220315 - DNA, 19 bp, Homo sapiens
aagtgtagatgtagcattg

SEQ ID NO: 220316 - DNA, 20 bp, Homo sapiens
aagtgtagatgtagcattgt

SEQ ID NO: 220317 - DNA, 23 bp, Homo sapiens
aagtgtattggtttctgtttgaa

SEQ ID NO: 220318 - DNA, 11 bp, Homo sapiens
aagtgtgagta

SEQ ID NO: 220319 - DNA, 19 bp, Homo sapiens
aagtgtgagtaagagctgg

SEQ ID NO: 220320 - DNA, 23 bp, Homo sapiens
aagtgtgctttatgctgaaacag

SEQ ID NO: 220321 - DNA, 17 bp, Homo sapiens
tctggacctccccctct

SEQ ID NO: 220322 - DNA, 16 bp, Homo sapiens
tctggacctctcttgt

SEQ ID NO: 220323 - DNA, 15 bp, Homo sapiens
tctggactcctctgt

SEQ ID NO: 220324 - DNA, 16 bp, Homo sapiens
tctggactcctctgtc

SEQ ID NO: 220325 - DNA, 22 bp, Homo sapiens
tctggactcctctgtccaggca

SEQ ID NO: 220326 - DNA, 14 bp, Homo sapiens
tctggactctgccc

SEQ ID NO: 220327 - DNA, 17 bp, Homo sapiens
tctggactctgccccaa

SEQ ID NO: 220328 - DNA, 19 bp, Homo sapiens
tctggactgaagcctgcag

SEQ ID NO: 220329 - DNA, 20 bp, Homo sapiens
tctggagaggttataggtca

SEQ ID NO: 220330 - DNA, 22 bp, Homo sapiens
tctggagaggttataggtcact

SEQ ID NO: 220331 - DNA, 15 bp, Homo sapiens
tctggagccacctgt

SEQ ID NO: 220332 - DNA, 23 bp, Homo sapiens
tctggagcccctatcctgcaccc

SEQ ID NO: 220333 - DNA, 14 bp, Homo sapiens
tctggaggcctctg

SEQ ID NO: 220334 - DNA, 21 bp, Homo sapiens
tctggagtctcacttgtctca

SEQ ID NO: 220335 - DNA, 15 bp, Homo sapiens
tctggagtctgaagg

SEQ ID NO: 220336 - DNA, 20 bp, Homo sapiens
tctggagtctgaaggagagg

SEQ ID NO: 220337 - DNA, 15 bp, Homo sapiens
tctggatcctgcact

SEQ ID NO: 220338 - DNA, 23 bp, Homo sapiens
tctggatgcacagatgccatggc

SEQ ID NO: 220339 - DNA, 13 bp, Homo sapiens
tctggatggccgg

SEQ ID NO: 220340 - DNA, 21 bp, Homo sapiens
tctggatggccgggctgctgc

SEQ ID NO: 220341 - DNA, 16 bp, Homo sapiens
tctggatttttacaaa

SEQ ID NO: 220342 - DNA, 22 bp, Homo sapiens
tctggatttttacaaataaaga

SEQ ID NO: 220343 - DNA, 17 bp, Homo sapiens
tctggcaaacatgtgca

SEQ ID NO: 220344 - DNA, 20 bp, Homo sapiens
tctggcaccactagggtcct

SEQ ID NO: 220345 - DNA, 21 bp, Homo sapiens
tctggccaaatatgcactttc

SEQ ID NO: 220346 - DNA, 21 bp, Homo sapiens
tctggccacaatcctccccac

SEQ ID NO: 220347 - DNA, 13 bp, Homo sapiens
tctggccaccctg

SEQ ID NO: 220348 - DNA, 15 bp, Homo sapiens
tctggccaccctggc

SEQ ID NO: 220349 - DNA, 17 bp, Homo sapiens
tctggccaccctggccc

SEQ ID NO: 220350 - DNA, 13 bp, Homo sapiens
tctggccctgttg

SEQ ID NO: 220351 - DNA, 15 bp, Homo sapiens
tctggccctgttgtg

SEQ ID NO: 220352 - DNA, 12 bp, Homo sapiens
tctggcctgcca

SEQ ID NO: 220353 - DNA, 12 bp, Homo sapiens
tctggcctggcc

SEQ ID NO: 220354 - DNA, 13 bp, Homo sapiens
tctggcctggcct

SEQ ID NO: 220355 - DNA, 18 bp, Homo sapiens
tctggcctggcctggccc

SEQ ID NO: 220356 - DNA, 19 bp, Homo sapiens
tctggcctgggttttgtgg

SEQ ID NO: 220357 - DNA, 21 bp, Homo sapiens
tctggcggcttcctgtccact

SEQ ID NO: 220358 - DNA, 21 bp, Homo sapiens
tctggctacgacttgggacgg

SEQ ID NO: 220359 - DNA, 16 bp, Homo sapiens
tctggctagaggccag

SEQ ID NO: 220360 - DNA, 17 bp, Homo sapiens
tctggctagaggccagc

SEQ ID NO: 220361 - DNA, 22 bp, Homo sapiens
tctggctagaggccagccccac

SEQ ID NO: 220362 - DNA, 19 bp, Homo sapiens
tctggctcctcaaacagta

SEQ ID NO: 220363 - DNA, 21 bp, Homo sapiens
tctggctcggacccaccccaa

SEQ ID NO: 220364 - DNA, 23 bp, Homo sapiens
tctggctcggacccaccccaact

SEQ ID NO: 220365 - DNA, 16 bp, Homo sapiens
tctggctgaaaatggt

SEQ ID NO: 220366 - DNA, 17 bp, Homo sapiens
tctggctgaaaatggtg

SEQ ID NO: 220367 - DNA, 23 bp, Homo sapiens
tctggctgataaaagatacattt

SEQ ID NO: 220368 - DNA, 15 bp, Homo sapiens
tctggctgcctggcc

SEQ ID NO: 220369 - DNA, 18 bp, Homo sapiens
tctggctgcctggcccag

SEQ ID NO: 220370 - DNA, 13 bp, Homo sapiens
tctggctgtggcc

SEQ ID NO: 220371 - DNA, 15 bp, Homo sapiens
tctggctgtggcccc

SEQ ID NO: 220372 - DNA, 16 bp, Homo sapiens
tctggctgtggcccct

SEQ ID NO: 220373 - DNA, 15 bp, Homo sapiens
tctggcttctgcatt

SEQ ID NO: 220374 - DNA, 21 bp, Homo sapiens
tctggctttgttcttgtcatc

SEQ ID NO: 220375 - DNA, 18 bp, Homo sapiens
tctgggaaagcagagtgg

SEQ ID NO: 220376 - DNA, 13 bp, Homo sapiens
tctgggaaaggtg

SEQ ID NO: 220377 - DNA, 18 bp, Homo sapiens
tctgggaaaggtgctcaa

SEQ ID NO: 220378 - DNA, 22 bp, Homo sapiens
tctgggaaaggtgctcaaagat

SEQ ID NO: 220379 - DNA, 21 bp, Homo sapiens
tctgggaagcttgagcctccc

SEQ ID NO: 220380 - DNA, 12 bp, Homo sapiens
tctgggaaggga

SEQ ID NO: 220381 - DNA, 14 bp, Homo sapiens
tctgggaagggaag

SEQ ID NO: 220382 - DNA, 20 bp, Homo sapiens
tctgggaagggagagttctt

SEQ ID NO: 220383 - DNA, 16 bp, Homo sapiens
tctgggacctcagttt

SEQ ID NO: 220384 - DNA, 20 bp, Homo sapiens
tctgggactctcctcctccc

SEQ ID NO: 220385 - DNA, 15 bp, Homo sapiens
tctgggacttccttg

SEQ ID NO: 220386 - DNA, 17 bp, Homo sapiens
tctgggacttccttgct

SEQ ID NO: 220387 - DNA, 14 bp, Homo sapiens
tctgggaggcaggt

SEQ ID NO: 220388 - DNA, 19 bp, Homo sapiens
tctgggagtgttctgtttc

SEQ ID NO: 220389 - DNA, 20 bp, Homo sapiens
tctgggagtgttctgtttcc

SEQ ID NO: 220390 - DNA, 18 bp, Homo sapiens
tctgggataagtaagttt

SEQ ID NO: 220391 - DNA, 19 bp, Homo sapiens
tctgggattctactttaag

SEQ ID NO: 220392 - DNA, 15 bp, Homo sapiens
tctgggcagagcctg

SEQ ID NO: 220393 - DNA, 23 bp, Homo sapiens
tctgggcagctaaaagcatccct

SEQ ID NO: 220394 - DNA, 14 bp, Homo sapiens
tctgggccctgcag

SEQ ID NO: 220395 - DNA, 15 bp, Homo sapiens
tctgggccctgcagg

SEQ ID NO: 220396 - DNA, 14 bp, Homo sapiens
tctgggcctctgac

SEQ ID NO: 220397 - DNA, 13 bp, Homo sapiens
tctgggcctgggc

SEQ ID NO: 220398 - DNA, 18 bp, Homo sapiens
tctgggcctgggctaggg

SEQ ID NO: 220399 - DNA, 12 bp, Homo sapiens
tctgggctcagg

SEQ ID NO: 220400 - DNA, 14 bp, Homo sapiens
tctgggctcagggc

SEQ ID NO: 220401 - DNA, 15 bp, Homo sapiens
tctgggctcagggct

SEQ ID NO: 220402 - DNA, 20 bp, Homo sapiens
tctgggctcagggctggagt

SEQ ID NO: 220403 - DNA, 19 bp, Homo sapiens
tctgggcttggggcttcct

SEQ ID NO: 220404 - DNA, 23 bp, Homo sapiens
tctggggatggagaatgccagcc

SEQ ID NO: 220405 - DNA, 17 bp, Homo sapiens
tctggggatttctggga

SEQ ID NO: 220406 - DNA, 22 bp, Homo sapiens
tctggggtctttttatgcattt

SEQ ID NO: 220407 - DNA, 19 bp, Homo sapiens
tctggggtggggcttggaa

SEQ ID NO: 220408 - DNA, 14 bp, Homo sapiens
tctgggtgaggtag

SEQ ID NO: 220409 - DNA, 17 bp, Homo sapiens
tctgggtgagtggctga

SEQ ID NO: 220410 - DNA, 18 bp, Homo sapiens
tctgggtggtaactgcca

SEQ ID NO: 220411 - DNA, 19 bp, Homo sapiens
tctgggtggttgcccttca

SEQ ID NO: 220412 - DNA, 23 bp, Homo sapiens
tctgggtttacaacaaacactgt

SEQ ID NO: 220413 - DNA, 18 bp, Homo sapiens
tctggtagatagaaataa

SEQ ID NO: 220414 - DNA, 14 bp, Homo sapiens
gccccccttcccac

SEQ ID NO: 220415 - DNA, 11 bp, Homo sapiens
gcccccgcccc

SEQ ID NO: 220416 - DNA, 14 bp, Homo sapiens
gcccccgccctcgc

SEQ ID NO: 220417 - DNA, 16 bp, Homo sapiens
gcccccgccctctgcc

SEQ ID NO: 220418 - DNA, 14 bp, Homo sapiens
gcccccgccctgct

SEQ ID NO: 220419 - DNA, 19 bp, Homo sapiens
gcccccgcgggttctagac

SEQ ID NO: 220420 - DNA, 15 bp, Homo sapiens
gcccccgctcatggg

SEQ ID NO: 220421 - DNA, 21 bp, Homo sapiens
gcccccggaggcgcccacctg

SEQ ID NO: 220422 - DNA, 23 bp, Homo sapiens
gcccccggaggcgcccacctgcc

SEQ ID NO: 220423 - DNA, 19 bp, Homo sapiens
gcccccggccacgctccct

SEQ ID NO: 220424 - DNA, 18 bp, Homo sapiens
gcccccgttccagctgac

SEQ ID NO: 220425 - DNA, 16 bp, Homo sapiens
gccccctcccccgcag

SEQ ID NO: 220426 - DNA, 21 bp, Homo sapiens
gccccctccgtgatccatcca

SEQ ID NO: 220427 - DNA, 11 bp, Homo sapiens
gccccctctct

SEQ ID NO: 220428 - DNA, 21 bp, Homo sapiens
gccccctctcttaccccgtcc

SEQ ID NO: 220429 - DNA, 18 bp, Homo sapiens
gccccctgcacccacccc

SEQ ID NO: 220430 - DNA, 13 bp, Homo sapiens
gccccctgccagt

SEQ ID NO: 220431 - DNA, 19 bp, Homo sapiens
gccccctggcccctcccac

SEQ ID NO: 220432 - DNA, 21 bp, Homo sapiens
gccccctggcccctcccacat

SEQ ID NO: 220433 - DNA, 21 bp, Homo sapiens
gccccctggggggcacagcca

SEQ ID NO: 220434 - DNA, 13 bp, Homo sapiens
gccccctgtcctt

SEQ ID NO: 220435 - DNA, 19 bp, Homo sapiens
gccccctgtgcccacccag

SEQ ID NO: 220436 - DNA, 16 bp, Homo sapiens
gcccccttctcccaca

SEQ ID NO: 220437 - DNA, 22 bp, Homo sapiens
gcccccttctcccacactgcta

SEQ ID NO: 220438 - DNA, 21 bp, Homo sapiens
gccccgcccccacccctacag

SEQ ID NO: 220439 - DNA, 16 bp, Homo sapiens
gccccgccccccagag

SEQ ID NO: 220440 - DNA, 20 bp, Homo sapiens
gccccgccccccagagccag

SEQ ID NO: 220441 - DNA, 23 bp, Homo sapiens
gccccgccccccagagccagggc

SEQ ID NO: 220442 - DNA, 14 bp, Homo sapiens
gccccgccctcagg

SEQ ID NO: 220443 - DNA, 14 bp, Homo sapiens
gccccgcctccccg

SEQ ID NO: 220444 - DNA, 15 bp, Homo sapiens
gccccgcgcgtgccc

SEQ ID NO: 220445 - DNA, 17 bp, Homo sapiens
gccccgcgcgtgccccc

SEQ ID NO: 220446 - DNA, 19 bp, Homo sapiens
gccccgcgcgtgcccccag

SEQ ID NO: 220447 - DNA, 13 bp, Homo sapiens
gccccggagcacc

SEQ ID NO: 220448 - DNA, 18 bp, Homo sapiens
gccccggaggaagcttgg

SEQ ID NO: 220449 - DNA, 17 bp, Homo sapiens
gccccggccactccctg

SEQ ID NO: 220450 - DNA, 18 bp, Homo sapiens
gccccggccactccctgc

SEQ ID NO: 220451 - DNA, 20 bp, Homo sapiens
gccccgggctctggccaccc

SEQ ID NO: 220452 - DNA, 21 bp, Homo sapiens
gccccgggctctggccaccct

SEQ ID NO: 220453 - DNA, 22 bp, Homo sapiens
gccccgggctctggccaccctg

SEQ ID NO: 220454 - DNA, 17 bp, Homo sapiens
gccccgtcaccatctca

SEQ ID NO: 220455 - DNA, 22 bp, Homo sapiens
gccccgtcaccatctcaggcca

SEQ ID NO: 220456 - DNA, 23 bp, Homo sapiens
gccccgtcggactgcccccagaa

SEQ ID NO: 220457 - DNA, 19 bp, Homo sapiens
gccccgtgcagactggagg

SEQ ID NO: 220458 - DNA, 15 bp, Homo sapiens
tctgtataaataatg

SEQ ID NO: 220459 - DNA, 20 bp, Homo sapiens
tctgtatatagctctacaca

SEQ ID NO: 220460 - DNA, 22 bp, Homo sapiens
tctgtattgcagctaagctcaa

SEQ ID NO: 220461 - DNA, 13 bp, Homo sapiens
tctgtattgctaa

SEQ ID NO: 220462 - DNA, 17 bp, Homo sapiens
tctgtattgtgctgatt

SEQ ID NO: 220463 - DNA, 22 bp, Homo sapiens
tctgtatttttaaattctgctc

SEQ ID NO: 220464 - DNA, 13 bp, Homo sapiens
tctgtcaccaaat

SEQ ID NO: 220465 - DNA, 19 bp, Homo sapiens
tctgtcaccacatcttgtc

SEQ ID NO: 220466 - DNA, 20 bp, Homo sapiens
tctgtcaccacatcttgtct

SEQ ID NO: 220467 - DNA, 21 bp, Homo sapiens
tctgtcagcgcaggtttagtt

SEQ ID NO: 220468 - DNA, 16 bp, Homo sapiens
tctgtcagcttcccaa

SEQ ID NO: 220469 - DNA, 21 bp, Homo sapiens
tctgtcagcttcccaacaata

SEQ ID NO: 220470 - DNA, 19 bp, Homo sapiens
tctgtcagggccttggccc

SEQ ID NO: 220471 - DNA, 23 bp, Homo sapiens
tctgtcagggccttggcccaggg

SEQ ID NO: 220472 - DNA, 13 bp, Homo sapiens
tctgtcagtcatg

SEQ ID NO: 220473 - DNA, 22 bp, Homo sapiens
tctgtcatgaacatgttcctga

SEQ ID NO: 220474 - DNA, 14 bp, Homo sapiens
tctgtccaggccac

SEQ ID NO: 220475 - DNA, 18 bp, Homo sapiens
tctgtccaggccactgtg

SEQ ID NO: 220476 - DNA, 21 bp, Homo sapiens
tctgtccaggccactgtggcc

SEQ ID NO: 220477 - DNA, 12 bp, Homo sapiens
tctgtccagggc

SEQ ID NO: 220478 - DNA, 19 bp, Homo sapiens
tctgtccagggcttcagat

SEQ ID NO: 220479 - DNA, 18 bp, Homo sapiens
tctgtccatcagtgcatg

SEQ ID NO: 220480 - DNA, 17 bp, Homo sapiens
tctgtccatctgtctgt

SEQ ID NO: 220481 - DNA, 12 bp, Homo sapiens
tctgtcccactg

SEQ ID NO: 220482 - DNA, 20 bp, Homo sapiens
tctgtccccagccctgtcct

SEQ ID NO: 220483 - DNA, 22 bp, Homo sapiens
tctgtccccagccctgtcctgg

SEQ ID NO: 220484 - DNA, 17 bp, Homo sapiens
tctgtccccgagccgag

SEQ ID NO: 220485 - DNA, 24 bp, Homo sapiens
tctgtccccgagccgagctctcct

SEQ ID NO: 220486 - DNA, 13 bp, Homo sapiens
tctgtccctgtcc

SEQ ID NO: 220487 - DNA, 18 bp, Homo sapiens
tctgtccctgtccctgcc

SEQ ID NO: 220488 - DNA, 13 bp, Homo sapiens
tctgtcctatgga

SEQ ID NO: 220489 - DNA, 18 bp, Homo sapiens
tctgtcctggctgtgcac

SEQ ID NO: 220490 - DNA, 23 bp, Homo sapiens
tctgtcctggctgtgcacattct

SEQ ID NO: 220491 - DNA, 14 bp, Homo sapiens
tctgtctacaaata

SEQ ID NO: 220492 - DNA, 22 bp, Homo sapiens
tctgtctacaaatataagattt

SEQ ID NO: 220493 - DNA, 16 bp, Homo sapiens
tctgtctaccatctcc

SEQ ID NO: 220494 - DNA, 14 bp, Homo sapiens
tctgtctactgtgg

SEQ ID NO: 220495 - DNA, 16 bp, Homo sapiens
tctgtctactgtggtg

SEQ ID NO: 220496 - DNA, 21 bp, Homo sapiens
tctgtctcaaaaaataaaaat

SEQ ID NO: 220497 - DNA, 14 bp, Homo sapiens
tctgtctgagccct

SEQ ID NO: 220498 - DNA, 15 bp, Homo sapiens
tctgtctgagccctg

SEQ ID NO: 220499 - DNA, 16 bp, Homo sapiens
tctgtctgagccctgc

SEQ ID NO: 220500 - DNA, 20 bp, Homo sapiens
tctgtctgagccctgccctc

SEQ ID NO: 220501 - DNA, 15 bp, Homo sapiens
tctgtctgtcccaaa

SEQ ID NO: 220502 - DNA, 16 bp, Homo sapiens
tctgtctgtcccaaag

SEQ ID NO: 220503 - DNA, 15 bp, Homo sapiens
tctgtctgtctgtcc

SEQ ID NO: 220504 - DNA, 15 bp, Homo sapiens
tctgtcttcacagct

SEQ ID NO: 220505 - DNA, 16 bp, Homo sapiens
tctgtcttctctccac

SEQ ID NO: 220506 - DNA, 17 bp, Homo sapiens
tctgtcttctctccact

SEQ ID NO: 220507 - DNA, 14 bp, Homo sapiens
tctgtctttatgat

SEQ ID NO: 220508 - DNA, 23 bp, Homo sapiens
tctgtctttatgatttcatgatt

SEQ ID NO: 220509 - DNA, 19 bp, Homo sapiens
tctgtctttttccttcctg

SEQ ID NO: 220510 - DNA, 21 bp, Homo sapiens
tctgtctttttccttcctgag

SEQ ID NO: 220511 - DNA, 23 bp, Homo sapiens
tctgtgaaagtctcctgtatcat

SEQ ID NO: 220512 - DNA, 17 bp, Homo sapiens
tctgtgaacgatttaga

SEQ ID NO: 220513 - DNA, 14 bp, Homo sapiens
tctgtgaagaatga

SEQ ID NO: 220514 - DNA, 19 bp, Homo sapiens
tctgtgaagcctttatcta

SEQ ID NO: 220515 - DNA, 13 bp, Homo sapiens
tctgtgaatacaa

SEQ ID NO: 220516 - DNA, 16 bp, Homo sapiens
tctgtgaatacaatta

SEQ ID NO: 220517 - DNA, 16 bp, Homo sapiens
tctgtgatgatcctca

SEQ ID NO: 220518 - DNA, 22 bp, Homo sapiens
tctgtgatggatggacacaaaa

SEQ ID NO: 220519 - DNA, 23 bp, Homo sapiens
tctgtgatggatggacacaaaaa

SEQ ID NO: 220520 - DNA, 21 bp, Homo sapiens
tctgtgattgccatttcttcc

SEQ ID NO: 220521 - DNA, 23 bp, Homo sapiens
tctgtgattgccatttcttccca

SEQ ID NO: 220522 - DNA, 22 bp, Homo sapiens
tctgtgcatttgtgtctgcctg

SEQ ID NO: 220523 - DNA, 22 bp, Homo sapiens
tctgtgccagaaacagtgggag

SEQ ID NO: 220524 - DNA, 16 bp, Homo sapiens
tctgtgccatggattt

SEQ ID NO: 220525 - DNA, 16 bp, Homo sapiens
tctgtgcccagctcag

SEQ ID NO: 220526 - DNA, 15 bp, Homo sapiens
tctgtgcctaataaa

SEQ ID NO: 220527 - DNA, 20 bp, Homo sapiens
tctgtgcctccccccagacc

SEQ ID NO: 220528 - DNA, 21 bp, Homo sapiens
tctgtgcctccccccagaccc

SEQ ID NO: 220529 - DNA, 22 bp, Homo sapiens
tctgtgcctgggatcagtgggg

SEQ ID NO: 220530 - DNA, 14 bp, Homo sapiens
tctgtgctgtgcct

SEQ ID NO: 220531 - DNA, 18 bp, Homo sapiens
tctgtgctgtgcctgcta

SEQ ID NO: 220532 - DNA, 16 bp, Homo sapiens
tctgtggaaaacaatt

SEQ ID NO: 220533 - DNA, 16 bp, Homo sapiens
tctgtggacactgtgg

SEQ ID NO: 220534 - DNA, 20 bp, Homo sapiens
tctgtggattcagcttctgt

SEQ ID NO: 220535 - DNA, 14 bp, Homo sapiens
tctgtggcctgtgt

SEQ ID NO: 220536 - DNA, 23 bp, Homo sapiens
tctgtgggactggcccacccctc

SEQ ID NO: 220537 - DNA, 15 bp, Homo sapiens
tctgtgggcttggcc

SEQ ID NO: 220538 - DNA, 19 bp, Homo sapiens
tctgtggttttcccctccc

SEQ ID NO: 220539 - DNA, 20 bp, Homo sapiens
tctgtggttttcccctccct

SEQ ID NO: 220540 - DNA, 22 bp, Homo sapiens
tctgtggttttcccctccctgg

SEQ ID NO: 220541 - DNA, 23 bp, Homo sapiens
tctgtggttttcccctccctggg

SEQ ID NO: 220542 - DNA, 17 bp, Homo sapiens
tctgtgtaatctctgat

SEQ ID NO: 220543 - DNA, 16 bp, Homo sapiens
tcttccaggcccagtc

SEQ ID NO: 220544 - DNA, 21 bp, Homo sapiens
tcttccaggcccagtccactg

SEQ ID NO: 220545 - DNA, 18 bp, Homo sapiens
tcttccatcagcagtgat

SEQ ID NO: 220546 - DNA, 24 bp, Homo sapiens
tcttcccatttgtaatgtatctta

SEQ ID NO: 220547 - DNA, 20 bp, Homo sapiens
tcttccccaccttcccccaa

SEQ ID NO: 220548 - DNA, 20 bp, Homo sapiens
tcttccccagaaaggagact

SEQ ID NO: 220549 - DNA, 22 bp, Homo sapiens
tcttccccagggttctgtattg

SEQ ID NO: 220550 - DNA, 18 bp, Homo sapiens
tcttcccccactcctctt

SEQ ID NO: 220551 - DNA, 16 bp, Homo sapiens
tcttccccctctccca

SEQ ID NO: 220552 - DNA, 13 bp, Homo sapiens
tcttcccccttcc

SEQ ID NO: 220553 - DNA, 24 bp, Homo sapiens
tcttcccctctaatgctcacgctc

SEQ ID NO: 220554 - DNA, 20 bp, Homo sapiens
tcttccctagagggttcctg

SEQ ID NO: 220555 - DNA, 15 bp, Homo sapiens
tcttccctctcgctc

SEQ ID NO: 220556 - DNA, 13 bp, Homo sapiens
tcttccctggggg

SEQ ID NO: 220557 - DNA, 22 bp, Homo sapiens
tcttccctgggggtcccaggat

SEQ ID NO: 220558 - DNA, 23 bp, Homo sapiens
tcttccctgggggtcccaggatc

SEQ ID NO: 220559 - DNA, 16 bp, Homo sapiens
tcttcccttagcctct

SEQ ID NO: 220560 - DNA, 17 bp, Homo sapiens
tcttcccttagcctctc

SEQ ID NO: 220561 - DNA, 18 bp, Homo sapiens
tcttcccttagcctctcc

SEQ ID NO: 220562 - DNA, 17 bp, Homo sapiens
tcttccctttcctccct

SEQ ID NO: 220563 - DNA, 15 bp, Homo sapiens
tcttccgggagctgg

SEQ ID NO: 220564 - DNA, 14 bp, Homo sapiens
tcttcctcaagtct

SEQ ID NO: 220565 - DNA, 17 bp, Homo sapiens
tcttcctccaaagcctg

SEQ ID NO: 220566 - DNA, 19 bp, Homo sapiens
tcttcctccagtctgttct

SEQ ID NO: 220567 - DNA, 20 bp, Homo sapiens
tcttcctccagtctgttctc

SEQ ID NO: 220568 - DNA, 21 bp, Homo sapiens
tcttcctccagtctgttctca

SEQ ID NO: 220569 - DNA, 23 bp, Homo sapiens
tcttcctccagtctgttctcaca

SEQ ID NO: 220570 - DNA, 15 bp, Homo sapiens
tcttcctctctctca

SEQ ID NO: 220571 - DNA, 17 bp, Homo sapiens
tcttcctctgcaggaca

SEQ ID NO: 220572 - DNA, 14 bp, Homo sapiens
tcttcctctgctga

SEQ ID NO: 220573 - DNA, 15 bp, Homo sapiens
tcttcctctggagct

SEQ ID NO: 220574 - DNA, 22 bp, Homo sapiens
tcttcctgaccaccttgcacta

SEQ ID NO: 220575 - DNA, 18 bp, Homo sapiens
tcttcctgagtggtgcca

SEQ ID NO: 220576 - DNA, 22 bp, Homo sapiens
tcttcctgcagaggcccagcca

SEQ ID NO: 220577 - DNA, 11 bp, Homo sapiens
tcttccttccg

SEQ ID NO: 220578 - DNA, 14 bp, Homo sapiens
tcttccttctctac

SEQ ID NO: 220579 - DNA, 13 bp, Homo sapiens
tcttcgctgctct

SEQ ID NO: 220580 - DNA, 20 bp, Homo sapiens
tcttcgctgtgatgcatgag

SEQ ID NO: 220581 - DNA, 14 bp, Homo sapiens
tcttcggaggtggc

SEQ ID NO: 220582 - DNA, 18 bp, Homo sapiens
tcttcgggaagagaggag

SEQ ID NO: 220583 - DNA, 17 bp, Homo sapiens
tcttcgtacagttcttc

SEQ ID NO: 220584 - DNA, 13 bp, Homo sapiens
tcttcgtcctttt

SEQ ID NO: 220585 - DNA, 19 bp, Homo sapiens
tcttctaaagaggaagcct

SEQ ID NO: 220586 - DNA, 15 bp, Homo sapiens
tcttctaatttcaaa

SEQ ID NO: 220587 - DNA, 18 bp, Homo sapiens
tcttctacaaccagagcc

SEQ ID NO: 220588 - DNA, 20 bp, Homo sapiens
tcttctacaaccagagcccc

SEQ ID NO: 220589 - DNA, 19 bp, Homo sapiens
tcttctacttgtttaacat

SEQ ID NO: 220590 - DNA, 17 bp, Homo sapiens
tcttctagagtaattat

SEQ ID NO: 220591 - DNA, 15 bp, Homo sapiens
tcttctatcctgcaa

SEQ ID NO: 220592 - DNA, 13 bp, Homo sapiens
tcttctcaagtgc

SEQ ID NO: 220593 - DNA, 20 bp, Homo sapiens
tcttctcagctccactctga

SEQ ID NO: 220594 - DNA, 17 bp, Homo sapiens
tcttctcatagcattaa

SEQ ID NO: 220595 - DNA, 17 bp, Homo sapiens
gccccgtgtccccccag

SEQ ID NO: 220596 - DNA, 24 bp, Homo sapiens
gccccgtgtccccccaggtgctgg

SEQ ID NO: 220597 - DNA, 21 bp, Homo sapiens
gccccgttccctgtcagaggc

SEQ ID NO: 220598 - DNA, 15 bp, Homo sapiens
gccccgttttgggga

SEQ ID NO: 220599 - DNA, 20 bp, Homo sapiens
gcccctaggactcaggcctg

SEQ ID NO: 220600 - DNA, 23 bp, Homo sapiens
gcccctaggactcaggcctgcca

SEQ ID NO: 220601 - DNA, 14 bp, Homo sapiens
gcccctatcctgca

SEQ ID NO: 220602 - DNA, 15 bp, Homo sapiens
gcccctatcctgcac

SEQ ID NO: 220603 - DNA, 18 bp, Homo sapiens
gcccctatcctgcaccct

SEQ ID NO: 220604 - DNA, 19 bp, Homo sapiens
gcccctatcctgcaccctc

SEQ ID NO: 220605 - DNA, 22 bp, Homo sapiens
gcccctatcctgcaccctctgc

SEQ ID NO: 220606 - DNA, 15 bp, Homo sapiens
gcccctcaccccaag

SEQ ID NO: 220607 - DNA, 17 bp, Homo sapiens
gcccctcacctcaggac

SEQ ID NO: 220608 - DNA, 18 bp, Homo sapiens
gcccctcacctgggcctt

SEQ ID NO: 220609 - DNA, 12 bp, Homo sapiens
gcccctcagagc

SEQ ID NO: 220610 - DNA, 22 bp, Homo sapiens
gcccctcagagccctgccctgc

SEQ ID NO: 220611 - DNA, 23 bp, Homo sapiens
gcccctcagagccctgccctgca

SEQ ID NO: 220612 - DNA, 13 bp, Homo sapiens
gcccctcagccct

SEQ ID NO: 220613 - DNA, 17 bp, Homo sapiens
gcccctcagcccttgcc

SEQ ID NO: 220614 - DNA, 14 bp, Homo sapiens
gcccctccaggaac

SEQ ID NO: 220615 - DNA, 15 bp, Homo sapiens
gcccctccagtgttg

SEQ ID NO: 220616 - DNA, 23 bp, Homo sapiens
gcccctccagtgttgcctcctcc

SEQ ID NO: 220617 - DNA, 22 bp, Homo sapiens
gcccctcccaagcgttcctggc

SEQ ID NO: 220618 - DNA, 15 bp, Homo sapiens
gcccctcccaccaca

SEQ ID NO: 220619 - DNA, 14 bp, Homo sapiens
gcccctcccatggc

SEQ ID NO: 220620 - DNA, 19 bp, Homo sapiens
gcccctcccatggcccagc

SEQ ID NO: 220621 - DNA, 12 bp, Homo sapiens
gcccctccccca

SEQ ID NO: 220622 - DNA, 14 bp, Homo sapiens
gcccctccctctgc

SEQ ID NO: 220623 - DNA, 17 bp, Homo sapiens
gcccctccctctgcccc

SEQ ID NO: 220624 - DNA, 14 bp, Homo sapiens
gcccctcccttcaa

SEQ ID NO: 220625 - DNA, 18 bp, Homo sapiens
gcccctccgtccccaggg

SEQ ID NO: 220626 - DNA, 11 bp, Homo sapiens
gcccctcctcg

SEQ ID NO: 220627 - DNA, 12 bp, Homo sapiens
gcccctcctcgg

SEQ ID NO: 220628 - DNA, 19 bp, Homo sapiens
gcccctcctcgggcgcctg

SEQ ID NO: 220629 - DNA, 20 bp, Homo sapiens
gcccctcctcgggcgcctgc

SEQ ID NO: 220630 - DNA, 13 bp, Homo sapiens
gcccctcctctcc

SEQ ID NO: 220631 - DNA, 15 bp, Homo sapiens
gcccctccttctccc

SEQ ID NO: 220632 - DNA, 16 bp, Homo sapiens
gcccctccttctcccc

SEQ ID NO: 220633 - DNA, 20 bp, Homo sapiens
gcccctccttctcccctcca

SEQ ID NO: 220634 - DNA, 16 bp, Homo sapiens
gcccctcgctgctgct

SEQ ID NO: 220635 - DNA, 17 bp, Homo sapiens
gcccctcgctgctgcta

SEQ ID NO: 220636 - DNA, 22 bp, Homo sapiens
gcccctcggcattcacacacag

SEQ ID NO: 220637 - DNA, 21 bp, Homo sapiens
gcccctcggctaccccccgtc

SEQ ID NO: 220638 - DNA, 23 bp, Homo sapiens
gcccctctctgtttaccctccct

SEQ ID NO: 220639 - DNA, 14 bp, Homo sapiens
gcccctctgcccag

SEQ ID NO: 220640 - DNA, 19 bp, Homo sapiens
gcccctctgcccagcttgg

SEQ ID NO: 220641 - DNA, 13 bp, Homo sapiens
gcccctctgctgt

SEQ ID NO: 220642 - DNA, 23 bp, Homo sapiens
gcccctctgttctggtggcccca

SEQ ID NO: 220643 - DNA, 13 bp, Homo sapiens
gcccctcttgccc

SEQ ID NO: 220644 - DNA, 16 bp, Homo sapiens
gcccctcttgcccccc

SEQ ID NO: 220645 - DNA, 18 bp, Homo sapiens
gcccctcttgccccccac

SEQ ID NO: 220646 - DNA, 18 bp, Homo sapiens
gcccctgaggactggaga

SEQ ID NO: 220647 - DNA, 13 bp, Homo sapiens
gcccctgcacaaa

SEQ ID NO: 220648 - DNA, 12 bp, Homo sapiens
gcccctgcaggg

SEQ ID NO: 220649 - DNA, 14 bp, Homo sapiens
gcccctgcagggga

SEQ ID NO: 220650 - DNA, 11 bp, Homo sapiens
gcccctgcccc

SEQ ID NO: 220651 - DNA, 20 bp, Homo sapiens
gcccctgccccgtcaccatc

SEQ ID NO: 220652 - DNA, 22 bp, Homo sapiens
gcccctgccccgtcaccatctc

SEQ ID NO: 220653 - DNA, 15 bp, Homo sapiens
gcccctgcccgagag

SEQ ID NO: 220654 - DNA, 21 bp, Homo sapiens
gcccctgcgtgggggccagtc

SEQ ID NO: 220655 - DNA, 16 bp, Homo sapiens
gcccctgctgcctccc

SEQ ID NO: 220656 - DNA, 13 bp, Homo sapiens
gcccctgctgctc

SEQ ID NO: 220657 - DNA, 14 bp, Homo sapiens
gcccctgctggacc

SEQ ID NO: 220658 - DNA, 21 bp, Homo sapiens
gcccctggcacgtcctccacc

SEQ ID NO: 220659 - DNA, 12 bp, Homo sapiens
gcccctggccca

SEQ ID NO: 220660 - DNA, 16 bp, Homo sapiens
gcccctggcccagcgg

SEQ ID NO: 220661 - DNA, 17 bp, Homo sapiens
gcccctggcccagcggc

SEQ ID NO: 220662 - DNA, 20 bp, Homo sapiens
gcccctggcccatctcagcc

SEQ ID NO: 220663 - DNA, 16 bp, Homo sapiens
gcccctggggcctaga

SEQ ID NO: 220664 - DNA, 17 bp, Homo sapiens
gcccctggggcctagac

SEQ ID NO: 220665 - DNA, 11 bp, Homo sapiens
gcccctggtgg

SEQ ID NO: 220666 - DNA, 12 bp, Homo sapiens
gcccctggtggc

SEQ ID NO: 220667 - DNA, 19 bp, Homo sapiens
gcccctgtctaacctacga

SEQ ID NO: 220668 - DNA, 15 bp, Homo sapiens
gcccctgtctggaag

SEQ ID NO: 220669 - DNA, 16 bp, Homo sapiens
gcccctgtctggaaga

SEQ ID NO: 220670 - DNA, 21 bp, Homo sapiens
gcccctgtgtgggagggcgag

SEQ ID NO: 220671 - DNA, 18 bp, Homo sapiens
gccccttaagggttgaag

SEQ ID NO: 220672 - DNA, 23 bp, Homo sapiens
gccccttaagggttgaaggcagt

SEQ ID NO: 220673 - DNA, 22 bp, Homo sapiens
tcttggtcaagtttttctctca

SEQ ID NO: 220674 - DNA, 18 bp, Homo sapiens
tcttgtaaaactgtgaca

SEQ ID NO: 220675 - DNA, 19 bp, Homo sapiens
tcttgtaaaactgtgacat

SEQ ID NO: 220676 - DNA, 20 bp, Homo sapiens
tcttgtaaaactgtgacatt

SEQ ID NO: 220677 - DNA, 23 bp, Homo sapiens
tcttgtaaaactgtgacattcca

SEQ ID NO: 220678 - DNA, 17 bp, Homo sapiens
tcttgtaaacctggagg

SEQ ID NO: 220679 - DNA, 16 bp, Homo sapiens
tcttgtattgctccat

SEQ ID NO: 220680 - DNA, 15 bp, Homo sapiens
tcttgtcacaataaa

SEQ ID NO: 220681 - DNA, 14 bp, Homo sapiens
tcttgtcatctttt

SEQ ID NO: 220682 - DNA, 19 bp, Homo sapiens
tcttgtcatttttaatatt

SEQ ID NO: 220683 - DNA, 16 bp, Homo sapiens
tcttgtccacattcta

SEQ ID NO: 220684 - DNA, 22 bp, Homo sapiens
tcttgtccagagacaagacttc

SEQ ID NO: 220685 - DNA, 12 bp, Homo sapiens
tcttgtctctgg

SEQ ID NO: 220686 - DNA, 14 bp, Homo sapiens
tcttgtctctgggc

SEQ ID NO: 220687 - DNA, 14 bp, Homo sapiens
tcttgtgactagtg

SEQ ID NO: 220688 - DNA, 22 bp, Homo sapiens
tcttgtgactagtgctgaagct

SEQ ID NO: 220689 - DNA, 23 bp, Homo sapiens
tcttgtgctagaatactttttaa

SEQ ID NO: 220690 - DNA, 22 bp, Homo sapiens
tcttgtgctcagcatgattctt

SEQ ID NO: 220691 - DNA, 15 bp, Homo sapiens
tcttgtgtatggata

SEQ ID NO: 220692 - DNA, 21 bp, Homo sapiens
tcttgtgtgtttattgtcaaa

SEQ ID NO: 220693 - DNA, 17 bp, Homo sapiens
tcttgtgtttgaaacac

SEQ ID NO: 220694 - DNA, 20 bp, Homo sapiens
tcttgttcatgttttgctaa

SEQ ID NO: 220695 - DNA, 21 bp, Homo sapiens
tcttgttcatgttttgctaat

SEQ ID NO: 220696 - DNA, 17 bp, Homo sapiens
tcttgttgcatcttttc

SEQ ID NO: 220697 - DNA, 22 bp, Homo sapiens
tcttgttgctcaaaaaatgagc

SEQ ID NO: 220698 - DNA, 15 bp, Homo sapiens
tcttgttttgttata

SEQ ID NO: 220699 - DNA, 19 bp, Homo sapiens
tcttgttttgttatataaa

SEQ ID NO: 220700 - DNA, 21 bp, Homo sapiens
tcttgttttttttttccactt

SEQ ID NO: 220701 - DNA, 17 bp, Homo sapiens
tctttaaatgatgtaca

SEQ ID NO: 220702 - DNA, 17 bp, Homo sapiens
tctttaacatacatcta

SEQ ID NO: 220703 - DNA, 17 bp, Homo sapiens
tctttaaggaagaataa

SEQ ID NO: 220704 - DNA, 21 bp, Homo sapiens
tctttaaggaagaataaaaaa

SEQ ID NO: 220705 - DNA, 15 bp, Homo sapiens
tctttaatcaaaagt

SEQ ID NO: 220706 - DNA, 15 bp, Homo sapiens
tctttaatcttcagt

SEQ ID NO: 220707 - DNA, 20 bp, Homo sapiens
tctttaatgttgtccaggaa

SEQ ID NO: 220708 - DNA, 13 bp, Homo sapiens
tctttaattgtat

SEQ ID NO: 220709 - DNA, 22 bp, Homo sapiens
tctttacaaaatgaatgcattg

SEQ ID NO: 220710 - DNA, 14 bp, Homo sapiens
tctttacaaactga

SEQ ID NO: 220711 - DNA, 16 bp, Homo sapiens
tctttacctgagacca

SEQ ID NO: 220712 - DNA, 21 bp, Homo sapiens
tctttactcccttcctggcct

SEQ ID NO: 220713 - DNA, 22 bp, Homo sapiens
tctttactcccttcctggcctc

SEQ ID NO: 220714 - DNA, 21 bp, Homo sapiens
tctttactcggcgtgctcctt

SEQ ID NO: 220715 - DNA, 22 bp, Homo sapiens
tctttagggagacccaataaag

SEQ ID NO: 220716 - DNA, 21 bp, Homo sapiens
tctttagtgatgcaataaaca

SEQ ID NO: 220717 - DNA, 20 bp, Homo sapiens
tctttataacaaaacaggga

SEQ ID NO: 220718 - DNA, 20 bp, Homo sapiens
tctttataattctactttga

SEQ ID NO: 220719 - DNA, 11 bp, Homo sapiens
tctttatactt

SEQ ID NO: 220720 - DNA, 17 bp, Homo sapiens
tctttatcattaaacat

SEQ ID NO: 220721 - DNA, 15 bp, Homo sapiens
tctttatgactgttt

SEQ ID NO: 220722 - DNA, 16 bp, Homo sapiens
tctttatgatttcatg

SEQ ID NO: 220723 - DNA, 14 bp, Homo sapiens
tctttcaagacagc

SEQ ID NO: 220724 - DNA, 23 bp, Homo sapiens
tctttcaagacagcctaatgaag

SEQ ID NO: 220725 - DNA, 17 bp, Homo sapiens
tctttcaatccacagta

SEQ ID NO: 220726 - DNA, 20 bp, Homo sapiens
tctttcaatccacagtattg

SEQ ID NO: 220727 - DNA, 14 bp, Homo sapiens
tctttcagatgttt

SEQ ID NO: 220728 - DNA, 18 bp, Homo sapiens
tctttcagatgtttattt

SEQ ID NO: 220729 - DNA, 16 bp, Homo sapiens
tctttcagccaagaat

SEQ ID NO: 220730 - DNA, 14 bp, Homo sapiens
tctttcatagttct

SEQ ID NO: 220731 - DNA, 22 bp, Homo sapiens
tctttcatagttctgttaaata

SEQ ID NO: 220732 - DNA, 20 bp, Homo sapiens
gcccggcccacgcagagccc

SEQ ID NO: 220733 - DNA, 23 bp, Homo sapiens
gcccggcccacgcagagccccgg

SEQ ID NO: 220734 - DNA, 13 bp, Homo sapiens
gcccggccggaga

SEQ ID NO: 220735 - DNA, 14 bp, Homo sapiens
gcccggcctgctcc

SEQ ID NO: 220736 - DNA, 15 bp, Homo sapiens
gcccggcctgctccc

SEQ ID NO: 220737 - DNA, 18 bp, Homo sapiens
gcccggcctgctcccagc

SEQ ID NO: 220738 - DNA, 17 bp, Homo sapiens
gcccgggagatccgccc

SEQ ID NO: 220739 - DNA, 13 bp, Homo sapiens
gcccgggcaggcc

SEQ ID NO: 220740 - DNA, 14 bp, Homo sapiens
gcccgggcaggcca

SEQ ID NO: 220741 - DNA, 15 bp, Homo sapiens
gcccgggcaggccag

SEQ ID NO: 220742 - DNA, 16 bp, Homo sapiens
gcccgggcaggccagc

SEQ ID NO: 220743 - DNA, 17 bp, Homo sapiens
gcccgggcccctggcac

SEQ ID NO: 220744 - DNA, 16 bp, Homo sapiens
gcccggggcagagctc

SEQ ID NO: 220745 - DNA, 21 bp, Homo sapiens
gcccggggcagagctcagagg

SEQ ID NO: 220746 - DNA, 21 bp, Homo sapiens
gcccgtcacccttatttatta

SEQ ID NO: 220747 - DNA, 20 bp, Homo sapiens
gcccgtgaagcagtgcctcg

SEQ ID NO: 220748 - DNA, 12 bp, Homo sapiens
gcccgtgcagta

SEQ ID NO: 220749 - DNA, 17 bp, Homo sapiens
gcccgtgcagtacaggc

SEQ ID NO: 220750 - DNA, 14 bp, Homo sapiens
gcccgtgcgcagcc

SEQ ID NO: 220751 - DNA, 15 bp, Homo sapiens
gcccgtgcgcagccg

SEQ ID NO: 220752 - DNA, 21 bp, Homo sapiens
gcccgtgcgcagccgcgctct

SEQ ID NO: 220753 - DNA, 17 bp, Homo sapiens
gcccgtgtggccccttc

SEQ ID NO: 220754 - DNA, 15 bp, Homo sapiens
gccctaaggatctct

SEQ ID NO: 220755 - DNA, 22 bp, Homo sapiens
gccctaccagcgcccgctgggc

SEQ ID NO: 220756 - DNA, 23 bp, Homo sapiens
gccctaccagcgcccgctgggct

SEQ ID NO: 220757 - DNA, 18 bp, Homo sapiens
gccctagaccctccccca

SEQ ID NO: 220758 - DNA, 19 bp, Homo sapiens
gccctagaccctcccccac

SEQ ID NO: 220759 - DNA, 22 bp, Homo sapiens
gccctagaccctcccccaccat

SEQ ID NO: 220760 - DNA, 22 bp, Homo sapiens
gccctagaggcgagccaggcaa

SEQ ID NO: 220761 - DNA, 21 bp, Homo sapiens
gccctagcgctctcttccaga

SEQ ID NO: 220762 - DNA, 19 bp, Homo sapiens
gccctaggcatactctcca

SEQ ID NO: 220763 - DNA, 20 bp, Homo sapiens
gccctaggcatactctccag

SEQ ID NO: 220764 - DNA, 23 bp, Homo sapiens
gccctaggcatactctccaggat

SEQ ID NO: 220765 - DNA, 17 bp, Homo sapiens
gccctagtgggagccca

SEQ ID NO: 220766 - DNA, 20 bp, Homo sapiens
gccctcactccactcccctc

SEQ ID NO: 220767 - DNA, 23 bp, Homo sapiens
gccctcagatgaaaataaaataa

SEQ ID NO: 220768 - DNA, 19 bp, Homo sapiens
gccctcaggggacttgaat

SEQ ID NO: 220769 - DNA, 22 bp, Homo sapiens
gccctcagtcagttcccggagc

SEQ ID NO: 220770 - DNA, 14 bp, Homo sapiens
gccctccaaaagca

SEQ ID NO: 220771 - DNA, 13 bp, Homo sapiens
gccctccactgcc

SEQ ID NO: 220772 - DNA, 13 bp, Homo sapiens
gccctccagagca

SEQ ID NO: 220773 - DNA, 21 bp, Homo sapiens
gccctccagctctttcctcct

SEQ ID NO: 220774 - DNA, 22 bp, Homo sapiens
gccctccatcccgacatggacc

SEQ ID NO: 220775 - DNA, 16 bp, Homo sapiens
gccctcccagctggtg

SEQ ID NO: 220776 - DNA, 23 bp, Homo sapiens
gccctcccatgttgcatgcctat

SEQ ID NO: 220777 - DNA, 19 bp, Homo sapiens
gccctccccagagcactgg

SEQ ID NO: 220778 - DNA, 10 bp, Homo sapiens
gccctccccc

SEQ ID NO: 220779 - DNA, 13 bp, Homo sapiens
gccctcccccacg

SEQ ID NO: 220780 - DNA, 13 bp, Homo sapiens
gccctccccctca

SEQ ID NO: 220781 - DNA, 22 bp, Homo sapiens
gccctccccctcaacctcacca

SEQ ID NO: 220782 - DNA, 14 bp, Homo sapiens
gccctccctccctc

SEQ ID NO: 220783 - DNA, 14 bp, Homo sapiens
gccctccctcttcc

SEQ ID NO: 220784 - DNA, 16 bp, Homo sapiens
gccctccctcttccca

SEQ ID NO: 220785 - DNA, 19 bp, Homo sapiens
gccctccctcttcccagca

SEQ ID NO: 220786 - DNA, 13 bp, Homo sapiens
gccctccctggct

SEQ ID NO: 220787 - DNA, 22 bp, Homo sapiens
gccctccctgtctccagggccc

SEQ ID NO: 220788 - DNA, 23 bp, Homo sapiens
gccctcccttggaaacctgccct

SEQ ID NO: 220789 - DNA, 17 bp, Homo sapiens
gccctccgcgggggaca

SEQ ID NO: 220790 - DNA, 23 bp, Homo sapiens
gccctccgcgggggacaggaaca

SEQ ID NO: 220791 - DNA, 17 bp, Homo sapiens
gccctccgtcctggcag

SEQ ID NO: 220792 - DNA, 18 bp, Homo sapiens
gccctccgtcctggcagg

SEQ ID NO: 220793 - DNA, 17 bp, Homo sapiens
gccctcctcgctgtgcc

SEQ ID NO: 220794 - DNA, 19 bp, Homo sapiens
gccctcctcgctgtgccac

SEQ ID NO: 220795 - DNA, 21 bp, Homo sapiens
gccctcctcgctgtgccacca

SEQ ID NO: 220796 - DNA, 13 bp, Homo sapiens
gccctcctctgcc

SEQ ID NO: 220797 - DNA, 16 bp, Homo sapiens
gccctcctctgccccc

SEQ ID NO: 220798 - DNA, 20 bp, Homo sapiens
gccctcctctgccccctccc

SEQ ID NO: 220799 - DNA, 22 bp, Homo sapiens
gccctcctctgccccctccccc

SEQ ID NO: 220800 - DNA, 23 bp, Homo sapiens
gccctcctgaaacttacacacaa

SEQ ID NO: 220801 - DNA, 19 bp, Homo sapiens
gccctcctgagcacccgct

SEQ ID NO: 220802 - DNA, 22 bp, Homo sapiens
tcttttgaactgttagatgctg

SEQ ID NO: 220803 - DNA, 23 bp, Homo sapiens
tcttttgaatcaatctggcttct

SEQ ID NO: 220804 - DNA, 18 bp, Homo sapiens
tcttttgaccccttcctg

SEQ ID NO: 220805 - DNA, 14 bp, Homo sapiens
tcttttgatacatt

SEQ ID NO: 220806 - DNA, 13 bp, Homo sapiens
tcttttggccttg

SEQ ID NO: 220807 - DNA, 22 bp, Homo sapiens
tctttttaaaaagttgcacatt

SEQ ID NO: 220808 - DNA, 15 bp, Homo sapiens
tctttttaaaaatga

SEQ ID NO: 220809 - DNA, 23 bp, Homo sapiens
tctttttcccctatcctgttctt

SEQ ID NO: 220810 - DNA, 14 bp, Homo sapiens
tctttttctggact

SEQ ID NO: 220811 - DNA, 15 bp, Homo sapiens
tctttttcttttcta

SEQ ID NO: 220812 - DNA, 14 bp, Homo sapiens
tcttttttaaatga

SEQ ID NO: 220813 - DNA, 21 bp, Homo sapiens
tctttttttaaaaataaatct

SEQ ID NO: 220814 - DNA, 18 bp, Homo sapiens
tctttttttacttatgcc

SEQ ID NO: 220815 - DNA, 17 bp, Homo sapiens
tctttttttggcccagg

SEQ ID NO: 220816 - DNA, 22 bp, Homo sapiens
tctttttttttttttttgaaag

SEQ ID NO: 220817 - DNA, 20 bp, Homo sapiens
tgaaaaaaaaattatttgcc

SEQ ID NO: 220818 - DNA, 22 bp, Homo sapiens
tgaaaaaaaaattatttgcctt

SEQ ID NO: 220819 - DNA, 17 bp, Homo sapiens
tgaaaaaaagtttacaa

SEQ ID NO: 220820 - DNA, 18 bp, Homo sapiens
tgaaaaaaatgatctatt

SEQ ID NO: 220821 - DNA, 20 bp, Homo sapiens
tgaaaaaaattggcattaaa

SEQ ID NO: 220822 - DNA, 22 bp, Homo sapiens
tgaaaaacacggcagctgtagc

SEQ ID NO: 220823 - DNA, 22 bp, Homo sapiens
tgaaaaagtatcctgcttctga

SEQ ID NO: 220824 - DNA, 20 bp, Homo sapiens
tgaaaaatagtgtgtccatg

SEQ ID NO: 220825 - DNA, 20 bp, Homo sapiens
tgaaaaatatgtgcttgaaa

SEQ ID NO: 220826 - DNA, 19 bp, Homo sapiens
tgaaaaatttaagcattgt

SEQ ID NO: 220827 - DNA, 16 bp, Homo sapiens
tgaaaacacctgagct

SEQ ID NO: 220828 - DNA, 22 bp, Homo sapiens
tgaaaacacttattttacacag

SEQ ID NO: 220829 - DNA, 18 bp, Homo sapiens
tgaaaacagaaaacggtt

SEQ ID NO: 220830 - DNA, 16 bp, Homo sapiens
tgaaaacattgatgaa

SEQ ID NO: 220831 - DNA, 19 bp, Homo sapiens
tgaaaacatttcaaagctg

SEQ ID NO: 220832 - DNA, 20 bp, Homo sapiens
tgaaaaccatctggcctggc

SEQ ID NO: 220833 - DNA, 21 bp, Homo sapiens
tgaaaaccatctggcctggcc

SEQ ID NO: 220834 - DNA, 20 bp, Homo sapiens
tgaaaacgcttaggccatga

SEQ ID NO: 220835 - DNA, 19 bp, Homo sapiens
tgaaaacgttttattgtgt

SEQ ID NO: 220836 - DNA, 16 bp, Homo sapiens
tgaaaactaagttctc

SEQ ID NO: 220837 - DNA, 20 bp, Homo sapiens
tgaaaactgtaaatacaaaa

SEQ ID NO: 220838 - DNA, 12 bp, Homo sapiens
tgaaaacttcaa

SEQ ID NO: 220839 - DNA, 14 bp, Homo sapiens
tgaaaacttcaaag

SEQ ID NO: 220840 - DNA, 16 bp, Homo sapiens
tgaaaacttcaaagct

SEQ ID NO: 220841 - DNA, 22 bp, Homo sapiens
tgaaaacttcaaagctgaatat

SEQ ID NO: 220842 - DNA, 19 bp, Homo sapiens
tgaaaagaaaatgtgccat

SEQ ID NO: 220843 - DNA, 18 bp, Homo sapiens
tgaaaagaagaaagtcta

SEQ ID NO: 220844 - DNA, 19 bp, Homo sapiens
tgaaaagaagaaagtctat

SEQ ID NO: 220845 - DNA, 21 bp, Homo sapiens
tgaaaagaagaaagtctatgc

SEQ ID NO: 220846 - DNA, 22 bp, Homo sapiens
tgaaaagaagaaagtctatgct

SEQ ID NO: 220847 - DNA, 18 bp, Homo sapiens
tgaaaagagaattactta

SEQ ID NO: 220848 - DNA, 16 bp, Homo sapiens
tgaaaagatgttgtgt

SEQ ID NO: 220849 - DNA, 17 bp, Homo sapiens
tgaaaagatttaagcac

SEQ ID NO: 220850 - DNA, 15 bp, Homo sapiens
tgaaaaggactcttg

SEQ ID NO: 220851 - DNA, 16 bp, Homo sapiens
tgaaaaggactcttga

SEQ ID NO: 220852 - DNA, 23 bp, Homo sapiens
tgaaaaggtgaccttgcaacttc

SEQ ID NO: 220853 - DNA, 10 bp, Homo sapiens
tgaaaagtgc

SEQ ID NO: 220854 - DNA, 20 bp, Homo sapiens
tgaaaataaaataaacgaaa

SEQ ID NO: 220855 - DNA, 12 bp, Homo sapiens
tgaaaatacaac

SEQ ID NO: 220856 - DNA, 22 bp, Homo sapiens
tgaaaatatttctatgtaaatt

SEQ ID NO: 220857 - DNA, 21 bp, Homo sapiens
tgaaaatatttttttctagct

SEQ ID NO: 220858 - DNA, 13 bp, Homo sapiens
tgaaaatcctacc

SEQ ID NO: 220859 - DNA, 14 bp, Homo sapiens
tgaaaatctaatat

SEQ ID NO: 220860 - DNA, 21 bp, Homo sapiens
tgaaaatctaatattaaaaat

SEQ ID NO: 220861 - DNA, 22 bp, Homo sapiens
tgaaaatgagcctgtaatcctc

SEQ ID NO: 220862 - DNA, 20 bp, Homo sapiens
tgaaaatggaagtggcaata

SEQ ID NO: 220863 - DNA, 15 bp, Homo sapiens
tgaaaatgtcagaaa

SEQ ID NO: 220864 - DNA, 21 bp, Homo sapiens
tgaaaattacacccatgcaca

SEQ ID NO: 220865 - DNA, 13 bp, Homo sapiens
tgaaaattcaaca

SEQ ID NO: 220866 - DNA, 20 bp, Homo sapiens
tgaaaattccagaaaggata

SEQ ID NO: 220867 - DNA, 12 bp, Homo sapiens
tgaaaattcttg

SEQ ID NO: 220868 - DNA, 21 bp, Homo sapiens
gccctggggtccccactccct

SEQ ID NO: 220869 - DNA, 15 bp, Homo sapiens
gccctggggtctctg

SEQ ID NO: 220870 - DNA, 16 bp, Homo sapiens
gccctggggtctctga

SEQ ID NO: 220871 - DNA, 19 bp, Homo sapiens
gccctggggtctctgagca

SEQ ID NO: 220872 - DNA, 18 bp, Homo sapiens
gccctggggtggcgtctg

SEQ ID NO: 220873 - DNA, 17 bp, Homo sapiens
gccctggtatgtgcctg

SEQ ID NO: 220874 - DNA, 13 bp, Homo sapiens
gccctggtccagg

SEQ ID NO: 220875 - DNA, 21 bp, Homo sapiens
gccctggtgctgccacacttc

SEQ ID NO: 220876 - DNA, 17 bp, Homo sapiens
gccctggttcccccagg

SEQ ID NO: 220877 - DNA, 23 bp, Homo sapiens
gccctggttcccccaggaccctg

SEQ ID NO: 220878 - DNA, 20 bp, Homo sapiens
gccctggtttcactggccca

SEQ ID NO: 220879 - DNA, 17 bp, Homo sapiens
gccctgtacctctctct

SEQ ID NO: 220880 - DNA, 20 bp, Homo sapiens
gccctgtacctctctctgct

SEQ ID NO: 220881 - DNA, 23 bp, Homo sapiens
gccctgtacctctctctgctcct

SEQ ID NO: 220882 - DNA, 16 bp, Homo sapiens
gccctgtccctgtccc

SEQ ID NO: 220883 - DNA, 21 bp, Homo sapiens
gccctgtcgagacacttgcct

SEQ ID NO: 220884 - DNA, 11 bp, Homo sapiens
gccctgtctgt

SEQ ID NO: 220885 - DNA, 16 bp, Homo sapiens
gccctgtggaagggac

SEQ ID NO: 220886 - DNA, 13 bp, Homo sapiens
gccctgtgggaga

SEQ ID NO: 220887 - DNA, 14 bp, Homo sapiens
gcccttaccttccc

SEQ ID NO: 220888 - DNA, 19 bp, Homo sapiens
gcccttcaggacccttcta

SEQ ID NO: 220889 - DNA, 21 bp, Homo sapiens
gcccttccatgtcgcctctgc

SEQ ID NO: 220890 - DNA, 15 bp, Homo sapiens
gcccttcccaggcca

SEQ ID NO: 220891 - DNA, 12 bp, Homo sapiens
gcccttccctct

SEQ ID NO: 220892 - DNA, 15 bp, Homo sapiens
gcccttccctctgtt

SEQ ID NO: 220893 - DNA, 22 bp, Homo sapiens
gcccttcctcctgaagcctctg

SEQ ID NO: 220894 - DNA, 16 bp, Homo sapiens
gcccttcctctccact

SEQ ID NO: 220895 - DNA, 20 bp, Homo sapiens
gcccttcctctccactgcct

SEQ ID NO: 220896 - DNA, 17 bp, Homo sapiens
gcccttgcacaggccac

SEQ ID NO: 220897 - DNA, 19 bp, Homo sapiens
gcccttgcccccatccctc

SEQ ID NO: 220898 - DNA, 13 bp, Homo sapiens
gcccttgctgggt

SEQ ID NO: 220899 - DNA, 16 bp, Homo sapiens
gcccttgggacagcca

SEQ ID NO: 220900 - DNA, 13 bp, Homo sapiens
gcccttgggcagt

SEQ ID NO: 220901 - DNA, 15 bp, Homo sapiens
gcccttgggcagttc

SEQ ID NO: 220902 - DNA, 14 bp, Homo sapiens
gcccttggggcctg

SEQ ID NO: 220903 - DNA, 17 bp, Homo sapiens
gcccttgtcctgccagc

SEQ ID NO: 220904 - DNA, 13 bp, Homo sapiens
gcccttgtgccct

SEQ ID NO: 220905 - DNA, 15 bp, Homo sapiens
gcccttgtgccctgc

SEQ ID NO: 220906 - DNA, 14 bp, Homo sapiens
gccctttccccact

SEQ ID NO: 220907 - DNA, 18 bp, Homo sapiens
gccctttccttgccttct

SEQ ID NO: 220908 - DNA, 23 bp, Homo sapiens
gccctttgcaggcccagcagact

SEQ ID NO: 220909 - DNA, 16 bp, Homo sapiens
gcccttttaaatggca

SEQ ID NO: 220910 - DNA, 17 bp, Homo sapiens
gcccttttaaatggcat

SEQ ID NO: 220911 - DNA, 17 bp, Homo sapiens
gcccttttacagctctt

SEQ ID NO: 220912 - DNA, 17 bp, Homo sapiens
gcccttttcctgggcct

SEQ ID NO: 220913 - DNA, 19 bp, Homo sapiens
gcccttttctggctcctgt

SEQ ID NO: 220914 - DNA, 22 bp, Homo sapiens
gccgaagaagggtccttccctc

SEQ ID NO: 220915 - DNA, 14 bp, Homo sapiens
gccgaattgtggtg

SEQ ID NO: 220916 - DNA, 19 bp, Homo sapiens
gccgaccgcctgcttcaca

SEQ ID NO: 220917 - DNA, 16 bp, Homo sapiens
gccgactggctgtgag

SEQ ID NO: 220918 - DNA, 17 bp, Homo sapiens
gccgagaccgcagaggg

SEQ ID NO: 220919 - DNA, 20 bp, Homo sapiens
gccgagatcggggtggcaga

SEQ ID NO: 220920 - DNA, 23 bp, Homo sapiens
gccgagctcgtgtatcctggggc

SEQ ID NO: 220921 - DNA, 12 bp, Homo sapiens
gccgagctctcc

SEQ ID NO: 220922 - DNA, 17 bp, Homo sapiens
gccgagctctcctgggc

SEQ ID NO: 220923 - DNA, 21 bp, Homo sapiens
gccgagctctcctgggccagg

SEQ ID NO: 220924 - DNA, 16 bp, Homo sapiens
gccgaggagccaggca

SEQ ID NO: 220925 - DNA, 20 bp, Homo sapiens
gccgaggcaggggctgggca

SEQ ID NO: 220926 - DNA, 14 bp, Homo sapiens
gccgaggggccagg

SEQ ID NO: 220927 - DNA, 15 bp, Homo sapiens
gccgagtgccccaga

SEQ ID NO: 220928 - DNA, 16 bp, Homo sapiens
gccgatgagctggttt

SEQ ID NO: 220929 - DNA, 17 bp, Homo sapiens
gccgcaagtctgcagcc

SEQ ID NO: 220930 - DNA, 19 bp, Homo sapiens
gccgcagggcgctccggca

SEQ ID NO: 220931 - DNA, 16 bp, Homo sapiens
tgaaatatttgcttat

SEQ ID NO: 220932 - DNA, 18 bp, Homo sapiens
tgaaatcaccttttctaa

SEQ ID NO: 220933 - DNA, 17 bp, Homo sapiens
tgaaatccaaactactt

SEQ ID NO: 220934 - DNA, 13 bp, Homo sapiens
tgaaatgaaaaca

SEQ ID NO: 220935 - DNA, 15 bp, Homo sapiens
tgaaatgggctttaa

SEQ ID NO: 220936 - DNA, 22 bp, Homo sapiens
tgaaatgtaccatcaaatgtta

SEQ ID NO: 220937 - DNA, 17 bp, Homo sapiens
tgaaatgtttccaggca

SEQ ID NO: 220938 - DNA, 18 bp, Homo sapiens
tgaaatgtttccaggcat

SEQ ID NO: 220939 - DNA, 21 bp, Homo sapiens
tgaaattatagtttcaagcca

SEQ ID NO: 220940 - DNA, 22 bp, Homo sapiens
tgaaattgtgaactcattgctc

SEQ ID NO: 220941 - DNA, 23 bp, Homo sapiens
tgaaatttcccacaccccagcgc

SEQ ID NO: 220942 - DNA, 14 bp, Homo sapiens
tgaaatttgttaat

SEQ ID NO: 220943 - DNA, 20 bp, Homo sapiens
tgaaatttgttaatatatat

SEQ ID NO: 220944 - DNA, 18 bp, Homo sapiens
tgaaattttctagacttt

SEQ ID NO: 220945 - DNA, 16 bp, Homo sapiens
tgaaatttttaaatca

SEQ ID NO: 220946 - DNA, 21 bp, Homo sapiens
tgaaatttttaaatcatttca

SEQ ID NO: 220947 - DNA, 23 bp, Homo sapiens
tgaacacaggcaaagaggtgctg

SEQ ID NO: 220948 - DNA, 15 bp, Homo sapiens
tgaacacagtttagt

SEQ ID NO: 220949 - DNA, 22 bp, Homo sapiens
tgaacacatctcttagtccctc

SEQ ID NO: 220950 - DNA, 18 bp, Homo sapiens
tgaacacttattgctttg

SEQ ID NO: 220951 - DNA, 15 bp, Homo sapiens
tgaacagggcccagg

SEQ ID NO: 220952 - DNA, 17 bp, Homo sapiens
tgaacaggttctccagg

SEQ ID NO: 220953 - DNA, 19 bp, Homo sapiens
tgaacataactgtaacata

SEQ ID NO: 220954 - DNA, 22 bp, Homo sapiens
tgaacatttggaaaccatgcac

SEQ ID NO: 220955 - DNA, 14 bp, Homo sapiens
tgaaccaaaacatt

SEQ ID NO: 220956 - DNA, 17 bp, Homo sapiens
tgaaccaaaacattccg

SEQ ID NO: 220957 - DNA, 16 bp, Homo sapiens
tgaaccaactgcctta

SEQ ID NO: 220958 - DNA, 20 bp, Homo sapiens
tgaaccagctcatctccaag

SEQ ID NO: 220959 - DNA, 17 bp, Homo sapiens
tgaaccaggccttctga

SEQ ID NO: 220960 - DNA, 16 bp, Homo sapiens
tgaaccccatgggctt

SEQ ID NO: 220961 - DNA, 18 bp, Homo sapiens
tgaaccccccccccccgc

SEQ ID NO: 220962 - DNA, 16 bp, Homo sapiens
tgaacccttgtgcttg

SEQ ID NO: 220963 - DNA, 14 bp, Homo sapiens
tgaacctcattaaa

SEQ ID NO: 220964 - DNA, 16 bp, Homo sapiens
tgaacgttttaataat

SEQ ID NO: 220965 - DNA, 17 bp, Homo sapiens
tgaacgttttaataatt

SEQ ID NO: 220966 - DNA, 19 bp, Homo sapiens
tgaactccatacagcctct

SEQ ID NO: 220967 - DNA, 11 bp, Homo sapiens
tgaactcctga

SEQ ID NO: 220968 - DNA, 12 bp, Homo sapiens
tgaactcctgac

SEQ ID NO: 220969 - DNA, 14 bp, Homo sapiens
tgaactcctgggct

SEQ ID NO: 220970 - DNA, 21 bp, Homo sapiens
tgaactctgttcccccaccct

SEQ ID NO: 220971 - DNA, 15 bp, Homo sapiens
tgaactcttaatcaa

SEQ ID NO: 220972 - DNA, 18 bp, Homo sapiens
tgaactcttcaatctctt

SEQ ID NO: 220973 - DNA, 18 bp, Homo sapiens
tgaactgcatgtataaat

SEQ ID NO: 220974 - DNA, 16 bp, Homo sapiens
tgaactgctgctggtc

SEQ ID NO: 220975 - DNA, 18 bp, Homo sapiens
tgaactgttagatgctga

SEQ ID NO: 220976 - DNA, 16 bp, Homo sapiens
tgaacttgaggacaca

SEQ ID NO: 220977 - DNA, 14 bp, Homo sapiens
tgaactttggaagc

SEQ ID NO: 220978 - DNA, 15 bp, Homo sapiens
tgaactttgtttcca

SEQ ID NO: 220979 - DNA, 17 bp, Homo sapiens
tgaactttgtttccaga

SEQ ID NO: 220980 - DNA, 19 bp, Homo sapiens
tgaactttgtttccagaaa

SEQ ID NO: 220981 - DNA, 14 bp, Homo sapiens
tgaacttttcagga

SEQ ID NO: 220982 - DNA, 15 bp, Homo sapiens
tgaagaaaagtgggc

SEQ ID NO: 220983 - DNA, 21 bp, Homo sapiens
tgaagaacacagcatgtgcca

SEQ ID NO: 220984 - DNA, 18 bp, Homo sapiens
tgaagaaccgcattttga

SEQ ID NO: 220985 - DNA, 21 bp, Homo sapiens
tgaagaagccatcaattttaa

SEQ ID NO: 220986 - DNA, 23 bp, Homo sapiens
tgaagaagccatcaattttaaca

SEQ ID NO: 220987 - DNA, 13 bp, Homo sapiens
tgaagaagctggg

SEQ ID NO: 220988 - DNA, 14 bp, Homo sapiens
tgaagaatacagtt

SEQ ID NO: 220989 - DNA, 18 bp, Homo sapiens
tgaagaatgcattcaaaa

SEQ ID NO: 220990 - DNA, 20 bp, Homo sapiens
tgaagaattaatgacaacaa

SEQ ID NO: 220991 - DNA, 21 bp, Homo sapiens
tgaagaattattttttttctt

SEQ ID NO: 220992 - DNA, 16 bp, Homo sapiens
tgaagaatttgttctt

SEQ ID NO: 220993 - DNA, 14 bp, Homo sapiens
tgaagacagaggga

SEQ ID NO: 220994 - DNA, 18 bp, Homo sapiens
tgaagagcgctcctctgc

SEQ ID NO: 220995 - DNA, 11 bp, Homo sapiens
tgaagagctga

SEQ ID NO: 220996 - DNA, 23 bp, Homo sapiens
tgaagaggggaggggcctaggga

SEQ ID NO: 220997 - DNA, 15 bp, Homo sapiens
tgaagaggggccaga

SEQ ID NO: 220998 - DNA, 22 bp, Homo sapiens
tgaagagtgactagtacaaatt

SEQ ID NO: 220999 - DNA, 23 bp, Homo sapiens
tgaagataccatcagcaaagaat

SEQ ID NO: 221000 - DNA, 19 bp, Homo sapiens
tgaagatcgttagtatcta

SEQ ID NO: 221001 - DNA, 13 bp, Homo sapiens
tgaagatgatcat

SEQ ID NO: 221002 - DNA, 16 bp, Homo sapiens
tgaagatgggaacgca

SEQ ID NO: 221003 - DNA, 13 bp, Homo sapiens
tgaagatgtagct

SEQ ID NO: 221004 - DNA, 19 bp, Homo sapiens
tgaagattattttttatga

SEQ ID NO: 221005 - DNA, 19 bp, Homo sapiens
tgaagattttctttctctt

SEQ ID NO: 221006 - DNA, 20 bp, Homo sapiens
gccgtcttcactcgcccccg

SEQ ID NO: 221007 - DNA, 21 bp, Homo sapiens
gccgtctttggttcctcatgg

SEQ ID NO: 221008 - DNA, 16 bp, Homo sapiens
gccgtgcacggggcca

SEQ ID NO: 221009 - DNA, 17 bp, Homo sapiens
gccgtgcacggggccag

SEQ ID NO: 221010 - DNA, 20 bp, Homo sapiens
gccgtgcacggggccagcat

SEQ ID NO: 221011 - DNA, 17 bp, Homo sapiens
gccgtgcatggctcctg

SEQ ID NO: 221012 - DNA, 23 bp, Homo sapiens
gccgtgcccgcccacctctgctg

SEQ ID NO: 221013 - DNA, 14 bp, Homo sapiens
gccgtgccttcagc

SEQ ID NO: 221014 - DNA, 13 bp, Homo sapiens
gccgtggcttccc

SEQ ID NO: 221015 - DNA, 19 bp, Homo sapiens
gccgtggcttcccgctcag

SEQ ID NO: 221016 - DNA, 23 bp, Homo sapiens
gccgtgggcctgtcgtgccagtc

SEQ ID NO: 221017 - DNA, 16 bp, Homo sapiens
gccgttccccttggct

SEQ ID NO: 221018 - DNA, 20 bp, Homo sapiens
gcctaaaattgtatgaaaat

SEQ ID NO: 221019 - DNA, 16 bp, Homo sapiens
gcctaacaccagcgtt

SEQ ID NO: 221020 - DNA, 12 bp, Homo sapiens
gcctaagaaaaa

SEQ ID NO: 221021 - DNA, 22 bp, Homo sapiens
gcctaattcctggcatgacact

SEQ ID NO: 221022 - DNA, 14 bp, Homo sapiens
gcctacattatcta

SEQ ID NO: 221023 - DNA, 22 bp, Homo sapiens
gcctaccagtcgccctctgtgc

SEQ ID NO: 221024 - DNA, 19 bp, Homo sapiens
gcctactgtctccttccca

SEQ ID NO: 221025 - DNA, 22 bp, Homo sapiens
gcctactgtctccttcccactg

SEQ ID NO: 221026 - DNA, 23 bp, Homo sapiens
gcctactgtctccttcccactgt

SEQ ID NO: 221027 - DNA, 18 bp, Homo sapiens
gcctagacttcccaacag

SEQ ID NO: 221028 - DNA, 18 bp, Homo sapiens
gcctagcactcacatgct

SEQ ID NO: 221029 - DNA, 23 bp, Homo sapiens
gcctagcactcacatgctggaca

SEQ ID NO: 221030 - DNA, 14 bp, Homo sapiens
gcctagcccaccct

SEQ ID NO: 221031 - DNA, 18 bp, Homo sapiens
gcctagcccaccctgctg

SEQ ID NO: 221032 - DNA, 12 bp, Homo sapiens
gcctaggagctg

SEQ ID NO: 221033 - DNA, 20 bp, Homo sapiens
gcctaggagctggctggcag

SEQ ID NO: 221034 - DNA, 22 bp, Homo sapiens
gcctaggagctggctggcaggt

SEQ ID NO: 221035 - DNA, 17 bp, Homo sapiens
gcctagggcctggtcca

SEQ ID NO: 221036 - DNA, 21 bp, Homo sapiens
gcctagggttgcttgggccac

SEQ ID NO: 221037 - DNA, 22 bp, Homo sapiens
gcctagtggcttcagcccctgg

SEQ ID NO: 221038 - DNA, 22 bp, Homo sapiens
gcctagttcctgtggccaggag

SEQ ID NO: 221039 - DNA, 16 bp, Homo sapiens
gcctatccatcctgcg

SEQ ID NO: 221040 - DNA, 15 bp, Homo sapiens
gcctatggaaagggt

SEQ ID NO: 221041 - DNA, 12 bp, Homo sapiens
gcctatttaagc

SEQ ID NO: 221042 - DNA, 14 bp, Homo sapiens
gcctatttaagccc

SEQ ID NO: 221043 - DNA, 15 bp, Homo sapiens
gcctatttaagcccc

SEQ ID NO: 221044 - DNA, 23 bp, Homo sapiens
gcctcaaacagccacgaggtggt

SEQ ID NO: 221045 - DNA, 14 bp, Homo sapiens
gcctcaaccctccc

SEQ ID NO: 221046 - DNA, 15 bp, Homo sapiens
gcctcaaccctccct

SEQ ID NO: 221047 - DNA, 17 bp, Homo sapiens
gcctcaaccctccctca

SEQ ID NO: 221048 - DNA, 21 bp, Homo sapiens
gcctcaaccctccctcagccc

SEQ ID NO: 221049 - DNA, 22 bp, Homo sapiens
gcctcaaccctccctcagcccc

SEQ ID NO: 221050 - DNA, 23 bp, Homo sapiens
gcctcaaccctccctcagcccct

SEQ ID NO: 221051 - DNA, 13 bp, Homo sapiens
gcctcaagttcaa

SEQ ID NO: 221052 - DNA, 14 bp, Homo sapiens
gcctcaagttcaat

SEQ ID NO: 221053 - DNA, 14 bp, Homo sapiens
gcctcaatgccagt

SEQ ID NO: 221054 - DNA, 14 bp, Homo sapiens
gcctcacatctccc

SEQ ID NO: 221055 - DNA, 12 bp, Homo sapiens
gcctcacccaga

SEQ ID NO: 221056 - DNA, 16 bp, Homo sapiens
gcctcacccagaagga

SEQ ID NO: 221057 - DNA, 11 bp, Homo sapiens
gcctcacccct

SEQ ID NO: 221058 - DNA, 18 bp, Homo sapiens
gcctcacccctgcaggcg

SEQ ID NO: 221059 - DNA, 12 bp, Homo sapiens
gcctcacctggc

SEQ ID NO: 221060 - DNA, 15 bp, Homo sapiens
gcctcacctggcttc

SEQ ID NO: 221061 - DNA, 13 bp, Homo sapiens
tgaagttgggaaa

SEQ ID NO: 221062 - DNA, 14 bp, Homo sapiens
tgaagtttcacatg

SEQ ID NO: 221063 - DNA, 22 bp, Homo sapiens
tgaataaaaaacatttgtacat

SEQ ID NO: 221064 - DNA, 14 bp, Homo sapiens
tgaataaaaacttt

SEQ ID NO: 221065 - DNA, 14 bp, Homo sapiens
tgaataaagacacc

SEQ ID NO: 221066 - DNA, 13 bp, Homo sapiens
tgaataaagccac

SEQ ID NO: 221067 - DNA, 20 bp, Homo sapiens
tgaataaagggaacatgcag

SEQ ID NO: 221068 - DNA, 17 bp, Homo sapiens
tgaataaagttgaagct

SEQ ID NO: 221069 - DNA, 21 bp, Homo sapiens
tgaataaattctataggaaca

SEQ ID NO: 221070 - DNA, 14 bp, Homo sapiens
tgaataacaacaat

SEQ ID NO: 221071 - DNA, 15 bp, Homo sapiens
tgaataaccacttaa

SEQ ID NO: 221072 - DNA, 15 bp, Homo sapiens
tgaataacttgaaga

SEQ ID NO: 221073 - DNA, 19 bp, Homo sapiens
tgaataagttgattctgtc

SEQ ID NO: 221074 - DNA, 21 bp, Homo sapiens
tgaataagttgattctgtccc

SEQ ID NO: 221075 - DNA, 15 bp, Homo sapiens
tgaataatttcccaa

SEQ ID NO: 221076 - DNA, 20 bp, Homo sapiens
tgaatacaattaaaggtcct

SEQ ID NO: 221077 - DNA, 19 bp, Homo sapiens
tgaatacagggcatgcatt

SEQ ID NO: 221078 - DNA, 18 bp, Homo sapiens
tgaatacatggtagcagg

SEQ ID NO: 221079 - DNA, 17 bp, Homo sapiens
tgaatacattaaaagaa

SEQ ID NO: 221080 - DNA, 22 bp, Homo sapiens
tgaataccattaaaactgcttt

SEQ ID NO: 221081 - DNA, 23 bp, Homo sapiens
tgaataccattaaaactgctttt

SEQ ID NO: 221082 - DNA, 12 bp, Homo sapiens
tgaatagaaatg

SEQ ID NO: 221083 - DNA, 13 bp, Homo sapiens
tgaatagatgtga

SEQ ID NO: 221084 - DNA, 12 bp, Homo sapiens
tgaatataaatg

SEQ ID NO: 221085 - DNA, 13 bp, Homo sapiens
tgaatataaatgt

SEQ ID NO: 221086 - DNA, 14 bp, Homo sapiens
tgaatataaatgta

SEQ ID NO: 221087 - DNA, 22 bp, Homo sapiens
tgaatatatttaagcaacatct

SEQ ID NO: 221088 - DNA, 12 bp, Homo sapiens
tgaatatcatat

SEQ ID NO: 221089 - DNA, 14 bp, Homo sapiens
tgaatattaatccc

SEQ ID NO: 221090 - DNA, 17 bp, Homo sapiens
tgaatattaatcccagc

SEQ ID NO: 221091 - DNA, 17 bp, Homo sapiens
tgaatatttataacagc

SEQ ID NO: 221092 - DNA, 19 bp, Homo sapiens
tgaatatttatatttcact

SEQ ID NO: 221093 - DNA, 20 bp, Homo sapiens
tgaatattttatctttcctt

SEQ ID NO: 221094 - DNA, 13 bp, Homo sapiens
tgaatcaaagaat

SEQ ID NO: 221095 - DNA, 17 bp, Homo sapiens
tgaatcaatctggcttc

SEQ ID NO: 221096 - DNA, 21 bp, Homo sapiens
tgaatcactgcacctctttgt

SEQ ID NO: 221097 - DNA, 20 bp, Homo sapiens
tgaatcagtatgaagacact

SEQ ID NO: 221098 - DNA, 15 bp, Homo sapiens
tgaatctaataaaat

SEQ ID NO: 221099 - DNA, 22 bp, Homo sapiens
tgaatctattgtttctcctctg

SEQ ID NO: 221100 - DNA, 19 bp, Homo sapiens
tgaatctctcaaaatgtgc

SEQ ID NO: 221101 - DNA, 20 bp, Homo sapiens
tgaatctctcaaaatgtgcc

SEQ ID NO: 221102 - DNA, 20 bp, Homo sapiens
tgaatctgcagggagcaact

SEQ ID NO: 221103 - DNA, 17 bp, Homo sapiens
tgaatgaaaaatttaag

SEQ ID NO: 221104 - DNA, 21 bp, Homo sapiens
tgaatgaaagtcttgtgacta

SEQ ID NO: 221105 - DNA, 21 bp, Homo sapiens
tgaatgagtaaataaactctt

SEQ ID NO: 221106 - DNA, 15 bp, Homo sapiens
tgaatgatctctctg

SEQ ID NO: 221107 - DNA, 16 bp, Homo sapiens
tgaatgcaaaaagata

SEQ ID NO: 221108 - DNA, 15 bp, Homo sapiens
tgaatgctgtacctt

SEQ ID NO: 221109 - DNA, 12 bp, Homo sapiens
tgaatgcttttt

SEQ ID NO: 221110 - DNA, 17 bp, Homo sapiens
tgaatggtgcaatgaat

SEQ ID NO: 221111 - DNA, 15 bp, Homo sapiens
tgaatggtgttgtat

SEQ ID NO: 221112 - DNA, 21 bp, Homo sapiens
tgaatggtgttgtatgccttt

SEQ ID NO: 221113 - DNA, 19 bp, Homo sapiens
tgaatggttccatgcctga

SEQ ID NO: 221114 - DNA, 19 bp, Homo sapiens
tgaatgtaaatttgtacta

SEQ ID NO: 221115 - DNA, 20 bp, Homo sapiens
tgaatgtaaatttgtactat

SEQ ID NO: 221116 - DNA, 21 bp, Homo sapiens
tgaatgtaaatttgtactatt

SEQ ID NO: 221117 - DNA, 22 bp, Homo sapiens
tgaatgtaaatttgtactattt

SEQ ID NO: 221118 - DNA, 12 bp, Homo sapiens
tgaatgtacaaa

SEQ ID NO: 221119 - DNA, 12 bp, Homo sapiens
tgaatgtatcta

SEQ ID NO: 221120 - DNA, 14 bp, Homo sapiens
tgaatgtcacaaat

SEQ ID NO: 221121 - DNA, 18 bp, Homo sapiens
tgaatgtcagtgtgactg

SEQ ID NO: 221122 - DNA, 22 bp, Homo sapiens
tgaatgtccccattctataaat

SEQ ID NO: 221123 - DNA, 15 bp, Homo sapiens
tgaatgtcttccttt

SEQ ID NO: 221124 - DNA, 22 bp, Homo sapiens
tgaatgtcttccttttctttct

SEQ ID NO: 221125 - DNA, 14 bp, Homo sapiens
tgaatgtgtcacta

SEQ ID NO: 221126 - DNA, 16 bp, Homo sapiens
tgaatgttatatcatc

SEQ ID NO: 221127 - DNA, 19 bp, Homo sapiens
tgaatgttatatcatcaat

SEQ ID NO: 221128 - DNA, 23 bp, Homo sapiens
tgaatgttatttgttattttcag

SEQ ID NO: 221129 - DNA, 18 bp, Homo sapiens
tgaatgttctgacattaa

SEQ ID NO: 221130 - DNA, 21 bp, Homo sapiens
tgaatgttctgacattaacag

SEQ ID NO: 221131 - DNA, 16 bp, Homo sapiens
tgaattaaaaaagctc

SEQ ID NO: 221132 - DNA, 15 bp, Homo sapiens
tgaattaaataaata

SEQ ID NO: 221133 - DNA, 13 bp, Homo sapiens
tgaattacagtga

SEQ ID NO: 221134 - DNA, 19 bp, Homo sapiens
tgaattagaagaaaatgga

SEQ ID NO: 221135 - DNA, 21 bp, Homo sapiens
tgaattattttgttactgtct

SEQ ID NO: 221136 - DNA, 13 bp, Homo sapiens
tgaattcataaaa

SEQ ID NO: 221137 - DNA, 15 bp, Homo sapiens
tgaattcataaaaat

SEQ ID NO: 221138 - DNA, 17 bp, Homo sapiens
tgaattctgtgaagaat

SEQ ID NO: 221139 - DNA, 15 bp, Homo sapiens
tgaattgataataaa

SEQ ID NO: 221140 - DNA, 21 bp, Homo sapiens
tgaattgcattttttaaaaca

SEQ ID NO: 221141 - DNA, 21 bp, Homo sapiens
tgaattgtaaggaatgattaa

SEQ ID NO: 221142 - DNA, 15 bp, Homo sapiens
tgaatttaaatataa

SEQ ID NO: 221143 - DNA, 21 bp, Homo sapiens
gcctcccgtccgtccgcccgc

SEQ ID NO: 221144 - DNA, 18 bp, Homo sapiens
gcctccctcccctgccct

SEQ ID NO: 221145 - DNA, 15 bp, Homo sapiens
gcctccctctcttcc

SEQ ID NO: 221146 - DNA, 11 bp, Homo sapiens
gcctccctgaa

SEQ ID NO: 221147 - DNA, 21 bp, Homo sapiens
gcctccctggggaccaggagc

SEQ ID NO: 221148 - DNA, 13 bp, Homo sapiens
gcctcccttccca

SEQ ID NO: 221149 - DNA, 14 bp, Homo sapiens
gcctcccttccgct

SEQ ID NO: 221150 - DNA, 13 bp, Homo sapiens
gcctcccttcctc

SEQ ID NO: 221151 - DNA, 14 bp, Homo sapiens
gcctccgaggctcc

SEQ ID NO: 221152 - DNA, 14 bp, Homo sapiens
gcctccgcccaaat

SEQ ID NO: 221153 - DNA, 14 bp, Homo sapiens
gcctccggaagctg

SEQ ID NO: 221154 - DNA, 14 bp, Homo sapiens
gcctccggccctgc

SEQ ID NO: 221155 - DNA, 18 bp, Homo sapiens
gcctccggccctgcccca

SEQ ID NO: 221156 - DNA, 20 bp, Homo sapiens
gcctccgtttatgggccttg

SEQ ID NO: 221157 - DNA, 21 bp, Homo sapiens
gcctccgtttatgggccttgc

SEQ ID NO: 221158 - DNA, 13 bp, Homo sapiens
gcctcctcctgac

SEQ ID NO: 221159 - DNA, 20 bp, Homo sapiens
gcctcctctaacaggggctg

SEQ ID NO: 221160 - DNA, 16 bp, Homo sapiens
gcctcctctctccctg

SEQ ID NO: 221161 - DNA, 18 bp, Homo sapiens
gcctcctctctccctgcc

SEQ ID NO: 221162 - DNA, 22 bp, Homo sapiens
gcctcctctctccctgcctcac

SEQ ID NO: 221163 - DNA, 15 bp, Homo sapiens
gcctcctgagcctgt

SEQ ID NO: 221164 - DNA, 16 bp, Homo sapiens
gcctcctgagcctgtg

SEQ ID NO: 221165 - DNA, 17 bp, Homo sapiens
gcctcctgagcctgtgg

SEQ ID NO: 221166 - DNA, 18 bp, Homo sapiens
gcctcctgccccctgcca

SEQ ID NO: 221167 - DNA, 19 bp, Homo sapiens
gcctcctgccccctgccag

SEQ ID NO: 221168 - DNA, 14 bp, Homo sapiens
gcctcctgcctgcc

SEQ ID NO: 221169 - DNA, 17 bp, Homo sapiens
gcctcctgtttgcaggc

SEQ ID NO: 221170 - DNA, 16 bp, Homo sapiens
gcctccttatttatca

SEQ ID NO: 221171 - DNA, 17 bp, Homo sapiens
gcctccttccacctccc

SEQ ID NO: 221172 - DNA, 19 bp, Homo sapiens
gcctccttccacctccctc

SEQ ID NO: 221173 - DNA, 15 bp, Homo sapiens
gcctccttcccatgc

SEQ ID NO: 221174 - DNA, 19 bp, Homo sapiens
gcctccttcccatgcctgt

SEQ ID NO: 221175 - DNA, 18 bp, Homo sapiens
gcctccttgtccaggtct

SEQ ID NO: 221176 - DNA, 21 bp, Homo sapiens
gcctcgaactcctgggctcaa

SEQ ID NO: 221177 - DNA, 13 bp, Homo sapiens
gcctcgaggcacc

SEQ ID NO: 221178 - DNA, 15 bp, Homo sapiens
gcctcgaggcaccgg

SEQ ID NO: 221179 - DNA, 16 bp, Homo sapiens
gcctcgaggcaccggc

SEQ ID NO: 221180 - DNA, 14 bp, Homo sapiens
gcctcgcccctcca

SEQ ID NO: 221181 - DNA, 22 bp, Homo sapiens
gcctcggcagaactctctgtct

SEQ ID NO: 221182 - DNA, 23 bp, Homo sapiens
gcctcggcctcccaaagtgctgg

SEQ ID NO: 221183 - DNA, 14 bp, Homo sapiens
gcctcgggccgcct

SEQ ID NO: 221184 - DNA, 18 bp, Homo sapiens
gcctcgggccgcctcctc

SEQ ID NO: 221185 - DNA, 22 bp, Homo sapiens
gcctcgggccgcctcctccaga

SEQ ID NO: 221186 - DNA, 14 bp, Homo sapiens
gcctcggggcaggg

SEQ ID NO: 221187 - DNA, 23 bp, Homo sapiens
gcctcgtggttattagcaaggct

SEQ ID NO: 221188 - DNA, 14 bp, Homo sapiens
gcctctaaggccaa

SEQ ID NO: 221189 - DNA, 16 bp, Homo sapiens
gcctctacagccgtcc

SEQ ID NO: 221190 - DNA, 17 bp, Homo sapiens
gcctctacagccgtccc

SEQ ID NO: 221191 - DNA, 14 bp, Homo sapiens
gcctctcagtcaaa

SEQ ID NO: 221192 - DNA, 21 bp, Homo sapiens
gcctctcagtcaaacaagttg

SEQ ID NO: 221193 - DNA, 13 bp, Homo sapiens
gcctctccaaggg

SEQ ID NO: 221194 - DNA, 13 bp, Homo sapiens
gcctctcccaccc

SEQ ID NO: 221195 - DNA, 22 bp, Homo sapiens
gcctctcccacccggccacagc

SEQ ID NO: 221196 - DNA, 13 bp, Homo sapiens
gcctctcccggct

SEQ ID NO: 221197 - DNA, 18 bp, Homo sapiens
gcctctcccggctgcctg

SEQ ID NO: 221198 - DNA, 19 bp, Homo sapiens
gcctctcccggctgcctgc

SEQ ID NO: 221199 - DNA, 18 bp, Homo sapiens
gcctctccttgccccagt

SEQ ID NO: 221200 - DNA, 20 bp, Homo sapiens
gcctctctcaggagtatctt

SEQ ID NO: 221201 - DNA, 14 bp, Homo sapiens
gcctctctgctata

SEQ ID NO: 221202 - DNA, 12 bp, Homo sapiens
gcctctgaactg

SEQ ID NO: 221203 - DNA, 19 bp, Homo sapiens
gcctctgaactgctgctgg

SEQ ID NO: 221204 - DNA, 20 bp, Homo sapiens
gcctctgaactgctgctggt

SEQ ID NO: 221205 - DNA, 19 bp, Homo sapiens
gcctctgaagttggacagc

SEQ ID NO: 221206 - DNA, 19 bp, Homo sapiens
gcctctgacagcagcctgt

SEQ ID NO: 221207 - DNA, 21 bp, Homo sapiens
gcctctgacagcagcctgtga

SEQ ID NO: 221208 - DNA, 17 bp, Homo sapiens
gcctctgagccaggagc

SEQ ID NO: 221209 - DNA, 20 bp, Homo sapiens
gcctctgagccaggagcctc

SEQ ID NO: 221210 - DNA, 15 bp, Homo sapiens
gcctctgcattcagg

SEQ ID NO: 221211 - DNA, 19 bp, Homo sapiens
gcctctgccacactctgac

SEQ ID NO: 221212 - DNA, 16 bp, Homo sapiens
gcctctgccactgact

SEQ ID NO: 221213 - DNA, 14 bp, Homo sapiens
gcctctgccaggcc

SEQ ID NO: 221214 - DNA, 14 bp, Homo sapiens
gcctctgcccgcag

SEQ ID NO: 221215 - DNA, 17 bp, Homo sapiens
gcctctgcccgcagagc

SEQ ID NO: 221216 - DNA, 18 bp, Homo sapiens
gcctctgcccgcagagcc

SEQ ID NO: 221217 - DNA, 15 bp, Homo sapiens
gcctctgccctgcct

SEQ ID NO: 221218 - DNA, 15 bp, Homo sapiens
gcctctgcctccagg

SEQ ID NO: 221219 - DNA, 17 bp, Homo sapiens
gcctctgcctccaggag

SEQ ID NO: 221220 - DNA, 18 bp, Homo sapiens
gcctctgcctccaggagg

SEQ ID NO: 221221 - DNA, 20 bp, Homo sapiens
gcctctgcctccaggagggc

SEQ ID NO: 221222 - DNA, 14 bp, Homo sapiens
gcctctgcctccca

SEQ ID NO: 221223 - DNA, 16 bp, Homo sapiens
gcctctgcctcccagg

SEQ ID NO: 221224 - DNA, 18 bp, Homo sapiens
gcctctgccttagaggag

SEQ ID NO: 221225 - DNA, 20 bp, Homo sapiens
gcctctgccttgatggagaa

SEQ ID NO: 221226 - DNA, 12 bp, Homo sapiens
gcctctgctggc

SEQ ID NO: 221227 - DNA, 21 bp, Homo sapiens
gcctctggaggcctctgggcc

SEQ ID NO: 221228 - DNA, 17 bp, Homo sapiens
gcctctggattgtggga

SEQ ID NO: 221229 - DNA, 12 bp, Homo sapiens
gcctctggccag

SEQ ID NO: 221230 - DNA, 12 bp, Homo sapiens
gcctctggctag

SEQ ID NO: 221231 - DNA, 22 bp, Homo sapiens
gcctctggctagaggccagccc

SEQ ID NO: 221232 - DNA, 12 bp, Homo sapiens
gcctctggctgc

SEQ ID NO: 221233 - DNA, 20 bp, Homo sapiens
gcctctggctgcctggccca

SEQ ID NO: 221234 - DNA, 23 bp, Homo sapiens
gcctctggggagaccgagtgtgg

SEQ ID NO: 221235 - DNA, 12 bp, Homo sapiens
gcctctgggtga

SEQ ID NO: 221236 - DNA, 14 bp, Homo sapiens
gcctctgggtgagt

SEQ ID NO: 221237 - DNA, 17 bp, Homo sapiens
gcctctggtctgggtgc

SEQ ID NO: 221238 - DNA, 18 bp, Homo sapiens
gcctctggtgttcctggc

SEQ ID NO: 221239 - DNA, 17 bp, Homo sapiens
gcctctggttccactca

SEQ ID NO: 221240 - DNA, 22 bp, Homo sapiens
gcctcttaaaaattatctttaa

SEQ ID NO: 221241 - DNA, 18 bp, Homo sapiens
gcctcttaaagctgcctg

SEQ ID NO: 221242 - DNA, 14 bp, Homo sapiens
gcctcttccaccca

SEQ ID NO: 221243 - DNA, 21 bp, Homo sapiens
gcctcttcctccctccctgca

SEQ ID NO: 221244 - DNA, 22 bp, Homo sapiens
gcctcttcctccctccctgcag

SEQ ID NO: 221245 - DNA, 23 bp, Homo sapiens
gcctcttcctccctccctgcagg

SEQ ID NO: 221246 - DNA, 20 bp, Homo sapiens
gcctcttgagcagtggctgg

SEQ ID NO: 221247 - DNA, 20 bp, Homo sapiens
gcctcttgcggtcccttctt

SEQ ID NO: 221248 - DNA, 16 bp, Homo sapiens
gcctcttgggagacgt

SEQ ID NO: 221249 - DNA, 14 bp, Homo sapiens
gcctcttgtgctca

SEQ ID NO: 221250 - DNA, 20 bp, Homo sapiens
gcctctttaacagctttctc

SEQ ID NO: 221251 - DNA, 23 bp, Homo sapiens
gcctgaaagaggctgaggcctgg

SEQ ID NO: 221252 - DNA, 18 bp, Homo sapiens
gcctgaagttggagtgag

SEQ ID NO: 221253 - DNA, 16 bp, Homo sapiens
gcctgacaagtgaagt

SEQ ID NO: 221254 - DNA, 22 bp, Homo sapiens
gcctgacacaggggacactgaa

SEQ ID NO: 221255 - DNA, 20 bp, Homo sapiens
gcctgacactgagccccacc

SEQ ID NO: 221256 - DNA, 20 bp, Homo sapiens
gcctgaccccttgctccctt

SEQ ID NO: 221257 - DNA, 16 bp, Homo sapiens
gcctgacctgagactg

SEQ ID NO: 221258 - DNA, 21 bp, Homo sapiens
gcctgactaatttttgtattt

SEQ ID NO: 221259 - DNA, 22 bp, Homo sapiens
gcctgagaatttaatttttaaa

SEQ ID NO: 221260 - DNA, 13 bp, Homo sapiens
gcctgagccacag

SEQ ID NO: 221261 - DNA, 17 bp, Homo sapiens
gcctgagccacagtggg

SEQ ID NO: 221262 - DNA, 18 bp, Homo sapiens
gcctgagccacagtgggg

SEQ ID NO: 221263 - DNA, 21 bp, Homo sapiens
gcctgagccacagtggggccc

SEQ ID NO: 221264 - DNA, 17 bp, Homo sapiens
gcctgagcccaggagct

SEQ ID NO: 221265 - DNA, 17 bp, Homo sapiens
gcctgagctccaccctc

SEQ ID NO: 221266 - DNA, 19 bp, Homo sapiens
gcctgagctccaccctccc

SEQ ID NO: 221267 - DNA, 14 bp, Homo sapiens
gcctgagctggggc

SEQ ID NO: 221268 - DNA, 14 bp, Homo sapiens
gcctgaggcaggag

SEQ ID NO: 221269 - DNA, 15 bp, Homo sapiens
gcctgaggcaggaga

SEQ ID NO: 221270 - DNA, 17 bp, Homo sapiens
gcctgaggccttccaga

SEQ ID NO: 221271 - DNA, 20 bp, Homo sapiens
gcctgagggaagcccacccg

SEQ ID NO: 221272 - DNA, 18 bp, Homo sapiens
gcctgagtcagggcccag

SEQ ID NO: 221273 - DNA, 15 bp, Homo sapiens
gcctgagtctcctgt

SEQ ID NO: 221274 - DNA, 17 bp, Homo sapiens
gcctgatgctccctccc

SEQ ID NO: 221275 - DNA, 16 bp, Homo sapiens
gcctgatggagaggag

SEQ ID NO: 221276 - DNA, 14 bp, Homo sapiens
gcctgatggccaag

SEQ ID NO: 221277 - DNA, 14 bp, Homo sapiens
tgaatttcctatct

SEQ ID NO: 221278 - DNA, 15 bp, Homo sapiens
tgaatttctgccata

SEQ ID NO: 221279 - DNA, 14 bp, Homo sapiens
tgaatttctttgat

SEQ ID NO: 221280 - DNA, 18 bp, Homo sapiens
tgaatttctttgatttaa

SEQ ID NO: 221281 - DNA, 22 bp, Homo sapiens
tgaatttctttgatttaactga

SEQ ID NO: 221282 - DNA, 15 bp, Homo sapiens
tgaatttgaatgaaa

SEQ ID NO: 221283 - DNA, 14 bp, Homo sapiens
tgaatttgggcctc

SEQ ID NO: 221284 - DNA, 17 bp, Homo sapiens
tgaattttttaaatgaa

SEQ ID NO: 221285 - DNA, 21 bp, Homo sapiens
tgaattttttaaatgaaagaa

SEQ ID NO: 221286 - DNA, 23 bp, Homo sapiens
tgaattttttttttaaatgattc

SEQ ID NO: 221287 - DNA, 15 bp, Homo sapiens
tgacaaaaaggtgct

SEQ ID NO: 221288 - DNA, 16 bp, Homo sapiens
tgacaaaacctaactt

SEQ ID NO: 221289 - DNA, 18 bp, Homo sapiens
tgacaaaatttgttgaaa

SEQ ID NO: 221290 - DNA, 15 bp, Homo sapiens
tgacaaagaaaatga

SEQ ID NO: 221291 - DNA, 19 bp, Homo sapiens
tgacaaagaaaatgagaat

SEQ ID NO: 221292 - DNA, 15 bp, Homo sapiens
tgacaaaggatgaag

SEQ ID NO: 221293 - DNA, 13 bp, Homo sapiens
tgacaacagaagc

SEQ ID NO: 221294 - DNA, 12 bp, Homo sapiens
tgacaacatttt

SEQ ID NO: 221295 - DNA, 19 bp, Homo sapiens
tgacaaccaccgctcccca

SEQ ID NO: 221296 - DNA, 21 bp, Homo sapiens
tgacaaccaccgctccccagc

SEQ ID NO: 221297 - DNA, 16 bp, Homo sapiens
tgacaaccactggtct

SEQ ID NO: 221298 - DNA, 15 bp, Homo sapiens
tgacaacctttgtgt

SEQ ID NO: 221299 - DNA, 21 bp, Homo sapiens
tgacaacctttgtgtaataaa

SEQ ID NO: 221300 - DNA, 17 bp, Homo sapiens
tgacaactgaagagaca

SEQ ID NO: 221301 - DNA, 22 bp, Homo sapiens
tgacaactgtctaactttagaa

SEQ ID NO: 221302 - DNA, 22 bp, Homo sapiens
tgacaacttcccagtgaattct

SEQ ID NO: 221303 - DNA, 19 bp, Homo sapiens
tgacaacttctaattgcca

SEQ ID NO: 221304 - DNA, 13 bp, Homo sapiens
tgacaagccccag

SEQ ID NO: 221305 - DNA, 15 bp, Homo sapiens
tgacaagccccaggc

SEQ ID NO: 221306 - DNA, 18 bp, Homo sapiens
tgacaaggccccagagac

SEQ ID NO: 221307 - DNA, 20 bp, Homo sapiens
tgacaagtcattttaacttt

SEQ ID NO: 221308 - DNA, 14 bp, Homo sapiens
tgacaataaataat

SEQ ID NO: 221309 - DNA, 13 bp, Homo sapiens
tgacaataaattt

SEQ ID NO: 221310 - DNA, 18 bp, Homo sapiens
tgacaatcaactctaata

SEQ ID NO: 221311 - DNA, 14 bp, Homo sapiens
tgacaatggcagct

SEQ ID NO: 221312 - DNA, 15 bp, Homo sapiens
tgacaatttcaaaat

SEQ ID NO: 221313 - DNA, 18 bp, Homo sapiens
tgacaatttcaaaatgca

SEQ ID NO: 221314 - DNA, 23 bp, Homo sapiens
tgacacaaaggacaaaaatataa

SEQ ID NO: 221315 - DNA, 23 bp, Homo sapiens
tgacacactcaccatttaatcat

SEQ ID NO: 221316 - DNA, 16 bp, Homo sapiens
tgacacagcagcttca

SEQ ID NO: 221317 - DNA, 10 bp, Homo sapiens
tgacacagtt

SEQ ID NO: 221318 - DNA, 15 bp, Homo sapiens
tgacacataaaagta

SEQ ID NO: 221319 - DNA, 22 bp, Homo sapiens
tgacacataaatctgtctgatt

SEQ ID NO: 221320 - DNA, 21 bp, Homo sapiens
tgacacataatttgaatggtg

SEQ ID NO: 221321 - DNA, 21 bp, Homo sapiens
tgacacatgctctcaatatat

SEQ ID NO: 221322 - DNA, 20 bp, Homo sapiens
aagttgtttcaaacagcatc

SEQ ID NO: 221323 - DNA, 18 bp, Homo sapiens
aagtttacaagtgtatat

SEQ ID NO: 221324 - DNA, 12 bp, Homo sapiens
aagtttacagta

SEQ ID NO: 221325 - DNA, 19 bp, Homo sapiens
aagtttacagtaaataaat

SEQ ID NO: 221326 - DNA, 19 bp, Homo sapiens
aagtttacattgtaaatag

SEQ ID NO: 221327 - DNA, 17 bp, Homo sapiens
aagtttagattttaatc

SEQ ID NO: 221328 - DNA, 16 bp, Homo sapiens
aagtttatgtctaaag

SEQ ID NO: 221329 - DNA, 20 bp, Homo sapiens
aagtttcagtaatagctgaa

SEQ ID NO: 221330 - DNA, 21 bp, Homo sapiens
aagtttcctaatcagaaattt

SEQ ID NO: 221331 - DNA, 23 bp, Homo sapiens
aagtttctagctagaaatatgat

SEQ ID NO: 221332 - DNA, 14 bp, Homo sapiens
aagtttgctagtga

SEQ ID NO: 221333 - DNA, 22 bp, Homo sapiens
aagtttgtagtttttgctgaag

SEQ ID NO: 221334 - DNA, 19 bp, Homo sapiens
aagtttgtgttctgtttgt

SEQ ID NO: 221335 - DNA, 18 bp, Homo sapiens
aagttttaacttccagtg

SEQ ID NO: 221336 - DNA, 15 bp, Homo sapiens
aagttttccagtatt

SEQ ID NO: 221337 - DNA, 16 bp, Homo sapiens
aagttttccagtattg

SEQ ID NO: 221338 - DNA, 13 bp, Homo sapiens
aagttttctttta

SEQ ID NO: 221339 - DNA, 13 bp, Homo sapiens
aagttttgatgaa

SEQ ID NO: 221340 - DNA, 15 bp, Homo sapiens
aagttttgcatttat

SEQ ID NO: 221341 - DNA, 20 bp, Homo sapiens
aagttttgtataaataataa

SEQ ID NO: 221342 - DNA, 15 bp, Homo sapiens
aataaaaaacaagaa

SEQ ID NO: 221343 - DNA, 23 bp, Homo sapiens
aataaaaaagtgagcttttatat

SEQ ID NO: 221344 - DNA, 12 bp, Homo sapiens
aataaaaaggtt

SEQ ID NO: 221345 - DNA, 13 bp, Homo sapiens
aataaaaatagct

SEQ ID NO: 221346 - DNA, 11 bp, Homo sapiens
aataaaacata

SEQ ID NO: 221347 - DNA, 22 bp, Homo sapiens
aataaaacctttcaaatttcac

SEQ ID NO: 221348 - DNA, 17 bp, Homo sapiens
aataaaactgcacagtg

SEQ ID NO: 221349 - DNA, 20 bp, Homo sapiens
aataaaactgcacagtgctg

SEQ ID NO: 221350 - DNA, 12 bp, Homo sapiens
aataaaataaac

SEQ ID NO: 221351 - DNA, 12 bp, Homo sapiens
aataaaataacc

SEQ ID NO: 221352 - DNA, 12 bp, Homo sapiens
aataaaataagt

SEQ ID NO: 221353 - DNA, 19 bp, Homo sapiens
aataaaatatcattcagca

SEQ ID NO: 221354 - DNA, 20 bp, Homo sapiens
aataaaatatcattcagcaa

SEQ ID NO: 221355 - DNA, 19 bp, Homo sapiens
aataaaatgaggacatgtt

SEQ ID NO: 221356 - DNA, 13 bp, Homo sapiens
aataaaatgatgt

SEQ ID NO: 221357 - DNA, 19 bp, Homo sapiens
aataaaatgcactgaccat

SEQ ID NO: 221358 - DNA, 15 bp, Homo sapiens
aataaaatgcattta

SEQ ID NO: 221359 - DNA, 15 bp, Homo sapiens
aataaaattggcacc

SEQ ID NO: 221360 - DNA, 12 bp, Homo sapiens
aataaaattgta

SEQ ID NO: 221361 - DNA, 14 bp, Homo sapiens
aataaaattgtaaa

SEQ ID NO: 221362 - DNA, 18 bp, Homo sapiens
aataaacacatagattca

SEQ ID NO: 221363 - DNA, 20 bp, Homo sapiens
aataaacctcaaaatgtcta

SEQ ID NO: 221364 - DNA, 15 bp, Homo sapiens
aataaaccttgtttc

SEQ ID NO: 221365 - DNA, 21 bp, Homo sapiens
aataaaccttgtttctttctg

SEQ ID NO: 221366 - DNA, 15 bp, Homo sapiens
aataaacgaaacatt

SEQ ID NO: 221367 - DNA, 18 bp, Homo sapiens
aataaacgaaacatttag

SEQ ID NO: 221368 - DNA, 20 bp, Homo sapiens
aataaactagggttttggcc

SEQ ID NO: 221369 - DNA, 21 bp, Homo sapiens
aataaactagggttttggcct

SEQ ID NO: 221370 - DNA, 15 bp, Homo sapiens
aataaactattggaa

SEQ ID NO: 221371 - DNA, 22 bp, Homo sapiens
aataaactgtcctctttcagaa

SEQ ID NO: 221372 - DNA, 17 bp, Homo sapiens
aataaactgtgtttact

SEQ ID NO: 221373 - DNA, 16 bp, Homo sapiens
aataaacttaacttta

SEQ ID NO: 221374 - DNA, 14 bp, Homo sapiens
aataaagcaaatat

SEQ ID NO: 221375 - DNA, 18 bp, Homo sapiens
aataaagcactattgttt

SEQ ID NO: 221376 - DNA, 13 bp, Homo sapiens
aataaagccacat

SEQ ID NO: 221377 - DNA, 11 bp, Homo sapiens
aataaagctgg

SEQ ID NO: 221378 - DNA, 12 bp, Homo sapiens
aataaagctgga

SEQ ID NO: 221379 - DNA, 22 bp, Homo sapiens
aataaagctggacaagaagctg

SEQ ID NO: 221380 - DNA, 22 bp, Homo sapiens
aataaaggctgagtttagtttt

SEQ ID NO: 221381 - DNA, 19 bp, Homo sapiens
aataaagtacgtgtttact

SEQ ID NO: 221382 - DNA, 15 bp, Homo sapiens
aataaagtatcatgc

SEQ ID NO: 221383 - DNA, 18 bp, Homo sapiens
aataaagtatcatgcatt

SEQ ID NO: 221384 - DNA, 16 bp, Homo sapiens
aataaagtcctcttcc

SEQ ID NO: 221385 - DNA, 15 bp, Homo sapiens
aataaagtctctttt

SEQ ID NO: 221386 - DNA, 20 bp, Homo sapiens
aataaagttacttgaatttc

SEQ ID NO: 221387 - DNA, 13 bp, Homo sapiens
aataaataatatt

SEQ ID NO: 221388 - DNA, 16 bp, Homo sapiens
aataaataatattata

SEQ ID NO: 221389 - DNA, 11 bp, Homo sapiens
aataaatatac

SEQ ID NO: 221390 - DNA, 12 bp, Homo sapiens
aataaatatact

SEQ ID NO: 221391 - DNA, 15 bp, Homo sapiens
aataaatatactaat

SEQ ID NO: 221392 - DNA, 18 bp, Homo sapiens
aataaatatactaataaa

SEQ ID NO: 221393 - DNA, 19 bp, Homo sapiens
aataaatatactaataaaa

SEQ ID NO: 221394 - DNA, 20 bp, Homo sapiens
aataaatatactaataaaaa

SEQ ID NO: 221395 - DNA, 15 bp, Homo sapiens
aataaatcatgttaa

SEQ ID NO: 221396 - DNA, 22 bp, Homo sapiens
aataaatctaaatgattatctt

SEQ ID NO: 221397 - DNA, 19 bp, Homo sapiens
aataaatctcttctttgct

SEQ ID NO: 221398 - DNA, 15 bp, Homo sapiens
aataaatgaccagtt

SEQ ID NO: 221399 - DNA, 16 bp, Homo sapiens
aataaatgaccagttt

SEQ ID NO: 221400 - DNA, 14 bp, Homo sapiens
aataaattgaaatt

SEQ ID NO: 221401 - DNA, 18 bp, Homo sapiens
aataaattggtgataagt

SEQ ID NO: 221402 - DNA, 20 bp, Homo sapiens
aataaattggtgataagtgg

SEQ ID NO: 221403 - DNA, 13 bp, Homo sapiens
aataaattgtttg

SEQ ID NO: 221404 - DNA, 13 bp, Homo sapiens
aataaatttaact

SEQ ID NO: 221405 - DNA, 19 bp, Homo sapiens
aataaatttataacaattg

SEQ ID NO: 221406 - DNA, 21 bp, Homo sapiens
aataaatttggttctaataga

SEQ ID NO: 221407 - DNA, 19 bp, Homo sapiens
aataacaacaatttaggaa

SEQ ID NO: 221408 - DNA, 20 bp, Homo sapiens
aataacacacatataaacat

SEQ ID NO: 221409 - DNA, 18 bp, Homo sapiens
aataacacagatattgtt

SEQ ID NO: 221410 - DNA, 19 bp, Homo sapiens
aataacactgcagccctct

SEQ ID NO: 221411 - DNA, 18 bp, Homo sapiens
aataacatattcttgctt

SEQ ID NO: 221412 - DNA, 12 bp, Homo sapiens
aataacattgca

SEQ ID NO: 221413 - DNA, 20 bp, Homo sapiens
aataaccaattcctcatttg

SEQ ID NO: 221414 - DNA, 21 bp, Homo sapiens
aataaccacttaaaaaatgtc

SEQ ID NO: 221415 - DNA, 17 bp, Homo sapiens
tgacccttcagggccag

SEQ ID NO: 221416 - DNA, 21 bp, Homo sapiens
tgaccgcacgttctctgcccc

SEQ ID NO: 221417 - DNA, 13 bp, Homo sapiens
tgaccgcccagct

SEQ ID NO: 221418 - DNA, 16 bp, Homo sapiens
tgaccgcccagctctc

SEQ ID NO: 221419 - DNA, 17 bp, Homo sapiens
tgaccgcccagctctcc

SEQ ID NO: 221420 - DNA, 22 bp, Homo sapiens
tgaccgcccagctctcccacat

SEQ ID NO: 221421 - DNA, 14 bp, Homo sapiens
tgaccggaggcaaa

SEQ ID NO: 221422 - DNA, 23 bp, Homo sapiens
tgacctacagggaactgggaaga

SEQ ID NO: 221423 - DNA, 13 bp, Homo sapiens
tgacctactctca

SEQ ID NO: 221424 - DNA, 18 bp, Homo sapiens
tgacctcaacctgtgatg

SEQ ID NO: 221425 - DNA, 14 bp, Homo sapiens
tgacctcagctgca

SEQ ID NO: 221426 - DNA, 16 bp, Homo sapiens
tgacctcagctgcaca

SEQ ID NO: 221427 - DNA, 19 bp, Homo sapiens
tgacctcaggtgatccgcc

SEQ ID NO: 221428 - DNA, 20 bp, Homo sapiens
tgacctcaggtgatccgcct

SEQ ID NO: 221429 - DNA, 17 bp, Homo sapiens
tgacctcccactttggg

SEQ ID NO: 221430 - DNA, 19 bp, Homo sapiens
tgacctcccactttgggga

SEQ ID NO: 221431 - DNA, 13 bp, Homo sapiens
tgacctccccacc

SEQ ID NO: 221432 - DNA, 14 bp, Homo sapiens
tgacctccctctaa

SEQ ID NO: 221433 - DNA, 17 bp, Homo sapiens
tgacctctgaagagctg

SEQ ID NO: 221434 - DNA, 19 bp, Homo sapiens
tgacctctgttgtcctccc

SEQ ID NO: 221435 - DNA, 21 bp, Homo sapiens
tgacctctgttgtcctcccct

SEQ ID NO: 221436 - DNA, 16 bp, Homo sapiens
tgacctgaactctgca

SEQ ID NO: 221437 - DNA, 23 bp, Homo sapiens
tgacctgcccctgccgcctgtgc

SEQ ID NO: 221438 - DNA, 21 bp, Homo sapiens
tgacctgctccgccaggaaag

SEQ ID NO: 221439 - DNA, 21 bp, Homo sapiens
tgacctgctgggtaaactgtg

SEQ ID NO: 221440 - DNA, 21 bp, Homo sapiens
tgacctgtggggatttctccc

SEQ ID NO: 221441 - DNA, 15 bp, Homo sapiens
tgaccttagcgttct

SEQ ID NO: 221442 - DNA, 21 bp, Homo sapiens
tgaccttagcgttctggactc

SEQ ID NO: 221443 - DNA, 21 bp, Homo sapiens
tgaccttcctctggggctcta

SEQ ID NO: 221444 - DNA, 14 bp, Homo sapiens
tgaccttctgaaca

SEQ ID NO: 221445 - DNA, 18 bp, Homo sapiens
tgaccttgaactcctggg

SEQ ID NO: 221446 - DNA, 17 bp, Homo sapiens
tgaccttgacgtgtgtg

SEQ ID NO: 221447 - DNA, 20 bp, Homo sapiens
tgaccttgatgtcttgagag

SEQ ID NO: 221448 - DNA, 21 bp, Homo sapiens
tgaccttggaggaatgacaat

SEQ ID NO: 221449 - DNA, 15 bp, Homo sapiens
tgacctttaagagaa

SEQ ID NO: 221450 - DNA, 20 bp, Homo sapiens
tgacctttgaggtctaaaca

SEQ ID NO: 221451 - DNA, 20 bp, Homo sapiens
tgaccttttgacttaaagca

SEQ ID NO: 221452 - DNA, 22 bp, Homo sapiens
tgagagcaaagggaaggactga

SEQ ID NO: 221453 - DNA, 14 bp, Homo sapiens
tgagagcacaaaga

SEQ ID NO: 221454 - DNA, 17 bp, Homo sapiens
tgagagcatgtggggga

SEQ ID NO: 221455 - DNA, 15 bp, Homo sapiens
tgagagcgaggctga

SEQ ID NO: 221456 - DNA, 19 bp, Homo sapiens
tgagagcgaggctgagcct

SEQ ID NO: 221457 - DNA, 16 bp, Homo sapiens
tgagagctgctgaggg

SEQ ID NO: 221458 - DNA, 20 bp, Homo sapiens
tgagaggaggggtaaatata

SEQ ID NO: 221459 - DNA, 15 bp, Homo sapiens
tgagaggatgaatgt

SEQ ID NO: 221460 - DNA, 20 bp, Homo sapiens
tgagaggcaatgattgttaa

SEQ ID NO: 221461 - DNA, 14 bp, Homo sapiens
tgagaggcagaagt

SEQ ID NO: 221462 - DNA, 20 bp, Homo sapiens
tgagaggtgggggatgctga

SEQ ID NO: 221463 - DNA, 22 bp, Homo sapiens
tgagaggtgggggatgctgagg

SEQ ID NO: 221464 - DNA, 17 bp, Homo sapiens
tgagagtagagtcactg

SEQ ID NO: 221465 - DNA, 14 bp, Homo sapiens
tgagataatttaac

SEQ ID NO: 221466 - DNA, 16 bp, Homo sapiens
tgagatagaagatgtt

SEQ ID NO: 221467 - DNA, 19 bp, Homo sapiens
tgagatagtagcatacatt

SEQ ID NO: 221468 - DNA, 20 bp, Homo sapiens
tgagatatatctttatactt

SEQ ID NO: 221469 - DNA, 15 bp, Homo sapiens
tgagatatttattgt

SEQ ID NO: 221470 - DNA, 20 bp, Homo sapiens
tgagatatttattgtttatt

SEQ ID NO: 221471 - DNA, 17 bp, Homo sapiens
tgagatcacagcctcca

SEQ ID NO: 221472 - DNA, 22 bp, Homo sapiens
tgagatcacagcctccagggcc

SEQ ID NO: 221473 - DNA, 16 bp, Homo sapiens
tgagatcagcattcaa

SEQ ID NO: 221474 - DNA, 20 bp, Homo sapiens
tgagatctaagcctttccat

SEQ ID NO: 221475 - DNA, 22 bp, Homo sapiens
tgagatgagccccacgtggagc

SEQ ID NO: 221476 - DNA, 12 bp, Homo sapiens
tgagatgcacca

SEQ ID NO: 221477 - DNA, 21 bp, Homo sapiens
tgagatgcaccaagtacagcc

SEQ ID NO: 221478 - DNA, 16 bp, Homo sapiens
tgagatggccatgctc

SEQ ID NO: 221479 - DNA, 19 bp, Homo sapiens
tgagatgtaggctccacct

SEQ ID NO: 221480 - DNA, 17 bp, Homo sapiens
tgagattagagggaggt

SEQ ID NO: 221481 - DNA, 16 bp, Homo sapiens
tgagattctgggaaag

SEQ ID NO: 221482 - DNA, 19 bp, Homo sapiens
tgagattctgggaaaggtg

SEQ ID NO: 221483 - DNA, 22 bp, Homo sapiens
tgagattctgggaaaggtgctc

SEQ ID NO: 221484 - DNA, 14 bp, Homo sapiens
tgagatttgccagc

SEQ ID NO: 221485 - DNA, 14 bp, Homo sapiens
tgagattttggtat

SEQ ID NO: 221486 - DNA, 17 bp, Homo sapiens
tgagcaaacctgcccca

SEQ ID NO: 221487 - DNA, 20 bp, Homo sapiens
tgagcaaacctgccccatcc

SEQ ID NO: 221488 - DNA, 21 bp, Homo sapiens
tgagcaaactgaagcccacag

SEQ ID NO: 221489 - DNA, 19 bp, Homo sapiens
tgagcaaatgtggctcctg

SEQ ID NO: 221490 - DNA, 13 bp, Homo sapiens
tgagcaaggacat

SEQ ID NO: 221491 - DNA, 18 bp, Homo sapiens
tgagcaaggacattgccc

SEQ ID NO: 221492 - DNA, 23 bp, Homo sapiens
tgagcaaggacattgccccaaga

SEQ ID NO: 221493 - DNA, 21 bp, Homo sapiens
tgagcaaggcaagaagtggga

SEQ ID NO: 221494 - DNA, 15 bp, Homo sapiens
tgagcaagtcccatc

SEQ ID NO: 221495 - DNA, 17 bp, Homo sapiens
tgagcaccgtcatggct

SEQ ID NO: 221496 - DNA, 14 bp, Homo sapiens
tgagcacctccagc

SEQ ID NO: 221497 - DNA, 15 bp, Homo sapiens
tgagcactcctgatt

SEQ ID NO: 221498 - DNA, 21 bp, Homo sapiens
tgagcagactggtgagcagac

SEQ ID NO: 221499 - DNA, 23 bp, Homo sapiens
tgagcagactggtgagcagactg

SEQ ID NO: 221500 - DNA, 20 bp, Homo sapiens
tgagcagcctccactgtgtc

SEQ ID NO: 221501 - DNA, 23 bp, Homo sapiens
tgagcagcctccactgtgtccag

SEQ ID NO: 221502 - DNA, 16 bp, Homo sapiens
tgagcaggaaggcctg

SEQ ID NO: 221503 - DNA, 17 bp, Homo sapiens
tgagcaggaaggcctgg

SEQ ID NO: 221504 - DNA, 22 bp, Homo sapiens
tgagcagtctacttctgtgtct

SEQ ID NO: 221505 - DNA, 17 bp, Homo sapiens
tgagcagtggggagcgg

SEQ ID NO: 221506 - DNA, 21 bp, Homo sapiens
tgagcagtggggagcgggggc

SEQ ID NO: 221507 - DNA, 18 bp, Homo sapiens
tgagcagtgtgtctcctg

SEQ ID NO: 221508 - DNA, 16 bp, Homo sapiens
tgagcatctgtctcaa

SEQ ID NO: 221509 - DNA, 16 bp, Homo sapiens
tgagccacagtggggc

SEQ ID NO: 221510 - DNA, 12 bp, Homo sapiens
tgagccaccacg

SEQ ID NO: 221511 - DNA, 19 bp, Homo sapiens
tgagccaccgcgagggcct

SEQ ID NO: 221512 - DNA, 14 bp, Homo sapiens
tgagccagacaaat

SEQ ID NO: 221513 - DNA, 13 bp, Homo sapiens
tgagccaggagcc

SEQ ID NO: 221514 - DNA, 14 bp, Homo sapiens
tgagccaggagcct

SEQ ID NO: 221515 - DNA, 18 bp, Homo sapiens
tgagccaggagcctcctg

SEQ ID NO: 221516 - DNA, 14 bp, Homo sapiens
tgagccagtcccag

SEQ ID NO: 221517 - DNA, 16 bp, Homo sapiens
tgagcccacaaagcct

SEQ ID NO: 221518 - DNA, 23 bp, Homo sapiens
tgagcccagaagctcaaggctgc

SEQ ID NO: 221519 - DNA, 22 bp, Homo sapiens
tgagcccaggaagtccagaacg

SEQ ID NO: 221520 - DNA, 22 bp, Homo sapiens
tgagcccaggagctgagtcacc

SEQ ID NO: 221521 - DNA, 22 bp, Homo sapiens
tgagcccaggagtttgagacaa

SEQ ID NO: 221522 - DNA, 14 bp, Homo sapiens
tgagcccaggccgt

SEQ ID NO: 221523 - DNA, 21 bp, Homo sapiens
tgagccccagaggcagaggtt

SEQ ID NO: 221524 - DNA, 17 bp, Homo sapiens
tgagcccccacctgcct

SEQ ID NO: 221525 - DNA, 13 bp, Homo sapiens
tgagccccctctc

SEQ ID NO: 221526 - DNA, 15 bp, Homo sapiens
tgagccccctctcct

SEQ ID NO: 221527 - DNA, 21 bp, Homo sapiens
tgagccccctgcacccacccc

SEQ ID NO: 221528 - DNA, 13 bp, Homo sapiens
tgagccccctgtg

SEQ ID NO: 221529 - DNA, 17 bp, Homo sapiens
tgagccccctgtgccca

SEQ ID NO: 221530 - DNA, 18 bp, Homo sapiens
tgagccccctgtgcccac

SEQ ID NO: 221531 - DNA, 18 bp, Homo sapiens
tgagcccctccccagcca

SEQ ID NO: 221532 - DNA, 12 bp, Homo sapiens
tgagcccctcct

SEQ ID NO: 221533 - DNA, 13 bp, Homo sapiens
tgagcccctggga

SEQ ID NO: 221534 - DNA, 19 bp, Homo sapiens
tgagcccgaatttctcact

SEQ ID NO: 221535 - DNA, 17 bp, Homo sapiens
tgagcccggatgcttct

SEQ ID NO: 221536 - DNA, 22 bp, Homo sapiens
tgagccctcctggaatggagct

SEQ ID NO: 221537 - DNA, 21 bp, Homo sapiens
tgagccctccttcttgccctg

SEQ ID NO: 221538 - DNA, 14 bp, Homo sapiens
tgagcccttgcaca

SEQ ID NO: 221539 - DNA, 17 bp, Homo sapiens
tgagccgtgcagctggg

SEQ ID NO: 221540 - DNA, 20 bp, Homo sapiens
tgagcctactgtctccttcc

SEQ ID NO: 221541 - DNA, 12 bp, Homo sapiens
tgagcctctcct

SEQ ID NO: 221542 - DNA, 20 bp, Homo sapiens
tgagcctctttaacagcttt

SEQ ID NO: 221543 - DNA, 23 bp, Homo sapiens
tgagcctctttaacagctttctc

SEQ ID NO: 221544 - DNA, 14 bp, Homo sapiens
tgagcctgagcaga

SEQ ID NO: 221545 - DNA, 19 bp, Homo sapiens
tgagcctgaggccttccag

SEQ ID NO: 221546 - DNA, 18 bp, Homo sapiens
tgagcctgcccgctgcaa

SEQ ID NO: 221547 - DNA, 21 bp, Homo sapiens
tgagcctgcccgctgcaatgc

SEQ ID NO: 221548 - DNA, 11 bp, Homo sapiens
tgagcctgtct

SEQ ID NO: 221549 - DNA, 13 bp, Homo sapiens
tgagcctgtctct

SEQ ID NO: 221550 - DNA, 14 bp, Homo sapiens
tgagcctgtctctc

SEQ ID NO: 221551 - DNA, 21 bp, Homo sapiens
tgagccttagaatctgtagag

SEQ ID NO: 221552 - DNA, 21 bp, Homo sapiens
tgagcgccccgcccccacccc

SEQ ID NO: 221553 - DNA, 22 bp, Homo sapiens
tgagcgccccgcccccacccct

SEQ ID NO: 221554 - DNA, 18 bp, Homo sapiens
tgagcggccgcctgtcct

SEQ ID NO: 221555 - DNA, 20 bp, Homo sapiens
tgagcggccgcctgtccttg

SEQ ID NO: 221556 - DNA, 17 bp, Homo sapiens
aatatactaaccatttc

SEQ ID NO: 221557 - DNA, 22 bp, Homo sapiens
aatatactaaccatttcttatg

SEQ ID NO: 221558 - DNA, 15 bp, Homo sapiens
aatatactaataaaa

SEQ ID NO: 221559 - DNA, 21 bp, Homo sapiens
aatatactaataaaaaggttt

SEQ ID NO: 221560 - DNA, 11 bp, Homo sapiens
aatatactcag

SEQ ID NO: 221561 - DNA, 16 bp, Homo sapiens
aatatactcagggatt

SEQ ID NO: 221562 - DNA, 21 bp, Homo sapiens
aatatagttaattgtggcttt

SEQ ID NO: 221563 - DNA, 17 bp, Homo sapiens
aatatagttgaacaaga

SEQ ID NO: 221564 - DNA, 21 bp, Homo sapiens
aatatagttgtctttctttgc

SEQ ID NO: 221565 - DNA, 18 bp, Homo sapiens
aatatataaaaagaaaag

SEQ ID NO: 221566 - DNA, 16 bp, Homo sapiens
aatatataataaatgg

SEQ ID NO: 221567 - DNA, 21 bp, Homo sapiens
aatatataatggtttactgct

SEQ ID NO: 221568 - DNA, 12 bp, Homo sapiens
aatatatatgta

SEQ ID NO: 221569 - DNA, 14 bp, Homo sapiens
aatatatattctgg

SEQ ID NO: 221570 - DNA, 22 bp, Homo sapiens
aatatatgtttggctgaaatta

SEQ ID NO: 221571 - DNA, 17 bp, Homo sapiens
aatatatgttttgagaa

SEQ ID NO: 221572 - DNA, 16 bp, Homo sapiens
aatatattaaaaatat

SEQ ID NO: 221573 - DNA, 22 bp, Homo sapiens
aatatattaaaaatataaacaa

SEQ ID NO: 221574 - DNA, 15 bp, Homo sapiens
aatatattaccagca

SEQ ID NO: 221575 - DNA, 20 bp, Homo sapiens
aatatattaccagcaagaat

SEQ ID NO: 221576 - DNA, 23 bp, Homo sapiens
aatatattaccagcaagaataaa

SEQ ID NO: 221577 - DNA, 21 bp, Homo sapiens
aatatattgccagtatataag

SEQ ID NO: 221578 - DNA, 15 bp, Homo sapiens
aatatatttaagata

SEQ ID NO: 221579 - DNA, 20 bp, Homo sapiens
aatatcaaaaaggagctctt

SEQ ID NO: 221580 - DNA, 23 bp, Homo sapiens
aatatcaacaacaagttgtttca

SEQ ID NO: 221581 - DNA, 17 bp, Homo sapiens
tgagctgggccctgggt

SEQ ID NO: 221582 - DNA, 12 bp, Homo sapiens
tgagctggggcc

SEQ ID NO: 221583 - DNA, 23 bp, Homo sapiens
tgagctgtgttttgtctgagcct

SEQ ID NO: 221584 - DNA, 13 bp, Homo sapiens
tgagctgttatct

SEQ ID NO: 221585 - DNA, 20 bp, Homo sapiens
tgagcttagccttgtgccct

SEQ ID NO: 221586 - DNA, 24 bp, Homo sapiens
tgagcttgagctcccctggagcca

SEQ ID NO: 221587 - DNA, 22 bp, Homo sapiens
tgagcttgattctaaaggggac

SEQ ID NO: 221588 - DNA, 13 bp, Homo sapiens
tgagcttggccag

SEQ ID NO: 221589 - DNA, 19 bp, Homo sapiens
tgagcttggccagaagggg

SEQ ID NO: 221590 - DNA, 17 bp, Homo sapiens
tgagctttggacacaca

SEQ ID NO: 221591 - DNA, 22 bp, Homo sapiens
tgagctttggacacacacagct

SEQ ID NO: 221592 - DNA, 19 bp, Homo sapiens
tgagctttggacgcacaca

SEQ ID NO: 221593 - DNA, 23 bp, Homo sapiens
tgagctttggacgcacacagctt

SEQ ID NO: 221594 - DNA, 21 bp, Homo sapiens
tgagctttggggacagttggc

SEQ ID NO: 221595 - DNA, 14 bp, Homo sapiens
tgagctttgttact

SEQ ID NO: 221596 - DNA, 23 bp, Homo sapiens
tgagcttttcagttaagttgctg

SEQ ID NO: 221597 - DNA, 11 bp, Homo sapiens
tgaggaataaa

SEQ ID NO: 221598 - DNA, 16 bp, Homo sapiens
tgaggaatgatgaagc

SEQ ID NO: 221599 - DNA, 18 bp, Homo sapiens
tgaggaatgctctgtgcc

SEQ ID NO: 221600 - DNA, 12 bp, Homo sapiens
tgaggacacatg

SEQ ID NO: 221601 - DNA, 14 bp, Homo sapiens
tgaggacaggcccc

SEQ ID NO: 221602 - DNA, 22 bp, Homo sapiens
tgaggacctccacctgggagat

SEQ ID NO: 221603 - DNA, 23 bp, Homo sapiens
tgaggacctccacctgggagatg

SEQ ID NO: 221604 - DNA, 15 bp, Homo sapiens
tgaggacctttctga

SEQ ID NO: 221605 - DNA, 17 bp, Homo sapiens
tgaggacggggcagagc

SEQ ID NO: 221606 - DNA, 16 bp, Homo sapiens
tgaggagctgctggct

SEQ ID NO: 221607 - DNA, 21 bp, Homo sapiens
tgaggaggaaggagagaaggg

SEQ ID NO: 221608 - DNA, 16 bp, Homo sapiens
tgaggaggaggcagaa

SEQ ID NO: 221609 - DNA, 19 bp, Homo sapiens
tgaggagggggaggacgga

SEQ ID NO: 221610 - DNA, 13 bp, Homo sapiens
tgaggagggtgga

SEQ ID NO: 221611 - DNA, 15 bp, Homo sapiens
tgaggagtccaaaat

SEQ ID NO: 221612 - DNA, 21 bp, Homo sapiens
tgaggatgacccggggcagct

SEQ ID NO: 221613 - DNA, 20 bp, Homo sapiens
tgaggatgagacagggtttt

SEQ ID NO: 221614 - DNA, 15 bp, Homo sapiens
tgaggatgcactggc

SEQ ID NO: 221615 - DNA, 16 bp, Homo sapiens
tgaggattttgagtat

SEQ ID NO: 221616 - DNA, 15 bp, Homo sapiens
tgaggcaaccccctc

SEQ ID NO: 221617 - DNA, 22 bp, Homo sapiens
tgaggcaaccccctcggagcct

SEQ ID NO: 221618 - DNA, 18 bp, Homo sapiens
tgaggcacctgcatatct

SEQ ID NO: 221619 - DNA, 17 bp, Homo sapiens
tgaggcagaacctggtg

SEQ ID NO: 221620 - DNA, 19 bp, Homo sapiens
tgaggcagaacctggtggc

SEQ ID NO: 221621 - DNA, 20 bp, Homo sapiens
tgaggcagaacctggtggct

SEQ ID NO: 221622 - DNA, 12 bp, Homo sapiens
tgaggcaggaga

SEQ ID NO: 221623 - DNA, 17 bp, Homo sapiens
tgaggcaggggagtctg

SEQ ID NO: 221624 - DNA, 23 bp, Homo sapiens
tgaggcaggggagtctgcttgtc

SEQ ID NO: 221625 - DNA, 20 bp, Homo sapiens
tgaggccattccctgtagga

SEQ ID NO: 221626 - DNA, 21 bp, Homo sapiens
tgaggccattccctgtaggag

SEQ ID NO: 221627 - DNA, 16 bp, Homo sapiens
tgaggcccactctgtt

SEQ ID NO: 221628 - DNA, 15 bp, Homo sapiens
tgaggcccagagagc

SEQ ID NO: 221629 - DNA, 18 bp, Homo sapiens
tgaggcccagagagctga

SEQ ID NO: 221630 - DNA, 17 bp, Homo sapiens
tgaggcccagcagagcc

SEQ ID NO: 221631 - DNA, 12 bp, Homo sapiens
tgaggcccagcc

SEQ ID NO: 221632 - DNA, 17 bp, Homo sapiens
tgaggcccagcctgtcc

SEQ ID NO: 221633 - DNA, 19 bp, Homo sapiens
tgaggcccagcctgtcctg

SEQ ID NO: 221634 - DNA, 14 bp, Homo sapiens
tgaggcccagggag

SEQ ID NO: 221635 - DNA, 13 bp, Homo sapiens
tgaggccccaggc

SEQ ID NO: 221636 - DNA, 21 bp, Homo sapiens
tgaggccccagggctgtgggt

SEQ ID NO: 221637 - DNA, 23 bp, Homo sapiens
tgaggccccagggctgtgggtgg

SEQ ID NO: 221638 - DNA, 12 bp, Homo sapiens
tgaggcccccgg

SEQ ID NO: 221639 - DNA, 22 bp, Homo sapiens
tgaggcccccggaggcgcccac

SEQ ID NO: 221640 - DNA, 23 bp, Homo sapiens
tgaggcccccggaggcgcccacc

SEQ ID NO: 221641 - DNA, 16 bp, Homo sapiens
tgaggccgctagaggc

SEQ ID NO: 221642 - DNA, 18 bp, Homo sapiens
tgaggccgctagaggcct

SEQ ID NO: 221643 - DNA, 23 bp, Homo sapiens
tgaggcctggactttcctgcaac

SEQ ID NO: 221644 - DNA, 16 bp, Homo sapiens
tgaggcggcagctggg

SEQ ID NO: 221645 - DNA, 22 bp, Homo sapiens
tgaggcggcagctggggccgga

SEQ ID NO: 221646 - DNA, 22 bp, Homo sapiens
tgaggcgtgggatccagagaga

SEQ ID NO: 221647 - DNA, 16 bp, Homo sapiens
tgaggcgttctcctgc

SEQ ID NO: 221648 - DNA, 14 bp, Homo sapiens
tgaggctaaaacaa

SEQ ID NO: 221649 - DNA, 20 bp, Homo sapiens
tgaggctatggagggtcctc

SEQ ID NO: 221650 - DNA, 18 bp, Homo sapiens
tgaggctgtcctgtacat

SEQ ID NO: 221651 - DNA, 14 bp, Homo sapiens
tgaggcttccaggc

SEQ ID NO: 221652 - DNA, 15 bp, Homo sapiens
tgaggcttccaggct

SEQ ID NO: 221653 - DNA, 21 bp, Homo sapiens
tgaggcttccaggctcttcct

SEQ ID NO: 221654 - DNA, 22 bp, Homo sapiens
tgaggcttccaggctcttcctg

SEQ ID NO: 221655 - DNA, 23 bp, Homo sapiens
tgaggcttttcccaccagctccc

SEQ ID NO: 221656 - DNA, 15 bp, Homo sapiens
tgagggaagcccacc

SEQ ID NO: 221657 - DNA, 16 bp, Homo sapiens
tgagggaagcccaccc

SEQ ID NO: 221658 - DNA, 22 bp, Homo sapiens
tgagggacaaatttaaaacaaa

SEQ ID NO: 221659 - DNA, 20 bp, Homo sapiens
tgagggacatgctcacctct

SEQ ID NO: 221660 - DNA, 15 bp, Homo sapiens
tgagggaccttggag

SEQ ID NO: 221661 - DNA, 19 bp, Homo sapiens
tgagggactgcctctgcca

SEQ ID NO: 221662 - DNA, 21 bp, Homo sapiens
tgagggagggggcgctcagga

SEQ ID NO: 221663 - DNA, 15 bp, Homo sapiens
tgagggagtgcagaa

SEQ ID NO: 221664 - DNA, 23 bp, Homo sapiens
tgagggagtgcagaacacctggc

SEQ ID NO: 221665 - DNA, 21 bp, Homo sapiens
tgagggatgccataccttgag

SEQ ID NO: 221666 - DNA, 14 bp, Homo sapiens
tgagggcccctctg

SEQ ID NO: 221667 - DNA, 21 bp, Homo sapiens
tgagggcccctctgcccagct

SEQ ID NO: 221668 - DNA, 17 bp, Homo sapiens
tgagggcgaggggaggg

SEQ ID NO: 221669 - DNA, 17 bp, Homo sapiens
tgagggctgagagggct

SEQ ID NO: 221670 - DNA, 13 bp, Homo sapiens
tgaggggccaggc

SEQ ID NO: 221671 - DNA, 22 bp, Homo sapiens
tgaggggctggccttcctgccc

SEQ ID NO: 221672 - DNA, 20 bp, Homo sapiens
tgaggggtatatctgggctg

SEQ ID NO: 221673 - DNA, 18 bp, Homo sapiens
tgagggtaataaacttag

SEQ ID NO: 221674 - DNA, 21 bp, Homo sapiens
tgagggtaataaacttagaat

SEQ ID NO: 221675 - DNA, 12 bp, Homo sapiens
tgagggtcttct

SEQ ID NO: 221676 - DNA, 12 bp, Homo sapiens
tgagggtgactg

SEQ ID NO: 221677 - DNA, 13 bp, Homo sapiens
tgagggtgactgt

SEQ ID NO: 221678 - DNA, 20 bp, Homo sapiens
tgaggtcaagtaagaagaca

SEQ ID NO: 221679 - DNA, 16 bp, Homo sapiens
tgaggtcaggagttcc

SEQ ID NO: 221680 - DNA, 13 bp, Homo sapiens
tgaggtcatcccg

SEQ ID NO: 221681 - DNA, 22 bp, Homo sapiens
tgaggtcatcccggggccatgg

SEQ ID NO: 221682 - DNA, 23 bp, Homo sapiens
tgaggtcatcccggggccatgga

SEQ ID NO: 221683 - DNA, 21 bp, Homo sapiens
tgaggtcatttctaaggtgtg

SEQ ID NO: 221684 - DNA, 17 bp, Homo sapiens
tgaggtctcttgaggga

SEQ ID NO: 221685 - DNA, 15 bp, Homo sapiens
tgaggtctgctcggc

SEQ ID NO: 221686 - DNA, 16 bp, Homo sapiens
tgaggtctgctcggcc

SEQ ID NO: 221687 - DNA, 23 bp, Homo sapiens
tgaggtctgctcggccgtcttca

SEQ ID NO: 221688 - DNA, 13 bp, Homo sapiens
tgaggtctggatt

SEQ ID NO: 221689 - DNA, 19 bp, Homo sapiens
tgaggtcttgagtttcatt

SEQ ID NO: 221690 - DNA, 19 bp, Homo sapiens
tgaggtcttttgacatgtg

SEQ ID NO: 221691 - DNA, 20 bp, Homo sapiens
tgaggtcttttgacatgtgg

SEQ ID NO: 221692 - DNA, 15 bp, Homo sapiens
tgaggtgaatgtctt

SEQ ID NO: 221693 - DNA, 19 bp, Homo sapiens
gcctgcacacacctgcctg

SEQ ID NO: 221694 - DNA, 16 bp, Homo sapiens
gcctgcaccaggagac

SEQ ID NO: 221695 - DNA, 21 bp, Homo sapiens
gcctgcacctgcgcctggctc

SEQ ID NO: 221696 - DNA, 13 bp, Homo sapiens
gcctgcagcccag

SEQ ID NO: 221697 - DNA, 18 bp, Homo sapiens
gcctgcagcggcacaaat

SEQ ID NO: 221698 - DNA, 18 bp, Homo sapiens
gcctgcaggccccagcca

SEQ ID NO: 221699 - DNA, 24 bp, Homo sapiens
gcctgcagggtggtgctgggactg

SEQ ID NO: 221700 - DNA, 14 bp, Homo sapiens
gcctgcattcgcag

SEQ ID NO: 221701 - DNA, 15 bp, Homo sapiens
gcctgcattcgcagc

SEQ ID NO: 221702 - DNA, 14 bp, Homo sapiens
gcctgccaatgcca

SEQ ID NO: 221703 - DNA, 19 bp, Homo sapiens
gcctgccaatgccacagcc

SEQ ID NO: 221704 - DNA, 10 bp, Homo sapiens
gcctgcccac

SEQ ID NO: 221705 - DNA, 13 bp, Homo sapiens
gcctgcccacccg

SEQ ID NO: 221706 - DNA, 14 bp, Homo sapiens
gcctgcccacccgt

SEQ ID NO: 221707 - DNA, 17 bp, Homo sapiens
gcctgccccaaacaaat

SEQ ID NO: 221708 - DNA, 23 bp, Homo sapiens
gcctgccccaaacaaatatgcaa

SEQ ID NO: 221709 - DNA, 15 bp, Homo sapiens
gcctgccccagctgg

SEQ ID NO: 221710 - DNA, 14 bp, Homo sapiens
gcctgccccccttc

SEQ ID NO: 221711 - DNA, 22 bp, Homo sapiens
gcctgccccccttcccacccct

SEQ ID NO: 221712 - DNA, 14 bp, Homo sapiens
gcctgcccctctcc

SEQ ID NO: 221713 - DNA, 15 bp, Homo sapiens
gcctgcccgcacagc

SEQ ID NO: 221714 - DNA, 19 bp, Homo sapiens
gcctgcccgcacagcagcc

SEQ ID NO: 221715 - DNA, 20 bp, Homo sapiens
gcctgcccgcacagcagcct

SEQ ID NO: 221716 - DNA, 21 bp, Homo sapiens
gcctgcccgttgccgggcctg

SEQ ID NO: 221717 - DNA, 22 bp, Homo sapiens
gcctgcccgttgccgggcctgg

SEQ ID NO: 221718 - DNA, 21 bp, Homo sapiens
gcctgccctccccagagcact

SEQ ID NO: 221719 - DNA, 14 bp, Homo sapiens
gcctgccgtgcatg

SEQ ID NO: 221720 - DNA, 13 bp, Homo sapiens
gcctgcctcccaa

SEQ ID NO: 221721 - DNA, 15 bp, Homo sapiens
gcctgcctccggccc

SEQ ID NO: 221722 - DNA, 23 bp, Homo sapiens
gcctgcctccggccctgccccac

SEQ ID NO: 221723 - DNA, 12 bp, Homo sapiens
gcctgcctggga

SEQ ID NO: 221724 - DNA, 14 bp, Homo sapiens
gcctgcctgggaac

SEQ ID NO: 221725 - DNA, 15 bp, Homo sapiens
gcctgccttcgttaa

SEQ ID NO: 221726 - DNA, 19 bp, Homo sapiens
gcctgccttctgggcaagg

SEQ ID NO: 221727 - DNA, 18 bp, Homo sapiens
gcctgcgaaacccagcgt

SEQ ID NO: 221728 - DNA, 19 bp, Homo sapiens
gcctgcgcctgcacctgcg

SEQ ID NO: 221729 - DNA, 20 bp, Homo sapiens
gcctgcgcctgcacctgcgc

SEQ ID NO: 221730 - DNA, 20 bp, Homo sapiens
gcctgcgctcctctgcagcc

SEQ ID NO: 221731 - DNA, 21 bp, Homo sapiens
gcctgcgctcctctgcagcct

SEQ ID NO: 221732 - DNA, 18 bp, Homo sapiens
gcctgcggactccatggc

SEQ ID NO: 221733 - DNA, 22 bp, Homo sapiens
gcctgcggactccatggccctt

SEQ ID NO: 221734 - DNA, 14 bp, Homo sapiens
gcctgcggctgctg

SEQ ID NO: 221735 - DNA, 15 bp, Homo sapiens
gcctgcggctgctgg

SEQ ID NO: 221736 - DNA, 17 bp, Homo sapiens
gcctgcgtcatggctca

SEQ ID NO: 221737 - DNA, 14 bp, Homo sapiens
gcctgcgtggcctg

SEQ ID NO: 221738 - DNA, 19 bp, Homo sapiens
gcctgcgtggcctggggct

SEQ ID NO: 221739 - DNA, 21 bp, Homo sapiens
gcctgcgtggcctggggctgc

SEQ ID NO: 221740 - DNA, 18 bp, Homo sapiens
gcctgctagagcaacccc

SEQ ID NO: 221741 - DNA, 23 bp, Homo sapiens
gcctgctagagcaacccctgtac

SEQ ID NO: 221742 - DNA, 15 bp, Homo sapiens
gcctgctatccagcc

SEQ ID NO: 221743 - DNA, 16 bp, Homo sapiens
gcctgctcccagcagc

SEQ ID NO: 221744 - DNA, 14 bp, Homo sapiens
gcctgctccttggc

SEQ ID NO: 221745 - DNA, 19 bp, Homo sapiens
gcctgctctccttgccctg

SEQ ID NO: 221746 - DNA, 20 bp, Homo sapiens
gcctgctctccttgccctgg

SEQ ID NO: 221747 - DNA, 18 bp, Homo sapiens
gcctgctgcatggggtgg

SEQ ID NO: 221748 - DNA, 19 bp, Homo sapiens
gcctgctgcgtcagaccag

SEQ ID NO: 221749 - DNA, 22 bp, Homo sapiens
gcctgctgggaaccccgcagcc

SEQ ID NO: 221750 - DNA, 13 bp, Homo sapiens
gcctgctgtgggt

SEQ ID NO: 221751 - DNA, 13 bp, Homo sapiens
gcctgcttcccac

SEQ ID NO: 221752 - DNA, 21 bp, Homo sapiens
gcctgcttcccacctccctgc

SEQ ID NO: 221753 - DNA, 23 bp, Homo sapiens
gcctgcttcccacctccctgccc

SEQ ID NO: 221754 - DNA, 15 bp, Homo sapiens
gcctgcttttccagg

SEQ ID NO: 221755 - DNA, 15 bp, Homo sapiens
gcctggaaccaggga

SEQ ID NO: 221756 - DNA, 16 bp, Homo sapiens
gcctggacaaaccctt

SEQ ID NO: 221757 - DNA, 11 bp, Homo sapiens
gcctggacctg

SEQ ID NO: 221758 - DNA, 15 bp, Homo sapiens
gcctggacctgcctc

SEQ ID NO: 221759 - DNA, 15 bp, Homo sapiens
gcctggactttcctg

SEQ ID NO: 221760 - DNA, 16 bp, Homo sapiens
gcctggactttcctgc

SEQ ID NO: 221761 - DNA, 13 bp, Homo sapiens
gcctggagcccct

SEQ ID NO: 221762 - DNA, 21 bp, Homo sapiens
gcctggagcccctgtgtggga

SEQ ID NO: 221763 - DNA, 12 bp, Homo sapiens
gcctggatctcc

SEQ ID NO: 221764 - DNA, 21 bp, Homo sapiens
gcctggatgccaaggagcccc

SEQ ID NO: 221765 - DNA, 18 bp, Homo sapiens
gcctggcaagtgggtgaa

SEQ ID NO: 221766 - DNA, 14 bp, Homo sapiens
gcctggcacagggc

SEQ ID NO: 221767 - DNA, 18 bp, Homo sapiens
gcctggcacagggcagtg

SEQ ID NO: 221768 - DNA, 16 bp, Homo sapiens
gcctggcacccactcc

SEQ ID NO: 221769 - DNA, 12 bp, Homo sapiens
gcctggcagccg

SEQ ID NO: 221770 - DNA, 20 bp, Homo sapiens
gcctggcagccgtgccttca

SEQ ID NO: 221771 - DNA, 21 bp, Homo sapiens
gcctggcagccgtgccttcag

SEQ ID NO: 221772 - DNA, 14 bp, Homo sapiens
gcctggcaggtgga

SEQ ID NO: 221773 - DNA, 18 bp, Homo sapiens
gcctggccacctctctcc

SEQ ID NO: 221774 - DNA, 18 bp, Homo sapiens
gcctggccacgcagccag

SEQ ID NO: 221775 - DNA, 19 bp, Homo sapiens
gcctggccacgcagccagg

SEQ ID NO: 221776 - DNA, 15 bp, Homo sapiens
gcctggccaggcaga

SEQ ID NO: 221777 - DNA, 23 bp, Homo sapiens
gcctggccaggcagatctgtgcc

SEQ ID NO: 221778 - DNA, 17 bp, Homo sapiens
gcctggcccacgccctc

SEQ ID NO: 221779 - DNA, 15 bp, Homo sapiens
gcctggcccagccag

SEQ ID NO: 221780 - DNA, 16 bp, Homo sapiens
gcctggcccagccagc

SEQ ID NO: 221781 - DNA, 17 bp, Homo sapiens
gcctggcccagccagca

SEQ ID NO: 221782 - DNA, 16 bp, Homo sapiens
gcctggcccagggagg

SEQ ID NO: 221783 - DNA, 20 bp, Homo sapiens
gcctggcccccctccaggca

SEQ ID NO: 221784 - DNA, 12 bp, Homo sapiens
gcctggccctgc

SEQ ID NO: 221785 - DNA, 17 bp, Homo sapiens
gcctggccctgccctga

SEQ ID NO: 221786 - DNA, 23 bp, Homo sapiens
gcctggcctcggggcagggcagg

SEQ ID NO: 221787 - DNA, 17 bp, Homo sapiens
gcctggcctgagctggg

SEQ ID NO: 221788 - DNA, 18 bp, Homo sapiens
gcctggcctgagctgggg

SEQ ID NO: 221789 - DNA, 13 bp, Homo sapiens
gcctggcctggct

SEQ ID NO: 221790 - DNA, 13 bp, Homo sapiens
gcctggcctgggt

SEQ ID NO: 221791 - DNA, 12 bp, Homo sapiens
gcctggcctggt

SEQ ID NO: 221792 - DNA, 14 bp, Homo sapiens
gcctggcgggcagc

SEQ ID NO: 221793 - DNA, 16 bp, Homo sapiens
gcctggcgggcagccc

SEQ ID NO: 221794 - DNA, 18 bp, Homo sapiens
gcctggcgggcagcccct

SEQ ID NO: 221795 - DNA, 20 bp, Homo sapiens
gcctggcgggcagcccctgc

SEQ ID NO: 221796 - DNA, 21 bp, Homo sapiens
gcctggcgggcagcccctgct

SEQ ID NO: 221797 - DNA, 15 bp, Homo sapiens
gcctggctccaggct

SEQ ID NO: 221798 - DNA, 16 bp, Homo sapiens
gcctggctccaggctc

SEQ ID NO: 221799 - DNA, 20 bp, Homo sapiens
gcctggctccaggctccagg

SEQ ID NO: 221800 - DNA, 19 bp, Homo sapiens
gcctggctccgctgtgtgg

SEQ ID NO: 221801 - DNA, 16 bp, Homo sapiens
gcctggctgtggaggc

SEQ ID NO: 221802 - DNA, 17 bp, Homo sapiens
gcctggctgtggaggcc

SEQ ID NO: 221803 - DNA, 21 bp, Homo sapiens
gcctggctgtggaggcctgat

SEQ ID NO: 221804 - DNA, 17 bp, Homo sapiens
gcctggcttgctccagg

SEQ ID NO: 221805 - DNA, 18 bp, Homo sapiens
gcctggcttgctccaggg

SEQ ID NO: 221806 - DNA, 19 bp, Homo sapiens
gcctggcttgctccagggt

SEQ ID NO: 221807 - DNA, 21 bp, Homo sapiens
gcctggcttgctccagggtct

SEQ ID NO: 221808 - DNA, 21 bp, Homo sapiens
gcctgggaaccttcctgtctt

SEQ ID NO: 221809 - DNA, 15 bp, Homo sapiens
gcctgggacccagct

SEQ ID NO: 221810 - DNA, 16 bp, Homo sapiens
gcctgggacccagcta

SEQ ID NO: 221811 - DNA, 21 bp, Homo sapiens
gcctgggagggtggttcctgt

SEQ ID NO: 221812 - DNA, 17 bp, Homo sapiens
gcctgggatcagtgggg

SEQ ID NO: 221813 - DNA, 20 bp, Homo sapiens
gcctgggcaacagagcaaga

SEQ ID NO: 221814 - DNA, 17 bp, Homo sapiens
gcctgggcagccaggct

SEQ ID NO: 221815 - DNA, 15 bp, Homo sapiens
gcctgggccactggc

SEQ ID NO: 221816 - DNA, 16 bp, Homo sapiens
gcctgggccactggca

SEQ ID NO: 221817 - DNA, 14 bp, Homo sapiens
gcctgggccagaga

SEQ ID NO: 221818 - DNA, 13 bp, Homo sapiens
gcctgggcctgct

SEQ ID NO: 221819 - DNA, 17 bp, Homo sapiens
gcctgggcctgtgcagc

SEQ ID NO: 221820 - DNA, 22 bp, Homo sapiens
gcctgggcctgtgcagcagccc

SEQ ID NO: 221821 - DNA, 23 bp, Homo sapiens
gcctgggctcccttgtgcgtggg

SEQ ID NO: 221822 - DNA, 20 bp, Homo sapiens
gcctggggatgtaaccaagc

SEQ ID NO: 221823 - DNA, 14 bp, Homo sapiens
gcctggggcctggc

SEQ ID NO: 221824 - DNA, 22 bp, Homo sapiens
gcctggggctcctttctccagc

SEQ ID NO: 221825 - DNA, 13 bp, Homo sapiens
gcctggggctgcc

SEQ ID NO: 221826 - DNA, 14 bp, Homo sapiens
gcctggggctgccg

SEQ ID NO: 221827 - DNA, 17 bp, Homo sapiens
tgaggtgctgggaggga

SEQ ID NO: 221828 - DNA, 13 bp, Homo sapiens
tgaggtgggcaga

SEQ ID NO: 221829 - DNA, 21 bp, Homo sapiens
tgaggtgggggtctggcctag

SEQ ID NO: 221830 - DNA, 14 bp, Homo sapiens
tgaggtggtctgaa

SEQ ID NO: 221831 - DNA, 21 bp, Homo sapiens
tgaggtggtctgaatgttctg

SEQ ID NO: 221832 - DNA, 18 bp, Homo sapiens
tgaggttaaggggatcta

SEQ ID NO: 221833 - DNA, 21 bp, Homo sapiens
tgaggttcagcaaggtgagag

SEQ ID NO: 221834 - DNA, 24 bp, Homo sapiens
tgaggttcagcaaggtgagagagg

SEQ ID NO: 221835 - DNA, 20 bp, Homo sapiens
tgagtaaataaactcttcaa

SEQ ID NO: 221836 - DNA, 21 bp, Homo sapiens
tgagtaaataaactcttcaag

SEQ ID NO: 221837 - DNA, 14 bp, Homo sapiens
tgagtaagagctgg

SEQ ID NO: 221838 - DNA, 13 bp, Homo sapiens
tgagtaatttaaa

SEQ ID NO: 221839 - DNA, 16 bp, Homo sapiens
tgagtacagtgaggag

SEQ ID NO: 221840 - DNA, 21 bp, Homo sapiens
aatcataacatagttgaaaaa

SEQ ID NO: 221841 - DNA, 19 bp, Homo sapiens
aatcatattgatgaaaaga

SEQ ID NO: 221842 - DNA, 14 bp, Homo sapiens
aatcatcttctctt

SEQ ID NO: 221843 - DNA, 16 bp, Homo sapiens
aatcatgaaatatgca

SEQ ID NO: 221844 - DNA, 19 bp, Homo sapiens
aatcatgtgggtgagccag

SEQ ID NO: 221845 - DNA, 22 bp, Homo sapiens
aatcattatttattaaattttt

SEQ ID NO: 221846 - DNA, 18 bp, Homo sapiens
aatcattcaaaactttca

SEQ ID NO: 221847 - DNA, 14 bp, Homo sapiens
aatcattcaatatc

SEQ ID NO: 221848 - DNA, 18 bp, Homo sapiens
aatcattcaatatctgac

SEQ ID NO: 221849 - DNA, 22 bp, Homo sapiens
aatcattgctttgaagcagttg

SEQ ID NO: 221850 - DNA, 14 bp, Homo sapiens
aatcattgtagaaa

SEQ ID NO: 221851 - DNA, 17 bp, Homo sapiens
aatcatttatcttatct

SEQ ID NO: 221852 - DNA, 19 bp, Homo sapiens
aatcattttaattattatt

SEQ ID NO: 221853 - DNA, 20 bp, Homo sapiens
aatcattttaattattattc

SEQ ID NO: 221854 - DNA, 19 bp, Homo sapiens
aatcattttgcctcttttc

SEQ ID NO: 221855 - DNA, 16 bp, Homo sapiens
aatccacaaatatgct

SEQ ID NO: 221856 - DNA, 18 bp, Homo sapiens
aatccacaagccattttt

SEQ ID NO: 221857 - DNA, 13 bp, Homo sapiens
aatccacacatca

SEQ ID NO: 221858 - DNA, 17 bp, Homo sapiens
aatccacgctcatcttg

SEQ ID NO: 221859 - DNA, 22 bp, Homo sapiens
aatccagaattgaccttttgac

SEQ ID NO: 221860 - DNA, 20 bp, Homo sapiens
aatccagccccatagaaaac

SEQ ID NO: 221861 - DNA, 17 bp, Homo sapiens
aatccagtgcttccaca

SEQ ID NO: 221862 - DNA, 20 bp, Homo sapiens
aatccataccccctgcccca

SEQ ID NO: 221863 - DNA, 13 bp, Homo sapiens
aatccatatctta

SEQ ID NO: 221864 - DNA, 22 bp, Homo sapiens
aatccattttctaaactgtttt

SEQ ID NO: 221865 - DNA, 15 bp, Homo sapiens
aatcccagcactttg

SEQ ID NO: 221866 - DNA, 22 bp, Homo sapiens
aatcccagggaaggacttggag

SEQ ID NO: 221867 - DNA, 14 bp, Homo sapiens
aatcccagttcatg

SEQ ID NO: 221868 - DNA, 17 bp, Homo sapiens
aatcccctaaacaaaaa

SEQ ID NO: 221869 - DNA, 14 bp, Homo sapiens
aatccccttctccc

SEQ ID NO: 221870 - DNA, 19 bp, Homo sapiens
aatcccggtttcagaagct

SEQ ID NO: 221871 - DNA, 12 bp, Homo sapiens
aatccctgttca

SEQ ID NO: 221872 - DNA, 23 bp, Homo sapiens
aatccggttttagttgagtcttc

SEQ ID NO: 221873 - DNA, 15 bp, Homo sapiens
aatcctaaaagaagc

SEQ ID NO: 221874 - DNA, 14 bp, Homo sapiens
aatcctaccaaagt

SEQ ID NO: 221875 - DNA, 16 bp, Homo sapiens
aatcctaccaacctct

SEQ ID NO: 221876 - DNA, 19 bp, Homo sapiens
aatcctagacttgaaagtt

SEQ ID NO: 221877 - DNA, 16 bp, Homo sapiens
aatcctcactgggtgg

SEQ ID NO: 221878 - DNA, 14 bp, Homo sapiens
aatcctccccacca

SEQ ID NO: 221879 - DNA, 18 bp, Homo sapiens
aatcctccctacttccaa

SEQ ID NO: 221880 - DNA, 23 bp, Homo sapiens
aatcctcctgagtgatcccattt

SEQ ID NO: 221881 - DNA, 21 bp, Homo sapiens
aatcctgaggggatatcccta

SEQ ID NO: 221882 - DNA, 11 bp, Homo sapiens
aatcctgcctc

SEQ ID NO: 221883 - DNA, 16 bp, Homo sapiens
aatcctggctctgatt

SEQ ID NO: 221884 - DNA, 20 bp, Homo sapiens
aatcctgttacttaaatagc

SEQ ID NO: 221885 - DNA, 21 bp, Homo sapiens
aatccttctaactaaactaaa

SEQ ID NO: 221886 - DNA, 19 bp, Homo sapiens
aatcgaggaaccagagcca

SEQ ID NO: 221887 - DNA, 14 bp, Homo sapiens
aatcgattggcttt

SEQ ID NO: 221888 - DNA, 16 bp, Homo sapiens
aatcggtgcagcggtg

SEQ ID NO: 221889 - DNA, 19 bp, Homo sapiens
aatcgtacattttgcttgc

SEQ ID NO: 221890 - DNA, 19 bp, Homo sapiens
aatctaaatagatactttt

SEQ ID NO: 221891 - DNA, 20 bp, Homo sapiens
aatctaaatgattatcttga

SEQ ID NO: 221892 - DNA, 12 bp, Homo sapiens
aatctaaattaa

SEQ ID NO: 221893 - DNA, 14 bp, Homo sapiens
aatctaaattaact

SEQ ID NO: 221894 - DNA, 18 bp, Homo sapiens
aatctacgatgttaaaac

SEQ ID NO: 221895 - DNA, 15 bp, Homo sapiens
aatctactagaacct

SEQ ID NO: 221896 - DNA, 16 bp, Homo sapiens
aatctactgagccacg

SEQ ID NO: 221897 - DNA, 12 bp, Homo sapiens
aatctagagcta

SEQ ID NO: 221898 - DNA, 17 bp, Homo sapiens
aatctagagctatgcac

SEQ ID NO: 221899 - DNA, 18 bp, Homo sapiens
aatctagtttacagaaaa

SEQ ID NO: 221900 - DNA, 19 bp, Homo sapiens
aatctagttttttttgtaa

SEQ ID NO: 221901 - DNA, 21 bp, Homo sapiens
aatctatagtatagaatgaac

SEQ ID NO: 221902 - DNA, 13 bp, Homo sapiens
aatctattcagac

SEQ ID NO: 221903 - DNA, 18 bp, Homo sapiens
aatctattgggttcatta

SEQ ID NO: 221904 - DNA, 13 bp, Homo sapiens
aatctattttcag

SEQ ID NO: 221905 - DNA, 22 bp, Homo sapiens
aatctcaccccatcccacaccc

SEQ ID NO: 221906 - DNA, 22 bp, Homo sapiens
aatctcagaggtagggctgcca

SEQ ID NO: 221907 - DNA, 20 bp, Homo sapiens
aatctcagcactttgtttca

SEQ ID NO: 221908 - DNA, 23 bp, Homo sapiens
aatctcataggttgccaataata

SEQ ID NO: 221909 - DNA, 18 bp, Homo sapiens
aatctccagggctgcccc

SEQ ID NO: 221910 - DNA, 19 bp, Homo sapiens
aatctccagggctgcccct

SEQ ID NO: 221911 - DNA, 20 bp, Homo sapiens
aatctccagggctgcccctg

SEQ ID NO: 221912 - DNA, 21 bp, Homo sapiens
aatctccagggctgcccctgt

SEQ ID NO: 221913 - DNA, 15 bp, Homo sapiens
aatctccagtattct

SEQ ID NO: 221914 - DNA, 16 bp, Homo sapiens
aatctctaaaattcta

SEQ ID NO: 221915 - DNA, 15 bp, Homo sapiens
aatctctcaaaatgt

SEQ ID NO: 221916 - DNA, 22 bp, Homo sapiens
aatctctcaaaatgtgccgtct

SEQ ID NO: 221917 - DNA, 14 bp, Homo sapiens
aatctctctctgtt

SEQ ID NO: 221918 - DNA, 11 bp, Homo sapiens
aatctctgtga

SEQ ID NO: 221919 - DNA, 14 bp, Homo sapiens
aatctctgttctgc

SEQ ID NO: 221920 - DNA, 21 bp, Homo sapiens
aatctctgttctgctcccaga

SEQ ID NO: 221921 - DNA, 21 bp, Homo sapiens
aatctcttctaaaaaaaaaca

SEQ ID NO: 221922 - DNA, 13 bp, Homo sapiens
aatctgaaacaca

SEQ ID NO: 221923 - DNA, 15 bp, Homo sapiens
aatctgaactctcaa

SEQ ID NO: 221924 - DNA, 21 bp, Homo sapiens
aatctgagggcactctctgcc

SEQ ID NO: 221925 - DNA, 22 bp, Homo sapiens
aatctgatcacccccctgctta

SEQ ID NO: 221926 - DNA, 20 bp, Homo sapiens
aatctgatcccataaagaaa

SEQ ID NO: 221927 - DNA, 22 bp, Homo sapiens
aatctgatcccataaagaaagt

SEQ ID NO: 221928 - DNA, 18 bp, Homo sapiens
aatctgattaatccattt

SEQ ID NO: 221929 - DNA, 20 bp, Homo sapiens
aatctgcatttagcacaaaa

SEQ ID NO: 221930 - DNA, 13 bp, Homo sapiens
aatctgccttcca

SEQ ID NO: 221931 - DNA, 14 bp, Homo sapiens
aatctgccttccag

SEQ ID NO: 221932 - DNA, 21 bp, Homo sapiens
aatctgctgttgccatagccc

SEQ ID NO: 221933 - DNA, 15 bp, Homo sapiens
aatctggactcctct

SEQ ID NO: 221934 - DNA, 19 bp, Homo sapiens
aatctggctcctgtttcca

SEQ ID NO: 221935 - DNA, 21 bp, Homo sapiens
aatctgggtggtaactgccag

SEQ ID NO: 221936 - DNA, 18 bp, Homo sapiens
aatctgtaaaaaagaaaa

SEQ ID NO: 221937 - DNA, 20 bp, Homo sapiens
aatctgtagaggagcctgga

SEQ ID NO: 221938 - DNA, 22 bp, Homo sapiens
aatctgtagaggagcctggagt

SEQ ID NO: 221939 - DNA, 22 bp, Homo sapiens
aatctgtagcataggctagtgg

SEQ ID NO: 221940 - DNA, 17 bp, Homo sapiens
aatctgtctgattctat

SEQ ID NO: 221941 - DNA, 12 bp, Homo sapiens
aatctgtgatga

SEQ ID NO: 221942 - DNA, 15 bp, Homo sapiens
aatctgttgtttgaa

SEQ ID NO: 221943 - DNA, 17 bp, Homo sapiens
aatctgtttgatccctg

SEQ ID NO: 221944 - DNA, 16 bp, Homo sapiens
aatcttaccagatgct

SEQ ID NO: 221945 - DNA, 20 bp, Homo sapiens
aatcttaccagatgctactg

SEQ ID NO: 221946 - DNA, 14 bp, Homo sapiens
aatcttagaacaga

SEQ ID NO: 221947 - DNA, 21 bp, Homo sapiens
aatcttatcatggtctcagtc

SEQ ID NO: 221948 - DNA, 13 bp, Homo sapiens
aatcttatgttga

SEQ ID NO: 221949 - DNA, 11 bp, Homo sapiens
aatcttcagct

SEQ ID NO: 221950 - DNA, 13 bp, Homo sapiens
aatcttcagctgg

SEQ ID NO: 221951 - DNA, 14 bp, Homo sapiens
aatcttcagctggt

SEQ ID NO: 221952 - DNA, 15 bp, Homo sapiens
aatcttcagctggtg

SEQ ID NO: 221953 - DNA, 17 bp, Homo sapiens
aatcttcagctggtgga

SEQ ID NO: 221954 - DNA, 22 bp, Homo sapiens
aatcttcagttttatctttaat

SEQ ID NO: 221955 - DNA, 12 bp, Homo sapiens
aatcttctactt

SEQ ID NO: 221956 - DNA, 23 bp, Homo sapiens
aatcttgctgtgaaacagtgtgg

SEQ ID NO: 221957 - DNA, 15 bp, Homo sapiens
aatcttgtcatgtgt

SEQ ID NO: 221958 - DNA, 18 bp, Homo sapiens
aatcttgtgctagaatac

SEQ ID NO: 221959 - DNA, 18 bp, Homo sapiens
aatctttattttattatt

SEQ ID NO: 221960 - DNA, 21 bp, Homo sapiens
aatctttattttattattcag

SEQ ID NO: 221961 - DNA, 16 bp, Homo sapiens
aatctttccatctcat

SEQ ID NO: 221962 - DNA, 15 bp, Homo sapiens
aatctttctatataa

SEQ ID NO: 221963 - DNA, 20 bp, Homo sapiens
aatctttctatataaaatgt

SEQ ID NO: 221964 - DNA, 15 bp, Homo sapiens
tgatatttccttcac

SEQ ID NO: 221965 - DNA, 16 bp, Homo sapiens
tgatatttcttgcttt

SEQ ID NO: 221966 - DNA, 19 bp, Homo sapiens
tgatattttcaacgcagcc

SEQ ID NO: 221967 - DNA, 22 bp, Homo sapiens
tgatattttcaacgcagccctg

SEQ ID NO: 221968 - DNA, 16 bp, Homo sapiens
tgatcaaattcatttt

SEQ ID NO: 221969 - DNA, 15 bp, Homo sapiens
tgatcaataaaatgt

SEQ ID NO: 221970 - DNA, 20 bp, Homo sapiens
gcctgggggcagtgactggc

SEQ ID NO: 221971 - DNA, 22 bp, Homo sapiens
gcctgggggcagtgactggcag

SEQ ID NO: 221972 - DNA, 16 bp, Homo sapiens
gcctgggtctgtgtct

SEQ ID NO: 221973 - DNA, 19 bp, Homo sapiens
gcctgggtctgtgtctctt

SEQ ID NO: 221974 - DNA, 20 bp, Homo sapiens
gcctgggtgacagagcaaga

SEQ ID NO: 221975 - DNA, 20 bp, Homo sapiens
gcctgggtgagaatcctgcc

SEQ ID NO: 221976 - DNA, 23 bp, Homo sapiens
gcctgggtgagaatcctgcctct

SEQ ID NO: 221977 - DNA, 17 bp, Homo sapiens
gcctgggtgctggctgc

SEQ ID NO: 221978 - DNA, 23 bp, Homo sapiens
gcctgggtggatcggcctcctct

SEQ ID NO: 221979 - DNA, 14 bp, Homo sapiens
gcctggtagagact

SEQ ID NO: 221980 - DNA, 14 bp, Homo sapiens
gcctggtcagcaga

SEQ ID NO: 221981 - DNA, 14 bp, Homo sapiens
gcctggtgacaggc

SEQ ID NO: 221982 - DNA, 21 bp, Homo sapiens
gcctggtgcgctgtgctccag

SEQ ID NO: 221983 - DNA, 23 bp, Homo sapiens
gcctggtgcgctgtgctccagca

SEQ ID NO: 221984 - DNA, 14 bp, Homo sapiens
gcctggttccctct

SEQ ID NO: 221985 - DNA, 17 bp, Homo sapiens
gcctggttccctctttc

SEQ ID NO: 221986 - DNA, 21 bp, Homo sapiens
gcctggttccctctttcctgt

SEQ ID NO: 221987 - DNA, 18 bp, Homo sapiens
gcctgtaatcccagcact

SEQ ID NO: 221988 - DNA, 21 bp, Homo sapiens
gcctgtaatcccagcactttg

SEQ ID NO: 221989 - DNA, 18 bp, Homo sapiens
gcctgtaatctttttctc

SEQ ID NO: 221990 - DNA, 19 bp, Homo sapiens
gcctgtaatctttttctcc

SEQ ID NO: 221991 - DNA, 16 bp, Homo sapiens
gcctgtagagccagcc

SEQ ID NO: 221992 - DNA, 16 bp, Homo sapiens
gcctgtagttaggaaa

SEQ ID NO: 221993 - DNA, 17 bp, Homo sapiens
gcctgtagttaggaaat

SEQ ID NO: 221994 - DNA, 18 bp, Homo sapiens
gcctgtagttaggaaata

SEQ ID NO: 221995 - DNA, 20 bp, Homo sapiens
gcctgtatttccaacaaact

SEQ ID NO: 221996 - DNA, 14 bp, Homo sapiens
gcctgtcactactg

SEQ ID NO: 221997 - DNA, 21 bp, Homo sapiens
gcctgtccacctgtgctgctg

SEQ ID NO: 221998 - DNA, 22 bp, Homo sapiens
gcctgtccacctgtgctgctgc

SEQ ID NO: 221999 - DNA, 17 bp, Homo sapiens
gcctgtccagcctgggc

SEQ ID NO: 222000 - DNA, 16 bp, Homo sapiens
gcctgtcccccaaggt

SEQ ID NO: 222001 - DNA, 13 bp, Homo sapiens
gcctgtccccgcc

SEQ ID NO: 222002 - DNA, 18 bp, Homo sapiens
gcctgtccccgccttccc

SEQ ID NO: 222003 - DNA, 19 bp, Homo sapiens
gcctgtccccgccttccct

SEQ ID NO: 222004 - DNA, 20 bp, Homo sapiens
gcctgtccctggccatctct

SEQ ID NO: 222005 - DNA, 16 bp, Homo sapiens
gcctgtcctggtacag

SEQ ID NO: 222006 - DNA, 18 bp, Homo sapiens
gcctgtcgtgccagtcct

SEQ ID NO: 222007 - DNA, 17 bp, Homo sapiens
gcctgtcgtgttctctc

SEQ ID NO: 222008 - DNA, 21 bp, Homo sapiens
gcctgtctctgttcagatgtg

SEQ ID NO: 222009 - DNA, 14 bp, Homo sapiens
gcctgtctgtctct

SEQ ID NO: 222010 - DNA, 20 bp, Homo sapiens
gcctgtctgtctctccatct

SEQ ID NO: 222011 - DNA, 22 bp, Homo sapiens
gcctgtgaataaaaaccctgta

SEQ ID NO: 222012 - DNA, 14 bp, Homo sapiens
gcctgtgagtgaca

SEQ ID NO: 222013 - DNA, 14 bp, Homo sapiens
gcctgtgcagcagc

SEQ ID NO: 222014 - DNA, 15 bp, Homo sapiens
gcctgtgcagcagcc

SEQ ID NO: 222015 - DNA, 16 bp, Homo sapiens
gcctgtgcagcagccc

SEQ ID NO: 222016 - DNA, 18 bp, Homo sapiens
gcctgtgcagcagcccag

SEQ ID NO: 222017 - DNA, 19 bp, Homo sapiens
gcctgtgcagcagcccagc

SEQ ID NO: 222018 - DNA, 22 bp, Homo sapiens
gcctgtgcagcagcccagcttc

SEQ ID NO: 222019 - DNA, 19 bp, Homo sapiens
gcctgtgcgttcccttcag

SEQ ID NO: 222020 - DNA, 15 bp, Homo sapiens
gcctgtgctgggcca

SEQ ID NO: 222021 - DNA, 14 bp, Homo sapiens
gcctgtggtgaagt

SEQ ID NO: 222022 - DNA, 22 bp, Homo sapiens
gcctgtggtgaagtgtggctgg

SEQ ID NO: 222023 - DNA, 23 bp, Homo sapiens
gcctgtggtgaagtgtggctggt

SEQ ID NO: 222024 - DNA, 13 bp, Homo sapiens
gcctgtgtccagc

SEQ ID NO: 222025 - DNA, 16 bp, Homo sapiens
gcctgtgtccagcagc

SEQ ID NO: 222026 - DNA, 20 bp, Homo sapiens
gcctgtgtccagcagctgcg

SEQ ID NO: 222027 - DNA, 21 bp, Homo sapiens
gcctgtgtgacatcagtggca

SEQ ID NO: 222028 - DNA, 16 bp, Homo sapiens
gcctgtgtgtaagctg

SEQ ID NO: 222029 - DNA, 21 bp, Homo sapiens
gcctgtgtgtaagctgactgg

SEQ ID NO: 222030 - DNA, 20 bp, Homo sapiens
gcctgtgttagtgtctgtcc

SEQ ID NO: 222031 - DNA, 22 bp, Homo sapiens
gcctgtgttagtgtctgtccat

SEQ ID NO: 222032 - DNA, 19 bp, Homo sapiens
gcctgttcccattcttgca

SEQ ID NO: 222033 - DNA, 19 bp, Homo sapiens
gcctgttgctgaagtcatt

SEQ ID NO: 222034 - DNA, 17 bp, Homo sapiens
gcctgtttgggaggctg

SEQ ID NO: 222035 - DNA, 19 bp, Homo sapiens
gcctgtttgggaggctgga

SEQ ID NO: 222036 - DNA, 16 bp, Homo sapiens
gccttaaagaaagtcg

SEQ ID NO: 222037 - DNA, 13 bp, Homo sapiens
gccttaataaata

SEQ ID NO: 222038 - DNA, 16 bp, Homo sapiens
gccttaatggatgctc

SEQ ID NO: 222039 - DNA, 15 bp, Homo sapiens
gccttacatttgtga

SEQ ID NO: 222040 - DNA, 23 bp, Homo sapiens
gccttagaatctgtagaggagcc

SEQ ID NO: 222041 - DNA, 23 bp, Homo sapiens
gccttaggaagtgacttgaatgt

SEQ ID NO: 222042 - DNA, 14 bp, Homo sapiens
gccttatcaagtgt

SEQ ID NO: 222043 - DNA, 19 bp, Homo sapiens
gccttatcaagtgtcttcc

SEQ ID NO: 222044 - DNA, 16 bp, Homo sapiens
gccttatgagaacatg

SEQ ID NO: 222045 - DNA, 13 bp, Homo sapiens
gccttcagctcta

SEQ ID NO: 222046 - DNA, 16 bp, Homo sapiens
gccttcagctctacag

SEQ ID NO: 222047 - DNA, 21 bp, Homo sapiens
gccttcagtatcaaggctgcc

SEQ ID NO: 222048 - DNA, 18 bp, Homo sapiens
gccttcattaaatgtttg

SEQ ID NO: 222049 - DNA, 20 bp, Homo sapiens
gccttcattaaatgtttgtt

SEQ ID NO: 222050 - DNA, 23 bp, Homo sapiens
gccttccagcccagacccccagt

SEQ ID NO: 222051 - DNA, 21 bp, Homo sapiens
gccttccaggcgtagggccag

SEQ ID NO: 222052 - DNA, 13 bp, Homo sapiens
gccttccataatt

SEQ ID NO: 222053 - DNA, 21 bp, Homo sapiens
gccttccataattatgacagt

SEQ ID NO: 222054 - DNA, 22 bp, Homo sapiens
gccttccccgtgcggcccgtgc

SEQ ID NO: 222055 - DNA, 20 bp, Homo sapiens
gccttccccttttgcctggc

SEQ ID NO: 222056 - DNA, 23 bp, Homo sapiens
gccttccccttttgcctggctgt

SEQ ID NO: 222057 - DNA, 16 bp, Homo sapiens
gccttccctcactctt

SEQ ID NO: 222058 - DNA, 20 bp, Homo sapiens
gccttccgctcccaccagcc

SEQ ID NO: 222059 - DNA, 21 bp, Homo sapiens
gccttccgctcccaccagccc

SEQ ID NO: 222060 - DNA, 16 bp, Homo sapiens
gccttcctaccctctc

SEQ ID NO: 222061 - DNA, 15 bp, Homo sapiens
gccttcctcatcccc

SEQ ID NO: 222062 - DNA, 18 bp, Homo sapiens
gccttcctccatggccca

SEQ ID NO: 222063 - DNA, 20 bp, Homo sapiens
gccttcctccatggcccatc

SEQ ID NO: 222064 - DNA, 13 bp, Homo sapiens
gccttcctcctcc

SEQ ID NO: 222065 - DNA, 22 bp, Homo sapiens
gccttcctcctccacagtgctg

SEQ ID NO: 222066 - DNA, 18 bp, Homo sapiens
gccttccttgaccttcct

SEQ ID NO: 222067 - DNA, 19 bp, Homo sapiens
gccttccttgaccttcctc

SEQ ID NO: 222068 - DNA, 22 bp, Homo sapiens
gccttcgatacaccgggcctgg

SEQ ID NO: 222069 - DNA, 23 bp, Homo sapiens
gccttcgatacaccgggcctgga

SEQ ID NO: 222070 - DNA, 19 bp, Homo sapiens
gccttcgtgcccccccttc

SEQ ID NO: 222071 - DNA, 21 bp, Homo sapiens
gccttctagattcactgtctt

SEQ ID NO: 222072 - DNA, 16 bp, Homo sapiens
gccttctcaaacttta

SEQ ID NO: 222073 - DNA, 13 bp, Homo sapiens
gccttctcagctc

SEQ ID NO: 222074 - DNA, 19 bp, Homo sapiens
gccttctcctctctgggcc

SEQ ID NO: 222075 - DNA, 20 bp, Homo sapiens
gccttctcctctctgggcct

SEQ ID NO: 222076 - DNA, 17 bp, Homo sapiens
gccttctgaactccata

SEQ ID NO: 222077 - DNA, 14 bp, Homo sapiens
gccttctgatgtct

SEQ ID NO: 222078 - DNA, 23 bp, Homo sapiens
gccttctgatgtctctaaagcac

SEQ ID NO: 222079 - DNA, 21 bp, Homo sapiens
gccttgaagaatttgttcttg

SEQ ID NO: 222080 - DNA, 23 bp, Homo sapiens
gccttgagagaaaaagtgcccct

SEQ ID NO: 222081 - DNA, 15 bp, Homo sapiens
gccttgagctgcctg

SEQ ID NO: 222082 - DNA, 22 bp, Homo sapiens
gccttgagctgcctgctctgca

SEQ ID NO: 222083 - DNA, 20 bp, Homo sapiens
gccttgcacaaaaagcacaa

SEQ ID NO: 222084 - DNA, 22 bp, Homo sapiens
gccttgcacaaaaagcacaagc

SEQ ID NO: 222085 - DNA, 19 bp, Homo sapiens
gccttgcatttgtacctta

SEQ ID NO: 222086 - DNA, 16 bp, Homo sapiens
gccttgcccgccagcc

SEQ ID NO: 222087 - DNA, 19 bp, Homo sapiens
gccttgctacctcaagggg

SEQ ID NO: 222088 - DNA, 14 bp, Homo sapiens
gccttgctgccaag

SEQ ID NO: 222089 - DNA, 22 bp, Homo sapiens
gccttgctgccaagtcctgcct

SEQ ID NO: 222090 - DNA, 17 bp, Homo sapiens
gccttggctcgttctct

SEQ ID NO: 222091 - DNA, 17 bp, Homo sapiens
gccttgggcctttcagt

SEQ ID NO: 222092 - DNA, 18 bp, Homo sapiens
gccttgggctgctcctca

SEQ ID NO: 222093 - DNA, 22 bp, Homo sapiens
gccttgggctgctcctcatggt

SEQ ID NO: 222094 - DNA, 16 bp, Homo sapiens
gccttggggccagact

SEQ ID NO: 222095 - DNA, 19 bp, Homo sapiens
gccttggggccagactggc

SEQ ID NO: 222096 - DNA, 21 bp, Homo sapiens
gccttggggccagactggctg

SEQ ID NO: 222097 - DNA, 18 bp, Homo sapiens
gccttgggggtctgctct

SEQ ID NO: 222098 - DNA, 23 bp, Homo sapiens
tgcaagagggagcacgtgactgt

SEQ ID NO: 222099 - DNA, 20 bp, Homo sapiens
tgcaagagtgggctttccag

SEQ ID NO: 222100 - DNA, 17 bp, Homo sapiens
tgcaagccccagggcct

SEQ ID NO: 222101 - DNA, 19 bp, Homo sapiens
tgcaagccccagggcctgg

SEQ ID NO: 222102 - DNA, 14 bp, Homo sapiens
tgcaagcttattta

SEQ ID NO: 222103 - DNA, 20 bp, Homo sapiens
gccttgtagatggagcaagt

SEQ ID NO: 222104 - DNA, 18 bp, Homo sapiens
gccttgtgacattcactc

SEQ ID NO: 222105 - DNA, 20 bp, Homo sapiens
gccttgtgagatccttcaca

SEQ ID NO: 222106 - DNA, 19 bp, Homo sapiens
gccttgtgccctgccccca

SEQ ID NO: 222107 - DNA, 18 bp, Homo sapiens
gccttgtggataagggag

SEQ ID NO: 222108 - DNA, 22 bp, Homo sapiens
gccttgtgtcagagctgggagt

SEQ ID NO: 222109 - DNA, 16 bp, Homo sapiens
gccttgtgtgctggct

SEQ ID NO: 222110 - DNA, 18 bp, Homo sapiens
gccttgttgtattcctgc

SEQ ID NO: 222111 - DNA, 15 bp, Homo sapiens
gccttgtttttttct

SEQ ID NO: 222112 - DNA, 17 bp, Homo sapiens
gcctttaaatctgtgat

SEQ ID NO: 222113 - DNA, 21 bp, Homo sapiens
gcctttaatggacttatttct

SEQ ID NO: 222114 - DNA, 15 bp, Homo sapiens
gcctttaggcaggaa

SEQ ID NO: 222115 - DNA, 17 bp, Homo sapiens
gcctttaggcaggaagt

SEQ ID NO: 222116 - DNA, 18 bp, Homo sapiens
gcctttcacagcttcttt

SEQ ID NO: 222117 - DNA, 15 bp, Homo sapiens
gcctttcctacaggg

SEQ ID NO: 222118 - DNA, 18 bp, Homo sapiens
gcctttcctctctcctgt

SEQ ID NO: 222119 - DNA, 19 bp, Homo sapiens
gcctttcctgtgccaacct

SEQ ID NO: 222120 - DNA, 23 bp, Homo sapiens
gcctttgagcccacaaagcctta

SEQ ID NO: 222121 - DNA, 16 bp, Homo sapiens
gcctttgctcttataa

SEQ ID NO: 222122 - DNA, 23 bp, Homo sapiens
gcctttgctgtttagcttcctcc

SEQ ID NO: 222123 - DNA, 11 bp, Homo sapiens
gcctttgtaag

SEQ ID NO: 222124 - DNA, 9 bp, Homo sapiens
gcctttgtt

SEQ ID NO: 222125 - DNA, 15 bp, Homo sapiens
gcctttgttgctcag

SEQ ID NO: 222126 - DNA, 17 bp, Homo sapiens
gccttttaaattctttt

SEQ ID NO: 222127 - DNA, 15 bp, Homo sapiens
gccttttccataaag

SEQ ID NO: 222128 - DNA, 13 bp, Homo sapiens
gccttttctcatt

SEQ ID NO: 222129 - DNA, 11 bp, Homo sapiens
gccttttgtgt

SEQ ID NO: 222130 - DNA, 13 bp, Homo sapiens
gccttttgtgtga

SEQ ID NO: 222131 - DNA, 20 bp, Homo sapiens
gcctttttccttatttcaag

SEQ ID NO: 222132 - DNA, 22 bp, Homo sapiens
gcctttttccttatttcaaggg

SEQ ID NO: 222133 - DNA, 21 bp, Homo sapiens
gcgaacggaacgttggacttt

SEQ ID NO: 222134 - DNA, 20 bp, Homo sapiens
gcgaagtatataaattggct

SEQ ID NO: 222135 - DNA, 19 bp, Homo sapiens
gcgaagtctttgccttctc

SEQ ID NO: 222136 - DNA, 20 bp, Homo sapiens
gcgaagtctttgccttctct

SEQ ID NO: 222137 - DNA, 14 bp, Homo sapiens
gcgaatgagctggg

SEQ ID NO: 222138 - DNA, 20 bp, Homo sapiens
gcgacggctcctccccgatc

SEQ ID NO: 222139 - DNA, 19 bp, Homo sapiens
gcgagcaaatcctggcaag

SEQ ID NO: 222140 - DNA, 15 bp, Homo sapiens
gcgagcaacagtgcc

SEQ ID NO: 222141 - DNA, 14 bp, Homo sapiens
gcgaggcagaatgg

SEQ ID NO: 222142 - DNA, 17 bp, Homo sapiens
gcgaggctgcctctggg

SEQ ID NO: 222143 - DNA, 18 bp, Homo sapiens
gcgaggctgcctctgggt

SEQ ID NO: 222144 - DNA, 10 bp, Homo sapiens
gcgagggagg

SEQ ID NO: 222145 - DNA, 12 bp, Homo sapiens
gcgagggcctgc

SEQ ID NO: 222146 - DNA, 13 bp, Homo sapiens
gcgagggcctgcg

SEQ ID NO: 222147 - DNA, 17 bp, Homo sapiens
gcgagggcctgcgttca

SEQ ID NO: 222148 - DNA, 14 bp, Homo sapiens
gcgagtcccctgcc

SEQ ID NO: 222149 - DNA, 21 bp, Homo sapiens
gcgagtctggagaccaggact

SEQ ID NO: 222150 - DNA, 20 bp, Homo sapiens
gcgagtgtgtgcatgtgtgt

SEQ ID NO: 222151 - DNA, 18 bp, Homo sapiens
gcgatcatggctcactgc

SEQ ID NO: 222152 - DNA, 21 bp, Homo sapiens
gcgatccacctgtctcagcct

SEQ ID NO: 222153 - DNA, 21 bp, Homo sapiens
gcgatgccctgggggccgtgc

SEQ ID NO: 222154 - DNA, 10 bp, Homo sapiens
gcgatgtgtt

SEQ ID NO: 222155 - DNA, 23 bp, Homo sapiens
gcgattcaagtcgcggctgcagg

SEQ ID NO: 222156 - DNA, 15 bp, Homo sapiens
gcgatttttgtatgt

SEQ ID NO: 222157 - DNA, 15 bp, Homo sapiens
gcgcaaaactgcctg

SEQ ID NO: 222158 - DNA, 23 bp, Homo sapiens
gcgcaaaactgcctgaaagcaac

SEQ ID NO: 222159 - DNA, 21 bp, Homo sapiens
gcgcagccgcgctctgcccct

SEQ ID NO: 222160 - DNA, 23 bp, Homo sapiens
gcgcagccgcgctctgcccctcc

SEQ ID NO: 222161 - DNA, 12 bp, Homo sapiens
gcgcaggccctc

SEQ ID NO: 222162 - DNA, 18 bp, Homo sapiens
gcgcagtggccctgagca

SEQ ID NO: 222163 - DNA, 20 bp, Homo sapiens
gcgcatagtgtgctcggaca

SEQ ID NO: 222164 - DNA, 14 bp, Homo sapiens
gcgccaccatcctg

SEQ ID NO: 222165 - DNA, 14 bp, Homo sapiens
gcgccacccgcccg

SEQ ID NO: 222166 - DNA, 12 bp, Homo sapiens
gcgccacctgct

SEQ ID NO: 222167 - DNA, 21 bp, Homo sapiens
gcgccagcacagaaacagagg

SEQ ID NO: 222168 - DNA, 16 bp, Homo sapiens
gcgccagccctaggct

SEQ ID NO: 222169 - DNA, 17 bp, Homo sapiens
gcgccccgcccccaccc

SEQ ID NO: 222170 - DNA, 18 bp, Homo sapiens
gcgccccgcccccacccc

SEQ ID NO: 222171 - DNA, 15 bp, Homo sapiens
gcgcccgctgggctg

SEQ ID NO: 222172 - DNA, 12 bp, Homo sapiens
gcgccctccctc

SEQ ID NO: 222173 - DNA, 13 bp, Homo sapiens
gcgccctggaagc

SEQ ID NO: 222174 - DNA, 19 bp, Homo sapiens
gcgcccttgtgccctgcct

SEQ ID NO: 222175 - DNA, 14 bp, Homo sapiens
gcgcctcctggaca

SEQ ID NO: 222176 - DNA, 15 bp, Homo sapiens
gcgcctgcacctgcg

SEQ ID NO: 222177 - DNA, 22 bp, Homo sapiens
gcgcctgcacctgcgcctggct

SEQ ID NO: 222178 - DNA, 11 bp, Homo sapiens
gcgcctgcccg

SEQ ID NO: 222179 - DNA, 15 bp, Homo sapiens
gcgcctgcgctcctc

SEQ ID NO: 222180 - DNA, 17 bp, Homo sapiens
gcgcctgcgctcctctg

SEQ ID NO: 222181 - DNA, 12 bp, Homo sapiens
gcgcctggctct

SEQ ID NO: 222182 - DNA, 17 bp, Homo sapiens
gcgcgcaccgcccaacc

SEQ ID NO: 222183 - DNA, 20 bp, Homo sapiens
gcgcgggagagagtgagaga

SEQ ID NO: 222184 - DNA, 16 bp, Homo sapiens
gcgcgggaggcaccag

SEQ ID NO: 222185 - DNA, 13 bp, Homo sapiens
gcgcgtgccccca

SEQ ID NO: 222186 - DNA, 14 bp, Homo sapiens
gcgcgtgcccccag

SEQ ID NO: 222187 - DNA, 14 bp, Homo sapiens
gcgcgtgccttccc

SEQ ID NO: 222188 - DNA, 23 bp, Homo sapiens
gcgctagagcattctggggtggg

SEQ ID NO: 222189 - DNA, 15 bp, Homo sapiens
gcgctatccacagaa

SEQ ID NO: 222190 - DNA, 14 bp, Homo sapiens
gcgctattacaaat

SEQ ID NO: 222191 - DNA, 23 bp, Homo sapiens
gcgctcacctgcagcccctcctc

SEQ ID NO: 222192 - DNA, 12 bp, Homo sapiens
gcgctcaggacc

SEQ ID NO: 222193 - DNA, 16 bp, Homo sapiens
gcgctcaggacccagg

SEQ ID NO: 222194 - DNA, 17 bp, Homo sapiens
gcgctcaggacccaggc

SEQ ID NO: 222195 - DNA, 18 bp, Homo sapiens
gcgctcaggacccaggcc

SEQ ID NO: 222196 - DNA, 20 bp, Homo sapiens
gcgctcaggacccaggccct

SEQ ID NO: 222197 - DNA, 15 bp, Homo sapiens
gcgctccggcagagg

SEQ ID NO: 222198 - DNA, 22 bp, Homo sapiens
gcgctccggcagaggcagggcc

SEQ ID NO: 222199 - DNA, 15 bp, Homo sapiens
gcgctcctctgcagc

SEQ ID NO: 222200 - DNA, 19 bp, Homo sapiens
gcgctcctctgcagcctga

SEQ ID NO: 222201 - DNA, 16 bp, Homo sapiens
gcgctcctctgccttg

SEQ ID NO: 222202 - DNA, 14 bp, Homo sapiens
gcgctctgcccctc

SEQ ID NO: 222203 - DNA, 20 bp, Homo sapiens
gcgctcttggtccctggtcc

SEQ ID NO: 222204 - DNA, 23 bp, Homo sapiens
gcgctgacaaccaccgctcccca

SEQ ID NO: 222205 - DNA, 23 bp, Homo sapiens
gcgctgagggcagggttctagaa

SEQ ID NO: 222206 - DNA, 22 bp, Homo sapiens
gcgctgcaggtacttcctcctg

SEQ ID NO: 222207 - DNA, 13 bp, Homo sapiens
gcgctggggagac

SEQ ID NO: 222208 - DNA, 12 bp, Homo sapiens
gcgctgtgctcc

SEQ ID NO: 222209 - DNA, 22 bp, Homo sapiens
gcgctgtgctccagcagtgctg

SEQ ID NO: 222210 - DNA, 11 bp, Homo sapiens
gcgcttcctgg

SEQ ID NO: 222211 - DNA, 19 bp, Homo sapiens
gcggaagtacttccctcag

SEQ ID NO: 222212 - DNA, 21 bp, Homo sapiens
gcggaccggagcggctgagga

SEQ ID NO: 222213 - DNA, 14 bp, Homo sapiens
gcggacgggctgtc

SEQ ID NO: 222214 - DNA, 14 bp, Homo sapiens
gcggagctgcatgg

SEQ ID NO: 222215 - DNA, 22 bp, Homo sapiens
gcggagctgcatggacgcctgg

SEQ ID NO: 222216 - DNA, 23 bp, Homo sapiens
gcggagctgcatggacgcctggc

SEQ ID NO: 222217 - DNA, 21 bp, Homo sapiens
gcggaggaggaagtcatggga

SEQ ID NO: 222218 - DNA, 20 bp, Homo sapiens
gcggatccgcggggaccctg

SEQ ID NO: 222219 - DNA, 12 bp, Homo sapiens
gcggcaccgccc

SEQ ID NO: 222220 - DNA, 17 bp, Homo sapiens
gcggcaccgcccaccca

SEQ ID NO: 222221 - DNA, 12 bp, Homo sapiens
gcggcagagagg

SEQ ID NO: 222222 - DNA, 23 bp, Homo sapiens
gcggcagccccacttcaccccca

SEQ ID NO: 222223 - DNA, 12 bp, Homo sapiens
gcggcagctggg

SEQ ID NO: 222224 - DNA, 15 bp, Homo sapiens
gcggcagctggggcc

SEQ ID NO: 222225 - DNA, 14 bp, Homo sapiens
gcggcccctcccac

SEQ ID NO: 222226 - DNA, 15 bp, Homo sapiens
gcggcccctcccaca

SEQ ID NO: 222227 - DNA, 13 bp, Homo sapiens
gcggcccggccca

SEQ ID NO: 222228 - DNA, 21 bp, Homo sapiens
gcggcccggcccacgcagagc

SEQ ID NO: 222229 - DNA, 19 bp, Homo sapiens
tgcagagctatggtgaggt

SEQ ID NO: 222230 - DNA, 22 bp, Homo sapiens
tgcagaggagccacctgggctg

SEQ ID NO: 222231 - DNA, 18 bp, Homo sapiens
tgcagaggatttaactgt

SEQ ID NO: 222232 - DNA, 14 bp, Homo sapiens
tgcagaggcagcag

SEQ ID NO: 222233 - DNA, 15 bp, Homo sapiens
tgcagaggcagcagg

SEQ ID NO: 222234 - DNA, 20 bp, Homo sapiens
tgcagaggcagcaggagcca

SEQ ID NO: 222235 - DNA, 16 bp, Homo sapiens
tgcagaggctgagcag

SEQ ID NO: 222236 - DNA, 18 bp, Homo sapiens
tgcagatctagccaggcc

SEQ ID NO: 222237 - DNA, 11 bp, Homo sapiens
tgcagatgcca

SEQ ID NO: 222238 - DNA, 15 bp, Homo sapiens
tgcagatgccagagc

SEQ ID NO: 222239 - DNA, 16 bp, Homo sapiens
tgcagatgccagagca

SEQ ID NO: 222240 - DNA, 15 bp, Homo sapiens
tgcagattcctgggc

SEQ ID NO: 222241 - DNA, 17 bp, Homo sapiens
tgcagattcctgggcct

SEQ ID NO: 222242 - DNA, 15 bp, Homo sapiens
gcggctggaaagagg

SEQ ID NO: 222243 - DNA, 17 bp, Homo sapiens
gcggcttcctgtccact

SEQ ID NO: 222244 - DNA, 20 bp, Homo sapiens
gcggcttcctgtccactctc

SEQ ID NO: 222245 - DNA, 22 bp, Homo sapiens
gcggcttcctgtccactctcgg

SEQ ID NO: 222246 - DNA, 19 bp, Homo sapiens
gcggcttttcagaagaaat

SEQ ID NO: 222247 - DNA, 17 bp, Homo sapiens
gcgggaaagccagtgac

SEQ ID NO: 222248 - DNA, 17 bp, Homo sapiens
gcgggagacctgtgcta

SEQ ID NO: 222249 - DNA, 12 bp, Homo sapiens
gcgggagagagt

SEQ ID NO: 222250 - DNA, 12 bp, Homo sapiens
gcgggaggcacc

SEQ ID NO: 222251 - DNA, 18 bp, Homo sapiens
gcgggaggcaccagctct

SEQ ID NO: 222252 - DNA, 19 bp, Homo sapiens
gcgggaggcaccagctctg

SEQ ID NO: 222253 - DNA, 23 bp, Homo sapiens
gcgggaggcaccagctctgtggc

SEQ ID NO: 222254 - DNA, 21 bp, Homo sapiens
gcgggcagccccgttttgggg

SEQ ID NO: 222255 - DNA, 18 bp, Homo sapiens
gcgggcagcccctgctgg

SEQ ID NO: 222256 - DNA, 19 bp, Homo sapiens
gcgggcagcccctgctgga

SEQ ID NO: 222257 - DNA, 13 bp, Homo sapiens
gcgggccaggaga

SEQ ID NO: 222258 - DNA, 13 bp, Homo sapiens
gcgggccctctgc

SEQ ID NO: 222259 - DNA, 15 bp, Homo sapiens
gcgggcggccaggca

SEQ ID NO: 222260 - DNA, 15 bp, Homo sapiens
gcgggcttcctcctg

SEQ ID NO: 222261 - DNA, 13 bp, Homo sapiens
gcgggggagcctg

SEQ ID NO: 222262 - DNA, 22 bp, Homo sapiens
gcgggggctaactggccccagg

SEQ ID NO: 222263 - DNA, 11 bp, Homo sapiens
gcggggtggag

SEQ ID NO: 222264 - DNA, 18 bp, Homo sapiens
gcgggtaaaaagagaagg

SEQ ID NO: 222265 - DNA, 21 bp, Homo sapiens
gcggtcaataattgtggagag

SEQ ID NO: 222266 - DNA, 12 bp, Homo sapiens
gcggtccccatc

SEQ ID NO: 222267 - DNA, 16 bp, Homo sapiens
gcggtccccatcccca

SEQ ID NO: 222268 - DNA, 19 bp, Homo sapiens
gcggtccccatccccacca

SEQ ID NO: 222269 - DNA, 19 bp, Homo sapiens
gcggtggaaggagcctgcg

SEQ ID NO: 222270 - DNA, 19 bp, Homo sapiens
gcggtgggccgaggccgct

SEQ ID NO: 222271 - DNA, 14 bp, Homo sapiens
gcggtttggggagc

SEQ ID NO: 222272 - DNA, 13 bp, Homo sapiens
gcgtagggccagg

SEQ ID NO: 222273 - DNA, 16 bp, Homo sapiens
gcgtagggccagggct

SEQ ID NO: 222274 - DNA, 20 bp, Homo sapiens
gcgtagggccagggctctgg

SEQ ID NO: 222275 - DNA, 21 bp, Homo sapiens
gcgtatgtctgttaccatgtc

SEQ ID NO: 222276 - DNA, 13 bp, Homo sapiens
gcgtcctgcagag

SEQ ID NO: 222277 - DNA, 21 bp, Homo sapiens
gcgtccttccccctgtagact

SEQ ID NO: 222278 - DNA, 14 bp, Homo sapiens
gcgtctacccagac

SEQ ID NO: 222279 - DNA, 17 bp, Homo sapiens
gcgtctcccttggccac

SEQ ID NO: 222280 - DNA, 17 bp, Homo sapiens
gcgtctgccccaccctc

SEQ ID NO: 222281 - DNA, 14 bp, Homo sapiens
gcgtcttcctgagt

SEQ ID NO: 222282 - DNA, 24 bp, Homo sapiens
gcgtgacttcagactctctcctct

SEQ ID NO: 222283 - DNA, 14 bp, Homo sapiens
gcgtgcccccagcg

SEQ ID NO: 222284 - DNA, 18 bp, Homo sapiens
gcgtgcccccctcctcca

SEQ ID NO: 222285 - DNA, 21 bp, Homo sapiens
gcgtgcccccctcctccagta

SEQ ID NO: 222286 - DNA, 22 bp, Homo sapiens
gcgtgcccccctcctccagtac

SEQ ID NO: 222287 - DNA, 21 bp, Homo sapiens
gcgtgccctgacccctgcacc

SEQ ID NO: 222288 - DNA, 22 bp, Homo sapiens
gcgtgccttccccgtgcggccc

SEQ ID NO: 222289 - DNA, 14 bp, Homo sapiens
gcgtgctgtctgtc

SEQ ID NO: 222290 - DNA, 14 bp, Homo sapiens
gcgtggagcaggcg

SEQ ID NO: 222291 - DNA, 12 bp, Homo sapiens
gcgtggcctggg

SEQ ID NO: 222292 - DNA, 15 bp, Homo sapiens
gcgtggcctggggct

SEQ ID NO: 222293 - DNA, 17 bp, Homo sapiens
gcgtggcctggggctgc

SEQ ID NO: 222294 - DNA, 13 bp, Homo sapiens
gcgtggctgtggc

SEQ ID NO: 222295 - DNA, 18 bp, Homo sapiens
gcgtggctgtggcacaga

SEQ ID NO: 222296 - DNA, 16 bp, Homo sapiens
gcgtgggatccagaga

SEQ ID NO: 222297 - DNA, 22 bp, Homo sapiens
gcgtgggatccagagagaagca

SEQ ID NO: 222298 - DNA, 20 bp, Homo sapiens
gcgtggtggacatgcacagc

SEQ ID NO: 222299 - DNA, 20 bp, Homo sapiens
gcgtgtagcgtcctgaggaa

SEQ ID NO: 222300 - DNA, 20 bp, Homo sapiens
gcgtgtcaactttcatttga

SEQ ID NO: 222301 - DNA, 15 bp, Homo sapiens
gcgtgtccctcctct

SEQ ID NO: 222302 - DNA, 11 bp, Homo sapiens
gcgtgtggccc

SEQ ID NO: 222303 - DNA, 18 bp, Homo sapiens
gcgtgtggccctgtggga

SEQ ID NO: 222304 - DNA, 21 bp, Homo sapiens
gcgtgtggccctgtgggagtc

SEQ ID NO: 222305 - DNA, 11 bp, Homo sapiens
gcgtgtggctc

SEQ ID NO: 222306 - DNA, 13 bp, Homo sapiens
gcgtgtggctcac

SEQ ID NO: 222307 - DNA, 14 bp, Homo sapiens
gcgtgtggctcacg

SEQ ID NO: 222308 - DNA, 19 bp, Homo sapiens
gcgtgtggctcacgtgtgt

SEQ ID NO: 222309 - DNA, 17 bp, Homo sapiens
gcgtgtgtccatgtgtg

SEQ ID NO: 222310 - DNA, 23 bp, Homo sapiens
gcgtgtgtccatgtgtgtgcaag

SEQ ID NO: 222311 - DNA, 22 bp, Homo sapiens
gcgttagaatgaggaggaagga

SEQ ID NO: 222312 - DNA, 18 bp, Homo sapiens
gcgttctggactctgccc

SEQ ID NO: 222313 - DNA, 20 bp, Homo sapiens
gcgttctggactctgcccca

SEQ ID NO: 222314 - DNA, 14 bp, Homo sapiens
gcgttggaattaaa

SEQ ID NO: 222315 - DNA, 15 bp, Homo sapiens
gcgttgttacaggaa

SEQ ID NO: 222316 - DNA, 21 bp, Homo sapiens
gcgtttagtttctagaggcct

SEQ ID NO: 222317 - DNA, 23 bp, Homo sapiens
gcgtttagtttctagaggcctca

SEQ ID NO: 222318 - DNA, 20 bp, Homo sapiens
gcgtttcaccatgttggcca

SEQ ID NO: 222319 - DNA, 12 bp, Homo sapiens
gctaaaaacatt

SEQ ID NO: 222320 - DNA, 14 bp, Homo sapiens
gctaaagaggtggg

SEQ ID NO: 222321 - DNA, 19 bp, Homo sapiens
gctaaatcctttactgtta

SEQ ID NO: 222322 - DNA, 13 bp, Homo sapiens
gctaaattttctg

SEQ ID NO: 222323 - DNA, 15 bp, Homo sapiens
gctaacactggcccc

SEQ ID NO: 222324 - DNA, 11 bp, Homo sapiens
gctaacattta

SEQ ID NO: 222325 - DNA, 17 bp, Homo sapiens
gctaacatttaggagaa

SEQ ID NO: 222326 - DNA, 15 bp, Homo sapiens
gctaactgagagaag

SEQ ID NO: 222327 - DNA, 13 bp, Homo sapiens
gctaactggcccc

SEQ ID NO: 222328 - DNA, 16 bp, Homo sapiens
gctaactggccccagg

SEQ ID NO: 222329 - DNA, 13 bp, Homo sapiens
gctaagaggctgc

SEQ ID NO: 222330 - DNA, 14 bp, Homo sapiens
gctaagaggctgct

SEQ ID NO: 222331 - DNA, 16 bp, Homo sapiens
gctaagagttttctgt

SEQ ID NO: 222332 - DNA, 17 bp, Homo sapiens
gctaagatactgctgat

SEQ ID NO: 222333 - DNA, 16 bp, Homo sapiens
gctaagcctgatgatg

SEQ ID NO: 222334 - DNA, 14 bp, Homo sapiens
gctaagctcaaatg

SEQ ID NO: 222335 - DNA, 16 bp, Homo sapiens
gctaagctcaaatgta

SEQ ID NO: 222336 - DNA, 23 bp, Homo sapiens
gctaaggcccccaaacatagccc

SEQ ID NO: 222337 - DNA, 16 bp, Homo sapiens
gctaaggcctcttgct

SEQ ID NO: 222338 - DNA, 22 bp, Homo sapiens
gctaaggcctcttgctggtgca

SEQ ID NO: 222339 - DNA, 17 bp, Homo sapiens
gctaaggctcctccttg

SEQ ID NO: 222340 - DNA, 18 bp, Homo sapiens
gctaagtgaaaaggtcat

SEQ ID NO: 222341 - DNA, 22 bp, Homo sapiens
gctaagttctaagttcatgttt

SEQ ID NO: 222342 - DNA, 17 bp, Homo sapiens
gctaagttgtcttacac

SEQ ID NO: 222343 - DNA, 21 bp, Homo sapiens
gctaataaaatatcattcagc

SEQ ID NO: 222344 - DNA, 15 bp, Homo sapiens
gctaataaactgttt

SEQ ID NO: 222345 - DNA, 13 bp, Homo sapiens
gctaataaatgac

SEQ ID NO: 222346 - DNA, 16 bp, Homo sapiens
gctaataaatgaccag

SEQ ID NO: 222347 - DNA, 17 bp, Homo sapiens
gctaataaatgaccagt

SEQ ID NO: 222348 - DNA, 18 bp, Homo sapiens
gctaataaatgaccagtt

SEQ ID NO: 222349 - DNA, 19 bp, Homo sapiens
gctaataaatgaccagttt

SEQ ID NO: 222350 - DNA, 16 bp, Homo sapiens
gctaatcagcattctc

SEQ ID NO: 222351 - DNA, 18 bp, Homo sapiens
gctaatgaattttaaaag

SEQ ID NO: 222352 - DNA, 21 bp, Homo sapiens
gctaatgaattttaaaagcat

SEQ ID NO: 222353 - DNA, 22 bp, Homo sapiens
gctaatgaattttaaaagcata

SEQ ID NO: 222354 - DNA, 20 bp, Homo sapiens
gctaatgccaggccagtaaa

SEQ ID NO: 222355 - DNA, 15 bp, Homo sapiens
gctaattacacacgt

SEQ ID NO: 222356 - DNA, 16 bp, Homo sapiens
gctaattaggaagctt

SEQ ID NO: 222357 - DNA, 16 bp, Homo sapiens
gctaatttctgtccag

SEQ ID NO: 222358 - DNA, 14 bp, Homo sapiens
gctaattttctcaa

SEQ ID NO: 222359 - DNA, 17 bp, Homo sapiens
gctaattttctcaaaag

SEQ ID NO: 222360 - DNA, 17 bp, Homo sapiens
tgccaccctcacacaca

SEQ ID NO: 222361 - DNA, 13 bp, Homo sapiens
tgccaccctctgc

SEQ ID NO: 222362 - DNA, 16 bp, Homo sapiens
tgccaccctctgcagg

SEQ ID NO: 222363 - DNA, 17 bp, Homo sapiens
tgccaccctctgcaggg

SEQ ID NO: 222364 - DNA, 18 bp, Homo sapiens
tgccaccctctgcagggc

SEQ ID NO: 222365 - DNA, 13 bp, Homo sapiens
tgccacctatgcc

SEQ ID NO: 222366 - DNA, 14 bp, Homo sapiens
tgccacctccctga

SEQ ID NO: 222367 - DNA, 14 bp, Homo sapiens
tgccacctcctgcc

SEQ ID NO: 222368 - DNA, 20 bp, Homo sapiens
tgccacctctggccaaatat

SEQ ID NO: 222369 - DNA, 10 bp, Homo sapiens
tgccacctgc

SEQ ID NO: 222370 - DNA, 16 bp, Homo sapiens
tgccacctggggcagt

SEQ ID NO: 222371 - DNA, 17 bp, Homo sapiens
tgccacctggggcagtc

SEQ ID NO: 222372 - DNA, 10 bp, Homo sapiens
tgccacctgt

SEQ ID NO: 222373 - DNA, 21 bp, Homo sapiens
tgccactaggctgggtgccca

SEQ ID NO: 222374 - DNA, 14 bp, Homo sapiens
tgccactccctgag

SEQ ID NO: 222375 - DNA, 19 bp, Homo sapiens
tgccactctctgggactct

SEQ ID NO: 222376 - DNA, 20 bp, Homo sapiens
tgccactctctgggactctc

SEQ ID NO: 222377 - DNA, 13 bp, Homo sapiens
tgccactgccagg

SEQ ID NO: 222378 - DNA, 20 bp, Homo sapiens
tgccactgcccgagctggtg

SEQ ID NO: 222379 - DNA, 21 bp, Homo sapiens
tgccactgcccgagctggtgc

SEQ ID NO: 222380 - DNA, 22 bp, Homo sapiens
tgccactgcccgagctggtgca

SEQ ID NO: 222381 - DNA, 18 bp, Homo sapiens
tgccactgcctcttcctc

SEQ ID NO: 222382 - DNA, 18 bp, Homo sapiens
tgccacttgacattcctt

SEQ ID NO: 222383 - DNA, 16 bp, Homo sapiens
tgccacttgcactgtg

SEQ ID NO: 222384 - DNA, 19 bp, Homo sapiens
tgccacttgcactgtgctt

SEQ ID NO: 222385 - DNA, 19 bp, Homo sapiens
tgccagaaacagtgggagc

SEQ ID NO: 222386 - DNA, 24 bp, Homo sapiens
tgccagaaacagtgggagccctga

SEQ ID NO: 222387 - DNA, 20 bp, Homo sapiens
gctcaggcaagcccctcagc

SEQ ID NO: 222388 - DNA, 23 bp, Homo sapiens
gctcaggcaagcccctcagccct

SEQ ID NO: 222389 - DNA, 18 bp, Homo sapiens
gctcaggcctcacctggc

SEQ ID NO: 222390 - DNA, 19 bp, Homo sapiens
gctcaggcctcacctggct

SEQ ID NO: 222391 - DNA, 19 bp, Homo sapiens
gctcaggcgatccacctgt

SEQ ID NO: 222392 - DNA, 24 bp, Homo sapiens
gctcaggcgatccacctgtctcag

SEQ ID NO: 222393 - DNA, 13 bp, Homo sapiens
gctcagggctgga

SEQ ID NO: 222394 - DNA, 15 bp, Homo sapiens
gctcaggggcagctc

SEQ ID NO: 222395 - DNA, 17 bp, Homo sapiens
gctcaggtagccaccac

SEQ ID NO: 222396 - DNA, 15 bp, Homo sapiens
gctcagtattgagac

SEQ ID NO: 222397 - DNA, 23 bp, Homo sapiens
gctcagtattgagacactgtcaa

SEQ ID NO: 222398 - DNA, 16 bp, Homo sapiens
gctcagtctccctttc

SEQ ID NO: 222399 - DNA, 19 bp, Homo sapiens
gctcagtctccctttccct

SEQ ID NO: 222400 - DNA, 23 bp, Homo sapiens
gctcagtcttccctagggctggg

SEQ ID NO: 222401 - DNA, 22 bp, Homo sapiens
gctcagtgccacctatgcctgt

SEQ ID NO: 222402 - DNA, 15 bp, Homo sapiens
gctcagtgcctcctg

SEQ ID NO: 222403 - DNA, 20 bp, Homo sapiens
gctcagtttggctgtaattt

SEQ ID NO: 222404 - DNA, 14 bp, Homo sapiens
gctcatattttgta

SEQ ID NO: 222405 - DNA, 15 bp, Homo sapiens
gctcatctccaagga

SEQ ID NO: 222406 - DNA, 16 bp, Homo sapiens
gctcatgggcccctct

SEQ ID NO: 222407 - DNA, 21 bp, Homo sapiens
gctcatgggcccctctgactc

SEQ ID NO: 222408 - DNA, 13 bp, Homo sapiens
gctcattcttttc

SEQ ID NO: 222409 - DNA, 13 bp, Homo sapiens
gctccaagagaat

SEQ ID NO: 222410 - DNA, 19 bp, Homo sapiens
gctccacagggtgggatga

SEQ ID NO: 222411 - DNA, 12 bp, Homo sapiens
gctccaccacat

SEQ ID NO: 222412 - DNA, 20 bp, Homo sapiens
gctccaccccactcacagag

SEQ ID NO: 222413 - DNA, 17 bp, Homo sapiens
gctccaccctcccctct

SEQ ID NO: 222414 - DNA, 11 bp, Homo sapiens
gctccaccctt

SEQ ID NO: 222415 - DNA, 15 bp, Homo sapiens
gctccacccttggcc

SEQ ID NO: 222416 - DNA, 16 bp, Homo sapiens
gctccacccttggcct

SEQ ID NO: 222417 - DNA, 17 bp, Homo sapiens
gctccacccttggcctg

SEQ ID NO: 222418 - DNA, 19 bp, Homo sapiens
gctccacccttggcctgtc

SEQ ID NO: 222419 - DNA, 16 bp, Homo sapiens
gctccacgccctgggg

SEQ ID NO: 222420 - DNA, 17 bp, Homo sapiens
gctccacgccctgggga

SEQ ID NO: 222421 - DNA, 23 bp, Homo sapiens
gctccacgccctggggagtgagc

SEQ ID NO: 222422 - DNA, 20 bp, Homo sapiens
gctccacgggggcctagtgg

SEQ ID NO: 222423 - DNA, 21 bp, Homo sapiens
gctccacggtgcgtggctgtg

SEQ ID NO: 222424 - DNA, 19 bp, Homo sapiens
gctccactcagggctggcc

SEQ ID NO: 222425 - DNA, 15 bp, Homo sapiens
gctccactctgaagt

SEQ ID NO: 222426 - DNA, 21 bp, Homo sapiens
gctccactctgaagtcccttc

SEQ ID NO: 222427 - DNA, 14 bp, Homo sapiens
gctccactggcctg

SEQ ID NO: 222428 - DNA, 17 bp, Homo sapiens
gctccagcagtgctggg

SEQ ID NO: 222429 - DNA, 19 bp, Homo sapiens
gctccagcagtgctgggcc

SEQ ID NO: 222430 - DNA, 23 bp, Homo sapiens
gctccagcagtgctgggcccagc

SEQ ID NO: 222431 - DNA, 13 bp, Homo sapiens
gctccagcatcca

SEQ ID NO: 222432 - DNA, 17 bp, Homo sapiens
gctccagcatccagcct

SEQ ID NO: 222433 - DNA, 18 bp, Homo sapiens
gctccagcatccagcctg

SEQ ID NO: 222434 - DNA, 22 bp, Homo sapiens
gctccagcatccagcctgtgtg

SEQ ID NO: 222435 - DNA, 16 bp, Homo sapiens
gctccagccaacccct

SEQ ID NO: 222436 - DNA, 18 bp, Homo sapiens
gctccagccaacccctgt

SEQ ID NO: 222437 - DNA, 23 bp, Homo sapiens
gctccagccaacccctgtggagc

SEQ ID NO: 222438 - DNA, 23 bp, Homo sapiens
gctccagcccgagtggtctcctc

SEQ ID NO: 222439 - DNA, 15 bp, Homo sapiens
gctccagctttaagg

SEQ ID NO: 222440 - DNA, 16 bp, Homo sapiens
gctccaggctgactgg

SEQ ID NO: 222441 - DNA, 22 bp, Homo sapiens
gctccaggggcccttgggacag

SEQ ID NO: 222442 - DNA, 14 bp, Homo sapiens
gctccagggtcttg

SEQ ID NO: 222443 - DNA, 23 bp, Homo sapiens
gctccagggtcttgggctactgg

SEQ ID NO: 222444 - DNA, 22 bp, Homo sapiens
gctccaggtgccctgtgggaga

SEQ ID NO: 222445 - DNA, 17 bp, Homo sapiens
gctccagtctgctgccc

SEQ ID NO: 222446 - DNA, 15 bp, Homo sapiens
gctccagttttcgta

SEQ ID NO: 222447 - DNA, 14 bp, Homo sapiens
gctccatcttattt

SEQ ID NO: 222448 - DNA, 19 bp, Homo sapiens
gctccatgctcctcactgc

SEQ ID NO: 222449 - DNA, 20 bp, Homo sapiens
gctccatttataaccccagc

SEQ ID NO: 222450 - DNA, 19 bp, Homo sapiens
gctcccaacagaggcctcc

SEQ ID NO: 222451 - DNA, 20 bp, Homo sapiens
gctcccaacagaggcctccc

SEQ ID NO: 222452 - DNA, 16 bp, Homo sapiens
gctcccacagcttcct

SEQ ID NO: 222453 - DNA, 20 bp, Homo sapiens
gctcccacagcttcctgagg

SEQ ID NO: 222454 - DNA, 22 bp, Homo sapiens
gctcccacagcttcctgagggc

SEQ ID NO: 222455 - DNA, 17 bp, Homo sapiens
gctcccacaggcccttc

SEQ ID NO: 222456 - DNA, 20 bp, Homo sapiens
gctcccacaggcccttcctc

SEQ ID NO: 222457 - DNA, 12 bp, Homo sapiens
gctcccaccagc

SEQ ID NO: 222458 - DNA, 13 bp, Homo sapiens
gctcccagaccca

SEQ ID NO: 222459 - DNA, 19 bp, Homo sapiens
gctcccagacccagggcag

SEQ ID NO: 222460 - DNA, 13 bp, Homo sapiens
gctcccagcccct

SEQ ID NO: 222461 - DNA, 18 bp, Homo sapiens
gctcccagcccctacctt

SEQ ID NO: 222462 - DNA, 17 bp, Homo sapiens
gctcccagcctgctgag

SEQ ID NO: 222463 - DNA, 12 bp, Homo sapiens
gctcccaggaca

SEQ ID NO: 222464 - DNA, 20 bp, Homo sapiens
gctcccaggacgcagggaga

SEQ ID NO: 222465 - DNA, 13 bp, Homo sapiens
gctcccagtgcca

SEQ ID NO: 222466 - DNA, 16 bp, Homo sapiens
gctcccattcctccct

SEQ ID NO: 222467 - DNA, 21 bp, Homo sapiens
gctccccacgagtcacctgca

SEQ ID NO: 222468 - DNA, 16 bp, Homo sapiens
gctccccagcccaggg

SEQ ID NO: 222469 - DNA, 14 bp, Homo sapiens
gctccccagcccca

SEQ ID NO: 222470 - DNA, 19 bp, Homo sapiens
gctcccccgcagtccccag

SEQ ID NO: 222471 - DNA, 13 bp, Homo sapiens
gctccccctgcca

SEQ ID NO: 222472 - DNA, 16 bp, Homo sapiens
gctccccctgccagca

SEQ ID NO: 222473 - DNA, 15 bp, Homo sapiens
gctcccctccctcct

SEQ ID NO: 222474 - DNA, 19 bp, Homo sapiens
gctcccctctatttagcat

SEQ ID NO: 222475 - DNA, 13 bp, Homo sapiens
gctcccctctgcc

SEQ ID NO: 222476 - DNA, 14 bp, Homo sapiens
gctcccctggagcc

SEQ ID NO: 222477 - DNA, 13 bp, Homo sapiens
gctcccctggtct

SEQ ID NO: 222478 - DNA, 14 bp, Homo sapiens
gctcccctttccca

SEQ ID NO: 222479 - DNA, 14 bp, Homo sapiens
gctcccgagctact

SEQ ID NO: 222480 - DNA, 17 bp, Homo sapiens
gctcccggggcagggca

SEQ ID NO: 222481 - DNA, 13 bp, Homo sapiens
gctccctccccct

SEQ ID NO: 222482 - DNA, 22 bp, Homo sapiens
gctccctccccctgccccttct

SEQ ID NO: 222483 - DNA, 19 bp, Homo sapiens
gctccctcccctgccctgg

SEQ ID NO: 222484 - DNA, 16 bp, Homo sapiens
gctccctcctggagca

SEQ ID NO: 222485 - DNA, 13 bp, Homo sapiens
gctccctcgctgt

SEQ ID NO: 222486 - DNA, 17 bp, Homo sapiens
gctccctcgctgtatga

SEQ ID NO: 222487 - DNA, 16 bp, Homo sapiens
gctccctcggtcacct

SEQ ID NO: 222488 - DNA, 15 bp, Homo sapiens
gctccctctcctgta

SEQ ID NO: 222489 - DNA, 16 bp, Homo sapiens
gctccgagggcggcca

SEQ ID NO: 222490 - DNA, 15 bp, Homo sapiens
tgccctcactccact

SEQ ID NO: 222491 - DNA, 23 bp, Homo sapiens
tgccctcagatgaaaataaaata

SEQ ID NO: 222492 - DNA, 20 bp, Homo sapiens
tgccctccatcccgacatgg

SEQ ID NO: 222493 - DNA, 15 bp, Homo sapiens
tgccctccccagagc

SEQ ID NO: 222494 - DNA, 16 bp, Homo sapiens
tgccctccccagagca

SEQ ID NO: 222495 - DNA, 19 bp, Homo sapiens
tgccctccccagagcactg

SEQ ID NO: 222496 - DNA, 11 bp, Homo sapiens
tgccctccccc

SEQ ID NO: 222497 - DNA, 20 bp, Homo sapiens
tgccctccctcggccccacc

SEQ ID NO: 222498 - DNA, 19 bp, Homo sapiens
tgccctccgtcctggcagg

SEQ ID NO: 222499 - DNA, 22 bp, Homo sapiens
tgccctcctaaatgtcagctgt

SEQ ID NO: 222500 - DNA, 14 bp, Homo sapiens
tgccctcgctgctt

SEQ ID NO: 222501 - DNA, 22 bp, Homo sapiens
tgccctctccacacccatgact

SEQ ID NO: 222502 - DNA, 16 bp, Homo sapiens
tgccctgacccctgca

SEQ ID NO: 222503 - DNA, 19 bp, Homo sapiens
tgccctgagctttccgggg

SEQ ID NO: 222504 - DNA, 23 bp, Homo sapiens
tgccctgatgcgtctacccagac

SEQ ID NO: 222505 - DNA, 12 bp, Homo sapiens
tgccctgcacct

SEQ ID NO: 222506 - DNA, 16 bp, Homo sapiens
tgccctgcaccttggg

SEQ ID NO: 222507 - DNA, 16 bp, Homo sapiens
tgccctgccaagcctg

SEQ ID NO: 222508 - DNA, 17 bp, Homo sapiens
tgccctgccacctgtct

SEQ ID NO: 222509 - DNA, 21 bp, Homo sapiens
tgccctgccacctgtctgtct

SEQ ID NO: 222510 - DNA, 14 bp, Homo sapiens
tgccctgccctgcc

SEQ ID NO: 222511 - DNA, 18 bp, Homo sapiens
tgccctgccctgccacct

SEQ ID NO: 222512 - DNA, 12 bp, Homo sapiens
tgccctgcctga

SEQ ID NO: 222513 - DNA, 12 bp, Homo sapiens
tgccctgcctgc

SEQ ID NO: 222514 - DNA, 17 bp, Homo sapiens
tgccctgcctgcccact

SEQ ID NO: 222515 - DNA, 21 bp, Homo sapiens
tgccctgggccagcccaggat

SEQ ID NO: 222516 - DNA, 16 bp, Homo sapiens
tgccctggtgctgcca

SEQ ID NO: 222517 - DNA, 20 bp, Homo sapiens
tgccctggtgctgccacact

SEQ ID NO: 222518 - DNA, 17 bp, Homo sapiens
tgccctgtaacttatct

SEQ ID NO: 222519 - DNA, 19 bp, Homo sapiens
tgccctgtacctctctctg

SEQ ID NO: 222520 - DNA, 11 bp, Homo sapiens
tgccctgtggg

SEQ ID NO: 222521 - DNA, 21 bp, Homo sapiens
tgccctgtgtccgctctctca

SEQ ID NO: 222522 - DNA, 20 bp, Homo sapiens
tgccctgttgtgtatagatg

SEQ ID NO: 222523 - DNA, 23 bp, Homo sapiens
tgcccttcagcatcctcagttcc

SEQ ID NO: 222524 - DNA, 20 bp, Homo sapiens
tgcccttcaggacccttcta

SEQ ID NO: 222525 - DNA, 14 bp, Homo sapiens
tgcccttgctgggt

SEQ ID NO: 222526 - DNA, 14 bp, Homo sapiens
tgccctttggggtc

SEQ ID NO: 222527 - DNA, 15 bp, Homo sapiens
tgccgaccgaggctg

SEQ ID NO: 222528 - DNA, 16 bp, Homo sapiens
tgccgaccgaggctgg

SEQ ID NO: 222529 - DNA, 15 bp, Homo sapiens
tgccgaccgcctgct

SEQ ID NO: 222530 - DNA, 16 bp, Homo sapiens
tgccgaccgcctgctt

SEQ ID NO: 222531 - DNA, 18 bp, Homo sapiens
tgccgaccgcctgcttca

SEQ ID NO: 222532 - DNA, 14 bp, Homo sapiens
tgccgactggctgt

SEQ ID NO: 222533 - DNA, 16 bp, Homo sapiens
tgccgactggctgtga

SEQ ID NO: 222534 - DNA, 22 bp, Homo sapiens
tgccgagagaggcgcgtctgcc

SEQ ID NO: 222535 - DNA, 16 bp, Homo sapiens
tgccgagcctaatgaa

SEQ ID NO: 222536 - DNA, 17 bp, Homo sapiens
tgccgaggagccaggca

SEQ ID NO: 222537 - DNA, 16 bp, Homo sapiens
tgccgagtgccccaga

SEQ ID NO: 222538 - DNA, 20 bp, Homo sapiens
tgccgcaagtctgcagcccg

SEQ ID NO: 222539 - DNA, 20 bp, Homo sapiens
tgccgcgggcggccaggcaa

SEQ ID NO: 222540 - DNA, 15 bp, Homo sapiens
tgccgctgggagagc

SEQ ID NO: 222541 - DNA, 14 bp, Homo sapiens
tgccggccttggcc

SEQ ID NO: 222542 - DNA, 17 bp, Homo sapiens
tgccggctgtggagcaa

SEQ ID NO: 222543 - DNA, 16 bp, Homo sapiens
tgccgggcctggactg

SEQ ID NO: 222544 - DNA, 20 bp, Homo sapiens
tgccgggcctggactgtcct

SEQ ID NO: 222545 - DNA, 19 bp, Homo sapiens
tgccgggttctagtctcct

SEQ ID NO: 222546 - DNA, 22 bp, Homo sapiens
tgccggtcccccatgccaccac

SEQ ID NO: 222547 - DNA, 23 bp, Homo sapiens
tgccgtagggagtacctgctgcc

SEQ ID NO: 222548 - DNA, 15 bp, Homo sapiens
tgccgtcctggactc

SEQ ID NO: 222549 - DNA, 12 bp, Homo sapiens
tgccgtctttgg

SEQ ID NO: 222550 - DNA, 23 bp, Homo sapiens
tgccgtctttggttcctcatggc

SEQ ID NO: 222551 - DNA, 18 bp, Homo sapiens
tgccgtgcacggggccag

SEQ ID NO: 222552 - DNA, 19 bp, Homo sapiens
tgccgtgcacggggccagc

SEQ ID NO: 222553 - DNA, 22 bp, Homo sapiens
tgccgtggattgcacgtggcct

SEQ ID NO: 222554 - DNA, 23 bp, Homo sapiens
tgccgtgggcctgtcgtgccagt

SEQ ID NO: 222555 - DNA, 21 bp, Homo sapiens
tgcctaaaattgtatgaaaat

SEQ ID NO: 222556 - DNA, 17 bp, Homo sapiens
tgcctaagtattccttt

SEQ ID NO: 222557 - DNA, 18 bp, Homo sapiens
tgcctaattcctggcatg

SEQ ID NO: 222558 - DNA, 14 bp, Homo sapiens
tgcctacagataat

SEQ ID NO: 222559 - DNA, 23 bp, Homo sapiens
tgcctacagataatttattttgt

SEQ ID NO: 222560 - DNA, 22 bp, Homo sapiens
tgcctaccagtcgccctctgtg

SEQ ID NO: 222561 - DNA, 18 bp, Homo sapiens
tgcctactatgtgcgaga

SEQ ID NO: 222562 - DNA, 14 bp, Homo sapiens
tgcctactctttgt

SEQ ID NO: 222563 - DNA, 20 bp, Homo sapiens
tgcctactctttgttttctt

SEQ ID NO: 222564 - DNA, 12 bp, Homo sapiens
tgcctaggagct

SEQ ID NO: 222565 - DNA, 14 bp, Homo sapiens
tgcctaggagctgg

SEQ ID NO: 222566 - DNA, 22 bp, Homo sapiens
tgcctaggccaaatgcacaagc

SEQ ID NO: 222567 - DNA, 18 bp, Homo sapiens
tgcctaggctgaccttga

SEQ ID NO: 222568 - DNA, 17 bp, Homo sapiens
tgcctagggcctggtcc

SEQ ID NO: 222569 - DNA, 16 bp, Homo sapiens
tgcctagtgatgtaga

SEQ ID NO: 222570 - DNA, 20 bp, Homo sapiens
tgcctatcacctcttatgca

SEQ ID NO: 222571 - DNA, 22 bp, Homo sapiens
tgcctcaagaaattgcctcctt

SEQ ID NO: 222572 - DNA, 14 bp, Homo sapiens
tgcctcaagagaag

SEQ ID NO: 222573 - DNA, 15 bp, Homo sapiens
tgcctcaagagaagg

SEQ ID NO: 222574 - DNA, 16 bp, Homo sapiens
tgcctcacatctccct

SEQ ID NO: 222575 - DNA, 18 bp, Homo sapiens
tgcctcagcctcccgagt

SEQ ID NO: 222576 - DNA, 17 bp, Homo sapiens
tgcctcagcctcctgag

SEQ ID NO: 222577 - DNA, 13 bp, Homo sapiens
tgcctcagccttc

SEQ ID NO: 222578 - DNA, 17 bp, Homo sapiens
tgcctcagcgctgccca

SEQ ID NO: 222579 - DNA, 18 bp, Homo sapiens
tgcctcagcgctgcccac

SEQ ID NO: 222580 - DNA, 16 bp, Homo sapiens
tgcctcatgctctcta

SEQ ID NO: 222581 - DNA, 19 bp, Homo sapiens
tgcctccaccgagccagct

SEQ ID NO: 222582 - DNA, 22 bp, Homo sapiens
tgcctccaccgagccagcttgg

SEQ ID NO: 222583 - DNA, 15 bp, Homo sapiens
tgcctccatggtgcc

SEQ ID NO: 222584 - DNA, 16 bp, Homo sapiens
tgcctccatggtgcct

SEQ ID NO: 222585 - DNA, 19 bp, Homo sapiens
tgcctcccaaggtcctctc

SEQ ID NO: 222586 - DNA, 23 bp, Homo sapiens
tgcctcccacacttgctggggct

SEQ ID NO: 222587 - DNA, 16 bp, Homo sapiens
tgcctcccaggctcaa

SEQ ID NO: 222588 - DNA, 15 bp, Homo sapiens
tgcctccccaaccct

SEQ ID NO: 222589 - DNA, 23 bp, Homo sapiens
tgcctccccaaccctgcccctgc

SEQ ID NO: 222590 - DNA, 14 bp, Homo sapiens
tgcctccccccaga

SEQ ID NO: 222591 - DNA, 21 bp, Homo sapiens
tgcctccccccagaccccgcc

SEQ ID NO: 222592 - DNA, 22 bp, Homo sapiens
tgcctcccccgccacctgtgtg

SEQ ID NO: 222593 - DNA, 24 bp, Homo sapiens
tgcctcccggctttgcagggagac

SEQ ID NO: 222594 - DNA, 20 bp, Homo sapiens
tgcctccctctcttccggga

SEQ ID NO: 222595 - DNA, 17 bp, Homo sapiens
tgcctccctgtccaccc

SEQ ID NO: 222596 - DNA, 14 bp, Homo sapiens
tgcctcccttccca

SEQ ID NO: 222597 - DNA, 20 bp, Homo sapiens
tgcctcccttcccagtgggc

SEQ ID NO: 222598 - DNA, 22 bp, Homo sapiens
tgcctcccttccgctgcgggcc

SEQ ID NO: 222599 - DNA, 14 bp, Homo sapiens
tgcctcccttcctc

SEQ ID NO: 222600 - DNA, 15 bp, Homo sapiens
tgcctcccttcctcc

SEQ ID NO: 222601 - DNA, 19 bp, Homo sapiens
tgcctcccttcctccgctc

SEQ ID NO: 222602 - DNA, 15 bp, Homo sapiens
tgcctccctttctgg

SEQ ID NO: 222603 - DNA, 17 bp, Homo sapiens
tgcctccggccctgccc

SEQ ID NO: 222604 - DNA, 21 bp, Homo sapiens
tgcctcctacaaccaggtctt

SEQ ID NO: 222605 - DNA, 16 bp, Homo sapiens
tgcctcctctgtcctc

SEQ ID NO: 222606 - DNA, 14 bp, Homo sapiens
tgcctcctgcctgc

SEQ ID NO: 222607 - DNA, 18 bp, Homo sapiens
tgcctcctgcctgcccct

SEQ ID NO: 222608 - DNA, 19 bp, Homo sapiens
tgcctccttccacctccct

SEQ ID NO: 222609 - DNA, 19 bp, Homo sapiens
tgcctcgtgggttcttcct

SEQ ID NO: 222610 - DNA, 13 bp, Homo sapiens
tgcctctgacagc

SEQ ID NO: 222611 - DNA, 22 bp, Homo sapiens
tgcctctgacagcagcctgtga

SEQ ID NO: 222612 - DNA, 11 bp, Homo sapiens
tgcctctgcca

SEQ ID NO: 222613 - DNA, 12 bp, Homo sapiens
tgcctctgccac

SEQ ID NO: 222614 - DNA, 12 bp, Homo sapiens
tgcctctgcctg

SEQ ID NO: 222615 - DNA, 14 bp, Homo sapiens
tgcctctgccttag

SEQ ID NO: 222616 - DNA, 19 bp, Homo sapiens
tgcctctgccttgatggag

SEQ ID NO: 222617 - DNA, 21 bp, Homo sapiens
tgcctctgccttgatggagaa

SEQ ID NO: 222618 - DNA, 13 bp, Homo sapiens
tgcctcttcctcc

SEQ ID NO: 222619 - DNA, 13 bp, Homo sapiens
tgcctcttgggag

SEQ ID NO: 222620 - DNA, 21 bp, Homo sapiens
tgcgatcatggctcactgcag

SEQ ID NO: 222621 - DNA, 11 bp, Homo sapiens
tgcgatgtgtt

SEQ ID NO: 222622 - DNA, 17 bp, Homo sapiens
tgcgcaaaacccagaag

SEQ ID NO: 222623 - DNA, 16 bp, Homo sapiens
tgcgcacaacttaaaa

SEQ ID NO: 222624 - DNA, 21 bp, Homo sapiens
tgcgcagccgcgctctgcccc

SEQ ID NO: 222625 - DNA, 13 bp, Homo sapiens
tgcgccacctgct

SEQ ID NO: 222626 - DNA, 11 bp, Homo sapiens
tgcgccctccc

SEQ ID NO: 222627 - DNA, 13 bp, Homo sapiens
tgcgccctccctc

SEQ ID NO: 222628 - DNA, 21 bp, Homo sapiens
tgcgccctccctccctccaca

SEQ ID NO: 222629 - DNA, 17 bp, Homo sapiens
tgcgcccttgtgccctg

SEQ ID NO: 222630 - DNA, 21 bp, Homo sapiens
tgcgccgagaccgcagaggga

SEQ ID NO: 222631 - DNA, 18 bp, Homo sapiens
tgcgccgctgtgctgttg

SEQ ID NO: 222632 - DNA, 18 bp, Homo sapiens
tgcgctcacctgcagccc

SEQ ID NO: 222633 - DNA, 19 bp, Homo sapiens
tgcgctcctctgcagcctg

SEQ ID NO: 222634 - DNA, 23 bp, Homo sapiens
tgcgctcctctgcagcctgagct

SEQ ID NO: 222635 - DNA, 12 bp, Homo sapiens
tgcgctcttggt

SEQ ID NO: 222636 - DNA, 17 bp, Homo sapiens
tgcgctcttggtccctg

SEQ ID NO: 222637 - DNA, 17 bp, Homo sapiens
tgcgcttttgctggtca

SEQ ID NO: 222638 - DNA, 18 bp, Homo sapiens
tgcgcttttgctggtcac

SEQ ID NO: 222639 - DNA, 16 bp, Homo sapiens
tgcggaccggagcggc

SEQ ID NO: 222640 - DNA, 20 bp, Homo sapiens
tgcggaccggagcggctgag

SEQ ID NO: 222641 - DNA, 14 bp, Homo sapiens
tgcggacgggctgt

SEQ ID NO: 222642 - DNA, 21 bp, Homo sapiens
tgcggactccatggcccttcc

SEQ ID NO: 222643 - DNA, 16 bp, Homo sapiens
tgcggctgcccacgct

SEQ ID NO: 222644 - DNA, 20 bp, Homo sapiens
tgcggcttccgagggcacta

SEQ ID NO: 222645 - DNA, 14 bp, Homo sapiens
tgcgggctgggcag

SEQ ID NO: 222646 - DNA, 20 bp, Homo sapiens
tgcgggcttcctcctggtgt

SEQ ID NO: 222647 - DNA, 18 bp, Homo sapiens
tgcggtttccaaggtgca

SEQ ID NO: 222648 - DNA, 14 bp, Homo sapiens
tgcgtatgtctgtt

SEQ ID NO: 222649 - DNA, 19 bp, Homo sapiens
tgcgtatgtctgttaccat

SEQ ID NO: 222650 - DNA, 15 bp, Homo sapiens
tgcgtccactttccc

SEQ ID NO: 222651 - DNA, 19 bp, Homo sapiens
tgcgtcctgacgccctgcg

SEQ ID NO: 222652 - DNA, 19 bp, Homo sapiens
tgcgtcctgcagaggacca

SEQ ID NO: 222653 - DNA, 15 bp, Homo sapiens
tgcgtctacccagac

SEQ ID NO: 222654 - DNA, 14 bp, Homo sapiens
tgcgtgaaacacac

SEQ ID NO: 222655 - DNA, 23 bp, Homo sapiens
tgcgtgaccggcccgccaccttg

SEQ ID NO: 222656 - DNA, 13 bp, Homo sapiens
tgcgtggatcaag

SEQ ID NO: 222657 - DNA, 15 bp, Homo sapiens
tgcgtggatcaagct

SEQ ID NO: 222658 - DNA, 13 bp, Homo sapiens
tgcgtggcctggg

SEQ ID NO: 222659 - DNA, 15 bp, Homo sapiens
tgcgtggctgtggca

SEQ ID NO: 222660 - DNA, 21 bp, Homo sapiens
tgcgtgggtggggagggaggt

SEQ ID NO: 222661 - DNA, 19 bp, Homo sapiens
tgcgttagaatgaggagga

SEQ ID NO: 222662 - DNA, 19 bp, Homo sapiens
tgcgttcccttcagtactg

SEQ ID NO: 222663 - DNA, 15 bp, Homo sapiens
tgcgttggagccact

SEQ ID NO: 222664 - DNA, 23 bp, Homo sapiens
tgcgttggagccactcctgtccc

SEQ ID NO: 222665 - DNA, 13 bp, Homo sapiens
tgcgttttagagt

SEQ ID NO: 222666 - DNA, 12 bp, Homo sapiens
tgctaaaaggaa

SEQ ID NO: 222667 - DNA, 13 bp, Homo sapiens
tgctaacaaactg

SEQ ID NO: 222668 - DNA, 18 bp, Homo sapiens
tgctaacaaactgaaaaa

SEQ ID NO: 222669 - DNA, 15 bp, Homo sapiens
tgctaacctaaaaga

SEQ ID NO: 222670 - DNA, 16 bp, Homo sapiens
tgctaactgtatgtgt

SEQ ID NO: 222671 - DNA, 16 bp, Homo sapiens
tgctaactttgccctt

SEQ ID NO: 222672 - DNA, 17 bp, Homo sapiens
tgctaataaactgtttt

SEQ ID NO: 222673 - DNA, 18 bp, Homo sapiens
tgctaataaatgaccagt

SEQ ID NO: 222674 - DNA, 21 bp, Homo sapiens
tgctaataaatgaccagttta

SEQ ID NO: 222675 - DNA, 23 bp, Homo sapiens
tgctaatcatgtgggtgagccag

SEQ ID NO: 222676 - DNA, 17 bp, Homo sapiens
tgctaatcttcagggca

SEQ ID NO: 222677 - DNA, 22 bp, Homo sapiens
tgctaatgaattttaaaagcat

SEQ ID NO: 222678 - DNA, 23 bp, Homo sapiens
tgctaatgaattttaaaagcata

SEQ ID NO: 222679 - DNA, 14 bp, Homo sapiens
tgctaatgtaatca

SEQ ID NO: 222680 - DNA, 13 bp, Homo sapiens
tgctaattacaca

SEQ ID NO: 222681 - DNA, 13 bp, Homo sapiens
tgctacaacttca

SEQ ID NO: 222682 - DNA, 19 bp, Homo sapiens
tgctacaacttcagcagta

SEQ ID NO: 222683 - DNA, 14 bp, Homo sapiens
tgctacagaaaata

SEQ ID NO: 222684 - DNA, 18 bp, Homo sapiens
tgctacagagaaaatcaa

SEQ ID NO: 222685 - DNA, 23 bp, Homo sapiens
tgctacctctaacaccacactga

SEQ ID NO: 222686 - DNA, 14 bp, Homo sapiens
tgctacctctgatc

SEQ ID NO: 222687 - DNA, 12 bp, Homo sapiens
tgctacgaagaa

SEQ ID NO: 222688 - DNA, 19 bp, Homo sapiens
tgctacggtagtgatgaaa

SEQ ID NO: 222689 - DNA, 13 bp, Homo sapiens
tgctactcagtat

SEQ ID NO: 222690 - DNA, 22 bp, Homo sapiens
tgctactccactgacctggaag

SEQ ID NO: 222691 - DNA, 19 bp, Homo sapiens
tgctacttttacttgttca

SEQ ID NO: 222692 - DNA, 14 bp, Homo sapiens
tgctagaaaatcga

SEQ ID NO: 222693 - DNA, 23 bp, Homo sapiens
tgctagatgagaattcagctgcc

SEQ ID NO: 222694 - DNA, 20 bp, Homo sapiens
tgctagccagcattccatat

SEQ ID NO: 222695 - DNA, 17 bp, Homo sapiens
tgctagctatgtgacct

SEQ ID NO: 222696 - DNA, 19 bp, Homo sapiens
tgctaggcgctggggagac

SEQ ID NO: 222697 - DNA, 19 bp, Homo sapiens
tgctagggtgcctgctctc

SEQ ID NO: 222698 - DNA, 23 bp, Homo sapiens
tgctaggtgggccagcccctccc

SEQ ID NO: 222699 - DNA, 23 bp, Homo sapiens
tgctaggttaattccaattatat

SEQ ID NO: 222700 - DNA, 15 bp, Homo sapiens
tgctagtacctgtaa

SEQ ID NO: 222701 - DNA, 13 bp, Homo sapiens
tgctagtgagctg

SEQ ID NO: 222702 - DNA, 22 bp, Homo sapiens
tgctagtgatacactgtatcta

SEQ ID NO: 222703 - DNA, 19 bp, Homo sapiens
tgctataattctatactgt

SEQ ID NO: 222704 - DNA, 22 bp, Homo sapiens
tgctatagtgtataccacctgt

SEQ ID NO: 222705 - DNA, 18 bp, Homo sapiens
tgctatataaataaagca

SEQ ID NO: 222706 - DNA, 23 bp, Homo sapiens
tgctatatttgtgatataggaat

SEQ ID NO: 222707 - DNA, 19 bp, Homo sapiens
tgctatgaaaatgagcatc

SEQ ID NO: 222708 - DNA, 22 bp, Homo sapiens
tgctatgaagactacttttaga

SEQ ID NO: 222709 - DNA, 16 bp, Homo sapiens
tgctatggactgcaca

SEQ ID NO: 222710 - DNA, 15 bp, Homo sapiens
tgctatgtctgtgat

SEQ ID NO: 222711 - DNA, 15 bp, Homo sapiens
tgctatttgctttag

SEQ ID NO: 222712 - DNA, 19 bp, Homo sapiens
tgctatttgctttagagac

SEQ ID NO: 222713 - DNA, 21 bp, Homo sapiens
tgctatttgctttagagacag

SEQ ID NO: 222714 - DNA, 19 bp, Homo sapiens
tgctatttgttgtttttaa

SEQ ID NO: 222715 - DNA, 22 bp, Homo sapiens
tgctatttgttgtttttaacaa

SEQ ID NO: 222716 - DNA, 15 bp, Homo sapiens
tgctcaaaaaatgag

SEQ ID NO: 222717 - DNA, 23 bp, Homo sapiens
tgctcaaagatgtactgagagga

SEQ ID NO: 222718 - DNA, 19 bp, Homo sapiens
tgctcaaatctattcagac

SEQ ID NO: 222719 - DNA, 16 bp, Homo sapiens
tgctcaacccccctcc

SEQ ID NO: 222720 - DNA, 19 bp, Homo sapiens
tgctcaacccccctcccag

SEQ ID NO: 222721 - DNA, 20 bp, Homo sapiens
tgctcaacccccctcccaga

SEQ ID NO: 222722 - DNA, 20 bp, Homo sapiens
tgctcaactctacccctgct

SEQ ID NO: 222723 - DNA, 23 bp, Homo sapiens
tgctcaactctacccctgctccc

SEQ ID NO: 222724 - DNA, 15 bp, Homo sapiens
tgctcaataaaggtc

SEQ ID NO: 222725 - DNA, 16 bp, Homo sapiens
tgctcaataaaggtca

SEQ ID NO: 222726 - DNA, 20 bp, Homo sapiens
tgctcaataaatatttgttt

SEQ ID NO: 222727 - DNA, 14 bp, Homo sapiens
tgctcacattccct

SEQ ID NO: 222728 - DNA, 17 bp, Homo sapiens
tgctcacattccctctc

SEQ ID NO: 222729 - DNA, 16 bp, Homo sapiens
tgctcacccattgtct

SEQ ID NO: 222730 - DNA, 12 bp, Homo sapiens
tgctcacctcta

SEQ ID NO: 222731 - DNA, 15 bp, Homo sapiens
tgctcacgactcttc

SEQ ID NO: 222732 - DNA, 16 bp, Homo sapiens
tgctcacgctcccccg

SEQ ID NO: 222733 - DNA, 16 bp, Homo sapiens
tgctcacgtctgtgag

SEQ ID NO: 222734 - DNA, 23 bp, Homo sapiens
tgctcacgtctgtgagtctgtcc

SEQ ID NO: 222735 - DNA, 13 bp, Homo sapiens
tgctcactcccta

SEQ ID NO: 222736 - DNA, 16 bp, Homo sapiens
tgctcagaagagaatc

SEQ ID NO: 222737 - DNA, 14 bp, Homo sapiens
tgctcagagaagga

SEQ ID NO: 222738 - DNA, 12 bp, Homo sapiens
tgctcagctggc

SEQ ID NO: 222739 - DNA, 14 bp, Homo sapiens
tgctcaggcctcac

SEQ ID NO: 222740 - DNA, 20 bp, Homo sapiens
tgctcaggcctcacctggct

SEQ ID NO: 222741 - DNA, 16 bp, Homo sapiens
tgctcagggtcaattt

SEQ ID NO: 222742 - DNA, 20 bp, Homo sapiens
tgctcagggtcaatttcttt

SEQ ID NO: 222743 - DNA, 12 bp, Homo sapiens
tgctcagtattg

SEQ ID NO: 222744 - DNA, 14 bp, Homo sapiens
tgctcagtctccct

SEQ ID NO: 222745 - DNA, 13 bp, Homo sapiens
tgctcagtggatc

SEQ ID NO: 222746 - DNA, 19 bp, Homo sapiens
tgctcagtggatcacacac

SEQ ID NO: 222747 - DNA, 14 bp, Homo sapiens
tgctcagttccaat

SEQ ID NO: 222748 - DNA, 15 bp, Homo sapiens
tgctcagttccaatg

SEQ ID NO: 222749 - DNA, 18 bp, Homo sapiens
tgctcatcggagactgcc

SEQ ID NO: 222750 - DNA, 23 bp, Homo sapiens
tgctgccatgccactgccaggca

SEQ ID NO: 222751 - DNA, 15 bp, Homo sapiens
tgctgcccacggcca

SEQ ID NO: 222752 - DNA, 19 bp, Homo sapiens
tgctgcccacggccaccca

SEQ ID NO: 222753 - DNA, 21 bp, Homo sapiens
tgctgcccacggccacccacc

SEQ ID NO: 222754 - DNA, 17 bp, Homo sapiens
tgctgccccacaacaca

SEQ ID NO: 222755 - DNA, 24 bp, Homo sapiens
tgctgccccacaacacaccttgcc

SEQ ID NO: 222756 - DNA, 21 bp, Homo sapiens
tgctgcccccagaccccatcc

SEQ ID NO: 222757 - DNA, 14 bp, Homo sapiens
tgctgcccctgtct

SEQ ID NO: 222758 - DNA, 18 bp, Homo sapiens
tgctgcccctgtctggaa

SEQ ID NO: 222759 - DNA, 14 bp, Homo sapiens
tgctgccctaggct

SEQ ID NO: 222760 - DNA, 13 bp, Homo sapiens
tgctgccctccat

SEQ ID NO: 222761 - DNA, 18 bp, Homo sapiens
tgctgccctgatgcgtct

SEQ ID NO: 222762 - DNA, 16 bp, Homo sapiens
tgctgccgcctcccag

SEQ ID NO: 222763 - DNA, 17 bp, Homo sapiens
tgctgccgcctcccagc

SEQ ID NO: 222764 - DNA, 18 bp, Homo sapiens
tgctgcctaggctgacct

SEQ ID NO: 222765 - DNA, 14 bp, Homo sapiens
tgctgcctccagaa

SEQ ID NO: 222766 - DNA, 14 bp, Homo sapiens
tgctgcctccccaa

SEQ ID NO: 222767 - DNA, 22 bp, Homo sapiens
tgctgcctccccaaccctgccc

SEQ ID NO: 222768 - DNA, 15 bp, Homo sapiens
tgctgcctccctggg

SEQ ID NO: 222769 - DNA, 12 bp, Homo sapiens
tgctgcctgccg

SEQ ID NO: 222770 - DNA, 14 bp, Homo sapiens
tgctgcctgcctcc

SEQ ID NO: 222771 - DNA, 22 bp, Homo sapiens
tgctgcctgcctccggccctgc

SEQ ID NO: 222772 - DNA, 23 bp, Homo sapiens
tgctgcctgcctccggccctgcc

SEQ ID NO: 222773 - DNA, 15 bp, Homo sapiens
tgctgcctgcctgtc

SEQ ID NO: 222774 - DNA, 16 bp, Homo sapiens
tgctgcctgcctgtct

SEQ ID NO: 222775 - DNA, 12 bp, Homo sapiens
tgctgccttcag

SEQ ID NO: 222776 - DNA, 16 bp, Homo sapiens
tgctgcgcccttacct

SEQ ID NO: 222777 - DNA, 20 bp, Homo sapiens
tgctgcgcccttaccttccc

SEQ ID NO: 222778 - DNA, 22 bp, Homo sapiens
tgctgcgggtgggtatcccacc

SEQ ID NO: 222779 - DNA, 22 bp, Homo sapiens
tgctgctaatcttcagggcact

SEQ ID NO: 222780 - DNA, 16 bp, Homo sapiens
tgctgctaccgccctg

SEQ ID NO: 222781 - DNA, 13 bp, Homo sapiens
tgctgctatgaaa

SEQ ID NO: 222782 - DNA, 13 bp, Homo sapiens
tgctgctccatgg

SEQ ID NO: 222783 - DNA, 14 bp, Homo sapiens
tgctgctcccagcc

SEQ ID NO: 222784 - DNA, 12 bp, Homo sapiens
tgctgctcctct

SEQ ID NO: 222785 - DNA, 19 bp, Homo sapiens
tgctgctcgggaaggcctg

SEQ ID NO: 222786 - DNA, 14 bp, Homo sapiens
tgctgctgcctgcc

SEQ ID NO: 222787 - DNA, 15 bp, Homo sapiens
tgctgctgcgccctt

SEQ ID NO: 222788 - DNA, 9 bp, Homo sapiens
tgctgctgt

SEQ ID NO: 222789 - DNA, 12 bp, Homo sapiens
tgctgctgtgaa

SEQ ID NO: 222790 - DNA, 13 bp, Homo sapiens
tgctgctgtgcct

SEQ ID NO: 222791 - DNA, 16 bp, Homo sapiens
tgctgcttccctctgc

SEQ ID NO: 222792 - DNA, 14 bp, Homo sapiens
tgctgcttctcttg

SEQ ID NO: 222793 - DNA, 16 bp, Homo sapiens
tgctgcttctgggcct

SEQ ID NO: 222794 - DNA, 17 bp, Homo sapiens
tgctgcttgtgcctccc

SEQ ID NO: 222795 - DNA, 22 bp, Homo sapiens
tgctgcttgtgcctcccttccc

SEQ ID NO: 222796 - DNA, 19 bp, Homo sapiens
tgctgctttaattgtgaat

SEQ ID NO: 222797 - DNA, 14 bp, Homo sapiens
tgctgctttgcttc

SEQ ID NO: 222798 - DNA, 17 bp, Homo sapiens
tgctgctttttggcaca

SEQ ID NO: 222799 - DNA, 22 bp, Homo sapiens
tgctggaaaatctgtaaaaaag

SEQ ID NO: 222800 - DNA, 18 bp, Homo sapiens
tgctggaatggggacctg

SEQ ID NO: 222801 - DNA, 19 bp, Homo sapiens
tgctggacaggtctgggag

SEQ ID NO: 222802 - DNA, 16 bp, Homo sapiens
tgctggacagtatcac

SEQ ID NO: 222803 - DNA, 22 bp, Homo sapiens
tgctggagagtagacatccccc

SEQ ID NO: 222804 - DNA, 13 bp, Homo sapiens
tgctggagcggct

SEQ ID NO: 222805 - DNA, 17 bp, Homo sapiens
tgctggaggcagactcg

SEQ ID NO: 222806 - DNA, 15 bp, Homo sapiens
tgctggagtgctggc

SEQ ID NO: 222807 - DNA, 15 bp, Homo sapiens
tgctggataaaatga

SEQ ID NO: 222808 - DNA, 18 bp, Homo sapiens
tgctggatgtcaccaaga

SEQ ID NO: 222809 - DNA, 15 bp, Homo sapiens
tgctggattaatgtt

SEQ ID NO: 222810 - DNA, 16 bp, Homo sapiens
tgctggattaatgttt

SEQ ID NO: 222811 - DNA, 21 bp, Homo sapiens
aatgctttgggaggccaaggc

SEQ ID NO: 222812 - DNA, 23 bp, Homo sapiens
aatgctttgtccatgatgtcctt

SEQ ID NO: 222813 - DNA, 19 bp, Homo sapiens
aatgctttgtgtgattgaa

SEQ ID NO: 222814 - DNA, 11 bp, Homo sapiens
aatgctttttg

SEQ ID NO: 222815 - DNA, 22 bp, Homo sapiens
aatggaaaacttagtttgtgaa

SEQ ID NO: 222816 - DNA, 19 bp, Homo sapiens
aatggaaagaaaagaatgt

SEQ ID NO: 222817 - DNA, 18 bp, Homo sapiens
aatggactggcttggcca

SEQ ID NO: 222818 - DNA, 14 bp, Homo sapiens
aatggacttgcttc

SEQ ID NO: 222819 - DNA, 16 bp, Homo sapiens
aatggagcttgtacat

SEQ ID NO: 222820 - DNA, 15 bp, Homo sapiens
aatggaggaatatga

SEQ ID NO: 222821 - DNA, 19 bp, Homo sapiens
aatggagtagacccctggc

SEQ ID NO: 222822 - DNA, 21 bp, Homo sapiens
aatggagtagacccctggctg

SEQ ID NO: 222823 - DNA, 19 bp, Homo sapiens
aatggagtcagtttgcagt

SEQ ID NO: 222824 - DNA, 15 bp, Homo sapiens
aatggatgacaaaga

SEQ ID NO: 222825 - DNA, 17 bp, Homo sapiens
aatggattaaatggcac

SEQ ID NO: 222826 - DNA, 19 bp, Homo sapiens
aatggatttttaaattata

SEQ ID NO: 222827 - DNA, 18 bp, Homo sapiens
aatggcagctagactgga

SEQ ID NO: 222828 - DNA, 14 bp, Homo sapiens
aatggcatgtaata

SEQ ID NO: 222829 - DNA, 15 bp, Homo sapiens
aatggcctcttaaaa

SEQ ID NO: 222830 - DNA, 19 bp, Homo sapiens
aatggcctcttaaaaatta

SEQ ID NO: 222831 - DNA, 18 bp, Homo sapiens
aatggcgcagtgcctctg

SEQ ID NO: 222832 - DNA, 15 bp, Homo sapiens
aatggctagtactgt

SEQ ID NO: 222833 - DNA, 14 bp, Homo sapiens
aatgggagccagaa

SEQ ID NO: 222834 - DNA, 16 bp, Homo sapiens
aatgggaggcctctga

SEQ ID NO: 222835 - DNA, 13 bp, Homo sapiens
aatgggcctgccc

SEQ ID NO: 222836 - DNA, 15 bp, Homo sapiens
aatggggtgggccca

SEQ ID NO: 222837 - DNA, 22 bp, Homo sapiens
aatggtagaagatgaatcagta

SEQ ID NO: 222838 - DNA, 16 bp, Homo sapiens
aatggtataaatttca

SEQ ID NO: 222839 - DNA, 14 bp, Homo sapiens
aatggtcccttctt

SEQ ID NO: 222840 - DNA, 22 bp, Homo sapiens
aatggtctttctaatgtgtgaa

SEQ ID NO: 222841 - DNA, 19 bp, Homo sapiens
aatggtgagaattaaaata

SEQ ID NO: 222842 - DNA, 17 bp, Homo sapiens
aatggtgcaatgaatta

SEQ ID NO: 222843 - DNA, 15 bp, Homo sapiens
aatggtgcccttgga

SEQ ID NO: 222844 - DNA, 19 bp, Homo sapiens
aatggtgggctccagagta

SEQ ID NO: 222845 - DNA, 23 bp, Homo sapiens
aatggtgtgtttccctagactct

SEQ ID NO: 222846 - DNA, 14 bp, Homo sapiens
aatggttgggacaa

SEQ ID NO: 222847 - DNA, 22 bp, Homo sapiens
aatggttgggacaatggcaata

SEQ ID NO: 222848 - DNA, 13 bp, Homo sapiens
aatggttgtgtag

SEQ ID NO: 222849 - DNA, 17 bp, Homo sapiens
aatggttttcttgtgtg

SEQ ID NO: 222850 - DNA, 14 bp, Homo sapiens
aatgtaaaacacat

SEQ ID NO: 222851 - DNA, 15 bp, Homo sapiens
aatgtaaaattcata

SEQ ID NO: 222852 - DNA, 15 bp, Homo sapiens
aatgtaaagacaaaa

SEQ ID NO: 222853 - DNA, 18 bp, Homo sapiens
aatgtaaatattctatat

SEQ ID NO: 222854 - DNA, 12 bp, Homo sapiens
aatgtaaatttg

SEQ ID NO: 222855 - DNA, 14 bp, Homo sapiens
aatgtaaatttgta

SEQ ID NO: 222856 - DNA, 18 bp, Homo sapiens
aatgtaaatttgtactat

SEQ ID NO: 222857 - DNA, 19 bp, Homo sapiens
aatgtaagaaaacaaaatc

SEQ ID NO: 222858 - DNA, 16 bp, Homo sapiens
aatgtaattgaataaa

SEQ ID NO: 222859 - DNA, 13 bp, Homo sapiens
aatgtacaaagat

SEQ ID NO: 222860 - DNA, 16 bp, Homo sapiens
aatgtacaaagatact

SEQ ID NO: 222861 - DNA, 16 bp, Homo sapiens
aatgtacaagttttgt

SEQ ID NO: 222862 - DNA, 21 bp, Homo sapiens
aatgtacacagtttaaacaca

SEQ ID NO: 222863 - DNA, 12 bp, Homo sapiens
aatgtactgaga

SEQ ID NO: 222864 - DNA, 22 bp, Homo sapiens
aatgtagaagaaagcaaaaaat

SEQ ID NO: 222865 - DNA, 14 bp, Homo sapiens
aatgtagctggttt

SEQ ID NO: 222866 - DNA, 17 bp, Homo sapiens
aatgtagctggtttcct

SEQ ID NO: 222867 - DNA, 20 bp, Homo sapiens
aatgtatatgaacttaacat

SEQ ID NO: 222868 - DNA, 17 bp, Homo sapiens
aatgtatattgatgtaa

SEQ ID NO: 222869 - DNA, 22 bp, Homo sapiens
aatgtatcccttctcacagcac

SEQ ID NO: 222870 - DNA, 12 bp, Homo sapiens
aatgtatcttat

SEQ ID NO: 222871 - DNA, 13 bp, Homo sapiens
aatgtatcttatt

SEQ ID NO: 222872 - DNA, 16 bp, Homo sapiens
aatgtatcttattcac

SEQ ID NO: 222873 - DNA, 18 bp, Homo sapiens
aatgtatcttattcacat

SEQ ID NO: 222874 - DNA, 18 bp, Homo sapiens
aatgtatgtgaaagtgta

SEQ ID NO: 222875 - DNA, 20 bp, Homo sapiens
aatgtatgtgcactgtcact

SEQ ID NO: 222876 - DNA, 14 bp, Homo sapiens
aatgtattattctg

SEQ ID NO: 222877 - DNA, 16 bp, Homo sapiens
aatgtattattctgca

SEQ ID NO: 222878 - DNA, 22 bp, Homo sapiens
aatgtattattctgcagcatga

SEQ ID NO: 222879 - DNA, 14 bp, Homo sapiens
aatgtattcaagca

SEQ ID NO: 222880 - DNA, 13 bp, Homo sapiens
aatgtattttgaa

SEQ ID NO: 222881 - DNA, 18 bp, Homo sapiens
gctgagaagcttttgaat

SEQ ID NO: 222882 - DNA, 19 bp, Homo sapiens
gctgagactggatactgcc

SEQ ID NO: 222883 - DNA, 20 bp, Homo sapiens
gctgagactggatactgccc

SEQ ID NO: 222884 - DNA, 14 bp, Homo sapiens
gctgagagactttt

SEQ ID NO: 222885 - DNA, 20 bp, Homo sapiens
gctgagagccccagctgaca

SEQ ID NO: 222886 - DNA, 23 bp, Homo sapiens
gctgagatcacaccactgtactc

SEQ ID NO: 222887 - DNA, 15 bp, Homo sapiens
gctgagatgagcccc

SEQ ID NO: 222888 - DNA, 21 bp, Homo sapiens
gctgagatgcaccaagtacag

SEQ ID NO: 222889 - DNA, 23 bp, Homo sapiens
gctgagatgcaccaagtacagcc

SEQ ID NO: 222890 - DNA, 19 bp, Homo sapiens
gctgagatgggaggatcac

SEQ ID NO: 222891 - DNA, 12 bp, Homo sapiens
gctgagccactc

SEQ ID NO: 222892 - DNA, 20 bp, Homo sapiens
gctgagcccctaccccacac

SEQ ID NO: 222893 - DNA, 13 bp, Homo sapiens
gctgagcccctcc

SEQ ID NO: 222894 - DNA, 14 bp, Homo sapiens
gctgagcctgaggc

SEQ ID NO: 222895 - DNA, 19 bp, Homo sapiens
gctgagctctgacctgccc

SEQ ID NO: 222896 - DNA, 15 bp, Homo sapiens
gctgagctgagcttc

SEQ ID NO: 222897 - DNA, 21 bp, Homo sapiens
gctgagcttcggttctccaga

SEQ ID NO: 222898 - DNA, 22 bp, Homo sapiens
gctgagcttcggttctccagaa

SEQ ID NO: 222899 - DNA, 16 bp, Homo sapiens
gctgagctttccagcc

SEQ ID NO: 222900 - DNA, 17 bp, Homo sapiens
gctgaggacggggcaga

SEQ ID NO: 222901 - DNA, 19 bp, Homo sapiens
gctgaggacggggcagagc

SEQ ID NO: 222902 - DNA, 22 bp, Homo sapiens
gctgaggacggggcagagctga

SEQ ID NO: 222903 - DNA, 23 bp, Homo sapiens
gctgaggacggggcagagctgag

SEQ ID NO: 222904 - DNA, 22 bp, Homo sapiens
gctgaggccggatgcggtggct

SEQ ID NO: 222905 - DNA, 12 bp, Homo sapiens
gctgaggcctgg

SEQ ID NO: 222906 - DNA, 17 bp, Homo sapiens
gctgaggcttgggccca

SEQ ID NO: 222907 - DNA, 18 bp, Homo sapiens
gctgaggcttgggcccag

SEQ ID NO: 222908 - DNA, 22 bp, Homo sapiens
gctgagggcagggttctagaag

SEQ ID NO: 222909 - DNA, 15 bp, Homo sapiens
gctgaggtgggcaga

SEQ ID NO: 222910 - DNA, 18 bp, Homo sapiens
gctgaggtgggcagatca

SEQ ID NO: 222911 - DNA, 15 bp, Homo sapiens
gctgagtactcaggc

SEQ ID NO: 222912 - DNA, 16 bp, Homo sapiens
gctgagtcacctcctc

SEQ ID NO: 222913 - DNA, 17 bp, Homo sapiens
gctgagtcacctcctcc

SEQ ID NO: 222914 - DNA, 19 bp, Homo sapiens
gctgagtcacctcctccac

SEQ ID NO: 222915 - DNA, 22 bp, Homo sapiens
gctgagtcacctcctccactca

SEQ ID NO: 222916 - DNA, 17 bp, Homo sapiens
gctgagtcggctgggca

SEQ ID NO: 222917 - DNA, 18 bp, Homo sapiens
gctgagtcggctgggcag

SEQ ID NO: 222918 - DNA, 20 bp, Homo sapiens
gctgagtcggctgggcaggg

SEQ ID NO: 222919 - DNA, 23 bp, Homo sapiens
gctgagtcggctgggcagggccg

SEQ ID NO: 222920 - DNA, 16 bp, Homo sapiens
gctgagtctggctagg

SEQ ID NO: 222921 - DNA, 13 bp, Homo sapiens
gctgataaaagat

SEQ ID NO: 222922 - DNA, 18 bp, Homo sapiens
gctgataaccgtccttca

SEQ ID NO: 222923 - DNA, 16 bp, Homo sapiens
gctgatagctaagtga

SEQ ID NO: 222924 - DNA, 18 bp, Homo sapiens
gctgatccagagcacaga

SEQ ID NO: 222925 - DNA, 23 bp, Homo sapiens
gctgatgaaactcctgattttgt

SEQ ID NO: 222926 - DNA, 22 bp, Homo sapiens
gctgatgatgtctcttgtagaa

SEQ ID NO: 222927 - DNA, 16 bp, Homo sapiens
gctgatgctgaaataa

SEQ ID NO: 222928 - DNA, 23 bp, Homo sapiens
gctgatggataacctatatgatt

SEQ ID NO: 222929 - DNA, 20 bp, Homo sapiens
gctgatggcttgacatgtgc

SEQ ID NO: 222930 - DNA, 21 bp, Homo sapiens
gctgattactgtcaataaaca

SEQ ID NO: 222931 - DNA, 15 bp, Homo sapiens
gctgattcccagagc

SEQ ID NO: 222932 - DNA, 15 bp, Homo sapiens
gctgatttccaggcc

SEQ ID NO: 222933 - DNA, 19 bp, Homo sapiens
gctgatttccaggcccctg

SEQ ID NO: 222934 - DNA, 15 bp, Homo sapiens
gctgattttaacaat

SEQ ID NO: 222935 - DNA, 13 bp, Homo sapiens
gctgcaaaggaca

SEQ ID NO: 222936 - DNA, 15 bp, Homo sapiens
gctgcaagctgcagg

SEQ ID NO: 222937 - DNA, 16 bp, Homo sapiens
gctgcaagctgcaggg

SEQ ID NO: 222938 - DNA, 17 bp, Homo sapiens
gctgcaagctgcaggga

SEQ ID NO: 222939 - DNA, 20 bp, Homo sapiens
gctgcaatacattaaaataa

SEQ ID NO: 222940 - DNA, 16 bp, Homo sapiens
gctgcacactgacata

SEQ ID NO: 222941 - DNA, 14 bp, Homo sapiens
gctgcacattcctg

SEQ ID NO: 222942 - DNA, 19 bp, Homo sapiens
gctgcacattcctggcccc

SEQ ID NO: 222943 - DNA, 12 bp, Homo sapiens
gctgcaccagag

SEQ ID NO: 222944 - DNA, 15 bp, Homo sapiens
gctgcaccgcggcgc

SEQ ID NO: 222945 - DNA, 14 bp, Homo sapiens
gctgcacctgaggc

SEQ ID NO: 222946 - DNA, 16 bp, Homo sapiens
gctgcagacaaaaaga

SEQ ID NO: 222947 - DNA, 15 bp, Homo sapiens
gctgcagcaggcaga

SEQ ID NO: 222948 - DNA, 18 bp, Homo sapiens
gctgcagcaggcagagga

SEQ ID NO: 222949 - DNA, 19 bp, Homo sapiens
gctgcagcgcctcctggac

SEQ ID NO: 222950 - DNA, 12 bp, Homo sapiens
gctgcagctggg

SEQ ID NO: 222951 - DNA, 13 bp, Homo sapiens
gctgcagctgggc

SEQ ID NO: 222952 - DNA, 14 bp, Homo sapiens
gctgcagctgggcc

SEQ ID NO: 222953 - DNA, 16 bp, Homo sapiens
gctgcagctgggcccc

SEQ ID NO: 222954 - DNA, 12 bp, Homo sapiens
gctgcagcttgg

SEQ ID NO: 222955 - DNA, 14 bp, Homo sapiens
gctgcagcttggga

SEQ ID NO: 222956 - DNA, 23 bp, Homo sapiens
gctgcagcttgggagagcccctg

SEQ ID NO: 222957 - DNA, 20 bp, Homo sapiens
gctgcaggtacttcctcctg

SEQ ID NO: 222958 - DNA, 22 bp, Homo sapiens
gctgcaggtacttcctcctgat

SEQ ID NO: 222959 - DNA, 13 bp, Homo sapiens
gctgcaggtgccc

SEQ ID NO: 222960 - DNA, 14 bp, Homo sapiens
gctgcagtcatcta

SEQ ID NO: 222961 - DNA, 15 bp, Homo sapiens
gctgcagttgaagag

SEQ ID NO: 222962 - DNA, 16 bp, Homo sapiens
gctgcatacccgggca

SEQ ID NO: 222963 - DNA, 15 bp, Homo sapiens
gctgcatcctcagcc

SEQ ID NO: 222964 - DNA, 17 bp, Homo sapiens
gctgcatcctcagcccc

SEQ ID NO: 222965 - DNA, 21 bp, Homo sapiens
gctgcatcctcagccccaggg

SEQ ID NO: 222966 - DNA, 13 bp, Homo sapiens
gctgcatggacgc

SEQ ID NO: 222967 - DNA, 17 bp, Homo sapiens
gctgcatggacgcctgg

SEQ ID NO: 222968 - DNA, 18 bp, Homo sapiens
gctgcatggacgcctggc

SEQ ID NO: 222969 - DNA, 21 bp, Homo sapiens
gctgccaagcactcgagacca

SEQ ID NO: 222970 - DNA, 23 bp, Homo sapiens
gctgccacacttcaggctcttct

SEQ ID NO: 222971 - DNA, 15 bp, Homo sapiens
gctgccaccacgtct

SEQ ID NO: 222972 - DNA, 21 bp, Homo sapiens
gctgccaccacgtctgccagg

SEQ ID NO: 222973 - DNA, 18 bp, Homo sapiens
gctgccagcacagagcgt

SEQ ID NO: 222974 - DNA, 22 bp, Homo sapiens
gctgccaggcgttggtgccact

SEQ ID NO: 222975 - DNA, 16 bp, Homo sapiens
gctgccaggggctgcg

SEQ ID NO: 222976 - DNA, 14 bp, Homo sapiens
gctgccataattct

SEQ ID NO: 222977 - DNA, 21 bp, Homo sapiens
gctgccatgattttggccact

SEQ ID NO: 222978 - DNA, 12 bp, Homo sapiens
gctgccatgcca

SEQ ID NO: 222979 - DNA, 19 bp, Homo sapiens
gctgccatgccactgccag

SEQ ID NO: 222980 - DNA, 13 bp, Homo sapiens
gctgccatgtgaa

SEQ ID NO: 222981 - DNA, 16 bp, Homo sapiens
gctgcccacaagccat

SEQ ID NO: 222982 - DNA, 23 bp, Homo sapiens
gctgcccacgctcctgccctcgt

SEQ ID NO: 222983 - DNA, 23 bp, Homo sapiens
gctgcccacggccacccaccctt

SEQ ID NO: 222984 - DNA, 11 bp, Homo sapiens
gctgcccagcc

SEQ ID NO: 222985 - DNA, 14 bp, Homo sapiens
gctgcccaggctct

SEQ ID NO: 222986 - DNA, 18 bp, Homo sapiens
gctgccccaacctgctga

SEQ ID NO: 222987 - DNA, 16 bp, Homo sapiens
gctgccccacaggcca

SEQ ID NO: 222988 - DNA, 15 bp, Homo sapiens
gctgccccacccctc

SEQ ID NO: 222989 - DNA, 20 bp, Homo sapiens
gctgccccacccctccatga

SEQ ID NO: 222990 - DNA, 14 bp, Homo sapiens
gctgccccagctga

SEQ ID NO: 222991 - DNA, 22 bp, Homo sapiens
gctgccccagctgactgtggcc

SEQ ID NO: 222992 - DNA, 18 bp, Homo sapiens
gctgccccgttccctgtc

SEQ ID NO: 222993 - DNA, 23 bp, Homo sapiens
gctgcccctcatttatcactctg

SEQ ID NO: 222994 - DNA, 20 bp, Homo sapiens
gctgcccctggtgcactggc

SEQ ID NO: 222995 - DNA, 15 bp, Homo sapiens
gctgccctccatccc

SEQ ID NO: 222996 - DNA, 19 bp, Homo sapiens
gctgccctccatcccgaca

SEQ ID NO: 222997 - DNA, 17 bp, Homo sapiens
gctgccctggtgctgcc

SEQ ID NO: 222998 - DNA, 23 bp, Homo sapiens
gctgccctggtgctgccacactt

SEQ ID NO: 222999 - DNA, 13 bp, Homo sapiens
gctgccgccactg

SEQ ID NO: 223000 - DNA, 13 bp, Homo sapiens
gctgccgcctccc

SEQ ID NO: 223001 - DNA, 16 bp, Homo sapiens
gctgccgcctcccagc

SEQ ID NO: 223002 - DNA, 12 bp, Homo sapiens
gctgcctcactt

SEQ ID NO: 223003 - DNA, 15 bp, Homo sapiens
gctgcctccccaacc

SEQ ID NO: 223004 - DNA, 20 bp, Homo sapiens
gctgcctccccaaccctgcc

SEQ ID NO: 223005 - DNA, 19 bp, Homo sapiens
gctgcctccctgtccaccc

SEQ ID NO: 223006 - DNA, 18 bp, Homo sapiens
gctgcctctcggtggcca

SEQ ID NO: 223007 - DNA, 21 bp, Homo sapiens
gctgcctctgacagcagcctg

SEQ ID NO: 223008 - DNA, 13 bp, Homo sapiens
gctgcctctgggt

SEQ ID NO: 223009 - DNA, 19 bp, Homo sapiens
gctgcctgcccgcacagca

SEQ ID NO: 223010 - DNA, 13 bp, Homo sapiens
gctgcctgccgcc

SEQ ID NO: 223011 - DNA, 22 bp, Homo sapiens
tggacagaagcttgtggggtac

SEQ ID NO: 223012 - DNA, 19 bp, Homo sapiens
tggacagagggagaaggga

SEQ ID NO: 223013 - DNA, 21 bp, Homo sapiens
tggacagagggagaagggaga

SEQ ID NO: 223014 - DNA, 18 bp, Homo sapiens
tggacagcccgccgtcag

SEQ ID NO: 223015 - DNA, 23 bp, Homo sapiens
tggacagggcccccggccacgct

SEQ ID NO: 223016 - DNA, 15 bp, Homo sapiens
tggacagtaagattt

SEQ ID NO: 223017 - DNA, 21 bp, Homo sapiens
tggacagtatcactgtctttc

SEQ ID NO: 223018 - DNA, 20 bp, Homo sapiens
tggacagttcacaccctgca

SEQ ID NO: 223019 - DNA, 21 bp, Homo sapiens
tggacagttcacaccctgcaa

SEQ ID NO: 223020 - DNA, 18 bp, Homo sapiens
tggacatcctcttctgct

SEQ ID NO: 223021 - DNA, 21 bp, Homo sapiens
tggacatgatttagggaagca

SEQ ID NO: 223022 - DNA, 13 bp, Homo sapiens
tggacatgcacag

SEQ ID NO: 223023 - DNA, 17 bp, Homo sapiens
tggacatggtctcctct

SEQ ID NO: 223024 - DNA, 15 bp, Homo sapiens
tggaccaccagcccc

SEQ ID NO: 223025 - DNA, 20 bp, Homo sapiens
tggaccaccagccccagcaa

SEQ ID NO: 223026 - DNA, 14 bp, Homo sapiens
tggaccagatgctg

SEQ ID NO: 223027 - DNA, 17 bp, Homo sapiens
tggaccagtggtgcctt

SEQ ID NO: 223028 - DNA, 22 bp, Homo sapiens
tggaccatttgattgttttatt

SEQ ID NO: 223029 - DNA, 22 bp, Homo sapiens
tggacccacgaacgctcttagc

SEQ ID NO: 223030 - DNA, 13 bp, Homo sapiens
tggaccccagaga

SEQ ID NO: 223031 - DNA, 15 bp, Homo sapiens
tggacccctcccttg

SEQ ID NO: 223032 - DNA, 18 bp, Homo sapiens
tggaccgggtgggcctgg

SEQ ID NO: 223033 - DNA, 15 bp, Homo sapiens
tggacctaacattcg

SEQ ID NO: 223034 - DNA, 13 bp, Homo sapiens
tggacctgaagga

SEQ ID NO: 223035 - DNA, 18 bp, Homo sapiens
tggacctgagtcggcccc

SEQ ID NO: 223036 - DNA, 21 bp, Homo sapiens
tggacctgcctacggagggtg

SEQ ID NO: 223037 - DNA, 20 bp, Homo sapiens
tggacctgcctcctgcctgc

SEQ ID NO: 223038 - DNA, 12 bp, Homo sapiens
tggacgcctggc

SEQ ID NO: 223039 - DNA, 14 bp, Homo sapiens
tggacgcctggctc

SEQ ID NO: 223040 - DNA, 21 bp, Homo sapiens
tggacgcctggctccaggctc

SEQ ID NO: 223041 - DNA, 18 bp, Homo sapiens
tggacggggacacggcct

SEQ ID NO: 223042 - DNA, 14 bp, Homo sapiens
tggacgtgtgagga

SEQ ID NO: 223043 - DNA, 23 bp, Homo sapiens
tggacgtgttatgactccagaat

SEQ ID NO: 223044 - DNA, 16 bp, Homo sapiens
tggactacctataaat

SEQ ID NO: 223045 - DNA, 17 bp, Homo sapiens
tggactacctataaatg

SEQ ID NO: 223046 - DNA, 19 bp, Homo sapiens
tggactacctataaatgga

SEQ ID NO: 223047 - DNA, 20 bp, Homo sapiens
tggactccaggatcctcctg

SEQ ID NO: 223048 - DNA, 20 bp, Homo sapiens
tggactccctccccacccca

SEQ ID NO: 223049 - DNA, 21 bp, Homo sapiens
tggactctacactgtgaactt

SEQ ID NO: 223050 - DNA, 13 bp, Homo sapiens
tggactctgcccc

SEQ ID NO: 223051 - DNA, 15 bp, Homo sapiens
tggactgaagcctgc

SEQ ID NO: 223052 - DNA, 14 bp, Homo sapiens
tggactgcacaaaa

SEQ ID NO: 223053 - DNA, 17 bp, Homo sapiens
tggactggaggtgggca

SEQ ID NO: 223054 - DNA, 22 bp, Homo sapiens
tggactggaggtgggcatgcca

SEQ ID NO: 223055 - DNA, 19 bp, Homo sapiens
tggactggcccttgcccaa

SEQ ID NO: 223056 - DNA, 20 bp, Homo sapiens
tggactggctagagtcctca

SEQ ID NO: 223057 - DNA, 23 bp, Homo sapiens
tggactggctgtcctttccagtg

SEQ ID NO: 223058 - DNA, 16 bp, Homo sapiens
tggactgggaagcatt

SEQ ID NO: 223059 - DNA, 21 bp, Homo sapiens
tggactgggttgcgtcctgac

SEQ ID NO: 223060 - DNA, 17 bp, Homo sapiens
tggactggtggcccctg

SEQ ID NO: 223061 - DNA, 13 bp, Homo sapiens
tggactgtggcct

SEQ ID NO: 223062 - DNA, 17 bp, Homo sapiens
tggactgtggcctcagg

SEQ ID NO: 223063 - DNA, 18 bp, Homo sapiens
tggacttatttcttcaaa

SEQ ID NO: 223064 - DNA, 14 bp, Homo sapiens
tggacttatttttg

SEQ ID NO: 223065 - DNA, 18 bp, Homo sapiens
tggacttgaggattttga

SEQ ID NO: 223066 - DNA, 23 bp, Homo sapiens
tggacttgcttcttgtgtttgaa

SEQ ID NO: 223067 - DNA, 16 bp, Homo sapiens
tggactttcaaaatta

SEQ ID NO: 223068 - DNA, 23 bp, Homo sapiens
tggactttcaaaattaaatctgt

SEQ ID NO: 223069 - DNA, 18 bp, Homo sapiens
tggactttccaccccctc

SEQ ID NO: 223070 - DNA, 14 bp, Homo sapiens
tggactttcctgca

SEQ ID NO: 223071 - DNA, 19 bp, Homo sapiens
tggactttcctgcaactca

SEQ ID NO: 223072 - DNA, 14 bp, Homo sapiens
tggactttgttaca

SEQ ID NO: 223073 - DNA, 18 bp, Homo sapiens
tggacttttcgttaacat

SEQ ID NO: 223074 - DNA, 20 bp, Homo sapiens
tggacttttgttcatgggag

SEQ ID NO: 223075 - DNA, 21 bp, Homo sapiens
tggacttttgttcatgggaga

SEQ ID NO: 223076 - DNA, 18 bp, Homo sapiens
tggagaaaggatggcagc

SEQ ID NO: 223077 - DNA, 21 bp, Homo sapiens
tggagaaattatttaataaaa

SEQ ID NO: 223078 - DNA, 14 bp, Homo sapiens
tggagaactagaga

SEQ ID NO: 223079 - DNA, 21 bp, Homo sapiens
tggagaaggaaaaggctggca

SEQ ID NO: 223080 - DNA, 16 bp, Homo sapiens
tggagaatctgagggc

SEQ ID NO: 223081 - DNA, 17 bp, Homo sapiens
tggagaatctgagggca

SEQ ID NO: 223082 - DNA, 17 bp, Homo sapiens
tggagaatgtacacagt

SEQ ID NO: 223083 - DNA, 17 bp, Homo sapiens
tggagacacaactattt

SEQ ID NO: 223084 - DNA, 19 bp, Homo sapiens
tggagaccgcttcacccct

SEQ ID NO: 223085 - DNA, 21 bp, Homo sapiens
tggagaccgcttcacccctgc

SEQ ID NO: 223086 - DNA, 22 bp, Homo sapiens
tggagaccgcttcacccctgca

SEQ ID NO: 223087 - DNA, 14 bp, Homo sapiens
tggagactgtctca

SEQ ID NO: 223088 - DNA, 13 bp, Homo sapiens
tggagagaatcat

SEQ ID NO: 223089 - DNA, 18 bp, Homo sapiens
tggagagaccagcctttc

SEQ ID NO: 223090 - DNA, 12 bp, Homo sapiens
tggagagcagct

SEQ ID NO: 223091 - DNA, 11 bp, Homo sapiens
tggagagctgg

SEQ ID NO: 223092 - DNA, 14 bp, Homo sapiens
tggagaggagaaca

SEQ ID NO: 223093 - DNA, 21 bp, Homo sapiens
tggagaggagagaatgagaga

SEQ ID NO: 223094 - DNA, 16 bp, Homo sapiens
tggagaggctaacctc

SEQ ID NO: 223095 - DNA, 17 bp, Homo sapiens
tggagagggacgaagaa

SEQ ID NO: 223096 - DNA, 18 bp, Homo sapiens
tggagagggacgaagaaa

SEQ ID NO: 223097 - DNA, 19 bp, Homo sapiens
tggagagggatgaggtgct

SEQ ID NO: 223098 - DNA, 14 bp, Homo sapiens
tggagagtgagaat

SEQ ID NO: 223099 - DNA, 17 bp, Homo sapiens
gctggtgcattacagag

SEQ ID NO: 223100 - DNA, 18 bp, Homo sapiens
gctggtgcattacagaga

SEQ ID NO: 223101 - DNA, 22 bp, Homo sapiens
gctggtgccagccttcctctgc

SEQ ID NO: 223102 - DNA, 18 bp, Homo sapiens
gctggtggatggtgactt

SEQ ID NO: 223103 - DNA, 13 bp, Homo sapiens
gctggtgggcacc

SEQ ID NO: 223104 - DNA, 20 bp, Homo sapiens
gctggtgtcactctgcctct

SEQ ID NO: 223105 - DNA, 21 bp, Homo sapiens
gctggtgtcactctgcctcta

SEQ ID NO: 223106 - DNA, 23 bp, Homo sapiens
gctggtgtccccttcccctgctg

SEQ ID NO: 223107 - DNA, 24 bp, Homo sapiens
gctggttgtcatttttgcagtaga

SEQ ID NO: 223108 - DNA, 15 bp, Homo sapiens
gctggttgttgccag

SEQ ID NO: 223109 - DNA, 16 bp, Homo sapiens
gctggttgttgccagg

SEQ ID NO: 223110 - DNA, 17 bp, Homo sapiens
gctgtaaataaaaatag

SEQ ID NO: 223111 - DNA, 17 bp, Homo sapiens
gctgtaaatacatgtgt

SEQ ID NO: 223112 - DNA, 20 bp, Homo sapiens
gctgtaaatacatgtgtgga

SEQ ID NO: 223113 - DNA, 15 bp, Homo sapiens
gctgtaactgctgag

SEQ ID NO: 223114 - DNA, 22 bp, Homo sapiens
gctgtaactgctgagccactcg

SEQ ID NO: 223115 - DNA, 19 bp, Homo sapiens
gctgtaagcattctgagct

SEQ ID NO: 223116 - DNA, 22 bp, Homo sapiens
gctgtaagcattctgagctggg

SEQ ID NO: 223117 - DNA, 16 bp, Homo sapiens
gctgtactcagagcag

SEQ ID NO: 223118 - DNA, 17 bp, Homo sapiens
gctgtactcagagcaga

SEQ ID NO: 223119 - DNA, 20 bp, Homo sapiens
gctgtactcagagcagagca

SEQ ID NO: 223120 - DNA, 12 bp, Homo sapiens
gctgtagagact

SEQ ID NO: 223121 - DNA, 13 bp, Homo sapiens
gctgtagccatgg

SEQ ID NO: 223122 - DNA, 15 bp, Homo sapiens
gctgtagccatggct

SEQ ID NO: 223123 - DNA, 19 bp, Homo sapiens
gctgtagccatggctcagg

SEQ ID NO: 223124 - DNA, 20 bp, Homo sapiens
gctgtatgatttaggcttct

SEQ ID NO: 223125 - DNA, 16 bp, Homo sapiens
gctgtattttctttta

SEQ ID NO: 223126 - DNA, 22 bp, Homo sapiens
gctgtattttcttttatatctg

SEQ ID NO: 223127 - DNA, 23 bp, Homo sapiens
gctgtattttcttttatatctgt

SEQ ID NO: 223128 - DNA, 24 bp, Homo sapiens
gctgtattttcttttatatctgta

SEQ ID NO: 223129 - DNA, 16 bp, Homo sapiens
gctgtatttttagaga

SEQ ID NO: 223130 - DNA, 16 bp, Homo sapiens
gctgtcagaccttctt

SEQ ID NO: 223131 - DNA, 20 bp, Homo sapiens
gctgtcatgtgaatccctca

SEQ ID NO: 223132 - DNA, 13 bp, Homo sapiens
gctgtcccagggg

SEQ ID NO: 223133 - DNA, 15 bp, Homo sapiens
gctgtccctcctgag

SEQ ID NO: 223134 - DNA, 23 bp, Homo sapiens
gctgtcccttacgtgagtcctgg

SEQ ID NO: 223135 - DNA, 22 bp, Homo sapiens
gctgtcctctcagaactcctgt

SEQ ID NO: 223136 - DNA, 23 bp, Homo sapiens
gctgtcctgagccccctgcaccc

SEQ ID NO: 223137 - DNA, 21 bp, Homo sapiens
gctgtccttagactccttctc

SEQ ID NO: 223138 - DNA, 13 bp, Homo sapiens
gctgtcgtccccc

SEQ ID NO: 223139 - DNA, 13 bp, Homo sapiens
gctgtctccagac

SEQ ID NO: 223140 - DNA, 22 bp, Homo sapiens
gcttcccaaactcccaggacct

SEQ ID NO: 223141 - DNA, 14 bp, Homo sapiens
gcttcccacctccc

SEQ ID NO: 223142 - DNA, 17 bp, Homo sapiens
gcttcccacctccctgc

SEQ ID NO: 223143 - DNA, 15 bp, Homo sapiens
gcttcccgctcagcc

SEQ ID NO: 223144 - DNA, 18 bp, Homo sapiens
gcttcccgctcagccctc

SEQ ID NO: 223145 - DNA, 19 bp, Homo sapiens
gcttcccgggatgcgcctg

SEQ ID NO: 223146 - DNA, 19 bp, Homo sapiens
gcttccctacccacagggc

SEQ ID NO: 223147 - DNA, 18 bp, Homo sapiens
gcttccctctgctccaca

SEQ ID NO: 223148 - DNA, 18 bp, Homo sapiens
gcttccctgacttgcttt

SEQ ID NO: 223149 - DNA, 23 bp, Homo sapiens
gcttccctttcactgaagtgaat

SEQ ID NO: 223150 - DNA, 14 bp, Homo sapiens
gcttcctccagagg

SEQ ID NO: 223151 - DNA, 17 bp, Homo sapiens
gcttcctccagaggagg

SEQ ID NO: 223152 - DNA, 18 bp, Homo sapiens
gcttcctccagaggaggg

SEQ ID NO: 223153 - DNA, 20 bp, Homo sapiens
gcttcctccgtccacccagg

SEQ ID NO: 223154 - DNA, 13 bp, Homo sapiens
gcttcctctgaat

SEQ ID NO: 223155 - DNA, 21 bp, Homo sapiens
gcttcctctgaatattaagaa

SEQ ID NO: 223156 - DNA, 21 bp, Homo sapiens
gcttcctgagaaagcccacct

SEQ ID NO: 223157 - DNA, 22 bp, Homo sapiens
gcttcctgagaaagcccacctg

SEQ ID NO: 223158 - DNA, 13 bp, Homo sapiens
gcttcctgagggc

SEQ ID NO: 223159 - DNA, 12 bp, Homo sapiens
gcttcctggtgt

SEQ ID NO: 223160 - DNA, 22 bp, Homo sapiens
gcttcctggtgtatttttcagg

SEQ ID NO: 223161 - DNA, 13 bp, Homo sapiens
gcttcctgtccac

SEQ ID NO: 223162 - DNA, 19 bp, Homo sapiens
gcttcggagggcccctgcg

SEQ ID NO: 223163 - DNA, 13 bp, Homo sapiens
gcttcggcctgct

SEQ ID NO: 223164 - DNA, 16 bp, Homo sapiens
gcttcggttctccaga

SEQ ID NO: 223165 - DNA, 23 bp, Homo sapiens
gcttcggttctccagaatgtaag

SEQ ID NO: 223166 - DNA, 17 bp, Homo sapiens
gcttcgtgctggaggaa

SEQ ID NO: 223167 - DNA, 18 bp, Homo sapiens
gcttcgtgctggaggaac

SEQ ID NO: 223168 - DNA, 16 bp, Homo sapiens
gcttctaatgttcccc

SEQ ID NO: 223169 - DNA, 20 bp, Homo sapiens
gcttctaattttgtgctctt

SEQ ID NO: 223170 - DNA, 20 bp, Homo sapiens
gcttctagaaagcccctcac

SEQ ID NO: 223171 - DNA, 12 bp, Homo sapiens
gcttctatccca

SEQ ID NO: 223172 - DNA, 19 bp, Homo sapiens
gcttctatgtccaacagag

SEQ ID NO: 223173 - DNA, 21 bp, Homo sapiens
gcttctatgtccaacagagtg

SEQ ID NO: 223174 - DNA, 14 bp, Homo sapiens
gcttctcctgaccc

SEQ ID NO: 223175 - DNA, 17 bp, Homo sapiens
gcttctccttctccttc

SEQ ID NO: 223176 - DNA, 16 bp, Homo sapiens
gcttctcggaggccag

SEQ ID NO: 223177 - DNA, 17 bp, Homo sapiens
gcttctcggaggccagg

SEQ ID NO: 223178 - DNA, 19 bp, Homo sapiens
gcttctcggaggccaggcc

SEQ ID NO: 223179 - DNA, 22 bp, Homo sapiens
gcttctcggaggccaggccctc

SEQ ID NO: 223180 - DNA, 19 bp, Homo sapiens
gcttctctgtgactgatgt

SEQ ID NO: 223181 - DNA, 23 bp, Homo sapiens
gcttctcttgggaactccactct

SEQ ID NO: 223182 - DNA, 13 bp, Homo sapiens
gcttctcttttcc

SEQ ID NO: 223183 - DNA, 14 bp, Homo sapiens
gcttctcttttcct

SEQ ID NO: 223184 - DNA, 12 bp, Homo sapiens
gcttctgcctgc

SEQ ID NO: 223185 - DNA, 20 bp, Homo sapiens
gcttctgcggtgaggcaggg

SEQ ID NO: 223186 - DNA, 21 bp, Homo sapiens
gcttctgctcacattccctct

SEQ ID NO: 223187 - DNA, 13 bp, Homo sapiens
gcttctgctgccc

SEQ ID NO: 223188 - DNA, 15 bp, Homo sapiens
gcttctggtactctc

SEQ ID NO: 223189 - DNA, 13 bp, Homo sapiens
gcttcttgctcct

SEQ ID NO: 223190 - DNA, 14 bp, Homo sapiens
gcttcttgctcctg

SEQ ID NO: 223191 - DNA, 18 bp, Homo sapiens
gcttcttgcttgtaaaaa

SEQ ID NO: 223192 - DNA, 20 bp, Homo sapiens
gcttctttttcaaaactagt

SEQ ID NO: 223193 - DNA, 14 bp, Homo sapiens
gcttgaagccaagt

SEQ ID NO: 223194 - DNA, 15 bp, Homo sapiens
gcttgacaggacagc

SEQ ID NO: 223195 - DNA, 19 bp, Homo sapiens
gcttgaccagtataaaatt

SEQ ID NO: 223196 - DNA, 23 bp, Homo sapiens
gcttgacgcgtggtcacaggacg

SEQ ID NO: 223197 - DNA, 23 bp, Homo sapiens
gcttgactcaggatttaaaaact

SEQ ID NO: 223198 - DNA, 13 bp, Homo sapiens
gcttgagcccagg

SEQ ID NO: 223199 - DNA, 13 bp, Homo sapiens
gcttgagcctccc

SEQ ID NO: 223200 - DNA, 19 bp, Homo sapiens
gcttgagctcccctggagc

SEQ ID NO: 223201 - DNA, 15 bp, Homo sapiens
gcttgcataataagc

SEQ ID NO: 223202 - DNA, 23 bp, Homo sapiens
gcttgcataataagctaaagagg

SEQ ID NO: 223203 - DNA, 16 bp, Homo sapiens
gcttgcccgctcccac

SEQ ID NO: 223204 - DNA, 17 bp, Homo sapiens
gcttgcccgctcccaca

SEQ ID NO: 223205 - DNA, 13 bp, Homo sapiens
gcttgcctagggc

SEQ ID NO: 223206 - DNA, 22 bp, Homo sapiens
gcttgcgccgagaccgcagagg

SEQ ID NO: 223207 - DNA, 23 bp, Homo sapiens
gcttgcgccgagaccgcagaggg

SEQ ID NO: 223208 - DNA, 16 bp, Homo sapiens
gcttgctattaagaaa

SEQ ID NO: 223209 - DNA, 13 bp, Homo sapiens
gcttgctccaggg

SEQ ID NO: 223210 - DNA, 21 bp, Homo sapiens
gcttgctgcaccccaagtcca

SEQ ID NO: 223211 - DNA, 21 bp, Homo sapiens
gcttggaacatttgggagact

SEQ ID NO: 223212 - DNA, 19 bp, Homo sapiens
gcttggactacctataaat

SEQ ID NO: 223213 - DNA, 22 bp, Homo sapiens
gcttggactacctataaatgga

SEQ ID NO: 223214 - DNA, 20 bp, Homo sapiens
gcttggagcagagacggcag

SEQ ID NO: 223215 - DNA, 21 bp, Homo sapiens
gcttggagcagagacggcagc

SEQ ID NO: 223216 - DNA, 22 bp, Homo sapiens
gcttggagcagagacggcagcc

SEQ ID NO: 223217 - DNA, 23 bp, Homo sapiens
gcttggagcagagacggcagccc

SEQ ID NO: 223218 - DNA, 11 bp, Homo sapiens
gcttggccttg

SEQ ID NO: 223219 - DNA, 12 bp, Homo sapiens
gcttggccttgt

SEQ ID NO: 223220 - DNA, 14 bp, Homo sapiens
gcttggctgcccca

SEQ ID NO: 223221 - DNA, 19 bp, Homo sapiens
gcttgggaccgccagatgg

SEQ ID NO: 223222 - DNA, 20 bp, Homo sapiens
gcttgggagagcccctgggg

SEQ ID NO: 223223 - DNA, 21 bp, Homo sapiens
gcttgggagagcccctggggc

SEQ ID NO: 223224 - DNA, 17 bp, Homo sapiens
gcttgggccactgccct

SEQ ID NO: 223225 - DNA, 14 bp, Homo sapiens
gcttgggcccagct

SEQ ID NO: 223226 - DNA, 18 bp, Homo sapiens
gcttgggcccagctgggc

SEQ ID NO: 223227 - DNA, 20 bp, Homo sapiens
gcttggggtagagaggacag

SEQ ID NO: 223228 - DNA, 22 bp, Homo sapiens
gcttggtccctatgggcttccg

SEQ ID NO: 223229 - DNA, 16 bp, Homo sapiens
gcttggtggggctcgt

SEQ ID NO: 223230 - DNA, 20 bp, Homo sapiens
gcttggtggttatgtcccat

SEQ ID NO: 223231 - DNA, 18 bp, Homo sapiens
gcttggtgtcttggcact

SEQ ID NO: 223232 - DNA, 15 bp, Homo sapiens
gcttgtaaaaatatg

SEQ ID NO: 223233 - DNA, 13 bp, Homo sapiens
gcttgtacatatt

SEQ ID NO: 223234 - DNA, 16 bp, Homo sapiens
gcttgtactaagccag

SEQ ID NO: 223235 - DNA, 18 bp, Homo sapiens
gcttgtactaagccagga

SEQ ID NO: 223236 - DNA, 18 bp, Homo sapiens
gcttgtagggtgaggcgt

SEQ ID NO: 223237 - DNA, 14 bp, Homo sapiens
gcttgtcagagctg

SEQ ID NO: 223238 - DNA, 17 bp, Homo sapiens
tggattttctttctatg

SEQ ID NO: 223239 - DNA, 21 bp, Homo sapiens
tggattttctttctatgtaga

SEQ ID NO: 223240 - DNA, 16 bp, Homo sapiens
tggatttttaaattat

SEQ ID NO: 223241 - DNA, 22 bp, Homo sapiens
tggcaaacatgtgcaactcttg

SEQ ID NO: 223242 - DNA, 15 bp, Homo sapiens
tggcaaatgaaagca

SEQ ID NO: 223243 - DNA, 23 bp, Homo sapiens
tggcaacaaacacattgtgaata

SEQ ID NO: 223244 - DNA, 12 bp, Homo sapiens
tggcaacagaag

SEQ ID NO: 223245 - DNA, 15 bp, Homo sapiens
tggcaagaaagctgg

SEQ ID NO: 223246 - DNA, 15 bp, Homo sapiens
tggcaagattgaagt

SEQ ID NO: 223247 - DNA, 19 bp, Homo sapiens
tggcaagattgaagtctga

SEQ ID NO: 223248 - DNA, 17 bp, Homo sapiens
tggcaagggggtgtcat

SEQ ID NO: 223249 - DNA, 12 bp, Homo sapiens
tggcaagtgacc

SEQ ID NO: 223250 - DNA, 13 bp, Homo sapiens
tggcaagtttttg

SEQ ID NO: 223251 - DNA, 15 bp, Homo sapiens
tggcaataaatggct

SEQ ID NO: 223252 - DNA, 20 bp, Homo sapiens
tggcaataaatgtcccaaat

SEQ ID NO: 223253 - DNA, 15 bp, Homo sapiens
tggcaataggacaaa

SEQ ID NO: 223254 - DNA, 17 bp, Homo sapiens
tggcaatagtgtgttct

SEQ ID NO: 223255 - DNA, 18 bp, Homo sapiens
tggcaatagtgtgttctg

SEQ ID NO: 223256 - DNA, 21 bp, Homo sapiens
tggcacagacttctggaaggc

SEQ ID NO: 223257 - DNA, 17 bp, Homo sapiens
tggcaccaaagatgcag

SEQ ID NO: 223258 - DNA, 20 bp, Homo sapiens
tggcaccaaagatgcagccg

SEQ ID NO: 223259 - DNA, 21 bp, Homo sapiens
tggcaccactagggtcctggc

SEQ ID NO: 223260 - DNA, 12 bp, Homo sapiens
tggcaccagccc

SEQ ID NO: 223261 - DNA, 15 bp, Homo sapiens
tggcaccagccccct

SEQ ID NO: 223262 - DNA, 16 bp, Homo sapiens
tggcaccagccccctg

SEQ ID NO: 223263 - DNA, 17 bp, Homo sapiens
tggcaccagccccctgg

SEQ ID NO: 223264 - DNA, 20 bp, Homo sapiens
tggcaccagccccctggatg

SEQ ID NO: 223265 - DNA, 13 bp, Homo sapiens
tggcaccatgtgc

SEQ ID NO: 223266 - DNA, 15 bp, Homo sapiens
tggcaccatgtgcca

SEQ ID NO: 223267 - DNA, 14 bp, Homo sapiens
tggcaccccagcta

SEQ ID NO: 223268 - DNA, 18 bp, Homo sapiens
tggcacccccatgctgcc

SEQ ID NO: 223269 - DNA, 20 bp, Homo sapiens
tggcacccccatgctgcctt

SEQ ID NO: 223270 - DNA, 22 bp, Homo sapiens
tggccccaggtgccaccaataa

SEQ ID NO: 223271 - DNA, 20 bp, Homo sapiens
tggccccatccagcatgtgt

SEQ ID NO: 223272 - DNA, 15 bp, Homo sapiens
tggcccccctccagg

SEQ ID NO: 223273 - DNA, 16 bp, Homo sapiens
tggcccccctccaggc

SEQ ID NO: 223274 - DNA, 14 bp, Homo sapiens
tggcccccgagctg

SEQ ID NO: 223275 - DNA, 15 bp, Homo sapiens
tggcccccgagctgg

SEQ ID NO: 223276 - DNA, 19 bp, Homo sapiens
tggcccccgagctgggggc

SEQ ID NO: 223277 - DNA, 19 bp, Homo sapiens
tggccccgggctctggcca

SEQ ID NO: 223278 - DNA, 21 bp, Homo sapiens
tggccccgggctctggccacc

SEQ ID NO: 223279 - DNA, 22 bp, Homo sapiens
tggccccgggctctggccaccc

SEQ ID NO: 223280 - DNA, 16 bp, Homo sapiens
tggcccctcacctggg

SEQ ID NO: 223281 - DNA, 17 bp, Homo sapiens
tggcccctccttctccc

SEQ ID NO: 223282 - DNA, 23 bp, Homo sapiens
tggcccctctctgtttaccctcc

SEQ ID NO: 223283 - DNA, 13 bp, Homo sapiens
tggccccttcact

SEQ ID NO: 223284 - DNA, 18 bp, Homo sapiens
tggcccgacagcctggca

SEQ ID NO: 223285 - DNA, 22 bp, Homo sapiens
tggcccgcccctcgctgctgct

SEQ ID NO: 223286 - DNA, 13 bp, Homo sapiens
tggccctcttctt

SEQ ID NO: 223287 - DNA, 21 bp, Homo sapiens
tggccctgacaaaaaggtgct

SEQ ID NO: 223288 - DNA, 12 bp, Homo sapiens
tggccctgggga

SEQ ID NO: 223289 - DNA, 12 bp, Homo sapiens
tggccctgtggg

SEQ ID NO: 223290 - DNA, 16 bp, Homo sapiens
tggccgaggactttga

SEQ ID NO: 223291 - DNA, 14 bp, Homo sapiens
tggccgatgagctg

SEQ ID NO: 223292 - DNA, 15 bp, Homo sapiens
tggccgatgagctgg

SEQ ID NO: 223293 - DNA, 20 bp, Homo sapiens
tggccgatggggcccacatt

SEQ ID NO: 223294 - DNA, 22 bp, Homo sapiens
tggccgctgggagaaaagccag

SEQ ID NO: 223295 - DNA, 23 bp, Homo sapiens
tggccgctgggagaaaagccaga

SEQ ID NO: 223296 - DNA, 18 bp, Homo sapiens
tggccgcttccctaccca

SEQ ID NO: 223297 - DNA, 13 bp, Homo sapiens
tggccgggcacag

SEQ ID NO: 223298 - DNA, 14 bp, Homo sapiens
tggccgggcacagc

SEQ ID NO: 223299 - DNA, 17 bp, Homo sapiens
tggccgggcatggtagc

SEQ ID NO: 223300 - DNA, 17 bp, Homo sapiens
tggccgggctgctgctg

SEQ ID NO: 223301 - DNA, 19 bp, Homo sapiens
tggccgggtcaccctgtga

SEQ ID NO: 223302 - DNA, 23 bp, Homo sapiens
tggccgggttggaggcctcaccc

SEQ ID NO: 223303 - DNA, 20 bp, Homo sapiens
tggcctagcccaccctgctg

SEQ ID NO: 223304 - DNA, 18 bp, Homo sapiens
tggcctagtcagatggat

SEQ ID NO: 223305 - DNA, 22 bp, Homo sapiens
tggcctagtggggaggggcctg

SEQ ID NO: 223306 - DNA, 17 bp, Homo sapiens
tggcctattatattaaa

SEQ ID NO: 223307 - DNA, 21 bp, Homo sapiens
tggcctattatattaaaatat

SEQ ID NO: 223308 - DNA, 19 bp, Homo sapiens
tggcctcaaccctccctca

SEQ ID NO: 223309 - DNA, 13 bp, Homo sapiens
tggcctcactggc

SEQ ID NO: 223310 - DNA, 19 bp, Homo sapiens
tggcctcactggctggggc

SEQ ID NO: 223311 - DNA, 17 bp, Homo sapiens
tggcctcagaattcaca

SEQ ID NO: 223312 - DNA, 13 bp, Homo sapiens
tggcctcagacca

SEQ ID NO: 223313 - DNA, 11 bp, Homo sapiens
tggcctcagcc

SEQ ID NO: 223314 - DNA, 16 bp, Homo sapiens
tggcctcagccagctg

SEQ ID NO: 223315 - DNA, 12 bp, Homo sapiens
tggcctcccagc

SEQ ID NO: 223316 - DNA, 19 bp, Homo sapiens
tggcctcccagccacccgg

SEQ ID NO: 223317 - DNA, 17 bp, Homo sapiens
tggcctcccctgcggag

SEQ ID NO: 223318 - DNA, 14 bp, Homo sapiens
tggcctcggggcag

SEQ ID NO: 223319 - DNA, 16 bp, Homo sapiens
tggcctcggggcaggg

SEQ ID NO: 223320 - DNA, 18 bp, Homo sapiens
tggcctcggggcagggca

SEQ ID NO: 223321 - DNA, 19 bp, Homo sapiens
tggcctcggggcagggcag

SEQ ID NO: 223322 - DNA, 15 bp, Homo sapiens
tggcctctgtgccat

SEQ ID NO: 223323 - DNA, 22 bp, Homo sapiens
tggcctcttcctccctccctgc

SEQ ID NO: 223324 - DNA, 17 bp, Homo sapiens
tggcctcttgagcagtg

SEQ ID NO: 223325 - DNA, 19 bp, Homo sapiens
tggcctcttgagcagtggc

SEQ ID NO: 223326 - DNA, 14 bp, Homo sapiens
tggcctgagaagag

SEQ ID NO: 223327 - DNA, 15 bp, Homo sapiens
tggcctgagaagagt

SEQ ID NO: 223328 - DNA, 14 bp, Homo sapiens
tggcctgagctggg

SEQ ID NO: 223329 - DNA, 14 bp, Homo sapiens
tggcctgcaggggc

SEQ ID NO: 223330 - DNA, 12 bp, Homo sapiens
tggcctgctggg

SEQ ID NO: 223331 - DNA, 15 bp, Homo sapiens
tggcctgctgggaac

SEQ ID NO: 223332 - DNA, 16 bp, Homo sapiens
tggcctggaggtgggg

SEQ ID NO: 223333 - DNA, 21 bp, Homo sapiens
tggcctggatctccccactct

SEQ ID NO: 223334 - DNA, 10 bp, Homo sapiens
tggcctggcc

SEQ ID NO: 223335 - DNA, 12 bp, Homo sapiens
tggcctggccag

SEQ ID NO: 223336 - DNA, 13 bp, Homo sapiens
tggcctggccagg

SEQ ID NO: 223337 - DNA, 16 bp, Homo sapiens
tggcctggccaggagc

SEQ ID NO: 223338 - DNA, 17 bp, Homo sapiens
tggcctggccaggagct

SEQ ID NO: 223339 - DNA, 16 bp, Homo sapiens
tggcctggccctgccc

SEQ ID NO: 223340 - DNA, 20 bp, Homo sapiens
tggcctggccctgccctgag

SEQ ID NO: 223341 - DNA, 18 bp, Homo sapiens
tggcctggcctggccctg

SEQ ID NO: 223342 - DNA, 14 bp, Homo sapiens
tggcctggctccgc

SEQ ID NO: 223343 - DNA, 14 bp, Homo sapiens
tggcctgggtctcc

SEQ ID NO: 223344 - DNA, 17 bp, Homo sapiens
tggcctgggtctccctg

SEQ ID NO: 223345 - DNA, 16 bp, Homo sapiens
tggcctggttcaattt

SEQ ID NO: 223346 - DNA, 22 bp, Homo sapiens
tggcctgtccacctgtgctgct

SEQ ID NO: 223347 - DNA, 16 bp, Homo sapiens
tggcctgtctcatccc

SEQ ID NO: 223348 - DNA, 12 bp, Homo sapiens
tggcctgtgctg

SEQ ID NO: 223349 - DNA, 22 bp, Homo sapiens
tggcctgtgctgggccagtggc

SEQ ID NO: 223350 - DNA, 14 bp, Homo sapiens
tggcctgtgtccag

SEQ ID NO: 223351 - DNA, 21 bp, Homo sapiens
tggcctgtgtccagcagctgc

SEQ ID NO: 223352 - DNA, 20 bp, Homo sapiens
tggcctgtttctgcagccct

SEQ ID NO: 223353 - DNA, 23 bp, Homo sapiens
tggccttccccttttgcctggct

SEQ ID NO: 223354 - DNA, 16 bp, Homo sapiens
tggccttcctgcccta

SEQ ID NO: 223355 - DNA, 18 bp, Homo sapiens
tggccttgaaaccacctt

SEQ ID NO: 223356 - DNA, 21 bp, Homo sapiens
tggccttgagcaagtcccatc

SEQ ID NO: 223357 - DNA, 21 bp, Homo sapiens
tggccttgcccgccagcctca

SEQ ID NO: 223358 - DNA, 22 bp, Homo sapiens
tggccttgcccgccagcctcag

SEQ ID NO: 223359 - DNA, 17 bp, Homo sapiens
tggccttggggccagac

SEQ ID NO: 223360 - DNA, 19 bp, Homo sapiens
tggcctttgaggcaaaggc

SEQ ID NO: 223361 - DNA, 13 bp, Homo sapiens
tggccttttccta

SEQ ID NO: 223362 - DNA, 18 bp, Homo sapiens
tggcgattcccattgaaa

SEQ ID NO: 223363 - DNA, 15 bp, Homo sapiens
tggcgcacccggcag

SEQ ID NO: 223364 - DNA, 15 bp, Homo sapiens
tggcgcgcagcccgg

SEQ ID NO: 223365 - DNA, 15 bp, Homo sapiens
tggcgcgggaggcac

SEQ ID NO: 223366 - DNA, 16 bp, Homo sapiens
tggcgcgggaggcacc

SEQ ID NO: 223367 - DNA, 23 bp, Homo sapiens
tggcgcgggaggcaccagctctg

SEQ ID NO: 223368 - DNA, 18 bp, Homo sapiens
tggcggcttcctgtccac

SEQ ID NO: 223369 - DNA, 19 bp, Homo sapiens
tggcggcttcctgtccact

SEQ ID NO: 223370 - DNA, 16 bp, Homo sapiens
tggcgggcagcccctg

SEQ ID NO: 223371 - DNA, 20 bp, Homo sapiens
tggcgggcagcccctgctgg

SEQ ID NO: 223372 - DNA, 20 bp, Homo sapiens
tggcgtaatgggcctgccca

SEQ ID NO: 223373 - DNA, 17 bp, Homo sapiens
tggcgtctgtcttcaag

SEQ ID NO: 223374 - DNA, 20 bp, Homo sapiens
tggcgtggggggagctctgg

SEQ ID NO: 223375 - DNA, 21 bp, Homo sapiens
tggcgtgtgtccctgtggtac

SEQ ID NO: 223376 - DNA, 13 bp, Homo sapiens
tggcgttcctgcc

SEQ ID NO: 223377 - DNA, 18 bp, Homo sapiens
tggcgttcctgccaggct

SEQ ID NO: 223378 - DNA, 17 bp, Homo sapiens
tggcgttgtgggcaggc

SEQ ID NO: 223379 - DNA, 14 bp, Homo sapiens
tggctaaaggtccc

SEQ ID NO: 223380 - DNA, 15 bp, Homo sapiens
ggaaaggtgctcaaa

SEQ ID NO: 223381 - DNA, 15 bp, Homo sapiens
ggaaataaaaccttt

SEQ ID NO: 223382 - DNA, 18 bp, Homo sapiens
ggaaataaaacctttcaa

SEQ ID NO: 223383 - DNA, 20 bp, Homo sapiens
ggaaataaaacctttcaaat

SEQ ID NO: 223384 - DNA, 15 bp, Homo sapiens
ggaaataataaatta

SEQ ID NO: 223385 - DNA, 15 bp, Homo sapiens
ggaaatattaaaaga

SEQ ID NO: 223386 - DNA, 15 bp, Homo sapiens
ggaaatatttatttt

SEQ ID NO: 223387 - DNA, 14 bp, Homo sapiens
ggaaatgctgattt

SEQ ID NO: 223388 - DNA, 17 bp, Homo sapiens
ggaaattctgctgcttg

SEQ ID NO: 223389 - DNA, 16 bp, Homo sapiens
ggaaattcttccctgg

SEQ ID NO: 223390 - DNA, 17 bp, Homo sapiens
ggaaattcttccctggg

SEQ ID NO: 223391 - DNA, 23 bp, Homo sapiens
ggaaattgagattagagggaggt

SEQ ID NO: 223392 - DNA, 14 bp, Homo sapiens
ggaaattgcaaaga

SEQ ID NO: 223393 - DNA, 15 bp, Homo sapiens
ggaacaaagacaacc

SEQ ID NO: 223394 - DNA, 16 bp, Homo sapiens
ggaacaagtgtacaga

SEQ ID NO: 223395 - DNA, 18 bp, Homo sapiens
ggaacaagtgtacagaag

SEQ ID NO: 223396 - DNA, 11 bp, Homo sapiens
ggaacacacac

SEQ ID NO: 223397 - DNA, 14 bp, Homo sapiens
ggaacacacttgga

SEQ ID NO: 223398 - DNA, 22 bp, Homo sapiens
ggaacactggtgggcagctgag

SEQ ID NO: 223399 - DNA, 23 bp, Homo sapiens
ggaacactggtgggcagctgagg

SEQ ID NO: 223400 - DNA, 18 bp, Homo sapiens
ggaacagagtatatatgt

SEQ ID NO: 223401 - DNA, 21 bp, Homo sapiens
tggctcatattcctgcagcct

SEQ ID NO: 223402 - DNA, 17 bp, Homo sapiens
tggctccacgccctggg

SEQ ID NO: 223403 - DNA, 13 bp, Homo sapiens
tggctccaggctc

SEQ ID NO: 223404 - DNA, 19 bp, Homo sapiens
tggctccagtctgctgccc

SEQ ID NO: 223405 - DNA, 17 bp, Homo sapiens
tggctcccaagggaggc

SEQ ID NO: 223406 - DNA, 14 bp, Homo sapiens
tggctcccacaggc

SEQ ID NO: 223407 - DNA, 13 bp, Homo sapiens
tggctcccaggac

SEQ ID NO: 223408 - DNA, 22 bp, Homo sapiens
tggctccccacgagtcacctgc

SEQ ID NO: 223409 - DNA, 22 bp, Homo sapiens
tggctcctcaaacagtaggttg

SEQ ID NO: 223410 - DNA, 14 bp, Homo sapiens
tggctcctgagggg

SEQ ID NO: 223411 - DNA, 15 bp, Homo sapiens
tggctcctgtctggc

SEQ ID NO: 223412 - DNA, 14 bp, Homo sapiens
tggctcctgtgtgg

SEQ ID NO: 223413 - DNA, 17 bp, Homo sapiens
tggctcctgtttccatg

SEQ ID NO: 223414 - DNA, 14 bp, Homo sapiens
tggctcctttccca

SEQ ID NO: 223415 - DNA, 18 bp, Homo sapiens
tggctcctttcccacagt

SEQ ID NO: 223416 - DNA, 19 bp, Homo sapiens
tggctcggacccaccccaa

SEQ ID NO: 223417 - DNA, 22 bp, Homo sapiens
tggctcggacccaccccaactc

SEQ ID NO: 223418 - DNA, 16 bp, Homo sapiens
tggctcgtgggctctg

SEQ ID NO: 223419 - DNA, 18 bp, Homo sapiens
tggctcgtgggctctggc

SEQ ID NO: 223420 - DNA, 21 bp, Homo sapiens
tggctcgtgggctctggctcc

SEQ ID NO: 223421 - DNA, 17 bp, Homo sapiens
tggctcgttctcttctc

SEQ ID NO: 223422 - DNA, 14 bp, Homo sapiens
tggctctctccagg

SEQ ID NO: 223423 - DNA, 15 bp, Homo sapiens
tggctctctccagga

SEQ ID NO: 223424 - DNA, 21 bp, Homo sapiens
tggctctgtcaccgccatgca

SEQ ID NO: 223425 - DNA, 14 bp, Homo sapiens
tggctctttcagag

SEQ ID NO: 223426 - DNA, 16 bp, Homo sapiens
tggctgaaaatcacta

SEQ ID NO: 223427 - DNA, 12 bp, Homo sapiens
tggctgaaatta

SEQ ID NO: 223428 - DNA, 13 bp, Homo sapiens
tggctgactgggg

SEQ ID NO: 223429 - DNA, 14 bp, Homo sapiens
tggctgactggggc

SEQ ID NO: 223430 - DNA, 20 bp, Homo sapiens
tggctgaggcttgggcccag

SEQ ID NO: 223431 - DNA, 21 bp, Homo sapiens
tggctgagtggaatgcaggga

SEQ ID NO: 223432 - DNA, 11 bp, Homo sapiens
tggctgccagg

SEQ ID NO: 223433 - DNA, 12 bp, Homo sapiens
tggctgccaggc

SEQ ID NO: 223434 - DNA, 21 bp, Homo sapiens
tggctgcccagacccctctgg

SEQ ID NO: 223435 - DNA, 13 bp, Homo sapiens
tggctgccccaca

SEQ ID NO: 223436 - DNA, 18 bp, Homo sapiens
tggctgccccacaggcca

SEQ ID NO: 223437 - DNA, 15 bp, Homo sapiens
tggctgcctggccca

SEQ ID NO: 223438 - DNA, 21 bp, Homo sapiens
tggctgcctggcccagggagg

SEQ ID NO: 223439 - DNA, 17 bp, Homo sapiens
tggctgcgaactgtgca

SEQ ID NO: 223440 - DNA, 21 bp, Homo sapiens
tggctggagaggaaaagccag

SEQ ID NO: 223441 - DNA, 14 bp, Homo sapiens
tggctggcaggtgt

SEQ ID NO: 223442 - DNA, 12 bp, Homo sapiens
tggctgggaggg

SEQ ID NO: 223443 - DNA, 23 bp, Homo sapiens
tggctgggagggggcccttccag

SEQ ID NO: 223444 - DNA, 15 bp, Homo sapiens
tggctgggcccagaa

SEQ ID NO: 223445 - DNA, 16 bp, Homo sapiens
tggctgggcccagaag

SEQ ID NO: 223446 - DNA, 15 bp, Homo sapiens
tggctggggacttgg

SEQ ID NO: 223447 - DNA, 20 bp, Homo sapiens
tggctggggcagaggggcag

SEQ ID NO: 223448 - DNA, 18 bp, Homo sapiens
tggctggggctggcacgg

SEQ ID NO: 223449 - DNA, 19 bp, Homo sapiens
tggctgggggcatggggga

SEQ ID NO: 223450 - DNA, 22 bp, Homo sapiens
tggctgggggcatgggggaggc

SEQ ID NO: 223451 - DNA, 22 bp, Homo sapiens
tggctgggtgggcccagaactg

SEQ ID NO: 223452 - DNA, 16 bp, Homo sapiens
tggctgggtggtcagc

SEQ ID NO: 223453 - DNA, 20 bp, Homo sapiens
tggctgggtttgggcagtgg

SEQ ID NO: 223454 - DNA, 13 bp, Homo sapiens
tggctggtccagg

SEQ ID NO: 223455 - DNA, 15 bp, Homo sapiens
tggctggtccagggc

SEQ ID NO: 223456 - DNA, 12 bp, Homo sapiens
tggctggtgtcc

SEQ ID NO: 223457 - DNA, 14 bp, Homo sapiens
tggctggtgtcccc

SEQ ID NO: 223458 - DNA, 19 bp, Homo sapiens
tggctggtgtccccttccc

SEQ ID NO: 223459 - DNA, 14 bp, Homo sapiens
tggctggtttctga

SEQ ID NO: 223460 - DNA, 15 bp, Homo sapiens
tggctgtaatttaat

SEQ ID NO: 223461 - DNA, 17 bp, Homo sapiens
tggctgtatttttagag

SEQ ID NO: 223462 - DNA, 21 bp, Homo sapiens
tggctgtcccctccatctggg

SEQ ID NO: 223463 - DNA, 20 bp, Homo sapiens
tggctgtgagacgaggcagg

SEQ ID NO: 223464 - DNA, 23 bp, Homo sapiens
tggctgtgagacgaggcaggggc

SEQ ID NO: 223465 - DNA, 14 bp, Homo sapiens
tggctgtgcctctg

SEQ ID NO: 223466 - DNA, 15 bp, Homo sapiens
tggctgtgcctctgc

SEQ ID NO: 223467 - DNA, 17 bp, Homo sapiens
tggctgtgcctctgcct

SEQ ID NO: 223468 - DNA, 14 bp, Homo sapiens
tggctgtggaggcc

SEQ ID NO: 223469 - DNA, 15 bp, Homo sapiens
tggctgtggcacaga

SEQ ID NO: 223470 - DNA, 14 bp, Homo sapiens
tggctgtggcaggc

SEQ ID NO: 223471 - DNA, 22 bp, Homo sapiens
tggctgtggcattgttgatgct

SEQ ID NO: 223472 - DNA, 23 bp, Homo sapiens
tggctgtggcccctccttctccc

SEQ ID NO: 223473 - DNA, 22 bp, Homo sapiens
tggctgtggttcctaagcctgt

SEQ ID NO: 223474 - DNA, 23 bp, Homo sapiens
tggctgtggttcctaagcctgtt

SEQ ID NO: 223475 - DNA, 19 bp, Homo sapiens
tggctgttatctgtcttta

SEQ ID NO: 223476 - DNA, 17 bp, Homo sapiens
tggctgttccagactca

SEQ ID NO: 223477 - DNA, 18 bp, Homo sapiens
tggcttagcgttctgttt

SEQ ID NO: 223478 - DNA, 13 bp, Homo sapiens
tggcttataaaca

SEQ ID NO: 223479 - DNA, 21 bp, Homo sapiens
tggcttataaacacattgaat

SEQ ID NO: 223480 - DNA, 15 bp, Homo sapiens
tggcttcagaattgt

SEQ ID NO: 223481 - DNA, 16 bp, Homo sapiens
tggcttcagcccctgg

SEQ ID NO: 223482 - DNA, 18 bp, Homo sapiens
tggcttcccaggaccctg

SEQ ID NO: 223483 - DNA, 20 bp, Homo sapiens
tggcttcccaggaccctggg

SEQ ID NO: 223484 - DNA, 13 bp, Homo sapiens
tggcttccgctgt

SEQ ID NO: 223485 - DNA, 15 bp, Homo sapiens
tggcttccgctgtca

SEQ ID NO: 223486 - DNA, 22 bp, Homo sapiens
tggcttcctccgtccacccagg

SEQ ID NO: 223487 - DNA, 23 bp, Homo sapiens
tggcttcctgagaaagcccacct

SEQ ID NO: 223488 - DNA, 15 bp, Homo sapiens
tggcttcggcctgct

SEQ ID NO: 223489 - DNA, 19 bp, Homo sapiens
tggcttctgcttgtcatcc

SEQ ID NO: 223490 - DNA, 14 bp, Homo sapiens
tggcttctgggacc

SEQ ID NO: 223491 - DNA, 19 bp, Homo sapiens
tggcttctgggacctgtgt

SEQ ID NO: 223492 - DNA, 17 bp, Homo sapiens
tggcttgctccagggtc

SEQ ID NO: 223493 - DNA, 16 bp, Homo sapiens
tggcttgtagggtgag

SEQ ID NO: 223494 - DNA, 13 bp, Homo sapiens
tggctttcatcct

SEQ ID NO: 223495 - DNA, 18 bp, Homo sapiens
tggctttcatcctgtgtc

SEQ ID NO: 223496 - DNA, 21 bp, Homo sapiens
tggctttggtctcttgcttgt

SEQ ID NO: 223497 - DNA, 22 bp, Homo sapiens
tggctttgtcccacagcttggg

SEQ ID NO: 223498 - DNA, 17 bp, Homo sapiens
tggctttgttcttgtca

SEQ ID NO: 223499 - DNA, 16 bp, Homo sapiens
tggcttttcactgctg

SEQ ID NO: 223500 - DNA, 22 bp, Homo sapiens
tggcttttgaatcaaagaatag

SEQ ID NO: 223501 - DNA, 15 bp, Homo sapiens
tggctttttaacatg

SEQ ID NO: 223502 - DNA, 23 bp, Homo sapiens
tggctttttcccagccctttcca

SEQ ID NO: 223503 - DNA, 21 bp, Homo sapiens
tggctttttgtcaaataaaat

SEQ ID NO: 223504 - DNA, 20 bp, Homo sapiens
tgggaaaaaagttttgatga

SEQ ID NO: 223505 - DNA, 21 bp, Homo sapiens
tgggaaaaaagttttgatgaa

SEQ ID NO: 223506 - DNA, 22 bp, Homo sapiens
tgggaaaaaagttttgatgaaa

SEQ ID NO: 223507 - DNA, 19 bp, Homo sapiens
tgggaaactgttgtgggcg

SEQ ID NO: 223508 - DNA, 16 bp, Homo sapiens
tgggaaagccacctct

SEQ ID NO: 223509 - DNA, 13 bp, Homo sapiens
tgggaaaggtgct

SEQ ID NO: 223510 - DNA, 14 bp, Homo sapiens
tgggaaaggtgctc

SEQ ID NO: 223511 - DNA, 17 bp, Homo sapiens
tgggaaaggtgctcaaa

SEQ ID NO: 223512 - DNA, 21 bp, Homo sapiens
tgggaaaggtgctcaaagatg

SEQ ID NO: 223513 - DNA, 15 bp, Homo sapiens
tgggaaatggcttga

SEQ ID NO: 223514 - DNA, 19 bp, Homo sapiens
tgggaaattcttgcactgt

SEQ ID NO: 223515 - DNA, 20 bp, Homo sapiens
tgggaaattcttgcactgta

SEQ ID NO: 223516 - DNA, 17 bp, Homo sapiens
tgggaacaagtgtacag

SEQ ID NO: 223517 - DNA, 21 bp, Homo sapiens
tgggaacaagtgtacagaaga

SEQ ID NO: 223518 - DNA, 18 bp, Homo sapiens
tgggaacactggcctggg

SEQ ID NO: 223519 - DNA, 16 bp, Homo sapiens
ggaagtacttccctca

SEQ ID NO: 223520 - DNA, 16 bp, Homo sapiens
ggaagtcaggagccag

SEQ ID NO: 223521 - DNA, 18 bp, Homo sapiens
ggaagtccctgagaagcc

SEQ ID NO: 223522 - DNA, 22 bp, Homo sapiens
ggaagtgaatccttaaccctaa

SEQ ID NO: 223523 - DNA, 18 bp, Homo sapiens
ggaagtgacaaggcccca

SEQ ID NO: 223524 - DNA, 19 bp, Homo sapiens
ggaagtgacaaggccccag

SEQ ID NO: 223525 - DNA, 21 bp, Homo sapiens
ggaagtgacaaggccccagag

SEQ ID NO: 223526 - DNA, 16 bp, Homo sapiens
ggaagtgtaacagctg

SEQ ID NO: 223527 - DNA, 19 bp, Homo sapiens
ggaagtgtaacagctgagg

SEQ ID NO: 223528 - DNA, 18 bp, Homo sapiens
ggaagtgttcaagaaata

SEQ ID NO: 223529 - DNA, 22 bp, Homo sapiens
ggaagtgttcaagaaataaaaa

SEQ ID NO: 223530 - DNA, 19 bp, Homo sapiens
ggaagttgctgagaaatgg

SEQ ID NO: 223531 - DNA, 12 bp, Homo sapiens
ggacctgctgct

SEQ ID NO: 223532 - DNA, 17 bp, Homo sapiens
ggacctttcagctgtga

SEQ ID NO: 223533 - DNA, 17 bp, Homo sapiens
ggacgcagggagaccct

SEQ ID NO: 223534 - DNA, 16 bp, Homo sapiens
ggacgcctggctccag

SEQ ID NO: 223535 - DNA, 18 bp, Homo sapiens
ggacgcctggctccaggc

SEQ ID NO: 223536 - DNA, 13 bp, Homo sapiens
ggacggaagtggc

SEQ ID NO: 223537 - DNA, 21 bp, Homo sapiens
ggacggcctgatgctccctcc

SEQ ID NO: 223538 - DNA, 13 bp, Homo sapiens
ggacgggacagcg

SEQ ID NO: 223539 - DNA, 21 bp, Homo sapiens
ggacgggacagcggcccggcc

SEQ ID NO: 223540 - DNA, 17 bp, Homo sapiens
ggacgggggctgcttct

SEQ ID NO: 223541 - DNA, 21 bp, Homo sapiens
ggacgttaggcccgggcccct

SEQ ID NO: 223542 - DNA, 14 bp, Homo sapiens
ggacgttggttctg

SEQ ID NO: 223543 - DNA, 22 bp, Homo sapiens
ggactagaaaaacttgggtctc

SEQ ID NO: 223544 - DNA, 17 bp, Homo sapiens
ggactatagcagggctg

SEQ ID NO: 223545 - DNA, 15 bp, Homo sapiens
ggactcagccctgag

SEQ ID NO: 223546 - DNA, 17 bp, Homo sapiens
ggactcagccctgaggt

SEQ ID NO: 223547 - DNA, 24 bp, Homo sapiens
ggactcatttcattcctaacacag

SEQ ID NO: 223548 - DNA, 19 bp, Homo sapiens
ggactccaggatcctcctg

SEQ ID NO: 223549 - DNA, 20 bp, Homo sapiens
ggactccaggatcctcctgg

SEQ ID NO: 223550 - DNA, 14 bp, Homo sapiens
ggactccaggccag

SEQ ID NO: 223551 - DNA, 18 bp, Homo sapiens
ggactcccgggccacgcc

SEQ ID NO: 223552 - DNA, 17 bp, Homo sapiens
ggactccctccccaccc

SEQ ID NO: 223553 - DNA, 14 bp, Homo sapiens
ggactcgctagtga

SEQ ID NO: 223554 - DNA, 11 bp, Homo sapiens
ggactctcagg

SEQ ID NO: 223555 - DNA, 15 bp, Homo sapiens
ggactctcagggatt

SEQ ID NO: 223556 - DNA, 13 bp, Homo sapiens
ggactctctttct

SEQ ID NO: 223557 - DNA, 23 bp, Homo sapiens
ggactctgccccttctgtttcca

SEQ ID NO: 223558 - DNA, 19 bp, Homo sapiens
ggactctgccttccaggcg

SEQ ID NO: 223559 - DNA, 16 bp, Homo sapiens
ggactctgcttggctg

SEQ ID NO: 223560 - DNA, 17 bp, Homo sapiens
ggactctggaccccagg

SEQ ID NO: 223561 - DNA, 15 bp, Homo sapiens
ggactctgtgctcac

SEQ ID NO: 223562 - DNA, 13 bp, Homo sapiens
ggactctgtgggg

SEQ ID NO: 223563 - DNA, 16 bp, Homo sapiens
ggactctgtggggcca

SEQ ID NO: 223564 - DNA, 16 bp, Homo sapiens
ggactcttgctctttc

SEQ ID NO: 223565 - DNA, 21 bp, Homo sapiens
ggactcttgctctttctactc

SEQ ID NO: 223566 - DNA, 22 bp, Homo sapiens
ggactgacctgcccctgccgcc

SEQ ID NO: 223567 - DNA, 12 bp, Homo sapiens
ggactgagccag

SEQ ID NO: 223568 - DNA, 14 bp, Homo sapiens
ggactgatgtcatc

SEQ ID NO: 223569 - DNA, 18 bp, Homo sapiens
ggactgatgtcatcttga

SEQ ID NO: 223570 - DNA, 23 bp, Homo sapiens
ggactgcagctgcaccagcaggt

SEQ ID NO: 223571 - DNA, 10 bp, Homo sapiens
ggactgcatg

SEQ ID NO: 223572 - DNA, 19 bp, Homo sapiens
ggactgcatggtaatttat

SEQ ID NO: 223573 - DNA, 14 bp, Homo sapiens
ggactgcccccaga

SEQ ID NO: 223574 - DNA, 21 bp, Homo sapiens
ggactgccccgtgcagactgg

SEQ ID NO: 223575 - DNA, 13 bp, Homo sapiens
ggactgcctctgc

SEQ ID NO: 223576 - DNA, 14 bp, Homo sapiens
ggactgcctctgcc

SEQ ID NO: 223577 - DNA, 17 bp, Homo sapiens
ggactggaggtgggcat

SEQ ID NO: 223578 - DNA, 23 bp, Homo sapiens
ggactggaggtgggcatgccacc

SEQ ID NO: 223579 - DNA, 18 bp, Homo sapiens
ggactggcccttgcccaa

SEQ ID NO: 223580 - DNA, 19 bp, Homo sapiens
ggactggctagagtcctca

SEQ ID NO: 223581 - DNA, 22 bp, Homo sapiens
ggactggctagagtcctcactc

SEQ ID NO: 223582 - DNA, 15 bp, Homo sapiens
ggactggctgtcctt

SEQ ID NO: 223583 - DNA, 19 bp, Homo sapiens
ggactggtggcccctgcct

SEQ ID NO: 223584 - DNA, 17 bp, Homo sapiens
ggactgtacctgtagga

SEQ ID NO: 223585 - DNA, 18 bp, Homo sapiens
ggactgtatttctgtgga

SEQ ID NO: 223586 - DNA, 14 bp, Homo sapiens
ggactgtcctaggt

SEQ ID NO: 223587 - DNA, 20 bp, Homo sapiens
ggactgtcttcaaccctgcc

SEQ ID NO: 223588 - DNA, 21 bp, Homo sapiens
ggactgtcttcaaccctgccc

SEQ ID NO: 223589 - DNA, 22 bp, Homo sapiens
ggactgtcttcaaccctgccct

SEQ ID NO: 223590 - DNA, 23 bp, Homo sapiens
ggactgtcttcaaccctgccctg

SEQ ID NO: 223591 - DNA, 22 bp, Homo sapiens
ggactgtggcctcaggaggcag

SEQ ID NO: 223592 - DNA, 17 bp, Homo sapiens
ggacttaacggctccag

SEQ ID NO: 223593 - DNA, 10 bp, Homo sapiens
ggacttcaaa

SEQ ID NO: 223594 - DNA, 22 bp, Homo sapiens
ggacttcctgctacagtagctg

SEQ ID NO: 223595 - DNA, 16 bp, Homo sapiens
ggacttcctggggccc

SEQ ID NO: 223596 - DNA, 15 bp, Homo sapiens
ggacttccttgctct

SEQ ID NO: 223597 - DNA, 23 bp, Homo sapiens
ggacttgaaagcatccatgtgtg

SEQ ID NO: 223598 - DNA, 18 bp, Homo sapiens
ggacttgaggattttgag

SEQ ID NO: 223599 - DNA, 15 bp, Homo sapiens
ggacttggcgcgccc

SEQ ID NO: 223600 - DNA, 14 bp, Homo sapiens
ggacttgggtcctc

SEQ ID NO: 223601 - DNA, 21 bp, Homo sapiens
ggactttatttaatttcataa

SEQ ID NO: 223602 - DNA, 23 bp, Homo sapiens
ggactttatttaatttcataaat

SEQ ID NO: 223603 - DNA, 16 bp, Homo sapiens
ggactttccaccccct

SEQ ID NO: 223604 - DNA, 17 bp, Homo sapiens
ggactttccaccccctc

SEQ ID NO: 223605 - DNA, 21 bp, Homo sapiens
ggactttcttttcgccgtggc

SEQ ID NO: 223606 - DNA, 14 bp, Homo sapiens
ggagaaaagccaga

SEQ ID NO: 223607 - DNA, 16 bp, Homo sapiens
ggagaaaatgcttaat

SEQ ID NO: 223608 - DNA, 19 bp, Homo sapiens
ggagaaaatggacgtgtta

SEQ ID NO: 223609 - DNA, 17 bp, Homo sapiens
ggagaaatgttgttcat

SEQ ID NO: 223610 - DNA, 18 bp, Homo sapiens
ggagaacatctgccttgc

SEQ ID NO: 223611 - DNA, 19 bp, Homo sapiens
ggagaacatctgccttgct

SEQ ID NO: 223612 - DNA, 22 bp, Homo sapiens
ggagaacctcgttgacatgcac

SEQ ID NO: 223613 - DNA, 15 bp, Homo sapiens
ggagaactgtgctct

SEQ ID NO: 223614 - DNA, 17 bp, Homo sapiens
ggagaaggcctgccccc

SEQ ID NO: 223615 - DNA, 18 bp, Homo sapiens
ggagaaggcctgcccccc

SEQ ID NO: 223616 - DNA, 16 bp, Homo sapiens
ggagaaggtgcttggg

SEQ ID NO: 223617 - DNA, 19 bp, Homo sapiens
ggagaagttggtcttactt

SEQ ID NO: 223618 - DNA, 14 bp, Homo sapiens
ggagaatcatgtga

SEQ ID NO: 223619 - DNA, 17 bp, Homo sapiens
ggagaatcatgtgaacc

SEQ ID NO: 223620 - DNA, 19 bp, Homo sapiens
ggagaatcatgtgaacccg

SEQ ID NO: 223621 - DNA, 15 bp, Homo sapiens
ggagacaaagcagga

SEQ ID NO: 223622 - DNA, 12 bp, Homo sapiens
ggagacaatcta

SEQ ID NO: 223623 - DNA, 17 bp, Homo sapiens
ggagacaatctaaaaaa

SEQ ID NO: 223624 - DNA, 21 bp, Homo sapiens
ggagacacatccagcaattgt

SEQ ID NO: 223625 - DNA, 20 bp, Homo sapiens
ggagacaggcagggagggct

SEQ ID NO: 223626 - DNA, 18 bp, Homo sapiens
ggagacagtgatctccat

SEQ ID NO: 223627 - DNA, 13 bp, Homo sapiens
ggagaccaggact

SEQ ID NO: 223628 - DNA, 17 bp, Homo sapiens
ggagaccaggactctgc

SEQ ID NO: 223629 - DNA, 21 bp, Homo sapiens
ggagaccccttggggagcagg

SEQ ID NO: 223630 - DNA, 14 bp, Homo sapiens
ggagaccctgggag

SEQ ID NO: 223631 - DNA, 20 bp, Homo sapiens
ggagaccgagtgtggagctg

SEQ ID NO: 223632 - DNA, 21 bp, Homo sapiens
ggagaccgcttcacccctgca

SEQ ID NO: 223633 - DNA, 22 bp, Homo sapiens
ggagaccgcttcacccctgcac

SEQ ID NO: 223634 - DNA, 23 bp, Homo sapiens
ggagaccgcttcacccctgcact

SEQ ID NO: 223635 - DNA, 12 bp, Homo sapiens
ggagacctgtgc

SEQ ID NO: 223636 - DNA, 18 bp, Homo sapiens
ggagacgtccaccctgca

SEQ ID NO: 223637 - DNA, 16 bp, Homo sapiens
ggagactaagccctgt

SEQ ID NO: 223638 - DNA, 14 bp, Homo sapiens
ggagactagattgc

SEQ ID NO: 223639 - DNA, 17 bp, Homo sapiens
ggagactatgtgtcatg

SEQ ID NO: 223640 - DNA, 21 bp, Homo sapiens
ggagactccatgagaagccgt

SEQ ID NO: 223641 - DNA, 14 bp, Homo sapiens
ggagactgagcttg

SEQ ID NO: 223642 - DNA, 12 bp, Homo sapiens
ggagactgtccc

SEQ ID NO: 223643 - DNA, 18 bp, Homo sapiens
ggagagaaggggaggagg

SEQ ID NO: 223644 - DNA, 17 bp, Homo sapiens
ggagagaatgagagagt

SEQ ID NO: 223645 - DNA, 19 bp, Homo sapiens
ggagagaatgagagagtgt

SEQ ID NO: 223646 - DNA, 21 bp, Homo sapiens
ggagagaatgagagagtgtgg

SEQ ID NO: 223647 - DNA, 18 bp, Homo sapiens
ggagagaccgagtgaacc

SEQ ID NO: 223648 - DNA, 13 bp, Homo sapiens
ggagagacctcat

SEQ ID NO: 223649 - DNA, 13 bp, Homo sapiens
ggagagagagaga

SEQ ID NO: 223650 - DNA, 16 bp, Homo sapiens
ggagagagagagagaa

SEQ ID NO: 223651 - DNA, 17 bp, Homo sapiens
ggagagagagagagaaa

SEQ ID NO: 223652 - DNA, 15 bp, Homo sapiens
ggagagagtgagaga

SEQ ID NO: 223653 - DNA, 17 bp, Homo sapiens
ggagagagtgagagaga

SEQ ID NO: 223654 - DNA, 18 bp, Homo sapiens
ggagagagtgagagagag

SEQ ID NO: 223655 - DNA, 13 bp, Homo sapiens
ggagagcagctgg

SEQ ID NO: 223656 - DNA, 17 bp, Homo sapiens
ggagagcatcaccacca

SEQ ID NO: 223657 - DNA, 21 bp, Homo sapiens
ggagagcatcaccaccacacc

SEQ ID NO: 223658 - DNA, 18 bp, Homo sapiens
ggagagcatctgctctga

SEQ ID NO: 223659 - DNA, 13 bp, Homo sapiens
ggagagccaacct

SEQ ID NO: 223660 - DNA, 17 bp, Homo sapiens
ggagagctcaggatggc

SEQ ID NO: 223661 - DNA, 16 bp, Homo sapiens
ggaggatgctgtgcct

SEQ ID NO: 223662 - DNA, 17 bp, Homo sapiens
ggaggatgctgtgcctc

SEQ ID NO: 223663 - DNA, 12 bp, Homo sapiens
ggaggcaagaac

SEQ ID NO: 223664 - DNA, 14 bp, Homo sapiens
ggaggcaccagctc

SEQ ID NO: 223665 - DNA, 16 bp, Homo sapiens
ggaggcaccagctctg

SEQ ID NO: 223666 - DNA, 22 bp, Homo sapiens
ggaggcaccagctctgtggcct

SEQ ID NO: 223667 - DNA, 21 bp, Homo sapiens
ggaggcagaaagcagaggctg

SEQ ID NO: 223668 - DNA, 23 bp, Homo sapiens
tggggagcgggggctaactggcc

SEQ ID NO: 223669 - DNA, 15 bp, Homo sapiens
tggggaggcagaggg

SEQ ID NO: 223670 - DNA, 15 bp, Homo sapiens
tggggagggacaagg

SEQ ID NO: 223671 - DNA, 17 bp, Homo sapiens
tggggagggagagatct

SEQ ID NO: 223672 - DNA, 19 bp, Homo sapiens
tggggaggggtcagctctg

SEQ ID NO: 223673 - DNA, 19 bp, Homo sapiens
tggggagtgggacagagtc

SEQ ID NO: 223674 - DNA, 23 bp, Homo sapiens
tggggatcagagtctggcctgcc

SEQ ID NO: 223675 - DNA, 20 bp, Homo sapiens
tggggatcccgtgctggaag

SEQ ID NO: 223676 - DNA, 19 bp, Homo sapiens
tggggatggggacaaagaa

SEQ ID NO: 223677 - DNA, 18 bp, Homo sapiens
tggggatgtttgtgctgc

SEQ ID NO: 223678 - DNA, 16 bp, Homo sapiens
tggggattggtgggtc

SEQ ID NO: 223679 - DNA, 17 bp, Homo sapiens
tggggatttctcccagc

SEQ ID NO: 223680 - DNA, 15 bp, Homo sapiens
tggggatttctggga

SEQ ID NO: 223681 - DNA, 19 bp, Homo sapiens
tggggcaacgacggtttca

SEQ ID NO: 223682 - DNA, 15 bp, Homo sapiens
tggggcaagcctgag

SEQ ID NO: 223683 - DNA, 20 bp, Homo sapiens
tggggcactgtttcttctca

SEQ ID NO: 223684 - DNA, 17 bp, Homo sapiens
tggggcagaggggcagc

SEQ ID NO: 223685 - DNA, 22 bp, Homo sapiens
tggggcagcacagagagggggc

SEQ ID NO: 223686 - DNA, 15 bp, Homo sapiens
tggggcagggcctgg

SEQ ID NO: 223687 - DNA, 16 bp, Homo sapiens
tggggcatgtgtgcct

SEQ ID NO: 223688 - DNA, 17 bp, Homo sapiens
tggggcatgtgtgcctg

SEQ ID NO: 223689 - DNA, 22 bp, Homo sapiens
tggggcatgtgtgcctgtggca

SEQ ID NO: 223690 - DNA, 14 bp, Homo sapiens
tggggccacagcca

SEQ ID NO: 223691 - DNA, 15 bp, Homo sapiens
tggggccacagccag

SEQ ID NO: 223692 - DNA, 13 bp, Homo sapiens
tggggcccaagca

SEQ ID NO: 223693 - DNA, 23 bp, Homo sapiens
tggggcccagcacaactgctgtt

SEQ ID NO: 223694 - DNA, 17 bp, Homo sapiens
tggggcccaggggcttt

SEQ ID NO: 223695 - DNA, 17 bp, Homo sapiens
tggggcccatggcccca

SEQ ID NO: 223696 - DNA, 20 bp, Homo sapiens
tggggcccatggccccagct

SEQ ID NO: 223697 - DNA, 19 bp, Homo sapiens
tggggccccaaagcccagc

SEQ ID NO: 223698 - DNA, 21 bp, Homo sapiens
tggggccccaaagcccagccc

SEQ ID NO: 223699 - DNA, 22 bp, Homo sapiens
tggggccccaaagcccagcccg

SEQ ID NO: 223700 - DNA, 14 bp, Homo sapiens
tggggccgggctgg

SEQ ID NO: 223701 - DNA, 18 bp, Homo sapiens
tggggcctcacccagaag

SEQ ID NO: 223702 - DNA, 19 bp, Homo sapiens
tggggcctccttgtccagg

SEQ ID NO: 223703 - DNA, 12 bp, Homo sapiens
tggggcctctgt

SEQ ID NO: 223704 - DNA, 15 bp, Homo sapiens
tggggcctggacctg

SEQ ID NO: 223705 - DNA, 12 bp, Homo sapiens
tggggcctggca

SEQ ID NO: 223706 - DNA, 14 bp, Homo sapiens
tggggccttggcct

SEQ ID NO: 223707 - DNA, 13 bp, Homo sapiens
tggggcgaggcag

SEQ ID NO: 223708 - DNA, 14 bp, Homo sapiens
tggggcgaggcaga

SEQ ID NO: 223709 - DNA, 16 bp, Homo sapiens
tggggcgggaggccac

SEQ ID NO: 223710 - DNA, 22 bp, Homo sapiens
tggggcgggggtctatacattc

SEQ ID NO: 223711 - DNA, 19 bp, Homo sapiens
tggggctcacggggcctcc

SEQ ID NO: 223712 - DNA, 18 bp, Homo sapiens
tggggctcgccccaccca

SEQ ID NO: 223713 - DNA, 20 bp, Homo sapiens
tggggctcgtggccttcccc

SEQ ID NO: 223714 - DNA, 15 bp, Homo sapiens
tggggctgagcctga

SEQ ID NO: 223715 - DNA, 17 bp, Homo sapiens
tggggctgagcctgagg

SEQ ID NO: 223716 - DNA, 18 bp, Homo sapiens
tggggcttctcctgaccc

SEQ ID NO: 223717 - DNA, 18 bp, Homo sapiens
tggggcttggcgtggagc

SEQ ID NO: 223718 - DNA, 20 bp, Homo sapiens
tggggcttttgtgccaggag

SEQ ID NO: 223719 - DNA, 17 bp, Homo sapiens
tgggggaacagatgcta

SEQ ID NO: 223720 - DNA, 14 bp, Homo sapiens
tgggggactgggag

SEQ ID NO: 223721 - DNA, 14 bp, Homo sapiens
tgggggagagcagg

SEQ ID NO: 223722 - DNA, 15 bp, Homo sapiens
tgggggagcctggag

SEQ ID NO: 223723 - DNA, 15 bp, Homo sapiens
tgggggaggctctga

SEQ ID NO: 223724 - DNA, 19 bp, Homo sapiens
tgggggattcaaatgcatg

SEQ ID NO: 223725 - DNA, 22 bp, Homo sapiens
tgggggatttcaagggactggg

SEQ ID NO: 223726 - DNA, 15 bp, Homo sapiens
tgggggcagagcagc

SEQ ID NO: 223727 - DNA, 22 bp, Homo sapiens
tgggggcatgggggaggctctg

SEQ ID NO: 223728 - DNA, 23 bp, Homo sapiens
tgggggcatgggggaggctctga

SEQ ID NO: 223729 - DNA, 13 bp, Homo sapiens
tgggggcatgggt

SEQ ID NO: 223730 - DNA, 12 bp, Homo sapiens
tgggggccctgg

SEQ ID NO: 223731 - DNA, 15 bp, Homo sapiens
tgggggcctgctgtg

SEQ ID NO: 223732 - DNA, 20 bp, Homo sapiens
tgggggctagaaaaaacata

SEQ ID NO: 223733 - DNA, 13 bp, Homo sapiens
tgggggctggtgc

SEQ ID NO: 223734 - DNA, 21 bp, Homo sapiens
tggggggccaacaccagggat

SEQ ID NO: 223735 - DNA, 15 bp, Homo sapiens
tgggggtcccaggat

SEQ ID NO: 223736 - DNA, 23 bp, Homo sapiens
tgggggtctgctctgtgcctggg

SEQ ID NO: 223737 - DNA, 13 bp, Homo sapiens
tgggggtctggga

SEQ ID NO: 223738 - DNA, 15 bp, Homo sapiens
tgggggtctgggagg

SEQ ID NO: 223739 - DNA, 16 bp, Homo sapiens
tgggggtctgggaggc

SEQ ID NO: 223740 - DNA, 21 bp, Homo sapiens
tgggggtgaggggccaggcca

SEQ ID NO: 223741 - DNA, 15 bp, Homo sapiens
tgggggttctttctt

SEQ ID NO: 223742 - DNA, 19 bp, Homo sapiens
tgggggttctttcttcctc

SEQ ID NO: 223743 - DNA, 13 bp, Homo sapiens
tggggtaaggagg

SEQ ID NO: 223744 - DNA, 17 bp, Homo sapiens
tggggtaaggaggagaa

SEQ ID NO: 223745 - DNA, 21 bp, Homo sapiens
tggggtactcttgatgtgaag

SEQ ID NO: 223746 - DNA, 16 bp, Homo sapiens
tggggtagagaggaca

SEQ ID NO: 223747 - DNA, 17 bp, Homo sapiens
tggggtagagaggacag

SEQ ID NO: 223748 - DNA, 13 bp, Homo sapiens
tggggtcaggaac

SEQ ID NO: 223749 - DNA, 22 bp, Homo sapiens
tggggtcaggaacagtggctgg

SEQ ID NO: 223750 - DNA, 17 bp, Homo sapiens
tggggtccccactccct

SEQ ID NO: 223751 - DNA, 23 bp, Homo sapiens
tggggtcctgtggggcccccaca

SEQ ID NO: 223752 - DNA, 23 bp, Homo sapiens
tggggtctcacagtgttgcccag

SEQ ID NO: 223753 - DNA, 17 bp, Homo sapiens
tggggtctctgagcagt

SEQ ID NO: 223754 - DNA, 12 bp, Homo sapiens
tggggtgcctga

SEQ ID NO: 223755 - DNA, 22 bp, Homo sapiens
tggggtggaatagggaactgta

SEQ ID NO: 223756 - DNA, 16 bp, Homo sapiens
tggggttgcaaccact

SEQ ID NO: 223757 - DNA, 18 bp, Homo sapiens
tggggttggctgggccca

SEQ ID NO: 223758 - DNA, 16 bp, Homo sapiens
tggggtttccacacag

SEQ ID NO: 223759 - DNA, 19 bp, Homo sapiens
tggggtttccacacaggcc

SEQ ID NO: 223760 - DNA, 13 bp, Homo sapiens
tgggtaaatatac

SEQ ID NO: 223761 - DNA, 15 bp, Homo sapiens
tgggtacaagagcca

SEQ ID NO: 223762 - DNA, 16 bp, Homo sapiens
tgggtacaagagccat

SEQ ID NO: 223763 - DNA, 13 bp, Homo sapiens
tgggtaccaggcc

SEQ ID NO: 223764 - DNA, 14 bp, Homo sapiens
tgggtaccaggcca

SEQ ID NO: 223765 - DNA, 16 bp, Homo sapiens
tgggtacccaggctgg

SEQ ID NO: 223766 - DNA, 17 bp, Homo sapiens
tgggtacccaggctggt

SEQ ID NO: 223767 - DNA, 21 bp, Homo sapiens
tgggtagcttctgacctcagc

SEQ ID NO: 223768 - DNA, 20 bp, Homo sapiens
tgggtatcaaacagctcagg

SEQ ID NO: 223769 - DNA, 13 bp, Homo sapiens
tgggtatcccacc

SEQ ID NO: 223770 - DNA, 18 bp, Homo sapiens
tgggtatcccacctccag

SEQ ID NO: 223771 - DNA, 20 bp, Homo sapiens
tgggtatttcttatttgaaa

SEQ ID NO: 223772 - DNA, 16 bp, Homo sapiens
tgggtcaactccaagg

SEQ ID NO: 223773 - DNA, 23 bp, Homo sapiens
tgggtcaactccaaggcaaatgt

SEQ ID NO: 223774 - DNA, 12 bp, Homo sapiens
tgggtcacagga

SEQ ID NO: 223775 - DNA, 17 bp, Homo sapiens
tgggtcaccttcctggg

SEQ ID NO: 223776 - DNA, 15 bp, Homo sapiens
tgggtcagtgtgcca

SEQ ID NO: 223777 - DNA, 18 bp, Homo sapiens
tgggtccaggaaggcagc

SEQ ID NO: 223778 - DNA, 17 bp, Homo sapiens
tgggtcccccacgtgac

SEQ ID NO: 223779 - DNA, 13 bp, Homo sapiens
tgggtcgcccctc

SEQ ID NO: 223780 - DNA, 14 bp, Homo sapiens
tgggtcgcccctcc

SEQ ID NO: 223781 - DNA, 15 bp, Homo sapiens
tgggtcgcccctcct

SEQ ID NO: 223782 - DNA, 17 bp, Homo sapiens
tgggtcgcccctcctcg

SEQ ID NO: 223783 - DNA, 18 bp, Homo sapiens
tgggtcggccctgcccaa

SEQ ID NO: 223784 - DNA, 13 bp, Homo sapiens
tgggtctcactcc

SEQ ID NO: 223785 - DNA, 22 bp, Homo sapiens
tgggtctcgctttgttgcccag

SEQ ID NO: 223786 - DNA, 15 bp, Homo sapiens
tgggtctgaaaggaa

SEQ ID NO: 223787 - DNA, 16 bp, Homo sapiens
tgggtctgaaaggaaa

SEQ ID NO: 223788 - DNA, 18 bp, Homo sapiens
tgggtctgaaaggaaaag

SEQ ID NO: 223789 - DNA, 22 bp, Homo sapiens
tgggtcttgttttttttttcca

SEQ ID NO: 223790 - DNA, 14 bp, Homo sapiens
tgggtgacagagca

SEQ ID NO: 223791 - DNA, 13 bp, Homo sapiens
tgggtgacggtcc

SEQ ID NO: 223792 - DNA, 16 bp, Homo sapiens
tgtaaatgatatgtct

SEQ ID NO: 223793 - DNA, 18 bp, Homo sapiens
tgtaaatggagcttgtac

SEQ ID NO: 223794 - DNA, 20 bp, Homo sapiens
tgtaaatggagcttgtacat

SEQ ID NO: 223795 - DNA, 16 bp, Homo sapiens
tgtaaatgttatgact

SEQ ID NO: 223796 - DNA, 13 bp, Homo sapiens
tgtaaattattgt

SEQ ID NO: 223797 - DNA, 15 bp, Homo sapiens
tgtaaattattgtaa

SEQ ID NO: 223798 - DNA, 17 bp, Homo sapiens
tgtaaattattgtaaac

SEQ ID NO: 223799 - DNA, 16 bp, Homo sapiens
tgtaaattcctgttgt

SEQ ID NO: 223800 - DNA, 20 bp, Homo sapiens
tgtaaatttaactgcatata

SEQ ID NO: 223801 - DNA, 14 bp, Homo sapiens
tgtaaatttgtact

SEQ ID NO: 223802 - DNA, 11 bp, Homo sapiens
tgtaacacaag

SEQ ID NO: 223803 - DNA, 11 bp, Homo sapiens
tgtaacagctg

SEQ ID NO: 223804 - DNA, 19 bp, Homo sapiens
tgtaacagttggtgatttt

SEQ ID NO: 223805 - DNA, 22 bp, Homo sapiens
tgtaacatcactatccatgcac

SEQ ID NO: 223806 - DNA, 20 bp, Homo sapiens
tgtaaccacctctctgtctt

SEQ ID NO: 223807 - DNA, 18 bp, Homo sapiens
tgtaaccagcagtcacag

SEQ ID NO: 223808 - DNA, 16 bp, Homo sapiens
tgtaacccttgaattt

SEQ ID NO: 223809 - DNA, 23 bp, Homo sapiens
tgtaacctcagctctgggagagg

SEQ ID NO: 223810 - DNA, 18 bp, Homo sapiens
tgtaacctcgtgtctagt

SEQ ID NO: 223811 - DNA, 11 bp, Homo sapiens
tgtaactgccc

SEQ ID NO: 223812 - DNA, 24 bp, Homo sapiens
tgtaactgcccttttaaatggcat

SEQ ID NO: 223813 - DNA, 17 bp, Homo sapiens
tgtaactgctgagccac

SEQ ID NO: 223814 - DNA, 13 bp, Homo sapiens
tgtaacttgtgct

SEQ ID NO: 223815 - DNA, 19 bp, Homo sapiens
tgtaactttgcatgttctt

SEQ ID NO: 223816 - DNA, 20 bp, Homo sapiens
ggcacgagcaaagtgaagac

SEQ ID NO: 223817 - DNA, 14 bp, Homo sapiens
ggcacgcacctgta

SEQ ID NO: 223818 - DNA, 19 bp, Homo sapiens
ggcacgccaacagcccccc

SEQ ID NO: 223819 - DNA, 15 bp, Homo sapiens
ggcacggctccgagg

SEQ ID NO: 223820 - DNA, 15 bp, Homo sapiens
ggcacgtcctccacc

SEQ ID NO: 223821 - DNA, 22 bp, Homo sapiens
ggcactgatgggcactggaaaa

SEQ ID NO: 223822 - DNA, 20 bp, Homo sapiens
ggcactgccttctcctctct

SEQ ID NO: 223823 - DNA, 21 bp, Homo sapiens
ggcactggcattgtccctgtg

SEQ ID NO: 223824 - DNA, 13 bp, Homo sapiens
ggcactggtggca

SEQ ID NO: 223825 - DNA, 15 bp, Homo sapiens
ggcactggtggcccg

SEQ ID NO: 223826 - DNA, 15 bp, Homo sapiens
ggcagaaaagaggag

SEQ ID NO: 223827 - DNA, 16 bp, Homo sapiens
ggcagaaaagaggaga

SEQ ID NO: 223828 - DNA, 22 bp, Homo sapiens
ggcagaaaagaggagaccctgg

SEQ ID NO: 223829 - DNA, 18 bp, Homo sapiens
ggcagaaagcagaggctg

SEQ ID NO: 223830 - DNA, 13 bp, Homo sapiens
ggcagaaaggaga

SEQ ID NO: 223831 - DNA, 14 bp, Homo sapiens
ggcagaaaggagat

SEQ ID NO: 223832 - DNA, 16 bp, Homo sapiens
ggcagaacctggtggc

SEQ ID NO: 223833 - DNA, 13 bp, Homo sapiens
ggcagaactgagc

SEQ ID NO: 223834 - DNA, 14 bp, Homo sapiens
ggcagaagggaatt

SEQ ID NO: 223835 - DNA, 16 bp, Homo sapiens
ggcagaatggtgggct

SEQ ID NO: 223836 - DNA, 21 bp, Homo sapiens
ggcagaatggtgggctccaga

SEQ ID NO: 223837 - DNA, 22 bp, Homo sapiens
ggcagaatggtgggctccagag

SEQ ID NO: 223838 - DNA, 22 bp, Homo sapiens
ggcagacacatgctgttggcct

SEQ ID NO: 223839 - DNA, 16 bp, Homo sapiens
ggcagactcgagggcc

SEQ ID NO: 223840 - DNA, 19 bp, Homo sapiens
ggcagagaaaacacacgct

SEQ ID NO: 223841 - DNA, 23 bp, Homo sapiens
ggcagagattgggggggcttggg

SEQ ID NO: 223842 - DNA, 24 bp, Homo sapiens
ggcagagccatgggcctgggcctg

SEQ ID NO: 223843 - DNA, 21 bp, Homo sapiens
ggcagagcccgcccacctggg

SEQ ID NO: 223844 - DNA, 12 bp, Homo sapiens
ggcagagcctgt

SEQ ID NO: 223845 - DNA, 14 bp, Homo sapiens
ggcagagcctgtcc

SEQ ID NO: 223846 - DNA, 15 bp, Homo sapiens
ggcagagctcagagg

SEQ ID NO: 223847 - DNA, 20 bp, Homo sapiens
ggcagagctgagtcggctgg

SEQ ID NO: 223848 - DNA, 23 bp, Homo sapiens
ggcagagctgagtcggctgggca

SEQ ID NO: 223849 - DNA, 13 bp, Homo sapiens
ggcagaggagagt

SEQ ID NO: 223850 - DNA, 12 bp, Homo sapiens
ggcagaggcagg

SEQ ID NO: 223851 - DNA, 14 bp, Homo sapiens
ggcagaggggagag

SEQ ID NO: 223852 - DNA, 15 bp, Homo sapiens
ggcagaggggagagg

SEQ ID NO: 223853 - DNA, 18 bp, Homo sapiens
ggcagaggggagaggaag

SEQ ID NO: 223854 - DNA, 16 bp, Homo sapiens
ggcagaggggcagccg

SEQ ID NO: 223855 - DNA, 18 bp, Homo sapiens
ggcagaggggcagccgct

SEQ ID NO: 223856 - DNA, 22 bp, Homo sapiens
ggcagagggttgcagtgagccg

SEQ ID NO: 223857 - DNA, 21 bp, Homo sapiens
ggcagagtgccccacctgcca

SEQ ID NO: 223858 - DNA, 15 bp, Homo sapiens
ggcagataatcagcc

SEQ ID NO: 223859 - DNA, 20 bp, Homo sapiens
ggcagatcatttgaggccag

SEQ ID NO: 223860 - DNA, 16 bp, Homo sapiens
ggcagatctgtgcccc

SEQ ID NO: 223861 - DNA, 15 bp, Homo sapiens
ggcagcaaaggaaga

SEQ ID NO: 223862 - DNA, 15 bp, Homo sapiens
ggcagcacctggagc

SEQ ID NO: 223863 - DNA, 13 bp, Homo sapiens
ggcagcactggga

SEQ ID NO: 223864 - DNA, 16 bp, Homo sapiens
ggcagcactgggaagc

SEQ ID NO: 223865 - DNA, 19 bp, Homo sapiens
ggcagcactgggaagctgg

SEQ ID NO: 223866 - DNA, 13 bp, Homo sapiens
ggcagcaggagcc

SEQ ID NO: 223867 - DNA, 14 bp, Homo sapiens
ggcagcaggagcca

SEQ ID NO: 223868 - DNA, 13 bp, Homo sapiens
ggcagccagggct

SEQ ID NO: 223869 - DNA, 14 bp, Homo sapiens
ggcagccatgcctc

SEQ ID NO: 223870 - DNA, 21 bp, Homo sapiens
ggcagccatgcctcatgccac

SEQ ID NO: 223871 - DNA, 13 bp, Homo sapiens
ggcagcccagaga

SEQ ID NO: 223872 - DNA, 14 bp, Homo sapiens
ggcagcccagagag

SEQ ID NO: 223873 - DNA, 20 bp, Homo sapiens
ggcagcccagagagaccctg

SEQ ID NO: 223874 - DNA, 15 bp, Homo sapiens
ggcagccccctccac

SEQ ID NO: 223875 - DNA, 16 bp, Homo sapiens
ggcagccccctccaca

SEQ ID NO: 223876 - DNA, 12 bp, Homo sapiens
ggcagcccctcc

SEQ ID NO: 223877 - DNA, 13 bp, Homo sapiens
ggcagcccctccc

SEQ ID NO: 223878 - DNA, 21 bp, Homo sapiens
ggcagcccctgctggaccaag

SEQ ID NO: 223879 - DNA, 19 bp, Homo sapiens
ggcagccgtgccttcagct

SEQ ID NO: 223880 - DNA, 15 bp, Homo sapiens
ggcagcctcagggct

SEQ ID NO: 223881 - DNA, 14 bp, Homo sapiens
ggcagcctccagag

SEQ ID NO: 223882 - DNA, 16 bp, Homo sapiens
ggcagcctccagagcc

SEQ ID NO: 223883 - DNA, 17 bp, Homo sapiens
ggcagcctccagagcca

SEQ ID NO: 223884 - DNA, 20 bp, Homo sapiens
ggcagcctccagagccagcc

SEQ ID NO: 223885 - DNA, 21 bp, Homo sapiens
ggcagcctccagagccagcct

SEQ ID NO: 223886 - DNA, 11 bp, Homo sapiens
ggcagcctgcc

SEQ ID NO: 223887 - DNA, 14 bp, Homo sapiens
ggcagcctgtggga

SEQ ID NO: 223888 - DNA, 15 bp, Homo sapiens
ggcagcctgtgggag

SEQ ID NO: 223889 - DNA, 16 bp, Homo sapiens
ggcagcctgtgggaga

SEQ ID NO: 223890 - DNA, 17 bp, Homo sapiens
ggcagcctgtgggagaa

SEQ ID NO: 223891 - DNA, 15 bp, Homo sapiens
ggcagcgcctcccgc

SEQ ID NO: 223892 - DNA, 17 bp, Homo sapiens
ggcagcgcctcccgccg

SEQ ID NO: 223893 - DNA, 22 bp, Homo sapiens
ggcagcgcctcccgccgcctcg

SEQ ID NO: 223894 - DNA, 20 bp, Homo sapiens
ggcagctcacccctgggcag

SEQ ID NO: 223895 - DNA, 23 bp, Homo sapiens
ggcagctcatagagtcccccctc

SEQ ID NO: 223896 - DNA, 19 bp, Homo sapiens
ggcagctcctctccttggg

SEQ ID NO: 223897 - DNA, 20 bp, Homo sapiens
ggcagctcttctgggcagag

SEQ ID NO: 223898 - DNA, 21 bp, Homo sapiens
ggcagctcttctgggcagagc

SEQ ID NO: 223899 - DNA, 22 bp, Homo sapiens
ggcagctcttctgggcagagcc

SEQ ID NO: 223900 - DNA, 15 bp, Homo sapiens
ggcagctgccagaga

SEQ ID NO: 223901 - DNA, 12 bp, Homo sapiens
ggcagctgctct

SEQ ID NO: 223902 - DNA, 15 bp, Homo sapiens
ggcagctgctcttag

SEQ ID NO: 223903 - DNA, 16 bp, Homo sapiens
ggcaggaaggagagcc

SEQ ID NO: 223904 - DNA, 15 bp, Homo sapiens
ggcaggaagtccctg

SEQ ID NO: 223905 - DNA, 16 bp, Homo sapiens
ggcaggaagtccctga

SEQ ID NO: 223906 - DNA, 20 bp, Homo sapiens
ggcaggaatcaaggagcctc

SEQ ID NO: 223907 - DNA, 21 bp, Homo sapiens
ggcaggacctcagagtccagg

SEQ ID NO: 223908 - DNA, 19 bp, Homo sapiens
ggcaggacgagactcctcg

SEQ ID NO: 223909 - DNA, 18 bp, Homo sapiens
ggcaggagacactggtct

SEQ ID NO: 223910 - DNA, 15 bp, Homo sapiens
ggcaggagctcagat

SEQ ID NO: 223911 - DNA, 14 bp, Homo sapiens
ggcaggagggccct

SEQ ID NO: 223912 - DNA, 16 bp, Homo sapiens
ggcaggaggtgggtga

SEQ ID NO: 223913 - DNA, 16 bp, Homo sapiens
ggcaggagtggcagct

SEQ ID NO: 223914 - DNA, 13 bp, Homo sapiens
ggcaggccctgca

SEQ ID NO: 223915 - DNA, 14 bp, Homo sapiens
ggcaggcctgggac

SEQ ID NO: 223916 - DNA, 23 bp, Homo sapiens
ggcaggcggtccccatccccacc

SEQ ID NO: 223917 - DNA, 14 bp, Homo sapiens
ggcagggagggctt

SEQ ID NO: 223918 - DNA, 14 bp, Homo sapiens
ggcagggagtgtct

SEQ ID NO: 223919 - DNA, 16 bp, Homo sapiens
ggcagggagtgtctgc

SEQ ID NO: 223920 - DNA, 20 bp, Homo sapiens
ggcagggagtgtctgcagtc

SEQ ID NO: 223921 - DNA, 21 bp, Homo sapiens
ggcagggccgctcgatgcctt

SEQ ID NO: 223922 - DNA, 22 bp, Homo sapiens
ggcagggcggctaggccggcca

SEQ ID NO: 223923 - DNA, 22 bp, Homo sapiens
aattattttgttactgtctgta

SEQ ID NO: 223924 - DNA, 14 bp, Homo sapiens
aattatttttgtgt

SEQ ID NO: 223925 - DNA, 19 bp, Homo sapiens
aattatttttgtgtttcta

SEQ ID NO: 223926 - DNA, 14 bp, Homo sapiens
aattcaaaaagtgt

SEQ ID NO: 223927 - DNA, 15 bp, Homo sapiens
aattcaaaaagtgtt

SEQ ID NO: 223928 - DNA, 14 bp, Homo sapiens
aattcaaagaatca

SEQ ID NO: 223929 - DNA, 15 bp, Homo sapiens
aattcaacaaatgat

SEQ ID NO: 223930 - DNA, 19 bp, Homo sapiens
aattcaacaaatgatgttg

SEQ ID NO: 223931 - DNA, 22 bp, Homo sapiens
aattcaactctgtgtcccagca

SEQ ID NO: 223932 - DNA, 12 bp, Homo sapiens
aattcaagaaaa

SEQ ID NO: 223933 - DNA, 12 bp, Homo sapiens
aattcaatttct

SEQ ID NO: 223934 - DNA, 19 bp, Homo sapiens
aattcaatttctcacaata

SEQ ID NO: 223935 - DNA, 21 bp, Homo sapiens
aattcaatttctcacaataga

SEQ ID NO: 223936 - DNA, 18 bp, Homo sapiens
aattcacaagctgcctcc

SEQ ID NO: 223937 - DNA, 12 bp, Homo sapiens
aattcagcaccc

SEQ ID NO: 223938 - DNA, 14 bp, Homo sapiens
aattcagcaccctg

SEQ ID NO: 223939 - DNA, 17 bp, Homo sapiens
aattcagcaccctgggt

SEQ ID NO: 223940 - DNA, 19 bp, Homo sapiens
aattcagttttagtttcaa

SEQ ID NO: 223941 - DNA, 15 bp, Homo sapiens
aattcatactctgtt

SEQ ID NO: 223942 - DNA, 19 bp, Homo sapiens
aattcatactctgttgcct

SEQ ID NO: 223943 - DNA, 16 bp, Homo sapiens
aattcatataaagtgc

SEQ ID NO: 223944 - DNA, 10 bp, Homo sapiens
aattcattaa

SEQ ID NO: 223945 - DNA, 19 bp, Homo sapiens
aattcattaaaagttttat

SEQ ID NO: 223946 - DNA, 15 bp, Homo sapiens
aattcattaaagaaa

SEQ ID NO: 223947 - DNA, 22 bp, Homo sapiens
aattcattaaatttctggattt

SEQ ID NO: 223948 - DNA, 20 bp, Homo sapiens
aattccagaaaggatattta

SEQ ID NO: 223949 - DNA, 12 bp, Homo sapiens
aattccagagct

SEQ ID NO: 223950 - DNA, 19 bp, Homo sapiens
aattcccattttgcaaaat

SEQ ID NO: 223951 - DNA, 22 bp, Homo sapiens
aattcccattttgcaaaatttc

SEQ ID NO: 223952 - DNA, 20 bp, Homo sapiens
aattcccgggcccttcagtc

SEQ ID NO: 223953 - DNA, 10 bp, Homo sapiens
aattccctat

SEQ ID NO: 223954 - DNA, 23 bp, Homo sapiens
aattccctatcttttagttttag

SEQ ID NO: 223955 - DNA, 20 bp, Homo sapiens
aattcctagataaaaagatg

SEQ ID NO: 223956 - DNA, 13 bp, Homo sapiens
aattcctcatttg

SEQ ID NO: 223957 - DNA, 20 bp, Homo sapiens
aattcctcatttgttcatta

SEQ ID NO: 223958 - DNA, 18 bp, Homo sapiens
aattcctcctgtctcctc

SEQ ID NO: 223959 - DNA, 13 bp, Homo sapiens
aattcctggaata

SEQ ID NO: 223960 - DNA, 18 bp, Homo sapiens
aattcctggcaaacacca

SEQ ID NO: 223961 - DNA, 19 bp, Homo sapiens
aattctaaaagagaaggga

SEQ ID NO: 223962 - DNA, 18 bp, Homo sapiens
aattctaagattgtacat

SEQ ID NO: 223963 - DNA, 16 bp, Homo sapiens
aattctaagttattta

SEQ ID NO: 223964 - DNA, 19 bp, Homo sapiens
aattctaagttatttactt

SEQ ID NO: 223965 - DNA, 14 bp, Homo sapiens
aattctactttgag

SEQ ID NO: 223966 - DNA, 14 bp, Homo sapiens
aattctagatcaga

SEQ ID NO: 223967 - DNA, 17 bp, Homo sapiens
aattctagtctctgatt

SEQ ID NO: 223968 - DNA, 14 bp, Homo sapiens
aattctatactgtt

SEQ ID NO: 223969 - DNA, 13 bp, Homo sapiens
aattctattgaaa

SEQ ID NO: 223970 - DNA, 16 bp, Homo sapiens
aattctctaggaaagt

SEQ ID NO: 223971 - DNA, 22 bp, Homo sapiens
aattctctctaaaaataaaatg

SEQ ID NO: 223972 - DNA, 23 bp, Homo sapiens
aattctctctaaaaataaaatga

SEQ ID NO: 223973 - DNA, 18 bp, Homo sapiens
aattctcttcgctgtgat

SEQ ID NO: 223974 - DNA, 14 bp, Homo sapiens
aattctctttcaaa

SEQ ID NO: 223975 - DNA, 10 bp, Homo sapiens
aattctgaat

SEQ ID NO: 223976 - DNA, 21 bp, Homo sapiens
aattctgatgctaggttgttt

SEQ ID NO: 223977 - DNA, 12 bp, Homo sapiens
aattctgtaaat

SEQ ID NO: 223978 - DNA, 15 bp, Homo sapiens
aattctgtccctgtc

SEQ ID NO: 223979 - DNA, 22 bp, Homo sapiens
aattctgtccctgtccctgccc

SEQ ID NO: 223980 - DNA, 20 bp, Homo sapiens
aattcttacctcatttgcat

SEQ ID NO: 223981 - DNA, 15 bp, Homo sapiens
aattcttccctgggg

SEQ ID NO: 223982 - DNA, 21 bp, Homo sapiens
aattcttgaaggaaaatgata

SEQ ID NO: 223983 - DNA, 13 bp, Homo sapiens
aattcttgcactg

SEQ ID NO: 223984 - DNA, 14 bp, Homo sapiens
aattcttgcactgt

SEQ ID NO: 223985 - DNA, 23 bp, Homo sapiens
aattcttttatctttattttagt

SEQ ID NO: 223986 - DNA, 20 bp, Homo sapiens
aattgaaatttttaaatcat

SEQ ID NO: 223987 - DNA, 16 bp, Homo sapiens
aattgaagtcatcata

SEQ ID NO: 223988 - DNA, 20 bp, Homo sapiens
aattgaagtcatcataaaag

SEQ ID NO: 223989 - DNA, 21 bp, Homo sapiens
aattgaccctagccagagaat

SEQ ID NO: 223990 - DNA, 20 bp, Homo sapiens
aattgacctgatttccattt

SEQ ID NO: 223991 - DNA, 15 bp, Homo sapiens
aattgagagatgttt

SEQ ID NO: 223992 - DNA, 14 bp, Homo sapiens
aattgaggtctgct

SEQ ID NO: 223993 - DNA, 15 bp, Homo sapiens
aattgataataaact

SEQ ID NO: 223994 - DNA, 15 bp, Homo sapiens
aattgatgggtgggc

SEQ ID NO: 223995 - DNA, 21 bp, Homo sapiens
aattgatgggtgggctagtaa

SEQ ID NO: 223996 - DNA, 20 bp, Homo sapiens
aattgatgtatatgtttata

SEQ ID NO: 223997 - DNA, 13 bp, Homo sapiens
aattgatgtgttt

SEQ ID NO: 223998 - DNA, 13 bp, Homo sapiens
aattgattaaact

SEQ ID NO: 223999 - DNA, 13 bp, Homo sapiens
aattgatttccaa

SEQ ID NO: 224000 - DNA, 15 bp, Homo sapiens
aattgcactgctgtt

SEQ ID NO: 224001 - DNA, 15 bp, Homo sapiens
aattgcataaagcat

SEQ ID NO: 224002 - DNA, 17 bp, Homo sapiens
aattgcatgctgcttta

SEQ ID NO: 224003 - DNA, 21 bp, Homo sapiens
aattgcatgctgctttaattg

SEQ ID NO: 224004 - DNA, 22 bp, Homo sapiens
aattgcatgctgctttaattgt

SEQ ID NO: 224005 - DNA, 18 bp, Homo sapiens
aattgcatttttaccttt

SEQ ID NO: 224006 - DNA, 13 bp, Homo sapiens
aattgccctgcca

SEQ ID NO: 224007 - DNA, 13 bp, Homo sapiens
aattgcctccctt

SEQ ID NO: 224008 - DNA, 17 bp, Homo sapiens
aattgcctcccttcctc

SEQ ID NO: 224009 - DNA, 14 bp, Homo sapiens
aattgctcaagttc

SEQ ID NO: 224010 - DNA, 13 bp, Homo sapiens
aattgctgagatg

SEQ ID NO: 224011 - DNA, 20 bp, Homo sapiens
aattgctgagatgtttagta

SEQ ID NO: 224012 - DNA, 17 bp, Homo sapiens
aattgcttaaaagacat

SEQ ID NO: 224013 - DNA, 19 bp, Homo sapiens
aattgcttaaaagacattt

SEQ ID NO: 224014 - DNA, 15 bp, Homo sapiens
aattgcttacatttt

SEQ ID NO: 224015 - DNA, 14 bp, Homo sapiens
aattgcttctctaa

SEQ ID NO: 224016 - DNA, 21 bp, Homo sapiens
aattggctcctttcccacagt

SEQ ID NO: 224017 - DNA, 23 bp, Homo sapiens
aattggcttttgaatcaaagaat

SEQ ID NO: 224018 - DNA, 18 bp, Homo sapiens
aattgggtgtgccctggc

SEQ ID NO: 224019 - DNA, 21 bp, Homo sapiens
aattgggtgtgccctggctcc

SEQ ID NO: 224020 - DNA, 14 bp, Homo sapiens
aattggtcattcct

SEQ ID NO: 224021 - DNA, 18 bp, Homo sapiens
aattggtgataagtggaa

SEQ ID NO: 224022 - DNA, 19 bp, Homo sapiens
aattggtgataagtggaaa

SEQ ID NO: 224023 - DNA, 12 bp, Homo sapiens
aattggtgtata

SEQ ID NO: 224024 - DNA, 13 bp, Homo sapiens
aattggtgtatat

SEQ ID NO: 224025 - DNA, 20 bp, Homo sapiens
aattggtgtatatcatgaag

SEQ ID NO: 224026 - DNA, 18 bp, Homo sapiens
aattgtaaaattgtatag

SEQ ID NO: 224027 - DNA, 21 bp, Homo sapiens
aattgtaaaattgtatagaga

SEQ ID NO: 224028 - DNA, 18 bp, Homo sapiens
aattgtaggggtgtgtgt

SEQ ID NO: 224029 - DNA, 14 bp, Homo sapiens
aattgtatacattt

SEQ ID NO: 224030 - DNA, 21 bp, Homo sapiens
aattgtatacattttgttata

SEQ ID NO: 224031 - DNA, 22 bp, Homo sapiens
aattgtatacattttgttatag

SEQ ID NO: 224032 - DNA, 20 bp, Homo sapiens
aattgtatctagtgcagctg

SEQ ID NO: 224033 - DNA, 18 bp, Homo sapiens
aattgtatgaaaatcctt

SEQ ID NO: 224034 - DNA, 15 bp, Homo sapiens
aattgtcaaatgtca

SEQ ID NO: 224035 - DNA, 20 bp, Homo sapiens
aattgtgaattgataataaa

SEQ ID NO: 224036 - DNA, 18 bp, Homo sapiens
aattgtggagaggagaga

SEQ ID NO: 224037 - DNA, 22 bp, Homo sapiens
aattgtgtacaaagtagagaag

SEQ ID NO: 224038 - DNA, 14 bp, Homo sapiens
aattgtgtctgtgg

SEQ ID NO: 224039 - DNA, 13 bp, Homo sapiens
aattgtgtggtca

SEQ ID NO: 224040 - DNA, 19 bp, Homo sapiens
aattgttgaaactaaagca

SEQ ID NO: 224041 - DNA, 16 bp, Homo sapiens
aattgtttgtctttaa

SEQ ID NO: 224042 - DNA, 17 bp, Homo sapiens
aattgttttgcactttt

SEQ ID NO: 224043 - DNA, 21 bp, Homo sapiens
aattgtttttgaatttaaata

SEQ ID NO: 224044 - DNA, 15 bp, Homo sapiens
aatttaaataaagtt

SEQ ID NO: 224045 - DNA, 16 bp, Homo sapiens
aatttaaatataattc

SEQ ID NO: 224046 - DNA, 19 bp, Homo sapiens
aatttaaatataattctgt

SEQ ID NO: 224047 - DNA, 20 bp, Homo sapiens
aatttaaatataattctgta

SEQ ID NO: 224048 - DNA, 17 bp, Homo sapiens
aatttaaatgctttgtt

SEQ ID NO: 224049 - DNA, 12 bp, Homo sapiens
aatttaactgca

SEQ ID NO: 224050 - DNA, 15 bp, Homo sapiens
aatttaactgcatat

SEQ ID NO: 224051 - DNA, 18 bp, Homo sapiens
aatttaactgcatataga

SEQ ID NO: 224052 - DNA, 20 bp, Homo sapiens
aatttaagcatgagtggcct

SEQ ID NO: 224053 - DNA, 12 bp, Homo sapiens
aatttaagcatt

SEQ ID NO: 224054 - DNA, 19 bp, Homo sapiens
acaaactgaagataatgaa

SEQ ID NO: 224055 - DNA, 15 bp, Homo sapiens
acaaactgtgtaact

SEQ ID NO: 224056 - DNA, 16 bp, Homo sapiens
acaaactgtgtaactg

SEQ ID NO: 224057 - DNA, 12 bp, Homo sapiens
acaaactttgtt

SEQ ID NO: 224058 - DNA, 10 bp, Homo sapiens
acaaagaaaa

SEQ ID NO: 224059 - DNA, 16 bp, Homo sapiens
acaaagaaaatgagaa

SEQ ID NO: 224060 - DNA, 12 bp, Homo sapiens
acaaagaaggaa

SEQ ID NO: 224061 - DNA, 15 bp, Homo sapiens
acaaagaaggaaaag

SEQ ID NO: 224062 - DNA, 17 bp, Homo sapiens
acaaagaaggaaaagag

SEQ ID NO: 224063 - DNA, 15 bp, Homo sapiens
acaaagacagggaat

SEQ ID NO: 224064 - DNA, 16 bp, Homo sapiens
acaaagagaataaaga

SEQ ID NO: 224065 - DNA, 14 bp, Homo sapiens
acaaagatattatt

SEQ ID NO: 224066 - DNA, 15 bp, Homo sapiens
acaaagcaggagtgg

SEQ ID NO: 224067 - DNA, 18 bp, Homo sapiens
acaaagcccttccatgtc

SEQ ID NO: 224068 - DNA, 18 bp, Homo sapiens
acaaagccttaaaatgca

SEQ ID NO: 224069 - DNA, 23 bp, Homo sapiens
acaaagccttatcaagtgtcttc

SEQ ID NO: 224070 - DNA, 21 bp, Homo sapiens
acaaagcgtggtggacatgca

SEQ ID NO: 224071 - DNA, 14 bp, Homo sapiens
acaaagctgtgaaa

SEQ ID NO: 224072 - DNA, 16 bp, Homo sapiens
acaaagctgtgaaatg

SEQ ID NO: 224073 - DNA, 17 bp, Homo sapiens
acaaagctgtgaaatgt

SEQ ID NO: 224074 - DNA, 20 bp, Homo sapiens
acaaagcttctatcccagga

SEQ ID NO: 224075 - DNA, 14 bp, Homo sapiens
acaaaggacaaaaa

SEQ ID NO: 224076 - DNA, 11 bp, Homo sapiens
acaaaggatga

SEQ ID NO: 224077 - DNA, 13 bp, Homo sapiens
acaaaggcccaga

SEQ ID NO: 224078 - DNA, 19 bp, Homo sapiens
acaaaggtgattttcctgt

SEQ ID NO: 224079 - DNA, 14 bp, Homo sapiens
acaaagtgtattca

SEQ ID NO: 224080 - DNA, 18 bp, Homo sapiens
acaaagttacaaattcaa

SEQ ID NO: 224081 - DNA, 13 bp, Homo sapiens
acaaataatcaca

SEQ ID NO: 224082 - DNA, 20 bp, Homo sapiens
acaaatagtgcaactatgaa

SEQ ID NO: 224083 - DNA, 21 bp, Homo sapiens
acaaatatgattctcctctcc

SEQ ID NO: 224084 - DNA, 11 bp, Homo sapiens
acaaatatgca

SEQ ID NO: 224085 - DNA, 12 bp, Homo sapiens
acaaatatgcaa

SEQ ID NO: 224086 - DNA, 15 bp, Homo sapiens
acaaatatttcactt

SEQ ID NO: 224087 - DNA, 20 bp, Homo sapiens
acaaatatttcacttaaact

SEQ ID NO: 224088 - DNA, 17 bp, Homo sapiens
acaaatctaatctctta

SEQ ID NO: 224089 - DNA, 16 bp, Homo sapiens
acaaatgcagacacac

SEQ ID NO: 224090 - DNA, 17 bp, Homo sapiens
acaaatgcagacacaca

SEQ ID NO: 224091 - DNA, 19 bp, Homo sapiens
acaaatgggactgatgtca

SEQ ID NO: 224092 - DNA, 21 bp, Homo sapiens
acaaatgggactgatgtcatc

SEQ ID NO: 224093 - DNA, 22 bp, Homo sapiens
acaaatgggactgatgtcatct

SEQ ID NO: 224094 - DNA, 19 bp, Homo sapiens
acaaatgggggcggctgga

SEQ ID NO: 224095 - DNA, 18 bp, Homo sapiens
acaaatgtgtcccagtga

SEQ ID NO: 224096 - DNA, 14 bp, Homo sapiens
acaacaaaaaataa

SEQ ID NO: 224097 - DNA, 11 bp, Homo sapiens
acaacaaaaat

SEQ ID NO: 224098 - DNA, 23 bp, Homo sapiens
acaacaatttaggaatgctcaat

SEQ ID NO: 224099 - DNA, 23 bp, Homo sapiens
acaacacacacacacacaaaaca

SEQ ID NO: 224100 - DNA, 12 bp, Homo sapiens
acaacaccagga

SEQ ID NO: 224101 - DNA, 14 bp, Homo sapiens
acaacaccaggact

SEQ ID NO: 224102 - DNA, 17 bp, Homo sapiens
acaacactaatacacta

SEQ ID NO: 224103 - DNA, 13 bp, Homo sapiens
acaacagaagctt

SEQ ID NO: 224104 - DNA, 19 bp, Homo sapiens
acaacagaagcttcagaag

SEQ ID NO: 224105 - DNA, 18 bp, Homo sapiens
acaacagagatgccatga

SEQ ID NO: 224106 - DNA, 14 bp, Homo sapiens
ggccagccacacca

SEQ ID NO: 224107 - DNA, 13 bp, Homo sapiens
ggccagccccacc

SEQ ID NO: 224108 - DNA, 15 bp, Homo sapiens
ggccagccccaccca

SEQ ID NO: 224109 - DNA, 16 bp, Homo sapiens
ggccagccccacccag

SEQ ID NO: 224110 - DNA, 12 bp, Homo sapiens
ggccagcccctc

SEQ ID NO: 224111 - DNA, 14 bp, Homo sapiens
ggccagcccctccc

SEQ ID NO: 224112 - DNA, 17 bp, Homo sapiens
ggccagccctccctggc

SEQ ID NO: 224113 - DNA, 16 bp, Homo sapiens
ggccagcctcaccctt

SEQ ID NO: 224114 - DNA, 18 bp, Homo sapiens
ggccagcctcacccttgc

SEQ ID NO: 224115 - DNA, 19 bp, Homo sapiens
ggccagcctggggcctggc

SEQ ID NO: 224116 - DNA, 19 bp, Homo sapiens
ggccagcgagtggtcaagg

SEQ ID NO: 224117 - DNA, 14 bp, Homo sapiens
ggccagctccccct

SEQ ID NO: 224118 - DNA, 14 bp, Homo sapiens
ggccagctcctttt

SEQ ID NO: 224119 - DNA, 18 bp, Homo sapiens
ggccagctccttttctgt

SEQ ID NO: 224120 - DNA, 12 bp, Homo sapiens
ggccagctgccc

SEQ ID NO: 224121 - DNA, 22 bp, Homo sapiens
ggccagcttcgtgctggaggaa

SEQ ID NO: 224122 - DNA, 23 bp, Homo sapiens
ggccaggacagagctgacaaaat

SEQ ID NO: 224123 - DNA, 23 bp, Homo sapiens
ggccaggcaacgtgcgtgtctct

SEQ ID NO: 224124 - DNA, 15 bp, Homo sapiens
ggccaggcagatctg

SEQ ID NO: 224125 - DNA, 22 bp, Homo sapiens
ggccaggcatggcccagcctgg

SEQ ID NO: 224126 - DNA, 13 bp, Homo sapiens
ggccaggccatgg

SEQ ID NO: 224127 - DNA, 19 bp, Homo sapiens
ggccaggccctcctgctgg

SEQ ID NO: 224128 - DNA, 20 bp, Homo sapiens
ggccaggccctcctgctggc

SEQ ID NO: 224129 - DNA, 12 bp, Homo sapiens
ggccagggctct

SEQ ID NO: 224130 - DNA, 16 bp, Homo sapiens
ggccagggctctggca

SEQ ID NO: 224131 - DNA, 17 bp, Homo sapiens
ggccagggctctggcag

SEQ ID NO: 224132 - DNA, 22 bp, Homo sapiens
ggccagggttgcggtcgcggct

SEQ ID NO: 224133 - DNA, 21 bp, Homo sapiens
ggccaggttggaaaagaaatc

SEQ ID NO: 224134 - DNA, 19 bp, Homo sapiens
ggccagtcctgcctggcca

SEQ ID NO: 224135 - DNA, 15 bp, Homo sapiens
ggccagtctgggctg

SEQ ID NO: 224136 - DNA, 16 bp, Homo sapiens
ggccagtctgggctgc

SEQ ID NO: 224137 - DNA, 14 bp, Homo sapiens
ggccagtggacaga

SEQ ID NO: 224138 - DNA, 15 bp, Homo sapiens
ggccagtggacagag

SEQ ID NO: 224139 - DNA, 19 bp, Homo sapiens
ggccatccggcccccagag

SEQ ID NO: 224140 - DNA, 17 bp, Homo sapiens
ggccatcggtcctgtct

SEQ ID NO: 224141 - DNA, 19 bp, Homo sapiens
ggccatctgtaaatatccc

SEQ ID NO: 224142 - DNA, 20 bp, Homo sapiens
ggccatctgtaaatatccca

SEQ ID NO: 224143 - DNA, 15 bp, Homo sapiens
ggccatgaactttgt

SEQ ID NO: 224144 - DNA, 23 bp, Homo sapiens
ggccatgaccactttccccgtgg

SEQ ID NO: 224145 - DNA, 16 bp, Homo sapiens
ggccatgagctccaga

SEQ ID NO: 224146 - DNA, 17 bp, Homo sapiens
ggccatgagctccagac

SEQ ID NO: 224147 - DNA, 18 bp, Homo sapiens
ggccatgagctccagacc

SEQ ID NO: 224148 - DNA, 20 bp, Homo sapiens
ggccatgctcaacccccctc

SEQ ID NO: 224149 - DNA, 18 bp, Homo sapiens
ggccatggaagctggcag

SEQ ID NO: 224150 - DNA, 21 bp, Homo sapiens
ggccatggctttcatcctgtg

SEQ ID NO: 224151 - DNA, 13 bp, Homo sapiens
ggccatgggggcc

SEQ ID NO: 224152 - DNA, 21 bp, Homo sapiens
ggccatgggggcccctcggca

SEQ ID NO: 224153 - DNA, 21 bp, Homo sapiens
ggccatgtgagccaccgctgc

SEQ ID NO: 224154 - DNA, 13 bp, Homo sapiens
ggccattccctgt

SEQ ID NO: 224155 - DNA, 24 bp, Homo sapiens
ggcccaaaggaagtagcaggccca

SEQ ID NO: 224156 - DNA, 17 bp, Homo sapiens
ggcccaaggtcccctcc

SEQ ID NO: 224157 - DNA, 21 bp, Homo sapiens
ggcccaaggtcccctccacat

SEQ ID NO: 224158 - DNA, 21 bp, Homo sapiens
ggcccacattgcccacacctg

SEQ ID NO: 224159 - DNA, 12 bp, Homo sapiens
ggcccacccctc

SEQ ID NO: 224160 - DNA, 15 bp, Homo sapiens
ggcccacgcagagcc

SEQ ID NO: 224161 - DNA, 23 bp, Homo sapiens
ggcccagaggctgagttttctct

SEQ ID NO: 224162 - DNA, 22 bp, Homo sapiens
ggcccagatctggtcccttgca

SEQ ID NO: 224163 - DNA, 20 bp, Homo sapiens
ggcccagcacaactgctgtt

SEQ ID NO: 224164 - DNA, 15 bp, Homo sapiens
ggcccagcagagccg

SEQ ID NO: 224165 - DNA, 11 bp, Homo sapiens
ggcccagcagc

SEQ ID NO: 224166 - DNA, 13 bp, Homo sapiens
ggcccagcagctt

SEQ ID NO: 224167 - DNA, 16 bp, Homo sapiens
ggcccagcagcttggc

SEQ ID NO: 224168 - DNA, 17 bp, Homo sapiens
ggcccagcagcttggct

SEQ ID NO: 224169 - DNA, 18 bp, Homo sapiens
ggcccagcagcttggctg

SEQ ID NO: 224170 - DNA, 22 bp, Homo sapiens
ggcccagcagcttggctgagcc

SEQ ID NO: 224171 - DNA, 13 bp, Homo sapiens
ggcccagcctgga

SEQ ID NO: 224172 - DNA, 15 bp, Homo sapiens
ggcccagcctggagc

SEQ ID NO: 224173 - DNA, 13 bp, Homo sapiens
ggcccagcctggc

SEQ ID NO: 224174 - DNA, 17 bp, Homo sapiens
ggcccagcctggcccca

SEQ ID NO: 224175 - DNA, 16 bp, Homo sapiens
ggcccagcctgtcctg

SEQ ID NO: 224176 - DNA, 13 bp, Homo sapiens
ggcccagccttgt

SEQ ID NO: 224177 - DNA, 13 bp, Homo sapiens
ggcccaggcagca

SEQ ID NO: 224178 - DNA, 11 bp, Homo sapiens
ggcccaggctc

SEQ ID NO: 224179 - DNA, 20 bp, Homo sapiens
ggcccagggagaggccatga

SEQ ID NO: 224180 - DNA, 16 bp, Homo sapiens
ggcccagtagccccaa

SEQ ID NO: 224181 - DNA, 17 bp, Homo sapiens
ggcccagtagccccaat

SEQ ID NO: 224182 - DNA, 22 bp, Homo sapiens
ggcccagtgtcaagttgtgctt

SEQ ID NO: 224183 - DNA, 23 bp, Homo sapiens
ggcccataatagttagccctcag

SEQ ID NO: 224184 - DNA, 15 bp, Homo sapiens
ggcccatctcagcct

SEQ ID NO: 224185 - DNA, 19 bp, Homo sapiens
tgtcatgtaggttgtctaa

SEQ ID NO: 224186 - DNA, 15 bp, Homo sapiens
tgtcatgtgtataaa

SEQ ID NO: 224187 - DNA, 15 bp, Homo sapiens
tgtcattatgtagaa

SEQ ID NO: 224188 - DNA, 23 bp, Homo sapiens
tgtcattcaagcctgtgaataaa

SEQ ID NO: 224189 - DNA, 14 bp, Homo sapiens
tgtcattgtccatg

SEQ ID NO: 224190 - DNA, 18 bp, Homo sapiens
tgtcattgtccatgccta

SEQ ID NO: 224191 - DNA, 11 bp, Homo sapiens
tgtcatttcta

SEQ ID NO: 224192 - DNA, 13 bp, Homo sapiens
tgtcatttgttaa

SEQ ID NO: 224193 - DNA, 16 bp, Homo sapiens
tgtcatttgttaaaat

SEQ ID NO: 224194 - DNA, 22 bp, Homo sapiens
tgtcatttttaatattactgtc

SEQ ID NO: 224195 - DNA, 20 bp, Homo sapiens
tgtccaacaactccaggaaa

SEQ ID NO: 224196 - DNA, 21 bp, Homo sapiens
tgtccaacaactccaggaaaa

SEQ ID NO: 224197 - DNA, 17 bp, Homo sapiens
tgtccaagtgtgtgtgc

SEQ ID NO: 224198 - DNA, 17 bp, Homo sapiens
tgtccaagttcttcacc

SEQ ID NO: 224199 - DNA, 19 bp, Homo sapiens
tgtccaagttcttcacctc

SEQ ID NO: 224200 - DNA, 19 bp, Homo sapiens
tgtccaattccagagctgt

SEQ ID NO: 224201 - DNA, 12 bp, Homo sapiens
tgtccacaaatg

SEQ ID NO: 224202 - DNA, 20 bp, Homo sapiens
tgtccacaaatgtcctcaga

SEQ ID NO: 224203 - DNA, 17 bp, Homo sapiens
tgtccacactaccagtt

SEQ ID NO: 224204 - DNA, 19 bp, Homo sapiens
tgtccacattctacttcag

SEQ ID NO: 224205 - DNA, 20 bp, Homo sapiens
tgtccacccacttagtccac

SEQ ID NO: 224206 - DNA, 21 bp, Homo sapiens
tgtccacccacttagtccact

SEQ ID NO: 224207 - DNA, 21 bp, Homo sapiens
tgtccactctcggggcccttg

SEQ ID NO: 224208 - DNA, 18 bp, Homo sapiens
tgtccagaacaaaagata

SEQ ID NO: 224209 - DNA, 23 bp, Homo sapiens
tgtccagagagagaagtgcccct

SEQ ID NO: 224210 - DNA, 15 bp, Homo sapiens
tgtccagataattgg

SEQ ID NO: 224211 - DNA, 21 bp, Homo sapiens
tgtccagcagctgcgggtctg

SEQ ID NO: 224212 - DNA, 14 bp, Homo sapiens
tgtccagcctgggc

SEQ ID NO: 224213 - DNA, 19 bp, Homo sapiens
tgtccagcctgggcagcca

SEQ ID NO: 224214 - DNA, 17 bp, Homo sapiens
tgtccagctgctgtcag

SEQ ID NO: 224215 - DNA, 18 bp, Homo sapiens
tgtccaggccactgtggc

SEQ ID NO: 224216 - DNA, 15 bp, Homo sapiens
tgtccagggcttcag

SEQ ID NO: 224217 - DNA, 20 bp, Homo sapiens
tgtccaggtctcactgcttt

SEQ ID NO: 224218 - DNA, 17 bp, Homo sapiens
tgtccataagagaaatg

SEQ ID NO: 224219 - DNA, 13 bp, Homo sapiens
tgtccatcagtgc

SEQ ID NO: 224220 - DNA, 18 bp, Homo sapiens
tgtccatgcctacagata

SEQ ID NO: 224221 - DNA, 14 bp, Homo sapiens
tgtccatgtgaaat

SEQ ID NO: 224222 - DNA, 13 bp, Homo sapiens
tgtccatgtgtgt

SEQ ID NO: 224223 - DNA, 15 bp, Homo sapiens
tgtccatgtgtgtgc

SEQ ID NO: 224224 - DNA, 19 bp, Homo sapiens
tgtccattattcaagaaag

SEQ ID NO: 224225 - DNA, 12 bp, Homo sapiens
tgtccatttcaa

SEQ ID NO: 224226 - DNA, 16 bp, Homo sapiens
tgtcccaaggagctga

SEQ ID NO: 224227 - DNA, 12 bp, Homo sapiens
tgtcccacagct

SEQ ID NO: 224228 - DNA, 14 bp, Homo sapiens
tgtcccacagcttg

SEQ ID NO: 224229 - DNA, 17 bp, Homo sapiens
tgtcccacagcttgggg

SEQ ID NO: 224230 - DNA, 23 bp, Homo sapiens
tgtcccaccaactctgcactcca

SEQ ID NO: 224231 - DNA, 12 bp, Homo sapiens
tgtcccacctca

SEQ ID NO: 224232 - DNA, 18 bp, Homo sapiens
tgtcccagcacctggcac

SEQ ID NO: 224233 - DNA, 16 bp, Homo sapiens
tgtcccagcccctggt

SEQ ID NO: 224234 - DNA, 15 bp, Homo sapiens
tgtcccattctagat

SEQ ID NO: 224235 - DNA, 17 bp, Homo sapiens
tgtcccattctagatcc

SEQ ID NO: 224236 - DNA, 18 bp, Homo sapiens
tgtccccaacgtcccctc

SEQ ID NO: 224237 - DNA, 14 bp, Homo sapiens
tgtccccagcccac

SEQ ID NO: 224238 - DNA, 14 bp, Homo sapiens
tgtccccagggccc

SEQ ID NO: 224239 - DNA, 22 bp, Homo sapiens
tgtccccattctataaattcaa

SEQ ID NO: 224240 - DNA, 13 bp, Homo sapiens
tgtcccccaactt

SEQ ID NO: 224241 - DNA, 14 bp, Homo sapiens
tgtcccccaggggc

SEQ ID NO: 224242 - DNA, 18 bp, Homo sapiens
tgtccccctcccctccca

SEQ ID NO: 224243 - DNA, 18 bp, Homo sapiens
tgtccccgccttccctca

SEQ ID NO: 224244 - DNA, 22 bp, Homo sapiens
tgtccccgccttccctcactct

SEQ ID NO: 224245 - DNA, 19 bp, Homo sapiens
tgtcccctccatctgggga

SEQ ID NO: 224246 - DNA, 13 bp, Homo sapiens
tgtcccctctccc

SEQ ID NO: 224247 - DNA, 13 bp, Homo sapiens
tgtcccctctgtc

SEQ ID NO: 224248 - DNA, 17 bp, Homo sapiens
tgtcccctgacctgtcc

SEQ ID NO: 224249 - DNA, 18 bp, Homo sapiens
tgtcccctgacctgtcca

SEQ ID NO: 224250 - DNA, 13 bp, Homo sapiens
tgtcccctgcctg

SEQ ID NO: 224251 - DNA, 15 bp, Homo sapiens
tgtcccctgtcccac

SEQ ID NO: 224252 - DNA, 15 bp, Homo sapiens
tgtccccttccaggg

SEQ ID NO: 224253 - DNA, 15 bp, Homo sapiens
tgtccccttcccctg

SEQ ID NO: 224254 - DNA, 17 bp, Homo sapiens
tgtcccgattgtaactc

SEQ ID NO: 224255 - DNA, 23 bp, Homo sapiens
tgtcccgccttcctcctccacag

SEQ ID NO: 224256 - DNA, 21 bp, Homo sapiens
tgtccctaccactgagccctt

SEQ ID NO: 224257 - DNA, 23 bp, Homo sapiens
tgtccctaccactgagcccttgc

SEQ ID NO: 224258 - DNA, 22 bp, Homo sapiens
tgtccctcctcttcctgtagtg

SEQ ID NO: 224259 - DNA, 14 bp, Homo sapiens
tgtccctcctgagg

SEQ ID NO: 224260 - DNA, 11 bp, Homo sapiens
tgtccctctca

SEQ ID NO: 224261 - DNA, 12 bp, Homo sapiens
tgtccctgcccc

SEQ ID NO: 224262 - DNA, 17 bp, Homo sapiens
tgtccctgccccgcccc

SEQ ID NO: 224263 - DNA, 20 bp, Homo sapiens
tgtccctgccccgcccccca

SEQ ID NO: 224264 - DNA, 23 bp, Homo sapiens
tgtccctgccccgccccccagag

SEQ ID NO: 224265 - DNA, 19 bp, Homo sapiens
tgtccctgtccccctcccc

SEQ ID NO: 224266 - DNA, 17 bp, Homo sapiens
tgtccctgtccctgccc

SEQ ID NO: 224267 - DNA, 20 bp, Homo sapiens
tgtccctgtggtaccctggc

SEQ ID NO: 224268 - DNA, 15 bp, Homo sapiens
tgtcccttacctggc

SEQ ID NO: 224269 - DNA, 15 bp, Homo sapiens
tgtccctttccctac

SEQ ID NO: 224270 - DNA, 17 bp, Homo sapiens
tgtccctttccctacct

SEQ ID NO: 224271 - DNA, 18 bp, Homo sapiens
tgtccctttcttggccag

SEQ ID NO: 224272 - DNA, 22 bp, Homo sapiens
tgtccgagaactaaagccaagg

SEQ ID NO: 224273 - DNA, 13 bp, Homo sapiens
tgtccgccctctt

SEQ ID NO: 224274 - DNA, 13 bp, Homo sapiens
tgtccgcctctgc

SEQ ID NO: 224275 - DNA, 20 bp, Homo sapiens
tgtcctaaggacacactaat

SEQ ID NO: 224276 - DNA, 22 bp, Homo sapiens
tgtcctattactgatgtgtgca

SEQ ID NO: 224277 - DNA, 17 bp, Homo sapiens
tgtcctccagaagcctc

SEQ ID NO: 224278 - DNA, 22 bp, Homo sapiens
tgtcctccagaagcctctggct

SEQ ID NO: 224279 - DNA, 18 bp, Homo sapiens
tgtcctctcagaactcct

SEQ ID NO: 224280 - DNA, 20 bp, Homo sapiens
tgtcctctcagaactcctgt

SEQ ID NO: 224281 - DNA, 23 bp, Homo sapiens
tgtcctcttgctcaaaaatctgt

SEQ ID NO: 224282 - DNA, 22 bp, Homo sapiens
tgtcctctttactcccttcctg

SEQ ID NO: 224283 - DNA, 11 bp, Homo sapiens
tgtcctgactg

SEQ ID NO: 224284 - DNA, 18 bp, Homo sapiens
tgtcctgagccccctgca

SEQ ID NO: 224285 - DNA, 21 bp, Homo sapiens
tgtcctgagccccctgcaccc

SEQ ID NO: 224286 - DNA, 22 bp, Homo sapiens
tgtcctgagccccctgcaccca

SEQ ID NO: 224287 - DNA, 21 bp, Homo sapiens
tgtcctgatggtcagctccct

SEQ ID NO: 224288 - DNA, 14 bp, Homo sapiens
tgtcctgcagagct

SEQ ID NO: 224289 - DNA, 12 bp, Homo sapiens
tgtcctgctcac

SEQ ID NO: 224290 - DNA, 21 bp, Homo sapiens
tgtcctgctcacgtctgtgag

SEQ ID NO: 224291 - DNA, 16 bp, Homo sapiens
tgtcctgggcgccctg

SEQ ID NO: 224292 - DNA, 18 bp, Homo sapiens
tgtcctgggcgccctgga

SEQ ID NO: 224293 - DNA, 15 bp, Homo sapiens
tgtcctggtacagca

SEQ ID NO: 224294 - DNA, 19 bp, Homo sapiens
tgtcctggtacagcagggt

SEQ ID NO: 224295 - DNA, 20 bp, Homo sapiens
tgtcctgtaaacactcagct

SEQ ID NO: 224296 - DNA, 16 bp, Homo sapiens
tgtcctgtacattgtg

SEQ ID NO: 224297 - DNA, 20 bp, Homo sapiens
tgtcctgtagaggttttgtt

SEQ ID NO: 224298 - DNA, 12 bp, Homo sapiens
tgtcctgtgtca

SEQ ID NO: 224299 - DNA, 17 bp, Homo sapiens
tgtcctgtgtcatctgt

SEQ ID NO: 224300 - DNA, 19 bp, Homo sapiens
tgtcctgtgtcatctgtca

SEQ ID NO: 224301 - DNA, 23 bp, Homo sapiens
tgtccttagactccttctcccca

SEQ ID NO: 224302 - DNA, 17 bp, Homo sapiens
tgtcctttcaaggggaa

SEQ ID NO: 224303 - DNA, 13 bp, Homo sapiens
tgtcctttccctc

SEQ ID NO: 224304 - DNA, 12 bp, Homo sapiens
tgtcctttctcc

SEQ ID NO: 224305 - DNA, 14 bp, Homo sapiens
tgtcctttgagaaa

SEQ ID NO: 224306 - DNA, 14 bp, Homo sapiens
tgtcgcccaggctg

SEQ ID NO: 224307 - DNA, 19 bp, Homo sapiens
tgtcgccgtccctctgcct

SEQ ID NO: 224308 - DNA, 13 bp, Homo sapiens
tgtcgcctctgca

SEQ ID NO: 224309 - DNA, 14 bp, Homo sapiens
tgtcgcctctgcat

SEQ ID NO: 224310 - DNA, 20 bp, Homo sapiens
tgtcggagaggctgtctggg

SEQ ID NO: 224311 - DNA, 17 bp, Homo sapiens
tgtcggagtagaaattg

SEQ ID NO: 224312 - DNA, 21 bp, Homo sapiens
tgtcgggcaagatagctcctt

SEQ ID NO: 224313 - DNA, 14 bp, Homo sapiens
tgtcgttcccttgt

SEQ ID NO: 224314 - DNA, 18 bp, Homo sapiens
tgtcgtttcattcatttt

SEQ ID NO: 224315 - DNA, 22 bp, Homo sapiens
tgtgaagatgatatactatttt

SEQ ID NO: 224316 - DNA, 19 bp, Homo sapiens
tgtgaagcatgctttgctg

SEQ ID NO: 224317 - DNA, 21 bp, Homo sapiens
tgtgaagcctgtcgtgttctc

SEQ ID NO: 224318 - DNA, 16 bp, Homo sapiens
tgtgaagcctttatct

SEQ ID NO: 224319 - DNA, 13 bp, Homo sapiens
tgtgaaggcccaa

SEQ ID NO: 224320 - DNA, 11 bp, Homo sapiens
tgtgaatacaa

SEQ ID NO: 224321 - DNA, 15 bp, Homo sapiens
tgtgaatacaattaa

SEQ ID NO: 224322 - DNA, 17 bp, Homo sapiens
tgtgaatacaattaaag

SEQ ID NO: 224323 - DNA, 22 bp, Homo sapiens
tgtgaatgctgtacctttctga

SEQ ID NO: 224324 - DNA, 21 bp, Homo sapiens
tgtgaatgttgtgatgtattc

SEQ ID NO: 224325 - DNA, 20 bp, Homo sapiens
tgtgaattgaagtcatcata

SEQ ID NO: 224326 - DNA, 21 bp, Homo sapiens
tgtgaattgaagtcatcataa

SEQ ID NO: 224327 - DNA, 17 bp, Homo sapiens
tgtgacaacctttgtgt

SEQ ID NO: 224328 - DNA, 19 bp, Homo sapiens
tgtgacaactgtctaactt

SEQ ID NO: 224329 - DNA, 19 bp, Homo sapiens
tgtgacaataagtttgaac

SEQ ID NO: 224330 - DNA, 19 bp, Homo sapiens
tgtgacatctacctcccga

SEQ ID NO: 224331 - DNA, 19 bp, Homo sapiens
tgtgaccaccttctgtccc

SEQ ID NO: 224332 - DNA, 15 bp, Homo sapiens
tgtgaccctctcact

SEQ ID NO: 224333 - DNA, 22 bp, Homo sapiens
tgtgactagtgctgaagcttat

SEQ ID NO: 224334 - DNA, 23 bp, Homo sapiens
tgtgactagtgctgaagcttatt

SEQ ID NO: 224335 - DNA, 22 bp, Homo sapiens
tgtgactatatagagatgtttt

SEQ ID NO: 224336 - DNA, 20 bp, Homo sapiens
tgtgactcgcttagctgaaa

SEQ ID NO: 224337 - DNA, 19 bp, Homo sapiens
tgtgactgagggcctggtc

SEQ ID NO: 224338 - DNA, 20 bp, Homo sapiens
tgtgactgatgttaggctgg

SEQ ID NO: 224339 - DNA, 23 bp, Homo sapiens
tgtgactgatgttaggctgggcc

SEQ ID NO: 224340 - DNA, 12 bp, Homo sapiens
tgtgactggcac

SEQ ID NO: 224341 - DNA, 14 bp, Homo sapiens
tgtgacttctctct

SEQ ID NO: 224342 - DNA, 14 bp, Homo sapiens
tgtgagaaaacgtt

SEQ ID NO: 224343 - DNA, 12 bp, Homo sapiens
tgtgagaacttt

SEQ ID NO: 224344 - DNA, 13 bp, Homo sapiens
tgtgagacagcaa

SEQ ID NO: 224345 - DNA, 16 bp, Homo sapiens
tgtgagacccccacac

SEQ ID NO: 224346 - DNA, 20 bp, Homo sapiens
tgtgagcaaaaatgccaggc

SEQ ID NO: 224347 - DNA, 19 bp, Homo sapiens
tgtgagcacaaaggtagct

SEQ ID NO: 224348 - DNA, 18 bp, Homo sapiens
tgtgagcatccttcccag

SEQ ID NO: 224349 - DNA, 14 bp, Homo sapiens
tgtgagcgagcaag

SEQ ID NO: 224350 - DNA, 15 bp, Homo sapiens
tgtgagcgagcaagc

SEQ ID NO: 224351 - DNA, 20 bp, Homo sapiens
tgtgagcgagcctggcaggt

SEQ ID NO: 224352 - DNA, 17 bp, Homo sapiens
tgtgaggacagacagaa

SEQ ID NO: 224353 - DNA, 13 bp, Homo sapiens
tgtgaggagctgc

SEQ ID NO: 224354 - DNA, 18 bp, Homo sapiens
tgtgaggagctgctggct

SEQ ID NO: 224355 - DNA, 19 bp, Homo sapiens
tgtgaggatgtggatggag

SEQ ID NO: 224356 - DNA, 23 bp, Homo sapiens
tgtgaggcccatggttgagaaat

SEQ ID NO: 224357 - DNA, 15 bp, Homo sapiens
tgtgagggagtgcag

SEQ ID NO: 224358 - DNA, 18 bp, Homo sapiens
tgtgagggagtgcagaac

SEQ ID NO: 224359 - DNA, 16 bp, Homo sapiens
tgtgaggtgaatgtct

SEQ ID NO: 224360 - DNA, 17 bp, Homo sapiens
tgtgaggtgataggcaa

SEQ ID NO: 224361 - DNA, 16 bp, Homo sapiens
tgtgaggtttcacctc

SEQ ID NO: 224362 - DNA, 19 bp, Homo sapiens
tgtgagtaagagctggtgt

SEQ ID NO: 224363 - DNA, 14 bp, Homo sapiens
tgtgagtctgtcct

SEQ ID NO: 224364 - DNA, 18 bp, Homo sapiens
tgtgagtggcagccatgc

SEQ ID NO: 224365 - DNA, 20 bp, Homo sapiens
tgtgagtggcagccatgcct

SEQ ID NO: 224366 - DNA, 22 bp, Homo sapiens
tgtgagtgggaggagagggcag

SEQ ID NO: 224367 - DNA, 20 bp, Homo sapiens
tgtgagtgtgtccaagtgtg

SEQ ID NO: 224368 - DNA, 22 bp, Homo sapiens
tgtgagtgtgtgtttgtgctga

SEQ ID NO: 224369 - DNA, 22 bp, Homo sapiens
tgtgatacccatagcttccatg

SEQ ID NO: 224370 - DNA, 17 bp, Homo sapiens
tgtgatatctgaacaca

SEQ ID NO: 224371 - DNA, 15 bp, Homo sapiens
tgtgatatggagccc

SEQ ID NO: 224372 - DNA, 15 bp, Homo sapiens
tgtgatatgtgtaat

SEQ ID NO: 224373 - DNA, 21 bp, Homo sapiens
tgtgatatgtgtaatatcatt

SEQ ID NO: 224374 - DNA, 23 bp, Homo sapiens
tgtgatctattactctgacataa

SEQ ID NO: 224375 - DNA, 16 bp, Homo sapiens
tgtgatgatagcactg

SEQ ID NO: 224376 - DNA, 15 bp, Homo sapiens
tgtgatgccacacag

SEQ ID NO: 224377 - DNA, 17 bp, Homo sapiens
tgtgatgccacacagag

SEQ ID NO: 224378 - DNA, 14 bp, Homo sapiens
tgtgatgtattcta

SEQ ID NO: 224379 - DNA, 17 bp, Homo sapiens
tgtgattccccggagct

SEQ ID NO: 224380 - DNA, 19 bp, Homo sapiens
tgtgattccccggagctgg

SEQ ID NO: 224381 - DNA, 20 bp, Homo sapiens
tgtgattccccggagctggg

SEQ ID NO: 224382 - DNA, 21 bp, Homo sapiens
tgtgattctaatgtcttcatt

SEQ ID NO: 224383 - DNA, 19 bp, Homo sapiens
tgtgattggcagcttcaaa

SEQ ID NO: 224384 - DNA, 23 bp, Homo sapiens
tgtgattggcagcttcaaaacag

SEQ ID NO: 224385 - DNA, 17 bp, Homo sapiens
tgtgatttagaactgta

SEQ ID NO: 224386 - DNA, 12 bp, Homo sapiens
tgtgatttccat

SEQ ID NO: 224387 - DNA, 13 bp, Homo sapiens
tgtgatttccatt

SEQ ID NO: 224388 - DNA, 19 bp, Homo sapiens
acaccaccccttgcccaac

SEQ ID NO: 224389 - DNA, 18 bp, Homo sapiens
acaccacctcactcctgt

SEQ ID NO: 224390 - DNA, 15 bp, Homo sapiens
acaccacttaatctt

SEQ ID NO: 224391 - DNA, 20 bp, Homo sapiens
acaccacttaatcttctctc

SEQ ID NO: 224392 - DNA, 12 bp, Homo sapiens
acaccaggactt

SEQ ID NO: 224393 - DNA, 12 bp, Homo sapiens
acaccaggccgt

SEQ ID NO: 224394 - DNA, 22 bp, Homo sapiens
acaccaggccgtcctcccgggc

SEQ ID NO: 224395 - DNA, 14 bp, Homo sapiens
acaccaggctgtgg

SEQ ID NO: 224396 - DNA, 15 bp, Homo sapiens
acaccagttactgtt

SEQ ID NO: 224397 - DNA, 17 bp, Homo sapiens
acaccagttactgttca

SEQ ID NO: 224398 - DNA, 20 bp, Homo sapiens
acaccagttactgttcatgg

SEQ ID NO: 224399 - DNA, 14 bp, Homo sapiens
acaccatagtttac

SEQ ID NO: 224400 - DNA, 15 bp, Homo sapiens
acacccaagtccacc

SEQ ID NO: 224401 - DNA, 16 bp, Homo sapiens
acacccaagtccaggc

SEQ ID NO: 224402 - DNA, 12 bp, Homo sapiens
acacccatgcac

SEQ ID NO: 224403 - DNA, 19 bp, Homo sapiens
acaccccatctctcttccc

SEQ ID NO: 224404 - DNA, 19 bp, Homo sapiens
acaccccctttccatctgt

SEQ ID NO: 224405 - DNA, 16 bp, Homo sapiens
acaccccgtctgcccc

SEQ ID NO: 224406 - DNA, 17 bp, Homo sapiens
acaccccgtctgcccct

SEQ ID NO: 224407 - DNA, 14 bp, Homo sapiens
acacccctcagcgc

SEQ ID NO: 224408 - DNA, 21 bp, Homo sapiens
acacccgacaccagccctgct

SEQ ID NO: 224409 - DNA, 21 bp, Homo sapiens
acaccctaactcttgctcact

SEQ ID NO: 224410 - DNA, 24 bp, Homo sapiens
acaccctaactcttgctcactccc

SEQ ID NO: 224411 - DNA, 17 bp, Homo sapiens
acaccctcactctgcca

SEQ ID NO: 224412 - DNA, 19 bp, Homo sapiens
acaccctcactctgccagg

SEQ ID NO: 224413 - DNA, 11 bp, Homo sapiens
acaccctgcaa

SEQ ID NO: 224414 - DNA, 23 bp, Homo sapiens
acaccctgcaaggcccacaggag

SEQ ID NO: 224415 - DNA, 20 bp, Homo sapiens
acacccttcacataccctcc

SEQ ID NO: 224416 - DNA, 13 bp, Homo sapiens
acacccttcccca

SEQ ID NO: 224417 - DNA, 21 bp, Homo sapiens
acacctaaaaccagttttgct

SEQ ID NO: 224418 - DNA, 20 bp, Homo sapiens
acacctaagtgactaccact

SEQ ID NO: 224419 - DNA, 16 bp, Homo sapiens
acacctaccatgctgc

SEQ ID NO: 224420 - DNA, 14 bp, Homo sapiens
acacctagatcaga

SEQ ID NO: 224421 - DNA, 18 bp, Homo sapiens
acacctcagagccccgca

SEQ ID NO: 224422 - DNA, 18 bp, Homo sapiens
acacctcagttcccttgg

SEQ ID NO: 224423 - DNA, 23 bp, Homo sapiens
acacctcagttcccttggcctca

SEQ ID NO: 224424 - DNA, 12 bp, Homo sapiens
acacctccaccc

SEQ ID NO: 224425 - DNA, 13 bp, Homo sapiens
acacctccacccg

SEQ ID NO: 224426 - DNA, 20 bp, Homo sapiens
acacctcccaccccctgtat

SEQ ID NO: 224427 - DNA, 15 bp, Homo sapiens
acacctcctagcaag

SEQ ID NO: 224428 - DNA, 15 bp, Homo sapiens
acacctgagctggtg

SEQ ID NO: 224429 - DNA, 15 bp, Homo sapiens
acacctgccctgccc

SEQ ID NO: 224430 - DNA, 17 bp, Homo sapiens
acacctgccctgccctg

SEQ ID NO: 224431 - DNA, 20 bp, Homo sapiens
acacctgccctgccctgcca

SEQ ID NO: 224432 - DNA, 22 bp, Homo sapiens
acacctgccctgccctgccacc

SEQ ID NO: 224433 - DNA, 15 bp, Homo sapiens
acacctggccgggtc

SEQ ID NO: 224434 - DNA, 20 bp, Homo sapiens
acacctggccgggtcaccct

SEQ ID NO: 224435 - DNA, 16 bp, Homo sapiens
acacctgggcccgggc

SEQ ID NO: 224436 - DNA, 21 bp, Homo sapiens
acacctggtctgttttctgtg

SEQ ID NO: 224437 - DNA, 17 bp, Homo sapiens
acacctgttgcacctca

SEQ ID NO: 224438 - DNA, 18 bp, Homo sapiens
acacgagcgaatgattta

SEQ ID NO: 224439 - DNA, 21 bp, Homo sapiens
acacgcaagggcatcaggcac

SEQ ID NO: 224440 - DNA, 14 bp, Homo sapiens
acacgcacgcacac

SEQ ID NO: 224441 - DNA, 17 bp, Homo sapiens
acacgcacgcacacaca

SEQ ID NO: 224442 - DNA, 18 bp, Homo sapiens
acacgcacgcacacacac

SEQ ID NO: 224443 - DNA, 12 bp, Homo sapiens
acacgcagacac

SEQ ID NO: 224444 - DNA, 20 bp, Homo sapiens
acacgccggggctggccctg

SEQ ID NO: 224445 - DNA, 15 bp, Homo sapiens
ggcccttgtcctgcc

SEQ ID NO: 224446 - DNA, 16 bp, Homo sapiens
ggcccttgtcctgcca

SEQ ID NO: 224447 - DNA, 18 bp, Homo sapiens
ggcccttgtcctgccagc

SEQ ID NO: 224448 - DNA, 22 bp, Homo sapiens
ggcccttgtcctgccagctgcc

SEQ ID NO: 224449 - DNA, 16 bp, Homo sapiens
ggcccttttctggctc

SEQ ID NO: 224450 - DNA, 19 bp, Homo sapiens
ggcccttttctggctcctg

SEQ ID NO: 224451 - DNA, 14 bp, Homo sapiens
ggccgaacccccca

SEQ ID NO: 224452 - DNA, 15 bp, Homo sapiens
ggccgaggcacgaga

SEQ ID NO: 224453 - DNA, 18 bp, Homo sapiens
ggccgagggtcctggctc

SEQ ID NO: 224454 - DNA, 16 bp, Homo sapiens
ggccgagtccaggagc

SEQ ID NO: 224455 - DNA, 14 bp, Homo sapiens
ggccgatgagctgg

SEQ ID NO: 224456 - DNA, 12 bp, Homo sapiens
ggccgcagggcg

SEQ ID NO: 224457 - DNA, 14 bp, Homo sapiens
ggccgcagggcgct

SEQ ID NO: 224458 - DNA, 16 bp, Homo sapiens
ggccgcatggcccctc

SEQ ID NO: 224459 - DNA, 22 bp, Homo sapiens
ggccgcatggcccctccaggaa

SEQ ID NO: 224460 - DNA, 19 bp, Homo sapiens
ggccgcatgtctgcatggc

SEQ ID NO: 224461 - DNA, 14 bp, Homo sapiens
ggccgcccacctgc

SEQ ID NO: 224462 - DNA, 18 bp, Homo sapiens
ggccgccccagcctctga

SEQ ID NO: 224463 - DNA, 18 bp, Homo sapiens
ggccgccccgccccagag

SEQ ID NO: 224464 - DNA, 20 bp, Homo sapiens
ggccgccccgccccagagct

SEQ ID NO: 224465 - DNA, 21 bp, Homo sapiens
ggccgcccgggcccagaggag

SEQ ID NO: 224466 - DNA, 15 bp, Homo sapiens
ggccgcctcctccag

SEQ ID NO: 224467 - DNA, 16 bp, Homo sapiens
ggccgcctcctccaga

SEQ ID NO: 224468 - DNA, 17 bp, Homo sapiens
ggccgcctgcgggctgc

SEQ ID NO: 224469 - DNA, 13 bp, Homo sapiens
ggccgcctggcag

SEQ ID NO: 224470 - DNA, 16 bp, Homo sapiens
ggccgcctggcaggtg

SEQ ID NO: 224471 - DNA, 13 bp, Homo sapiens
ggccgcctgtcct

SEQ ID NO: 224472 - DNA, 14 bp, Homo sapiens
ggccgctagaggcc

SEQ ID NO: 224473 - DNA, 19 bp, Homo sapiens
ggccgctagaggcctgagg

SEQ ID NO: 224474 - DNA, 21 bp, Homo sapiens
ggccgctagaggcctgaggat

SEQ ID NO: 224475 - DNA, 22 bp, Homo sapiens
ggccgctgggagaaaagccaga

SEQ ID NO: 224476 - DNA, 18 bp, Homo sapiens
ggccgcttccctacccac

SEQ ID NO: 224477 - DNA, 18 bp, Homo sapiens
ggccggccagctccccct

SEQ ID NO: 224478 - DNA, 12 bp, Homo sapiens
ggccggcctggg

SEQ ID NO: 224479 - DNA, 14 bp, Homo sapiens
ggccggcctggggc

SEQ ID NO: 224480 - DNA, 22 bp, Homo sapiens
ggccggctggccggtccacccc

SEQ ID NO: 224481 - DNA, 20 bp, Homo sapiens
ggccgggccctctgtagctc

SEQ ID NO: 224482 - DNA, 21 bp, Homo sapiens
ggccgggctggcttctccctg

SEQ ID NO: 224483 - DNA, 18 bp, Homo sapiens
ggccgggctttccagaag

SEQ ID NO: 224484 - DNA, 23 bp, Homo sapiens
ggccgggggtgggggcctgctgt

SEQ ID NO: 224485 - DNA, 19 bp, Homo sapiens
ggccgggtcaccctgtgac

SEQ ID NO: 224486 - DNA, 19 bp, Homo sapiens
ggccgtccctgacttccca

SEQ ID NO: 224487 - DNA, 18 bp, Homo sapiens
ggccgtcctcccgggccc

SEQ ID NO: 224488 - DNA, 20 bp, Homo sapiens
ggccgtcctcccgggccctc

SEQ ID NO: 224489 - DNA, 13 bp, Homo sapiens
ggccgtctcctcc

SEQ ID NO: 224490 - DNA, 15 bp, Homo sapiens
ggccgtctcctccct

SEQ ID NO: 224491 - DNA, 17 bp, Homo sapiens
ggccgtctcctccctca

SEQ ID NO: 224492 - DNA, 20 bp, Homo sapiens
ggccgtcttcactcgccccc

SEQ ID NO: 224493 - DNA, 17 bp, Homo sapiens
ggccgttccccttggct

SEQ ID NO: 224494 - DNA, 14 bp, Homo sapiens
ggcctaaacttcag

SEQ ID NO: 224495 - DNA, 24 bp, Homo sapiens
ggcctactagagtctgaacagctg

SEQ ID NO: 224496 - DNA, 22 bp, Homo sapiens
ggcctagcccaccctgctgcct

SEQ ID NO: 224497 - DNA, 16 bp, Homo sapiens
ggcctagtcagatgga

SEQ ID NO: 224498 - DNA, 15 bp, Homo sapiens
ggcctcaaccctccc

SEQ ID NO: 224499 - DNA, 21 bp, Homo sapiens
ggcctcaaccctccctcagcc

SEQ ID NO: 224500 - DNA, 21 bp, Homo sapiens
ggcctcaagcaaggaagcaga

SEQ ID NO: 224501 - DNA, 21 bp, Homo sapiens
ggcctcaagccatcttcccgc

SEQ ID NO: 224502 - DNA, 15 bp, Homo sapiens
ggcctcaaggacttg

SEQ ID NO: 224503 - DNA, 12 bp, Homo sapiens
ggcctcacccag

SEQ ID NO: 224504 - DNA, 15 bp, Homo sapiens
ggcctcacccagaag

SEQ ID NO: 224505 - DNA, 13 bp, Homo sapiens
ggcctcaccctgc

SEQ ID NO: 224506 - DNA, 14 bp, Homo sapiens
ggcctcaccctgct

SEQ ID NO: 224507 - DNA, 14 bp, Homo sapiens
ggcctcacctggct

SEQ ID NO: 224508 - DNA, 23 bp, Homo sapiens
ggcctcactggctggggcagagg

SEQ ID NO: 224509 - DNA, 16 bp, Homo sapiens
ggcctcagccagctgc

SEQ ID NO: 224510 - DNA, 17 bp, Homo sapiens
ggcctcagccagctgcc

SEQ ID NO: 224511 - DNA, 22 bp, Homo sapiens
ggcctcagctgcctcacttcct

SEQ ID NO: 224512 - DNA, 20 bp, Homo sapiens
ggcctcagtttctccatcag

SEQ ID NO: 224513 - DNA, 21 bp, Homo sapiens
ggcctccactcccccacctga

SEQ ID NO: 224514 - DNA, 23 bp, Homo sapiens
ggcctccactcccccacctgaca

SEQ ID NO: 224515 - DNA, 20 bp, Homo sapiens
ggcctccagccctctcactg

SEQ ID NO: 224516 - DNA, 13 bp, Homo sapiens
ggcctccagcctc

SEQ ID NO: 224517 - DNA, 16 bp, Homo sapiens
ggcctccagcctctcc

SEQ ID NO: 224518 - DNA, 16 bp, Homo sapiens
ggcctccaggctgggg

SEQ ID NO: 224519 - DNA, 17 bp, Homo sapiens
ggcctccaggctggggc

SEQ ID NO: 224520 - DNA, 19 bp, Homo sapiens
ggcctccaggctggggcct

SEQ ID NO: 224521 - DNA, 17 bp, Homo sapiens
ggcctcccaataaagct

SEQ ID NO: 224522 - DNA, 21 bp, Homo sapiens
ggcctcccaataaagctggac

SEQ ID NO: 224523 - DNA, 14 bp, Homo sapiens
ggcctcccagccac

SEQ ID NO: 224524 - DNA, 15 bp, Homo sapiens
ggcctcccagccacc

SEQ ID NO: 224525 - DNA, 18 bp, Homo sapiens
ggcctcccatagtgctgg

SEQ ID NO: 224526 - DNA, 11 bp, Homo sapiens
ggcctccccca

SEQ ID NO: 224527 - DNA, 10 bp, Homo sapiens
ggcctccccg

SEQ ID NO: 224528 - DNA, 12 bp, Homo sapiens
ggcctcccctgc

SEQ ID NO: 224529 - DNA, 15 bp, Homo sapiens
tgtggccgaggactt

SEQ ID NO: 224530 - DNA, 16 bp, Homo sapiens
tgtggccgaggacttt

SEQ ID NO: 224531 - DNA, 16 bp, Homo sapiens
tgtggccgtctcctcc

SEQ ID NO: 224532 - DNA, 14 bp, Homo sapiens
tgtggcctctcagt

SEQ ID NO: 224533 - DNA, 21 bp, Homo sapiens
tgtggcctgtgtccagcagct

SEQ ID NO: 224534 - DNA, 22 bp, Homo sapiens
tgtggcctgtgtccagcagctg

SEQ ID NO: 224535 - DNA, 23 bp, Homo sapiens
tgtggcctgtgtccagcagctgc

SEQ ID NO: 224536 - DNA, 10 bp, Homo sapiens
tgtggctcac

SEQ ID NO: 224537 - DNA, 17 bp, Homo sapiens
tgtggctcctatctgtg

SEQ ID NO: 224538 - DNA, 18 bp, Homo sapiens
tgtggctcctatctgtgt

SEQ ID NO: 224539 - DNA, 20 bp, Homo sapiens
tgtggctcctatctgtgttt

SEQ ID NO: 224540 - DNA, 15 bp, Homo sapiens
tgtggctgggggcag

SEQ ID NO: 224541 - DNA, 18 bp, Homo sapiens
tgtggctgggggcaggag

SEQ ID NO: 224542 - DNA, 17 bp, Homo sapiens
tgtggctgggtggtcag

SEQ ID NO: 224543 - DNA, 12 bp, Homo sapiens
tgtggctggtgt

SEQ ID NO: 224544 - DNA, 13 bp, Homo sapiens
tgtggctggtgtc

SEQ ID NO: 224545 - DNA, 16 bp, Homo sapiens
tgtggctggtgtcccc

SEQ ID NO: 224546 - DNA, 19 bp, Homo sapiens
tgtggcttgctagctatgt

SEQ ID NO: 224547 - DNA, 17 bp, Homo sapiens
tgtgggactagcctggc

SEQ ID NO: 224548 - DNA, 22 bp, Homo sapiens
tgtgggactccaggccagctcc

SEQ ID NO: 224549 - DNA, 16 bp, Homo sapiens
tgtgggactggcccac

SEQ ID NO: 224550 - DNA, 14 bp, Homo sapiens
tgtgggagtccact

SEQ ID NO: 224551 - DNA, 22 bp, Homo sapiens
tgtgggatacttagtggtatgt

SEQ ID NO: 224552 - DNA, 13 bp, Homo sapiens
tgtgggattatgg

SEQ ID NO: 224553 - DNA, 16 bp, Homo sapiens
tgtggggatttctccc

SEQ ID NO: 224554 - DNA, 14 bp, Homo sapiens
tgtggggcaagcct

SEQ ID NO: 224555 - DNA, 15 bp, Homo sapiens
tgtggggcaagcctg

SEQ ID NO: 224556 - DNA, 13 bp, Homo sapiens
tgtggggccacac

SEQ ID NO: 224557 - DNA, 18 bp, Homo sapiens
tgtgggggctagaaaaaa

SEQ ID NO: 224558 - DNA, 18 bp, Homo sapiens
tgtgggggtctgggaggc

SEQ ID NO: 224559 - DNA, 21 bp, Homo sapiens
tgtgggtacagagaggtcaag

SEQ ID NO: 224560 - DNA, 16 bp, Homo sapiens
tgtgggtcagtgtgcc

SEQ ID NO: 224561 - DNA, 15 bp, Homo sapiens
tgtgggtccccactc

SEQ ID NO: 224562 - DNA, 15 bp, Homo sapiens
tgtgggttgtgatat

SEQ ID NO: 224563 - DNA, 18 bp, Homo sapiens
tgtgggttgtgatattga

SEQ ID NO: 224564 - DNA, 16 bp, Homo sapiens
tgtggtaccctggcag

SEQ ID NO: 224565 - DNA, 18 bp, Homo sapiens
tgtggtaccctggcagag

SEQ ID NO: 224566 - DNA, 19 bp, Homo sapiens
tgtggtaccctggcagaga

SEQ ID NO: 224567 - DNA, 16 bp, Homo sapiens
tgtggtgcagtaacca

SEQ ID NO: 224568 - DNA, 21 bp, Homo sapiens
tgtggttacagtgcagacagg

SEQ ID NO: 224569 - DNA, 18 bp, Homo sapiens
tgtggttctattttactt

SEQ ID NO: 224570 - DNA, 15 bp, Homo sapiens
tgtggttgcagcctg

SEQ ID NO: 224571 - DNA, 22 bp, Homo sapiens
tgtggtttgcattgtctccttc

SEQ ID NO: 224572 - DNA, 12 bp, Homo sapiens
tgtggtttgttg

SEQ ID NO: 224573 - DNA, 18 bp, Homo sapiens
tgtggttttcccctccct

SEQ ID NO: 224574 - DNA, 21 bp, Homo sapiens
tgtggttttcttttgccatga

SEQ ID NO: 224575 - DNA, 13 bp, Homo sapiens
tgtgtaaaggaac

SEQ ID NO: 224576 - DNA, 18 bp, Homo sapiens
tgttagtgacagagccca

SEQ ID NO: 224577 - DNA, 13 bp, Homo sapiens
tgttagtgggaag

SEQ ID NO: 224578 - DNA, 14 bp, Homo sapiens
tgttataaaatctg

SEQ ID NO: 224579 - DNA, 13 bp, Homo sapiens
tgttataaataaa

SEQ ID NO: 224580 - DNA, 18 bp, Homo sapiens
tgttataactctgcacta

SEQ ID NO: 224581 - DNA, 15 bp, Homo sapiens
tgttatacattttta

SEQ ID NO: 224582 - DNA, 13 bp, Homo sapiens
tgttatacttcaa

SEQ ID NO: 224583 - DNA, 15 bp, Homo sapiens
tgttatatcagcaga

SEQ ID NO: 224584 - DNA, 22 bp, Homo sapiens
tgttatcctgctagctgtagaa

SEQ ID NO: 224585 - DNA, 12 bp, Homo sapiens
tgttatctgtct

SEQ ID NO: 224586 - DNA, 20 bp, Homo sapiens
tgttatctgtctttatgatt

SEQ ID NO: 224587 - DNA, 19 bp, Homo sapiens
tgttatcttgtgtatggat

SEQ ID NO: 224588 - DNA, 13 bp, Homo sapiens
tgttatgaacatg

SEQ ID NO: 224589 - DNA, 13 bp, Homo sapiens
tgttatgactcct

SEQ ID NO: 224590 - DNA, 20 bp, Homo sapiens
tgttatgccaaacagttgta

SEQ ID NO: 224591 - DNA, 14 bp, Homo sapiens
tgttatggaaactg

SEQ ID NO: 224592 - DNA, 18 bp, Homo sapiens
tgttattcttttccagaa

SEQ ID NO: 224593 - DNA, 16 bp, Homo sapiens
tgttatttgtacagtt

SEQ ID NO: 224594 - DNA, 22 bp, Homo sapiens
tgttattttcagcatgaaaatg

SEQ ID NO: 224595 - DNA, 16 bp, Homo sapiens
tgttcaaactactgta

SEQ ID NO: 224596 - DNA, 18 bp, Homo sapiens
tgttcaaactactgtaca

SEQ ID NO: 224597 - DNA, 20 bp, Homo sapiens
tgttcaaactactgtacatt

SEQ ID NO: 224598 - DNA, 13 bp, Homo sapiens
tgttcaaagtact

SEQ ID NO: 224599 - DNA, 19 bp, Homo sapiens
tgttcacggcagaccagaa

SEQ ID NO: 224600 - DNA, 15 bp, Homo sapiens
tgttcagcactgtcc

SEQ ID NO: 224601 - DNA, 18 bp, Homo sapiens
tgttcagcactgtccctt

SEQ ID NO: 224602 - DNA, 18 bp, Homo sapiens
tgttcatgttttgctaat

SEQ ID NO: 224603 - DNA, 11 bp, Homo sapiens
tgttcattcta

SEQ ID NO: 224604 - DNA, 19 bp, Homo sapiens
tgttcattgtaatgttact

SEQ ID NO: 224605 - DNA, 22 bp, Homo sapiens
tgttcattgtaatgttactgat

SEQ ID NO: 224606 - DNA, 13 bp, Homo sapiens
tgttcatttctgt

SEQ ID NO: 224607 - DNA, 15 bp, Homo sapiens
tgttccaagacattg

SEQ ID NO: 224608 - DNA, 19 bp, Homo sapiens
tgttccaagacattgtcaa

SEQ ID NO: 224609 - DNA, 21 bp, Homo sapiens
tgttccacacatttaaaacat

SEQ ID NO: 224610 - DNA, 23 bp, Homo sapiens
tgttccagactcaggttccagaa

SEQ ID NO: 224611 - DNA, 21 bp, Homo sapiens
tgttcccacaatggctgggag

SEQ ID NO: 224612 - DNA, 22 bp, Homo sapiens
tgttcccacaatggctgggagg

SEQ ID NO: 224613 - DNA, 14 bp, Homo sapiens
tgttcccatgtcta

SEQ ID NO: 224614 - DNA, 14 bp, Homo sapiens
tgttccctctgctc

SEQ ID NO: 224615 - DNA, 16 bp, Homo sapiens
tgttccctctgctcct

SEQ ID NO: 224616 - DNA, 18 bp, Homo sapiens
tgttccctctgctcctgg

SEQ ID NO: 224617 - DNA, 14 bp, Homo sapiens
tgttccctgcaccc

SEQ ID NO: 224618 - DNA, 14 bp, Homo sapiens
tgttccctgctggg

SEQ ID NO: 224619 - DNA, 19 bp, Homo sapiens
tgttccgttcatctgagga

SEQ ID NO: 224620 - DNA, 20 bp, Homo sapiens
tgttccgttcatctgaggag

SEQ ID NO: 224621 - DNA, 21 bp, Homo sapiens
tgttccgttcatctgaggagt

SEQ ID NO: 224622 - DNA, 21 bp, Homo sapiens
tgttcctaaaaatctgtggca

SEQ ID NO: 224623 - DNA, 16 bp, Homo sapiens
tgttcctagagtagag

SEQ ID NO: 224624 - DNA, 17 bp, Homo sapiens
tgttcctgccttctctt

SEQ ID NO: 224625 - DNA, 20 bp, Homo sapiens
tgttcctgccttctcttcta

SEQ ID NO: 224626 - DNA, 13 bp, Homo sapiens
tgttcctgctttc

SEQ ID NO: 224627 - DNA, 24 bp, Homo sapiens
tgttcctggcctcagccagctgcc

SEQ ID NO: 224628 - DNA, 15 bp, Homo sapiens
tgttcctgtgttctt

SEQ ID NO: 224629 - DNA, 16 bp, Homo sapiens
tgttcctgtgttcttc

SEQ ID NO: 224630 - DNA, 22 bp, Homo sapiens
tgttccttagtggtagaggtgt

SEQ ID NO: 224631 - DNA, 16 bp, Homo sapiens
tgttccttgctagccc

SEQ ID NO: 224632 - DNA, 14 bp, Homo sapiens
tgttcgcttggctc

SEQ ID NO: 224633 - DNA, 16 bp, Homo sapiens
tgttctaacatgtaat

SEQ ID NO: 224634 - DNA, 20 bp, Homo sapiens
tgttctacttgatatttcct

SEQ ID NO: 224635 - DNA, 16 bp, Homo sapiens
tgttctagacttcccc

SEQ ID NO: 224636 - DNA, 17 bp, Homo sapiens
tgttctagacttcccca

SEQ ID NO: 224637 - DNA, 12 bp, Homo sapiens
tgttctcagagc

SEQ ID NO: 224638 - DNA, 16 bp, Homo sapiens
tgttctcagagctcca

SEQ ID NO: 224639 - DNA, 16 bp, Homo sapiens
tgttctcctccaaatg

SEQ ID NO: 224640 - DNA, 20 bp, Homo sapiens
tgttctcctccaaatgctgt

SEQ ID NO: 224641 - DNA, 20 bp, Homo sapiens
tgttctctcttggtctcttt

SEQ ID NO: 224642 - DNA, 13 bp, Homo sapiens
tgttctgaactgt

SEQ ID NO: 224643 - DNA, 19 bp, Homo sapiens
tgttctgaaggtgcccagg

SEQ ID NO: 224644 - DNA, 21 bp, Homo sapiens
tgttctgaaggtgcccaggag

SEQ ID NO: 224645 - DNA, 18 bp, Homo sapiens
tgttctgaataatttctt

SEQ ID NO: 224646 - DNA, 13 bp, Homo sapiens
tgttctgacatta

SEQ ID NO: 224647 - DNA, 13 bp, Homo sapiens
tgttctgagcccc

SEQ ID NO: 224648 - DNA, 16 bp, Homo sapiens
tgttctgattagaaat

SEQ ID NO: 224649 - DNA, 23 bp, Homo sapiens
tgttctgcagagacttctaggag

SEQ ID NO: 224650 - DNA, 16 bp, Homo sapiens
tgttctggcctcagac

SEQ ID NO: 224651 - DNA, 21 bp, Homo sapiens
tgttctgggtgatttctagaa

SEQ ID NO: 224652 - DNA, 20 bp, Homo sapiens
tgttctgtgggcttggcctt

SEQ ID NO: 224653 - DNA, 21 bp, Homo sapiens
tgttctgtgggcttggccttg

SEQ ID NO: 224654 - DNA, 17 bp, Homo sapiens
tgttctgtgtctgctgt

SEQ ID NO: 224655 - DNA, 18 bp, Homo sapiens
tgttctgtgtctgctgta

SEQ ID NO: 224656 - DNA, 13 bp, Homo sapiens
tgttctgtttccc

SEQ ID NO: 224657 - DNA, 16 bp, Homo sapiens
tgttctgtttgttaaa

SEQ ID NO: 224658 - DNA, 14 bp, Homo sapiens
tgttcttcgtatat

SEQ ID NO: 224659 - DNA, 12 bp, Homo sapiens
tgttcttgtaaa

SEQ ID NO: 224660 - DNA, 23 bp, Homo sapiens
tgttcttgtaaaactgtgacatt

SEQ ID NO: 224661 - DNA, 16 bp, Homo sapiens
tgttcttgtcatcagt

SEQ ID NO: 224662 - DNA, 18 bp, Homo sapiens
tgttcttttctggaaaat

SEQ ID NO: 224663 - DNA, 15 bp, Homo sapiens
tgttcttttctggta

SEQ ID NO: 224664 - DNA, 23 bp, Homo sapiens
tgttcttttctggtaggttctgt

SEQ ID NO: 224665 - DNA, 15 bp, Homo sapiens
tgttcttttgataca

SEQ ID NO: 224666 - DNA, 19 bp, Homo sapiens
tgttctttttaaaaagttg

SEQ ID NO: 224667 - DNA, 17 bp, Homo sapiens
tgttgacagttcatatg

SEQ ID NO: 224668 - DNA, 20 bp, Homo sapiens
tgttgactgctgctccccac

SEQ ID NO: 224669 - DNA, 22 bp, Homo sapiens
tgttgactgctgctccccaccc

SEQ ID NO: 224670 - DNA, 13 bp, Homo sapiens
tgttgacttattt

SEQ ID NO: 224671 - DNA, 15 bp, Homo sapiens
ggcgcccccagtgtg

SEQ ID NO: 224672 - DNA, 14 bp, Homo sapiens
ggcgcctgcgctcc

SEQ ID NO: 224673 - DNA, 24 bp, Homo sapiens
ggcgcctgcgctcctctgcagcct

SEQ ID NO: 224674 - DNA, 22 bp, Homo sapiens
ggcgcgcacctgtaatcccagc

SEQ ID NO: 224675 - DNA, 15 bp, Homo sapiens
ggcgcgcagcccggg

SEQ ID NO: 224676 - DNA, 22 bp, Homo sapiens
ggcgcggttcaggtcagggcta

SEQ ID NO: 224677 - DNA, 15 bp, Homo sapiens
ggcgctcaggaccca

SEQ ID NO: 224678 - DNA, 18 bp, Homo sapiens
ggcgctcaggacccaggc

SEQ ID NO: 224679 - DNA, 19 bp, Homo sapiens
ggcgctcaggacccaggcc

SEQ ID NO: 224680 - DNA, 21 bp, Homo sapiens
ggcgctcaggacccaggccct

SEQ ID NO: 224681 - DNA, 18 bp, Homo sapiens
ggcgctccggcagaggca

SEQ ID NO: 224682 - DNA, 15 bp, Homo sapiens
ggcgctgagggcagg

SEQ ID NO: 224683 - DNA, 18 bp, Homo sapiens
ggcgctgccacctgcccc

SEQ ID NO: 224684 - DNA, 23 bp, Homo sapiens
ggcggagggatgcaggtgggccg

SEQ ID NO: 224685 - DNA, 16 bp, Homo sapiens
ggcggatccgcgggga

SEQ ID NO: 224686 - DNA, 21 bp, Homo sapiens
ggcggatccgcggggaccctg

SEQ ID NO: 224687 - DNA, 21 bp, Homo sapiens
ggcggcacgccaacagccccc

SEQ ID NO: 224688 - DNA, 20 bp, Homo sapiens
ggcggcagctcttctgggca

SEQ ID NO: 224689 - DNA, 12 bp, Homo sapiens
ggcggcagctgg

SEQ ID NO: 224690 - DNA, 12 bp, Homo sapiens
ggcggccaggca

SEQ ID NO: 224691 - DNA, 13 bp, Homo sapiens
ggcggccaggcaa

SEQ ID NO: 224692 - DNA, 17 bp, Homo sapiens
ggcggccctaagccact

SEQ ID NO: 224693 - DNA, 14 bp, Homo sapiens
ggcggcgcagaggg

SEQ ID NO: 224694 - DNA, 18 bp, Homo sapiens
ggcggctaggccggccag

SEQ ID NO: 224695 - DNA, 18 bp, Homo sapiens
ggcggctgagagccccag

SEQ ID NO: 224696 - DNA, 22 bp, Homo sapiens
ggcgggaggccacgggggaggc

SEQ ID NO: 224697 - DNA, 15 bp, Homo sapiens
ggcgggcagcccctg

SEQ ID NO: 224698 - DNA, 22 bp, Homo sapiens
ggcgggcagcccctgctggacc

SEQ ID NO: 224699 - DNA, 23 bp, Homo sapiens
ggcgggcagcccctgctggacca

SEQ ID NO: 224700 - DNA, 14 bp, Homo sapiens
ggcgggcggtcagg

SEQ ID NO: 224701 - DNA, 13 bp, Homo sapiens
ggcgggggagcct

SEQ ID NO: 224702 - DNA, 21 bp, Homo sapiens
ggcgggggtctatacattcct

SEQ ID NO: 224703 - DNA, 22 bp, Homo sapiens
ggcggtcaataattgtggagag

SEQ ID NO: 224704 - DNA, 23 bp, Homo sapiens
ggcggtcaataattgtggagagg

SEQ ID NO: 224705 - DNA, 16 bp, Homo sapiens
ggcggtccccatcccc

SEQ ID NO: 224706 - DNA, 17 bp, Homo sapiens
ggctgaggacggggcag

SEQ ID NO: 224707 - DNA, 20 bp, Homo sapiens
ggctgaggacggggcagagc

SEQ ID NO: 224708 - DNA, 22 bp, Homo sapiens
ggctgaggacggggcagagctg

SEQ ID NO: 224709 - DNA, 14 bp, Homo sapiens
ggctgaggaggcag

SEQ ID NO: 224710 - DNA, 16 bp, Homo sapiens
ggctgaggcctggact

SEQ ID NO: 224711 - DNA, 15 bp, Homo sapiens
ggctgaggcttgggc

SEQ ID NO: 224712 - DNA, 16 bp, Homo sapiens
ggctgaggtgggagga

SEQ ID NO: 224713 - DNA, 16 bp, Homo sapiens
ggctgagtctggctag

SEQ ID NO: 224714 - DNA, 18 bp, Homo sapiens
ggctgcaagctgcaggga

SEQ ID NO: 224715 - DNA, 12 bp, Homo sapiens
ggctgcactgca

SEQ ID NO: 224716 - DNA, 17 bp, Homo sapiens
ggctgcagcaggcagag

SEQ ID NO: 224717 - DNA, 15 bp, Homo sapiens
ggctgcagtgagcca

SEQ ID NO: 224718 - DNA, 21 bp, Homo sapiens
ggctgcatacccgggcagggc

SEQ ID NO: 224719 - DNA, 15 bp, Homo sapiens
ggctgcatcctcagc

SEQ ID NO: 224720 - DNA, 21 bp, Homo sapiens
ggctgcatcctcagccccagg

SEQ ID NO: 224721 - DNA, 23 bp, Homo sapiens
ggctgcatcctcagccccagggc

SEQ ID NO: 224722 - DNA, 10 bp, Homo sapiens
ggctgccagg

SEQ ID NO: 224723 - DNA, 12 bp, Homo sapiens
ggctgccaggcg

SEQ ID NO: 224724 - DNA, 15 bp, Homo sapiens
ggctgccccacccct

SEQ ID NO: 224725 - DNA, 17 bp, Homo sapiens
ggctgccccacccctcc

SEQ ID NO: 224726 - DNA, 12 bp, Homo sapiens
ggctgccctggt

SEQ ID NO: 224727 - DNA, 15 bp, Homo sapiens
ggctgccctggtgct

SEQ ID NO: 224728 - DNA, 19 bp, Homo sapiens
ggctgccctggtgctgcca

SEQ ID NO: 224729 - DNA, 16 bp, Homo sapiens
ggctgccggctgcacc

SEQ ID NO: 224730 - DNA, 21 bp, Homo sapiens
ggctgccgggttctagtctcc

SEQ ID NO: 224731 - DNA, 14 bp, Homo sapiens
ggctgcctctgggt

SEQ ID NO: 224732 - DNA, 18 bp, Homo sapiens
ggctgcgaactgtgcagt

SEQ ID NO: 224733 - DNA, 16 bp, Homo sapiens
ggctgcggtgggcagc

SEQ ID NO: 224734 - DNA, 19 bp, Homo sapiens
ggctgcgtctgacatcctg

SEQ ID NO: 224735 - DNA, 12 bp, Homo sapiens
ggctgctcccca

SEQ ID NO: 224736 - DNA, 13 bp, Homo sapiens
ggctgctccccac

SEQ ID NO: 224737 - DNA, 19 bp, Homo sapiens
ggctgctgaaaaccatctg

SEQ ID NO: 224738 - DNA, 15 bp, Homo sapiens
ggctgctggaggaaa

SEQ ID NO: 224739 - DNA, 11 bp, Homo sapiens
ggctgctggca

SEQ ID NO: 224740 - DNA, 24 bp, Homo sapiens
ggctgctggggcatgtgtgcctgt

SEQ ID NO: 224741 - DNA, 18 bp, Homo sapiens
ggctgcttctccacctcc

SEQ ID NO: 224742 - DNA, 22 bp, Homo sapiens
ggctgcttctccacctccccca

SEQ ID NO: 224743 - DNA, 13 bp, Homo sapiens
ggctggaaagagg

SEQ ID NO: 224744 - DNA, 17 bp, Homo sapiens
ggctggaaagaggagaa

SEQ ID NO: 224745 - DNA, 13 bp, Homo sapiens
ggctggactggag

SEQ ID NO: 224746 - DNA, 14 bp, Homo sapiens
ggctggactggagg

SEQ ID NO: 224747 - DNA, 21 bp, Homo sapiens
ggctggacttttgcagcttcc

SEQ ID NO: 224748 - DNA, 20 bp, Homo sapiens
ggctggagaggaaaagccag

SEQ ID NO: 224749 - DNA, 13 bp, Homo sapiens
ggctggagctggc

SEQ ID NO: 224750 - DNA, 15 bp, Homo sapiens
ggctggaggcattcc

SEQ ID NO: 224751 - DNA, 17 bp, Homo sapiens
ggctggaggcattccca

SEQ ID NO: 224752 - DNA, 20 bp, Homo sapiens
ggctggagtgcagtggtgtg

SEQ ID NO: 224753 - DNA, 19 bp, Homo sapiens
ggctggagtggagtggcgt

SEQ ID NO: 224754 - DNA, 15 bp, Homo sapiens
ggctggcaagcaggg

SEQ ID NO: 224755 - DNA, 14 bp, Homo sapiens
ggctggcagctctc

SEQ ID NO: 224756 - DNA, 18 bp, Homo sapiens
ggctggcagctctccagt

SEQ ID NO: 224757 - DNA, 20 bp, Homo sapiens
ggctggcagctctccagtca

SEQ ID NO: 224758 - DNA, 18 bp, Homo sapiens
ggctggccagcaaggcag

SEQ ID NO: 224759 - DNA, 20 bp, Homo sapiens
ggctggccagcaaggcaggt

SEQ ID NO: 224760 - DNA, 11 bp, Homo sapiens
ggctggccctg

SEQ ID NO: 224761 - DNA, 16 bp, Homo sapiens
ggctggccggtccacc

SEQ ID NO: 224762 - DNA, 18 bp, Homo sapiens
ggctggccggtccacccc

SEQ ID NO: 224763 - DNA, 19 bp, Homo sapiens
ggctggctgaaaatcacta

SEQ ID NO: 224764 - DNA, 13 bp, Homo sapiens
ggctggctgagtg

SEQ ID NO: 224765 - DNA, 18 bp, Homo sapiens
ggctggcttctccctgga

SEQ ID NO: 224766 - DNA, 21 bp, Homo sapiens
ggctggcttctccctggactc

SEQ ID NO: 224767 - DNA, 18 bp, Homo sapiens
ggctgggagaaggtgctt

SEQ ID NO: 224768 - DNA, 14 bp, Homo sapiens
ggctgggagggggc

SEQ ID NO: 224769 - DNA, 16 bp, Homo sapiens
ggctgggagggggccc

SEQ ID NO: 224770 - DNA, 17 bp, Homo sapiens
ggctgggagggggccct

SEQ ID NO: 224771 - DNA, 14 bp, Homo sapiens
ggctgggcagctgt

SEQ ID NO: 224772 - DNA, 21 bp, Homo sapiens
ggctgggcaggtcctggggag

SEQ ID NO: 224773 - DNA, 14 bp, Homo sapiens
ggctgggcccagaa

SEQ ID NO: 224774 - DNA, 15 bp, Homo sapiens
ggctgggcccagagg

SEQ ID NO: 224775 - DNA, 17 bp, Homo sapiens
ggctgggcccagaggca

SEQ ID NO: 224776 - DNA, 13 bp, Homo sapiens
ggctgggcccccc

SEQ ID NO: 224777 - DNA, 21 bp, Homo sapiens
ggctgggctctgtcttcctgg

SEQ ID NO: 224778 - DNA, 15 bp, Homo sapiens
ggctggggcagaggg

SEQ ID NO: 224779 - DNA, 22 bp, Homo sapiens
ggctggggcagaggggcagccg

SEQ ID NO: 224780 - DNA, 15 bp, Homo sapiens
ggctggggcccagca

SEQ ID NO: 224781 - DNA, 17 bp, Homo sapiens
ggctggggcctggccta

SEQ ID NO: 224782 - DNA, 18 bp, Homo sapiens
ggctgggggcatggggga

SEQ ID NO: 224783 - DNA, 21 bp, Homo sapiens
ggctgggggcatgggggaggc

SEQ ID NO: 224784 - DNA, 22 bp, Homo sapiens
ggctgggtaatgtgaaggccca

SEQ ID NO: 224785 - DNA, 21 bp, Homo sapiens
ggctgggtgcccacagcccgc

SEQ ID NO: 224786 - DNA, 22 bp, Homo sapiens
ggctgggtgcccacagcccgca

SEQ ID NO: 224787 - DNA, 19 bp, Homo sapiens
ggctgggtttgggcagtgg

SEQ ID NO: 224788 - DNA, 20 bp, Homo sapiens
ggctggtctcgaactcctga

SEQ ID NO: 224789 - DNA, 17 bp, Homo sapiens
ggctggtcttgaactcc

SEQ ID NO: 224790 - DNA, 20 bp, Homo sapiens
ggctggtcttgaactcctga

SEQ ID NO: 224791 - DNA, 13 bp, Homo sapiens
ggctggtgcccca

SEQ ID NO: 224792 - DNA, 21 bp, Homo sapiens
ggctggtgccccacagctacc

SEQ ID NO: 224793 - DNA, 13 bp, Homo sapiens
ggctgtaatttaa

SEQ ID NO: 224794 - DNA, 20 bp, Homo sapiens
ggctgtacacaccctccagc

SEQ ID NO: 224795 - DNA, 18 bp, Homo sapiens
ggctgtcagtatgacatt

SEQ ID NO: 224796 - DNA, 19 bp, Homo sapiens
ggctgtccaatcacattca

SEQ ID NO: 224797 - DNA, 18 bp, Homo sapiens
ggctgtcccctccatctg

SEQ ID NO: 224798 - DNA, 22 bp, Homo sapiens
ggctgtcccctccatctgggga

SEQ ID NO: 224799 - DNA, 16 bp, Homo sapiens
ggctgtcctgagcccc

SEQ ID NO: 224800 - DNA, 19 bp, Homo sapiens
ggctgtcctttccagtggc

SEQ ID NO: 224801 - DNA, 15 bp, Homo sapiens
ggctgtctgcctgta

SEQ ID NO: 224802 - DNA, 17 bp, Homo sapiens
ggctgtgagcagcctcc

SEQ ID NO: 224803 - DNA, 19 bp, Homo sapiens
ggctgtgagcagcctccac

SEQ ID NO: 224804 - DNA, 11 bp, Homo sapiens
ggctgtgagtg

SEQ ID NO: 224805 - DNA, 20 bp, Homo sapiens
ggctgtgcacattctccctt

SEQ ID NO: 224806 - DNA, 12 bp, Homo sapiens
ggctgtgcctcc

SEQ ID NO: 224807 - DNA, 19 bp, Homo sapiens
ggctgtgcgctgacaacca

SEQ ID NO: 224808 - DNA, 13 bp, Homo sapiens
ggctgtggaggcc

SEQ ID NO: 224809 - DNA, 14 bp, Homo sapiens
ggctgtggaggcct

SEQ ID NO: 224810 - DNA, 15 bp, Homo sapiens
ggctgtggaggcctg

SEQ ID NO: 224811 - DNA, 17 bp, Homo sapiens
ggctgtggaggcctgat

SEQ ID NO: 224812 - DNA, 12 bp, Homo sapiens
ggctgtggcccc

SEQ ID NO: 224813 - DNA, 17 bp, Homo sapiens
tgtttgtccagttcagg

SEQ ID NO: 224814 - DNA, 17 bp, Homo sapiens
tgtttgtgagtatgtgt

SEQ ID NO: 224815 - DNA, 14 bp, Homo sapiens
tgtttgtggcctca

SEQ ID NO: 224816 - DNA, 20 bp, Homo sapiens
tgttttaaaagtttgtcctt

SEQ ID NO: 224817 - DNA, 18 bp, Homo sapiens
tgttttaaatatagaatt

SEQ ID NO: 224818 - DNA, 18 bp, Homo sapiens
tgttttaaggaagaaaaa

SEQ ID NO: 224819 - DNA, 17 bp, Homo sapiens
tgttttacaatggctgg

SEQ ID NO: 224820 - DNA, 16 bp, Homo sapiens
tgttttactctttttc

SEQ ID NO: 224821 - DNA, 16 bp, Homo sapiens
tgttttactgctttta

SEQ ID NO: 224822 - DNA, 14 bp, Homo sapiens
tgttttagttcttg

SEQ ID NO: 224823 - DNA, 11 bp, Homo sapiens
tgttttatata

SEQ ID NO: 224824 - DNA, 14 bp, Homo sapiens
tgttttatgtgcac

SEQ ID NO: 224825 - DNA, 22 bp, Homo sapiens
tgttttattgagttctgaaggt

SEQ ID NO: 224826 - DNA, 15 bp, Homo sapiens
tgttttcataataaa

SEQ ID NO: 224827 - DNA, 19 bp, Homo sapiens
tgttttcccacacatattc

SEQ ID NO: 224828 - DNA, 14 bp, Homo sapiens
tgttttctcagaac

SEQ ID NO: 224829 - DNA, 14 bp, Homo sapiens
tgttttctgtaaat

SEQ ID NO: 224830 - DNA, 12 bp, Homo sapiens
tgttttcttcaa

SEQ ID NO: 224831 - DNA, 23 bp, Homo sapiens
tgttttcttcttcagtgaagcag

SEQ ID NO: 224832 - DNA, 17 bp, Homo sapiens
tgttttgacggatgatt

SEQ ID NO: 224833 - DNA, 11 bp, Homo sapiens
tgttttgagaa

SEQ ID NO: 224834 - DNA, 21 bp, Homo sapiens
tgttttgagggctattagaag

SEQ ID NO: 224835 - DNA, 12 bp, Homo sapiens
tgttttgcactt

SEQ ID NO: 224836 - DNA, 11 bp, Homo sapiens
tgttttgctaa

SEQ ID NO: 224837 - DNA, 17 bp, Homo sapiens
gggagaaggagaggctc

SEQ ID NO: 224838 - DNA, 15 bp, Homo sapiens
gggagaagggacagc

SEQ ID NO: 224839 - DNA, 18 bp, Homo sapiens
gggagaatggcatggtag

SEQ ID NO: 224840 - DNA, 15 bp, Homo sapiens
gggagaatggctctg

SEQ ID NO: 224841 - DNA, 17 bp, Homo sapiens
gggagacccaataaaga

SEQ ID NO: 224842 - DNA, 16 bp, Homo sapiens
gggagaccctgggaga

SEQ ID NO: 224843 - DNA, 14 bp, Homo sapiens
gggagagagtgaga

SEQ ID NO: 224844 - DNA, 18 bp, Homo sapiens
gggagagagtgagagaga

SEQ ID NO: 224845 - DNA, 22 bp, Homo sapiens
gggagagccaaggcctatgcca

SEQ ID NO: 224846 - DNA, 12 bp, Homo sapiens
gggagagccagc

SEQ ID NO: 224847 - DNA, 15 bp, Homo sapiens
gggagagccagctcc

SEQ ID NO: 224848 - DNA, 23 bp, Homo sapiens
gggagagcgccacccgcccgccc

SEQ ID NO: 224849 - DNA, 13 bp, Homo sapiens
gggagaggaactc

SEQ ID NO: 224850 - DNA, 21 bp, Homo sapiens
gggagaggatttttttctgag

SEQ ID NO: 224851 - DNA, 11 bp, Homo sapiens
gggagaggcag

SEQ ID NO: 224852 - DNA, 22 bp, Homo sapiens
gggagaggccatgattcgccca

SEQ ID NO: 224853 - DNA, 18 bp, Homo sapiens
gggagagggagcaagcct

SEQ ID NO: 224854 - DNA, 19 bp, Homo sapiens
gggagatcggggccagagg

SEQ ID NO: 224855 - DNA, 20 bp, Homo sapiens
gggagatcggggccagaggc

SEQ ID NO: 224856 - DNA, 22 bp, Homo sapiens
gggagatggtcagtgtggagag

SEQ ID NO: 224857 - DNA, 11 bp, Homo sapiens
gggagcactgg

SEQ ID NO: 224858 - DNA, 15 bp, Homo sapiens
gggagcagctgggca

SEQ ID NO: 224859 - DNA, 19 bp, Homo sapiens
gggagcagctgggcactgg

SEQ ID NO: 224860 - DNA, 20 bp, Homo sapiens
gggagcagtgtcttccataa

SEQ ID NO: 224861 - DNA, 18 bp, Homo sapiens
gggagcattctgcctgcc

SEQ ID NO: 224862 - DNA, 21 bp, Homo sapiens
gggagccaatactgagtgcct

SEQ ID NO: 224863 - DNA, 18 bp, Homo sapiens
gggagcccaggcctggcc

SEQ ID NO: 224864 - DNA, 18 bp, Homo sapiens
gggagcctgcgtggcctg

SEQ ID NO: 224865 - DNA, 19 bp, Homo sapiens
gggagcctgcgtggcctgg

SEQ ID NO: 224866 - DNA, 12 bp, Homo sapiens
gggagctctgca

SEQ ID NO: 224867 - DNA, 10 bp, Homo sapiens
gggagctggt

SEQ ID NO: 224868 - DNA, 22 bp, Homo sapiens
gggaggaatcttttactgtgga

SEQ ID NO: 224869 - DNA, 21 bp, Homo sapiens
gggaggagaggggaagggcca

SEQ ID NO: 224870 - DNA, 12 bp, Homo sapiens
gggaggcaccag

SEQ ID NO: 224871 - DNA, 15 bp, Homo sapiens
gggaggcaccagctc

SEQ ID NO: 224872 - DNA, 19 bp, Homo sapiens
gggaggcagatggagccca

SEQ ID NO: 224873 - DNA, 19 bp, Homo sapiens
gggaggccaaggcaggtag

SEQ ID NO: 224874 - DNA, 20 bp, Homo sapiens
gggaggccaaggtgggcgga

SEQ ID NO: 224875 - DNA, 16 bp, Homo sapiens
gggaggccaccccaaa

SEQ ID NO: 224876 - DNA, 16 bp, Homo sapiens
gggaggcccatgtgac

SEQ ID NO: 224877 - DNA, 16 bp, Homo sapiens
gggaggccgaggcagg

SEQ ID NO: 224878 - DNA, 21 bp, Homo sapiens
gggaggctcccagacccaggg

SEQ ID NO: 224879 - DNA, 11 bp, Homo sapiens
gggaggctgag

SEQ ID NO: 224880 - DNA, 14 bp, Homo sapiens
gggaggctgagact

SEQ ID NO: 224881 - DNA, 16 bp, Homo sapiens
gggaggctgagactgc

SEQ ID NO: 224882 - DNA, 19 bp, Homo sapiens
gggaggctgagactgcaga

SEQ ID NO: 224883 - DNA, 20 bp, Homo sapiens
gggaggctgaggtgggcaga

SEQ ID NO: 224884 - DNA, 14 bp, Homo sapiens
gggagggctgcctg

SEQ ID NO: 224885 - DNA, 16 bp, Homo sapiens
gggaggggcctaggga

SEQ ID NO: 224886 - DNA, 19 bp, Homo sapiens
gggaggggcctagggagcc

SEQ ID NO: 224887 - DNA, 13 bp, Homo sapiens
gggaggggcctgg

SEQ ID NO: 224888 - DNA, 18 bp, Homo sapiens
gggaggggctgagtctgg

SEQ ID NO: 224889 - DNA, 13 bp, Homo sapiens
gggagggtcagtg

SEQ ID NO: 224890 - DNA, 15 bp, Homo sapiens
gggagggtcagtgcc

SEQ ID NO: 224891 - DNA, 18 bp, Homo sapiens
gggaggttgatcagatct

SEQ ID NO: 224892 - DNA, 15 bp, Homo sapiens
gggaggtttgtttgt

SEQ ID NO: 224893 - DNA, 20 bp, Homo sapiens
gggagtcaagtgtgcctgct

SEQ ID NO: 224894 - DNA, 21 bp, Homo sapiens
gggagtcaagtgtgcctgcta

SEQ ID NO: 224895 - DNA, 12 bp, Homo sapiens
gggagtcagagc

SEQ ID NO: 224896 - DNA, 14 bp, Homo sapiens
gggagtcagagccc

SEQ ID NO: 224897 - DNA, 14 bp, Homo sapiens
gggagtctccctcc

SEQ ID NO: 224898 - DNA, 14 bp, Homo sapiens
gggagtgagcttgg

SEQ ID NO: 224899 - DNA, 21 bp, Homo sapiens
gggagtgggacagagtctggg

SEQ ID NO: 224900 - DNA, 13 bp, Homo sapiens
gggagtgggagag

SEQ ID NO: 224901 - DNA, 15 bp, Homo sapiens
gggagtgggcacctc

SEQ ID NO: 224902 - DNA, 13 bp, Homo sapiens
gggatacttagtg

SEQ ID NO: 224903 - DNA, 23 bp, Homo sapiens
gggatcctggagttctggttcct

SEQ ID NO: 224904 - DNA, 17 bp, Homo sapiens
gggatctaaaaggagga

SEQ ID NO: 224905 - DNA, 20 bp, Homo sapiens
gggatctaaaaggaggacag

SEQ ID NO: 224906 - DNA, 14 bp, Homo sapiens
gggatgagcctctc

SEQ ID NO: 224907 - DNA, 16 bp, Homo sapiens
gggatgagcctctcct

SEQ ID NO: 224908 - DNA, 21 bp, Homo sapiens
gggatgccaacaccttcttgg

SEQ ID NO: 224909 - DNA, 15 bp, Homo sapiens
gggatggaaaaggaa

SEQ ID NO: 224910 - DNA, 21 bp, Homo sapiens
gggatggagaatgccagccca

SEQ ID NO: 224911 - DNA, 18 bp, Homo sapiens
gggatggccgatggggcc

SEQ ID NO: 224912 - DNA, 15 bp, Homo sapiens
gggatgggcacaggc

SEQ ID NO: 224913 - DNA, 16 bp, Homo sapiens
gggatgggcacaggct

SEQ ID NO: 224914 - DNA, 17 bp, Homo sapiens
gggatggggccacagcc

SEQ ID NO: 224915 - DNA, 12 bp, Homo sapiens
gggatgtcctct

SEQ ID NO: 224916 - DNA, 22 bp, Homo sapiens
gggatgtttgtgctgcagacaa

SEQ ID NO: 224917 - DNA, 20 bp, Homo sapiens
gggattatgggtcacaggaa

SEQ ID NO: 224918 - DNA, 17 bp, Homo sapiens
gggattcaaatgcatga

SEQ ID NO: 224919 - DNA, 14 bp, Homo sapiens
gggattcaggctgc

SEQ ID NO: 224920 - DNA, 11 bp, Homo sapiens
gggattctggg

SEQ ID NO: 224921 - DNA, 17 bp, Homo sapiens
gggattgaacacaggca

SEQ ID NO: 224922 - DNA, 20 bp, Homo sapiens
gggattggaccgagctggaa

SEQ ID NO: 224923 - DNA, 20 bp, Homo sapiens
gggatttcttcgctgctcta

SEQ ID NO: 224924 - DNA, 15 bp, Homo sapiens
gggcaaacaggcagt

SEQ ID NO: 224925 - DNA, 13 bp, Homo sapiens
gggcaaagaaaac

SEQ ID NO: 224926 - DNA, 14 bp, Homo sapiens
gggcaaagaaaaca

SEQ ID NO: 224927 - DNA, 23 bp, Homo sapiens
gggcaagaaattcattaaagaaa

SEQ ID NO: 224928 - DNA, 18 bp, Homo sapiens
gggcaagggccgtgcccg

SEQ ID NO: 224929 - DNA, 23 bp, Homo sapiens
gggcacaccactgccctgcctgc

SEQ ID NO: 224930 - DNA, 12 bp, Homo sapiens
gggcacagccag

SEQ ID NO: 224931 - DNA, 14 bp, Homo sapiens
gggcacagccagaa

SEQ ID NO: 224932 - DNA, 16 bp, Homo sapiens
gggcacccacctccac

SEQ ID NO: 224933 - DNA, 22 bp, Homo sapiens
gggcacctatgagatggccatg

SEQ ID NO: 224934 - DNA, 16 bp, Homo sapiens
gggcacgggagagcgc

SEQ ID NO: 224935 - DNA, 17 bp, Homo sapiens
gggcacgggagagcgcc

SEQ ID NO: 224936 - DNA, 18 bp, Homo sapiens
gggcacgggagagcgcca

SEQ ID NO: 224937 - DNA, 22 bp, Homo sapiens
gggcacgggagagcgccacccg

SEQ ID NO: 224938 - DNA, 23 bp, Homo sapiens
gggcacgggagagcgccacccgc

SEQ ID NO: 224939 - DNA, 15 bp, Homo sapiens
gggcactctctgcca

SEQ ID NO: 224940 - DNA, 15 bp, Homo sapiens
gggcactggctgctc

SEQ ID NO: 224941 - DNA, 13 bp, Homo sapiens
gggcactggtggc

SEQ ID NO: 224942 - DNA, 16 bp, Homo sapiens
gggcagagccatgggc

SEQ ID NO: 224943 - DNA, 17 bp, Homo sapiens
gggcagagccatgggcc

SEQ ID NO: 224944 - DNA, 14 bp, Homo sapiens
gggcagagctcaga

SEQ ID NO: 224945 - DNA, 12 bp, Homo sapiens
gggcagagggga

SEQ ID NO: 224946 - DNA, 20 bp, Homo sapiens
gggcagaggggagaggaagc

SEQ ID NO: 224947 - DNA, 14 bp, Homo sapiens
gggcagccaggctg

SEQ ID NO: 224948 - DNA, 13 bp, Homo sapiens
gggcagcccagag

SEQ ID NO: 224949 - DNA, 22 bp, Homo sapiens
gggcagcccagagagaccctgc

SEQ ID NO: 224950 - DNA, 12 bp, Homo sapiens
gggcagcccctg

SEQ ID NO: 224951 - DNA, 15 bp, Homo sapiens
gggcagcccctgctg

SEQ ID NO: 224952 - DNA, 17 bp, Homo sapiens
gggcagccgctaggaga

SEQ ID NO: 224953 - DNA, 14 bp, Homo sapiens
gggcagctgaggac

SEQ ID NO: 224954 - DNA, 16 bp, Homo sapiens
gggcagctgccagaga

SEQ ID NO: 224955 - DNA, 13 bp, Homo sapiens
gggcagctgggcc

SEQ ID NO: 224956 - DNA, 12 bp, Homo sapiens
gggcaggccagc

SEQ ID NO: 224957 - DNA, 12 bp, Homo sapiens
gggcaggcctgg

SEQ ID NO: 224958 - DNA, 13 bp, Homo sapiens
gggcaggcctggg

SEQ ID NO: 224959 - DNA, 23 bp, Homo sapiens
gggcaggcctgggacccagctac

SEQ ID NO: 224960 - DNA, 16 bp, Homo sapiens
gggcagggcagggcgg

SEQ ID NO: 224961 - DNA, 19 bp, Homo sapiens
ttaatagaatataattatc

SEQ ID NO: 224962 - DNA, 21 bp, Homo sapiens
ttaatagatttaccctttata

SEQ ID NO: 224963 - DNA, 23 bp, Homo sapiens
ttaatagatttaccctttataga

SEQ ID NO: 224964 - DNA, 17 bp, Homo sapiens
ttaataggataaattaa

SEQ ID NO: 224965 - DNA, 23 bp, Homo sapiens
ttaatataactgccttaaaactt

SEQ ID NO: 224966 - DNA, 17 bp, Homo sapiens
ttaatatactaaccatt

SEQ ID NO: 224967 - DNA, 16 bp, Homo sapiens
ttaatatactcaggga

SEQ ID NO: 224968 - DNA, 14 bp, Homo sapiens
ttagcttttctgca

SEQ ID NO: 224969 - DNA, 18 bp, Homo sapiens
ttagctttttaaaacatt

SEQ ID NO: 224970 - DNA, 20 bp, Homo sapiens
ttagctttttaaaacattag

SEQ ID NO: 224971 - DNA, 17 bp, Homo sapiens
ttaggaacagagtatat

SEQ ID NO: 224972 - DNA, 13 bp, Homo sapiens
gggcgaggcagag

SEQ ID NO: 224973 - DNA, 13 bp, Homo sapiens
gggcgagggaggg

SEQ ID NO: 224974 - DNA, 15 bp, Homo sapiens
gggcgcctgcgctcc

SEQ ID NO: 224975 - DNA, 18 bp, Homo sapiens
gggcgcctgcgctcctct

SEQ ID NO: 224976 - DNA, 17 bp, Homo sapiens
gggcgctcaggacccag

SEQ ID NO: 224977 - DNA, 19 bp, Homo sapiens
gggcgctcaggacccaggc

SEQ ID NO: 224978 - DNA, 20 bp, Homo sapiens
gggcgctcaggacccaggcc

SEQ ID NO: 224979 - DNA, 18 bp, Homo sapiens
gggcgctccggcagaggc

SEQ ID NO: 224980 - DNA, 13 bp, Homo sapiens
gggcggctgagag

SEQ ID NO: 224981 - DNA, 22 bp, Homo sapiens
gggcggtcaataattgtggaga

SEQ ID NO: 224982 - DNA, 20 bp, Homo sapiens
gggctaaaggggagaaactg

SEQ ID NO: 224983 - DNA, 13 bp, Homo sapiens
gggctaactggcc

SEQ ID NO: 224984 - DNA, 15 bp, Homo sapiens
gggctaactggcccc

SEQ ID NO: 224985 - DNA, 16 bp, Homo sapiens
gggctaactggcccca

SEQ ID NO: 224986 - DNA, 18 bp, Homo sapiens
gggctaactggccccagg

SEQ ID NO: 224987 - DNA, 21 bp, Homo sapiens
gggctaattctgggaagggag

SEQ ID NO: 224988 - DNA, 20 bp, Homo sapiens
gggctactgcagctttacat

SEQ ID NO: 224989 - DNA, 14 bp, Homo sapiens
gggctactggcagc

SEQ ID NO: 224990 - DNA, 17 bp, Homo sapiens
gggctactggcagctcc

SEQ ID NO: 224991 - DNA, 19 bp, Homo sapiens
gggctactggcagctcctc

SEQ ID NO: 224992 - DNA, 22 bp, Homo sapiens
gggctagtgtgagtggcagcca

SEQ ID NO: 224993 - DNA, 23 bp, Homo sapiens
gggctagtgtgagtggcagccat

SEQ ID NO: 224994 - DNA, 18 bp, Homo sapiens
gggctatcccttctcaga

SEQ ID NO: 224995 - DNA, 16 bp, Homo sapiens
gggctatttctctccc

SEQ ID NO: 224996 - DNA, 22 bp, Homo sapiens
gggctcaaggcaccgcagcctg

SEQ ID NO: 224997 - DNA, 17 bp, Homo sapiens
gggctcacggggcctcc

SEQ ID NO: 224998 - DNA, 14 bp, Homo sapiens
gggctcagctctgg

SEQ ID NO: 224999 - DNA, 14 bp, Homo sapiens
gggctcagggctgg

SEQ ID NO: 225000 - DNA, 12 bp, Homo sapiens
gggctccagagt

SEQ ID NO: 225001 - DNA, 17 bp, Homo sapiens
gggctccagcatccagc

SEQ ID NO: 225002 - DNA, 23 bp, Homo sapiens
gggctcccggagagggagtcagt

SEQ ID NO: 225003 - DNA, 15 bp, Homo sapiens
gggctccctcctgga

SEQ ID NO: 225004 - DNA, 13 bp, Homo sapiens
gggctcctggctg

SEQ ID NO: 225005 - DNA, 15 bp, Homo sapiens
gggctcctggctgcc

SEQ ID NO: 225006 - DNA, 18 bp, Homo sapiens
gggctcctggctgccagg

SEQ ID NO: 225007 - DNA, 18 bp, Homo sapiens
gggctcctttctccagcc

SEQ ID NO: 225008 - DNA, 21 bp, Homo sapiens
gggctcctttctccagccagc

SEQ ID NO: 225009 - DNA, 16 bp, Homo sapiens
gggctctccaaagggg

SEQ ID NO: 225010 - DNA, 18 bp, Homo sapiens
gggctctccaaaggggct

SEQ ID NO: 225011 - DNA, 19 bp, Homo sapiens
gggctctctgctgtacata

SEQ ID NO: 225012 - DNA, 16 bp, Homo sapiens
gggctctgccctccct

SEQ ID NO: 225013 - DNA, 15 bp, Homo sapiens
gggctctggccaccc

SEQ ID NO: 225014 - DNA, 17 bp, Homo sapiens
gggctctggctccctgg

SEQ ID NO: 225015 - DNA, 21 bp, Homo sapiens
gggctgacacctaccatgctg

SEQ ID NO: 225016 - DNA, 20 bp, Homo sapiens
gggctgactagaagggccag

SEQ ID NO: 225017 - DNA, 14 bp, Homo sapiens
gggctgagcccctc

SEQ ID NO: 225018 - DNA, 12 bp, Homo sapiens
gggctgagcctg

SEQ ID NO: 225019 - DNA, 18 bp, Homo sapiens
gggctgaggggcaacgaa

SEQ ID NO: 225020 - DNA, 20 bp, Homo sapiens
gggctgcatcctcagcccca

SEQ ID NO: 225021 - DNA, 23 bp, Homo sapiens
gggctgcatcctcagccccaggg

SEQ ID NO: 225022 - DNA, 21 bp, Homo sapiens
gggctgcatgcgggcttcctc

SEQ ID NO: 225023 - DNA, 14 bp, Homo sapiens
gggctgccctggtg

SEQ ID NO: 225024 - DNA, 21 bp, Homo sapiens
gggctgccgtgcacggggcca

SEQ ID NO: 225025 - DNA, 11 bp, Homo sapiens
gggctgctcct

SEQ ID NO: 225026 - DNA, 14 bp, Homo sapiens
gggctgctcctcat

SEQ ID NO: 225027 - DNA, 11 bp, Homo sapiens
gggctgctggg

SEQ ID NO: 225028 - DNA, 14 bp, Homo sapiens
gggctgctggggca

SEQ ID NO: 225029 - DNA, 21 bp, Homo sapiens
gggctggagtgcgctcttggt

SEQ ID NO: 225030 - DNA, 13 bp, Homo sapiens
gggctggcaagca

SEQ ID NO: 225031 - DNA, 11 bp, Homo sapiens
gggctggccct

SEQ ID NO: 225032 - DNA, 15 bp, Homo sapiens
gggctggccctgccc

SEQ ID NO: 225033 - DNA, 19 bp, Homo sapiens
gggctggccctgccctccc

SEQ ID NO: 225034 - DNA, 11 bp, Homo sapiens
gggctgggaga

SEQ ID NO: 225035 - DNA, 18 bp, Homo sapiens
gggctgggagctctgcag

SEQ ID NO: 225036 - DNA, 15 bp, Homo sapiens
gggctgggcagaggg

SEQ ID NO: 225037 - DNA, 23 bp, Homo sapiens
gggctgggcaggtcctggggagg

SEQ ID NO: 225038 - DNA, 18 bp, Homo sapiens
gggctgggccctctgtcc

SEQ ID NO: 225039 - DNA, 17 bp, Homo sapiens
gggctggtgccagcctt

SEQ ID NO: 225040 - DNA, 20 bp, Homo sapiens
gggctggtgccagccttcct

SEQ ID NO: 225041 - DNA, 19 bp, Homo sapiens
gggctggtgccccacagct

SEQ ID NO: 225042 - DNA, 11 bp, Homo sapiens
gggctgtcctt

SEQ ID NO: 225043 - DNA, 16 bp, Homo sapiens
gggctgtggctgggtg

SEQ ID NO: 225044 - DNA, 17 bp, Homo sapiens
gggctgttggctggggg

SEQ ID NO: 225045 - DNA, 22 bp, Homo sapiens
gggcttacctgtacactgactt

SEQ ID NO: 225046 - DNA, 19 bp, Homo sapiens
gggcttatctagccaaaga

SEQ ID NO: 225047 - DNA, 21 bp, Homo sapiens
gggcttcaaccttgagacagc

SEQ ID NO: 225048 - DNA, 23 bp, Homo sapiens
gggcttccatttgtgtgtgtgca

SEQ ID NO: 225049 - DNA, 12 bp, Homo sapiens
gggcttccctag

SEQ ID NO: 225050 - DNA, 18 bp, Homo sapiens
gggcttccctctgctcca

SEQ ID NO: 225051 - DNA, 14 bp, Homo sapiens
gggcttggaagggc

SEQ ID NO: 225052 - DNA, 17 bp, Homo sapiens
gggcttggagcagagac

SEQ ID NO: 225053 - DNA, 14 bp, Homo sapiens
gggcttggcgtgga

SEQ ID NO: 225054 - DNA, 19 bp, Homo sapiens
gggcttggggtagagagga

SEQ ID NO: 225055 - DNA, 20 bp, Homo sapiens
gggcttggggtagagaggac

SEQ ID NO: 225056 - DNA, 14 bp, Homo sapiens
gggctttgcaggct

SEQ ID NO: 225057 - DNA, 16 bp, Homo sapiens
gggcttttatttttta

SEQ ID NO: 225058 - DNA, 21 bp, Homo sapiens
gggcttttctttagtggagaa

SEQ ID NO: 225059 - DNA, 21 bp, Homo sapiens
ggggaagactttaaagtataa

SEQ ID NO: 225060 - DNA, 16 bp, Homo sapiens
ggggaagagagcctgc

SEQ ID NO: 225061 - DNA, 23 bp, Homo sapiens
ggggaagatgaaaccgtccctga

SEQ ID NO: 225062 - DNA, 14 bp, Homo sapiens
ggggaaggaccaac

SEQ ID NO: 225063 - DNA, 21 bp, Homo sapiens
ggggaagggaaccagccctcc

SEQ ID NO: 225064 - DNA, 23 bp, Homo sapiens
ggggaagggccagtctgggctgc

SEQ ID NO: 225065 - DNA, 23 bp, Homo sapiens
ggggacgctggtagagatggagg

SEQ ID NO: 225066 - DNA, 16 bp, Homo sapiens
ggggactcagccctga

SEQ ID NO: 225067 - DNA, 18 bp, Homo sapiens
ggggactgcatgcaagct

SEQ ID NO: 225068 - DNA, 18 bp, Homo sapiens
ggggactgggggactggg

SEQ ID NO: 225069 - DNA, 14 bp, Homo sapiens
ggggactgtctttc

SEQ ID NO: 225070 - DNA, 19 bp, Homo sapiens
ggggacttgtaggaatctg

SEQ ID NO: 225071 - DNA, 13 bp, Homo sapiens
ggggagaagagcc

SEQ ID NO: 225072 - DNA, 14 bp, Homo sapiens
ggggagaatggctc

SEQ ID NO: 225073 - DNA, 13 bp, Homo sapiens
ggggagaggaagc

SEQ ID NO: 225074 - DNA, 12 bp, Homo sapiens
ggggagcctgga

SEQ ID NO: 225075 - DNA, 14 bp, Homo sapiens
ggggagctggtggg

SEQ ID NO: 225076 - DNA, 18 bp, Homo sapiens
ggggaggaaactcacctg

SEQ ID NO: 225077 - DNA, 13 bp, Homo sapiens
ggggaggagcacc

SEQ ID NO: 225078 - DNA, 15 bp, Homo sapiens
ggggaggagcacccc

SEQ ID NO: 225079 - DNA, 13 bp, Homo sapiens
ggggaggagcctt

SEQ ID NO: 225080 - DNA, 13 bp, Homo sapiens
ggggaggccaagt

SEQ ID NO: 225081 - DNA, 13 bp, Homo sapiens
ggggaggctgaga

SEQ ID NO: 225082 - DNA, 17 bp, Homo sapiens
ggggaggctgagactgc

SEQ ID NO: 225083 - DNA, 13 bp, Homo sapiens
ggggagggagaga

SEQ ID NO: 225084 - DNA, 20 bp, Homo sapiens
ggggaggggcctagggagcc

SEQ ID NO: 225085 - DNA, 12 bp, Homo sapiens
ggggagtgagct

SEQ ID NO: 225086 - DNA, 20 bp, Homo sapiens
ggggatcccgtgctggaaga

SEQ ID NO: 225087 - DNA, 16 bp, Homo sapiens
ggggatcctggagccc

SEQ ID NO: 225088 - DNA, 18 bp, Homo sapiens
ggggatctaaaaggagga

SEQ ID NO: 225089 - DNA, 23 bp, Homo sapiens
ggggatggagaatgccagcccaa

SEQ ID NO: 225090 - DNA, 19 bp, Homo sapiens
ggggcaagagctcaggaga

SEQ ID NO: 225091 - DNA, 20 bp, Homo sapiens
ggggcaagagctcaggagaa

SEQ ID NO: 225092 - DNA, 14 bp, Homo sapiens
ggggcaaggtctcc

SEQ ID NO: 225093 - DNA, 15 bp, Homo sapiens
ggggcaaggtctcct

SEQ ID NO: 225094 - DNA, 22 bp, Homo sapiens
ggggcacaccactgccctgcct

SEQ ID NO: 225095 - DNA, 13 bp, Homo sapiens
ggggcacagccag

SEQ ID NO: 225096 - DNA, 14 bp, Homo sapiens
ggggcacagccaga

SEQ ID NO: 225097 - DNA, 16 bp, Homo sapiens
ggggcagaggggcagc

SEQ ID NO: 225098 - DNA, 14 bp, Homo sapiens
ggggcagctgccag

SEQ ID NO: 225099 - DNA, 12 bp, Homo sapiens
ggtagagaggac

SEQ ID NO: 225100 - DNA, 17 bp, Homo sapiens
ggtagagaggggactgg

SEQ ID NO: 225101 - DNA, 18 bp, Homo sapiens
ggtagagaggggactggg

SEQ ID NO: 225102 - DNA, 19 bp, Homo sapiens
ggtagagattcattatttt

SEQ ID NO: 225103 - DNA, 18 bp, Homo sapiens
ggtagagcaaaggagaca

SEQ ID NO: 225104 - DNA, 15 bp, Homo sapiens
ggtagagctgatcca

SEQ ID NO: 225105 - DNA, 18 bp, Homo sapiens
ggtagatcgcttgagccc

SEQ ID NO: 225106 - DNA, 20 bp, Homo sapiens
ggtagatcgcttgagcccag

SEQ ID NO: 225107 - DNA, 15 bp, Homo sapiens
ggtagcatgaccttt

SEQ ID NO: 225108 - DNA, 21 bp, Homo sapiens
ggtagcatgaccttttggcct

SEQ ID NO: 225109 - DNA, 20 bp, Homo sapiens
ggtagcctggcttttctggc

SEQ ID NO: 225110 - DNA, 13 bp, Homo sapiens
ggtagctctgagc

SEQ ID NO: 225111 - DNA, 14 bp, Homo sapiens
ggtagctctgagcc

SEQ ID NO: 225112 - DNA, 18 bp, Homo sapiens
ggtaggaaaccaccctga

SEQ ID NO: 225113 - DNA, 16 bp, Homo sapiens
ggtaggcaaggctgcc

SEQ ID NO: 225114 - DNA, 14 bp, Homo sapiens
ggtaggcccttgtc

SEQ ID NO: 225115 - DNA, 13 bp, Homo sapiens
ggtagggggcctg

SEQ ID NO: 225116 - DNA, 16 bp, Homo sapiens
ggtaggttctgtctgt

SEQ ID NO: 225117 - DNA, 19 bp, Homo sapiens
ggtagttagtagcatgttg

SEQ ID NO: 225118 - DNA, 18 bp, Homo sapiens
ggtagttctgtgcctccc

SEQ ID NO: 225119 - DNA, 16 bp, Homo sapiens
ggtataaaaaataagt

SEQ ID NO: 225120 - DNA, 21 bp, Homo sapiens
ggtataaaactttcctcgcct

SEQ ID NO: 225121 - DNA, 22 bp, Homo sapiens
ggtataaaactttcctcgcctg

SEQ ID NO: 225122 - DNA, 15 bp, Homo sapiens
ggtatcctgcccagt

SEQ ID NO: 225123 - DNA, 16 bp, Homo sapiens
ggtatgaacttgagga

SEQ ID NO: 225124 - DNA, 23 bp, Homo sapiens
ttattttataattttaaaattgc

SEQ ID NO: 225125 - DNA, 17 bp, Homo sapiens
ttattttattattcaga

SEQ ID NO: 225126 - DNA, 19 bp, Homo sapiens
ttattttcagtatactgtg

SEQ ID NO: 225127 - DNA, 14 bp, Homo sapiens
ttattttcagtatt

SEQ ID NO: 225128 - DNA, 14 bp, Homo sapiens
ttattttcctcccc

SEQ ID NO: 225129 - DNA, 15 bp, Homo sapiens
ttattttcctcccca

SEQ ID NO: 225130 - DNA, 14 bp, Homo sapiens
ttattttcctgtct

SEQ ID NO: 225131 - DNA, 13 bp, Homo sapiens
ttattttctgaat

SEQ ID NO: 225132 - DNA, 21 bp, Homo sapiens
ttattttctggtagatagaaa

SEQ ID NO: 225133 - DNA, 20 bp, Homo sapiens
ttattttgactgtgatttat

SEQ ID NO: 225134 - DNA, 15 bp, Homo sapiens
ttatttttatttatt

SEQ ID NO: 225135 - DNA, 19 bp, Homo sapiens
ttatttttcatattgtgcc

SEQ ID NO: 225136 - DNA, 11 bp, Homo sapiens
ttatttttgta

SEQ ID NO: 225137 - DNA, 16 bp, Homo sapiens
ttatttttgtactgtg

SEQ ID NO: 225138 - DNA, 14 bp, Homo sapiens
ttattttttacatt

SEQ ID NO: 225139 - DNA, 14 bp, Homo sapiens
ttcaaaaagtgttt

SEQ ID NO: 225140 - DNA, 15 bp, Homo sapiens
ttcaaaaatataact

SEQ ID NO: 225141 - DNA, 17 bp, Homo sapiens
ttcaaaactagttctta

SEQ ID NO: 225142 - DNA, 16 bp, Homo sapiens
ttcaaaagaagagttt

SEQ ID NO: 225143 - DNA, 23 bp, Homo sapiens
ttcaaaagcacaaaccctgggga

SEQ ID NO: 225144 - DNA, 21 bp, Homo sapiens
ttcaaaagccataacttgaaa

SEQ ID NO: 225145 - DNA, 13 bp, Homo sapiens
ttcaaaatccttc

SEQ ID NO: 225146 - DNA, 16 bp, Homo sapiens
ttcaaaatccttccaa

SEQ ID NO: 225147 - DNA, 17 bp, Homo sapiens
ttcaaaatccttccaaa

SEQ ID NO: 225148 - DNA, 12 bp, Homo sapiens
ttcaaaatgcat

SEQ ID NO: 225149 - DNA, 16 bp, Homo sapiens
ttcaaaatggagggaa

SEQ ID NO: 225150 - DNA, 18 bp, Homo sapiens
ttcaaaatgtctgtagct

SEQ ID NO: 225151 - DNA, 12 bp, Homo sapiens
ttcaaaatgtta

SEQ ID NO: 225152 - DNA, 13 bp, Homo sapiens
ttcaaaatgttaa

SEQ ID NO: 225153 - DNA, 23 bp, Homo sapiens
ttcaaaatgttaataaaggtttc

SEQ ID NO: 225154 - DNA, 16 bp, Homo sapiens
ttcaaacctgcatatt

SEQ ID NO: 225155 - DNA, 17 bp, Homo sapiens
ttcaaactactgtacat

SEQ ID NO: 225156 - DNA, 20 bp, Homo sapiens
ttcaaactactgtacatttt

SEQ ID NO: 225157 - DNA, 21 bp, Homo sapiens
ttcaaagaacccccctcccca

SEQ ID NO: 225158 - DNA, 16 bp, Homo sapiens
ttcaaagcttgaagat

SEQ ID NO: 225159 - DNA, 20 bp, Homo sapiens
ttcaaagtactaaaactaga

SEQ ID NO: 225160 - DNA, 13 bp, Homo sapiens
ttcaaatactttt

SEQ ID NO: 225161 - DNA, 15 bp, Homo sapiens
ttcaaatcagagcag

SEQ ID NO: 225162 - DNA, 13 bp, Homo sapiens
ttcaaatcagcaa

SEQ ID NO: 225163 - DNA, 23 bp, Homo sapiens
ttcaaatcagcaagcttgtagct

SEQ ID NO: 225164 - DNA, 15 bp, Homo sapiens
ttcaaatccttccaa

SEQ ID NO: 225165 - DNA, 16 bp, Homo sapiens
ttcaaatccttccaaa

SEQ ID NO: 225166 - DNA, 17 bp, Homo sapiens
ttcaaatccttccaaaa

SEQ ID NO: 225167 - DNA, 22 bp, Homo sapiens
ttcaaatgatttttacaagttt

SEQ ID NO: 225168 - DNA, 11 bp, Homo sapiens
ttcaaatgcat

SEQ ID NO: 225169 - DNA, 13 bp, Homo sapiens
ttcaaatgcatga

SEQ ID NO: 225170 - DNA, 21 bp, Homo sapiens
ttcaaatgttagagtttaatt

SEQ ID NO: 225171 - DNA, 23 bp, Homo sapiens
ttcaaatgttagagtttaatttt

SEQ ID NO: 225172 - DNA, 15 bp, Homo sapiens
ttcaacacttatttt

SEQ ID NO: 225173 - DNA, 20 bp, Homo sapiens
ttcaacctagaaacctttat

SEQ ID NO: 225174 - DNA, 20 bp, Homo sapiens
ttcaacctcagccctgaaaa

SEQ ID NO: 225175 - DNA, 15 bp, Homo sapiens
ttcaacgcagccctg

SEQ ID NO: 225176 - DNA, 16 bp, Homo sapiens
ttcaacgcagccctgc

SEQ ID NO: 225177 - DNA, 14 bp, Homo sapiens
ttcaacttaaatca

SEQ ID NO: 225178 - DNA, 18 bp, Homo sapiens
ttcaacttaaatcactga

SEQ ID NO: 225179 - DNA, 22 bp, Homo sapiens
ttcaagaaaacaacttcaatat

SEQ ID NO: 225180 - DNA, 12 bp, Homo sapiens
ttcaagaaataa

SEQ ID NO: 225181 - DNA, 21 bp, Homo sapiens
ttcaagacttgagcggagccc

SEQ ID NO: 225182 - DNA, 14 bp, Homo sapiens
ttcaagatccaaat

SEQ ID NO: 225183 - DNA, 16 bp, Homo sapiens
ttcaagatgcctcttc

SEQ ID NO: 225184 - DNA, 21 bp, Homo sapiens
ttcaagattggacatggtctc

SEQ ID NO: 225185 - DNA, 19 bp, Homo sapiens
ttcaaggagatataaaatc

SEQ ID NO: 225186 - DNA, 15 bp, Homo sapiens
ttcaagggaagaaac

SEQ ID NO: 225187 - DNA, 21 bp, Homo sapiens
ttcaagggaagaaacactctt

SEQ ID NO: 225188 - DNA, 19 bp, Homo sapiens
ttcaagggttgcttctgag

SEQ ID NO: 225189 - DNA, 23 bp, Homo sapiens
ttcaaggtccgagctctgtcctc

SEQ ID NO: 225190 - DNA, 22 bp, Homo sapiens
ttcaaggtggccaaattatttg

SEQ ID NO: 225191 - DNA, 19 bp, Homo sapiens
ttcaagtcgcggctgcagg

SEQ ID NO: 225192 - DNA, 23 bp, Homo sapiens
ttcaagtgcctttctgcagtttt

SEQ ID NO: 225193 - DNA, 17 bp, Homo sapiens
ttcaataaagaaaaaaa

SEQ ID NO: 225194 - DNA, 12 bp, Homo sapiens
ttcaataaagct

SEQ ID NO: 225195 - DNA, 19 bp, Homo sapiens
ttcaataaatctttggaaa

SEQ ID NO: 225196 - DNA, 16 bp, Homo sapiens
ttcaataataaatatt

SEQ ID NO: 225197 - DNA, 22 bp, Homo sapiens
ttcaataatagacttatatgca

SEQ ID NO: 225198 - DNA, 22 bp, Homo sapiens
ttcaatcctgtcaatgtttgct

SEQ ID NO: 225199 - DNA, 13 bp, Homo sapiens
ttcaatctctgtt

SEQ ID NO: 225200 - DNA, 17 bp, Homo sapiens
ttcaatgacctgtattt

SEQ ID NO: 225201 - DNA, 18 bp, Homo sapiens
ttcaatggttgggacaat

SEQ ID NO: 225202 - DNA, 21 bp, Homo sapiens
ttcaattacaaagcagttact

SEQ ID NO: 225203 - DNA, 16 bp, Homo sapiens
ttcaattcctctggga

SEQ ID NO: 225204 - DNA, 20 bp, Homo sapiens
ttcaattgcagatgccaaaa

SEQ ID NO: 225205 - DNA, 20 bp, Homo sapiens
ttcaatttactttttaaaca

SEQ ID NO: 225206 - DNA, 21 bp, Homo sapiens
ttcaatttactttttaaacag

SEQ ID NO: 225207 - DNA, 22 bp, Homo sapiens
ttcaatttactttttaaacagt

SEQ ID NO: 225208 - DNA, 12 bp, Homo sapiens
ttcaatttgaaa

SEQ ID NO: 225209 - DNA, 17 bp, Homo sapiens
ttcacaaacagtaaagg

SEQ ID NO: 225210 - DNA, 13 bp, Homo sapiens
ttcacaagctgcc

SEQ ID NO: 225211 - DNA, 14 bp, Homo sapiens
ttcacaagctgcct

SEQ ID NO: 225212 - DNA, 19 bp, Homo sapiens
ttcacaagctgcctccctg

SEQ ID NO: 225213 - DNA, 15 bp, Homo sapiens
ttcacaagttaagat

SEQ ID NO: 225214 - DNA, 12 bp, Homo sapiens
ttcacacacagc

SEQ ID NO: 225215 - DNA, 14 bp, Homo sapiens
ttcacacagacaag

SEQ ID NO: 225216 - DNA, 21 bp, Homo sapiens
ttcacaccagtcacacattat

SEQ ID NO: 225217 - DNA, 13 bp, Homo sapiens
ttcacaccctgca

SEQ ID NO: 225218 - DNA, 15 bp, Homo sapiens
ttcacaccctgcaag

SEQ ID NO: 225219 - DNA, 23 bp, Homo sapiens
ttcacacctcacgctctggacat

SEQ ID NO: 225220 - DNA, 22 bp, Homo sapiens
ttcacactgtgcgttttagagt

SEQ ID NO: 225221 - DNA, 15 bp, Homo sapiens
ttcacagctctgtgt

SEQ ID NO: 225222 - DNA, 18 bp, Homo sapiens
ttcacagtaccatctgaa

SEQ ID NO: 225223 - DNA, 17 bp, Homo sapiens
ttcacataccctccccc

SEQ ID NO: 225224 - DNA, 17 bp, Homo sapiens
ttcacatagatgtccct

SEQ ID NO: 225225 - DNA, 20 bp, Homo sapiens
ttcacatttcaagatccaaa

SEQ ID NO: 225226 - DNA, 18 bp, Homo sapiens
ttcaccaacaacagtcag

SEQ ID NO: 225227 - DNA, 21 bp, Homo sapiens
ttcaccaacaacagtcagcca

SEQ ID NO: 225228 - DNA, 11 bp, Homo sapiens
ttcaccaccct

SEQ ID NO: 225229 - DNA, 23 bp, Homo sapiens
ggtggggagcccaggcctggcct

SEQ ID NO: 225230 - DNA, 15 bp, Homo sapiens
ggtggggcttggaag

SEQ ID NO: 225231 - DNA, 14 bp, Homo sapiens
ggtgggggagcctg

SEQ ID NO: 225232 - DNA, 15 bp, Homo sapiens
ggtgggggagcctgg

SEQ ID NO: 225233 - DNA, 13 bp, Homo sapiens
ggtgggggagggg

SEQ ID NO: 225234 - DNA, 21 bp, Homo sapiens
ggtgggggcctgctgtgggtc

SEQ ID NO: 225235 - DNA, 18 bp, Homo sapiens
ggtgggtatcccacctcc

SEQ ID NO: 225236 - DNA, 23 bp, Homo sapiens
ggtgggtatcccacctccagccc

SEQ ID NO: 225237 - DNA, 18 bp, Homo sapiens
ggtgggtggagtcaggct

SEQ ID NO: 225238 - DNA, 22 bp, Homo sapiens
ggtggtactttattcttgctgg

SEQ ID NO: 225239 - DNA, 18 bp, Homo sapiens
ggtggtagctctgagccc

SEQ ID NO: 225240 - DNA, 21 bp, Homo sapiens
ggtggtcagcagaaaccccca

SEQ ID NO: 225241 - DNA, 20 bp, Homo sapiens
ggtggtcttggagaggaggt

SEQ ID NO: 225242 - DNA, 17 bp, Homo sapiens
ggtggtgcagccccagg

SEQ ID NO: 225243 - DNA, 20 bp, Homo sapiens
ggtggtgctgggactgagcc

SEQ ID NO: 225244 - DNA, 19 bp, Homo sapiens
ggtggtgtccttcttcctc

SEQ ID NO: 225245 - DNA, 15 bp, Homo sapiens
ggtggttggaggcct

SEQ ID NO: 225246 - DNA, 17 bp, Homo sapiens
ggtgtatttattttcct

SEQ ID NO: 225247 - DNA, 22 bp, Homo sapiens
ggtgtatttattttcctcccca

SEQ ID NO: 225248 - DNA, 17 bp, Homo sapiens
ggtgtcacagaggcagt

SEQ ID NO: 225249 - DNA, 23 bp, Homo sapiens
ggtgtcacatggggcctggccca

SEQ ID NO: 225250 - DNA, 17 bp, Homo sapiens
ggtgtcaccctgcagag

SEQ ID NO: 225251 - DNA, 17 bp, Homo sapiens
ggtgtcactctgcctct

SEQ ID NO: 225252 - DNA, 16 bp, Homo sapiens
ggtgtccccttcccct

SEQ ID NO: 225253 - DNA, 20 bp, Homo sapiens
ggtgtccccttcccctgctg

SEQ ID NO: 225254 - DNA, 23 bp, Homo sapiens
ggtgtccccttcccctgctgacc

SEQ ID NO: 225255 - DNA, 20 bp, Homo sapiens
ggtgtctcactctttcttct

SEQ ID NO: 225256 - DNA, 24 bp, Homo sapiens
ggtgtcttttaatgatactgtcta

SEQ ID NO: 225257 - DNA, 20 bp, Homo sapiens
ggtgtgaggcccccggaggc

SEQ ID NO: 225258 - DNA, 17 bp, Homo sapiens
ggtgtgatagagccttt

SEQ ID NO: 225259 - DNA, 15 bp, Homo sapiens
ggtgtgcacatctct

SEQ ID NO: 225260 - DNA, 16 bp, Homo sapiens
ggtgtgcacatctctg

SEQ ID NO: 225261 - DNA, 18 bp, Homo sapiens
ggtgtgcacatctctgct

SEQ ID NO: 225262 - DNA, 23 bp, Homo sapiens
ggtgtgccacaggctgcaagctg

SEQ ID NO: 225263 - DNA, 22 bp, Homo sapiens
ggtgtgtgccatcatgcctgac

SEQ ID NO: 225264 - DNA, 19 bp, Homo sapiens
ggtgtgtggccgcctggca

SEQ ID NO: 225265 - DNA, 21 bp, Homo sapiens
ggtgtgtttcaggacagctgc

SEQ ID NO: 225266 - DNA, 18 bp, Homo sapiens
ggtgttagtacctagtgg

SEQ ID NO: 225267 - DNA, 22 bp, Homo sapiens
ggtgttccaaagagaaggcctg

SEQ ID NO: 225268 - DNA, 18 bp, Homo sapiens
ttcatcctgttggctgct

SEQ ID NO: 225269 - DNA, 14 bp, Homo sapiens
ttcatctccaggga

SEQ ID NO: 225270 - DNA, 11 bp, Homo sapiens
ttcatcttgaa

SEQ ID NO: 225271 - DNA, 18 bp, Homo sapiens
ttcatcttgagcctgagc

SEQ ID NO: 225272 - DNA, 22 bp, Homo sapiens
ttcatctttcctttgctctgga

SEQ ID NO: 225273 - DNA, 16 bp, Homo sapiens
ttcatgaaaatcctac

SEQ ID NO: 225274 - DNA, 16 bp, Homo sapiens
ttcatgattagacaat

SEQ ID NO: 225275 - DNA, 18 bp, Homo sapiens
ttcatgattagacaatgt

SEQ ID NO: 225276 - DNA, 17 bp, Homo sapiens
ttcatgatttcatttca

SEQ ID NO: 225277 - DNA, 21 bp, Homo sapiens
ttcatgcaatgacatcttcaa

SEQ ID NO: 225278 - DNA, 18 bp, Homo sapiens
ttcatgcctttgtaagtt

SEQ ID NO: 225279 - DNA, 13 bp, Homo sapiens
ttcatgcttttct

SEQ ID NO: 225280 - DNA, 17 bp, Homo sapiens
ttcatgcttttctcatg

SEQ ID NO: 225281 - DNA, 23 bp, Homo sapiens
ttcatggcacccgggaatgactt

SEQ ID NO: 225282 - DNA, 13 bp, Homo sapiens
ttcatgggcacct

SEQ ID NO: 225283 - DNA, 14 bp, Homo sapiens
ttcatgtaaataaa

SEQ ID NO: 225284 - DNA, 20 bp, Homo sapiens
ttcatgtagaactcagcagt

SEQ ID NO: 225285 - DNA, 22 bp, Homo sapiens
ttcatgtgttgcaaattattct

SEQ ID NO: 225286 - DNA, 15 bp, Homo sapiens
ttcatgtttgtaaat

SEQ ID NO: 225287 - DNA, 15 bp, Homo sapiens
ttcatgttttgctaa

SEQ ID NO: 225288 - DNA, 13 bp, Homo sapiens
ttcattaaagaaa

SEQ ID NO: 225289 - DNA, 16 bp, Homo sapiens
ttcattaaagaaaaac

SEQ ID NO: 225290 - DNA, 17 bp, Homo sapiens
ttcattaaccaaagaaa

SEQ ID NO: 225291 - DNA, 18 bp, Homo sapiens
ttcattattggaattaac

SEQ ID NO: 225292 - DNA, 15 bp, Homo sapiens
ttcattattttgtgg

SEQ ID NO: 225293 - DNA, 16 bp, Homo sapiens
ttcattattttgtggt

SEQ ID NO: 225294 - DNA, 24 bp, Homo sapiens
ttcattcaatcaacctgcacttca

SEQ ID NO: 225295 - DNA, 16 bp, Homo sapiens
ttcattcatatcctcc

SEQ ID NO: 225296 - DNA, 14 bp, Homo sapiens
ttcattcattcact

SEQ ID NO: 225297 - DNA, 12 bp, Homo sapiens
ttcattccgtta

SEQ ID NO: 225298 - DNA, 19 bp, Homo sapiens
ttcattctccgttgtcatt

SEQ ID NO: 225299 - DNA, 17 bp, Homo sapiens
ttcattctgtgatcatt

SEQ ID NO: 225300 - DNA, 22 bp, Homo sapiens
ttcattgctacacttacaagta

SEQ ID NO: 225301 - DNA, 19 bp, Homo sapiens
ttcattgctgtgtcacact

SEQ ID NO: 225302 - DNA, 13 bp, Homo sapiens
ttcattggatgca

SEQ ID NO: 225303 - DNA, 15 bp, Homo sapiens
ttcatttaaaatgat

SEQ ID NO: 225304 - DNA, 16 bp, Homo sapiens
ttcatttatcaagcag

SEQ ID NO: 225305 - DNA, 15 bp, Homo sapiens
ttcatttcattgtat

SEQ ID NO: 225306 - DNA, 17 bp, Homo sapiens
ttcatttcctctgagct

SEQ ID NO: 225307 - DNA, 21 bp, Homo sapiens
ttcatttcctctgagctgtta

SEQ ID NO: 225308 - DNA, 20 bp, Homo sapiens
ttcatttctgtctcccctac

SEQ ID NO: 225309 - DNA, 16 bp, Homo sapiens
ttcatttgatgctaaa

SEQ ID NO: 225310 - DNA, 13 bp, Homo sapiens
ttcattttctctc

SEQ ID NO: 225311 - DNA, 16 bp, Homo sapiens
ttcattttggttttgt

SEQ ID NO: 225312 - DNA, 15 bp, Homo sapiens
ttcatttttcctaac

SEQ ID NO: 225313 - DNA, 21 bp, Homo sapiens
ttccaaaaagattttcagaaa

SEQ ID NO: 225314 - DNA, 15 bp, Homo sapiens
ttccaaaaattatta

SEQ ID NO: 225315 - DNA, 18 bp, Homo sapiens
ttccaaaattccatccct

SEQ ID NO: 225316 - DNA, 16 bp, Homo sapiens
ttccaaaattcttatt

SEQ ID NO: 225317 - DNA, 20 bp, Homo sapiens
ttccaaaattcttatttttc

SEQ ID NO: 225318 - DNA, 17 bp, Homo sapiens
ttccaaataaaacttga

SEQ ID NO: 225319 - DNA, 22 bp, Homo sapiens
ttccaaataaaacttgagccca

SEQ ID NO: 225320 - DNA, 15 bp, Homo sapiens
ttccaaataaaatga

SEQ ID NO: 225321 - DNA, 18 bp, Homo sapiens
ttccaaatacattccagt

SEQ ID NO: 225322 - DNA, 15 bp, Homo sapiens
ttccaaattgatggg

SEQ ID NO: 225323 - DNA, 20 bp, Homo sapiens
ttccaacaaacttactgtca

SEQ ID NO: 225324 - DNA, 16 bp, Homo sapiens
ttccaacagttaaact

SEQ ID NO: 225325 - DNA, 13 bp, Homo sapiens
ttccaaccaggca

SEQ ID NO: 225326 - DNA, 15 bp, Homo sapiens
ttccaaccaggcagt

SEQ ID NO: 225327 - DNA, 23 bp, Homo sapiens
ttccaagacagttgtatcacaaa

SEQ ID NO: 225328 - DNA, 12 bp, Homo sapiens
ttccaagacatt

SEQ ID NO: 225329 - DNA, 19 bp, Homo sapiens
ttccaagacattgtcaata

SEQ ID NO: 225330 - DNA, 20 bp, Homo sapiens
ttccaagacattgtcaataa

SEQ ID NO: 225331 - DNA, 13 bp, Homo sapiens
ttccaagcccttc

SEQ ID NO: 225332 - DNA, 19 bp, Homo sapiens
ttccaagcccttccctctg

SEQ ID NO: 225333 - DNA, 16 bp, Homo sapiens
ttccaagcctgggcca

SEQ ID NO: 225334 - DNA, 21 bp, Homo sapiens
ttccaagggtatgggaagcca

SEQ ID NO: 225335 - DNA, 23 bp, Homo sapiens
ttccaagggtatgggaagccata

SEQ ID NO: 225336 - DNA, 15 bp, Homo sapiens
ttccaagtcttcctg

SEQ ID NO: 225337 - DNA, 16 bp, Homo sapiens
ttccaagtgtgtgtgc

SEQ ID NO: 225338 - DNA, 17 bp, Homo sapiens
ttccaagtgtgtgtgca

SEQ ID NO: 225339 - DNA, 18 bp, Homo sapiens
ttccaagtgtgtgtgcaa

SEQ ID NO: 225340 - DNA, 13 bp, Homo sapiens
ttccaataaacca

SEQ ID NO: 225341 - DNA, 15 bp, Homo sapiens
ttccaatcctggctc

SEQ ID NO: 225342 - DNA, 14 bp, Homo sapiens
ttccaatgtgccca

SEQ ID NO: 225343 - DNA, 21 bp, Homo sapiens
ttccaatgtgcccagtcatga

SEQ ID NO: 225344 - DNA, 18 bp, Homo sapiens
ttccacaaaatctgtcca

SEQ ID NO: 225345 - DNA, 13 bp, Homo sapiens
ttccacacagcct

SEQ ID NO: 225346 - DNA, 12 bp, Homo sapiens
ttccacacaggc

SEQ ID NO: 225347 - DNA, 16 bp, Homo sapiens
ttccacacaggcccat

SEQ ID NO: 225348 - DNA, 14 bp, Homo sapiens
ttccacacatttaa

SEQ ID NO: 225349 - DNA, 15 bp, Homo sapiens
ttccacatgctctga

SEQ ID NO: 225350 - DNA, 16 bp, Homo sapiens
ttccacatgctctgag

SEQ ID NO: 225351 - DNA, 15 bp, Homo sapiens
ttccaccccctccct

SEQ ID NO: 225352 - DNA, 18 bp, Homo sapiens
ttccaccccctccctggc

SEQ ID NO: 225353 - DNA, 18 bp, Homo sapiens
ttccacctcacaactcct

SEQ ID NO: 225354 - DNA, 15 bp, Homo sapiens
ttccacctccctccc

SEQ ID NO: 225355 - DNA, 16 bp, Homo sapiens
ttccaccttaaattaa

SEQ ID NO: 225356 - DNA, 23 bp, Homo sapiens
ttccaccttaccctactggctgt

SEQ ID NO: 225357 - DNA, 18 bp, Homo sapiens
ttccacggaaacagaact

SEQ ID NO: 225358 - DNA, 23 bp, Homo sapiens
ttccacgtaattcaatttctcac

SEQ ID NO: 225359 - DNA, 21 bp, Homo sapiens
ttcctggattttctttctatg

SEQ ID NO: 225360 - DNA, 23 bp, Homo sapiens
ttcctggattttctttctatgta

SEQ ID NO: 225361 - DNA, 20 bp, Homo sapiens
ttcctggcaatagtgtgttc

SEQ ID NO: 225362 - DNA, 22 bp, Homo sapiens
ttcctggcaatagtgtgttctg

SEQ ID NO: 225363 - DNA, 23 bp, Homo sapiens
ttcctggccccgggctctggcca

SEQ ID NO: 225364 - DNA, 22 bp, Homo sapiens
ttcctggcctcactggctgggg

SEQ ID NO: 225365 - DNA, 21 bp, Homo sapiens
ttcctggcctcagccagctgc

SEQ ID NO: 225366 - DNA, 18 bp, Homo sapiens
ttcctgggagtgggagtc

SEQ ID NO: 225367 - DNA, 16 bp, Homo sapiens
ttcctgggcagcccag

SEQ ID NO: 225368 - DNA, 19 bp, Homo sapiens
ttcctgggcagcccagaga

SEQ ID NO: 225369 - DNA, 14 bp, Homo sapiens
ttcctgggcctgtc

SEQ ID NO: 225370 - DNA, 14 bp, Homo sapiens
ttcctgggccttct

SEQ ID NO: 225371 - DNA, 21 bp, Homo sapiens
ttcctgggccttctcagctct

SEQ ID NO: 225372 - DNA, 22 bp, Homo sapiens
ttcctgggccttctcagctctc

SEQ ID NO: 225373 - DNA, 20 bp, Homo sapiens
ttcctggggtgccctccact

SEQ ID NO: 225374 - DNA, 20 bp, Homo sapiens
ttcctggtcaaagctcctta

SEQ ID NO: 225375 - DNA, 12 bp, Homo sapiens
ttcctggtgagg

SEQ ID NO: 225376 - DNA, 15 bp, Homo sapiens
ttcctgtccagagag

SEQ ID NO: 225377 - DNA, 15 bp, Homo sapiens
ttcctgtcctgctca

SEQ ID NO: 225378 - DNA, 22 bp, Homo sapiens
ttcctgtgcccatcatctctgc

SEQ ID NO: 225379 - DNA, 14 bp, Homo sapiens
ttcctgtgtccaca

SEQ ID NO: 225380 - DNA, 16 bp, Homo sapiens
ttcctgttctgtgtct

SEQ ID NO: 225381 - DNA, 15 bp, Homo sapiens
ttcctgtttctaagt

SEQ ID NO: 225382 - DNA, 16 bp, Homo sapiens
ttccttaaactgtgtg

SEQ ID NO: 225383 - DNA, 14 bp, Homo sapiens
ttccttaataaatt

SEQ ID NO: 225384 - DNA, 16 bp, Homo sapiens
ttccttagcagctcag

SEQ ID NO: 225385 - DNA, 19 bp, Homo sapiens
ttccttaggcttaagagag

SEQ ID NO: 225386 - DNA, 23 bp, Homo sapiens
ttccttcaccacctcatgtcatt

SEQ ID NO: 225387 - DNA, 14 bp, Homo sapiens
ttccttcctgccct

SEQ ID NO: 225388 - DNA, 14 bp, Homo sapiens
ttccttctcgtctt

SEQ ID NO: 225389 - DNA, 21 bp, Homo sapiens
ttccttctcgtcttcctctct

SEQ ID NO: 225390 - DNA, 20 bp, Homo sapiens
ttccttctctactcatgcca

SEQ ID NO: 225391 - DNA, 13 bp, Homo sapiens
ttccttctggcct

SEQ ID NO: 225392 - DNA, 14 bp, Homo sapiens
ttccttctggcctt

SEQ ID NO: 225393 - DNA, 15 bp, Homo sapiens
ttccttgaccttcct

SEQ ID NO: 225394 - DNA, 15 bp, Homo sapiens
ttccttgataatgtt

SEQ ID NO: 225395 - DNA, 11 bp, Homo sapiens
ttccttgctct

SEQ ID NO: 225396 - DNA, 15 bp, Homo sapiens
ttccttgcttttatg

SEQ ID NO: 225397 - DNA, 15 bp, Homo sapiens
ttccttggcccagca

SEQ ID NO: 225398 - DNA, 15 bp, Homo sapiens
ttcctttaaatactc

SEQ ID NO: 225399 - DNA, 20 bp, Homo sapiens
ttcctttacaactaaataac

SEQ ID NO: 225400 - DNA, 18 bp, Homo sapiens
ttcctttcatcctcagca

SEQ ID NO: 225401 - DNA, 20 bp, Homo sapiens
ttccttttctattccttctg

SEQ ID NO: 225402 - DNA, 23 bp, Homo sapiens
ttccttttctttctccctaacca

SEQ ID NO: 225403 - DNA, 14 bp, Homo sapiens
ttcgaagctcagcc

SEQ ID NO: 225404 - DNA, 17 bp, Homo sapiens
ttcgaccctttctctga

SEQ ID NO: 225405 - DNA, 20 bp, Homo sapiens
ttcgaccctttctctgagag

SEQ ID NO: 225406 - DNA, 19 bp, Homo sapiens
ttcgactgtgacctgtggg

SEQ ID NO: 225407 - DNA, 20 bp, Homo sapiens
ttcgatacaccgggcctgga

SEQ ID NO: 225408 - DNA, 18 bp, Homo sapiens
ttcgatctcattcagtat

SEQ ID NO: 225409 - DNA, 16 bp, Homo sapiens
ttcgatgtacagtctc

SEQ ID NO: 225410 - DNA, 16 bp, Homo sapiens
ttcgcagaacatgagt

SEQ ID NO: 225411 - DNA, 22 bp, Homo sapiens
ttcgccgtctggcgagccctta

SEQ ID NO: 225412 - DNA, 14 bp, Homo sapiens
ttcgctattcccag

SEQ ID NO: 225413 - DNA, 18 bp, Homo sapiens
ttcgctattcccaggcag

SEQ ID NO: 225414 - DNA, 14 bp, Homo sapiens
ttcgctgctctagc

SEQ ID NO: 225415 - DNA, 17 bp, Homo sapiens
ttcggaagggaaaacag

SEQ ID NO: 225416 - DNA, 22 bp, Homo sapiens
ttcggcaccttcccctgaggac

SEQ ID NO: 225417 - DNA, 22 bp, Homo sapiens
gtacagttcagttcctctttgc

SEQ ID NO: 225418 - DNA, 21 bp, Homo sapiens
gtacataaattgcataaagca

SEQ ID NO: 225419 - DNA, 16 bp, Homo sapiens
gtacatacattgtata

SEQ ID NO: 225420 - DNA, 18 bp, Homo sapiens
gtacatagtgaattttaa

SEQ ID NO: 225421 - DNA, 14 bp, Homo sapiens
gtacatctggcctt

SEQ ID NO: 225422 - DNA, 15 bp, Homo sapiens
gtacattccaactta

SEQ ID NO: 225423 - DNA, 13 bp, Homo sapiens
gtacattcctgat

SEQ ID NO: 225424 - DNA, 15 bp, Homo sapiens
gtacatttggagaca

SEQ ID NO: 225425 - DNA, 14 bp, Homo sapiens
gtaccaactgagcc

SEQ ID NO: 225426 - DNA, 21 bp, Homo sapiens
gtaccaatgctgttgtaaaca

SEQ ID NO: 225427 - DNA, 12 bp, Homo sapiens
gtaccacaggaa

SEQ ID NO: 225428 - DNA, 12 bp, Homo sapiens
gtaccactgcta

SEQ ID NO: 225429 - DNA, 23 bp, Homo sapiens
gtaccactgctaataaatgacca

SEQ ID NO: 225430 - DNA, 14 bp, Homo sapiens
gtaccaggccaccc

SEQ ID NO: 225431 - DNA, 21 bp, Homo sapiens
gtaccagtgttagtgggaaga

SEQ ID NO: 225432 - DNA, 11 bp, Homo sapiens
gtaccatcaat

SEQ ID NO: 225433 - DNA, 19 bp, Homo sapiens
gtaccatcccactgatatc

SEQ ID NO: 225434 - DNA, 22 bp, Homo sapiens
gtacccagccaccttcctgact

SEQ ID NO: 225435 - DNA, 14 bp, Homo sapiens
gtacccaggctggt

SEQ ID NO: 225436 - DNA, 21 bp, Homo sapiens
gtaccctcgactggcaataat

SEQ ID NO: 225437 - DNA, 11 bp, Homo sapiens
gtaccctgctt

SEQ ID NO: 225438 - DNA, 14 bp, Homo sapiens
gtacccttccacct

SEQ ID NO: 225439 - DNA, 20 bp, Homo sapiens
gtacccttccacctcctaga

SEQ ID NO: 225440 - DNA, 16 bp, Homo sapiens
gtacctctctctgctc

SEQ ID NO: 225441 - DNA, 18 bp, Homo sapiens
gtacctctctctgctcct

SEQ ID NO: 225442 - DNA, 23 bp, Homo sapiens
gtacctctctctgctcctcaccc

SEQ ID NO: 225443 - DNA, 19 bp, Homo sapiens
gtacctgcccccactcagc

SEQ ID NO: 225444 - DNA, 12 bp, Homo sapiens
gtacctgctgcc

SEQ ID NO: 225445 - DNA, 12 bp, Homo sapiens
gtacctgggaaa

SEQ ID NO: 225446 - DNA, 19 bp, Homo sapiens
gtacctgggaaaggaccca

SEQ ID NO: 225447 - DNA, 18 bp, Homo sapiens
gtacctgtaggaaacaga

SEQ ID NO: 225448 - DNA, 22 bp, Homo sapiens
gtacctttctgacaataaataa

SEQ ID NO: 225449 - DNA, 23 bp, Homo sapiens
gtacctttgctcttgcagagaag

SEQ ID NO: 225450 - DNA, 15 bp, Homo sapiens
gtacgtggagaggga

SEQ ID NO: 225451 - DNA, 21 bp, Homo sapiens
gtacgtgggtacccaggctgg

SEQ ID NO: 225452 - DNA, 14 bp, Homo sapiens
gtactaaggagaat

SEQ ID NO: 225453 - DNA, 14 bp, Homo sapiens
gtactacatttgca

SEQ ID NO: 225454 - DNA, 16 bp, Homo sapiens
gtactacatttgcatg

SEQ ID NO: 225455 - DNA, 19 bp, Homo sapiens
gtactagaagctgatctga

SEQ ID NO: 225456 - DNA, 16 bp, Homo sapiens
gtactatatctgtttt

SEQ ID NO: 225457 - DNA, 21 bp, Homo sapiens
gtactatatctgttttactgc

SEQ ID NO: 225458 - DNA, 14 bp, Homo sapiens
gtactcacttttca

SEQ ID NO: 225459 - DNA, 14 bp, Homo sapiens
gtactccagcctgg

SEQ ID NO: 225460 - DNA, 16 bp, Homo sapiens
gtactcccccagccct

SEQ ID NO: 225461 - DNA, 17 bp, Homo sapiens
gtactccttggatttgc

SEQ ID NO: 225462 - DNA, 16 bp, Homo sapiens
gtactctcacatgtgg

SEQ ID NO: 225463 - DNA, 14 bp, Homo sapiens
gtactctcctagag

SEQ ID NO: 225464 - DNA, 15 bp, Homo sapiens
gtactctctgctcta

SEQ ID NO: 225465 - DNA, 17 bp, Homo sapiens
gtactctctgctctagc

SEQ ID NO: 225466 - DNA, 22 bp, Homo sapiens
gtactctctgctctagccagga

SEQ ID NO: 225467 - DNA, 15 bp, Homo sapiens
gtactgagaggaggg

SEQ ID NO: 225468 - DNA, 12 bp, Homo sapiens
gtactgagattt

SEQ ID NO: 225469 - DNA, 17 bp, Homo sapiens
gtactgctttcaactta

SEQ ID NO: 225470 - DNA, 12 bp, Homo sapiens
gtactggccagt

SEQ ID NO: 225471 - DNA, 19 bp, Homo sapiens
gtactggccagtgtcattt

SEQ ID NO: 225472 - DNA, 14 bp, Homo sapiens
gtactgtgctgatt

SEQ ID NO: 225473 - DNA, 14 bp, Homo sapiens
gtacttaatatact

SEQ ID NO: 225474 - DNA, 15 bp, Homo sapiens
gtacttcctcctgat

SEQ ID NO: 225475 - DNA, 20 bp, Homo sapiens
gtacttcctcctgatggcca

SEQ ID NO: 225476 - DNA, 22 bp, Homo sapiens
gtacttcttcatccatagacac

SEQ ID NO: 225477 - DNA, 23 bp, Homo sapiens
gtacttcttcatccatagacaca

SEQ ID NO: 225478 - DNA, 21 bp, Homo sapiens
gtacttgctcaataaaggtca

SEQ ID NO: 225479 - DNA, 15 bp, Homo sapiens
gtacttgtgtttgct

SEQ ID NO: 225480 - DNA, 21 bp, Homo sapiens
gtactttgatttacagtgcct

SEQ ID NO: 225481 - DNA, 17 bp, Homo sapiens
gtactttgtttttccat

SEQ ID NO: 225482 - DNA, 17 bp, Homo sapiens
gtagaaataatatgcat

SEQ ID NO: 225483 - DNA, 21 bp, Homo sapiens
gtagaagaaagcaaaaaataa

SEQ ID NO: 225484 - DNA, 15 bp, Homo sapiens
gtagaagagggagaa

SEQ ID NO: 225485 - DNA, 16 bp, Homo sapiens
gtagaagatggactct

SEQ ID NO: 225486 - DNA, 23 bp, Homo sapiens
gtagacaatttgccttaggaagt

SEQ ID NO: 225487 - DNA, 15 bp, Homo sapiens
gtagacccctggctg

SEQ ID NO: 225488 - DNA, 16 bp, Homo sapiens
gtagacccctggctgg

SEQ ID NO: 225489 - DNA, 13 bp, Homo sapiens
acagatagttgtg

SEQ ID NO: 225490 - DNA, 14 bp, Homo sapiens
acagatcagaacat

SEQ ID NO: 225491 - DNA, 22 bp, Homo sapiens
acagatcccatccatcagctcc

SEQ ID NO: 225492 - DNA, 23 bp, Homo sapiens
acagatcccatccatcagctccc

SEQ ID NO: 225493 - DNA, 14 bp, Homo sapiens
acagatccgcatgt

SEQ ID NO: 225494 - DNA, 18 bp, Homo sapiens
acagatccgcatgtgtct

SEQ ID NO: 225495 - DNA, 12 bp, Homo sapiens
acagatcttgag

SEQ ID NO: 225496 - DNA, 14 bp, Homo sapiens
acagatcttgagca

SEQ ID NO: 225497 - DNA, 17 bp, Homo sapiens
acagatcttgagcaagg

SEQ ID NO: 225498 - DNA, 19 bp, Homo sapiens
acagatgaactctttctgg

SEQ ID NO: 225499 - DNA, 17 bp, Homo sapiens
acagatgagaagactag

SEQ ID NO: 225500 - DNA, 16 bp, Homo sapiens
acagatgctaataaac

SEQ ID NO: 225501 - DNA, 16 bp, Homo sapiens
acagatggatttgcct

SEQ ID NO: 225502 - DNA, 17 bp, Homo sapiens
acagatggatttgcctg

SEQ ID NO: 225503 - DNA, 18 bp, Homo sapiens
acagatggcacctgtggc

SEQ ID NO: 225504 - DNA, 19 bp, Homo sapiens
acagatggcacctgtggcc

SEQ ID NO: 225505 - DNA, 20 bp, Homo sapiens
acagatggcacctgtggcca

SEQ ID NO: 225506 - DNA, 16 bp, Homo sapiens
acagatggctgtgaaa

SEQ ID NO: 225507 - DNA, 16 bp, Homo sapiens
acagatgtatcatgat

SEQ ID NO: 225508 - DNA, 14 bp, Homo sapiens
acagatgtccctga

SEQ ID NO: 225509 - DNA, 19 bp, Homo sapiens
acagatgtgcccagagtag

SEQ ID NO: 225510 - DNA, 14 bp, Homo sapiens
acagatgttccatc

SEQ ID NO: 225511 - DNA, 20 bp, Homo sapiens
acagatgtttgttttcaaaa

SEQ ID NO: 225512 - DNA, 18 bp, Homo sapiens
acagattaaacttcacct

SEQ ID NO: 225513 - DNA, 21 bp, Homo sapiens
acagattaaacttcacctaca

SEQ ID NO: 225514 - DNA, 14 bp, Homo sapiens
acagattgcctcct

SEQ ID NO: 225515 - DNA, 15 bp, Homo sapiens
acagattgcctcctt

SEQ ID NO: 225516 - DNA, 13 bp, Homo sapiens
acagattgctgct

SEQ ID NO: 225517 - DNA, 17 bp, Homo sapiens
acagattgctgcttctg

SEQ ID NO: 225518 - DNA, 22 bp, Homo sapiens
acagcaaataaccattggttaa

SEQ ID NO: 225519 - DNA, 12 bp, Homo sapiens
acagcacatgct

SEQ ID NO: 225520 - DNA, 21 bp, Homo sapiens
acagcacctcctctctgctgg

SEQ ID NO: 225521 - DNA, 23 bp, Homo sapiens
acagcacgggcacagctgctgtg

SEQ ID NO: 225522 - DNA, 13 bp, Homo sapiens
acagcactactct

SEQ ID NO: 225523 - DNA, 13 bp, Homo sapiens
acagcagcctgct

SEQ ID NO: 225524 - DNA, 12 bp, Homo sapiens
acagcagcctgt

SEQ ID NO: 225525 - DNA, 24 bp, Homo sapiens
acagcagctgttcaacaagagtaa

SEQ ID NO: 225526 - DNA, 12 bp, Homo sapiens
acagcagcttca

SEQ ID NO: 225527 - DNA, 16 bp, Homo sapiens
acagcagcttcaccag

SEQ ID NO: 225528 - DNA, 17 bp, Homo sapiens
acagcagcttcaccaga

SEQ ID NO: 225529 - DNA, 22 bp, Homo sapiens
acagcagcttcaccagagcatt

SEQ ID NO: 225530 - DNA, 22 bp, Homo sapiens
acagcagggtagtctggtttct

SEQ ID NO: 225531 - DNA, 23 bp, Homo sapiens
acagcagtacttgctcaataaag

SEQ ID NO: 225532 - DNA, 14 bp, Homo sapiens
acagcatgcccctt

SEQ ID NO: 225533 - DNA, 17 bp, Homo sapiens
acagcatgccccttggc

SEQ ID NO: 225534 - DNA, 19 bp, Homo sapiens
acagcatttcagctgtgag

SEQ ID NO: 225535 - DNA, 18 bp, Homo sapiens
acagccaagcccaccctg

SEQ ID NO: 225536 - DNA, 14 bp, Homo sapiens
acagccagagctgg

SEQ ID NO: 225537 - DNA, 17 bp, Homo sapiens
acagccagtaaggcagc

SEQ ID NO: 225538 - DNA, 13 bp, Homo sapiens
acagccatttcaa

SEQ ID NO: 225539 - DNA, 18 bp, Homo sapiens
acagcccaaccaggaggg

SEQ ID NO: 225540 - DNA, 15 bp, Homo sapiens
acagcccgcatgcag

SEQ ID NO: 225541 - DNA, 16 bp, Homo sapiens
acagccctcggcctcc

SEQ ID NO: 225542 - DNA, 21 bp, Homo sapiens
acagccctgtcagtgcagccc

SEQ ID NO: 225543 - DNA, 15 bp, Homo sapiens
acagccgccggaagt

SEQ ID NO: 225544 - DNA, 23 bp, Homo sapiens
acagccggatcttggagacaatt

SEQ ID NO: 225545 - DNA, 16 bp, Homo sapiens
acagccggggcctgcc

SEQ ID NO: 225546 - DNA, 17 bp, Homo sapiens
acagccgtcagccaaat

SEQ ID NO: 225547 - DNA, 21 bp, Homo sapiens
acagcctaggaccagttttgt

SEQ ID NO: 225548 - DNA, 13 bp, Homo sapiens
acagcctccaggg

SEQ ID NO: 225549 - DNA, 14 bp, Homo sapiens
acagcctccagggc

SEQ ID NO: 225550 - DNA, 16 bp, Homo sapiens
acagcctccagggccc

SEQ ID NO: 225551 - DNA, 15 bp, Homo sapiens
acagcctcccacccc

SEQ ID NO: 225552 - DNA, 15 bp, Homo sapiens
acagcctctacagcc

SEQ ID NO: 225553 - DNA, 13 bp, Homo sapiens
acagcctgcacac

SEQ ID NO: 225554 - DNA, 19 bp, Homo sapiens
acagcctgcacacacctgc

SEQ ID NO: 225555 - DNA, 22 bp, Homo sapiens
acagcctgtttgggaggctgga

SEQ ID NO: 225556 - DNA, 18 bp, Homo sapiens
acagccttagctgccagt

SEQ ID NO: 225557 - DNA, 19 bp, Homo sapiens
acagccttagctgccagtg

SEQ ID NO: 225558 - DNA, 22 bp, Homo sapiens
acagccttagctgccagtgctg

SEQ ID NO: 225559 - DNA, 13 bp, Homo sapiens
acagcctttctgt

SEQ ID NO: 225560 - DNA, 15 bp, Homo sapiens
acagcctttctgtat

SEQ ID NO: 225561 - DNA, 23 bp, Homo sapiens
acagcctttctgtatcaagcccc

SEQ ID NO: 225562 - DNA, 19 bp, Homo sapiens
acagcgacgctcccctgag

SEQ ID NO: 225563 - DNA, 20 bp, Homo sapiens
acagcgacgctcccctgaga

SEQ ID NO: 225564 - DNA, 14 bp, Homo sapiens
acagcggcccggcc

SEQ ID NO: 225565 - DNA, 20 bp, Homo sapiens
acagcggcccggcccacgca

SEQ ID NO: 225566 - DNA, 23 bp, Homo sapiens
acagcgtccggggtggtggacag

SEQ ID NO: 225567 - DNA, 23 bp, Homo sapiens
acagctactaacctggagacagt

SEQ ID NO: 225568 - DNA, 18 bp, Homo sapiens
acagctaggctgagatgc

SEQ ID NO: 225569 - DNA, 19 bp, Homo sapiens
acagctaggctgagatgca

SEQ ID NO: 225570 - DNA, 16 bp, Homo sapiens
acagctatgggagccc

SEQ ID NO: 225571 - DNA, 18 bp, Homo sapiens
acagctcattcgctccag

SEQ ID NO: 225572 - DNA, 15 bp, Homo sapiens
acagctctcactggc

SEQ ID NO: 225573 - DNA, 20 bp, Homo sapiens
acagctcttggcattttcct

SEQ ID NO: 225574 - DNA, 21 bp, Homo sapiens
acagctgcagagacagagagg

SEQ ID NO: 225575 - DNA, 16 bp, Homo sapiens
acagctgcctgcagta

SEQ ID NO: 225576 - DNA, 14 bp, Homo sapiens
acagctgctggaga

SEQ ID NO: 225577 - DNA, 15 bp, Homo sapiens
acagctggagctctc

SEQ ID NO: 225578 - DNA, 12 bp, Homo sapiens
acagctgggcaa

SEQ ID NO: 225579 - DNA, 15 bp, Homo sapiens
acagctgggcaaagc

SEQ ID NO: 225580 - DNA, 17 bp, Homo sapiens
acagctgggcaaagcca

SEQ ID NO: 225581 - DNA, 20 bp, Homo sapiens
acagctgtgaggacagacag

SEQ ID NO: 225582 - DNA, 21 bp, Homo sapiens
acagctgtgaggacagacaga

SEQ ID NO: 225583 - DNA, 23 bp, Homo sapiens
acagctgtggtgaggttgggcag

SEQ ID NO: 225584 - DNA, 17 bp, Homo sapiens
acagcttcaccctgtca

SEQ ID NO: 225585 - DNA, 21 bp, Homo sapiens
acagcttcaccctgtcaagtt

SEQ ID NO: 225586 - DNA, 21 bp, Homo sapiens
acagcttcacttaaaatcaaa

SEQ ID NO: 225587 - DNA, 15 bp, Homo sapiens
acagctttcccaggt

SEQ ID NO: 225588 - DNA, 15 bp, Homo sapiens
acagctttcctgggt

SEQ ID NO: 225589 - DNA, 19 bp, Homo sapiens
acagcttttagtacccacc

SEQ ID NO: 225590 - DNA, 21 bp, Homo sapiens
acagcttttagtacccacctg

SEQ ID NO: 225591 - DNA, 23 bp, Homo sapiens
acagcttttagtacccacctgag

SEQ ID NO: 225592 - DNA, 14 bp, Homo sapiens
acagcttttctctt

SEQ ID NO: 225593 - DNA, 23 bp, Homo sapiens
acagcttttttagaggtgagttt

SEQ ID NO: 225594 - DNA, 22 bp, Homo sapiens
acaggaaaaaaacttttataaa

SEQ ID NO: 225595 - DNA, 16 bp, Homo sapiens
acaggaaagggaaggc

SEQ ID NO: 225596 - DNA, 16 bp, Homo sapiens
acaggaacacccagcc

SEQ ID NO: 225597 - DNA, 17 bp, Homo sapiens
acaggaacacccagccc

SEQ ID NO: 225598 - DNA, 21 bp, Homo sapiens
acaggaacacccagccccagc

SEQ ID NO: 225599 - DNA, 13 bp, Homo sapiens
acaggaagaccaa

SEQ ID NO: 225600 - DNA, 16 bp, Homo sapiens
acaggaagactggaga

SEQ ID NO: 225601 - DNA, 17 bp, Homo sapiens
acaggaagactggagac

SEQ ID NO: 225602 - DNA, 18 bp, Homo sapiens
acaggaagatcttaaatt

SEQ ID NO: 225603 - DNA, 22 bp, Homo sapiens
acaggaagatcttaaattttgt

SEQ ID NO: 225604 - DNA, 22 bp, Homo sapiens
acaggaagccgcctagtgcaga

SEQ ID NO: 225605 - DNA, 17 bp, Homo sapiens
acaggaagtcttcaggg

SEQ ID NO: 225606 - DNA, 15 bp, Homo sapiens
acaggacacagtcag

SEQ ID NO: 225607 - DNA, 20 bp, Homo sapiens
acaggacagcatggtgcatg

SEQ ID NO: 225608 - DNA, 13 bp, Homo sapiens
acaggaccaggag

SEQ ID NO: 225609 - DNA, 14 bp, Homo sapiens
acaggaccaggagc

SEQ ID NO: 225610 - DNA, 17 bp, Homo sapiens
acaggaccaggagccag

SEQ ID NO: 225611 - DNA, 19 bp, Homo sapiens
acaggaggaactggtccag

SEQ ID NO: 225612 - DNA, 14 bp, Homo sapiens
acaggaggaggaga

SEQ ID NO: 225613 - DNA, 19 bp, Homo sapiens
acaggaggaggagatggcc

SEQ ID NO: 225614 - DNA, 19 bp, Homo sapiens
acaggaggcaagcaagctc

SEQ ID NO: 225615 - DNA, 17 bp, Homo sapiens
acaggaggtgtgataga

SEQ ID NO: 225616 - DNA, 21 bp, Homo sapiens
acaggattaatatattgaaca

SEQ ID NO: 225617 - DNA, 15 bp, Homo sapiens
acaggattagacagt

SEQ ID NO: 225618 - DNA, 17 bp, Homo sapiens
acaggcaacattacaaa

SEQ ID NO: 225619 - DNA, 17 bp, Homo sapiens
gtcaggcttctcttgct

SEQ ID NO: 225620 - DNA, 19 bp, Homo sapiens
gtcagggacagcagcctcc

SEQ ID NO: 225621 - DNA, 14 bp, Homo sapiens
gtcagggaccaagg

SEQ ID NO: 225622 - DNA, 19 bp, Homo sapiens
gtcagggcccagaggctga

SEQ ID NO: 225623 - DNA, 21 bp, Homo sapiens
gtcagggcccagaggctgagt

SEQ ID NO: 225624 - DNA, 15 bp, Homo sapiens
gtcagtcgtgttgct

SEQ ID NO: 225625 - DNA, 19 bp, Homo sapiens
gtcagtgaagcccaggagg

SEQ ID NO: 225626 - DNA, 15 bp, Homo sapiens
gtcagtggctctttt

SEQ ID NO: 225627 - DNA, 20 bp, Homo sapiens
gtcagtgtgcaaagaaaaga

SEQ ID NO: 225628 - DNA, 21 bp, Homo sapiens
gtcagtgtgccaccctctgca

SEQ ID NO: 225629 - DNA, 16 bp, Homo sapiens
gtcagtgtggagaggg

SEQ ID NO: 225630 - DNA, 21 bp, Homo sapiens
gtcagttcccggagcacagcc

SEQ ID NO: 225631 - DNA, 22 bp, Homo sapiens
gtcagttcccggagcacagccc

SEQ ID NO: 225632 - DNA, 21 bp, Homo sapiens
gtcatactatctactctcctc

SEQ ID NO: 225633 - DNA, 22 bp, Homo sapiens
gtcatactatctactctcctca

SEQ ID NO: 225634 - DNA, 16 bp, Homo sapiens
gtcatatgttaagcag

SEQ ID NO: 225635 - DNA, 14 bp, Homo sapiens
gtcatcaaaaagag

SEQ ID NO: 225636 - DNA, 18 bp, Homo sapiens
gtcatcactccctggatg

SEQ ID NO: 225637 - DNA, 20 bp, Homo sapiens
gtcatcccagcacctgccag

SEQ ID NO: 225638 - DNA, 12 bp, Homo sapiens
gtcatcttgagc

SEQ ID NO: 225639 - DNA, 18 bp, Homo sapiens
gtcatgaacatgttcctg

SEQ ID NO: 225640 - DNA, 22 bp, Homo sapiens
gtcatgcggtttccaaggtgca

SEQ ID NO: 225641 - DNA, 15 bp, Homo sapiens
gtcatggctcaagga

SEQ ID NO: 225642 - DNA, 18 bp, Homo sapiens
gtcatgggaacgcagcct

SEQ ID NO: 225643 - DNA, 15 bp, Homo sapiens
gtcatggtgatgcaa

SEQ ID NO: 225644 - DNA, 20 bp, Homo sapiens
gtcatggtgatgcaagtcac

SEQ ID NO: 225645 - DNA, 14 bp, Homo sapiens
gtcatgtaccatca

SEQ ID NO: 225646 - DNA, 16 bp, Homo sapiens
gtcatgtaccatcaat

SEQ ID NO: 225647 - DNA, 19 bp, Homo sapiens
gtcatgtaggttgtctaaa

SEQ ID NO: 225648 - DNA, 13 bp, Homo sapiens
gtcatgtgtataa

SEQ ID NO: 225649 - DNA, 14 bp, Homo sapiens
gtcatgtgtataaa

SEQ ID NO: 225650 - DNA, 21 bp, Homo sapiens
gtcattatgagaggcaatgat

SEQ ID NO: 225651 - DNA, 16 bp, Homo sapiens
gtcattatttaaagca

SEQ ID NO: 225652 - DNA, 21 bp, Homo sapiens
gtcattatttgataacatttt

SEQ ID NO: 225653 - DNA, 18 bp, Homo sapiens
gtcattcaagcctgtgaa

SEQ ID NO: 225654 - DNA, 17 bp, Homo sapiens
gtcattcctaatgcatt

SEQ ID NO: 225655 - DNA, 22 bp, Homo sapiens
gtcattcttacaattgcactgc

SEQ ID NO: 225656 - DNA, 16 bp, Homo sapiens
gtcattgctttactgg

SEQ ID NO: 225657 - DNA, 21 bp, Homo sapiens
gtcattgtaacctcgtgtcta

SEQ ID NO: 225658 - DNA, 16 bp, Homo sapiens
gtcatttcagagccct

SEQ ID NO: 225659 - DNA, 22 bp, Homo sapiens
gtcatttgctgagcatgtactg

SEQ ID NO: 225660 - DNA, 21 bp, Homo sapiens
gtcattttaactttatcacat

SEQ ID NO: 225661 - DNA, 19 bp, Homo sapiens
gtcattttattttttccct

SEQ ID NO: 225662 - DNA, 23 bp, Homo sapiens
gtcatttttaatattactgtctt

SEQ ID NO: 225663 - DNA, 16 bp, Homo sapiens
gtccaaaggaggctgg

SEQ ID NO: 225664 - DNA, 20 bp, Homo sapiens
gtccaaaggaggctggcagg

SEQ ID NO: 225665 - DNA, 23 bp, Homo sapiens
gtccaaaggagtgcatggccaca

SEQ ID NO: 225666 - DNA, 16 bp, Homo sapiens
gtccaacctgcctgtg

SEQ ID NO: 225667 - DNA, 21 bp, Homo sapiens
gtccaacgtggggcagcacag

SEQ ID NO: 225668 - DNA, 21 bp, Homo sapiens
gtccaagggccatacttttga

SEQ ID NO: 225669 - DNA, 17 bp, Homo sapiens
gtccaagtgtgtgtgcg

SEQ ID NO: 225670 - DNA, 19 bp, Homo sapiens
gtccaagtgtgtgtgcgtg

SEQ ID NO: 225671 - DNA, 19 bp, Homo sapiens
gtccaagttcttcacctct

SEQ ID NO: 225672 - DNA, 13 bp, Homo sapiens
gtccacaggggca

SEQ ID NO: 225673 - DNA, 16 bp, Homo sapiens
gtccacaggggcaggc

SEQ ID NO: 225674 - DNA, 17 bp, Homo sapiens
gtccacaggggcaggcc

SEQ ID NO: 225675 - DNA, 18 bp, Homo sapiens
gtccacaggggcaggcct

SEQ ID NO: 225676 - DNA, 20 bp, Homo sapiens
gtccacaggggcaggcctgg

SEQ ID NO: 225677 - DNA, 22 bp, Homo sapiens
gtccacaggggcaggcctggga

SEQ ID NO: 225678 - DNA, 23 bp, Homo sapiens
gtccacaggggcaggcctgggac

SEQ ID NO: 225679 - DNA, 16 bp, Homo sapiens
gtccacatctaacaaa

SEQ ID NO: 225680 - DNA, 22 bp, Homo sapiens
gtccacatgtggggacagggct

SEQ ID NO: 225681 - DNA, 16 bp, Homo sapiens
gtccacattctgctgc

SEQ ID NO: 225682 - DNA, 20 bp, Homo sapiens
gtccacccacttagtccact

SEQ ID NO: 225683 - DNA, 14 bp, Homo sapiens
gtccacccaggctg

SEQ ID NO: 225684 - DNA, 17 bp, Homo sapiens
gtccacccccattgtga

SEQ ID NO: 225685 - DNA, 21 bp, Homo sapiens
gtccacccccattgtgaatgt

SEQ ID NO: 225686 - DNA, 23 bp, Homo sapiens
gtccacccccattgtgaatgttg

SEQ ID NO: 225687 - DNA, 19 bp, Homo sapiens
gtccacccgtttccaagcc

SEQ ID NO: 225688 - DNA, 22 bp, Homo sapiens
gtccacccgtttccaagcctgg

SEQ ID NO: 225689 - DNA, 22 bp, Homo sapiens
gtccacctgagctgccatccag

SEQ ID NO: 225690 - DNA, 15 bp, Homo sapiens
gtccacctgtgctgc

SEQ ID NO: 225691 - DNA, 17 bp, Homo sapiens
gtccacctgtgctgctg

SEQ ID NO: 225692 - DNA, 13 bp, Homo sapiens
gtccactccctgc

SEQ ID NO: 225693 - DNA, 15 bp, Homo sapiens
gtccactccctgctc

SEQ ID NO: 225694 - DNA, 17 bp, Homo sapiens
gtccactctcggggccc

SEQ ID NO: 225695 - DNA, 18 bp, Homo sapiens
gtccactctgagtcgatt

SEQ ID NO: 225696 - DNA, 20 bp, Homo sapiens
gtccactggggagtgctgga

SEQ ID NO: 225697 - DNA, 19 bp, Homo sapiens
gtccactttcctctctctc

SEQ ID NO: 225698 - DNA, 23 bp, Homo sapiens
gtccagaaaatagggtggacaga

SEQ ID NO: 225699 - DNA, 19 bp, Homo sapiens
gtccagaagaaattattta

SEQ ID NO: 225700 - DNA, 17 bp, Homo sapiens
gtccagaagaatattca

SEQ ID NO: 225701 - DNA, 19 bp, Homo sapiens
gtccagaagaatattcagg

SEQ ID NO: 225702 - DNA, 18 bp, Homo sapiens
gtccagacctgggccctg

SEQ ID NO: 225703 - DNA, 20 bp, Homo sapiens
gtccagacctgggccctggt

SEQ ID NO: 225704 - DNA, 22 bp, Homo sapiens
gtccagacgtcaaccaggaaca

SEQ ID NO: 225705 - DNA, 16 bp, Homo sapiens
gtccagagaccacacc

SEQ ID NO: 225706 - DNA, 19 bp, Homo sapiens
gtccagagaccacaccact

SEQ ID NO: 225707 - DNA, 20 bp, Homo sapiens
gtccagagagagaagtgccc

SEQ ID NO: 225708 - DNA, 22 bp, Homo sapiens
gtccagagagagaagtgcccct

SEQ ID NO: 225709 - DNA, 16 bp, Homo sapiens
gtccagagcttttcag

SEQ ID NO: 225710 - DNA, 12 bp, Homo sapiens
acatctgaaaag

SEQ ID NO: 225711 - DNA, 11 bp, Homo sapiens
acatcttcata

SEQ ID NO: 225712 - DNA, 24 bp, Homo sapiens
acatcttgtcttttcccctcattg

SEQ ID NO: 225713 - DNA, 20 bp, Homo sapiens
acatctttaacttagtattt

SEQ ID NO: 225714 - DNA, 16 bp, Homo sapiens
acatcttttaactgcc

SEQ ID NO: 225715 - DNA, 18 bp, Homo sapiens
acatcttttgggaagcca

SEQ ID NO: 225716 - DNA, 22 bp, Homo sapiens
acatgaaaaacacggcagctgt

SEQ ID NO: 225717 - DNA, 13 bp, Homo sapiens
acatgaaaacatt

SEQ ID NO: 225718 - DNA, 15 bp, Homo sapiens
acatgaaaacattga

SEQ ID NO: 225719 - DNA, 13 bp, Homo sapiens
acatgaaatgccc

SEQ ID NO: 225720 - DNA, 22 bp, Homo sapiens
acatgaaatgccctcctaaatg

SEQ ID NO: 225721 - DNA, 18 bp, Homo sapiens
acatgaatttaatgtcta

SEQ ID NO: 225722 - DNA, 14 bp, Homo sapiens
acatgactgggcct

SEQ ID NO: 225723 - DNA, 13 bp, Homo sapiens
acatgagtcccag

SEQ ID NO: 225724 - DNA, 13 bp, Homo sapiens
acatgagtgctga

SEQ ID NO: 225725 - DNA, 19 bp, Homo sapiens
acatgagttcaaatacttt

SEQ ID NO: 225726 - DNA, 17 bp, Homo sapiens
acatgatcttctttata

SEQ ID NO: 225727 - DNA, 16 bp, Homo sapiens
acatgatgatttcaga

SEQ ID NO: 225728 - DNA, 15 bp, Homo sapiens
acatgcaaggcactg

SEQ ID NO: 225729 - DNA, 20 bp, Homo sapiens
acatgcacagctaacatgga

SEQ ID NO: 225730 - DNA, 15 bp, Homo sapiens
acatgcagaaattga

SEQ ID NO: 225731 - DNA, 20 bp, Homo sapiens
acatgcagaaattgacctga

SEQ ID NO: 225732 - DNA, 17 bp, Homo sapiens
acatgcagcccatgccc

SEQ ID NO: 225733 - DNA, 18 bp, Homo sapiens
acatgcagcccatgccca

SEQ ID NO: 225734 - DNA, 20 bp, Homo sapiens
acatgcagcccatgcccacc

SEQ ID NO: 225735 - DNA, 21 bp, Homo sapiens
acatgcatttgaggtcaagta

SEQ ID NO: 225736 - DNA, 21 bp, Homo sapiens
acatgcccgctgtcccagggg

SEQ ID NO: 225737 - DNA, 22 bp, Homo sapiens
acatgcctgccccaaacaaata

SEQ ID NO: 225738 - DNA, 17 bp, Homo sapiens
acatgctaaatagttct

SEQ ID NO: 225739 - DNA, 21 bp, Homo sapiens
acatgctacctgatcccactc

SEQ ID NO: 225740 - DNA, 16 bp, Homo sapiens
acatgctcacctctag

SEQ ID NO: 225741 - DNA, 22 bp, Homo sapiens
acatgctcatcccaaaagctag

SEQ ID NO: 225742 - DNA, 18 bp, Homo sapiens
acatgctctcaatatata

SEQ ID NO: 225743 - DNA, 18 bp, Homo sapiens
acatgctgtgctctttga

SEQ ID NO: 225744 - DNA, 21 bp, Homo sapiens
acatgctgtgctctttgaaga

SEQ ID NO: 225745 - DNA, 14 bp, Homo sapiens
acatggaagtacta

SEQ ID NO: 225746 - DNA, 16 bp, Homo sapiens
acatggacccggagct

SEQ ID NO: 225747 - DNA, 18 bp, Homo sapiens
gtctccaagaatgttttg

SEQ ID NO: 225748 - DNA, 12 bp, Homo sapiens
gtctccaccagg

SEQ ID NO: 225749 - DNA, 17 bp, Homo sapiens
gtctccaccaggaacct

SEQ ID NO: 225750 - DNA, 20 bp, Homo sapiens
gtctccaccaggaacctctt

SEQ ID NO: 225751 - DNA, 15 bp, Homo sapiens
gtctccacccctcaa

SEQ ID NO: 225752 - DNA, 17 bp, Homo sapiens
gtctccacccctcaagc

SEQ ID NO: 225753 - DNA, 13 bp, Homo sapiens
gtctccatgtttg

SEQ ID NO: 225754 - DNA, 19 bp, Homo sapiens
gtctcccaggccccctgca

SEQ ID NO: 225755 - DNA, 22 bp, Homo sapiens
gtctccctataatgctggagcg

SEQ ID NO: 225756 - DNA, 16 bp, Homo sapiens
gtctccctgagcctgc

SEQ ID NO: 225757 - DNA, 13 bp, Homo sapiens
gtctccctggcca

SEQ ID NO: 225758 - DNA, 14 bp, Homo sapiens
gtctccctggccac

SEQ ID NO: 225759 - DNA, 21 bp, Homo sapiens
gtctccctggtggggtgtgca

SEQ ID NO: 225760 - DNA, 14 bp, Homo sapiens
gtctcccttggcca

SEQ ID NO: 225761 - DNA, 21 bp, Homo sapiens
gtctcccttggccacggcctg

SEQ ID NO: 225762 - DNA, 18 bp, Homo sapiens
gtctccctttcccttctt

SEQ ID NO: 225763 - DNA, 14 bp, Homo sapiens
gtctcctactctgt

SEQ ID NO: 225764 - DNA, 17 bp, Homo sapiens
gtctcctccccgtagcc

SEQ ID NO: 225765 - DNA, 14 bp, Homo sapiens
gtctcctctcagct

SEQ ID NO: 225766 - DNA, 16 bp, Homo sapiens
gtctcctctccagccc

SEQ ID NO: 225767 - DNA, 17 bp, Homo sapiens
gtctcctctccagccct

SEQ ID NO: 225768 - DNA, 18 bp, Homo sapiens
gtctcctctccagcccta

SEQ ID NO: 225769 - DNA, 17 bp, Homo sapiens
gtctcctctgtcagttt

SEQ ID NO: 225770 - DNA, 22 bp, Homo sapiens
gtctcctctgtcagtttgtgaa

SEQ ID NO: 225771 - DNA, 19 bp, Homo sapiens
gtctcctctttgttttgtt

SEQ ID NO: 225772 - DNA, 18 bp, Homo sapiens
gtctcctgtatcatttct

SEQ ID NO: 225773 - DNA, 21 bp, Homo sapiens
gtctcctgtgcccacatccca

SEQ ID NO: 225774 - DNA, 22 bp, Homo sapiens
gtctcctgtgcccacatcccag

SEQ ID NO: 225775 - DNA, 21 bp, Homo sapiens
gtctccttactctgagcccag

SEQ ID NO: 225776 - DNA, 12 bp, Homo sapiens
gtctccttccca

SEQ ID NO: 225777 - DNA, 18 bp, Homo sapiens
gtctccttcccactgtcc

SEQ ID NO: 225778 - DNA, 20 bp, Homo sapiens
gtctccttcccactgtcctt

SEQ ID NO: 225779 - DNA, 18 bp, Homo sapiens
gtctcctttgcactgagg

SEQ ID NO: 225780 - DNA, 22 bp, Homo sapiens
gtctcctttgcactgagggcca

SEQ ID NO: 225781 - DNA, 23 bp, Homo sapiens
gtctcgctttgttgcccaggctg

SEQ ID NO: 225782 - DNA, 13 bp, Homo sapiens
gtctcgtggcccc

SEQ ID NO: 225783 - DNA, 14 bp, Homo sapiens
gtctctaaagcact

SEQ ID NO: 225784 - DNA, 18 bp, Homo sapiens
gtctctactaaaaataag

SEQ ID NO: 225785 - DNA, 18 bp, Homo sapiens
gtctctagagcagggatt

SEQ ID NO: 225786 - DNA, 13 bp, Homo sapiens
gtctctcatttct

SEQ ID NO: 225787 - DNA, 13 bp, Homo sapiens
gtctctccctggg

SEQ ID NO: 225788 - DNA, 14 bp, Homo sapiens
gtctctccctgggg

SEQ ID NO: 225789 - DNA, 16 bp, Homo sapiens
gtctctctctcttttt

SEQ ID NO: 225790 - DNA, 13 bp, Homo sapiens
gtctctctgtgaa

SEQ ID NO: 225791 - DNA, 16 bp, Homo sapiens
gtctctctgtgaatac

SEQ ID NO: 225792 - DNA, 15 bp, Homo sapiens
gtctctgagcagtgg

SEQ ID NO: 225793 - DNA, 17 bp, Homo sapiens
gtctctgagcagtgggg

SEQ ID NO: 225794 - DNA, 14 bp, Homo sapiens
gtctctgcagtgtc

SEQ ID NO: 225795 - DNA, 15 bp, Homo sapiens
gtctctgccacccac

SEQ ID NO: 225796 - DNA, 16 bp, Homo sapiens
gtctctgccacccact

SEQ ID NO: 225797 - DNA, 21 bp, Homo sapiens
gtctctgccacccactcagga

SEQ ID NO: 225798 - DNA, 22 bp, Homo sapiens
gtctctgccacccactcaggat

SEQ ID NO: 225799 - DNA, 17 bp, Homo sapiens
gtctctgccggctcttt

SEQ ID NO: 225800 - DNA, 12 bp, Homo sapiens
gtctctgcttcc

SEQ ID NO: 225801 - DNA, 13 bp, Homo sapiens
gtctctgcttcca

SEQ ID NO: 225802 - DNA, 16 bp, Homo sapiens
gtctctggcagttctg

SEQ ID NO: 225803 - DNA, 21 bp, Homo sapiens
gtctctggcagttctggaatg

SEQ ID NO: 225804 - DNA, 16 bp, Homo sapiens
gtctctgttcagatgt

SEQ ID NO: 225805 - DNA, 18 bp, Homo sapiens
gtctcttctccactggat

SEQ ID NO: 225806 - DNA, 19 bp, Homo sapiens
gtctcttctgggcaccctc

SEQ ID NO: 225807 - DNA, 23 bp, Homo sapiens
gtctcttgagggagcttagccaa

SEQ ID NO: 225808 - DNA, 12 bp, Homo sapiens
gtctcttgcttg

SEQ ID NO: 225809 - DNA, 20 bp, Homo sapiens
gtctcttgtagaagatggac

SEQ ID NO: 225810 - DNA, 18 bp, Homo sapiens
gtctctttaagttttgat

SEQ ID NO: 225811 - DNA, 18 bp, Homo sapiens
gtctctttaatcttcagt

SEQ ID NO: 225812 - DNA, 11 bp, Homo sapiens
gtctctttcca

SEQ ID NO: 225813 - DNA, 14 bp, Homo sapiens
gtctctttccactt

SEQ ID NO: 225814 - DNA, 15 bp, Homo sapiens
gtctctttctttcca

SEQ ID NO: 225815 - DNA, 19 bp, Homo sapiens
gtctctttctttccaaagg

SEQ ID NO: 225816 - DNA, 14 bp, Homo sapiens
gtctcttttgttcc

SEQ ID NO: 225817 - DNA, 20 bp, Homo sapiens
gtctctttttttggcccagg

SEQ ID NO: 225818 - DNA, 15 bp, Homo sapiens
gtctgaacccttgtg

SEQ ID NO: 225819 - DNA, 21 bp, Homo sapiens
gtctgaaggactggattggcc

SEQ ID NO: 225820 - DNA, 19 bp, Homo sapiens
gtctgaagtcactgcacag

SEQ ID NO: 225821 - DNA, 13 bp, Homo sapiens
gtctgaatgttct

SEQ ID NO: 225822 - DNA, 20 bp, Homo sapiens
gtctgaatgttctgacatta

SEQ ID NO: 225823 - DNA, 14 bp, Homo sapiens
gtctgacaggaaga

SEQ ID NO: 225824 - DNA, 15 bp, Homo sapiens
gtctgactccagagt

SEQ ID NO: 225825 - DNA, 12 bp, Homo sapiens
gtctgagccctg

SEQ ID NO: 225826 - DNA, 16 bp, Homo sapiens
gtctgagccctgccct

SEQ ID NO: 225827 - DNA, 18 bp, Homo sapiens
gtctgagccctgccctca

SEQ ID NO: 225828 - DNA, 21 bp, Homo sapiens
gtctgagcggccgcctgtcct

SEQ ID NO: 225829 - DNA, 15 bp, Homo sapiens
gtctgaggccccagg

SEQ ID NO: 225830 - DNA, 19 bp, Homo sapiens
gtctgaggcctcatccctc

SEQ ID NO: 225831 - DNA, 19 bp, Homo sapiens
gtctgagtcatcaaaaaga

SEQ ID NO: 225832 - DNA, 21 bp, Homo sapiens
gtctgatgttttgatgccatt

SEQ ID NO: 225833 - DNA, 14 bp, Homo sapiens
gtctgcaaaggagg

SEQ ID NO: 225834 - DNA, 18 bp, Homo sapiens
gtctgcaaaggagggcct

SEQ ID NO: 225835 - DNA, 23 bp, Homo sapiens
gtctgcaaaggagggcctcagag

SEQ ID NO: 225836 - DNA, 18 bp, Homo sapiens
gtctgcagcccggcgcca

SEQ ID NO: 225837 - DNA, 19 bp, Homo sapiens
gtctgcagcccggcgccac

SEQ ID NO: 225838 - DNA, 18 bp, Homo sapiens
gtctgcagtcctggtggg

SEQ ID NO: 225839 - DNA, 22 bp, Homo sapiens
gtctgcattgttattgtggaag

SEQ ID NO: 225840 - DNA, 14 bp, Homo sapiens
gtctgccaggccca

SEQ ID NO: 225841 - DNA, 15 bp, Homo sapiens
gtctgccgtgagagc

SEQ ID NO: 225842 - DNA, 16 bp, Homo sapiens
gtctgcctaggagctg

SEQ ID NO: 225843 - DNA, 22 bp, Homo sapiens
gtctgcctcccacgctgggaca

SEQ ID NO: 225844 - DNA, 14 bp, Homo sapiens
gtctgcctgtattt

SEQ ID NO: 225845 - DNA, 19 bp, Homo sapiens
gtctgctctgtgcctggga

SEQ ID NO: 225846 - DNA, 20 bp, Homo sapiens
gtctgctctttctctgccag

SEQ ID NO: 225847 - DNA, 22 bp, Homo sapiens
gtctgctctttctctgccagtg

SEQ ID NO: 225848 - DNA, 23 bp, Homo sapiens
gtctgctgtaagacggccttgga

SEQ ID NO: 225849 - DNA, 17 bp, Homo sapiens
gtctggaatcccagctc

SEQ ID NO: 225850 - DNA, 21 bp, Homo sapiens
gtctggaatcccagctccgct

SEQ ID NO: 225851 - DNA, 24 bp, Homo sapiens
gtctggagcccctatcctgcaccc

SEQ ID NO: 225852 - DNA, 20 bp, Homo sapiens
gtctggatgcacagatgcca

SEQ ID NO: 225853 - DNA, 19 bp, Homo sapiens
gtctggcctgccaggctcc

SEQ ID NO: 225854 - DNA, 16 bp, Homo sapiens
gtctggcgagccctta

SEQ ID NO: 225855 - DNA, 15 bp, Homo sapiens
gtctggctgtggccc

SEQ ID NO: 225856 - DNA, 22 bp, Homo sapiens
gtctggctgtggcccctccttc

SEQ ID NO: 225857 - DNA, 22 bp, Homo sapiens
gtctgggaaagcagagtggtgg

SEQ ID NO: 225858 - DNA, 23 bp, Homo sapiens
gtctgggaaggggcgtgtccctc

SEQ ID NO: 225859 - DNA, 24 bp, Homo sapiens
gtctgggacttccttgctctccct

SEQ ID NO: 225860 - DNA, 22 bp, Homo sapiens
accagcagcacaattctgtccc

SEQ ID NO: 225861 - DNA, 21 bp, Homo sapiens
accagcaggtgtggtggctca

SEQ ID NO: 225862 - DNA, 22 bp, Homo sapiens
accagcaggtgtggtggctcat

SEQ ID NO: 225863 - DNA, 23 bp, Homo sapiens
accagccccccaccccacagatc

SEQ ID NO: 225864 - DNA, 15 bp, Homo sapiens
accagccccctggat

SEQ ID NO: 225865 - DNA, 11 bp, Homo sapiens
accagccctcc

SEQ ID NO: 225866 - DNA, 12 bp, Homo sapiens
accagccctcca

SEQ ID NO: 225867 - DNA, 14 bp, Homo sapiens
accagccctccaga

SEQ ID NO: 225868 - DNA, 16 bp, Homo sapiens
accagccctccagagc

SEQ ID NO: 225869 - DNA, 22 bp, Homo sapiens
accagccctgctgcttcctaac

SEQ ID NO: 225870 - DNA, 11 bp, Homo sapiens
accagccctgg

SEQ ID NO: 225871 - DNA, 16 bp, Homo sapiens
accagccctggggctg

SEQ ID NO: 225872 - DNA, 17 bp, Homo sapiens
accagccctggggctgg

SEQ ID NO: 225873 - DNA, 20 bp, Homo sapiens
accagccctggggctgggcc

SEQ ID NO: 225874 - DNA, 13 bp, Homo sapiens
accagcccttccc

SEQ ID NO: 225875 - DNA, 17 bp, Homo sapiens
accagcccttccctgct

SEQ ID NO: 225876 - DNA, 16 bp, Homo sapiens
accagccgccccagcc

SEQ ID NO: 225877 - DNA, 17 bp, Homo sapiens
ttctggttgtatttcta

SEQ ID NO: 225878 - DNA, 18 bp, Homo sapiens
ttctggttgtatttctat

SEQ ID NO: 225879 - DNA, 10 bp, Homo sapiens
ttctgtaaaa

SEQ ID NO: 225880 - DNA, 19 bp, Homo sapiens
ttctgtaaaatggaaaact

SEQ ID NO: 225881 - DNA, 20 bp, Homo sapiens
ttctgtaaactcaaaactta

SEQ ID NO: 225882 - DNA, 15 bp, Homo sapiens
ttctgtaaataacct

SEQ ID NO: 225883 - DNA, 20 bp, Homo sapiens
ttctgtagagccttctgatg

SEQ ID NO: 225884 - DNA, 19 bp, Homo sapiens
ttctgtatcaagcccctgt

SEQ ID NO: 225885 - DNA, 23 bp, Homo sapiens
ttctgtatcaagcccctgtctaa

SEQ ID NO: 225886 - DNA, 14 bp, Homo sapiens
ttctgtccttcaga

SEQ ID NO: 225887 - DNA, 19 bp, Homo sapiens
ttctgtctcataattgtca

SEQ ID NO: 225888 - DNA, 14 bp, Homo sapiens
ttctgtctgtaaga

SEQ ID NO: 225889 - DNA, 23 bp, Homo sapiens
ttctgtgaagccctttgcctgta

SEQ ID NO: 225890 - DNA, 17 bp, Homo sapiens
ttctgtgatcatttatt

SEQ ID NO: 225891 - DNA, 14 bp, Homo sapiens
ttctgtgcataaaa

SEQ ID NO: 225892 - DNA, 15 bp, Homo sapiens
ttctgtgcctccccc

SEQ ID NO: 225893 - DNA, 18 bp, Homo sapiens
ttctgtggaaaacaattt

SEQ ID NO: 225894 - DNA, 15 bp, Homo sapiens
ttctgtggattctat

SEQ ID NO: 225895 - DNA, 19 bp, Homo sapiens
ttctgtggattctatattt

SEQ ID NO: 225896 - DNA, 12 bp, Homo sapiens
ttctgtggctca

SEQ ID NO: 225897 - DNA, 16 bp, Homo sapiens
ttctgtggctcacaga

SEQ ID NO: 225898 - DNA, 21 bp, Homo sapiens
ttctgtgggcttggccttgtg

SEQ ID NO: 225899 - DNA, 23 bp, Homo sapiens
ttctgtgtgcaccttaccaactt

SEQ ID NO: 225900 - DNA, 13 bp, Homo sapiens
ttctgttaaatat

SEQ ID NO: 225901 - DNA, 22 bp, Homo sapiens
ttctgttaaatatttttgtaca

SEQ ID NO: 225902 - DNA, 18 bp, Homo sapiens
ttctgttacacaatatgt

SEQ ID NO: 225903 - DNA, 14 bp, Homo sapiens
ttctgttccctgct

SEQ ID NO: 225904 - DNA, 15 bp, Homo sapiens
ttctgttgcccaggc

SEQ ID NO: 225905 - DNA, 14 bp, Homo sapiens
ttctgttgtttctt

SEQ ID NO: 225906 - DNA, 17 bp, Homo sapiens
ttctgtttgaattttca

SEQ ID NO: 225907 - DNA, 14 bp, Homo sapiens
ttctgtttgttaaa

SEQ ID NO: 225908 - DNA, 16 bp, Homo sapiens
ttctgttttgcctgaa

SEQ ID NO: 225909 - DNA, 15 bp, Homo sapiens
ttctgtttttctcaa

SEQ ID NO: 225910 - DNA, 20 bp, Homo sapiens
ttctgttttttttttttgta

SEQ ID NO: 225911 - DNA, 21 bp, Homo sapiens
ttctgttttttttttttgtat

SEQ ID NO: 225912 - DNA, 14 bp, Homo sapiens
ttcttaaaggcctg

SEQ ID NO: 225913 - DNA, 22 bp, Homo sapiens
ttcttaataggctttatcgttt

SEQ ID NO: 225914 - DNA, 21 bp, Homo sapiens
ttcttacaattgcactgctgt

SEQ ID NO: 225915 - DNA, 13 bp, Homo sapiens
ttcttacataatt

SEQ ID NO: 225916 - DNA, 15 bp, Homo sapiens
ttcttaccctctctt

SEQ ID NO: 225917 - DNA, 18 bp, Homo sapiens
ttcttacctcatttgcat

SEQ ID NO: 225918 - DNA, 14 bp, Homo sapiens
ttcttagtaaaatg

SEQ ID NO: 225919 - DNA, 19 bp, Homo sapiens
ttcttagttctcactgttc

SEQ ID NO: 225920 - DNA, 17 bp, Homo sapiens
ttcttagtttcagaagt

SEQ ID NO: 225921 - DNA, 15 bp, Homo sapiens
ttcttattgctttta

SEQ ID NO: 225922 - DNA, 17 bp, Homo sapiens
ttcttatttgaaagtgt

SEQ ID NO: 225923 - DNA, 19 bp, Homo sapiens
ttcttcaaatccttccaaa

SEQ ID NO: 225924 - DNA, 20 bp, Homo sapiens
ttcttcatccatagacacag

SEQ ID NO: 225925 - DNA, 22 bp, Homo sapiens
ttcttcatccatagacacagta

SEQ ID NO: 225926 - DNA, 17 bp, Homo sapiens
ttcttccaaaaagattt

SEQ ID NO: 225927 - DNA, 13 bp, Homo sapiens
ttcttccccacaa

SEQ ID NO: 225928 - DNA, 22 bp, Homo sapiens
ttcttccttcccaactcactgt

SEQ ID NO: 225929 - DNA, 23 bp, Homo sapiens
ttcttcgctgctctagctggcag

SEQ ID NO: 225930 - DNA, 23 bp, Homo sapiens
ttcttctaaagaggaagccttgc

SEQ ID NO: 225931 - DNA, 18 bp, Homo sapiens
ttcttctaggttctaaaa

SEQ ID NO: 225932 - DNA, 21 bp, Homo sapiens
ttcttctaggttctaaaaatt

SEQ ID NO: 225933 - DNA, 21 bp, Homo sapiens
ttcttcttgtgtctccttatg

SEQ ID NO: 225934 - DNA, 23 bp, Homo sapiens
ttcttcttgtgtctccttatggt

SEQ ID NO: 225935 - DNA, 15 bp, Homo sapiens
ttcttgaaagctgtg

SEQ ID NO: 225936 - DNA, 17 bp, Homo sapiens
ttcttgaagtccagtgt

SEQ ID NO: 225937 - DNA, 20 bp, Homo sapiens
ttcttgacaaaacctaactt

SEQ ID NO: 225938 - DNA, 17 bp, Homo sapiens
ttcttgagatctgctga

SEQ ID NO: 225939 - DNA, 23 bp, Homo sapiens
ttcttgagcaccaggtgttaaaa

SEQ ID NO: 225940 - DNA, 17 bp, Homo sapiens
ttcttgagtaatttaaa

SEQ ID NO: 225941 - DNA, 20 bp, Homo sapiens
ttcttgatgtaaaatcttgt

SEQ ID NO: 225942 - DNA, 19 bp, Homo sapiens
ttcttgattttcaagcttt

SEQ ID NO: 225943 - DNA, 17 bp, Homo sapiens
ttcttgcaaaacaaaca

SEQ ID NO: 225944 - DNA, 19 bp, Homo sapiens
ttcttgcactgtatccaag

SEQ ID NO: 225945 - DNA, 16 bp, Homo sapiens
ttcttgccaatgaggt

SEQ ID NO: 225946 - DNA, 12 bp, Homo sapiens
ttcttgccagct

SEQ ID NO: 225947 - DNA, 13 bp, Homo sapiens
ttcttgccagctc

SEQ ID NO: 225948 - DNA, 14 bp, Homo sapiens
ttcttgccagctca

SEQ ID NO: 225949 - DNA, 15 bp, Homo sapiens
ttcttgccagctcag

SEQ ID NO: 225950 - DNA, 21 bp, Homo sapiens
ttcttgcggcaccgcccaccc

SEQ ID NO: 225951 - DNA, 15 bp, Homo sapiens
ttcttgctaagctcc

SEQ ID NO: 225952 - DNA, 12 bp, Homo sapiens
ttcttgctcctg

SEQ ID NO: 225953 - DNA, 20 bp, Homo sapiens
ttcttgctctatctctcaaa

SEQ ID NO: 225954 - DNA, 15 bp, Homo sapiens
ttcttgctttcaatt

SEQ ID NO: 225955 - DNA, 21 bp, Homo sapiens
ttcttggacacttaattctgt

SEQ ID NO: 225956 - DNA, 23 bp, Homo sapiens
ttcttggacacttaattctgttc

SEQ ID NO: 225957 - DNA, 19 bp, Homo sapiens
ttcttggcttctgggacct

SEQ ID NO: 225958 - DNA, 22 bp, Homo sapiens
ttcttgggggaggccaccccaa

SEQ ID NO: 225959 - DNA, 16 bp, Homo sapiens
ttcttggtagagattc

SEQ ID NO: 225960 - DNA, 15 bp, Homo sapiens
ttcttggtgcattcg

SEQ ID NO: 225961 - DNA, 19 bp, Homo sapiens
ttcttgtaaaactgtgaca

SEQ ID NO: 225962 - DNA, 20 bp, Homo sapiens
ttcttgtaaaactgtgacat

SEQ ID NO: 225963 - DNA, 23 bp, Homo sapiens
ttcttgtaaaactgtgacattcc

SEQ ID NO: 225964 - DNA, 18 bp, Homo sapiens
ttcttgtcaatggaagaa

SEQ ID NO: 225965 - DNA, 22 bp, Homo sapiens
ttcttgtcatcagtaagtataa

SEQ ID NO: 225966 - DNA, 17 bp, Homo sapiens
ttcttgtgtcctgatga

SEQ ID NO: 225967 - DNA, 21 bp, Homo sapiens
ttcttgtgtgtttattgtcaa

SEQ ID NO: 225968 - DNA, 14 bp, Homo sapiens
ttcttgtgtttgaa

SEQ ID NO: 225969 - DNA, 16 bp, Homo sapiens
ttcttgttacggcagt

SEQ ID NO: 225970 - DNA, 20 bp, Homo sapiens
ttcttgttcatgttttgcta

SEQ ID NO: 225971 - DNA, 16 bp, Homo sapiens
ttcttgttctgttttg

SEQ ID NO: 225972 - DNA, 20 bp, Homo sapiens
ttctttaacatacatctaag

SEQ ID NO: 225973 - DNA, 14 bp, Homo sapiens
ttctttaaggaaga

SEQ ID NO: 225974 - DNA, 16 bp, Homo sapiens
ttctttaatcaaaagt

SEQ ID NO: 225975 - DNA, 16 bp, Homo sapiens
ttctttaccttcattt

SEQ ID NO: 225976 - DNA, 23 bp, Homo sapiens
ttctttactactgcaagttcaag

SEQ ID NO: 225977 - DNA, 17 bp, Homo sapiens
ttctttactcctttggc

SEQ ID NO: 225978 - DNA, 16 bp, Homo sapiens
ttctttataaaccata

SEQ ID NO: 225979 - DNA, 18 bp, Homo sapiens
ttctttataattctactt

SEQ ID NO: 225980 - DNA, 22 bp, Homo sapiens
ttctttcaagatcttcaaccat

SEQ ID NO: 225981 - DNA, 13 bp, Homo sapiens
ttctttcagatgt

SEQ ID NO: 225982 - DNA, 17 bp, Homo sapiens
ttctttccatgcagact

SEQ ID NO: 225983 - DNA, 13 bp, Homo sapiens
ttctttccccaga

SEQ ID NO: 225984 - DNA, 22 bp, Homo sapiens
ttctttccccagaggctcccaa

SEQ ID NO: 225985 - DNA, 12 bp, Homo sapiens
ttctttctatgt

SEQ ID NO: 225986 - DNA, 17 bp, Homo sapiens
ttctttctatgtagaac

SEQ ID NO: 225987 - DNA, 23 bp, Homo sapiens
ttctttctctcagccttacattt

SEQ ID NO: 225988 - DNA, 14 bp, Homo sapiens
ttctttcttggtgc

SEQ ID NO: 225989 - DNA, 22 bp, Homo sapiens
ttctttgaccaaactgtgggta

SEQ ID NO: 225990 - DNA, 15 bp, Homo sapiens
ttctttgctgtgcca

SEQ ID NO: 225991 - DNA, 14 bp, Homo sapiens
ttctttgtatctta

SEQ ID NO: 225992 - DNA, 15 bp, Homo sapiens
ttctttgtatcttaa

SEQ ID NO: 225993 - DNA, 16 bp, Homo sapiens
ttctttgtatcttaaa

SEQ ID NO: 225994 - DNA, 12 bp, Homo sapiens
ttctttgttcct

SEQ ID NO: 225995 - DNA, 14 bp, Homo sapiens
ttctttgttcctgc

SEQ ID NO: 225996 - DNA, 22 bp, Homo sapiens
ttctttgttcctgctttctctt

SEQ ID NO: 225997 - DNA, 15 bp, Homo sapiens
ttcttttactatctt

SEQ ID NO: 225998 - DNA, 14 bp, Homo sapiens
ttcttttatatctg

SEQ ID NO: 225999 - DNA, 17 bp, Homo sapiens
ttcttttccagaaagaa

SEQ ID NO: 226000 - DNA, 20 bp, Homo sapiens
ttctttttataactcatggc

SEQ ID NO: 226001 - DNA, 14 bp, Homo sapiens
ttcttttttaaatt

SEQ ID NO: 226002 - DNA, 23 bp, Homo sapiens
ttctttttttttttttttgaaag

SEQ ID NO: 226003 - DNA, 13 bp, Homo sapiens
ttgaaaaatactg

SEQ ID NO: 226004 - DNA, 16 bp, Homo sapiens
ttgaaaacttcaaagc

SEQ ID NO: 226005 - DNA, 22 bp, Homo sapiens
gtgattaaatatttaatgatgt

SEQ ID NO: 226006 - DNA, 18 bp, Homo sapiens
gtgattaactgtgaataa

SEQ ID NO: 226007 - DNA, 15 bp, Homo sapiens
gtggaggcattgttt

SEQ ID NO: 226008 - DNA, 11 bp, Homo sapiens
gtggaggcctg

SEQ ID NO: 226009 - DNA, 15 bp, Homo sapiens
gtggaggcctgatgc

SEQ ID NO: 226010 - DNA, 18 bp, Homo sapiens
gtggagggattgaacaca

SEQ ID NO: 226011 - DNA, 23 bp, Homo sapiens
gtggagttattcactctcccaga

SEQ ID NO: 226012 - DNA, 22 bp, Homo sapiens
gtggatggtgacttttgaagaa

SEQ ID NO: 226013 - DNA, 15 bp, Homo sapiens
gtggatgtcttcctt

SEQ ID NO: 226014 - DNA, 17 bp, Homo sapiens
gtggatgtgtaaatgga

SEQ ID NO: 226015 - DNA, 13 bp, Homo sapiens
gtggattctatat

SEQ ID NO: 226016 - DNA, 16 bp, Homo sapiens
gtggattggctttgtg

SEQ ID NO: 226017 - DNA, 14 bp, Homo sapiens
ttgagtatttgctg

SEQ ID NO: 226018 - DNA, 16 bp, Homo sapiens
ttgagtatttgctgtt

SEQ ID NO: 226019 - DNA, 17 bp, Homo sapiens
ttgagtccattgcaaaa

SEQ ID NO: 226020 - DNA, 18 bp, Homo sapiens
ttgagtccattgcaaaag

SEQ ID NO: 226021 - DNA, 15 bp, Homo sapiens
ttgagtcccttccag

SEQ ID NO: 226022 - DNA, 20 bp, Homo sapiens
ttgagtcttcacatttagaa

SEQ ID NO: 226023 - DNA, 16 bp, Homo sapiens
ttgagtgtcaggctct

SEQ ID NO: 226024 - DNA, 16 bp, Homo sapiens
ttgagttcaaattttg

SEQ ID NO: 226025 - DNA, 17 bp, Homo sapiens
ttgagttcatcatgagc

SEQ ID NO: 226026 - DNA, 18 bp, Homo sapiens
ttgagttggacacactgt

SEQ ID NO: 226027 - DNA, 19 bp, Homo sapiens
ttgagtttcctcaggctgc

SEQ ID NO: 226028 - DNA, 22 bp, Homo sapiens
ttgagtttcctcaggctgctgg

SEQ ID NO: 226029 - DNA, 14 bp, Homo sapiens
ttgagtttcttcta

SEQ ID NO: 226030 - DNA, 15 bp, Homo sapiens
ttgataacattttgt

SEQ ID NO: 226031 - DNA, 16 bp, Homo sapiens
ttgatacatttatctt

SEQ ID NO: 226032 - DNA, 19 bp, Homo sapiens
ttgatacatttatcttctg

SEQ ID NO: 226033 - DNA, 20 bp, Homo sapiens
ttgatacatttatcttctgt

SEQ ID NO: 226034 - DNA, 21 bp, Homo sapiens
ttgatacatttatcttctgtt

SEQ ID NO: 226035 - DNA, 23 bp, Homo sapiens
ttgatacatttatcttctgtttt

SEQ ID NO: 226036 - DNA, 14 bp, Homo sapiens
ttgatagctttatt

SEQ ID NO: 226037 - DNA, 23 bp, Homo sapiens
ttgatatcctctttgagtgaagc

SEQ ID NO: 226038 - DNA, 16 bp, Homo sapiens
ttgatatgggctttct

SEQ ID NO: 226039 - DNA, 12 bp, Homo sapiens
ttgatatgtaac

SEQ ID NO: 226040 - DNA, 13 bp, Homo sapiens
ttgatatgtaaca

SEQ ID NO: 226041 - DNA, 14 bp, Homo sapiens
ttgatcacagatgt

SEQ ID NO: 226042 - DNA, 23 bp, Homo sapiens
ttgatcacagatgtgcccagagt

SEQ ID NO: 226043 - DNA, 18 bp, Homo sapiens
ttgatcagatcttacaag

SEQ ID NO: 226044 - DNA, 14 bp, Homo sapiens
ttgatcatgcagga

SEQ ID NO: 226045 - DNA, 21 bp, Homo sapiens
ttgatccctgttacccagaga

SEQ ID NO: 226046 - DNA, 23 bp, Homo sapiens
ttgatctaaggcatgctcccagc

SEQ ID NO: 226047 - DNA, 19 bp, Homo sapiens
ttgatctcctgacctcatg

SEQ ID NO: 226048 - DNA, 23 bp, Homo sapiens
ttgatctcctggtagcatgacct

SEQ ID NO: 226049 - DNA, 13 bp, Homo sapiens
ttgatctctgctt

SEQ ID NO: 226050 - DNA, 19 bp, Homo sapiens
ttgatctggtgcgtgtggc

SEQ ID NO: 226051 - DNA, 15 bp, Homo sapiens
ttgatgaaagctgat

SEQ ID NO: 226052 - DNA, 19 bp, Homo sapiens
ttgatgaccaatctctgtg

SEQ ID NO: 226053 - DNA, 11 bp, Homo sapiens
ttgatgcactt

SEQ ID NO: 226054 - DNA, 21 bp, Homo sapiens
ttgatgccagctgtactgagt

SEQ ID NO: 226055 - DNA, 15 bp, Homo sapiens
ttgatgctggagagg

SEQ ID NO: 226056 - DNA, 18 bp, Homo sapiens
ttgatggctaagatactg

SEQ ID NO: 226057 - DNA, 19 bp, Homo sapiens
ttgatggctatgttttgga

SEQ ID NO: 226058 - DNA, 19 bp, Homo sapiens
ttgatggtagaaattttat

SEQ ID NO: 226059 - DNA, 21 bp, Homo sapiens
ttgatgtaaaatcttgtcatg

SEQ ID NO: 226060 - DNA, 14 bp, Homo sapiens
ttgatgtatatgtt

SEQ ID NO: 226061 - DNA, 18 bp, Homo sapiens
ttgatgtgtatgtgttta

SEQ ID NO: 226062 - DNA, 23 bp, Homo sapiens
ttgatgttctttcacccttttct

SEQ ID NO: 226063 - DNA, 16 bp, Homo sapiens
ttgatgtttgtggcct

SEQ ID NO: 226064 - DNA, 12 bp, Homo sapiens
ttgattacataa

SEQ ID NO: 226065 - DNA, 21 bp, Homo sapiens
ttgattagaagccaagacagt

SEQ ID NO: 226066 - DNA, 16 bp, Homo sapiens
ttgattattagccagg

SEQ ID NO: 226067 - DNA, 22 bp, Homo sapiens
ttgattcgtctgcgattttatc

SEQ ID NO: 226068 - DNA, 12 bp, Homo sapiens
ttgattctttca

SEQ ID NO: 226069 - DNA, 14 bp, Homo sapiens
ttgattgaaaaaag

SEQ ID NO: 226070 - DNA, 18 bp, Homo sapiens
ttgattgaaaaaagagaa

SEQ ID NO: 226071 - DNA, 17 bp, Homo sapiens
ttgattgatttttaaag

SEQ ID NO: 226072 - DNA, 17 bp, Homo sapiens
ttgattgtcagctacta

SEQ ID NO: 226073 - DNA, 14 bp, Homo sapiens
ttgattgttcatat

SEQ ID NO: 226074 - DNA, 18 bp, Homo sapiens
ttgatttacagtgcctgt

SEQ ID NO: 226075 - DNA, 17 bp, Homo sapiens
ttgatttcgatgtacag

SEQ ID NO: 226076 - DNA, 16 bp, Homo sapiens
ttgatttgcatggatt

SEQ ID NO: 226077 - DNA, 20 bp, Homo sapiens
ttgattttccccctaattct

SEQ ID NO: 226078 - DNA, 15 bp, Homo sapiens
ttgatttttaaagtt

SEQ ID NO: 226079 - DNA, 16 bp, Homo sapiens
ttgatttttaaagttt

SEQ ID NO: 226080 - DNA, 15 bp, Homo sapiens
ttgcaaaagaagttg

SEQ ID NO: 226081 - DNA, 13 bp, Homo sapiens
ttgcaaaaggtta

SEQ ID NO: 226082 - DNA, 20 bp, Homo sapiens
ttgcaaaaggttaagccata

SEQ ID NO: 226083 - DNA, 11 bp, Homo sapiens
ttgcaaaattt

SEQ ID NO: 226084 - DNA, 15 bp, Homo sapiens
ttgcaaaatttccag

SEQ ID NO: 226085 - DNA, 21 bp, Homo sapiens
ttgcaaaatttccagtacctt

SEQ ID NO: 226086 - DNA, 20 bp, Homo sapiens
ttgcaaagaaaattctcaag

SEQ ID NO: 226087 - DNA, 16 bp, Homo sapiens
ttgcaaagcctttaaa

SEQ ID NO: 226088 - DNA, 18 bp, Homo sapiens
ttgcaaagcctttaaatt

SEQ ID NO: 226089 - DNA, 20 bp, Homo sapiens
ttgcaaatgcacatttgtca

SEQ ID NO: 226090 - DNA, 15 bp, Homo sapiens
ttgcaaattattcta

SEQ ID NO: 226091 - DNA, 17 bp, Homo sapiens
ttgcaaattattctagt

SEQ ID NO: 226092 - DNA, 20 bp, Homo sapiens
ttgcaaattattctagtcaa

SEQ ID NO: 226093 - DNA, 22 bp, Homo sapiens
ttgcaacttcatgtcaacttct

SEQ ID NO: 226094 - DNA, 22 bp, Homo sapiens
ttgcaagggccagatctgttaa

SEQ ID NO: 226095 - DNA, 21 bp, Homo sapiens
ttgcaagtatgttttagcatg

SEQ ID NO: 226096 - DNA, 22 bp, Homo sapiens
ttgcaagtatgttttagcatgt

SEQ ID NO: 226097 - DNA, 16 bp, Homo sapiens
ttgcaatcttatgttg

SEQ ID NO: 226098 - DNA, 19 bp, Homo sapiens
ttgcaatggctatatggca

SEQ ID NO: 226099 - DNA, 13 bp, Homo sapiens
ttgcacagacatc

SEQ ID NO: 226100 - DNA, 13 bp, Homo sapiens
ttgcacattagga

SEQ ID NO: 226101 - DNA, 23 bp, Homo sapiens
ttgcacattgttgtttttttaat

SEQ ID NO: 226102 - DNA, 22 bp, Homo sapiens
ttgcacctacgggggcatctga

SEQ ID NO: 226103 - DNA, 17 bp, Homo sapiens
ttgcacgttaaaaatta

SEQ ID NO: 226104 - DNA, 15 bp, Homo sapiens
ttgcactaaaagtga

SEQ ID NO: 226105 - DNA, 21 bp, Homo sapiens
ttgcactaaaagtgatgtgat

SEQ ID NO: 226106 - DNA, 22 bp, Homo sapiens
ttgcactaaaagtgatgtgatt

SEQ ID NO: 226107 - DNA, 15 bp, Homo sapiens
ttgcactaaagtatg

SEQ ID NO: 226108 - DNA, 14 bp, Homo sapiens
ttgcactgaaaacc

SEQ ID NO: 226109 - DNA, 20 bp, Homo sapiens
ttgcactgaagttgtctgaa

SEQ ID NO: 226110 - DNA, 21 bp, Homo sapiens
ttgcactgagggccacactat

SEQ ID NO: 226111 - DNA, 15 bp, Homo sapiens
ttgcactgtatccaa

SEQ ID NO: 226112 - DNA, 20 bp, Homo sapiens
ttgcagaacatgagtgctga

SEQ ID NO: 226113 - DNA, 21 bp, Homo sapiens
ttgcagaacatgagtgctgat

SEQ ID NO: 226114 - DNA, 16 bp, Homo sapiens
ttgcagacctgggact

SEQ ID NO: 226115 - DNA, 19 bp, Homo sapiens
ttgcagacctgggacttta

SEQ ID NO: 226116 - DNA, 14 bp, Homo sapiens
ttgcagatatttga

SEQ ID NO: 226117 - DNA, 15 bp, Homo sapiens
ttgcagatgccaaaa

SEQ ID NO: 226118 - DNA, 22 bp, Homo sapiens
ttgcagccctgctgctgcctgc

SEQ ID NO: 226119 - DNA, 21 bp, Homo sapiens
ttgcagcctagtaggagctga

SEQ ID NO: 226120 - DNA, 11 bp, Homo sapiens
ttgcagctgct

SEQ ID NO: 226121 - DNA, 13 bp, Homo sapiens
ttgcagctgctgg

SEQ ID NO: 226122 - DNA, 20 bp, Homo sapiens
ttgcaggccagtggacagag

SEQ ID NO: 226123 - DNA, 17 bp, Homo sapiens
ttgcaggcccagcagac

SEQ ID NO: 226124 - DNA, 21 bp, Homo sapiens
ttgcaggctctgggctcaggg

SEQ ID NO: 226125 - DNA, 18 bp, Homo sapiens
ttgcaggggatactgaaa

SEQ ID NO: 226126 - DNA, 20 bp, Homo sapiens
ttgcagtagagtcatctcca

SEQ ID NO: 226127 - DNA, 16 bp, Homo sapiens
ttgcagtatgatggca

SEQ ID NO: 226128 - DNA, 21 bp, Homo sapiens
ttgcagttggactctcaggga

SEQ ID NO: 226129 - DNA, 20 bp, Homo sapiens
ttgcagtttatatatatgct

SEQ ID NO: 226130 - DNA, 14 bp, Homo sapiens
ttgcataaagcata

SEQ ID NO: 226131 - DNA, 21 bp, Homo sapiens
ttgcataataagctaaagagg

SEQ ID NO: 226132 - DNA, 15 bp, Homo sapiens
ttgcataatactaat

SEQ ID NO: 226133 - DNA, 16 bp, Homo sapiens
ttgcataatactaatt

SEQ ID NO: 226134 - DNA, 21 bp, Homo sapiens
ttgcatcctatcgatctggaa

SEQ ID NO: 226135 - DNA, 18 bp, Homo sapiens
ttgcatctacctgctcct

SEQ ID NO: 226136 - DNA, 21 bp, Homo sapiens
ttgcatgatctgtcaaagtga

SEQ ID NO: 226137 - DNA, 18 bp, Homo sapiens
gtgtctgctgctgcctcc

SEQ ID NO: 226138 - DNA, 11 bp, Homo sapiens
gtgtctgctgt

SEQ ID NO: 226139 - DNA, 20 bp, Homo sapiens
gtgtctggaatcccagctcc

SEQ ID NO: 226140 - DNA, 22 bp, Homo sapiens
gtgtctggaatcccagctccgc

SEQ ID NO: 226141 - DNA, 20 bp, Homo sapiens
gtgtctggtcgtttgaccac

SEQ ID NO: 226142 - DNA, 18 bp, Homo sapiens
gtgtctgtaaggactcag

SEQ ID NO: 226143 - DNA, 18 bp, Homo sapiens
gtgtctgtcaccacatct

SEQ ID NO: 226144 - DNA, 18 bp, Homo sapiens
gtgtctgtccatctgtct

SEQ ID NO: 226145 - DNA, 22 bp, Homo sapiens
gtgtcttacaaggcaggccttt

SEQ ID NO: 226146 - DNA, 20 bp, Homo sapiens
gtgtcttttaatgatactgt

SEQ ID NO: 226147 - DNA, 23 bp, Homo sapiens
gtgtcttttgttctctcttggtc

SEQ ID NO: 226148 - DNA, 13 bp, Homo sapiens
gtgtgaaaatggg

SEQ ID NO: 226149 - DNA, 16 bp, Homo sapiens
gtgtgaggagctgctg

SEQ ID NO: 226150 - DNA, 19 bp, Homo sapiens
gtgtgaggagctgctggct

SEQ ID NO: 226151 - DNA, 14 bp, Homo sapiens
gtgtgagggcagca

SEQ ID NO: 226152 - DNA, 18 bp, Homo sapiens
gtgtgaggtttcacctcc

SEQ ID NO: 226153 - DNA, 19 bp, Homo sapiens
gtgtgagtggcagccatgc

SEQ ID NO: 226154 - DNA, 11 bp, Homo sapiens
gtgtgagtgtg

SEQ ID NO: 226155 - DNA, 22 bp, Homo sapiens
gtgtgatgaactttctcttcat

SEQ ID NO: 226156 - DNA, 13 bp, Homo sapiens
gtgtgatgtatgt

SEQ ID NO: 226157 - DNA, 14 bp, Homo sapiens
gtgtgatgtatgtt

SEQ ID NO: 226158 - DNA, 16 bp, Homo sapiens
gtgtgattgaatctga

SEQ ID NO: 226159 - DNA, 16 bp, Homo sapiens
gtgtgatttgtctctg

SEQ ID NO: 226160 - DNA, 21 bp, Homo sapiens
ttggaaagacaggaagaccaa

SEQ ID NO: 226161 - DNA, 23 bp, Homo sapiens
ttggaaattgggtgtgccctggc

SEQ ID NO: 226162 - DNA, 15 bp, Homo sapiens
ttggaactgctgcca

SEQ ID NO: 226163 - DNA, 23 bp, Homo sapiens
ttggaagagaggcacctgctgga

SEQ ID NO: 226164 - DNA, 15 bp, Homo sapiens
ttggaagagtgacct

SEQ ID NO: 226165 - DNA, 22 bp, Homo sapiens
ttggaagctgattcccagagca

SEQ ID NO: 226166 - DNA, 13 bp, Homo sapiens
ttggaaggtttta

SEQ ID NO: 226167 - DNA, 15 bp, Homo sapiens
ttggaagtgaaatta

SEQ ID NO: 226168 - DNA, 21 bp, Homo sapiens
ttggaagtgttcaagaaataa

SEQ ID NO: 226169 - DNA, 15 bp, Homo sapiens
ttggaataggaataa

SEQ ID NO: 226170 - DNA, 19 bp, Homo sapiens
ttggaattaacctggtgct

SEQ ID NO: 226171 - DNA, 20 bp, Homo sapiens
ttggaattaacctggtgctg

SEQ ID NO: 226172 - DNA, 22 bp, Homo sapiens
ttggaatttgtaacctcagctc

SEQ ID NO: 226173 - DNA, 13 bp, Homo sapiens
ttggacacactgt

SEQ ID NO: 226174 - DNA, 18 bp, Homo sapiens
ttggacacttaattctgt

SEQ ID NO: 226175 - DNA, 19 bp, Homo sapiens
ttggacacttaattctgtt

SEQ ID NO: 226176 - DNA, 22 bp, Homo sapiens
ttggacagcaaaaccattgctt

SEQ ID NO: 226177 - DNA, 18 bp, Homo sapiens
ttggacattttcttcaga

SEQ ID NO: 226178 - DNA, 14 bp, Homo sapiens
ttggaccccagaga

SEQ ID NO: 226179 - DNA, 16 bp, Homo sapiens
ttggacgcacacagct

SEQ ID NO: 226180 - DNA, 13 bp, Homo sapiens
ttggacggcctga

SEQ ID NO: 226181 - DNA, 18 bp, Homo sapiens
ttggactacctataaatg

SEQ ID NO: 226182 - DNA, 16 bp, Homo sapiens
ttggactcttgctctt

SEQ ID NO: 226183 - DNA, 16 bp, Homo sapiens
ttggactgtggcctca

SEQ ID NO: 226184 - DNA, 12 bp, Homo sapiens
ttggactttgtt

SEQ ID NO: 226185 - DNA, 18 bp, Homo sapiens
ttggacttttcgttaaca

SEQ ID NO: 226186 - DNA, 20 bp, Homo sapiens
ttggacttttcgttaacatt

SEQ ID NO: 226187 - DNA, 22 bp, Homo sapiens
ttggacttttcgttaacattga

SEQ ID NO: 226188 - DNA, 18 bp, Homo sapiens
ttggagacacaactattt

SEQ ID NO: 226189 - DNA, 14 bp, Homo sapiens
ttggagagaatcat

SEQ ID NO: 226190 - DNA, 13 bp, Homo sapiens
ttggagagcagct

SEQ ID NO: 226191 - DNA, 14 bp, Homo sapiens
ttggagagcagctg

SEQ ID NO: 226192 - DNA, 15 bp, Homo sapiens
ttggagagcagctgg

SEQ ID NO: 226193 - DNA, 17 bp, Homo sapiens
ttggagagcagctggct

SEQ ID NO: 226194 - DNA, 19 bp, Homo sapiens
ttggagaggaggtgtggag

SEQ ID NO: 226195 - DNA, 20 bp, Homo sapiens
ttggagagggacgaagaaag

SEQ ID NO: 226196 - DNA, 19 bp, Homo sapiens
ttggagcagagacggcagc

SEQ ID NO: 226197 - DNA, 12 bp, Homo sapiens
ttggagccactc

SEQ ID NO: 226198 - DNA, 14 bp, Homo sapiens
ttggagcctgcagg

SEQ ID NO: 226199 - DNA, 20 bp, Homo sapiens
ttggagcgagcatcccccaa

SEQ ID NO: 226200 - DNA, 20 bp, Homo sapiens
ttggagctgagatgagcccc

SEQ ID NO: 226201 - DNA, 17 bp, Homo sapiens
ttggagctgtcctccag

SEQ ID NO: 226202 - DNA, 20 bp, Homo sapiens
ttggagctgtcctccagagg

SEQ ID NO: 226203 - DNA, 24 bp, Homo sapiens
ttggaggcccttttctggctcctg

SEQ ID NO: 226204 - DNA, 13 bp, Homo sapiens
ttggaggcctcac

SEQ ID NO: 226205 - DNA, 15 bp, Homo sapiens
ttggagggatcattt

SEQ ID NO: 226206 - DNA, 15 bp, Homo sapiens
ttggaggggggagcc

SEQ ID NO: 226207 - DNA, 16 bp, Homo sapiens
ttggagtggaggcatt

SEQ ID NO: 226208 - DNA, 22 bp, Homo sapiens
ttggataacaccaccattcaca

SEQ ID NO: 226209 - DNA, 21 bp, Homo sapiens
ttggataataactagatctcc

SEQ ID NO: 226210 - DNA, 20 bp, Homo sapiens
ttggataggagcttccagat

SEQ ID NO: 226211 - DNA, 19 bp, Homo sapiens
ttggatctatcacctgtca

SEQ ID NO: 226212 - DNA, 19 bp, Homo sapiens
ttggatcttcaatggcttt

SEQ ID NO: 226213 - DNA, 13 bp, Homo sapiens
ttggatgaatgca

SEQ ID NO: 226214 - DNA, 23 bp, Homo sapiens
ttggatgaatgcagtataaaatg

SEQ ID NO: 226215 - DNA, 21 bp, Homo sapiens
ttggatggagtccagggaaga

SEQ ID NO: 226216 - DNA, 21 bp, Homo sapiens
ttggatggcttaagcctgtgt

SEQ ID NO: 226217 - DNA, 22 bp, Homo sapiens
ttggatggcttaagcctgtgta

SEQ ID NO: 226218 - DNA, 17 bp, Homo sapiens
ttggattattcatttaa

SEQ ID NO: 226219 - DNA, 20 bp, Homo sapiens
ttggattattcatttaaaat

SEQ ID NO: 226220 - DNA, 23 bp, Homo sapiens
ttggattattcatttaaaatgat

SEQ ID NO: 226221 - DNA, 18 bp, Homo sapiens
ttggcaagaagactgtat

SEQ ID NO: 226222 - DNA, 16 bp, Homo sapiens
ttggcaattcttcttc

SEQ ID NO: 226223 - DNA, 20 bp, Homo sapiens
ttggcaattcttcttctcaa

SEQ ID NO: 226224 - DNA, 11 bp, Homo sapiens
ttggcaccaaa

SEQ ID NO: 226225 - DNA, 18 bp, Homo sapiens
ttggcaccaaagatgcag

SEQ ID NO: 226226 - DNA, 15 bp, Homo sapiens
ttggcactgatgggc

SEQ ID NO: 226227 - DNA, 17 bp, Homo sapiens
ttggcagagaaggcctc

SEQ ID NO: 226228 - DNA, 22 bp, Homo sapiens
ttggcaggagtgggctctgagc

SEQ ID NO: 226229 - DNA, 14 bp, Homo sapiens
ttggcatggcttta

SEQ ID NO: 226230 - DNA, 20 bp, Homo sapiens
ttggccaaacatcagacctg

SEQ ID NO: 226231 - DNA, 19 bp, Homo sapiens
ttggccactgggtctcact

SEQ ID NO: 226232 - DNA, 22 bp, Homo sapiens
ttggccactgggtctcactcct

SEQ ID NO: 226233 - DNA, 19 bp, Homo sapiens
ttggcccccgagctggggg

SEQ ID NO: 226234 - DNA, 22 bp, Homo sapiens
ttggccctctcccatgcacaca

SEQ ID NO: 226235 - DNA, 16 bp, Homo sapiens
ttggccgatgagctgg

SEQ ID NO: 226236 - DNA, 22 bp, Homo sapiens
ttggccgcacctaaagcagcca

SEQ ID NO: 226237 - DNA, 15 bp, Homo sapiens
ttggccggctggccg

SEQ ID NO: 226238 - DNA, 12 bp, Homo sapiens
ttggcctggagg

SEQ ID NO: 226239 - DNA, 23 bp, Homo sapiens
ttggcctgtccacctgtgctgct

SEQ ID NO: 226240 - DNA, 13 bp, Homo sapiens
ttggcgtggagca

SEQ ID NO: 226241 - DNA, 20 bp, Homo sapiens
ttggcgtgtgtccctgtggt

SEQ ID NO: 226242 - DNA, 14 bp, Homo sapiens
ttggcgttgtgggc

SEQ ID NO: 226243 - DNA, 17 bp, Homo sapiens
ttggctcactgcagcct

SEQ ID NO: 226244 - DNA, 15 bp, Homo sapiens
ttggctcctttccca

SEQ ID NO: 226245 - DNA, 17 bp, Homo sapiens
ttggctcctttcccaca

SEQ ID NO: 226246 - DNA, 18 bp, Homo sapiens
ttggctcgggacttcaaa

SEQ ID NO: 226247 - DNA, 14 bp, Homo sapiens
ttggctctttcaga

SEQ ID NO: 226248 - DNA, 15 bp, Homo sapiens
ttggctgaaattatg

SEQ ID NO: 226249 - DNA, 19 bp, Homo sapiens
ttggctgccccacaggcca

SEQ ID NO: 226250 - DNA, 15 bp, Homo sapiens
ttggctgctgccacc

SEQ ID NO: 226251 - DNA, 21 bp, Homo sapiens
ttggctggatgaaattttcta

SEQ ID NO: 226252 - DNA, 23 bp, Homo sapiens
ttggctgggggcatgggggaggc

SEQ ID NO: 226253 - DNA, 16 bp, Homo sapiens
ttggctgttccagact

SEQ ID NO: 226254 - DNA, 14 bp, Homo sapiens
ttggcttataaaca

SEQ ID NO: 226255 - DNA, 15 bp, Homo sapiens
ttggcttcagaattg

SEQ ID NO: 226256 - DNA, 22 bp, Homo sapiens
ttggctttaaacacccttcaca

SEQ ID NO: 226257 - DNA, 15 bp, Homo sapiens
ttggctttgtgcttg

SEQ ID NO: 226258 - DNA, 14 bp, Homo sapiens
ttggctttttaaat

SEQ ID NO: 226259 - DNA, 16 bp, Homo sapiens
ttgggaaatacaagaa

SEQ ID NO: 226260 - DNA, 21 bp, Homo sapiens
ttgggaaattcttgcactgta

SEQ ID NO: 226261 - DNA, 13 bp, Homo sapiens
ttgggacagccag

SEQ ID NO: 226262 - DNA, 14 bp, Homo sapiens
ttgggactgtcttg

SEQ ID NO: 226263 - DNA, 13 bp, Homo sapiens
ttgggagagactt

SEQ ID NO: 226264 - DNA, 16 bp, Homo sapiens
ttgggagagcccctgg

SEQ ID NO: 226265 - DNA, 15 bp, Homo sapiens
ttgggagcactggag

SEQ ID NO: 226266 - DNA, 16 bp, Homo sapiens
ttgggagcactggagt

SEQ ID NO: 226267 - DNA, 22 bp, Homo sapiens
gttcagagactggcagccaggg

SEQ ID NO: 226268 - DNA, 15 bp, Homo sapiens
gttcagattggacat

SEQ ID NO: 226269 - DNA, 16 bp, Homo sapiens
gttcagcaccacccta

SEQ ID NO: 226270 - DNA, 17 bp, Homo sapiens
gttcagcaccaccctag

SEQ ID NO: 226271 - DNA, 18 bp, Homo sapiens
gttcagcactgtcccttg

SEQ ID NO: 226272 - DNA, 15 bp, Homo sapiens
gttcagctgcttctc

SEQ ID NO: 226273 - DNA, 22 bp, Homo sapiens
gttcaggagagtaaaaattcat

SEQ ID NO: 226274 - DNA, 23 bp, Homo sapiens
gttcagggaactgcttgcccagg

SEQ ID NO: 226275 - DNA, 20 bp, Homo sapiens
gttcaggggactcagccctg

SEQ ID NO: 226276 - DNA, 23 bp, Homo sapiens
gttcaggtcccacgtctggccag

SEQ ID NO: 226277 - DNA, 15 bp, Homo sapiens
gttcagttccagctt

SEQ ID NO: 226278 - DNA, 17 bp, Homo sapiens
gttcatagggtctcttc

SEQ ID NO: 226279 - DNA, 22 bp, Homo sapiens
gttcatatgtaccatgtacatg

SEQ ID NO: 226280 - DNA, 16 bp, Homo sapiens
gttcatcagtgttaaa

SEQ ID NO: 226281 - DNA, 18 bp, Homo sapiens
gttcatctctgctgaaca

SEQ ID NO: 226282 - DNA, 19 bp, Homo sapiens
gttcatctgaggagtccaa

SEQ ID NO: 226283 - DNA, 12 bp, Homo sapiens
gttcatcttgaa

SEQ ID NO: 226284 - DNA, 12 bp, Homo sapiens
gttcatgaatac

SEQ ID NO: 226285 - DNA, 19 bp, Homo sapiens
gttcatgtgtaacttctag

SEQ ID NO: 226286 - DNA, 18 bp, Homo sapiens
gttcatgtttgtaaatta

SEQ ID NO: 226287 - DNA, 17 bp, Homo sapiens
gttcatgttttgctaat

SEQ ID NO: 226288 - DNA, 18 bp, Homo sapiens
gttcatgttttgctaatg

SEQ ID NO: 226289 - DNA, 13 bp, Homo sapiens
gttcattaaacag

SEQ ID NO: 226290 - DNA, 14 bp, Homo sapiens
gttcattattttgt

SEQ ID NO: 226291 - DNA, 11 bp, Homo sapiens
gttcattcaca

SEQ ID NO: 226292 - DNA, 21 bp, Homo sapiens
gttcattctatgacaataaat

SEQ ID NO: 226293 - DNA, 18 bp, Homo sapiens
gttcattgtaatgttact

SEQ ID NO: 226294 - DNA, 21 bp, Homo sapiens
gttcattgtaatgttactgat

SEQ ID NO: 226295 - DNA, 12 bp, Homo sapiens
gttcatttccac

SEQ ID NO: 226296 - DNA, 12 bp, Homo sapiens
gttcatttctgt

SEQ ID NO: 226297 - DNA, 16 bp, Homo sapiens
gttcatttctgtctcc

SEQ ID NO: 226298 - DNA, 16 bp, Homo sapiens
gttcatttgtgtgctc

SEQ ID NO: 226299 - DNA, 17 bp, Homo sapiens
gttcatttgtgtgctca

SEQ ID NO: 226300 - DNA, 20 bp, Homo sapiens
gttcattttctgtaattgct

SEQ ID NO: 226301 - DNA, 15 bp, Homo sapiens
gttccaaccaggcag

SEQ ID NO: 226302 - DNA, 13 bp, Homo sapiens
gttccaagacatt

SEQ ID NO: 226303 - DNA, 15 bp, Homo sapiens
gttccaagacattgt

SEQ ID NO: 226304 - DNA, 17 bp, Homo sapiens
gttccaagacattgtca

SEQ ID NO: 226305 - DNA, 16 bp, Homo sapiens
gttccaatcctggctc

SEQ ID NO: 226306 - DNA, 16 bp, Homo sapiens
ttgtcatgtaccatca

SEQ ID NO: 226307 - DNA, 18 bp, Homo sapiens
ttgtcatgtaccatcaat

SEQ ID NO: 226308 - DNA, 20 bp, Homo sapiens
ttgtcattcaagcctgtgaa

SEQ ID NO: 226309 - DNA, 20 bp, Homo sapiens
ttgtccaacaactccaggaa

SEQ ID NO: 226310 - DNA, 16 bp, Homo sapiens
ttgtccacaaatgtcc

SEQ ID NO: 226311 - DNA, 21 bp, Homo sapiens
ttgtccacaaatgtcctcaga

SEQ ID NO: 226312 - DNA, 22 bp, Homo sapiens
ttgtccacaaatgtcctcagag

SEQ ID NO: 226313 - DNA, 18 bp, Homo sapiens
ttgtccatatcagacctc

SEQ ID NO: 226314 - DNA, 13 bp, Homo sapiens
ttgtcccacagct

SEQ ID NO: 226315 - DNA, 21 bp, Homo sapiens
ttgtcccatttattattttaa

SEQ ID NO: 226316 - DNA, 23 bp, Homo sapiens
ttgtcccatttctaaaggcctct

SEQ ID NO: 226317 - DNA, 14 bp, Homo sapiens
ttgtccccagggcc

SEQ ID NO: 226318 - DNA, 16 bp, Homo sapiens
ttgtcccccaacttga

SEQ ID NO: 226319 - DNA, 15 bp, Homo sapiens
ttgtcccctcacctc

SEQ ID NO: 226320 - DNA, 18 bp, Homo sapiens
ttgtcccgattgtaactc

SEQ ID NO: 226321 - DNA, 20 bp, Homo sapiens
ttgtccctctcactccccag

SEQ ID NO: 226322 - DNA, 13 bp, Homo sapiens
ttgtccctttccc

SEQ ID NO: 226323 - DNA, 21 bp, Homo sapiens
ttgtccggtggaaggccttct

SEQ ID NO: 226324 - DNA, 15 bp, Homo sapiens
ttgtcctccccttgg

SEQ ID NO: 226325 - DNA, 17 bp, Homo sapiens
ttgtcctgccagctgcc

SEQ ID NO: 226326 - DNA, 18 bp, Homo sapiens
ttgtcctgccagctgcct

SEQ ID NO: 226327 - DNA, 15 bp, Homo sapiens
ttgtccttcagagct

SEQ ID NO: 226328 - DNA, 17 bp, Homo sapiens
ttgtccttcagagctct

SEQ ID NO: 226329 - DNA, 20 bp, Homo sapiens
ttgtcctttgagaaagaaat

SEQ ID NO: 226330 - DNA, 18 bp, Homo sapiens
ttgtctattctgagcctt

SEQ ID NO: 226331 - DNA, 19 bp, Homo sapiens
ttgtctattctgagccttg

SEQ ID NO: 226332 - DNA, 18 bp, Homo sapiens
ttgtctatttttgtctta

SEQ ID NO: 226333 - DNA, 16 bp, Homo sapiens
ttgtctcaccagctca

SEQ ID NO: 226334 - DNA, 13 bp, Homo sapiens
ttgtctccttcca

SEQ ID NO: 226335 - DNA, 12 bp, Homo sapiens
ttgtctctgggc

SEQ ID NO: 226336 - DNA, 13 bp, Homo sapiens
ttgtctcttagaa

SEQ ID NO: 226337 - DNA, 17 bp, Homo sapiens
ttgtctgaagtcactgc

SEQ ID NO: 226338 - DNA, 13 bp, Homo sapiens
ttgtctgaggcct

SEQ ID NO: 226339 - DNA, 21 bp, Homo sapiens
ttgtctgaggcctcatccctc

SEQ ID NO: 226340 - DNA, 16 bp, Homo sapiens
ttgtctggctgtggcc

SEQ ID NO: 226341 - DNA, 23 bp, Homo sapiens
ttgtctggggccgaggggccagg

SEQ ID NO: 226342 - DNA, 16 bp, Homo sapiens
ttgtcttagagagaga

SEQ ID NO: 226343 - DNA, 13 bp, Homo sapiens
ttgtctttctttg

SEQ ID NO: 226344 - DNA, 17 bp, Homo sapiens
ttgtctttctttgctgc

SEQ ID NO: 226345 - DNA, 14 bp, Homo sapiens
ttgtcttttgtaaa

SEQ ID NO: 226346 - DNA, 14 bp, Homo sapiens
ttgtctttttcctt

SEQ ID NO: 226347 - DNA, 15 bp, Homo sapiens
ttgtctttttccttt

SEQ ID NO: 226348 - DNA, 17 bp, Homo sapiens
ttgtcttttttttcatc

SEQ ID NO: 226349 - DNA, 11 bp, Homo sapiens
ttgtgaaagca

SEQ ID NO: 226350 - DNA, 20 bp, Homo sapiens
ttgtgaaagctccatgttta

SEQ ID NO: 226351 - DNA, 14 bp, Homo sapiens
ttgtgaaatgatgg

SEQ ID NO: 226352 - DNA, 19 bp, Homo sapiens
ttgtgaaatgtctgttcca

SEQ ID NO: 226353 - DNA, 14 bp, Homo sapiens
ttgtgaaatttgtt

SEQ ID NO: 226354 - DNA, 23 bp, Homo sapiens
ttgtgaaatttgttaatatatat

SEQ ID NO: 226355 - DNA, 18 bp, Homo sapiens
ttgtgaaccaactgcctt

SEQ ID NO: 226356 - DNA, 13 bp, Homo sapiens
ttgtgaactcatt

SEQ ID NO: 226357 - DNA, 21 bp, Homo sapiens
ttgtgaagtgattgacatttt

SEQ ID NO: 226358 - DNA, 16 bp, Homo sapiens
ttgtgaatgttgtcct

SEQ ID NO: 226359 - DNA, 16 bp, Homo sapiens
ttgtgactagtgctga

SEQ ID NO: 226360 - DNA, 19 bp, Homo sapiens
ttgtgactatatagagatg

SEQ ID NO: 226361 - DNA, 15 bp, Homo sapiens
ttgtgactggcaccc

SEQ ID NO: 226362 - DNA, 22 bp, Homo sapiens
ttgtgagacggctggaaattct

SEQ ID NO: 226363 - DNA, 18 bp, Homo sapiens
ttgtgagccaccacgtcc

SEQ ID NO: 226364 - DNA, 17 bp, Homo sapiens
ttgtgagccttgctgcc

SEQ ID NO: 226365 - DNA, 14 bp, Homo sapiens
ttgtgagtatgtgt

SEQ ID NO: 226366 - DNA, 22 bp, Homo sapiens
ttgtgatgtcccaacttgtaaa

SEQ ID NO: 226367 - DNA, 17 bp, Homo sapiens
ttgtgcataaatttcca

SEQ ID NO: 226368 - DNA, 20 bp, Homo sapiens
ttgtgcatgcaaaccaggag

SEQ ID NO: 226369 - DNA, 16 bp, Homo sapiens
ttgtgccaatatgtat

SEQ ID NO: 226370 - DNA, 17 bp, Homo sapiens
ttgtgccaatatgtatt

SEQ ID NO: 226371 - DNA, 16 bp, Homo sapiens
ttgtgcctcccttccc

SEQ ID NO: 226372 - DNA, 14 bp, Homo sapiens
ttgtgcctttcaca

SEQ ID NO: 226373 - DNA, 20 bp, Homo sapiens
ttgtgcctttcacagcttct

SEQ ID NO: 226374 - DNA, 15 bp, Homo sapiens
ttgtgcggtgtgtct

SEQ ID NO: 226375 - DNA, 13 bp, Homo sapiens
ttgtgctaatttc

SEQ ID NO: 226376 - DNA, 13 bp, Homo sapiens
ttgtgctctttcc

SEQ ID NO: 226377 - DNA, 16 bp, Homo sapiens
ttgtgctctttcctgc

SEQ ID NO: 226378 - DNA, 17 bp, Homo sapiens
ttgtgctctttcctgcc

SEQ ID NO: 226379 - DNA, 18 bp, Homo sapiens
ttgtggactttatttaat

SEQ ID NO: 226380 - DNA, 19 bp, Homo sapiens
ttgtggcagaagtgtttca

SEQ ID NO: 226381 - DNA, 20 bp, Homo sapiens
ttgtggccccttttactttt

SEQ ID NO: 226382 - DNA, 12 bp, Homo sapiens
ttgtggcctcag

SEQ ID NO: 226383 - DNA, 13 bp, Homo sapiens
ttgtggcctcaga

SEQ ID NO: 226384 - DNA, 20 bp, Homo sapiens
ttgtgggacttattacaatt

SEQ ID NO: 226385 - DNA, 20 bp, Homo sapiens
ttgtgggggctagaaaaaac

SEQ ID NO: 226386 - DNA, 23 bp, Homo sapiens
ttgtgggggtgtcacagaggcag

SEQ ID NO: 226387 - DNA, 17 bp, Homo sapiens
ttgtgggtttctctgtg

SEQ ID NO: 226388 - DNA, 13 bp, Homo sapiens
ttgtggtgtctta

SEQ ID NO: 226389 - DNA, 16 bp, Homo sapiens
ttgtggttctatttta

SEQ ID NO: 226390 - DNA, 17 bp, Homo sapiens
ttgtggttttcaaattg

SEQ ID NO: 226391 - DNA, 22 bp, Homo sapiens
ttgtgtaagagaatgttgaata

SEQ ID NO: 226392 - DNA, 14 bp, Homo sapiens
ttgtgtaatattac

SEQ ID NO: 226393 - DNA, 15 bp, Homo sapiens
ttgtgtacagtatgt

SEQ ID NO: 226394 - DNA, 17 bp, Homo sapiens
ttgtgtacagtatgtgt

SEQ ID NO: 226395 - DNA, 18 bp, Homo sapiens
ttgtgtatggatatgtgt

SEQ ID NO: 226396 - DNA, 16 bp, Homo sapiens
ttgtgtattagatatc

SEQ ID NO: 226397 - DNA, 21 bp, Homo sapiens
ttgtgtcaatgggcaatgaca

SEQ ID NO: 226398 - DNA, 18 bp, Homo sapiens
gttgtaaggattgccttt

SEQ ID NO: 226399 - DNA, 12 bp, Homo sapiens
gttgtacacttg

SEQ ID NO: 226400 - DNA, 18 bp, Homo sapiens
gttgtacacttgggtgaa

SEQ ID NO: 226401 - DNA, 14 bp, Homo sapiens
gttgtaccactgct

SEQ ID NO: 226402 - DNA, 18 bp, Homo sapiens
gttgtaccactgctaata

SEQ ID NO: 226403 - DNA, 22 bp, Homo sapiens
gttgtaccactgctaataaatg

SEQ ID NO: 226404 - DNA, 14 bp, Homo sapiens
gttgtatgccttta

SEQ ID NO: 226405 - DNA, 17 bp, Homo sapiens
gttgtcaagtctctgct

SEQ ID NO: 226406 - DNA, 14 bp, Homo sapiens
gttgtcattgcttt

SEQ ID NO: 226407 - DNA, 16 bp, Homo sapiens
gttgtcctccccttgg

SEQ ID NO: 226408 - DNA, 19 bp, Homo sapiens
gttgtcctccccttgggcg

SEQ ID NO: 226409 - DNA, 18 bp, Homo sapiens
gttgtcctgtgtcatctg

SEQ ID NO: 226410 - DNA, 21 bp, Homo sapiens
gttgtcctgtgtcatctgtca

SEQ ID NO: 226411 - DNA, 23 bp, Homo sapiens
gttgtctaaaaataaaatgcatt

SEQ ID NO: 226412 - DNA, 20 bp, Homo sapiens
gttgtctattctgagccttg

SEQ ID NO: 226413 - DNA, 22 bp, Homo sapiens
gttgtctattctgagccttgag

SEQ ID NO: 226414 - DNA, 18 bp, Homo sapiens
gttgtctctagagcaggg

SEQ ID NO: 226415 - DNA, 15 bp, Homo sapiens
gttgtgaagatgttt

SEQ ID NO: 226416 - DNA, 23 bp, Homo sapiens
gttgtgactttttagccagtgac

SEQ ID NO: 226417 - DNA, 22 bp, Homo sapiens
gttgtgattccccggagctggg

SEQ ID NO: 226418 - DNA, 23 bp, Homo sapiens
gttgtgattccccggagctggga

SEQ ID NO: 226419 - DNA, 17 bp, Homo sapiens
gttgtgcaaattaacag

SEQ ID NO: 226420 - DNA, 19 bp, Homo sapiens
gttgtgctaatttctgtcc

SEQ ID NO: 226421 - DNA, 21 bp, Homo sapiens
gttgtgtaagagaatgttgaa

SEQ ID NO: 226422 - DNA, 21 bp, Homo sapiens
gttgtgttgttatcatttaag

SEQ ID NO: 226423 - DNA, 15 bp, Homo sapiens
gttgttaagagacat

SEQ ID NO: 226424 - DNA, 14 bp, Homo sapiens
gttgttatattcat

SEQ ID NO: 226425 - DNA, 16 bp, Homo sapiens
gttgttatggaaactg

SEQ ID NO: 226426 - DNA, 18 bp, Homo sapiens
gttgttcaagcttttcct

SEQ ID NO: 226427 - DNA, 20 bp, Homo sapiens
gttgttgccaactaagccct

SEQ ID NO: 226428 - DNA, 16 bp, Homo sapiens
gttgttgttaaatatc

SEQ ID NO: 226429 - DNA, 24 bp, Homo sapiens
gttgttgttaatgaaaatgtcaga

SEQ ID NO: 226430 - DNA, 15 bp, Homo sapiens
gttgtttctctgagc

SEQ ID NO: 226431 - DNA, 23 bp, Homo sapiens
gttgtttgaaaatattatctttg

SEQ ID NO: 226432 - DNA, 14 bp, Homo sapiens
gttgtttgatgtgt

SEQ ID NO: 226433 - DNA, 20 bp, Homo sapiens
gtttaaaaaaataacatctc

SEQ ID NO: 226434 - DNA, 19 bp, Homo sapiens
gtttaaaagacacacttgt

SEQ ID NO: 226435 - DNA, 22 bp, Homo sapiens
gtttaaaagcatactctatgtg

SEQ ID NO: 226436 - DNA, 13 bp, Homo sapiens
gtttaaaattatt

SEQ ID NO: 226437 - DNA, 17 bp, Homo sapiens
gtttaaaattattaaaa

SEQ ID NO: 226438 - DNA, 13 bp, Homo sapiens
gtttaaataaagt

SEQ ID NO: 226439 - DNA, 17 bp, Homo sapiens
gtttaaataaagtatca

SEQ ID NO: 226440 - DNA, 22 bp, Homo sapiens
gtttaacggcactgtggccttg

SEQ ID NO: 226441 - DNA, 12 bp, Homo sapiens
gtttaactcaga

SEQ ID NO: 226442 - DNA, 15 bp, Homo sapiens
gtttaactcagatca

SEQ ID NO: 226443 - DNA, 17 bp, Homo sapiens
gtttaactcagatcact

SEQ ID NO: 226444 - DNA, 19 bp, Homo sapiens
gtttaactcagatcactac

SEQ ID NO: 226445 - DNA, 22 bp, Homo sapiens
gtttaactcagatcactactgc

SEQ ID NO: 226446 - DNA, 19 bp, Homo sapiens
gtttaatattgagaaagaa

SEQ ID NO: 226447 - DNA, 13 bp, Homo sapiens
gtttaatgtcagg

SEQ ID NO: 226448 - DNA, 16 bp, Homo sapiens
gtttacaacaaacact

SEQ ID NO: 226449 - DNA, 21 bp, Homo sapiens
gtttacaacaaacactgtgat

SEQ ID NO: 226450 - DNA, 18 bp, Homo sapiens
gtttacaaccttgtgagc

SEQ ID NO: 226451 - DNA, 20 bp, Homo sapiens
accccggcaggccctgcagt

SEQ ID NO: 226452 - DNA, 22 bp, Homo sapiens
accccggctccccctgccagca

SEQ ID NO: 226453 - DNA, 23 bp, Homo sapiens
accccggggcatggacagggcca

SEQ ID NO: 226454 - DNA, 18 bp, Homo sapiens
accccgtccctttccctg

SEQ ID NO: 226455 - DNA, 15 bp, Homo sapiens
accccgtctgcccct

SEQ ID NO: 226456 - DNA, 23 bp, Homo sapiens
accccgtctgccccttgacccca

SEQ ID NO: 226457 - DNA, 14 bp, Homo sapiens
accccgtgccaccc

SEQ ID NO: 226458 - DNA, 15 bp, Homo sapiens
accccgttacagctc

SEQ ID NO: 226459 - DNA, 14 bp, Homo sapiens
acccctacagcctg

SEQ ID NO: 226460 - DNA, 16 bp, Homo sapiens
acccctacagcctgca

SEQ ID NO: 226461 - DNA, 17 bp, Homo sapiens
acccctacagcctgcac

SEQ ID NO: 226462 - DNA, 15 bp, Homo sapiens
acccctaccctttcc

SEQ ID NO: 226463 - DNA, 19 bp, Homo sapiens
acccctaccgatggtccca

SEQ ID NO: 226464 - DNA, 23 bp, Homo sapiens
acccctcaagccaggagaccctg

SEQ ID NO: 226465 - DNA, 15 bp, Homo sapiens
acccctcaccttgca

SEQ ID NO: 226466 - DNA, 19 bp, Homo sapiens
acccctcaccttgcaacac

SEQ ID NO: 226467 - DNA, 14 bp, Homo sapiens
acccctcccaacct

SEQ ID NO: 226468 - DNA, 19 bp, Homo sapiens
acccctccctctgctctca

SEQ ID NO: 226469 - DNA, 21 bp, Homo sapiens
acccctcccttgctcagtgcc

SEQ ID NO: 226470 - DNA, 22 bp, Homo sapiens
acccctcccttgctcagtgcct

SEQ ID NO: 226471 - DNA, 12 bp, Homo sapiens
acccctcctggg

SEQ ID NO: 226472 - DNA, 16 bp, Homo sapiens
acccctcctgggccca

SEQ ID NO: 226473 - DNA, 12 bp, Homo sapiens
acccctgcacca

SEQ ID NO: 226474 - DNA, 12 bp, Homo sapiens
acccctgcccag

SEQ ID NO: 226475 - DNA, 22 bp, Homo sapiens
acccctgcctggatttcttcct

SEQ ID NO: 226476 - DNA, 23 bp, Homo sapiens
acccctgcctggatttcttccta

SEQ ID NO: 226477 - DNA, 18 bp, Homo sapiens
acccctgctcccagcctg

SEQ ID NO: 226478 - DNA, 19 bp, Homo sapiens
acccctgctcccagcctgc

SEQ ID NO: 226479 - DNA, 19 bp, Homo sapiens
acccctgctcccattcctc

SEQ ID NO: 226480 - DNA, 23 bp, Homo sapiens
acccctgctcccattcctccctc

SEQ ID NO: 226481 - DNA, 18 bp, Homo sapiens
acccctggcttttcactg

SEQ ID NO: 226482 - DNA, 19 bp, Homo sapiens
acccctggcttttcactgc

SEQ ID NO: 226483 - DNA, 20 bp, Homo sapiens
acccctggcttttcactgct

SEQ ID NO: 226484 - DNA, 21 bp, Homo sapiens
acccctggcttttcactgctg

SEQ ID NO: 226485 - DNA, 12 bp, Homo sapiens
acccctgggcag

SEQ ID NO: 226486 - DNA, 14 bp, Homo sapiens
acccctgggcaggc

SEQ ID NO: 226487 - DNA, 12 bp, Homo sapiens
acccctgtaccc

SEQ ID NO: 226488 - DNA, 16 bp, Homo sapiens
acccctgtacccagct

SEQ ID NO: 226489 - DNA, 19 bp, Homo sapiens
acccctgtacccagctcct

SEQ ID NO: 226490 - DNA, 11 bp, Homo sapiens
accccttccca

SEQ ID NO: 226491 - DNA, 15 bp, Homo sapiens
accccttccccactg

SEQ ID NO: 226492 - DNA, 21 bp, Homo sapiens
accccttccccactgcctgcc

SEQ ID NO: 226493 - DNA, 13 bp, Homo sapiens
accccttccccat

SEQ ID NO: 226494 - DNA, 22 bp, Homo sapiens
accccttccccatttcctcttc

SEQ ID NO: 226495 - DNA, 15 bp, Homo sapiens
accccttcctgtctg

SEQ ID NO: 226496 - DNA, 18 bp, Homo sapiens
accccttcctgtctggcc

SEQ ID NO: 226497 - DNA, 19 bp, Homo sapiens
acccgacaccagccctgct

SEQ ID NO: 226498 - DNA, 14 bp, Homo sapiens
acccgactgtgaaa

SEQ ID NO: 226499 - DNA, 22 bp, Homo sapiens
acccgccgccactaggtgtccc

SEQ ID NO: 226500 - DNA, 15 bp, Homo sapiens
acccgctgcccagcc

SEQ ID NO: 226501 - DNA, 16 bp, Homo sapiens
acccgctgcccagccc

SEQ ID NO: 226502 - DNA, 19 bp, Homo sapiens
acccgctgcccagccctcc

SEQ ID NO: 226503 - DNA, 15 bp, Homo sapiens
acccgctgcttccag

SEQ ID NO: 226504 - DNA, 17 bp, Homo sapiens
acccgctgcttccaggt

SEQ ID NO: 226505 - DNA, 16 bp, Homo sapiens
acccgctttcttgctg

SEQ ID NO: 226506 - DNA, 21 bp, Homo sapiens
acccggaggggcctggcagcc

SEQ ID NO: 226507 - DNA, 16 bp, Homo sapiens
acccggatctccaggc

SEQ ID NO: 226508 - DNA, 17 bp, Homo sapiens
acccggatctccaggcc

SEQ ID NO: 226509 - DNA, 22 bp, Homo sapiens
acccggcatgccgagtgcccca

SEQ ID NO: 226510 - DNA, 20 bp, Homo sapiens
acccggccacagctgctgga

SEQ ID NO: 226511 - DNA, 19 bp, Homo sapiens
acccgggaccacagctgct

SEQ ID NO: 226512 - DNA, 20 bp, Homo sapiens
acccgggcagggctcccaca

SEQ ID NO: 226513 - DNA, 13 bp, Homo sapiens
acccggggcagct

SEQ ID NO: 226514 - DNA, 19 bp, Homo sapiens
acccgtaggcagcctctct

SEQ ID NO: 226515 - DNA, 23 bp, Homo sapiens
acccgtaggcagcctctctgcta

SEQ ID NO: 226516 - DNA, 13 bp, Homo sapiens
acccgtgttctcc

SEQ ID NO: 226517 - DNA, 15 bp, Homo sapiens
accctaacccggagg

SEQ ID NO: 226518 - DNA, 19 bp, Homo sapiens
accctaactcttgctcact

SEQ ID NO: 226519 - DNA, 17 bp, Homo sapiens
accctaactgagctgcc

SEQ ID NO: 226520 - DNA, 15 bp, Homo sapiens
accctacacctctgg

SEQ ID NO: 226521 - DNA, 21 bp, Homo sapiens
accctacacctctgggccctg

SEQ ID NO: 226522 - DNA, 15 bp, Homo sapiens
accctacagtatata

SEQ ID NO: 226523 - DNA, 21 bp, Homo sapiens
accctacagtatataagcttt

SEQ ID NO: 226524 - DNA, 15 bp, Homo sapiens
accctactggctgta

SEQ ID NO: 226525 - DNA, 19 bp, Homo sapiens
accctagccagagaataga

SEQ ID NO: 226526 - DNA, 22 bp, Homo sapiens
accctaggtctccacccctcaa

SEQ ID NO: 226527 - DNA, 17 bp, Homo sapiens
gttttttaataaaagtt

SEQ ID NO: 226528 - DNA, 16 bp, Homo sapiens
gttttttagttgaatt

SEQ ID NO: 226529 - DNA, 13 bp, Homo sapiens
gttttttcatagt

SEQ ID NO: 226530 - DNA, 15 bp, Homo sapiens
gttttttcatagtgc

SEQ ID NO: 226531 - DNA, 14 bp, Homo sapiens
gttttttcctgagc

SEQ ID NO: 226532 - DNA, 14 bp, Homo sapiens
gttttttgccactg

SEQ ID NO: 226533 - DNA, 15 bp, Homo sapiens
gttttttttttttgt

SEQ ID NO: 226534 - DNA, 16 bp, Homo sapiens
gttttttttttttgta

SEQ ID NO: 226535 - DNA, 17 bp, Homo sapiens
gttttttttttttgtat

SEQ ID NO: 226536 - DNA, 22 bp, Homo sapiens
gttttttttttttgtatttctt

SEQ ID NO: 226537 - DNA, 17 bp, Homo sapiens
taaaaaaaaaagttaca

SEQ ID NO: 226538 - DNA, 16 bp, Homo sapiens
taaaaaaaataataaa

SEQ ID NO: 226539 - DNA, 21 bp, Homo sapiens
taaaaaaacaatcatttgctt

SEQ ID NO: 226540 - DNA, 15 bp, Homo sapiens
taaaaaaagagaatt

SEQ ID NO: 226541 - DNA, 14 bp, Homo sapiens
taaaaaaataatat

SEQ ID NO: 226542 - DNA, 18 bp, Homo sapiens
taaaaaaataatataaat

SEQ ID NO: 226543 - DNA, 22 bp, Homo sapiens
taaaaaaatacagtattctgta

SEQ ID NO: 226544 - DNA, 13 bp, Homo sapiens
taaaaaacaagaa

SEQ ID NO: 226545 - DNA, 16 bp, Homo sapiens
taaaaaacatttgtac

SEQ ID NO: 226546 - DNA, 17 bp, Homo sapiens
taaaaaacatttgtaca

SEQ ID NO: 226547 - DNA, 12 bp, Homo sapiens
taaaaaagaaga

SEQ ID NO: 226548 - DNA, 14 bp, Homo sapiens
taaaaaagaagagg

SEQ ID NO: 226549 - DNA, 17 bp, Homo sapiens
taaaaaagatcccaaat

SEQ ID NO: 226550 - DNA, 13 bp, Homo sapiens
taaaaaagcatta

SEQ ID NO: 226551 - DNA, 20 bp, Homo sapiens
taaaaaagttattatgtagc

SEQ ID NO: 226552 - DNA, 22 bp, Homo sapiens
taaaaaataacatattcttgct

SEQ ID NO: 226553 - DNA, 14 bp, Homo sapiens
taaaaaataactgt

SEQ ID NO: 226554 - DNA, 21 bp, Homo sapiens
taaaaaataactgtgcactat

SEQ ID NO: 226555 - DNA, 12 bp, Homo sapiens
taaaaaatgaat

SEQ ID NO: 226556 - DNA, 16 bp, Homo sapiens
taaaaacattttaaaa

SEQ ID NO: 226557 - DNA, 14 bp, Homo sapiens
taaaaactcctttt

SEQ ID NO: 226558 - DNA, 14 bp, Homo sapiens
taaaaagagaaggc

SEQ ID NO: 226559 - DNA, 16 bp, Homo sapiens
taaaaagattctctgc

SEQ ID NO: 226560 - DNA, 23 bp, Homo sapiens
taaaaagccactagactcttcac

SEQ ID NO: 226561 - DNA, 15 bp, Homo sapiens
taaaaaggcctttgg

SEQ ID NO: 226562 - DNA, 17 bp, Homo sapiens
taaaaagtcttcactct

SEQ ID NO: 226563 - DNA, 15 bp, Homo sapiens
taaaaagtgacacag

SEQ ID NO: 226564 - DNA, 12 bp, Homo sapiens
taaaaatactat

SEQ ID NO: 226565 - DNA, 15 bp, Homo sapiens
taaaaatacttaata

SEQ ID NO: 226566 - DNA, 16 bp, Homo sapiens
taaaaatagctataaa

SEQ ID NO: 226567 - DNA, 15 bp, Homo sapiens
taaaaatataaacaa

SEQ ID NO: 226568 - DNA, 18 bp, Homo sapiens
taaaaatatgtgagcatg

SEQ ID NO: 226569 - DNA, 19 bp, Homo sapiens
taaaaatatgtgagcatga

SEQ ID NO: 226570 - DNA, 17 bp, Homo sapiens
taaaaatcattgattgt

SEQ ID NO: 226571 - DNA, 15 bp, Homo sapiens
taaaaatctttcaga

SEQ ID NO: 226572 - DNA, 21 bp, Homo sapiens
taaaaatgaaggaattacatt

SEQ ID NO: 226573 - DNA, 18 bp, Homo sapiens
taaaaatgtaaatattct

SEQ ID NO: 226574 - DNA, 20 bp, Homo sapiens
taaaaatgtaaatattctat

SEQ ID NO: 226575 - DNA, 21 bp, Homo sapiens
taaaaatgtaaatattctata

SEQ ID NO: 226576 - DNA, 16 bp, Homo sapiens
taaaaattcatataaa

SEQ ID NO: 226577 - DNA, 17 bp, Homo sapiens
taaaaattcatataaag

SEQ ID NO: 226578 - DNA, 14 bp, Homo sapiens
taaaaattccacca

SEQ ID NO: 226579 - DNA, 22 bp, Homo sapiens
taaaaattgttaatttttccta

SEQ ID NO: 226580 - DNA, 14 bp, Homo sapiens
taaaaatttgttta

SEQ ID NO: 226581 - DNA, 17 bp, Homo sapiens
taaaacaaaaaacaata

SEQ ID NO: 226582 - DNA, 14 bp, Homo sapiens
taaaacaaaatctg

SEQ ID NO: 226583 - DNA, 17 bp, Homo sapiens
taaaacattagaagaaa

SEQ ID NO: 226584 - DNA, 11 bp, Homo sapiens
taaaacattcc

SEQ ID NO: 226585 - DNA, 11 bp, Homo sapiens
taaaaccacta

SEQ ID NO: 226586 - DNA, 10 bp, Homo sapiens
taaaaccttt

SEQ ID NO: 226587 - DNA, 13 bp, Homo sapiens
taaaacctttcaa

SEQ ID NO: 226588 - DNA, 17 bp, Homo sapiens
taaaactagataactta

SEQ ID NO: 226589 - DNA, 18 bp, Homo sapiens
taaaactatggttcccaa

SEQ ID NO: 226590 - DNA, 22 bp, Homo sapiens
taaaactatggttcccaataaa

SEQ ID NO: 226591 - DNA, 13 bp, Homo sapiens
taaaactgtgaca

SEQ ID NO: 226592 - DNA, 14 bp, Homo sapiens
taaaactgtgacat

SEQ ID NO: 226593 - DNA, 20 bp, Homo sapiens
taaaacttacctaagtgaca

SEQ ID NO: 226594 - DNA, 22 bp, Homo sapiens
taaaacttgatgtgttatctct

SEQ ID NO: 226595 - DNA, 13 bp, Homo sapiens
taaaactttaatc

SEQ ID NO: 226596 - DNA, 18 bp, Homo sapiens
taaaactttatgtactgc

SEQ ID NO: 226597 - DNA, 12 bp, Homo sapiens
taaaagactttg

SEQ ID NO: 226598 - DNA, 19 bp, Homo sapiens
ttgttcttgtaaaactgtg

SEQ ID NO: 226599 - DNA, 21 bp, Homo sapiens
ttgttgatgggcacttgagaa

SEQ ID NO: 226600 - DNA, 15 bp, Homo sapiens
ttgttggatcttcaa

SEQ ID NO: 226601 - DNA, 21 bp, Homo sapiens
ttgttggcccttccagtggga

SEQ ID NO: 226602 - DNA, 21 bp, Homo sapiens
ttgttggcctccggcctcccc

SEQ ID NO: 226603 - DNA, 12 bp, Homo sapiens
ttgttgtgactt

SEQ ID NO: 226604 - DNA, 21 bp, Homo sapiens
ttgttgttaatgaaaatgtca

SEQ ID NO: 226605 - DNA, 9 bp, Homo sapiens
ttgttgttg

SEQ ID NO: 226606 - DNA, 11 bp, Homo sapiens
ttgttgttgtt

SEQ ID NO: 226607 - DNA, 13 bp, Homo sapiens
ttgttgttttata

SEQ ID NO: 226608 - DNA, 20 bp, Homo sapiens
ttgtttaaatataaatgttt

SEQ ID NO: 226609 - DNA, 13 bp, Homo sapiens
ttgtttaattgta

SEQ ID NO: 226610 - DNA, 17 bp, Homo sapiens
ttgtttatttttatata

SEQ ID NO: 226611 - DNA, 14 bp, Homo sapiens
ttgtttccagaaat

SEQ ID NO: 226612 - DNA, 14 bp, Homo sapiens
ttgtttccctgctg

SEQ ID NO: 226613 - DNA, 12 bp, Homo sapiens
ttgtttcctgtg

SEQ ID NO: 226614 - DNA, 17 bp, Homo sapiens
ttgtttcggtgccctgt

SEQ ID NO: 226615 - DNA, 16 bp, Homo sapiens
ttgtttctatactgtt

SEQ ID NO: 226616 - DNA, 22 bp, Homo sapiens
ttgtttctatactgtttgtaat

SEQ ID NO: 226617 - DNA, 21 bp, Homo sapiens
ttgtttctgacccactgatct

SEQ ID NO: 226618 - DNA, 13 bp, Homo sapiens
ttgtttcttccaa

SEQ ID NO: 226619 - DNA, 15 bp, Homo sapiens
ttgtttcttccaaag

SEQ ID NO: 226620 - DNA, 12 bp, Homo sapiens
ttgtttctttct

SEQ ID NO: 226621 - DNA, 13 bp, Homo sapiens
ttgtttctttctg

SEQ ID NO: 226622 - DNA, 16 bp, Homo sapiens
ttgtttgaaaatatta

SEQ ID NO: 226623 - DNA, 13 bp, Homo sapiens
ttgtttgatgtgt

SEQ ID NO: 226624 - DNA, 16 bp, Homo sapiens
ttgtttgatgtgtatg

SEQ ID NO: 226625 - DNA, 13 bp, Homo sapiens
ttgtttgtaaata

SEQ ID NO: 226626 - DNA, 23 bp, Homo sapiens
ttgtttgtgtgaaaggaaagtag

SEQ ID NO: 226627 - DNA, 12 bp, Homo sapiens
ttgtttgttttg

SEQ ID NO: 226628 - DNA, 16 bp, Homo sapiens
ttgttttgcacttttt

SEQ ID NO: 226629 - DNA, 14 bp, Homo sapiens
ttgttttgttttaa

SEQ ID NO: 226630 - DNA, 15 bp, Homo sapiens
ttgtttttccatgtg

SEQ ID NO: 226631 - DNA, 20 bp, Homo sapiens
ttgtttttgatgtgcgtgct

SEQ ID NO: 226632 - DNA, 14 bp, Homo sapiens
ttgttttttagttc

SEQ ID NO: 226633 - DNA, 15 bp, Homo sapiens
tttaaaaaaataaca

SEQ ID NO: 226634 - DNA, 18 bp, Homo sapiens
tttaaaaaaataacatct

SEQ ID NO: 226635 - DNA, 14 bp, Homo sapiens
tttaaaaaataaag

SEQ ID NO: 226636 - DNA, 15 bp, Homo sapiens
tttaaaaaataacat

SEQ ID NO: 226637 - DNA, 21 bp, Homo sapiens
tttaaaaaataacatattctt

SEQ ID NO: 226638 - DNA, 14 bp, Homo sapiens
tttaaaaaatgaat

SEQ ID NO: 226639 - DNA, 16 bp, Homo sapiens
tttaaaaaggcctttg

SEQ ID NO: 226640 - DNA, 15 bp, Homo sapiens
tttaaaacaagaaag

SEQ ID NO: 226641 - DNA, 22 bp, Homo sapiens
tttaaaacaagaaagtttcccc

SEQ ID NO: 226642 - DNA, 19 bp, Homo sapiens
tttaaaagacacacttgtc

SEQ ID NO: 226643 - DNA, 18 bp, Homo sapiens
tttaaaagcatatataaa

SEQ ID NO: 226644 - DNA, 20 bp, Homo sapiens
tttaaaagccctttccaaag

SEQ ID NO: 226645 - DNA, 14 bp, Homo sapiens
tttaaaatcaactt

SEQ ID NO: 226646 - DNA, 16 bp, Homo sapiens
tttaaaatcattcaat

SEQ ID NO: 226647 - DNA, 20 bp, Homo sapiens
tttaaaatggtttgtcctga

SEQ ID NO: 226648 - DNA, 22 bp, Homo sapiens
tttaaaatgtagaagaaagcaa

SEQ ID NO: 226649 - DNA, 23 bp, Homo sapiens
tttaaaattattaaaaattatag

SEQ ID NO: 226650 - DNA, 20 bp, Homo sapiens
tttaaacaaaatagaagctg

SEQ ID NO: 226651 - DNA, 20 bp, Homo sapiens
tttaaactaaccttttatca

SEQ ID NO: 226652 - DNA, 17 bp, Homo sapiens
tttaaagaaactgattt

SEQ ID NO: 226653 - DNA, 15 bp, Homo sapiens
tttaaagaagtctct

SEQ ID NO: 226654 - DNA, 14 bp, Homo sapiens
tttaaagaataaag

SEQ ID NO: 226655 - DNA, 13 bp, Homo sapiens
tttaaagacttaa

SEQ ID NO: 226656 - DNA, 15 bp, Homo sapiens
tttaaagacttaaga

SEQ ID NO: 226657 - DNA, 14 bp, Homo sapiens
tttaaagagaggtt

SEQ ID NO: 226658 - DNA, 13 bp, Homo sapiens
tttaaaggacaaa

SEQ ID NO: 226659 - DNA, 14 bp, Homo sapiens
taaaggcagtccag

SEQ ID NO: 226660 - DNA, 11 bp, Homo sapiens
taaaggcctgg

SEQ ID NO: 226661 - DNA, 23 bp, Homo sapiens
taaagggtgtgggtcagggaggg

SEQ ID NO: 226662 - DNA, 14 bp, Homo sapiens
taaagtaaagctaa

SEQ ID NO: 226663 - DNA, 19 bp, Homo sapiens
taaagtaaatgctacctct

SEQ ID NO: 226664 - DNA, 16 bp, Homo sapiens
taaagtacctgtagtg

SEQ ID NO: 226665 - DNA, 16 bp, Homo sapiens
taaagtatgtaaacag

SEQ ID NO: 226666 - DNA, 22 bp, Homo sapiens
taaagtatgtaaacaggagaca

SEQ ID NO: 226667 - DNA, 20 bp, Homo sapiens
taaagtattccaccttaaat

SEQ ID NO: 226668 - DNA, 15 bp, Homo sapiens
taaagtccaaagtca

SEQ ID NO: 226669 - DNA, 13 bp, Homo sapiens
taaagtctgtctg

SEQ ID NO: 226670 - DNA, 13 bp, Homo sapiens
taaagtgaccagg

SEQ ID NO: 226671 - DNA, 18 bp, Homo sapiens
taaagtgtgttgttgctt

SEQ ID NO: 226672 - DNA, 17 bp, Homo sapiens
taaagtgtgtttctatg

SEQ ID NO: 226673 - DNA, 17 bp, Homo sapiens
taaagttacttgaattt

SEQ ID NO: 226674 - DNA, 18 bp, Homo sapiens
taaagttacttgaatttc

SEQ ID NO: 226675 - DNA, 14 bp, Homo sapiens
taaagttcaaagca

SEQ ID NO: 226676 - DNA, 20 bp, Homo sapiens
taaagttgaagctaagattt

SEQ ID NO: 226677 - DNA, 13 bp, Homo sapiens
taaagtttaaata

SEQ ID NO: 226678 - DNA, 13 bp, Homo sapiens
taaagtttacagt

SEQ ID NO: 226679 - DNA, 20 bp, Homo sapiens
taaagttttattgatgtgaa

SEQ ID NO: 226680 - DNA, 16 bp, Homo sapiens
taaataaaaatattct

SEQ ID NO: 226681 - DNA, 13 bp, Homo sapiens
taaataaaagaaa

SEQ ID NO: 226682 - DNA, 21 bp, Homo sapiens
taaataaaagaaaaaatatct

SEQ ID NO: 226683 - DNA, 19 bp, Homo sapiens
taaataaaagcagcatctg

SEQ ID NO: 226684 - DNA, 14 bp, Homo sapiens
taaataaaatactg

SEQ ID NO: 226685 - DNA, 12 bp, Homo sapiens
taaataaaattg

SEQ ID NO: 226686 - DNA, 23 bp, Homo sapiens
taaataaacacatagattcacct

SEQ ID NO: 226687 - DNA, 22 bp, Homo sapiens
taaataaacctcaaaatgtcta

SEQ ID NO: 226688 - DNA, 21 bp, Homo sapiens
taaataaagaagaaaataacc

SEQ ID NO: 226689 - DNA, 16 bp, Homo sapiens
taaataaataaaaata

SEQ ID NO: 226690 - DNA, 12 bp, Homo sapiens
taaataaataca

SEQ ID NO: 226691 - DNA, 23 bp, Homo sapiens
taaataaattgcctcccttcctc

SEQ ID NO: 226692 - DNA, 13 bp, Homo sapiens
taaataaattgtt

SEQ ID NO: 226693 - DNA, 20 bp, Homo sapiens
taaataaattgtttgaccat

SEQ ID NO: 226694 - DNA, 17 bp, Homo sapiens
taaataacacagatatt

SEQ ID NO: 226695 - DNA, 18 bp, Homo sapiens
taaataacacagatattg

SEQ ID NO: 226696 - DNA, 11 bp, Homo sapiens
taaataagaga

SEQ ID NO: 226697 - DNA, 15 bp, Homo sapiens
taaataagagatttg

SEQ ID NO: 226698 - DNA, 15 bp, Homo sapiens
taaataatattatat

SEQ ID NO: 226699 - DNA, 23 bp, Homo sapiens
taaataatattatattgtattta

SEQ ID NO: 226700 - DNA, 13 bp, Homo sapiens
taaataatctcat

SEQ ID NO: 226701 - DNA, 14 bp, Homo sapiens
taaataatctcatc

SEQ ID NO: 226702 - DNA, 22 bp, Homo sapiens
taaataatgttcattaagttct

SEQ ID NO: 226703 - DNA, 13 bp, Homo sapiens
taaataatttaag

SEQ ID NO: 226704 - DNA, 19 bp, Homo sapiens
taaataattttacatgtct

SEQ ID NO: 226705 - DNA, 23 bp, Homo sapiens
taaatacaaaataaaattatggt

SEQ ID NO: 226706 - DNA, 23 bp, Homo sapiens
taaatacaccacctcactcctgt

SEQ ID NO: 226707 - DNA, 22 bp, Homo sapiens
taaatacagacactaagttata

SEQ ID NO: 226708 - DNA, 17 bp, Homo sapiens
taaatacatgtgtggat

SEQ ID NO: 226709 - DNA, 12 bp, Homo sapiens
taaataccacaa

SEQ ID NO: 226710 - DNA, 18 bp, Homo sapiens
taaataccacaagatgga

SEQ ID NO: 226711 - DNA, 17 bp, Homo sapiens
taaataccagacacgta

SEQ ID NO: 226712 - DNA, 17 bp, Homo sapiens
taaataccagtacttga

SEQ ID NO: 226713 - DNA, 16 bp, Homo sapiens
taaatactcccttttt

SEQ ID NO: 226714 - DNA, 16 bp, Homo sapiens
taaatagatgagtcct

SEQ ID NO: 226715 - DNA, 18 bp, Homo sapiens
taaatagatgagtcctgt

SEQ ID NO: 226716 - DNA, 21 bp, Homo sapiens
taaatagatttttagattcct

SEQ ID NO: 226717 - DNA, 16 bp, Homo sapiens
taaatagctatatcca

SEQ ID NO: 226718 - DNA, 18 bp, Homo sapiens
taaatagctatatccatg

SEQ ID NO: 226719 - DNA, 20 bp, Homo sapiens
taaatagctatatccatgta

SEQ ID NO: 226720 - DNA, 22 bp, Homo sapiens
taaatagtatccaactttgtag

SEQ ID NO: 226721 - DNA, 19 bp, Homo sapiens
taaatataaatctgatcac

SEQ ID NO: 226722 - DNA, 17 bp, Homo sapiens
taaatatactaataaaa

SEQ ID NO: 226723 - DNA, 18 bp, Homo sapiens
taaatatactaataaaaa

SEQ ID NO: 226724 - DNA, 21 bp, Homo sapiens
taaatatactaataaaaaggt

SEQ ID NO: 226725 - DNA, 23 bp, Homo sapiens
taaatatactaataaaaaggttt

SEQ ID NO: 226726 - DNA, 14 bp, Homo sapiens
taaatatataaaaa

SEQ ID NO: 226727 - DNA, 14 bp, Homo sapiens
taaatatatattta

SEQ ID NO: 226728 - DNA, 16 bp, Homo sapiens
taaatatatatttatc

SEQ ID NO: 226729 - DNA, 18 bp, Homo sapiens
taaatatatatttatcat

SEQ ID NO: 226730 - DNA, 11 bp, Homo sapiens
taaatatatgt

SEQ ID NO: 226731 - DNA, 13 bp, Homo sapiens
taaatatatgtat

SEQ ID NO: 226732 - DNA, 14 bp, Homo sapiens
taaatatatgtttt

SEQ ID NO: 226733 - DNA, 15 bp, Homo sapiens
taaatatatgttttg

SEQ ID NO: 226734 - DNA, 16 bp, Homo sapiens
taaatatatgttttga

SEQ ID NO: 226735 - DNA, 19 bp, Homo sapiens
taaatatatgttttgagaa

SEQ ID NO: 226736 - DNA, 15 bp, Homo sapiens
taaatatcattcttt

SEQ ID NO: 226737 - DNA, 21 bp, Homo sapiens
taaatatccaaagactgtact

SEQ ID NO: 226738 - DNA, 22 bp, Homo sapiens
taaatatccaaagactgtactg

SEQ ID NO: 226739 - DNA, 16 bp, Homo sapiens
taaatatcccagagaa

SEQ ID NO: 226740 - DNA, 13 bp, Homo sapiens
taaatattcttgt

SEQ ID NO: 226741 - DNA, 22 bp, Homo sapiens
taaatattcttgtccacattct

SEQ ID NO: 226742 - DNA, 13 bp, Homo sapiens
taaatatttcctt

SEQ ID NO: 226743 - DNA, 12 bp, Homo sapiens
taaatatttgtt

SEQ ID NO: 226744 - DNA, 13 bp, Homo sapiens
taaatattttcca

SEQ ID NO: 226745 - DNA, 18 bp, Homo sapiens
tttattaattcattaaat

SEQ ID NO: 226746 - DNA, 13 bp, Homo sapiens
tttattacattag

SEQ ID NO: 226747 - DNA, 20 bp, Homo sapiens
tttattacctctgatacctc

SEQ ID NO: 226748 - DNA, 17 bp, Homo sapiens
tttattattattactgt

SEQ ID NO: 226749 - DNA, 20 bp, Homo sapiens
tttattattttaatatttat

SEQ ID NO: 226750 - DNA, 19 bp, Homo sapiens
tttattcagcttcatttgt

SEQ ID NO: 226751 - DNA, 22 bp, Homo sapiens
tttattcagcttcatttgtgtc

SEQ ID NO: 226752 - DNA, 14 bp, Homo sapiens
tttattcatctgca

SEQ ID NO: 226753 - DNA, 16 bp, Homo sapiens
tttattgtaaatgagt

SEQ ID NO: 226754 - DNA, 17 bp, Homo sapiens
tttattgtgtttttaat

SEQ ID NO: 226755 - DNA, 20 bp, Homo sapiens
tttattgttaactcttgtct

SEQ ID NO: 226756 - DNA, 11 bp, Homo sapiens
tttatttaatt

SEQ ID NO: 226757 - DNA, 14 bp, Homo sapiens
tttatttattaaga

SEQ ID NO: 226758 - DNA, 15 bp, Homo sapiens
tttatttattttatc

SEQ ID NO: 226759 - DNA, 13 bp, Homo sapiens
tttatttcattca

SEQ ID NO: 226760 - DNA, 16 bp, Homo sapiens
tttatttctaagtatt

SEQ ID NO: 226761 - DNA, 15 bp, Homo sapiens
tttattttagcagtt

SEQ ID NO: 226762 - DNA, 23 bp, Homo sapiens
tttattttagcagttctgcaaat

SEQ ID NO: 226763 - DNA, 11 bp, Homo sapiens
tttattttata

SEQ ID NO: 226764 - DNA, 15 bp, Homo sapiens
tttattttgttaaaa

SEQ ID NO: 226765 - DNA, 15 bp, Homo sapiens
tttatttttcatatt

SEQ ID NO: 226766 - DNA, 17 bp, Homo sapiens
tttatttttcatattgt

SEQ ID NO: 226767 - DNA, 20 bp, Homo sapiens
tttatttttcatattgtgcc

SEQ ID NO: 226768 - DNA, 14 bp, Homo sapiens
tttattttttaagt

SEQ ID NO: 226769 - DNA, 17 bp, Homo sapiens
tttattttttaagttca

SEQ ID NO: 226770 - DNA, 15 bp, Homo sapiens
tttattttttacatt

SEQ ID NO: 226771 - DNA, 14 bp, Homo sapiens
tttatttttttcta

SEQ ID NO: 226772 - DNA, 20 bp, Homo sapiens
tttatttttttgatggctaa

SEQ ID NO: 226773 - DNA, 13 bp, Homo sapiens
tttcaaaaacatt

SEQ ID NO: 226774 - DNA, 21 bp, Homo sapiens
tttcaaaaatataacttaaaa

SEQ ID NO: 226775 - DNA, 23 bp, Homo sapiens
tttcaaaagtggattttcctgaa

SEQ ID NO: 226776 - DNA, 19 bp, Homo sapiens
tttcaaaatgcatgtgatt

SEQ ID NO: 226777 - DNA, 20 bp, Homo sapiens
tttcaaacagcatcaaaata

SEQ ID NO: 226778 - DNA, 19 bp, Homo sapiens
tttcaaatgagtttaaaaa

SEQ ID NO: 226779 - DNA, 19 bp, Homo sapiens
tttcaaattggactttcaa

SEQ ID NO: 226780 - DNA, 20 bp, Homo sapiens
tttcaaattggactttcaaa

SEQ ID NO: 226781 - DNA, 21 bp, Homo sapiens
tttcaaattggactttcaaaa

SEQ ID NO: 226782 - DNA, 14 bp, Homo sapiens
tttcaaattgtatc

SEQ ID NO: 226783 - DNA, 15 bp, Homo sapiens
tttcaacgcagccct

SEQ ID NO: 226784 - DNA, 16 bp, Homo sapiens
tttcaacgcagccctg

SEQ ID NO: 226785 - DNA, 21 bp, Homo sapiens
tttcaacgcagccctgctttg

SEQ ID NO: 226786 - DNA, 15 bp, Homo sapiens
tttcaacttaaatca

SEQ ID NO: 226787 - DNA, 23 bp, Homo sapiens
tttcaacttaaatcactgaggca

SEQ ID NO: 226788 - DNA, 15 bp, Homo sapiens
tttcaagatccaaat

SEQ ID NO: 226789 - DNA, 15 bp, Homo sapiens
tttcaatccacagta

SEQ ID NO: 226790 - DNA, 17 bp, Homo sapiens
taaatgtaaagacaaaa

SEQ ID NO: 226791 - DNA, 16 bp, Homo sapiens
taaatgtactacattt

SEQ ID NO: 226792 - DNA, 19 bp, Homo sapiens
taaatgtatcttattcaca

SEQ ID NO: 226793 - DNA, 16 bp, Homo sapiens
taaatgtcttttcaaa

SEQ ID NO: 226794 - DNA, 17 bp, Homo sapiens
taaatgtttatattgtt

SEQ ID NO: 226795 - DNA, 12 bp, Homo sapiens
taaatgtttgtt

SEQ ID NO: 226796 - DNA, 14 bp, Homo sapiens
taaatgtttgttga

SEQ ID NO: 226797 - DNA, 15 bp, Homo sapiens
taaattaaacaattt

SEQ ID NO: 226798 - DNA, 16 bp, Homo sapiens
taaattaaacaattta

SEQ ID NO: 226799 - DNA, 13 bp, Homo sapiens
taaattaagacat

SEQ ID NO: 226800 - DNA, 15 bp, Homo sapiens
taaattaagacatgc

SEQ ID NO: 226801 - DNA, 17 bp, Homo sapiens
taaattagtaatgtact

SEQ ID NO: 226802 - DNA, 13 bp, Homo sapiens
taaattataagga

SEQ ID NO: 226803 - DNA, 16 bp, Homo sapiens
taaattataaggactg

SEQ ID NO: 226804 - DNA, 21 bp, Homo sapiens
taaattataaggactgcatgg

SEQ ID NO: 226805 - DNA, 19 bp, Homo sapiens
taaattatatgatatgcat

SEQ ID NO: 226806 - DNA, 12 bp, Homo sapiens
taaattattcag

SEQ ID NO: 226807 - DNA, 22 bp, Homo sapiens
taaattattcagttaagaaaaa

SEQ ID NO: 226808 - DNA, 14 bp, Homo sapiens
taaattattgtaaa

SEQ ID NO: 226809 - DNA, 16 bp, Homo sapiens
taaattattttaaatt

SEQ ID NO: 226810 - DNA, 19 bp, Homo sapiens
taaattccccatatttgtg

SEQ ID NO: 226811 - DNA, 23 bp, Homo sapiens
taaattcgctgtgagtgagtggt

SEQ ID NO: 226812 - DNA, 17 bp, Homo sapiens
taaattctctctaacat

SEQ ID NO: 226813 - DNA, 13 bp, Homo sapiens
taaattctgctcc

SEQ ID NO: 226814 - DNA, 20 bp, Homo sapiens
taaattggtgataagtggaa

SEQ ID NO: 226815 - DNA, 23 bp, Homo sapiens
taaattggtgataagtggaaaaa

SEQ ID NO: 226816 - DNA, 15 bp, Homo sapiens
taaattgttcctctt

SEQ ID NO: 226817 - DNA, 16 bp, Homo sapiens
taaattgttcctcttt

SEQ ID NO: 226818 - DNA, 16 bp, Homo sapiens
taaatttaaaacaatg

SEQ ID NO: 226819 - DNA, 19 bp, Homo sapiens
taaatttacgtatatttca

SEQ ID NO: 226820 - DNA, 23 bp, Homo sapiens
taaatttccacccaatttccaag

SEQ ID NO: 226821 - DNA, 13 bp, Homo sapiens
taaatttctcagt

SEQ ID NO: 226822 - DNA, 21 bp, Homo sapiens
taaatttgaactccatgggat

SEQ ID NO: 226823 - DNA, 22 bp, Homo sapiens
taaatttgaatgttaagcagat

SEQ ID NO: 226824 - DNA, 13 bp, Homo sapiens
taaatttgtacta

SEQ ID NO: 226825 - DNA, 19 bp, Homo sapiens
taaatttgtactatttaac

SEQ ID NO: 226826 - DNA, 21 bp, Homo sapiens
taaatttgtactatttaactg

SEQ ID NO: 226827 - DNA, 16 bp, Homo sapiens
taaatttgtgtaatat

SEQ ID NO: 226828 - DNA, 23 bp, Homo sapiens
taaatttgtgtaatattacttta

SEQ ID NO: 226829 - DNA, 19 bp, Homo sapiens
taaatttgttgtcatgtgt

SEQ ID NO: 226830 - DNA, 21 bp, Homo sapiens
taaatttgttgtcatgtgtat

SEQ ID NO: 226831 - DNA, 16 bp, Homo sapiens
taaattttccattaat

SEQ ID NO: 226832 - DNA, 20 bp, Homo sapiens
taaattttgtctttaactca

SEQ ID NO: 226833 - DNA, 23 bp, Homo sapiens
taacaaaaaaatatatttaatga

SEQ ID NO: 226834 - DNA, 12 bp, Homo sapiens
taacaaaagatg

SEQ ID NO: 226835 - DNA, 20 bp, Homo sapiens
taacaaaagatgaaagcagg

SEQ ID NO: 226836 - DNA, 22 bp, Homo sapiens
taacaaacgtaatttgttatat

SEQ ID NO: 226837 - DNA, 15 bp, Homo sapiens
taacaaatgttttca

SEQ ID NO: 226838 - DNA, 23 bp, Homo sapiens
taacaacaatttaggaatgctca

SEQ ID NO: 226839 - DNA, 12 bp, Homo sapiens
taacaacactaa

SEQ ID NO: 226840 - DNA, 15 bp, Homo sapiens
taacaagatttttaa

SEQ ID NO: 226841 - DNA, 21 bp, Homo sapiens
taacaatatatgatatataaa

SEQ ID NO: 226842 - DNA, 12 bp, Homo sapiens
taacaatgcctt

SEQ ID NO: 226843 - DNA, 22 bp, Homo sapiens
taacaatgtatgtgaaagtgta

SEQ ID NO: 226844 - DNA, 12 bp, Homo sapiens
taacaatgtctt

SEQ ID NO: 226845 - DNA, 14 bp, Homo sapiens
taacaatttctgtc

SEQ ID NO: 226846 - DNA, 18 bp, Homo sapiens
taacaattttaatgctat

SEQ ID NO: 226847 - DNA, 12 bp, Homo sapiens
taacacagatat

SEQ ID NO: 226848 - DNA, 13 bp, Homo sapiens
taacacagatatt

SEQ ID NO: 226849 - DNA, 21 bp, Homo sapiens
taacacataaagtaaatgcta

SEQ ID NO: 226850 - DNA, 18 bp, Homo sapiens
taacacatgaatttctgc

SEQ ID NO: 226851 - DNA, 22 bp, Homo sapiens
taacacattatcgggagcagtg

SEQ ID NO: 226852 - DNA, 18 bp, Homo sapiens
taacaccacactgaccac

SEQ ID NO: 226853 - DNA, 19 bp, Homo sapiens
taacaccacactgaccaca

SEQ ID NO: 226854 - DNA, 17 bp, Homo sapiens
taacactagtctgtgtg

SEQ ID NO: 226855 - DNA, 18 bp, Homo sapiens
taacactagtctgtgtgc

SEQ ID NO: 226856 - DNA, 15 bp, Homo sapiens
taacactggccccta

SEQ ID NO: 226857 - DNA, 13 bp, Homo sapiens
taacactgtaata

SEQ ID NO: 226858 - DNA, 14 bp, Homo sapiens
taacactgtaatat

SEQ ID NO: 226859 - DNA, 16 bp, Homo sapiens
taacactgtaatatct

SEQ ID NO: 226860 - DNA, 17 bp, Homo sapiens
taacactgtaatatctt

SEQ ID NO: 226861 - DNA, 21 bp, Homo sapiens
taacagagtagttttggtttt

SEQ ID NO: 226862 - DNA, 23 bp, Homo sapiens
taacagagtttgatatgggcttt

SEQ ID NO: 226863 - DNA, 23 bp, Homo sapiens
taacagcattcttgtcacaataa

SEQ ID NO: 226864 - DNA, 20 bp, Homo sapiens
taacagcgtgtcaactttca

SEQ ID NO: 226865 - DNA, 19 bp, Homo sapiens
taacagctcaaagagtaaa

SEQ ID NO: 226866 - DNA, 23 bp, Homo sapiens
taacaggctcaatattcctgaat

SEQ ID NO: 226867 - DNA, 16 bp, Homo sapiens
taacagggccttgcta

SEQ ID NO: 226868 - DNA, 15 bp, Homo sapiens
taacagggtaaatta

SEQ ID NO: 226869 - DNA, 20 bp, Homo sapiens
taacagggtaaattattcag

SEQ ID NO: 226870 - DNA, 17 bp, Homo sapiens
taacaggttttcttcta

SEQ ID NO: 226871 - DNA, 13 bp, Homo sapiens
taacagtaaaaat

SEQ ID NO: 226872 - DNA, 17 bp, Homo sapiens
taacagtaaaaatttct

SEQ ID NO: 226873 - DNA, 17 bp, Homo sapiens
taacagtacctgtgcct

SEQ ID NO: 226874 - DNA, 14 bp, Homo sapiens
taacagtcatttaa

SEQ ID NO: 226875 - DNA, 20 bp, Homo sapiens
taacagttttccatgaaaac

SEQ ID NO: 226876 - DNA, 16 bp, Homo sapiens
taacataaaatctgtg

SEQ ID NO: 226877 - DNA, 20 bp, Homo sapiens
taacataaaatctgtgaatt

SEQ ID NO: 226878 - DNA, 19 bp, Homo sapiens
taacataaagaaacacttt

SEQ ID NO: 226879 - DNA, 19 bp, Homo sapiens
taacatagtgtctgctgct

SEQ ID NO: 226880 - DNA, 15 bp, Homo sapiens
taacatataaattaa

SEQ ID NO: 226881 - DNA, 20 bp, Homo sapiens
taacatataaattaatacat

SEQ ID NO: 226882 - DNA, 20 bp, Homo sapiens
taacatataatatatgtttt

SEQ ID NO: 226883 - DNA, 19 bp, Homo sapiens
taacatattcttgctttca

SEQ ID NO: 226884 - DNA, 14 bp, Homo sapiens
taacatatttacta

SEQ ID NO: 226885 - DNA, 18 bp, Homo sapiens
taacatcccaataaagtc

SEQ ID NO: 226886 - DNA, 11 bp, Homo sapiens
taacatctgaa

SEQ ID NO: 226887 - DNA, 15 bp, Homo sapiens
taacatctgaaaaga

SEQ ID NO: 226888 - DNA, 14 bp, Homo sapiens
taacatgctgtgta

SEQ ID NO: 226889 - DNA, 18 bp, Homo sapiens
taacatgctgtgtaagct

SEQ ID NO: 226890 - DNA, 23 bp, Homo sapiens
taacatggacatgatcttcttta

SEQ ID NO: 226891 - DNA, 19 bp, Homo sapiens
tttcttcaagtgagtggca

SEQ ID NO: 226892 - DNA, 16 bp, Homo sapiens
tttcttcatgcaatga

SEQ ID NO: 226893 - DNA, 20 bp, Homo sapiens
tttcttccacgtaattcaat

SEQ ID NO: 226894 - DNA, 12 bp, Homo sapiens
tttcttcccatt

SEQ ID NO: 226895 - DNA, 13 bp, Homo sapiens
tttcttcctctgc

SEQ ID NO: 226896 - DNA, 16 bp, Homo sapiens
tttcttctctctttgt

SEQ ID NO: 226897 - DNA, 14 bp, Homo sapiens
tttcttctgtagct

SEQ ID NO: 226898 - DNA, 21 bp, Homo sapiens
tttcttcttccacacatgcaa

SEQ ID NO: 226899 - DNA, 22 bp, Homo sapiens
tttcttgagatctgctgacaga

SEQ ID NO: 226900 - DNA, 16 bp, Homo sapiens
tttcttgccccagtgt

SEQ ID NO: 226901 - DNA, 19 bp, Homo sapiens
tttcttgctaagctccagc

SEQ ID NO: 226902 - DNA, 11 bp, Homo sapiens
tttcttgctgg

SEQ ID NO: 226903 - DNA, 20 bp, Homo sapiens
tttcttggcctcaagttcaa

SEQ ID NO: 226904 - DNA, 9 bp, Homo sapiens
tttcttggt

SEQ ID NO: 226905 - DNA, 17 bp, Homo sapiens
tttcttgttgcatcttt

SEQ ID NO: 226906 - DNA, 18 bp, Homo sapiens
tttctttatcattgctaa

SEQ ID NO: 226907 - DNA, 14 bp, Homo sapiens
tttctttctatgta

SEQ ID NO: 226908 - DNA, 12 bp, Homo sapiens
tttctttctgtt

SEQ ID NO: 226909 - DNA, 16 bp, Homo sapiens
tttctttgaatgcttt

SEQ ID NO: 226910 - DNA, 16 bp, Homo sapiens
tttctttgatttaact

SEQ ID NO: 226911 - DNA, 17 bp, Homo sapiens
tttctttgatttaactg

SEQ ID NO: 226912 - DNA, 17 bp, Homo sapiens
tttcttttatatataaa

SEQ ID NO: 226913 - DNA, 20 bp, Homo sapiens
tttcttttatatataaaata

SEQ ID NO: 226914 - DNA, 23 bp, Homo sapiens
tttcttttatatataaaataaat

SEQ ID NO: 226915 - DNA, 14 bp, Homo sapiens
tttcttttatatct

SEQ ID NO: 226916 - DNA, 13 bp, Homo sapiens
tttcttttctatg

SEQ ID NO: 226917 - DNA, 20 bp, Homo sapiens
tttcttttgaataatgtagt

SEQ ID NO: 226918 - DNA, 19 bp, Homo sapiens
tttctttttcttcttccct

SEQ ID NO: 226919 - DNA, 14 bp, Homo sapiens
tttgaaagaaaaat

SEQ ID NO: 226920 - DNA, 21 bp, Homo sapiens
taagatgagatttgccagcac

SEQ ID NO: 226921 - DNA, 15 bp, Homo sapiens
taagatggattctca

SEQ ID NO: 226922 - DNA, 20 bp, Homo sapiens
taagatggattctcagatat

SEQ ID NO: 226923 - DNA, 18 bp, Homo sapiens
taagatgggcagctagtt

SEQ ID NO: 226924 - DNA, 20 bp, Homo sapiens
taagattaaattatatctga

SEQ ID NO: 226925 - DNA, 14 bp, Homo sapiens
taagattacaagat

SEQ ID NO: 226926 - DNA, 14 bp, Homo sapiens
taagattccagaga

SEQ ID NO: 226927 - DNA, 20 bp, Homo sapiens
taagattcttggtatttgga

SEQ ID NO: 226928 - DNA, 19 bp, Homo sapiens
taagatttagagatgaatt

SEQ ID NO: 226929 - DNA, 22 bp, Homo sapiens
taagattttatccctttctctt

SEQ ID NO: 226930 - DNA, 18 bp, Homo sapiens
taagattttattttcaag

SEQ ID NO: 226931 - DNA, 14 bp, Homo sapiens
taagcaacatcttt

SEQ ID NO: 226932 - DNA, 13 bp, Homo sapiens
taagcaagagaga

SEQ ID NO: 226933 - DNA, 18 bp, Homo sapiens
taagcaagagagatgttt

SEQ ID NO: 226934 - DNA, 18 bp, Homo sapiens
taagcacacttgacatca

SEQ ID NO: 226935 - DNA, 15 bp, Homo sapiens
taagcacctgggctg

SEQ ID NO: 226936 - DNA, 13 bp, Homo sapiens
taagcactacata

SEQ ID NO: 226937 - DNA, 17 bp, Homo sapiens
taagcactcttaaagca

SEQ ID NO: 226938 - DNA, 14 bp, Homo sapiens
taagcactgtgttt

SEQ ID NO: 226939 - DNA, 23 bp, Homo sapiens
taagcactgtgtttatatgtctt

SEQ ID NO: 226940 - DNA, 18 bp, Homo sapiens
taagcagaggtggaaaat

SEQ ID NO: 226941 - DNA, 16 bp, Homo sapiens
taagcagagttctttg

SEQ ID NO: 226942 - DNA, 22 bp, Homo sapiens
taagcagctaaattttctgaaa

SEQ ID NO: 226943 - DNA, 16 bp, Homo sapiens
taagcagtgcttgtaa

SEQ ID NO: 226944 - DNA, 14 bp, Homo sapiens
taagcatgagtggc

SEQ ID NO: 226945 - DNA, 16 bp, Homo sapiens
taagcattctgagctg

SEQ ID NO: 226946 - DNA, 20 bp, Homo sapiens
taagcattgaaattatagtt

SEQ ID NO: 226947 - DNA, 21 bp, Homo sapiens
taagcattgtttgcttattgt

SEQ ID NO: 226948 - DNA, 23 bp, Homo sapiens
taagcattgtttgcttattgttc

SEQ ID NO: 226949 - DNA, 15 bp, Homo sapiens
taagcattttactgt

SEQ ID NO: 226950 - DNA, 14 bp, Homo sapiens
taagccaataaata

SEQ ID NO: 226951 - DNA, 15 bp, Homo sapiens
taagccaataaataa

SEQ ID NO: 226952 - DNA, 16 bp, Homo sapiens
taagccataggcccag

SEQ ID NO: 226953 - DNA, 19 bp, Homo sapiens
taagccctcgaaccaaggc

SEQ ID NO: 226954 - DNA, 22 bp, Homo sapiens
taagccctgtcgagacacttgc

SEQ ID NO: 226955 - DNA, 20 bp, Homo sapiens
taagcctccatttagttctt

SEQ ID NO: 226956 - DNA, 21 bp, Homo sapiens
taagcctccatttagttcttt

SEQ ID NO: 226957 - DNA, 15 bp, Homo sapiens
taagcctttccataa

SEQ ID NO: 226958 - DNA, 13 bp, Homo sapiens
taagctccagctt

SEQ ID NO: 226959 - DNA, 14 bp, Homo sapiens
taagctccagcttt

SEQ ID NO: 226960 - DNA, 19 bp, Homo sapiens
taagctccagttttcgtat

SEQ ID NO: 226961 - DNA, 20 bp, Homo sapiens
taagctccttcagtttgaag

SEQ ID NO: 226962 - DNA, 17 bp, Homo sapiens
taagctctttgagaact

SEQ ID NO: 226963 - DNA, 16 bp, Homo sapiens
taagctgtttagtttg

SEQ ID NO: 226964 - DNA, 11 bp, Homo sapiens
taagctgtttc

SEQ ID NO: 226965 - DNA, 16 bp, Homo sapiens
taagctgtttccatag

SEQ ID NO: 226966 - DNA, 16 bp, Homo sapiens
taagcttaaaaaaaac

SEQ ID NO: 226967 - DNA, 17 bp, Homo sapiens
taagcttaaaaaaaact

SEQ ID NO: 226968 - DNA, 14 bp, Homo sapiens
taagcttaaaataa

SEQ ID NO: 226969 - DNA, 17 bp, Homo sapiens
taagcttaaaataagtg

SEQ ID NO: 226970 - DNA, 15 bp, Homo sapiens
taagcttatttctaa

SEQ ID NO: 226971 - DNA, 15 bp, Homo sapiens
taagctttctccttt

SEQ ID NO: 226972 - DNA, 16 bp, Homo sapiens
taaggaaagcaataaa

SEQ ID NO: 226973 - DNA, 18 bp, Homo sapiens
taaggaaagcaataaatg

SEQ ID NO: 226974 - DNA, 17 bp, Homo sapiens
taaggaaatccagcccc

SEQ ID NO: 226975 - DNA, 18 bp, Homo sapiens
taaggaaatccagcccca

SEQ ID NO: 226976 - DNA, 21 bp, Homo sapiens
taaggaagaataaaaaagaag

SEQ ID NO: 226977 - DNA, 22 bp, Homo sapiens
taaggaattgacttcagcaggg

SEQ ID NO: 226978 - DNA, 15 bp, Homo sapiens
taaggacacactaat

SEQ ID NO: 226979 - DNA, 13 bp, Homo sapiens
taaggacaggatg

SEQ ID NO: 226980 - DNA, 14 bp, Homo sapiens
taaggagaatggcc

SEQ ID NO: 226981 - DNA, 14 bp, Homo sapiens
taaggagaggagag

SEQ ID NO: 226982 - DNA, 16 bp, Homo sapiens
taaggagatgggcctt

SEQ ID NO: 226983 - DNA, 14 bp, Homo sapiens
taaggaggagaaaa

SEQ ID NO: 226984 - DNA, 15 bp, Homo sapiens
taaggatagcctttg

SEQ ID NO: 226985 - DNA, 19 bp, Homo sapiens
taaggatggagccagctct

SEQ ID NO: 226986 - DNA, 20 bp, Homo sapiens
taaggatggagccagctctg

SEQ ID NO: 226987 - DNA, 20 bp, Homo sapiens
taaggcaacatttccgaaga

SEQ ID NO: 226988 - DNA, 20 bp, Homo sapiens
taaggcaactgaacaaaaaa

SEQ ID NO: 226989 - DNA, 14 bp, Homo sapiens
taaggccaaggcct

SEQ ID NO: 226990 - DNA, 21 bp, Homo sapiens
taaggccacgtatagtcctag

SEQ ID NO: 226991 - DNA, 16 bp, Homo sapiens
taaggccgaagaaggg

SEQ ID NO: 226992 - DNA, 17 bp, Homo sapiens
taaggcctcttgctggt

SEQ ID NO: 226993 - DNA, 19 bp, Homo sapiens
taaggcctcttgctggtgc

SEQ ID NO: 226994 - DNA, 14 bp, Homo sapiens
taaggcctgccctc

SEQ ID NO: 226995 - DNA, 16 bp, Homo sapiens
taaggcctgccctccc

SEQ ID NO: 226996 - DNA, 20 bp, Homo sapiens
taaggctgctgtaaagttga

SEQ ID NO: 226997 - DNA, 18 bp, Homo sapiens
taaggcttaggtgccagg

SEQ ID NO: 226998 - DNA, 21 bp, Homo sapiens
taaggcttaggtgccaggctg

SEQ ID NO: 226999 - DNA, 17 bp, Homo sapiens
taagggaaaagggaaca

SEQ ID NO: 227000 - DNA, 23 bp, Homo sapiens
taagggaaataacagtatttcca

SEQ ID NO: 227001 - DNA, 18 bp, Homo sapiens
taaggggaattaacaatt

SEQ ID NO: 227002 - DNA, 16 bp, Homo sapiens
taagggttgaaggcag

SEQ ID NO: 227003 - DNA, 18 bp, Homo sapiens
taagggttgaaggcagtc

SEQ ID NO: 227004 - DNA, 13 bp, Homo sapiens
taagggttttaga

SEQ ID NO: 227005 - DNA, 17 bp, Homo sapiens
taaggtcttcttgtgtc

SEQ ID NO: 227006 - DNA, 18 bp, Homo sapiens
taaggtggaaaatggact

SEQ ID NO: 227007 - DNA, 13 bp, Homo sapiens
taaggttcttgct

SEQ ID NO: 227008 - DNA, 13 bp, Homo sapiens
taagtaacatata

SEQ ID NO: 227009 - DNA, 15 bp, Homo sapiens
taagtaacatataaa

SEQ ID NO: 227010 - DNA, 20 bp, Homo sapiens
taagtaacctctacaggcat

SEQ ID NO: 227011 - DNA, 16 bp, Homo sapiens
taagtaatatctttca

SEQ ID NO: 227012 - DNA, 21 bp, Homo sapiens
taagtaattatcgggaacagt

SEQ ID NO: 227013 - DNA, 22 bp, Homo sapiens
taagtattccttggcccagcag

SEQ ID NO: 227014 - DNA, 18 bp, Homo sapiens
taagtatttaaatgttct

SEQ ID NO: 227015 - DNA, 13 bp, Homo sapiens
taagtatttatat

SEQ ID NO: 227016 - DNA, 15 bp, Homo sapiens
taagtatttatatat

SEQ ID NO: 227017 - DNA, 21 bp, Homo sapiens
taagtatttcagatgctttag

SEQ ID NO: 227018 - DNA, 16 bp, Homo sapiens
taagtcctaaagtgaa

SEQ ID NO: 227019 - DNA, 19 bp, Homo sapiens
taagtcgggaaattctgct

SEQ ID NO: 227020 - DNA, 20 bp, Homo sapiens
taagtcgggaaattctgctg

SEQ ID NO: 227021 - DNA, 15 bp, Homo sapiens
taagtgacatttgta

SEQ ID NO: 227022 - DNA, 12 bp, Homo sapiens
taagtgcccaaa

SEQ ID NO: 227023 - DNA, 16 bp, Homo sapiens
taagtgcccaaagtgg

SEQ ID NO: 227024 - DNA, 14 bp, Homo sapiens
taagtgcttttaaa

SEQ ID NO: 227025 - DNA, 16 bp, Homo sapiens
taagtggaaaaaagag

SEQ ID NO: 227026 - DNA, 20 bp, Homo sapiens
taagtggaaaaaagagaaaa

SEQ ID NO: 227027 - DNA, 21 bp, Homo sapiens
taagtggggttgcaaccactg

SEQ ID NO: 227028 - DNA, 16 bp, Homo sapiens
taagtgtcatttcttt

SEQ ID NO: 227029 - DNA, 19 bp, Homo sapiens
taagtgtgagtaagagctg

SEQ ID NO: 227030 - DNA, 20 bp, Homo sapiens
taagtgtgcacagatacaca

SEQ ID NO: 227031 - DNA, 23 bp, Homo sapiens
taagttaggcagtcttctaccaa

SEQ ID NO: 227032 - DNA, 15 bp, Homo sapiens
taagttataccagca

SEQ ID NO: 227033 - DNA, 14 bp, Homo sapiens
taagttatagtata

SEQ ID NO: 227034 - DNA, 21 bp, Homo sapiens
taagttcaccgtagtaacaca

SEQ ID NO: 227035 - DNA, 17 bp, Homo sapiens
taagttcctatcttttg

SEQ ID NO: 227036 - DNA, 18 bp, Homo sapiens
taagttctgaaaactgtt

SEQ ID NO: 227037 - DNA, 14 bp, Homo sapiens
taagttgaccttta

SEQ ID NO: 227038 - DNA, 14 bp, Homo sapiens
ttttaaaaaataac

SEQ ID NO: 227039 - DNA, 23 bp, Homo sapiens
ttttaaaaaataacatattcttg

SEQ ID NO: 227040 - DNA, 15 bp, Homo sapiens
ttttaaaaactcctt

SEQ ID NO: 227041 - DNA, 17 bp, Homo sapiens
ttttaaaaagttgcaca

SEQ ID NO: 227042 - DNA, 22 bp, Homo sapiens
ttttaaaacaagaaagtttccc

SEQ ID NO: 227043 - DNA, 16 bp, Homo sapiens
ttttaaaacacttcca

SEQ ID NO: 227044 - DNA, 13 bp, Homo sapiens
ttttaaaacatgg

SEQ ID NO: 227045 - DNA, 13 bp, Homo sapiens
ttttaaaagactt

SEQ ID NO: 227046 - DNA, 14 bp, Homo sapiens
ttttaaaagacttt

SEQ ID NO: 227047 - DNA, 12 bp, Homo sapiens
ttttaaaagttt

SEQ ID NO: 227048 - DNA, 13 bp, Homo sapiens
ttttaaaagtttc

SEQ ID NO: 227049 - DNA, 21 bp, Homo sapiens
ttttaaaagtttcaatgtgat

SEQ ID NO: 227050 - DNA, 21 bp, Homo sapiens
ttttaaaataagttaaaggca

SEQ ID NO: 227051 - DNA, 15 bp, Homo sapiens
taatgtagtgcagtc

SEQ ID NO: 227052 - DNA, 22 bp, Homo sapiens
taatgtatatgaacttaacatg

SEQ ID NO: 227053 - DNA, 18 bp, Homo sapiens
taatgtatcttatttata

SEQ ID NO: 227054 - DNA, 17 bp, Homo sapiens
taatgtcagtctacagg

SEQ ID NO: 227055 - DNA, 14 bp, Homo sapiens
taatgtcctttccc

SEQ ID NO: 227056 - DNA, 17 bp, Homo sapiens
taatgtcctttccctgg

SEQ ID NO: 227057 - DNA, 14 bp, Homo sapiens
taatgtgagacagc

SEQ ID NO: 227058 - DNA, 18 bp, Homo sapiens
taatgtgagacagcaagt

SEQ ID NO: 227059 - DNA, 21 bp, Homo sapiens
taatgtgatatgaaaatatct

SEQ ID NO: 227060 - DNA, 18 bp, Homo sapiens
taatgtgggaagaaacaa

SEQ ID NO: 227061 - DNA, 15 bp, Homo sapiens
taatgtgtatgtctg

SEQ ID NO: 227062 - DNA, 23 bp, Homo sapiens
taatgtgtatgtctggtaaatag

SEQ ID NO: 227063 - DNA, 20 bp, Homo sapiens
taatgttctgaataatttct

SEQ ID NO: 227064 - DNA, 16 bp, Homo sapiens
taatgttctttaatgt

SEQ ID NO: 227065 - DNA, 17 bp, Homo sapiens
taatgtttatgagccag

SEQ ID NO: 227066 - DNA, 22 bp, Homo sapiens
taatgtttatgagccagacaaa

SEQ ID NO: 227067 - DNA, 19 bp, Homo sapiens
taatgtttccctcaagaac

SEQ ID NO: 227068 - DNA, 15 bp, Homo sapiens
taatgttttgtacaa

SEQ ID NO: 227069 - DNA, 17 bp, Homo sapiens
taatgttttgtacaatt

SEQ ID NO: 227070 - DNA, 21 bp, Homo sapiens
taatgttttttgaagttctgg

SEQ ID NO: 227071 - DNA, 12 bp, Homo sapiens
taattaaatgaa

SEQ ID NO: 227072 - DNA, 18 bp, Homo sapiens
taattaaatgaaatactt

SEQ ID NO: 227073 - DNA, 16 bp, Homo sapiens
taattagcttgttaca

SEQ ID NO: 227074 - DNA, 20 bp, Homo sapiens
taattatcgggaacagtgtt

SEQ ID NO: 227075 - DNA, 23 bp, Homo sapiens
taattatcgggaacagtgtttcc

SEQ ID NO: 227076 - DNA, 12 bp, Homo sapiens
taattatgggaa

SEQ ID NO: 227077 - DNA, 17 bp, Homo sapiens
taattatgtgcatatta

SEQ ID NO: 227078 - DNA, 15 bp, Homo sapiens
taattatgttattga

SEQ ID NO: 227079 - DNA, 19 bp, Homo sapiens
taattattaactacattta

SEQ ID NO: 227080 - DNA, 16 bp, Homo sapiens
taattcaatttctcac

SEQ ID NO: 227081 - DNA, 19 bp, Homo sapiens
taattcagcactgatttca

SEQ ID NO: 227082 - DNA, 21 bp, Homo sapiens
taattcagggtggtaaagtat

SEQ ID NO: 227083 - DNA, 19 bp, Homo sapiens
taattcattaaaagtttta

SEQ ID NO: 227084 - DNA, 20 bp, Homo sapiens
taattccctatcttttagtt

SEQ ID NO: 227085 - DNA, 21 bp, Homo sapiens
taattcgtacataataagttt

SEQ ID NO: 227086 - DNA, 22 bp, Homo sapiens
taattctaaaagagaagggagc

SEQ ID NO: 227087 - DNA, 11 bp, Homo sapiens
taattctaaat

SEQ ID NO: 227088 - DNA, 18 bp, Homo sapiens
taattctaaatgaatgtt

SEQ ID NO: 227089 - DNA, 19 bp, Homo sapiens
taattctaagttatttact

SEQ ID NO: 227090 - DNA, 13 bp, Homo sapiens
taattctaccctg

SEQ ID NO: 227091 - DNA, 12 bp, Homo sapiens
taattctatact

SEQ ID NO: 227092 - DNA, 13 bp, Homo sapiens
taattctgtaaat

SEQ ID NO: 227093 - DNA, 15 bp, Homo sapiens
taattctgtaaatgt

SEQ ID NO: 227094 - DNA, 12 bp, Homo sapiens
taattcttaata

SEQ ID NO: 227095 - DNA, 18 bp, Homo sapiens
taattcttaataggcttt

SEQ ID NO: 227096 - DNA, 18 bp, Homo sapiens
taattctttgataagatg

SEQ ID NO: 227097 - DNA, 22 bp, Homo sapiens
taattgacaggattattggaaa

SEQ ID NO: 227098 - DNA, 13 bp, Homo sapiens
taattgattaaac

SEQ ID NO: 227099 - DNA, 17 bp, Homo sapiens
taattgattaaactgta

SEQ ID NO: 227100 - DNA, 14 bp, Homo sapiens
taattgcctttgag

SEQ ID NO: 227101 - DNA, 18 bp, Homo sapiens
taattgcttaaaagacat

SEQ ID NO: 227102 - DNA, 15 bp, Homo sapiens
taattgtaattgtct

SEQ ID NO: 227103 - DNA, 19 bp, Homo sapiens
taattgtcaaaaaccagaa

SEQ ID NO: 227104 - DNA, 14 bp, Homo sapiens
taattgtgaattga

SEQ ID NO: 227105 - DNA, 11 bp, Homo sapiens
taattgtgtac

SEQ ID NO: 227106 - DNA, 15 bp, Homo sapiens
taattgttatacatt

SEQ ID NO: 227107 - DNA, 18 bp, Homo sapiens
taattgttatacattttt

SEQ ID NO: 227108 - DNA, 17 bp, Homo sapiens
taattgtttgtctttaa

SEQ ID NO: 227109 - DNA, 16 bp, Homo sapiens
taattgttttgcactt

SEQ ID NO: 227110 - DNA, 15 bp, Homo sapiens
taatttaaaaaataa

SEQ ID NO: 227111 - DNA, 15 bp, Homo sapiens
taatttaaagctgtt

SEQ ID NO: 227112 - DNA, 19 bp, Homo sapiens
taatttaaagctgtttcta

SEQ ID NO: 227113 - DNA, 12 bp, Homo sapiens
taatttaaatgc

SEQ ID NO: 227114 - DNA, 16 bp, Homo sapiens
taatttaagccaataa

SEQ ID NO: 227115 - DNA, 21 bp, Homo sapiens
taatttaattccccttccctt

SEQ ID NO: 227116 - DNA, 18 bp, Homo sapiens
taatttatagtttataca

SEQ ID NO: 227117 - DNA, 15 bp, Homo sapiens
taatttatatttgtc

SEQ ID NO: 227118 - DNA, 14 bp, Homo sapiens
taatttatttatta

SEQ ID NO: 227119 - DNA, 13 bp, Homo sapiens
taatttattttgt

SEQ ID NO: 227120 - DNA, 23 bp, Homo sapiens
taatttattttgtatttttgaat

SEQ ID NO: 227121 - DNA, 20 bp, Homo sapiens
taatttcaaaaatataactt

SEQ ID NO: 227122 - DNA, 21 bp, Homo sapiens
taatttcaaaaatataactta

SEQ ID NO: 227123 - DNA, 22 bp, Homo sapiens
taatttcagctagttaataatt

SEQ ID NO: 227124 - DNA, 14 bp, Homo sapiens
taatttcataaatt

SEQ ID NO: 227125 - DNA, 21 bp, Homo sapiens
taatttcataaattggctcct

SEQ ID NO: 227126 - DNA, 22 bp, Homo sapiens
taatttctaaagataatattac

SEQ ID NO: 227127 - DNA, 17 bp, Homo sapiens
taatttgatgaaagctg

SEQ ID NO: 227128 - DNA, 13 bp, Homo sapiens
taatttgtatgtt

SEQ ID NO: 227129 - DNA, 19 bp, Homo sapiens
taattttaaaattgcagca

SEQ ID NO: 227130 - DNA, 13 bp, Homo sapiens
taattttacatgt

SEQ ID NO: 227131 - DNA, 15 bp, Homo sapiens
taattttacatgtct

SEQ ID NO: 227132 - DNA, 16 bp, Homo sapiens
taattttattattaga

SEQ ID NO: 227133 - DNA, 12 bp, Homo sapiens
taattttctaaa

SEQ ID NO: 227134 - DNA, 23 bp, Homo sapiens
taattttcttcatgcaatgacat

SEQ ID NO: 227135 - DNA, 15 bp, Homo sapiens
taattttgtagtagt

SEQ ID NO: 227136 - DNA, 19 bp, Homo sapiens
taattttgtagtagttgat

SEQ ID NO: 227137 - DNA, 20 bp, Homo sapiens
taattttgtgctctttcctg

SEQ ID NO: 227138 - DNA, 15 bp, Homo sapiens
taatttttaaaagac

SEQ ID NO: 227139 - DNA, 18 bp, Homo sapiens
taatttttaaaagacttt

SEQ ID NO: 227140 - DNA, 16 bp, Homo sapiens
taatttttatatttaa

SEQ ID NO: 227141 - DNA, 18 bp, Homo sapiens
taatttttgtactttgct

SEQ ID NO: 227142 - DNA, 19 bp, Homo sapiens
taattttttagttaaaatc

SEQ ID NO: 227143 - DNA, 15 bp, Homo sapiens
taatttttttctagt

SEQ ID NO: 227144 - DNA, 18 bp, Homo sapiens
taatttttttctagttgt

SEQ ID NO: 227145 - DNA, 14 bp, Homo sapiens
tacaaaaatatatt

SEQ ID NO: 227146 - DNA, 19 bp, Homo sapiens
tacaaaacctgatgttaaa

SEQ ID NO: 227147 - DNA, 16 bp, Homo sapiens
tacaaaagaagatgaa

SEQ ID NO: 227148 - DNA, 14 bp, Homo sapiens
tacaaaagcaaagt

SEQ ID NO: 227149 - DNA, 16 bp, Homo sapiens
tacaaaagcaaagtga

SEQ ID NO: 227150 - DNA, 12 bp, Homo sapiens
tacaaaatgaat

SEQ ID NO: 227151 - DNA, 21 bp, Homo sapiens
tacaaaatgagattcagtgaa

SEQ ID NO: 227152 - DNA, 19 bp, Homo sapiens
tacaaaatttgaaatttag

SEQ ID NO: 227153 - DNA, 12 bp, Homo sapiens
tacaaacaaagg

SEQ ID NO: 227154 - DNA, 9 bp, Homo sapiens
tacaaacat

SEQ ID NO: 227155 - DNA, 11 bp, Homo sapiens
tacaaactgca

SEQ ID NO: 227156 - DNA, 12 bp, Homo sapiens
tacaaactgcaa

SEQ ID NO: 227157 - DNA, 17 bp, Homo sapiens
tacaaactgcaatagag

SEQ ID NO: 227158 - DNA, 13 bp, Homo sapiens
tacaaactttgtt

SEQ ID NO: 227159 - DNA, 13 bp, Homo sapiens
tacaaagacaggg

SEQ ID NO: 227160 - DNA, 17 bp, Homo sapiens
tacaaagctgaagaaaa

SEQ ID NO: 227161 - DNA, 16 bp, Homo sapiens
tacaaagtaaaaataa

SEQ ID NO: 227162 - DNA, 17 bp, Homo sapiens
tacaaagtagagaagta

SEQ ID NO: 227163 - DNA, 13 bp, Homo sapiens
tacaaataaagat

SEQ ID NO: 227164 - DNA, 18 bp, Homo sapiens
tacaaatagaagcttctt

SEQ ID NO: 227165 - DNA, 21 bp, Homo sapiens
tacaaattataaaaagccact

SEQ ID NO: 227166 - DNA, 16 bp, Homo sapiens
tacaaattcaaggaga

SEQ ID NO: 227167 - DNA, 13 bp, Homo sapiens
tacaaattttcac

SEQ ID NO: 227168 - DNA, 15 bp, Homo sapiens
tacaaattttcactg

SEQ ID NO: 227169 - DNA, 15 bp, Homo sapiens
tacaacaaacactgt

SEQ ID NO: 227170 - DNA, 22 bp, Homo sapiens
tacaacaagagtttatttccaa

SEQ ID NO: 227171 - DNA, 23 bp, Homo sapiens
tacaacataatctagtttacaga

SEQ ID NO: 227172 - DNA, 14 bp, Homo sapiens
tacaaccacatttc

SEQ ID NO: 227173 - DNA, 14 bp, Homo sapiens
tacaaccaggtctt

SEQ ID NO: 227174 - DNA, 18 bp, Homo sapiens
tacaactaaataacacag

SEQ ID NO: 227175 - DNA, 20 bp, Homo sapiens
tacaactaaataacacagat

SEQ ID NO: 227176 - DNA, 20 bp, Homo sapiens
tacaactgagtccttaaaca

SEQ ID NO: 227177 - DNA, 15 bp, Homo sapiens
tacaagactaacctt

SEQ ID NO: 227178 - DNA, 18 bp, Homo sapiens
tacaagagccatgtacca

SEQ ID NO: 227179 - DNA, 12 bp, Homo sapiens
tacaagataaaa

SEQ ID NO: 227180 - DNA, 17 bp, Homo sapiens
tacaagatttagaaaaa

SEQ ID NO: 227181 - DNA, 23 bp, Homo sapiens
tacaagccaagctagaaggaagc

SEQ ID NO: 227182 - DNA, 19 bp, Homo sapiens
taccccaagtccacctgcc

SEQ ID NO: 227183 - DNA, 17 bp, Homo sapiens
taccccacctcatgcct

SEQ ID NO: 227184 - DNA, 21 bp, Homo sapiens
taccccacctcatgcctggcc

SEQ ID NO: 227185 - DNA, 14 bp, Homo sapiens
taccccagccactc

SEQ ID NO: 227186 - DNA, 12 bp, Homo sapiens
taccccagctcc

SEQ ID NO: 227187 - DNA, 20 bp, Homo sapiens
taccccagggcctactgcca

SEQ ID NO: 227188 - DNA, 14 bp, Homo sapiens
taccccccgtctcc

SEQ ID NO: 227189 - DNA, 18 bp, Homo sapiens
taccccccgtctcctgcc

SEQ ID NO: 227190 - DNA, 19 bp, Homo sapiens
taccccccgtctcctgccg

SEQ ID NO: 227191 - DNA, 15 bp, Homo sapiens
tacccccctgagagc

SEQ ID NO: 227192 - DNA, 15 bp, Homo sapiens
taccccctgccccag

SEQ ID NO: 227193 - DNA, 18 bp, Homo sapiens
taccccctgccccagaga

SEQ ID NO: 227194 - DNA, 15 bp, Homo sapiens
tacccccttgtctgc

SEQ ID NO: 227195 - DNA, 15 bp, Homo sapiens
taccccgtccctttc

SEQ ID NO: 227196 - DNA, 18 bp, Homo sapiens
taccccgtccctttccct

SEQ ID NO: 227197 - DNA, 14 bp, Homo sapiens
tacccctgctccca

SEQ ID NO: 227198 - DNA, 22 bp, Homo sapiens
tacccctgctcccattcctccc

SEQ ID NO: 227199 - DNA, 19 bp, Homo sapiens
taccctacacctctgggcc

SEQ ID NO: 227200 - DNA, 18 bp, Homo sapiens
tccatttcatgtgatcta

SEQ ID NO: 227201 - DNA, 11 bp, Homo sapiens
tccatttctga

SEQ ID NO: 227202 - DNA, 14 bp, Homo sapiens
tccatttgtgtgtg

SEQ ID NO: 227203 - DNA, 13 bp, Homo sapiens
tccattttaacaa

SEQ ID NO: 227204 - DNA, 11 bp, Homo sapiens
tccattttcta

SEQ ID NO: 227205 - DNA, 22 bp, Homo sapiens
tccattttggcgctattacaaa

SEQ ID NO: 227206 - DNA, 18 bp, Homo sapiens
tccatttttactaaagca

SEQ ID NO: 227207 - DNA, 20 bp, Homo sapiens
tccatttttactaaagcagt

SEQ ID NO: 227208 - DNA, 21 bp, Homo sapiens
tccatttttactaaagcagtg

SEQ ID NO: 227209 - DNA, 15 bp, Homo sapiens
tccatttttcccagg

SEQ ID NO: 227210 - DNA, 23 bp, Homo sapiens
tccattttttcaaggtaatttct

SEQ ID NO: 227211 - DNA, 14 bp, Homo sapiens
tcccaaacccttcg

SEQ ID NO: 227212 - DNA, 14 bp, Homo sapiens
tcccaaactcccag

SEQ ID NO: 227213 - DNA, 18 bp, Homo sapiens
tcccaaactcccaggacc

SEQ ID NO: 227214 - DNA, 13 bp, Homo sapiens
tcccaaagagctg

SEQ ID NO: 227215 - DNA, 15 bp, Homo sapiens
tcccaaagagctgcc

SEQ ID NO: 227216 - DNA, 17 bp, Homo sapiens
tcccaaagcagtgcatg

SEQ ID NO: 227217 - DNA, 20 bp, Homo sapiens
tcccaaagtgctgggattac

SEQ ID NO: 227218 - DNA, 17 bp, Homo sapiens
tcccaaataaactcctt

SEQ ID NO: 227219 - DNA, 21 bp, Homo sapiens
tcccaaataaatttataacaa

SEQ ID NO: 227220 - DNA, 22 bp, Homo sapiens
tcccaaataaatttataacaat

SEQ ID NO: 227221 - DNA, 17 bp, Homo sapiens
tcccaaatatgcccctc

SEQ ID NO: 227222 - DNA, 21 bp, Homo sapiens
tcccaacaaccacacttaaat

SEQ ID NO: 227223 - DNA, 14 bp, Homo sapiens
tcccaacactttgg

SEQ ID NO: 227224 - DNA, 16 bp, Homo sapiens
tcccaacagaggcctc

SEQ ID NO: 227225 - DNA, 13 bp, Homo sapiens
tcccaacagcctt

SEQ ID NO: 227226 - DNA, 22 bp, Homo sapiens
tcccaacagccttagctgccag

SEQ ID NO: 227227 - DNA, 21 bp, Homo sapiens
tcccaacgtactcctcagacg

SEQ ID NO: 227228 - DNA, 17 bp, Homo sapiens
tcccaactcctataatt

SEQ ID NO: 227229 - DNA, 18 bp, Homo sapiens
tcccaacttccctgttct

SEQ ID NO: 227230 - DNA, 19 bp, Homo sapiens
tcccaagaacagcaggccc

SEQ ID NO: 227231 - DNA, 22 bp, Homo sapiens
tcccaagaacagcaggcccacc

SEQ ID NO: 227232 - DNA, 23 bp, Homo sapiens
tcccaagaacagcaggcccacct

SEQ ID NO: 227233 - DNA, 18 bp, Homo sapiens
tcccaagcgttcctggcc

SEQ ID NO: 227234 - DNA, 18 bp, Homo sapiens
tcccaagctcagagcagc

SEQ ID NO: 227235 - DNA, 12 bp, Homo sapiens
tcccaagctgga

SEQ ID NO: 227236 - DNA, 23 bp, Homo sapiens
tcccaaggagctgatttccaggc

SEQ ID NO: 227237 - DNA, 18 bp, Homo sapiens
tcccaaggctctgagcaa

SEQ ID NO: 227238 - DNA, 18 bp, Homo sapiens
tcccaaggtcctctcagt

SEQ ID NO: 227239 - DNA, 21 bp, Homo sapiens
tcccaagtaggtgggattaca

SEQ ID NO: 227240 - DNA, 14 bp, Homo sapiens
tcccaagtcaaaca

SEQ ID NO: 227241 - DNA, 15 bp, Homo sapiens
tcccaataaaagtga

SEQ ID NO: 227242 - DNA, 16 bp, Homo sapiens
tcccaataaaagtgac

SEQ ID NO: 227243 - DNA, 22 bp, Homo sapiens
tcccaataaagtcctcttccct

SEQ ID NO: 227244 - DNA, 19 bp, Homo sapiens
tcccaatctttctatataa

SEQ ID NO: 227245 - DNA, 20 bp, Homo sapiens
tcccaatctttctatataaa

SEQ ID NO: 227246 - DNA, 24 bp, Homo sapiens
tcccaatctttctatataaaatgt

SEQ ID NO: 227247 - DNA, 19 bp, Homo sapiens
tcccaattaggaagtgtaa

SEQ ID NO: 227248 - DNA, 19 bp, Homo sapiens
tcccaatttaagagtcctg

SEQ ID NO: 227249 - DNA, 23 bp, Homo sapiens
tcccaatttaagagtcctgaggc

SEQ ID NO: 227250 - DNA, 14 bp, Homo sapiens
tcccacacaagcag

SEQ ID NO: 227251 - DNA, 17 bp, Homo sapiens
tcccacacatattcaaa

SEQ ID NO: 227252 - DNA, 13 bp, Homo sapiens
tcccacaccctgg

SEQ ID NO: 227253 - DNA, 19 bp, Homo sapiens
tcccacacttgctggggct

SEQ ID NO: 227254 - DNA, 20 bp, Homo sapiens
tcccacagtctctccctggg

SEQ ID NO: 227255 - DNA, 21 bp, Homo sapiens
tcccacagtctctccctgggg

SEQ ID NO: 227256 - DNA, 13 bp, Homo sapiens
tcccacatccccc

SEQ ID NO: 227257 - DNA, 19 bp, Homo sapiens
tcccaccaaccctcagagc

SEQ ID NO: 227258 - DNA, 20 bp, Homo sapiens
tcccacccactagccctctt

SEQ ID NO: 227259 - DNA, 19 bp, Homo sapiens
tcccacccccttctctgct

SEQ ID NO: 227260 - DNA, 19 bp, Homo sapiens
tcccaccccggcctccact

SEQ ID NO: 227261 - DNA, 12 bp, Homo sapiens
tcccacccctat

SEQ ID NO: 227262 - DNA, 22 bp, Homo sapiens
tcccacccctataccctaggtc

SEQ ID NO: 227263 - DNA, 20 bp, Homo sapiens
tcccaccggttgcttctggg

SEQ ID NO: 227264 - DNA, 12 bp, Homo sapiens
tcccacctccag

SEQ ID NO: 227265 - DNA, 15 bp, Homo sapiens
tcccacctccagccc

SEQ ID NO: 227266 - DNA, 17 bp, Homo sapiens
tcccacctccagcccac

SEQ ID NO: 227267 - DNA, 14 bp, Homo sapiens
tcccacctccagtc

SEQ ID NO: 227268 - DNA, 14 bp, Homo sapiens
tcccacctccctgc

SEQ ID NO: 227269 - DNA, 15 bp, Homo sapiens
tcccacctccctgcc

SEQ ID NO: 227270 - DNA, 16 bp, Homo sapiens
tcccacctccctgccc

SEQ ID NO: 227271 - DNA, 17 bp, Homo sapiens
tcccacctccctgccca

SEQ ID NO: 227272 - DNA, 19 bp, Homo sapiens
tcccacctccctgcccagg

SEQ ID NO: 227273 - DNA, 20 bp, Homo sapiens
tcccacctccctgcccaggc

SEQ ID NO: 227274 - DNA, 21 bp, Homo sapiens
tcccacctcgcggcgcagccc

SEQ ID NO: 227275 - DNA, 15 bp, Homo sapiens
tcccacctctccttt

SEQ ID NO: 227276 - DNA, 23 bp, Homo sapiens
tcccacgctgggacacagaccgg

SEQ ID NO: 227277 - DNA, 18 bp, Homo sapiens
tcccactaagctttctcc

SEQ ID NO: 227278 - DNA, 19 bp, Homo sapiens
tcccacttatcaaatcatt

SEQ ID NO: 227279 - DNA, 12 bp, Homo sapiens
tcccagaaatta

SEQ ID NO: 227280 - DNA, 20 bp, Homo sapiens
tcccagacaaggagagcgga

SEQ ID NO: 227281 - DNA, 22 bp, Homo sapiens
tcccagacaggccctccctgtc

SEQ ID NO: 227282 - DNA, 23 bp, Homo sapiens
tcccagacaggccctccctgtct

SEQ ID NO: 227283 - DNA, 14 bp, Homo sapiens
tcccagacttgttt

SEQ ID NO: 227284 - DNA, 19 bp, Homo sapiens
tcccagagaacaatcacta

SEQ ID NO: 227285 - DNA, 19 bp, Homo sapiens
tcccagagcttattggcca

SEQ ID NO: 227286 - DNA, 22 bp, Homo sapiens
tcccagagcttattggccactg

SEQ ID NO: 227287 - DNA, 23 bp, Homo sapiens
tcccagagcttattggccactgg

SEQ ID NO: 227288 - DNA, 15 bp, Homo sapiens
tcccagaggctcctg

SEQ ID NO: 227289 - DNA, 19 bp, Homo sapiens
tcccagaggctcctggagc

SEQ ID NO: 227290 - DNA, 21 bp, Homo sapiens
tcccagaggtgggatcctccc

SEQ ID NO: 227291 - DNA, 23 bp, Homo sapiens
tcccagaggtggggaagagagcc

SEQ ID NO: 227292 - DNA, 19 bp, Homo sapiens
tcccagaggttatctgcct

SEQ ID NO: 227293 - DNA, 23 bp, Homo sapiens
tcccagaggttatctgcctggcc

SEQ ID NO: 227294 - DNA, 24 bp, Homo sapiens
tcccagaggttatctgcctggcct

SEQ ID NO: 227295 - DNA, 15 bp, Homo sapiens
tcccagagtgctggg

SEQ ID NO: 227296 - DNA, 14 bp, Homo sapiens
tgccacgctttgct

SEQ ID NO: 227297 - DNA, 19 bp, Homo sapiens
tgccacgctttgctgctac

SEQ ID NO: 227298 - DNA, 16 bp, Homo sapiens
tgccactaggctgggt

SEQ ID NO: 227299 - DNA, 16 bp, Homo sapiens
tgccactccctgagct

SEQ ID NO: 227300 - DNA, 17 bp, Homo sapiens
tgccactccctgagctt

SEQ ID NO: 227301 - DNA, 18 bp, Homo sapiens
tgccactcctcaactgat

SEQ ID NO: 227302 - DNA, 16 bp, Homo sapiens
tgccactgccaggcac

SEQ ID NO: 227303 - DNA, 21 bp, Homo sapiens
tgccactgccaggcacctggc

SEQ ID NO: 227304 - DNA, 19 bp, Homo sapiens
tgccactgcccgagctggt

SEQ ID NO: 227305 - DNA, 17 bp, Homo sapiens
tgccactgcctcttcct

SEQ ID NO: 227306 - DNA, 19 bp, Homo sapiens
tgccactgcctcttcctcc

SEQ ID NO: 227307 - DNA, 20 bp, Homo sapiens
tgccacttcttaaaggcctg

SEQ ID NO: 227308 - DNA, 21 bp, Homo sapiens
tgccacttcttaaaggcctgg

SEQ ID NO: 227309 - DNA, 22 bp, Homo sapiens
tgccacttcttaaaggcctgga

SEQ ID NO: 227310 - DNA, 18 bp, Homo sapiens
tgccacttgcactgtgct

SEQ ID NO: 227311 - DNA, 22 bp, Homo sapiens
tgccagaaacagtgggagccct

SEQ ID NO: 227312 - DNA, 14 bp, Homo sapiens
tgccagacttaaat

SEQ ID NO: 227313 - DNA, 17 bp, Homo sapiens
tgccagagccttaataa

SEQ ID NO: 227314 - DNA, 16 bp, Homo sapiens
tgccagcacaggggcc

SEQ ID NO: 227315 - DNA, 18 bp, Homo sapiens
tgccagcacaggggcccc

SEQ ID NO: 227316 - DNA, 21 bp, Homo sapiens
tgccagcacaggggccccaga

SEQ ID NO: 227317 - DNA, 15 bp, Homo sapiens
tgccagcatatactg

SEQ ID NO: 227318 - DNA, 18 bp, Homo sapiens
tgccagccttcctctgca

SEQ ID NO: 227319 - DNA, 17 bp, Homo sapiens
tgccagcgcatgtgtcc

SEQ ID NO: 227320 - DNA, 19 bp, Homo sapiens
tgccagctccacagggtgg

SEQ ID NO: 227321 - DNA, 14 bp, Homo sapiens
tgccagctgccttc

SEQ ID NO: 227322 - DNA, 15 bp, Homo sapiens
tgccaggaatgtttc

SEQ ID NO: 227323 - DNA, 17 bp, Homo sapiens
tgccaggaatgtttcag

SEQ ID NO: 227324 - DNA, 16 bp, Homo sapiens
tgccaggacagctgca

SEQ ID NO: 227325 - DNA, 22 bp, Homo sapiens
tgccaggacagctgcaggtgcc

SEQ ID NO: 227326 - DNA, 18 bp, Homo sapiens
tgccaggactctctttct

SEQ ID NO: 227327 - DNA, 17 bp, Homo sapiens
tgccaggagcaatggga

SEQ ID NO: 227328 - DNA, 19 bp, Homo sapiens
tgccaggagcaatgggact

SEQ ID NO: 227329 - DNA, 20 bp, Homo sapiens
tgccaggagcaatgggactg

SEQ ID NO: 227330 - DNA, 22 bp, Homo sapiens
tgccaggaggctggcagtacag

SEQ ID NO: 227331 - DNA, 12 bp, Homo sapiens
tgccaggagtgg

SEQ ID NO: 227332 - DNA, 14 bp, Homo sapiens
tgccaggcacctgg

SEQ ID NO: 227333 - DNA, 15 bp, Homo sapiens
tgccaggcacctggc

SEQ ID NO: 227334 - DNA, 18 bp, Homo sapiens
tgccaggcacctggcctg

SEQ ID NO: 227335 - DNA, 20 bp, Homo sapiens
tgccaggcacctggcctgct

SEQ ID NO: 227336 - DNA, 21 bp, Homo sapiens
tgccaggcacctggcctgctg

SEQ ID NO: 227337 - DNA, 22 bp, Homo sapiens
tgccaggcagaaaactggcagt

SEQ ID NO: 227338 - DNA, 22 bp, Homo sapiens
tgccaggcccatctcaggtgcc

SEQ ID NO: 227339 - DNA, 23 bp, Homo sapiens
tgccaggcccatctcaggtgcca

SEQ ID NO: 227340 - DNA, 15 bp, Homo sapiens
tgccaggctgggcac

SEQ ID NO: 227341 - DNA, 19 bp, Homo sapiens
tgccaggctgggcacggct

SEQ ID NO: 227342 - DNA, 17 bp, Homo sapiens
tgccagggaaaaagacc

SEQ ID NO: 227343 - DNA, 21 bp, Homo sapiens
tgccagggaaaaagaccaaat

SEQ ID NO: 227344 - DNA, 14 bp, Homo sapiens
tgccaggtggctca

SEQ ID NO: 227345 - DNA, 14 bp, Homo sapiens
tgccaggttgcagc

SEQ ID NO: 227346 - DNA, 19 bp, Homo sapiens
tgccaggttgcagctgctc

SEQ ID NO: 227347 - DNA, 15 bp, Homo sapiens
tgccagtgaagtcct

SEQ ID NO: 227348 - DNA, 16 bp, Homo sapiens
tgccagtgaagtcctt

SEQ ID NO: 227349 - DNA, 17 bp, Homo sapiens
tgccagtgacagacagg

SEQ ID NO: 227350 - DNA, 14 bp, Homo sapiens
tgccagtgctggtc

SEQ ID NO: 227351 - DNA, 16 bp, Homo sapiens
tgccatacatgttatt

SEQ ID NO: 227352 - DNA, 15 bp, Homo sapiens
tgccataccttgaga

SEQ ID NO: 227353 - DNA, 21 bp, Homo sapiens
tgccatagagtttaacacaag

SEQ ID NO: 227354 - DNA, 14 bp, Homo sapiens
tgccatatttttga

SEQ ID NO: 227355 - DNA, 19 bp, Homo sapiens
tgccatatttttgagggct

SEQ ID NO: 227356 - DNA, 16 bp, Homo sapiens
tgccatcatgcctgac

SEQ ID NO: 227357 - DNA, 21 bp, Homo sapiens
tgccatcctaaaagccacccc

SEQ ID NO: 227358 - DNA, 16 bp, Homo sapiens
tgccatcgggtgccaa

SEQ ID NO: 227359 - DNA, 15 bp, Homo sapiens
tgccatgatagctgg

SEQ ID NO: 227360 - DNA, 19 bp, Homo sapiens
tgccatgccactgccaggc

SEQ ID NO: 227361 - DNA, 22 bp, Homo sapiens
tgccatgccactgccaggcacc

SEQ ID NO: 227362 - DNA, 21 bp, Homo sapiens
tgccatgctgctatgaagact

SEQ ID NO: 227363 - DNA, 23 bp, Homo sapiens
tgccatggaggcacacagctgca

SEQ ID NO: 227364 - DNA, 13 bp, Homo sapiens
tgccatggatgat

SEQ ID NO: 227365 - DNA, 21 bp, Homo sapiens
tgccatggatgattcttttcc

SEQ ID NO: 227366 - DNA, 19 bp, Homo sapiens
tgccatggcctgtgctggg

SEQ ID NO: 227367 - DNA, 18 bp, Homo sapiens
tgccatgtacagtatgtt

SEQ ID NO: 227368 - DNA, 13 bp, Homo sapiens
tgccatgtcgctt

SEQ ID NO: 227369 - DNA, 13 bp, Homo sapiens
tgccatgtggcag

SEQ ID NO: 227370 - DNA, 22 bp, Homo sapiens
tgccattaaatccgcaaacagc

SEQ ID NO: 227371 - DNA, 18 bp, Homo sapiens
tgccattagactgaattt

SEQ ID NO: 227372 - DNA, 19 bp, Homo sapiens
tgccattagactgaattta

SEQ ID NO: 227373 - DNA, 14 bp, Homo sapiens
tgccattcccagcg

SEQ ID NO: 227374 - DNA, 18 bp, Homo sapiens
tgccattgtactccagcc

SEQ ID NO: 227375 - DNA, 20 bp, Homo sapiens
tgccattgtactccagcctg

SEQ ID NO: 227376 - DNA, 18 bp, Homo sapiens
tgccattgtctttcctcc

SEQ ID NO: 227377 - DNA, 21 bp, Homo sapiens
tgccattgtctttcctccctt

SEQ ID NO: 227378 - DNA, 13 bp, Homo sapiens
tgccatttgtctt

SEQ ID NO: 227379 - DNA, 21 bp, Homo sapiens
tgccattttgggttaggagaa

SEQ ID NO: 227380 - DNA, 15 bp, Homo sapiens
tgcccaaagtgggga

SEQ ID NO: 227381 - DNA, 22 bp, Homo sapiens
tgcccaaagtggggagggacaa

SEQ ID NO: 227382 - DNA, 18 bp, Homo sapiens
tgcccaacctcagcaacc

SEQ ID NO: 227383 - DNA, 19 bp, Homo sapiens
tgcccaacctcagcaacct

SEQ ID NO: 227384 - DNA, 15 bp, Homo sapiens
tgcccaactcccagc

SEQ ID NO: 227385 - DNA, 20 bp, Homo sapiens
tgcccaactcccagccacca

SEQ ID NO: 227386 - DNA, 21 bp, Homo sapiens
tgcccaagaatagatgctgac

SEQ ID NO: 227387 - DNA, 22 bp, Homo sapiens
tgcccaagaatagatgctgact

SEQ ID NO: 227388 - DNA, 16 bp, Homo sapiens
tgcccaatgctttggg

SEQ ID NO: 227389 - DNA, 16 bp, Homo sapiens
tgcccacacaccccaa

SEQ ID NO: 227390 - DNA, 17 bp, Homo sapiens
tgcccacacctgcctct

SEQ ID NO: 227391 - DNA, 18 bp, Homo sapiens
tgcccacacctgcctctg

SEQ ID NO: 227392 - DNA, 17 bp, Homo sapiens
tgcccacccagggcccg

SEQ ID NO: 227393 - DNA, 20 bp, Homo sapiens
tgcccacccgtggagatggg

SEQ ID NO: 227394 - DNA, 22 bp, Homo sapiens
tgcccacccgtgttctcctcca

SEQ ID NO: 227395 - DNA, 11 bp, Homo sapiens
tgcccaccctg

SEQ ID NO: 227396 - DNA, 19 bp, Homo sapiens
tgcccaccctgggcctccc

SEQ ID NO: 227397 - DNA, 17 bp, Homo sapiens
tgcccacctgcccatca

SEQ ID NO: 227398 - DNA, 15 bp, Homo sapiens
tgcccacggccaccc

SEQ ID NO: 227399 - DNA, 17 bp, Homo sapiens
tgcccacggccacccac

SEQ ID NO: 227400 - DNA, 21 bp, Homo sapiens
tgcccacggccacccaccctt

SEQ ID NO: 227401 - DNA, 16 bp, Homo sapiens
tgcccactaagaagtt

SEQ ID NO: 227402 - DNA, 19 bp, Homo sapiens
tgcccagacccctctggcc

SEQ ID NO: 227403 - DNA, 14 bp, Homo sapiens
tgcccagagctggg

SEQ ID NO: 227404 - DNA, 15 bp, Homo sapiens
tgcccagagctgggt

SEQ ID NO: 227405 - DNA, 18 bp, Homo sapiens
tgcccagagtagcccagg

SEQ ID NO: 227406 - DNA, 11 bp, Homo sapiens
tgcccagccct

SEQ ID NO: 227407 - DNA, 15 bp, Homo sapiens
tgcccagctcagtct

SEQ ID NO: 227408 - DNA, 21 bp, Homo sapiens
tgcccagctcagtcttcccta

SEQ ID NO: 227409 - DNA, 12 bp, Homo sapiens
tgcccagctctg

SEQ ID NO: 227410 - DNA, 14 bp, Homo sapiens
tgcccagcttgggc

SEQ ID NO: 227411 - DNA, 21 bp, Homo sapiens
tgcccaggcagtctttgctca

SEQ ID NO: 227412 - DNA, 12 bp, Homo sapiens
tgcccaggctct

SEQ ID NO: 227413 - DNA, 13 bp, Homo sapiens
tgcccaggctctg

SEQ ID NO: 227414 - DNA, 14 bp, Homo sapiens
tgcccaggctctgc

SEQ ID NO: 227415 - DNA, 18 bp, Homo sapiens
tgcccaggctggagtgca

SEQ ID NO: 227416 - DNA, 17 bp, Homo sapiens
tgcccagggtcagtgta

SEQ ID NO: 227417 - DNA, 17 bp, Homo sapiens
tgcccagggtcctgtgc

SEQ ID NO: 227418 - DNA, 19 bp, Homo sapiens
tgcccagggtcctgtgcct

SEQ ID NO: 227419 - DNA, 17 bp, Homo sapiens
tgcccaggtaccaccct

SEQ ID NO: 227420 - DNA, 18 bp, Homo sapiens
tgcccagtcatgacattt

SEQ ID NO: 227421 - DNA, 18 bp, Homo sapiens
tgcccagtgttgtttgta

SEQ ID NO: 227422 - DNA, 20 bp, Homo sapiens
tgcccagtgttgtttgtaaa

SEQ ID NO: 227423 - DNA, 21 bp, Homo sapiens
tgcccagtgttgtttgtaaat

SEQ ID NO: 227424 - DNA, 22 bp, Homo sapiens
tgcccagtgttgtttgtaaata

SEQ ID NO: 227425 - DNA, 20 bp, Homo sapiens
tgcccagttaatcttgcttt

SEQ ID NO: 227426 - DNA, 22 bp, Homo sapiens
tgcccagttaatcttgctttct

SEQ ID NO: 227427 - DNA, 23 bp, Homo sapiens
tgcccatcacagggttgggccca

SEQ ID NO: 227428 - DNA, 17 bp, Homo sapiens
tgcccatcatctctgcc

SEQ ID NO: 227429 - DNA, 17 bp, Homo sapiens
agcttcagacctccctc

SEQ ID NO: 227430 - DNA, 21 bp, Homo sapiens
agcttcatcttgagcctgagc

SEQ ID NO: 227431 - DNA, 22 bp, Homo sapiens
agcttcatcttgagcctgagcc

SEQ ID NO: 227432 - DNA, 21 bp, Homo sapiens
agcttcatgcctttgtaagtt

SEQ ID NO: 227433 - DNA, 22 bp, Homo sapiens
agcttcattctcactctgcttt

SEQ ID NO: 227434 - DNA, 17 bp, Homo sapiens
agcttcatttgtgtcaa

SEQ ID NO: 227435 - DNA, 20 bp, Homo sapiens
agcttccacctgtccctctc

SEQ ID NO: 227436 - DNA, 11 bp, Homo sapiens
agcttccagat

SEQ ID NO: 227437 - DNA, 21 bp, Homo sapiens
agcttccatgtttaatgttat

SEQ ID NO: 227438 - DNA, 14 bp, Homo sapiens
agcttcccaacaat

SEQ ID NO: 227439 - DNA, 20 bp, Homo sapiens
agcttcctagcttatctccc

SEQ ID NO: 227440 - DNA, 14 bp, Homo sapiens
agcttcctccagag

SEQ ID NO: 227441 - DNA, 16 bp, Homo sapiens
agcttcctgagggcta

SEQ ID NO: 227442 - DNA, 14 bp, Homo sapiens
agcttcggagggcc

SEQ ID NO: 227443 - DNA, 14 bp, Homo sapiens
agcttcgtgctgga

SEQ ID NO: 227444 - DNA, 21 bp, Homo sapiens
agcttctacagattttagaca

SEQ ID NO: 227445 - DNA, 14 bp, Homo sapiens
agcttctctgtgaa

SEQ ID NO: 227446 - DNA, 16 bp, Homo sapiens
agcttctgacctcagc

SEQ ID NO: 227447 - DNA, 18 bp, Homo sapiens
agcttctgacctcagcat

SEQ ID NO: 227448 - DNA, 14 bp, Homo sapiens
agcttctggtactc

SEQ ID NO: 227449 - DNA, 15 bp, Homo sapiens
agcttctggtactct

SEQ ID NO: 227450 - DNA, 21 bp, Homo sapiens
agcttctggtactctcctaga

SEQ ID NO: 227451 - DNA, 21 bp, Homo sapiens
agcttcttaatataactgcct

SEQ ID NO: 227452 - DNA, 11 bp, Homo sapiens
agcttgaatgt

SEQ ID NO: 227453 - DNA, 17 bp, Homo sapiens
agcttgatgctgtttct

SEQ ID NO: 227454 - DNA, 19 bp, Homo sapiens
agcttgcttcattgggctg

SEQ ID NO: 227455 - DNA, 12 bp, Homo sapiens
agcttggcagcc

SEQ ID NO: 227456 - DNA, 13 bp, Homo sapiens
agcttggcagccg

SEQ ID NO: 227457 - DNA, 15 bp, Homo sapiens
agcttggcagccgag

SEQ ID NO: 227458 - DNA, 21 bp, Homo sapiens
agcttggcagccgagctcgtg

SEQ ID NO: 227459 - DNA, 15 bp, Homo sapiens
agcttgggagagccc

SEQ ID NO: 227460 - DNA, 19 bp, Homo sapiens
agcttgggagagcccctgg

SEQ ID NO: 227461 - DNA, 10 bp, Homo sapiens
agcttgggcc

SEQ ID NO: 227462 - DNA, 16 bp, Homo sapiens
agcttgggcccagctg

SEQ ID NO: 227463 - DNA, 23 bp, Homo sapiens
agcttgggcccagctgggctctg

SEQ ID NO: 227464 - DNA, 21 bp, Homo sapiens
agcttggtgtcttggcactgt

SEQ ID NO: 227465 - DNA, 17 bp, Homo sapiens
agcttgtattatcagtg

SEQ ID NO: 227466 - DNA, 14 bp, Homo sapiens
agcttgtggcccct

SEQ ID NO: 227467 - DNA, 18 bp, Homo sapiens
agcttgtggcccctttta

SEQ ID NO: 227468 - DNA, 13 bp, Homo sapiens
agcttgtttccct

SEQ ID NO: 227469 - DNA, 16 bp, Homo sapiens
agcttgtttccctgct

SEQ ID NO: 227470 - DNA, 17 bp, Homo sapiens
agcttgtttctatactg

SEQ ID NO: 227471 - DNA, 17 bp, Homo sapiens
agcttgtttgttctagt

SEQ ID NO: 227472 - DNA, 16 bp, Homo sapiens
agctttaatcaatcat

SEQ ID NO: 227473 - DNA, 21 bp, Homo sapiens
agctttaatcaatcatgccct

SEQ ID NO: 227474 - DNA, 21 bp, Homo sapiens
agctttacatgcaatttatta

SEQ ID NO: 227475 - DNA, 17 bp, Homo sapiens
agctttaccctcaggca

SEQ ID NO: 227476 - DNA, 16 bp, Homo sapiens
agctttagcttctctg

SEQ ID NO: 227477 - DNA, 15 bp, Homo sapiens
agctttcagagccag

SEQ ID NO: 227478 - DNA, 20 bp, Homo sapiens
agctttccacatttgtcaca

SEQ ID NO: 227479 - DNA, 12 bp, Homo sapiens
agctttcctgcc

SEQ ID NO: 227480 - DNA, 20 bp, Homo sapiens
agctttcctgccccaggcct

SEQ ID NO: 227481 - DNA, 21 bp, Homo sapiens
agctttcctgccccaggcctg

SEQ ID NO: 227482 - DNA, 23 bp, Homo sapiens
agctttcctgccccaggcctgaa

SEQ ID NO: 227483 - DNA, 16 bp, Homo sapiens
agctttctcagggggt

SEQ ID NO: 227484 - DNA, 23 bp, Homo sapiens
agctttctcagggggtcagcaga

SEQ ID NO: 227485 - DNA, 15 bp, Homo sapiens
agctttctctgcttc

SEQ ID NO: 227486 - DNA, 16 bp, Homo sapiens
agctttctctgcttca

SEQ ID NO: 227487 - DNA, 15 bp, Homo sapiens
agctttcttctacaa

SEQ ID NO: 227488 - DNA, 20 bp, Homo sapiens
agctttcttctacaaccaga

SEQ ID NO: 227489 - DNA, 21 bp, Homo sapiens
agctttcttctacaaccagag

SEQ ID NO: 227490 - DNA, 22 bp, Homo sapiens
agctttctttttaaagcttttg

SEQ ID NO: 227491 - DNA, 16 bp, Homo sapiens
agctttgcagccaagg

SEQ ID NO: 227492 - DNA, 18 bp, Homo sapiens
agctttgcagccaaggtg

SEQ ID NO: 227493 - DNA, 20 bp, Homo sapiens
agctttgcagccaaggtgct

SEQ ID NO: 227494 - DNA, 20 bp, Homo sapiens
agctttggacacacacagct

SEQ ID NO: 227495 - DNA, 23 bp, Homo sapiens
agctttggacacacacagcttct

SEQ ID NO: 227496 - DNA, 19 bp, Homo sapiens
agctttgtttcaaccaagt

SEQ ID NO: 227497 - DNA, 12 bp, Homo sapiens
agcttttaaaaa

SEQ ID NO: 227498 - DNA, 18 bp, Homo sapiens
agcttttagtacccacct

SEQ ID NO: 227499 - DNA, 23 bp, Homo sapiens
agcttttagtacccacctgagct

SEQ ID NO: 227500 - DNA, 15 bp, Homo sapiens
agcttttattgtata

SEQ ID NO: 227501 - DNA, 17 bp, Homo sapiens
agcttttattgtataaa

SEQ ID NO: 227502 - DNA, 23 bp, Homo sapiens
agcttttcatggaagtggcagtg

SEQ ID NO: 227503 - DNA, 13 bp, Homo sapiens
agcttttcccttc

SEQ ID NO: 227504 - DNA, 15 bp, Homo sapiens
agcttttcctttctt

SEQ ID NO: 227505 - DNA, 19 bp, Homo sapiens
agcttttcttgccagctca

SEQ ID NO: 227506 - DNA, 16 bp, Homo sapiens
agcttttgttctagac

SEQ ID NO: 227507 - DNA, 13 bp, Homo sapiens
agcttttgttgtt

SEQ ID NO: 227508 - DNA, 18 bp, Homo sapiens
agcttttttacacaaatg

SEQ ID NO: 227509 - DNA, 21 bp, Homo sapiens
aggaaaaaaacttttataaat

SEQ ID NO: 227510 - DNA, 14 bp, Homo sapiens
aggaaaaacagagg

SEQ ID NO: 227511 - DNA, 21 bp, Homo sapiens
aggaaaaccaagccgtggctt

SEQ ID NO: 227512 - DNA, 22 bp, Homo sapiens
aggaaaaccaagccgtggcttc

SEQ ID NO: 227513 - DNA, 23 bp, Homo sapiens
aggaaaaccaagccgtggcttcc

SEQ ID NO: 227514 - DNA, 18 bp, Homo sapiens
aggaaaactcaccatttc

SEQ ID NO: 227515 - DNA, 16 bp, Homo sapiens
aggaaaagagtatcaa

SEQ ID NO: 227516 - DNA, 18 bp, Homo sapiens
aggaaaagattcaaagct

SEQ ID NO: 227517 - DNA, 16 bp, Homo sapiens
aggaaacagaaaagag

SEQ ID NO: 227518 - DNA, 18 bp, Homo sapiens
aggaaacagaaaagagaa

SEQ ID NO: 227519 - DNA, 22 bp, Homo sapiens
aggaaacagaaaagagaagaaa

SEQ ID NO: 227520 - DNA, 11 bp, Homo sapiens
aggaaaccaag

SEQ ID NO: 227521 - DNA, 17 bp, Homo sapiens
aggaaaccaccctgagg

SEQ ID NO: 227522 - DNA, 17 bp, Homo sapiens
aggaaactcacctgctg

SEQ ID NO: 227523 - DNA, 20 bp, Homo sapiens
aggaaactcacctgctggcc

SEQ ID NO: 227524 - DNA, 18 bp, Homo sapiens
aggaaactgaggcccaga

SEQ ID NO: 227525 - DNA, 12 bp, Homo sapiens
aggaaagaggct

SEQ ID NO: 227526 - DNA, 16 bp, Homo sapiens
aggaaagatcccaagt

SEQ ID NO: 227527 - DNA, 11 bp, Homo sapiens
aggaaagcacc

SEQ ID NO: 227528 - DNA, 14 bp, Homo sapiens
aggaaaggcagaaa

SEQ ID NO: 227529 - DNA, 19 bp, Homo sapiens
aggaaaggggcgagcaccc

SEQ ID NO: 227530 - DNA, 18 bp, Homo sapiens
aggaaagtagtccaggct

SEQ ID NO: 227531 - DNA, 12 bp, Homo sapiens
aggaaataacat

SEQ ID NO: 227532 - DNA, 14 bp, Homo sapiens
aggaaatccagccc

SEQ ID NO: 227533 - DNA, 22 bp, Homo sapiens
aggaaattaaataattttacat

SEQ ID NO: 227534 - DNA, 23 bp, Homo sapiens
aggaaattgagattagagggagg

SEQ ID NO: 227535 - DNA, 13 bp, Homo sapiens
aggaacaaggcaa

SEQ ID NO: 227536 - DNA, 19 bp, Homo sapiens
aggaacaaggcaaggctgt

SEQ ID NO: 227537 - DNA, 16 bp, Homo sapiens
aggaacacccagcccc

SEQ ID NO: 227538 - DNA, 19 bp, Homo sapiens
aggaacacccggaaagact

SEQ ID NO: 227539 - DNA, 20 bp, Homo sapiens
aggaacacgtgggtgagcgt

SEQ ID NO: 227540 - DNA, 16 bp, Homo sapiens
aggaacagagtatata

SEQ ID NO: 227541 - DNA, 21 bp, Homo sapiens
aggaacagctatgggagcccc

SEQ ID NO: 227542 - DNA, 15 bp, Homo sapiens
aggaacagtggctgg

SEQ ID NO: 227543 - DNA, 16 bp, Homo sapiens
aggaacagtggctggg

SEQ ID NO: 227544 - DNA, 18 bp, Homo sapiens
aggaacagtggctgggtg

SEQ ID NO: 227545 - DNA, 21 bp, Homo sapiens
aggaacccggtcccaggccgc

SEQ ID NO: 227546 - DNA, 13 bp, Homo sapiens
aggaacctggacc

SEQ ID NO: 227547 - DNA, 14 bp, Homo sapiens
aggaacgagcactg

SEQ ID NO: 227548 - DNA, 19 bp, Homo sapiens
aggaacgtggttcagagac

SEQ ID NO: 227549 - DNA, 17 bp, Homo sapiens
aggaactgaaaaccagt

SEQ ID NO: 227550 - DNA, 18 bp, Homo sapiens
aggaactgggcctgttgc

SEQ ID NO: 227551 - DNA, 21 bp, Homo sapiens
aggaactgggccttgtgtgct

SEQ ID NO: 227552 - DNA, 12 bp, Homo sapiens
aggaactggtcc

SEQ ID NO: 227553 - DNA, 13 bp, Homo sapiens
aggaactggtcca

SEQ ID NO: 227554 - DNA, 14 bp, Homo sapiens
aggaactggtccag

SEQ ID NO: 227555 - DNA, 20 bp, Homo sapiens
aggaactggtccaggccagg

SEQ ID NO: 227556 - DNA, 21 bp, Homo sapiens
aggaactggtccaggccaggc

SEQ ID NO: 227557 - DNA, 20 bp, Homo sapiens
aggaagaataaaaaagaaga

SEQ ID NO: 227558 - DNA, 19 bp, Homo sapiens
aggaagaccaaggcctcgg

SEQ ID NO: 227559 - DNA, 15 bp, Homo sapiens
aggaagactggagac

SEQ ID NO: 227560 - DNA, 22 bp, Homo sapiens
aggaagacttggcccaggaaaa

SEQ ID NO: 227561 - DNA, 14 bp, Homo sapiens
aggaagagaaacca

SEQ ID NO: 227562 - DNA, 13 bp, Homo sapiens
aggaagagagaga

SEQ ID NO: 227563 - DNA, 18 bp, Homo sapiens
tgcccatcatctctgcct

SEQ ID NO: 227564 - DNA, 21 bp, Homo sapiens
tgcccatcatctctgcctttg

SEQ ID NO: 227565 - DNA, 19 bp, Homo sapiens
tgcccatgggatatgtggt

SEQ ID NO: 227566 - DNA, 14 bp, Homo sapiens
tgccccaaacaaat

SEQ ID NO: 227567 - DNA, 17 bp, Homo sapiens
tgccccaagcagccagc

SEQ ID NO: 227568 - DNA, 18 bp, Homo sapiens
tgccccaagcagccagcc

SEQ ID NO: 227569 - DNA, 16 bp, Homo sapiens
tgccccacacaggcct

SEQ ID NO: 227570 - DNA, 23 bp, Homo sapiens
tgccccacacaggcctggcccag

SEQ ID NO: 227571 - DNA, 21 bp, Homo sapiens
tgccccacacggactcccggg

SEQ ID NO: 227572 - DNA, 14 bp, Homo sapiens
tgccccacccaccc

SEQ ID NO: 227573 - DNA, 17 bp, Homo sapiens
tgccccacccacccctc

SEQ ID NO: 227574 - DNA, 23 bp, Homo sapiens
tgccccacccctccatgattcca

SEQ ID NO: 227575 - DNA, 14 bp, Homo sapiens
tgccccacctgcca

SEQ ID NO: 227576 - DNA, 11 bp, Homo sapiens
tgccccagaga

SEQ ID NO: 227577 - DNA, 13 bp, Homo sapiens
tgccccagagccc

SEQ ID NO: 227578 - DNA, 17 bp, Homo sapiens
tgccccagagctgttta

SEQ ID NO: 227579 - DNA, 18 bp, Homo sapiens
tgccccagctgactgtgg

SEQ ID NO: 227580 - DNA, 14 bp, Homo sapiens
tgccccaggcctga

SEQ ID NO: 227581 - DNA, 19 bp, Homo sapiens
tgccccatgataaaataag

SEQ ID NO: 227582 - DNA, 16 bp, Homo sapiens
tgcccccactcagcat

SEQ ID NO: 227583 - DNA, 13 bp, Homo sapiens
tgcccccagaaag

SEQ ID NO: 227584 - DNA, 18 bp, Homo sapiens
tgcccccagaaagcctcc

SEQ ID NO: 227585 - DNA, 19 bp, Homo sapiens
tgcccccagaaagcctcct

SEQ ID NO: 227586 - DNA, 15 bp, Homo sapiens
tgcccccagacccca

SEQ ID NO: 227587 - DNA, 14 bp, Homo sapiens
tgcccccatccctc

SEQ ID NO: 227588 - DNA, 17 bp, Homo sapiens
tgcccccatctccccag

SEQ ID NO: 227589 - DNA, 19 bp, Homo sapiens
tgcccccatctccccaggc

SEQ ID NO: 227590 - DNA, 20 bp, Homo sapiens
tgcccccatctccccaggcc

SEQ ID NO: 227591 - DNA, 21 bp, Homo sapiens
tgcccccatctccccaggcct

SEQ ID NO: 227592 - DNA, 16 bp, Homo sapiens
tgccccccaccccagc

SEQ ID NO: 227593 - DNA, 17 bp, Homo sapiens
tgccccccaccccagcc

SEQ ID NO: 227594 - DNA, 20 bp, Homo sapiens
tgccccccaccccagcctaa

SEQ ID NO: 227595 - DNA, 11 bp, Homo sapiens
tgccccccttc

SEQ ID NO: 227596 - DNA, 13 bp, Homo sapiens
tgccccccttccc

SEQ ID NO: 227597 - DNA, 12 bp, Homo sapiens
tgccccctcagg

SEQ ID NO: 227598 - DNA, 11 bp, Homo sapiens
tgccccctccc

SEQ ID NO: 227599 - DNA, 17 bp, Homo sapiens
tgccccctcccccgcag

SEQ ID NO: 227600 - DNA, 13 bp, Homo sapiens
tgcccccttctcc

SEQ ID NO: 227601 - DNA, 15 bp, Homo sapiens
tgcccccttctccca

SEQ ID NO: 227602 - DNA, 17 bp, Homo sapiens
tgcccccttctcccaca

SEQ ID NO: 227603 - DNA, 20 bp, Homo sapiens
tgcccccttctcccacactg

SEQ ID NO: 227604 - DNA, 22 bp, Homo sapiens
tgcccccttctcccacactgct

SEQ ID NO: 227605 - DNA, 18 bp, Homo sapiens
tgccccctttcagatgtc

SEQ ID NO: 227606 - DNA, 21 bp, Homo sapiens
tgccccctttcagatgtcttc

SEQ ID NO: 227607 - DNA, 23 bp, Homo sapiens
tgccccctttcagatgtcttctg

SEQ ID NO: 227608 - DNA, 17 bp, Homo sapiens
tgccccgccccccagag

SEQ ID NO: 227609 - DNA, 23 bp, Homo sapiens
tgccccgccccccagagccaggg

SEQ ID NO: 227610 - DNA, 14 bp, Homo sapiens
tgccccggaggaag

SEQ ID NO: 227611 - DNA, 17 bp, Homo sapiens
tgccccgtcaccatctc

SEQ ID NO: 227612 - DNA, 19 bp, Homo sapiens
tgccccgtcaccatctcag

SEQ ID NO: 227613 - DNA, 15 bp, Homo sapiens
tgccccgtcccctgg

SEQ ID NO: 227614 - DNA, 21 bp, Homo sapiens
tgccccgtcccctgggccacc

SEQ ID NO: 227615 - DNA, 18 bp, Homo sapiens
tgccccgttccctgtcag

SEQ ID NO: 227616 - DNA, 16 bp, Homo sapiens
tgcccctcccatggcc

SEQ ID NO: 227617 - DNA, 19 bp, Homo sapiens
tgcccctcccatggcccag

SEQ ID NO: 227618 - DNA, 21 bp, Homo sapiens
tgcccctcccatggcccagca

SEQ ID NO: 227619 - DNA, 14 bp, Homo sapiens
tgcccctccccagt

SEQ ID NO: 227620 - DNA, 21 bp, Homo sapiens
tgcccctcccccaacccccac

SEQ ID NO: 227621 - DNA, 12 bp, Homo sapiens
tgcccctgcagg

SEQ ID NO: 227622 - DNA, 18 bp, Homo sapiens
tgcccctgcccctgcccg

SEQ ID NO: 227623 - DNA, 16 bp, Homo sapiens
tgcccctgcccgagag

SEQ ID NO: 227624 - DNA, 15 bp, Homo sapiens
tgcccctgccgcctg

SEQ ID NO: 227625 - DNA, 16 bp, Homo sapiens
tgcccctgctgcctcc

SEQ ID NO: 227626 - DNA, 13 bp, Homo sapiens
tgcccctggccca

SEQ ID NO: 227627 - DNA, 17 bp, Homo sapiens
tgcccctggcccatctc

SEQ ID NO: 227628 - DNA, 17 bp, Homo sapiens
tgcccctgtaggttgct

SEQ ID NO: 227629 - DNA, 17 bp, Homo sapiens
tgcccctgtctggaaga

SEQ ID NO: 227630 - DNA, 14 bp, Homo sapiens
tgccccttctacac

SEQ ID NO: 227631 - DNA, 18 bp, Homo sapiens
tgccccttctacactctc

SEQ ID NO: 227632 - DNA, 23 bp, Homo sapiens
tgccccttctacactctcctggg

SEQ ID NO: 227633 - DNA, 18 bp, Homo sapiens
tgccccttgaccccacac

SEQ ID NO: 227634 - DNA, 18 bp, Homo sapiens
tgccccttgggcatccac

SEQ ID NO: 227635 - DNA, 15 bp, Homo sapiens
tgcccgcacagcagc

SEQ ID NO: 227636 - DNA, 14 bp, Homo sapiens
tgcccgccagccag

SEQ ID NO: 227637 - DNA, 16 bp, Homo sapiens
tgcccgccagccagtg

SEQ ID NO: 227638 - DNA, 17 bp, Homo sapiens
tgcccgccagccagtgg

SEQ ID NO: 227639 - DNA, 13 bp, Homo sapiens
tgcccgccagcct

SEQ ID NO: 227640 - DNA, 14 bp, Homo sapiens
tgcccgccagcctc

SEQ ID NO: 227641 - DNA, 19 bp, Homo sapiens
tgcccgctcccacagcttc

SEQ ID NO: 227642 - DNA, 18 bp, Homo sapiens
tgcccgctgtcccagggg

SEQ ID NO: 227643 - DNA, 22 bp, Homo sapiens
tgcccggctaatttttttgtat

SEQ ID NO: 227644 - DNA, 20 bp, Homo sapiens
tgcccggtggtttgccatgt

SEQ ID NO: 227645 - DNA, 23 bp, Homo sapiens
tgcccgtgtcggttcttcctgga

SEQ ID NO: 227646 - DNA, 19 bp, Homo sapiens
tgccctaagagtgtcactg

SEQ ID NO: 227647 - DNA, 21 bp, Homo sapiens
tgccctataacccctgcctgg

SEQ ID NO: 227648 - DNA, 22 bp, Homo sapiens
tgccctataacccctgcctgga

SEQ ID NO: 227649 - DNA, 19 bp, Homo sapiens
tgccctcaaaatctttaga

SEQ ID NO: 227650 - DNA, 19 bp, Homo sapiens
tgccctcactccactcccc

SEQ ID NO: 227651 - DNA, 18 bp, Homo sapiens
tgccctcagatggagaca

SEQ ID NO: 227652 - DNA, 12 bp, Homo sapiens
tgccctcagggg

SEQ ID NO: 227653 - DNA, 14 bp, Homo sapiens
tgccctccactgcc

SEQ ID NO: 227654 - DNA, 18 bp, Homo sapiens
tgccctccactgccctct

SEQ ID NO: 227655 - DNA, 17 bp, Homo sapiens
tgccctccatcccgaca

SEQ ID NO: 227656 - DNA, 22 bp, Homo sapiens
tgccctcccatgttgcatgcct

SEQ ID NO: 227657 - DNA, 15 bp, Homo sapiens
tgccctcccccacgg

SEQ ID NO: 227658 - DNA, 17 bp, Homo sapiens
tgccctcccccacggcc

SEQ ID NO: 227659 - DNA, 15 bp, Homo sapiens
tgccctccctccttc

SEQ ID NO: 227660 - DNA, 16 bp, Homo sapiens
tgccctccctccttcc

SEQ ID NO: 227661 - DNA, 18 bp, Homo sapiens
tgccctccgtcctggcag

SEQ ID NO: 227662 - DNA, 14 bp, Homo sapiens
tgccctctccacac

SEQ ID NO: 227663 - DNA, 15 bp, Homo sapiens
tgccctctccacacc

SEQ ID NO: 227664 - DNA, 18 bp, Homo sapiens
tgccctctccacacccat

SEQ ID NO: 227665 - DNA, 24 bp, Homo sapiens
tgccctctccacacccatgactgc

SEQ ID NO: 227666 - DNA, 14 bp, Homo sapiens
tgccctgaggaagg

SEQ ID NO: 227667 - DNA, 18 bp, Homo sapiens
tgccctgcaccttgggca

SEQ ID NO: 227668 - DNA, 19 bp, Homo sapiens
tgccctgccaagcctggag

SEQ ID NO: 227669 - DNA, 16 bp, Homo sapiens
tgccctgccacctgtc

SEQ ID NO: 227670 - DNA, 19 bp, Homo sapiens
tgccctgccacctgtctgt

SEQ ID NO: 227671 - DNA, 22 bp, Homo sapiens
tgccctgccacctgtctgtctg

SEQ ID NO: 227672 - DNA, 15 bp, Homo sapiens
tgccctgccaggctg

SEQ ID NO: 227673 - DNA, 20 bp, Homo sapiens
tgccctgccaggctgtcagc

SEQ ID NO: 227674 - DNA, 13 bp, Homo sapiens
tgccctgccccca

SEQ ID NO: 227675 - DNA, 13 bp, Homo sapiens
tgccctgcctccc

SEQ ID NO: 227676 - DNA, 14 bp, Homo sapiens
tgccctgcctccct

SEQ ID NO: 227677 - DNA, 17 bp, Homo sapiens
tgccctgcctgagggcc

SEQ ID NO: 227678 - DNA, 16 bp, Homo sapiens
tgccctgcctgcccac

SEQ ID NO: 227679 - DNA, 18 bp, Homo sapiens
tgccctgcctgcccactt

SEQ ID NO: 227680 - DNA, 23 bp, Homo sapiens
tgccctgctgccgcctcccagcc

SEQ ID NO: 227681 - DNA, 13 bp, Homo sapiens
tgccctgggccag

SEQ ID NO: 227682 - DNA, 12 bp, Homo sapiens
tgccctggtgct

SEQ ID NO: 227683 - DNA, 12 bp, Homo sapiens
tgccctgtccct

SEQ ID NO: 227684 - DNA, 14 bp, Homo sapiens
tgccctgtgggaga

SEQ ID NO: 227685 - DNA, 16 bp, Homo sapiens
tgccctgttcaaagta

SEQ ID NO: 227686 - DNA, 17 bp, Homo sapiens
tgccctgttcaaagtac

SEQ ID NO: 227687 - DNA, 21 bp, Homo sapiens
tgcccttaaaataatgattta

SEQ ID NO: 227688 - DNA, 15 bp, Homo sapiens
tgcccttaaatcata

SEQ ID NO: 227689 - DNA, 15 bp, Homo sapiens
tgcccttcactgttg

SEQ ID NO: 227690 - DNA, 22 bp, Homo sapiens
tgcccttcaggacccttctact

SEQ ID NO: 227691 - DNA, 17 bp, Homo sapiens
tgcccttttaaatggca

SEQ ID NO: 227692 - DNA, 23 bp, Homo sapiens
tgcccttttcctgggccttctca

SEQ ID NO: 227693 - DNA, 22 bp, Homo sapiens
tgccgaatgtgcaggtttgtta

SEQ ID NO: 227694 - DNA, 23 bp, Homo sapiens
tgccgaccgcctgcttcacaccc

SEQ ID NO: 227695 - DNA, 21 bp, Homo sapiens
tgccgcatgacaactgaaggc

SEQ ID NO: 227696 - DNA, 18 bp, Homo sapiens
tgccgccgtctctgtccc

SEQ ID NO: 227697 - DNA, 22 bp, Homo sapiens
tgcctgggctcccttgtgcgtg

SEQ ID NO: 227698 - DNA, 16 bp, Homo sapiens
tgcctgggcttatgcc

SEQ ID NO: 227699 - DNA, 15 bp, Homo sapiens
tgcctgtaacttgag

SEQ ID NO: 227700 - DNA, 15 bp, Homo sapiens
tgcctgtagagccag

SEQ ID NO: 227701 - DNA, 16 bp, Homo sapiens
tgcctgtagttaggaa

SEQ ID NO: 227702 - DNA, 22 bp, Homo sapiens
tgcctgtagttaggaaataaaa

SEQ ID NO: 227703 - DNA, 20 bp, Homo sapiens
tgcctgtcagtttcatggag

SEQ ID NO: 227704 - DNA, 15 bp, Homo sapiens
tgcctgtccagcctg

SEQ ID NO: 227705 - DNA, 18 bp, Homo sapiens
tgcctgtccagcctgggc

SEQ ID NO: 227706 - DNA, 19 bp, Homo sapiens
tgcctgtccagcctgggca

SEQ ID NO: 227707 - DNA, 15 bp, Homo sapiens
tgcctgtctggagct

SEQ ID NO: 227708 - DNA, 18 bp, Homo sapiens
tgcctgtctgtctctcca

SEQ ID NO: 227709 - DNA, 21 bp, Homo sapiens
tgcctgtctgtctctccatct

SEQ ID NO: 227710 - DNA, 23 bp, Homo sapiens
tgcctgtgcatgacctgatcatt

SEQ ID NO: 227711 - DNA, 14 bp, Homo sapiens
tgcctgtgccaata

SEQ ID NO: 227712 - DNA, 14 bp, Homo sapiens
tgcctgtgccaccc

SEQ ID NO: 227713 - DNA, 12 bp, Homo sapiens
tgcctgtgtgct

SEQ ID NO: 227714 - DNA, 22 bp, Homo sapiens
tgcctgtgtttgtgtggatacc

SEQ ID NO: 227715 - DNA, 17 bp, Homo sapiens
tgcctgttaagtctgag

SEQ ID NO: 227716 - DNA, 21 bp, Homo sapiens
tgccttaattcttacctcatt

SEQ ID NO: 227717 - DNA, 17 bp, Homo sapiens
tgccttaggaagtgact

SEQ ID NO: 227718 - DNA, 14 bp, Homo sapiens
tgccttatcttgca

SEQ ID NO: 227719 - DNA, 14 bp, Homo sapiens
tgccttcagggaga

SEQ ID NO: 227720 - DNA, 21 bp, Homo sapiens
tgccttcagtatcaaggctgc

SEQ ID NO: 227721 - DNA, 21 bp, Homo sapiens
tgccttcataaattatttcta

SEQ ID NO: 227722 - DNA, 21 bp, Homo sapiens
tgccttccataattatgacag

SEQ ID NO: 227723 - DNA, 12 bp, Homo sapiens
tgccttcccctt

SEQ ID NO: 227724 - DNA, 22 bp, Homo sapiens
tgccttcgttaactgtgtatgt

SEQ ID NO: 227725 - DNA, 16 bp, Homo sapiens
tgccttctacttttaa

SEQ ID NO: 227726 - DNA, 19 bp, Homo sapiens
tgccttctcctctctgggc

SEQ ID NO: 227727 - DNA, 18 bp, Homo sapiens
tgccttctcttctatcct

SEQ ID NO: 227728 - DNA, 19 bp, Homo sapiens
tgccttctgacggccctgc

SEQ ID NO: 227729 - DNA, 22 bp, Homo sapiens
tgccttctgacggccctgcaat

SEQ ID NO: 227730 - DNA, 13 bp, Homo sapiens
tgccttctgggca

SEQ ID NO: 227731 - DNA, 14 bp, Homo sapiens
tgccttgagctgcc

SEQ ID NO: 227732 - DNA, 21 bp, Homo sapiens
tgccttgatgttgtgttgtta

SEQ ID NO: 227733 - DNA, 17 bp, Homo sapiens
tgccttgctgcacctga

SEQ ID NO: 227734 - DNA, 18 bp, Homo sapiens
tgccttgctgcacctgag

SEQ ID NO: 227735 - DNA, 16 bp, Homo sapiens
tgccttgggctgctcc

SEQ ID NO: 227736 - DNA, 19 bp, Homo sapiens
tgccttgggctgctcctca

SEQ ID NO: 227737 - DNA, 13 bp, Homo sapiens
tgccttgtccctc

SEQ ID NO: 227738 - DNA, 23 bp, Homo sapiens
tgccttgttgtattcctgccttt

SEQ ID NO: 227739 - DNA, 18 bp, Homo sapiens
tgcctttaaatctgtgat

SEQ ID NO: 227740 - DNA, 21 bp, Homo sapiens
tgcctttagcgtgtaaatgga

SEQ ID NO: 227741 - DNA, 15 bp, Homo sapiens
tgcctttaggcagga

SEQ ID NO: 227742 - DNA, 17 bp, Homo sapiens
tgcctttaggcaggaag

SEQ ID NO: 227743 - DNA, 18 bp, Homo sapiens
tgcctttaggcaggaagt

SEQ ID NO: 227744 - DNA, 19 bp, Homo sapiens
tgcctttatctctgaggct

SEQ ID NO: 227745 - DNA, 15 bp, Homo sapiens
tgcctttctagcaat

SEQ ID NO: 227746 - DNA, 13 bp, Homo sapiens
tgcctttctagtc

SEQ ID NO: 227747 - DNA, 23 bp, Homo sapiens
tgcctttctcgtggtagaagcca

SEQ ID NO: 227748 - DNA, 13 bp, Homo sapiens
tgcctttcttcca

SEQ ID NO: 227749 - DNA, 23 bp, Homo sapiens
tgcctttgggtcgacatagtatg

SEQ ID NO: 227750 - DNA, 9 bp, Homo sapiens
tgcctttgt

SEQ ID NO: 227751 - DNA, 10 bp, Homo sapiens
tgcctttgtt

SEQ ID NO: 227752 - DNA, 22 bp, Homo sapiens
tgcctttgtttcggtgccctgt

SEQ ID NO: 227753 - DNA, 22 bp, Homo sapiens
tgccttttatagctattactgt

SEQ ID NO: 227754 - DNA, 15 bp, Homo sapiens
tgccttttccctctg

SEQ ID NO: 227755 - DNA, 20 bp, Homo sapiens
tgcctttttccttatttcaa

SEQ ID NO: 227756 - DNA, 14 bp, Homo sapiens
tgcgaaacccagcg

SEQ ID NO: 227757 - DNA, 22 bp, Homo sapiens
tgcgaaacccagcgttcttcag

SEQ ID NO: 227758 - DNA, 18 bp, Homo sapiens
tgcgaactctcaggacta

SEQ ID NO: 227759 - DNA, 13 bp, Homo sapiens
tgcgaactgtgca

SEQ ID NO: 227760 - DNA, 20 bp, Homo sapiens
tgcgaccagaggtgggaggc

SEQ ID NO: 227761 - DNA, 12 bp, Homo sapiens
tgcgatgtgttt

SEQ ID NO: 227762 - DNA, 16 bp, Homo sapiens
tgcgattttatctgtt

SEQ ID NO: 227763 - DNA, 21 bp, Homo sapiens
tgcgcaaactttaacaggttt

SEQ ID NO: 227764 - DNA, 21 bp, Homo sapiens
tgcgcaaagagtgtgctcggg

SEQ ID NO: 227765 - DNA, 16 bp, Homo sapiens
tgcgcagaaaacaaga

SEQ ID NO: 227766 - DNA, 19 bp, Homo sapiens
tgcgcagccgcgctctgcc

SEQ ID NO: 227767 - DNA, 20 bp, Homo sapiens
tgcgcagccgcgctctgccc

SEQ ID NO: 227768 - DNA, 22 bp, Homo sapiens
tgcgcagccgcgctctgcccct

SEQ ID NO: 227769 - DNA, 20 bp, Homo sapiens
tgcgcccgggcaagaccttt

SEQ ID NO: 227770 - DNA, 19 bp, Homo sapiens
tgcgccctccctccctcca

SEQ ID NO: 227771 - DNA, 20 bp, Homo sapiens
tgcgccctccctccctccac

SEQ ID NO: 227772 - DNA, 15 bp, Homo sapiens
tgcgcccttaccttc

SEQ ID NO: 227773 - DNA, 20 bp, Homo sapiens
tgcgccgagaccgcagaggg

SEQ ID NO: 227774 - DNA, 12 bp, Homo sapiens
tgcgcctgcccg

SEQ ID NO: 227775 - DNA, 17 bp, Homo sapiens
tgcgcctgcccgcccgc

SEQ ID NO: 227776 - DNA, 13 bp, Homo sapiens
tgcgcctggctct

SEQ ID NO: 227777 - DNA, 23 bp, Homo sapiens
tgcgcgtgcacgtggagagctgg

SEQ ID NO: 227778 - DNA, 18 bp, Homo sapiens
tgcgcgttctgaaatatt

SEQ ID NO: 227779 - DNA, 13 bp, Homo sapiens
tgcgctcctctgc

SEQ ID NO: 227780 - DNA, 17 bp, Homo sapiens
tgcgctcctctgcagcc

SEQ ID NO: 227781 - DNA, 20 bp, Homo sapiens
tgcgctcctctgcagcctga

SEQ ID NO: 227782 - DNA, 15 bp, Homo sapiens
tgcgctcttcaccag

SEQ ID NO: 227783 - DNA, 19 bp, Homo sapiens
tgcgctcttcaccaggaag

SEQ ID NO: 227784 - DNA, 20 bp, Homo sapiens
tgcgctcttcaccaggaaga

SEQ ID NO: 227785 - DNA, 21 bp, Homo sapiens
tgcgctcttggtccctggtcc

SEQ ID NO: 227786 - DNA, 23 bp, Homo sapiens
tgcgctgacaaccaccgctcccc

SEQ ID NO: 227787 - DNA, 18 bp, Homo sapiens
tgcgctgtgctccagcag

SEQ ID NO: 227788 - DNA, 17 bp, Homo sapiens
tgcgctttattgcccat

SEQ ID NO: 227789 - DNA, 18 bp, Homo sapiens
tgcgctttattgcccatg

SEQ ID NO: 227790 - DNA, 15 bp, Homo sapiens
tgcggacaagtttta

SEQ ID NO: 227791 - DNA, 18 bp, Homo sapiens
tgcggaccggagcggctg

SEQ ID NO: 227792 - DNA, 19 bp, Homo sapiens
tgcggaccggagcggctga

SEQ ID NO: 227793 - DNA, 15 bp, Homo sapiens
tgcggactccatggc

SEQ ID NO: 227794 - DNA, 16 bp, Homo sapiens
tgcggactccatggcc

SEQ ID NO: 227795 - DNA, 13 bp, Homo sapiens
tgcggcaccgccc

SEQ ID NO: 227796 - DNA, 15 bp, Homo sapiens
tgcggcaccgcccac

SEQ ID NO: 227797 - DNA, 18 bp, Homo sapiens
tgcggcaccgcccaccca

SEQ ID NO: 227798 - DNA, 19 bp, Homo sapiens
tgcggcaccgcccacccac

SEQ ID NO: 227799 - DNA, 20 bp, Homo sapiens
tgcggcaccgcccacccaca

SEQ ID NO: 227800 - DNA, 14 bp, Homo sapiens
tgcggcccagccat

SEQ ID NO: 227801 - DNA, 18 bp, Homo sapiens
tgcggcccgtgcgcagcc

SEQ ID NO: 227802 - DNA, 15 bp, Homo sapiens
tgcggccggcctggg

SEQ ID NO: 227803 - DNA, 16 bp, Homo sapiens
tgcggctgctggcaca

SEQ ID NO: 227804 - DNA, 19 bp, Homo sapiens
tgcggctgctggcacagac

SEQ ID NO: 227805 - DNA, 19 bp, Homo sapiens
tgcggcttccgagggcact

SEQ ID NO: 227806 - DNA, 23 bp, Homo sapiens
tgcgggcattttgaatgtgatca

SEQ ID NO: 227807 - DNA, 13 bp, Homo sapiens
tgcgggctgggca

SEQ ID NO: 227808 - DNA, 15 bp, Homo sapiens
tgcgggtctgaagga

SEQ ID NO: 227809 - DNA, 13 bp, Homo sapiens
tgcggtaggtgct

SEQ ID NO: 227810 - DNA, 16 bp, Homo sapiens
tgcggtaggtgctggc

SEQ ID NO: 227811 - DNA, 19 bp, Homo sapiens
tgcggtaggtgctggcctc

SEQ ID NO: 227812 - DNA, 15 bp, Homo sapiens
tgcggtgaggcaggg

SEQ ID NO: 227813 - DNA, 14 bp, Homo sapiens
tgcgtcatggctca

SEQ ID NO: 227814 - DNA, 18 bp, Homo sapiens
tgcgtcctgacgccctgc

SEQ ID NO: 227815 - DNA, 14 bp, Homo sapiens
tgcgtcctgcagag

SEQ ID NO: 227816 - DNA, 22 bp, Homo sapiens
tgcgtctctgtcgtggacacgc

SEQ ID NO: 227817 - DNA, 17 bp, Homo sapiens
tgcgtgaccggcccgcc

SEQ ID NO: 227818 - DNA, 22 bp, Homo sapiens
tgcgtgccctgacccctgcacc

SEQ ID NO: 227819 - DNA, 12 bp, Homo sapiens
tgcgtgctggga

SEQ ID NO: 227820 - DNA, 22 bp, Homo sapiens
tgcgtggcacatctaaattgat

SEQ ID NO: 227821 - DNA, 16 bp, Homo sapiens
tgcgtggctgtggcac

SEQ ID NO: 227822 - DNA, 21 bp, Homo sapiens
tgcgtggctgtggcacagact

SEQ ID NO: 227823 - DNA, 23 bp, Homo sapiens
tgcgtggtgtggagtgtgtgtct

SEQ ID NO: 227824 - DNA, 16 bp, Homo sapiens
tgcgtgtctctgccat

SEQ ID NO: 227825 - DNA, 16 bp, Homo sapiens
tgcgtgtctgtttcct

SEQ ID NO: 227826 - DNA, 18 bp, Homo sapiens
tgcgtgtgcgtgcatgtg

SEQ ID NO: 227827 - DNA, 17 bp, Homo sapiens
tgcgtgtggccctgtgg

SEQ ID NO: 227828 - DNA, 20 bp, Homo sapiens
tgcgtgtggccctgtgggag

SEQ ID NO: 227829 - DNA, 21 bp, Homo sapiens
tgcgtgtggccctgtgggagt

SEQ ID NO: 227830 - DNA, 17 bp, Homo sapiens
tgcgtgtgtccatgtgt

SEQ ID NO: 227831 - DNA, 19 bp, Homo sapiens
tgcgttggagccactcctg

SEQ ID NO: 227832 - DNA, 14 bp, Homo sapiens
tgctaaaaggaata

SEQ ID NO: 227833 - DNA, 19 bp, Homo sapiens
tgctaaatgacttattgat

SEQ ID NO: 227834 - DNA, 14 bp, Homo sapiens
tgctaaatttacgt

SEQ ID NO: 227835 - DNA, 15 bp, Homo sapiens
tgctaaattttcagt

SEQ ID NO: 227836 - DNA, 23 bp, Homo sapiens
tgctaaccacgtctgtcttcaca

SEQ ID NO: 227837 - DNA, 19 bp, Homo sapiens
tgctaactgtatgtgtctt

SEQ ID NO: 227838 - DNA, 13 bp, Homo sapiens
tgctaactttgcc

SEQ ID NO: 227839 - DNA, 16 bp, Homo sapiens
tgctaaggctcctcct

SEQ ID NO: 227840 - DNA, 18 bp, Homo sapiens
tgctaagtgttgactttt

SEQ ID NO: 227841 - DNA, 15 bp, Homo sapiens
tgctaataaactgtt

SEQ ID NO: 227842 - DNA, 13 bp, Homo sapiens
tgctaataaatga

SEQ ID NO: 227843 - DNA, 16 bp, Homo sapiens
tgctaataaatgacca

SEQ ID NO: 227844 - DNA, 22 bp, Homo sapiens
tgctaataaatgaccagtttac

SEQ ID NO: 227845 - DNA, 23 bp, Homo sapiens
tgctaatcagggaggtcattttg

SEQ ID NO: 227846 - DNA, 20 bp, Homo sapiens
tgctaatcgggttgtcactc

SEQ ID NO: 227847 - DNA, 13 bp, Homo sapiens
tgctaatgaattt

SEQ ID NO: 227848 - DNA, 18 bp, Homo sapiens
tgctaatgtaatcattta

SEQ ID NO: 227849 - DNA, 21 bp, Homo sapiens
tgctaatgtaatcatttatct

SEQ ID NO: 227850 - DNA, 16 bp, Homo sapiens
tgctaatttctgtcca

SEQ ID NO: 227851 - DNA, 21 bp, Homo sapiens
tgctaatttctgtccagaaaa

SEQ ID NO: 227852 - DNA, 16 bp, Homo sapiens
tgctacaaaatgtgtg

SEQ ID NO: 227853 - DNA, 11 bp, Homo sapiens
tgctacacttc

SEQ ID NO: 227854 - DNA, 13 bp, Homo sapiens
tgctacacttctg

SEQ ID NO: 227855 - DNA, 19 bp, Homo sapiens
tgctacccagaaccttttt

SEQ ID NO: 227856 - DNA, 24 bp, Homo sapiens
tgctacccagcatgctacctgaat

SEQ ID NO: 227857 - DNA, 17 bp, Homo sapiens
tgctaccgccctgggct

SEQ ID NO: 227858 - DNA, 23 bp, Homo sapiens
tgctaccgccctgggctggactg

SEQ ID NO: 227859 - DNA, 13 bp, Homo sapiens
tgctacctctaac

SEQ ID NO: 227860 - DNA, 15 bp, Homo sapiens
tgctacctgtgagca

SEQ ID NO: 227861 - DNA, 22 bp, Homo sapiens
tgctacggtagtgatgaaatta

SEQ ID NO: 227862 - DNA, 21 bp, Homo sapiens
tgctactacccgagcccagct

SEQ ID NO: 227863 - DNA, 18 bp, Homo sapiens
tgctactggacttgaatg

SEQ ID NO: 227864 - DNA, 14 bp, Homo sapiens
tgctactgtcagtg

SEQ ID NO: 227865 - DNA, 15 bp, Homo sapiens
tgctactgtcagtgt

SEQ ID NO: 227866 - DNA, 19 bp, Homo sapiens
tgctactgtcagtgtcctc

SEQ ID NO: 227867 - DNA, 19 bp, Homo sapiens
tgctacttaattcctttct

SEQ ID NO: 227868 - DNA, 22 bp, Homo sapiens
tgctacttaattcctttctcat

SEQ ID NO: 227869 - DNA, 19 bp, Homo sapiens
tgctagacaaggttgctgt

SEQ ID NO: 227870 - DNA, 20 bp, Homo sapiens
tgctagacaaggttgctgtt

SEQ ID NO: 227871 - DNA, 19 bp, Homo sapiens
tgctagatgtgcaaatgca

SEQ ID NO: 227872 - DNA, 20 bp, Homo sapiens
tgctagcaaatggcagaacc

SEQ ID NO: 227873 - DNA, 19 bp, Homo sapiens
tgctagccctggggtggcg

SEQ ID NO: 227874 - DNA, 18 bp, Homo sapiens
tgctagctatgtgacctt

SEQ ID NO: 227875 - DNA, 13 bp, Homo sapiens
tgctagctgtaga

SEQ ID NO: 227876 - DNA, 15 bp, Homo sapiens
tgctagggtgcctgc

SEQ ID NO: 227877 - DNA, 15 bp, Homo sapiens
tgctaggtataaaaa

SEQ ID NO: 227878 - DNA, 21 bp, Homo sapiens
tgctaggtataaaaaataagt

SEQ ID NO: 227879 - DNA, 22 bp, Homo sapiens
tgctaggtataaaaaataagta

SEQ ID NO: 227880 - DNA, 21 bp, Homo sapiens
tgctaggtgggccagcccctc

SEQ ID NO: 227881 - DNA, 13 bp, Homo sapiens
tgctagtacctgt

SEQ ID NO: 227882 - DNA, 19 bp, Homo sapiens
tgctagtgagctgggcatg

SEQ ID NO: 227883 - DNA, 13 bp, Homo sapiens
tgctagtgataca

SEQ ID NO: 227884 - DNA, 22 bp, Homo sapiens
tgctagtgggccctctctctgg

SEQ ID NO: 227885 - DNA, 15 bp, Homo sapiens
tgctatataaataaa

SEQ ID NO: 227886 - DNA, 18 bp, Homo sapiens
tgctatattttcatgact

SEQ ID NO: 227887 - DNA, 22 bp, Homo sapiens
tgctatattttcatgacttttc

SEQ ID NO: 227888 - DNA, 16 bp, Homo sapiens
tgctatcatatattat

SEQ ID NO: 227889 - DNA, 21 bp, Homo sapiens
tgctatcatatattataagat

SEQ ID NO: 227890 - DNA, 12 bp, Homo sapiens
tgctatccagcc

SEQ ID NO: 227891 - DNA, 13 bp, Homo sapiens
tgctatccagccg

SEQ ID NO: 227892 - DNA, 22 bp, Homo sapiens
tgctatcgcaccactgtgtatt

SEQ ID NO: 227893 - DNA, 12 bp, Homo sapiens
tgctatgaaaat

SEQ ID NO: 227894 - DNA, 17 bp, Homo sapiens
tgctatgaaaatgagca

SEQ ID NO: 227895 - DNA, 18 bp, Homo sapiens
tgctatgctgttcattga

SEQ ID NO: 227896 - DNA, 17 bp, Homo sapiens
tgctatgtctgtgatgt

SEQ ID NO: 227897 - DNA, 16 bp, Homo sapiens
tgctattgacaagtca

SEQ ID NO: 227898 - DNA, 18 bp, Homo sapiens
tgctattgttgtgggctt

SEQ ID NO: 227899 - DNA, 15 bp, Homo sapiens
tgctcaaaaatctgt

SEQ ID NO: 227900 - DNA, 16 bp, Homo sapiens
tgctcaaagatgtact

SEQ ID NO: 227901 - DNA, 17 bp, Homo sapiens
tgctcaaagatgtactg

SEQ ID NO: 227902 - DNA, 21 bp, Homo sapiens
tgctcaaagatgtactgagag

SEQ ID NO: 227903 - DNA, 21 bp, Homo sapiens
tgctcaaatctattcagacaa

SEQ ID NO: 227904 - DNA, 15 bp, Homo sapiens
tgctcaacccccctc

SEQ ID NO: 227905 - DNA, 18 bp, Homo sapiens
tgctcaacccccctccca

SEQ ID NO: 227906 - DNA, 22 bp, Homo sapiens
tgctcaacccccctcccagaca

SEQ ID NO: 227907 - DNA, 22 bp, Homo sapiens
tgctcaagaagacatggagact

SEQ ID NO: 227908 - DNA, 19 bp, Homo sapiens
tgctcaatgtgctgttgat

SEQ ID NO: 227909 - DNA, 18 bp, Homo sapiens
tgctcacattccctctca

SEQ ID NO: 227910 - DNA, 19 bp, Homo sapiens
tgctcacccattgtctcat

SEQ ID NO: 227911 - DNA, 20 bp, Homo sapiens
tgctcacccattgtctcatt

SEQ ID NO: 227912 - DNA, 18 bp, Homo sapiens
tgctcacgactcttcctg

SEQ ID NO: 227913 - DNA, 19 bp, Homo sapiens
tgctcacgactcttcctgc

SEQ ID NO: 227914 - DNA, 20 bp, Homo sapiens
tgctcacgactcttcctgca

SEQ ID NO: 227915 - DNA, 21 bp, Homo sapiens
tgctcacgactcttcctgcaa

SEQ ID NO: 227916 - DNA, 23 bp, Homo sapiens
tgctcacgactcttcctgcaaag

SEQ ID NO: 227917 - DNA, 21 bp, Homo sapiens
tgctcactccctaaagccctc

SEQ ID NO: 227918 - DNA, 22 bp, Homo sapiens
tgctcactccctaaagccctct

SEQ ID NO: 227919 - DNA, 20 bp, Homo sapiens
tgctcagaaatgttggttac

SEQ ID NO: 227920 - DNA, 16 bp, Homo sapiens
tgctcagaatgccgca

SEQ ID NO: 227921 - DNA, 20 bp, Homo sapiens
tgctcagcaaggggctctgc

SEQ ID NO: 227922 - DNA, 13 bp, Homo sapiens
tgctcagcatgat

SEQ ID NO: 227923 - DNA, 17 bp, Homo sapiens
tgctcaggcctcacctg

SEQ ID NO: 227924 - DNA, 21 bp, Homo sapiens
tgctcaggcctcacctggctt

SEQ ID NO: 227925 - DNA, 23 bp, Homo sapiens
tgctcaggcctcacctggcttcc

SEQ ID NO: 227926 - DNA, 16 bp, Homo sapiens
tgctcagtgcctcctg

SEQ ID NO: 227927 - DNA, 16 bp, Homo sapiens
tgctcagttgtacttt

SEQ ID NO: 227928 - DNA, 15 bp, Homo sapiens
tgctcatgggaagaa

SEQ ID NO: 227929 - DNA, 14 bp, Homo sapiens
tgctccaccacatc

SEQ ID NO: 227930 - DNA, 17 bp, Homo sapiens
tgctccacccttggcct

SEQ ID NO: 227931 - DNA, 16 bp, Homo sapiens
tgctccacgaagcctt

SEQ ID NO: 227932 - DNA, 18 bp, Homo sapiens
tgctccagcagtgctggg

SEQ ID NO: 227933 - DNA, 14 bp, Homo sapiens
tgctccagggtctt

SEQ ID NO: 227934 - DNA, 19 bp, Homo sapiens
tgctccagggtcttgggct

SEQ ID NO: 227935 - DNA, 21 bp, Homo sapiens
tgctccatgcagatctagcca

SEQ ID NO: 227936 - DNA, 22 bp, Homo sapiens
tgctccatgcagatctagccag

SEQ ID NO: 227937 - DNA, 19 bp, Homo sapiens
tgctccatggatgcatgcc

SEQ ID NO: 227938 - DNA, 16 bp, Homo sapiens
tgctccatgggcacct

SEQ ID NO: 227939 - DNA, 14 bp, Homo sapiens
tgctccattttctt

SEQ ID NO: 227940 - DNA, 21 bp, Homo sapiens
tgctcccagatgccttctaga

SEQ ID NO: 227941 - DNA, 17 bp, Homo sapiens
tgctcccagcagcccta

SEQ ID NO: 227942 - DNA, 21 bp, Homo sapiens
tgctcccagcagccctaagga

SEQ ID NO: 227943 - DNA, 16 bp, Homo sapiens
tgctcccagcatttgt

SEQ ID NO: 227944 - DNA, 23 bp, Homo sapiens
tgctcccagcccctaccttgaga

SEQ ID NO: 227945 - DNA, 14 bp, Homo sapiens
tgctcccagcctgc

SEQ ID NO: 227946 - DNA, 16 bp, Homo sapiens
tgctcccagcctgctg

SEQ ID NO: 227947 - DNA, 14 bp, Homo sapiens
tgctcccagtgcca

SEQ ID NO: 227948 - DNA, 18 bp, Homo sapiens
tgctcccattcctccctc

SEQ ID NO: 227949 - DNA, 15 bp, Homo sapiens
tgctcccccatcctc

SEQ ID NO: 227950 - DNA, 20 bp, Homo sapiens
tgctcccccatcctcccctt

SEQ ID NO: 227951 - DNA, 16 bp, Homo sapiens
tgctcccctccctcct

SEQ ID NO: 227952 - DNA, 15 bp, Homo sapiens
tgctccctcccctgc

SEQ ID NO: 227953 - DNA, 19 bp, Homo sapiens
tgctccctcccctgccctg

SEQ ID NO: 227954 - DNA, 20 bp, Homo sapiens
tgctccctcccctgccctgg

SEQ ID NO: 227955 - DNA, 12 bp, Homo sapiens
tgctcccttcaa

SEQ ID NO: 227956 - DNA, 13 bp, Homo sapiens
tgctccgccagga

SEQ ID NO: 227957 - DNA, 15 bp, Homo sapiens
tgctccgccaggaaa

SEQ ID NO: 227958 - DNA, 23 bp, Homo sapiens
tgctccggagatgaatatgagct

SEQ ID NO: 227959 - DNA, 14 bp, Homo sapiens
tgctcctacccctg

SEQ ID NO: 227960 - DNA, 14 bp, Homo sapiens
tgctcctcaccccc

SEQ ID NO: 227961 - DNA, 22 bp, Homo sapiens
tgctcctcacccccacccctgt

SEQ ID NO: 227962 - DNA, 12 bp, Homo sapiens
tgctcctcaggg

SEQ ID NO: 227963 - DNA, 18 bp, Homo sapiens
aggaagcacaagaagtgg

SEQ ID NO: 227964 - DNA, 22 bp, Homo sapiens
aggaagcacaagaagtgggagt

SEQ ID NO: 227965 - DNA, 11 bp, Homo sapiens
aggaagcacag

SEQ ID NO: 227966 - DNA, 14 bp, Homo sapiens
aggaagcacaggcc

SEQ ID NO: 227967 - DNA, 16 bp, Homo sapiens
aggaagcacaggccag

SEQ ID NO: 227968 - DNA, 12 bp, Homo sapiens
aggaagcaggga

SEQ ID NO: 227969 - DNA, 14 bp, Homo sapiens
aggaagcagggaga

SEQ ID NO: 227970 - DNA, 15 bp, Homo sapiens
aggaagcagggagag

SEQ ID NO: 227971 - DNA, 19 bp, Homo sapiens
aggaagcagggagagttgg

SEQ ID NO: 227972 - DNA, 23 bp, Homo sapiens
aggaagcattgcttttggacaag

SEQ ID NO: 227973 - DNA, 22 bp, Homo sapiens
aggaagccacgtgctggagagt

SEQ ID NO: 227974 - DNA, 19 bp, Homo sapiens
aggaagcccagtagccatt

SEQ ID NO: 227975 - DNA, 16 bp, Homo sapiens
aggaagcctcctgctg

SEQ ID NO: 227976 - DNA, 20 bp, Homo sapiens
aggaagctccagtcctgctc

SEQ ID NO: 227977 - DNA, 14 bp, Homo sapiens
aggaaggaaacaat

SEQ ID NO: 227978 - DNA, 12 bp, Homo sapiens
aggaaggcagct

SEQ ID NO: 227979 - DNA, 15 bp, Homo sapiens
aggaaggcagctgct

SEQ ID NO: 227980 - DNA, 18 bp, Homo sapiens
aggaaggcagctgctctt

SEQ ID NO: 227981 - DNA, 20 bp, Homo sapiens
aggaaggcgtgtccaggaga

SEQ ID NO: 227982 - DNA, 18 bp, Homo sapiens
aggaagggactggtccag

SEQ ID NO: 227983 - DNA, 20 bp, Homo sapiens
aggaagggactggtccaggc

SEQ ID NO: 227984 - DNA, 24 bp, Homo sapiens
aggaagggactggtccaggcatgg

SEQ ID NO: 227985 - DNA, 16 bp, Homo sapiens
aggaagggagaggagg

SEQ ID NO: 227986 - DNA, 19 bp, Homo sapiens
aggaagggccagagcctgg

SEQ ID NO: 227987 - DNA, 20 bp, Homo sapiens
aggaagggccagagcctggt

SEQ ID NO: 227988 - DNA, 23 bp, Homo sapiens
aggaaggggctggactggctgtc

SEQ ID NO: 227989 - DNA, 19 bp, Homo sapiens
aggaaggggggttgcagtg

SEQ ID NO: 227990 - DNA, 21 bp, Homo sapiens
aggaaggtgctgagcttagcc

SEQ ID NO: 227991 - DNA, 19 bp, Homo sapiens
aggaagtactggagaaaat

SEQ ID NO: 227992 - DNA, 17 bp, Homo sapiens
aggaagtagatgtgaaa

SEQ ID NO: 227993 - DNA, 15 bp, Homo sapiens
aggaagtcaggagcc

SEQ ID NO: 227994 - DNA, 20 bp, Homo sapiens
aggaagtcaggagccagcag

SEQ ID NO: 227995 - DNA, 22 bp, Homo sapiens
aggaagtcaggagccagcaggg

SEQ ID NO: 227996 - DNA, 14 bp, Homo sapiens
aggaagtgggagaa

SEQ ID NO: 227997 - DNA, 17 bp, Homo sapiens
aggaagtgtaacagctg

SEQ ID NO: 227998 - DNA, 22 bp, Homo sapiens
aggaagttgctgagaaatgggg

SEQ ID NO: 227999 - DNA, 21 bp, Homo sapiens
aggaataaatgagagggaatc

SEQ ID NO: 228000 - DNA, 14 bp, Homo sapiens
aggaataaggcctt

SEQ ID NO: 228001 - DNA, 18 bp, Homo sapiens
aggaataattatttattt

SEQ ID NO: 228002 - DNA, 15 bp, Homo sapiens
aggaatagccagaga

SEQ ID NO: 228003 - DNA, 22 bp, Homo sapiens
aggaatatgacggaagaacata

SEQ ID NO: 228004 - DNA, 16 bp, Homo sapiens
aggaatcatgttggat

SEQ ID NO: 228005 - DNA, 19 bp, Homo sapiens
aggaatcgaggaaccagag

SEQ ID NO: 228006 - DNA, 17 bp, Homo sapiens
aggaatcttttactgtg

SEQ ID NO: 228007 - DNA, 21 bp, Homo sapiens
aggaatcttttactgtggagg

SEQ ID NO: 228008 - DNA, 19 bp, Homo sapiens
aggaatgaagataccatca

SEQ ID NO: 228009 - DNA, 16 bp, Homo sapiens
aggaatgcaagagaag

SEQ ID NO: 228010 - DNA, 18 bp, Homo sapiens
aggaatgcaagagaagga

SEQ ID NO: 228011 - DNA, 20 bp, Homo sapiens
aggaatgcaagagaaggaga

SEQ ID NO: 228012 - DNA, 17 bp, Homo sapiens
aggaatgctcaatgtgc

SEQ ID NO: 228013 - DNA, 21 bp, Homo sapiens
aggaatgctcaatgtgctgtt

SEQ ID NO: 228014 - DNA, 13 bp, Homo sapiens
aggaatgctcccc

SEQ ID NO: 228015 - DNA, 22 bp, Homo sapiens
aggaatgctcccccatcctccc

SEQ ID NO: 228016 - DNA, 16 bp, Homo sapiens
aggaatgcttggaata

SEQ ID NO: 228017 - DNA, 20 bp, Homo sapiens
aggaatgggccaagccaggg

SEQ ID NO: 228018 - DNA, 18 bp, Homo sapiens
aggaatgtagctggtttc

SEQ ID NO: 228019 - DNA, 17 bp, Homo sapiens
aggaatgtgcttttcca

SEQ ID NO: 228020 - DNA, 23 bp, Homo sapiens
aggaattgacttcagcaggggtg

SEQ ID NO: 228021 - DNA, 15 bp, Homo sapiens
aggaatttctgagtg

SEQ ID NO: 228022 - DNA, 15 bp, Homo sapiens
aggacaaaaatataa

SEQ ID NO: 228023 - DNA, 18 bp, Homo sapiens
aggacaaaaatgaactga

SEQ ID NO: 228024 - DNA, 15 bp, Homo sapiens
aggacaaacagtgaa

SEQ ID NO: 228025 - DNA, 14 bp, Homo sapiens
aggacaacctgccc

SEQ ID NO: 228026 - DNA, 20 bp, Homo sapiens
aggacacaccccacacccca

SEQ ID NO: 228027 - DNA, 23 bp, Homo sapiens
aggacacaccccacaccccagcc

SEQ ID NO: 228028 - DNA, 13 bp, Homo sapiens
aggacacagtcag

SEQ ID NO: 228029 - DNA, 21 bp, Homo sapiens
aggacacatcccggcctcttc

SEQ ID NO: 228030 - DNA, 12 bp, Homo sapiens
aggacacatgtc

SEQ ID NO: 228031 - DNA, 12 bp, Homo sapiens
aggacactgatg

SEQ ID NO: 228032 - DNA, 20 bp, Homo sapiens
aggacagctgcaggtgccca

SEQ ID NO: 228033 - DNA, 21 bp, Homo sapiens
aggacagctgcaggtgcccat

SEQ ID NO: 228034 - DNA, 16 bp, Homo sapiens
aggacaggaaatatgt

SEQ ID NO: 228035 - DNA, 18 bp, Homo sapiens
aggacagtgctgacccca

SEQ ID NO: 228036 - DNA, 22 bp, Homo sapiens
aggacagtgctgaccccaggaa

SEQ ID NO: 228037 - DNA, 18 bp, Homo sapiens
aggacagtttaggaccca

SEQ ID NO: 228038 - DNA, 17 bp, Homo sapiens
aggacatactgcatgta

SEQ ID NO: 228039 - DNA, 16 bp, Homo sapiens
aggacatctctgtaaa

SEQ ID NO: 228040 - DNA, 12 bp, Homo sapiens
aggacattgccc

SEQ ID NO: 228041 - DNA, 13 bp, Homo sapiens
aggacattgcccc

SEQ ID NO: 228042 - DNA, 17 bp, Homo sapiens
aggacattgccccaaga

SEQ ID NO: 228043 - DNA, 21 bp, Homo sapiens
aggacatttgggactgtcttg

SEQ ID NO: 228044 - DNA, 20 bp, Homo sapiens
aggaccaacccatgccctgc

SEQ ID NO: 228045 - DNA, 19 bp, Homo sapiens
aggaccaagcttaaggaga

SEQ ID NO: 228046 - DNA, 14 bp, Homo sapiens
aggaccaatgttgt

SEQ ID NO: 228047 - DNA, 16 bp, Homo sapiens
aggaccactcctgtac

SEQ ID NO: 228048 - DNA, 13 bp, Homo sapiens
aggaccaggactc

SEQ ID NO: 228049 - DNA, 17 bp, Homo sapiens
aggaccaggactccctc

SEQ ID NO: 228050 - DNA, 13 bp, Homo sapiens
aggaccaggagcc

SEQ ID NO: 228051 - DNA, 17 bp, Homo sapiens
aggaccaggagccaggt

SEQ ID NO: 228052 - DNA, 20 bp, Homo sapiens
aggacccaaggtggtcttgg

SEQ ID NO: 228053 - DNA, 20 bp, Homo sapiens
aggacccacccatcttcctg

SEQ ID NO: 228054 - DNA, 13 bp, Homo sapiens
aggacccaggccc

SEQ ID NO: 228055 - DNA, 17 bp, Homo sapiens
aggacccaggccctcca

SEQ ID NO: 228056 - DNA, 23 bp, Homo sapiens
aggaccccagcttttcttgccag

SEQ ID NO: 228057 - DNA, 15 bp, Homo sapiens
aggacccctcacctt

SEQ ID NO: 228058 - DNA, 17 bp, Homo sapiens
aggacccgggaccacag

SEQ ID NO: 228059 - DNA, 20 bp, Homo sapiens
aggacccgggaccacagctg

SEQ ID NO: 228060 - DNA, 11 bp, Homo sapiens
aggaccctggg

SEQ ID NO: 228061 - DNA, 12 bp, Homo sapiens
aggaccctgggt

SEQ ID NO: 228062 - DNA, 21 bp, Homo sapiens
aggacctatgtttgctcagaa

SEQ ID NO: 228063 - DNA, 16 bp, Homo sapiens
aggacctccacctggg

SEQ ID NO: 228064 - DNA, 14 bp, Homo sapiens
aggacctctgggct

SEQ ID NO: 228065 - DNA, 16 bp, Homo sapiens
aggacctggagacagg

SEQ ID NO: 228066 - DNA, 17 bp, Homo sapiens
aggacctggagacagga

SEQ ID NO: 228067 - DNA, 15 bp, Homo sapiens
aggaccttatctgtg

SEQ ID NO: 228068 - DNA, 16 bp, Homo sapiens
aggacgagactcctcg

SEQ ID NO: 228069 - DNA, 18 bp, Homo sapiens
aggacgcagggagaccct

SEQ ID NO: 228070 - DNA, 19 bp, Homo sapiens
aggacgcagggagaccctg

SEQ ID NO: 228071 - DNA, 21 bp, Homo sapiens
aggacgcagggagaccctggg

SEQ ID NO: 228072 - DNA, 17 bp, Homo sapiens
aggacggagttcagagg

SEQ ID NO: 228073 - DNA, 20 bp, Homo sapiens
aggacgtgggcggcagagag

SEQ ID NO: 228074 - DNA, 13 bp, Homo sapiens
aggactatataaa

SEQ ID NO: 228075 - DNA, 15 bp, Homo sapiens
aggactatataaagt

SEQ ID NO: 228076 - DNA, 16 bp, Homo sapiens
aggactcaggcctgcc

SEQ ID NO: 228077 - DNA, 17 bp, Homo sapiens
aggactcaggcctgcca

SEQ ID NO: 228078 - DNA, 18 bp, Homo sapiens
aggactcaggcctgccaa

SEQ ID NO: 228079 - DNA, 21 bp, Homo sapiens
aggactcaggcctgccaatgc

SEQ ID NO: 228080 - DNA, 12 bp, Homo sapiens
aggactccctcc

SEQ ID NO: 228081 - DNA, 20 bp, Homo sapiens
aggactccctccatgtggcc

SEQ ID NO: 228082 - DNA, 13 bp, Homo sapiens
aggactccctcct

SEQ ID NO: 228083 - DNA, 14 bp, Homo sapiens
aggactccctcctc

SEQ ID NO: 228084 - DNA, 15 bp, Homo sapiens
aggactccctcctca

SEQ ID NO: 228085 - DNA, 19 bp, Homo sapiens
aggactccctcctcacctc

SEQ ID NO: 228086 - DNA, 15 bp, Homo sapiens
aggactctctttctt

SEQ ID NO: 228087 - DNA, 18 bp, Homo sapiens
aggactctgcccagacca

SEQ ID NO: 228088 - DNA, 12 bp, Homo sapiens
aggactctgcct

SEQ ID NO: 228089 - DNA, 19 bp, Homo sapiens
aggactctgccttccaggc

SEQ ID NO: 228090 - DNA, 21 bp, Homo sapiens
aggactctgccttccaggcgt

SEQ ID NO: 228091 - DNA, 16 bp, Homo sapiens
aggactggagaccgct

SEQ ID NO: 228092 - DNA, 21 bp, Homo sapiens
aggactgttttttcctgagct

SEQ ID NO: 228093 - DNA, 17 bp, Homo sapiens
aggacttaacggctcca

SEQ ID NO: 228094 - DNA, 23 bp, Homo sapiens
aggacttaagacaaatgggactg

SEQ ID NO: 228095 - DNA, 18 bp, Homo sapiens
aggacttcaaaaggtgat

SEQ ID NO: 228096 - DNA, 19 bp, Homo sapiens
aggacttgaaagcatccat

SEQ ID NO: 228097 - DNA, 14 bp, Homo sapiens
tgccgcctcccagc

SEQ ID NO: 228098 - DNA, 21 bp, Homo sapiens
tgccgcctgtgcccttgctgg

SEQ ID NO: 228099 - DNA, 22 bp, Homo sapiens
tgccgcctgtgcccttgctggg

SEQ ID NO: 228100 - DNA, 23 bp, Homo sapiens
tgccgcctgtgcccttgctgggt

SEQ ID NO: 228101 - DNA, 16 bp, Homo sapiens
tgccgcgggcggccag

SEQ ID NO: 228102 - DNA, 17 bp, Homo sapiens
tgccgcgggcggccagg

SEQ ID NO: 228103 - DNA, 18 bp, Homo sapiens
tgccgcgggcggccaggc

SEQ ID NO: 228104 - DNA, 19 bp, Homo sapiens
tgccgcgggcggccaggca

SEQ ID NO: 228105 - DNA, 19 bp, Homo sapiens
tgccgcgtgcgaccagagg

SEQ ID NO: 228106 - DNA, 13 bp, Homo sapiens
tgccgctgggaga

SEQ ID NO: 228107 - DNA, 22 bp, Homo sapiens
tgccgctgtgtccccgcgggca

SEQ ID NO: 228108 - DNA, 13 bp, Homo sapiens
tgccgggcctggg

SEQ ID NO: 228109 - DNA, 18 bp, Homo sapiens
tgccgggcctgggcctcc

SEQ ID NO: 228110 - DNA, 22 bp, Homo sapiens
tgccgtcctggactctgtgtga

SEQ ID NO: 228111 - DNA, 20 bp, Homo sapiens
tgccgtggattgcacgtggc

SEQ ID NO: 228112 - DNA, 20 bp, Homo sapiens
tgccgttgccaagaactgaa

SEQ ID NO: 228113 - DNA, 16 bp, Homo sapiens
tgcctaaaattgtatg

SEQ ID NO: 228114 - DNA, 14 bp, Homo sapiens
tgcctaacaccagc

SEQ ID NO: 228115 - DNA, 15 bp, Homo sapiens
tgcctaacaccagcg

SEQ ID NO: 228116 - DNA, 12 bp, Homo sapiens
tgcctaataaag

SEQ ID NO: 228117 - DNA, 14 bp, Homo sapiens
tgcctaattcctgg

SEQ ID NO: 228118 - DNA, 23 bp, Homo sapiens
tgcctaattcctggcatgacact

SEQ ID NO: 228119 - DNA, 15 bp, Homo sapiens
tgcctacattatcta

SEQ ID NO: 228120 - DNA, 21 bp, Homo sapiens
tgcctaccagtcgccctctgt

SEQ ID NO: 228121 - DNA, 23 bp, Homo sapiens
tgcctactctttgttttctttcc

SEQ ID NO: 228122 - DNA, 16 bp, Homo sapiens
tgcctagacttcccaa

SEQ ID NO: 228123 - DNA, 21 bp, Homo sapiens
tgcctagacttcccaacagcc

SEQ ID NO: 228124 - DNA, 22 bp, Homo sapiens
tgcctagacttcccaacagcct

SEQ ID NO: 228125 - DNA, 19 bp, Homo sapiens
tgcctaggagctggctggc

SEQ ID NO: 228126 - DNA, 17 bp, Homo sapiens
tgcctaggagctgggga

SEQ ID NO: 228127 - DNA, 18 bp, Homo sapiens
tgcctagggcctggtcca

SEQ ID NO: 228128 - DNA, 19 bp, Homo sapiens
tgcctagggttgcttgggc

SEQ ID NO: 228129 - DNA, 21 bp, Homo sapiens
tgcctagggttgcttgggcca

SEQ ID NO: 228130 - DNA, 18 bp, Homo sapiens
tgcctagtgatgtagaaa

SEQ ID NO: 228131 - DNA, 16 bp, Homo sapiens
tgcctatccatcctgc

SEQ ID NO: 228132 - DNA, 17 bp, Homo sapiens
tgcctatccatcctgcg

SEQ ID NO: 228133 - DNA, 14 bp, Homo sapiens
tgcctcagcgctgc

SEQ ID NO: 228134 - DNA, 22 bp, Homo sapiens
tgcctcagcgctgcccacacca

SEQ ID NO: 228135 - DNA, 23 bp, Homo sapiens
tgcctcagcgctgcccacaccac

SEQ ID NO: 228136 - DNA, 17 bp, Homo sapiens
tgcctcatgccacacct

SEQ ID NO: 228137 - DNA, 14 bp, Homo sapiens
tgcctcatgctctc

SEQ ID NO: 228138 - DNA, 20 bp, Homo sapiens
tgcctccaccgagccagctt

SEQ ID NO: 228139 - DNA, 21 bp, Homo sapiens
tgcctccaccgagccagcttg

SEQ ID NO: 228140 - DNA, 14 bp, Homo sapiens
tgcctccatggtgc

SEQ ID NO: 228141 - DNA, 19 bp, Homo sapiens
tgcctcccaagctcagagc

SEQ ID NO: 228142 - DNA, 13 bp, Homo sapiens
tgcctcccacact

SEQ ID NO: 228143 - DNA, 22 bp, Homo sapiens
tgcctcccacacttgctggggc

SEQ ID NO: 228144 - DNA, 21 bp, Homo sapiens
tgcctcccacgctgggacaca

SEQ ID NO: 228145 - DNA, 19 bp, Homo sapiens
tgcctccccaaccctgccc

SEQ ID NO: 228146 - DNA, 20 bp, Homo sapiens
tgcctccccaaccctgcccc

SEQ ID NO: 228147 - DNA, 21 bp, Homo sapiens
tgcctccccaaccctgcccct

SEQ ID NO: 228148 - DNA, 16 bp, Homo sapiens
tgcctccctctcttcc

SEQ ID NO: 228149 - DNA, 19 bp, Homo sapiens
tgcctccctctcttccggg

SEQ ID NO: 228150 - DNA, 19 bp, Homo sapiens
tgcctccctgaccctgcag

SEQ ID NO: 228151 - DNA, 16 bp, Homo sapiens
tgcctccctgtccacc

SEQ ID NO: 228152 - DNA, 11 bp, Homo sapiens
tgcctcccttc

SEQ ID NO: 228153 - DNA, 15 bp, Homo sapiens
tgcctcccttcccag

SEQ ID NO: 228154 - DNA, 13 bp, Homo sapiens
tgcctcccttcct

SEQ ID NO: 228155 - DNA, 16 bp, Homo sapiens
tgcctcccttcctccg

SEQ ID NO: 228156 - DNA, 14 bp, Homo sapiens
tgcctccctttctg

SEQ ID NO: 228157 - DNA, 21 bp, Homo sapiens
tgcctccggccctgccccaca

SEQ ID NO: 228158 - DNA, 19 bp, Homo sapiens
tgcctcctctctccctgcc

SEQ ID NO: 228159 - DNA, 21 bp, Homo sapiens
tgcctcctctctccctgcctc

SEQ ID NO: 228160 - DNA, 22 bp, Homo sapiens
tgcctcctctctccctgcctca

SEQ ID NO: 228161 - DNA, 23 bp, Homo sapiens
tgcctcctctctccctgcctcac

SEQ ID NO: 228162 - DNA, 14 bp, Homo sapiens
tgcctcctcttcaa

SEQ ID NO: 228163 - DNA, 13 bp, Homo sapiens
tgcctcctggccg

SEQ ID NO: 228164 - DNA, 13 bp, Homo sapiens
tgcctcctgtgta

SEQ ID NO: 228165 - DNA, 21 bp, Homo sapiens
tgcctcgaggcaccggcgctg

SEQ ID NO: 228166 - DNA, 22 bp, Homo sapiens
tgcctcgaggcaccggcgctgc

SEQ ID NO: 228167 - DNA, 23 bp, Homo sapiens
tgcctcgaggcaccggcgctgca

SEQ ID NO: 228168 - DNA, 17 bp, Homo sapiens
tgcctcgtgggttcttc

SEQ ID NO: 228169 - DNA, 18 bp, Homo sapiens
tgcctctaaggccaaggc

SEQ ID NO: 228170 - DNA, 21 bp, Homo sapiens
tgcctctaaggccaaggcctc

SEQ ID NO: 228171 - DNA, 17 bp, Homo sapiens
tgcctctgaaaatattt

SEQ ID NO: 228172 - DNA, 16 bp, Homo sapiens
tgcctctgacagcagc

SEQ ID NO: 228173 - DNA, 20 bp, Homo sapiens
tgcctctgacagcagcctgt

SEQ ID NO: 228174 - DNA, 11 bp, Homo sapiens
tgcctctgcct

SEQ ID NO: 228175 - DNA, 13 bp, Homo sapiens
tgcctctgcctta

SEQ ID NO: 228176 - DNA, 20 bp, Homo sapiens
tgcctctggaggcctctggg

SEQ ID NO: 228177 - DNA, 13 bp, Homo sapiens
tgcctctgggtga

SEQ ID NO: 228178 - DNA, 23 bp, Homo sapiens
tgcctctgggtgagtggctgaca

SEQ ID NO: 228179 - DNA, 14 bp, Homo sapiens
tgcctcttgggaga

SEQ ID NO: 228180 - DNA, 14 bp, Homo sapiens
tgcctctttcctgt

SEQ ID NO: 228181 - DNA, 12 bp, Homo sapiens
tgcctgaaacag

SEQ ID NO: 228182 - DNA, 13 bp, Homo sapiens
tgcctgaaagcaa

SEQ ID NO: 228183 - DNA, 17 bp, Homo sapiens
tgcctgacacaggggac

SEQ ID NO: 228184 - DNA, 18 bp, Homo sapiens
tgcctgacactgagcccc

SEQ ID NO: 228185 - DNA, 23 bp, Homo sapiens
tgcctgaccatcccatgagcagt

SEQ ID NO: 228186 - DNA, 20 bp, Homo sapiens
tgcctgactaatttttgtat

SEQ ID NO: 228187 - DNA, 11 bp, Homo sapiens
tgcctgagccc

SEQ ID NO: 228188 - DNA, 15 bp, Homo sapiens
tgcctgagcccagga

SEQ ID NO: 228189 - DNA, 18 bp, Homo sapiens
tgcctgagcccaggagct

SEQ ID NO: 228190 - DNA, 12 bp, Homo sapiens
tgcctgagcccg

SEQ ID NO: 228191 - DNA, 20 bp, Homo sapiens
tgcctgagggcccctctgcc

SEQ ID NO: 228192 - DNA, 23 bp, Homo sapiens
tgcctgagggcccctctgcccag

SEQ ID NO: 228193 - DNA, 11 bp, Homo sapiens
tgcctgagggt

SEQ ID NO: 228194 - DNA, 14 bp, Homo sapiens
tgcctgagggtgga

SEQ ID NO: 228195 - DNA, 18 bp, Homo sapiens
tgcctgaggtctgtacgt

SEQ ID NO: 228196 - DNA, 14 bp, Homo sapiens
tgcctgcaccagga

SEQ ID NO: 228197 - DNA, 14 bp, Homo sapiens
tgcctgcagcatct

SEQ ID NO: 228198 - DNA, 17 bp, Homo sapiens
tgcctgccactctctgg

SEQ ID NO: 228199 - DNA, 21 bp, Homo sapiens
tgcctgccactctctgggact

SEQ ID NO: 228200 - DNA, 13 bp, Homo sapiens
tgcctgcccaccc

SEQ ID NO: 228201 - DNA, 15 bp, Homo sapiens
tgcctgccccacacg

SEQ ID NO: 228202 - DNA, 15 bp, Homo sapiens
tgcctgcctcatgct

SEQ ID NO: 228203 - DNA, 19 bp, Homo sapiens
tgcctgcctcatgctctct

SEQ ID NO: 228204 - DNA, 13 bp, Homo sapiens
tgcctgcctccgg

SEQ ID NO: 228205 - DNA, 16 bp, Homo sapiens
tgcctgcctccggccc

SEQ ID NO: 228206 - DNA, 21 bp, Homo sapiens
tgcctgcctccggccctgccc

SEQ ID NO: 228207 - DNA, 23 bp, Homo sapiens
tgcctgcctccggccctgcccca

SEQ ID NO: 228208 - DNA, 12 bp, Homo sapiens
tgcctgctagag

SEQ ID NO: 228209 - DNA, 13 bp, Homo sapiens
tgcctgctagagc

SEQ ID NO: 228210 - DNA, 14 bp, Homo sapiens
tgcctgctatccag

SEQ ID NO: 228211 - DNA, 15 bp, Homo sapiens
tgcctgctatccagc

SEQ ID NO: 228212 - DNA, 11 bp, Homo sapiens
tgcctgctcct

SEQ ID NO: 228213 - DNA, 19 bp, Homo sapiens
tgcctggagaaaggatggc

SEQ ID NO: 228214 - DNA, 21 bp, Homo sapiens
tgcctggagaaaggatggcag

SEQ ID NO: 228215 - DNA, 18 bp, Homo sapiens
tgcctggagctcctggga

SEQ ID NO: 228216 - DNA, 23 bp, Homo sapiens
tgcctggatcccctctgtctaca

SEQ ID NO: 228217 - DNA, 22 bp, Homo sapiens
tgcctggatgggggtgcaggca

SEQ ID NO: 228218 - DNA, 12 bp, Homo sapiens
tgcctggccagg

SEQ ID NO: 228219 - DNA, 16 bp, Homo sapiens
tgcctggccaggcaga

SEQ ID NO: 228220 - DNA, 20 bp, Homo sapiens
tgcctggccaggcagatctg

SEQ ID NO: 228221 - DNA, 16 bp, Homo sapiens
tgcctggcccccagct

SEQ ID NO: 228222 - DNA, 15 bp, Homo sapiens
tgcctggcctggctc

SEQ ID NO: 228223 - DNA, 22 bp, Homo sapiens
tgcctggcgggcagcccctgct

SEQ ID NO: 228224 - DNA, 23 bp, Homo sapiens
tgcctggcgggcagcccctgctg

SEQ ID NO: 228225 - DNA, 17 bp, Homo sapiens
tgcctggctgtggaggc

SEQ ID NO: 228226 - DNA, 20 bp, Homo sapiens
tgcctggctgtggaggcctg

SEQ ID NO: 228227 - DNA, 14 bp, Homo sapiens
tgcctgggaatgta

SEQ ID NO: 228228 - DNA, 23 bp, Homo sapiens
tgcctgggatcagtggggcccca

SEQ ID NO: 228229 - DNA, 12 bp, Homo sapiens
tgcctgggcctg

SEQ ID NO: 228230 - DNA, 14 bp, Homo sapiens
tgcctgggcctgtg

SEQ ID NO: 228231 - DNA, 23 bp, Homo sapiens
aggacttgccctcgtggtggaaa

SEQ ID NO: 228232 - DNA, 17 bp, Homo sapiens
aggacttggggtcagga

SEQ ID NO: 228233 - DNA, 14 bp, Homo sapiens
aggacttgtgcctc

SEQ ID NO: 228234 - DNA, 13 bp, Homo sapiens
aggagaaacacat

SEQ ID NO: 228235 - DNA, 15 bp, Homo sapiens
aggagaactgtgctc

SEQ ID NO: 228236 - DNA, 12 bp, Homo sapiens
aggagaaggaga

SEQ ID NO: 228237 - DNA, 14 bp, Homo sapiens
aggagaaggcctgc

SEQ ID NO: 228238 - DNA, 16 bp, Homo sapiens
aggagaaggcctgccc

SEQ ID NO: 228239 - DNA, 17 bp, Homo sapiens
aggagaatcgcttgaac

SEQ ID NO: 228240 - DNA, 20 bp, Homo sapiens
aggagaatcgcttgaacctg

SEQ ID NO: 228241 - DNA, 15 bp, Homo sapiens
aggagaattaaactc

SEQ ID NO: 228242 - DNA, 14 bp, Homo sapiens
aggagacaaagcag

SEQ ID NO: 228243 - DNA, 20 bp, Homo sapiens
aggagaccaagtcctggcta

SEQ ID NO: 228244 - DNA, 14 bp, Homo sapiens
aggagaccctggaa

SEQ ID NO: 228245 - DNA, 21 bp, Homo sapiens
aggagacctggcactggatgc

SEQ ID NO: 228246 - DNA, 16 bp, Homo sapiens
aggagactcaggccca

SEQ ID NO: 228247 - DNA, 12 bp, Homo sapiens
aggagacttgta

SEQ ID NO: 228248 - DNA, 23 bp, Homo sapiens
aggagagactgaaagcagcagct

SEQ ID NO: 228249 - DNA, 13 bp, Homo sapiens
aggagagagagag

SEQ ID NO: 228250 - DNA, 15 bp, Homo sapiens
aggagagagagagag

SEQ ID NO: 228251 - DNA, 18 bp, Homo sapiens
aggagagagcttcctgtt

SEQ ID NO: 228252 - DNA, 24 bp, Homo sapiens
aggagagaggttgaggatgcactg

SEQ ID NO: 228253 - DNA, 18 bp, Homo sapiens
aggagagcatctgctctg

SEQ ID NO: 228254 - DNA, 24 bp, Homo sapiens
aggagagccaacctcggcttgtgg

SEQ ID NO: 228255 - DNA, 17 bp, Homo sapiens
aggagagccctctgctg

SEQ ID NO: 228256 - DNA, 19 bp, Homo sapiens
aggagagccctctgctgct

SEQ ID NO: 228257 - DNA, 16 bp, Homo sapiens
aggagagcccttcatt

SEQ ID NO: 228258 - DNA, 13 bp, Homo sapiens
aggagagcctgct

SEQ ID NO: 228259 - DNA, 13 bp, Homo sapiens
aggagaggagggt

SEQ ID NO: 228260 - DNA, 14 bp, Homo sapiens
aggagaggctctga

SEQ ID NO: 228261 - DNA, 23 bp, Homo sapiens
aggagagggagtacaaagacagg

SEQ ID NO: 228262 - DNA, 13 bp, Homo sapiens
aggagagggcaga

SEQ ID NO: 228263 - DNA, 22 bp, Homo sapiens
aggagaggggaagggccagtct

SEQ ID NO: 228264 - DNA, 23 bp, Homo sapiens
aggagagtacccccctgagagca

SEQ ID NO: 228265 - DNA, 20 bp, Homo sapiens
aggagagtcccagagcagga

SEQ ID NO: 228266 - DNA, 24 bp, Homo sapiens
aggagagtcccagagcaggaggcc

SEQ ID NO: 228267 - DNA, 13 bp, Homo sapiens
aggagatataaaa

SEQ ID NO: 228268 - DNA, 15 bp, Homo sapiens
aggagatataaaatc

SEQ ID NO: 228269 - DNA, 19 bp, Homo sapiens
aggagatgtaatgacagag

SEQ ID NO: 228270 - DNA, 21 bp, Homo sapiens
aggagatgtaatgacagagag

SEQ ID NO: 228271 - DNA, 15 bp, Homo sapiens
aggagattgctctgg

SEQ ID NO: 228272 - DNA, 15 bp, Homo sapiens
aggagattttccttc

SEQ ID NO: 228273 - DNA, 16 bp, Homo sapiens
aggagcaaacactgaa

SEQ ID NO: 228274 - DNA, 18 bp, Homo sapiens
aggagcaatgggactgga

SEQ ID NO: 228275 - DNA, 21 bp, Homo sapiens
aggagcaatgggactggagtc

SEQ ID NO: 228276 - DNA, 9 bp, Homo sapiens
aggagcacc

SEQ ID NO: 228277 - DNA, 13 bp, Homo sapiens
aggagcaccccca

SEQ ID NO: 228278 - DNA, 14 bp, Homo sapiens
aggagcacccccag

SEQ ID NO: 228279 - DNA, 18 bp, Homo sapiens
aggagcacccccagcctc

SEQ ID NO: 228280 - DNA, 23 bp, Homo sapiens
aggagcacccccagcctccccca

SEQ ID NO: 228281 - DNA, 17 bp, Homo sapiens
aggagcacttccaaaat

SEQ ID NO: 228282 - DNA, 16 bp, Homo sapiens
aggagcagcttcagtt

SEQ ID NO: 228283 - DNA, 14 bp, Homo sapiens
aggagcaggaagca

SEQ ID NO: 228284 - DNA, 17 bp, Homo sapiens
aggagcattttgtgtct

SEQ ID NO: 228285 - DNA, 16 bp, Homo sapiens
aggagccacctgggct

SEQ ID NO: 228286 - DNA, 17 bp, Homo sapiens
aggagccacctgggctg

SEQ ID NO: 228287 - DNA, 19 bp, Homo sapiens
aggagccaggcaacttcag

SEQ ID NO: 228288 - DNA, 12 bp, Homo sapiens
aggagccccagc

SEQ ID NO: 228289 - DNA, 13 bp, Homo sapiens
aggagccccagcc

SEQ ID NO: 228290 - DNA, 14 bp, Homo sapiens
aggagccccagcca

SEQ ID NO: 228291 - DNA, 15 bp, Homo sapiens
aggagccccagccag

SEQ ID NO: 228292 - DNA, 19 bp, Homo sapiens
aggagccccagccagccct

SEQ ID NO: 228293 - DNA, 17 bp, Homo sapiens
aggagcctatggcatct

SEQ ID NO: 228294 - DNA, 14 bp, Homo sapiens
aggagcctcctgac

SEQ ID NO: 228295 - DNA, 19 bp, Homo sapiens
aggagcctgcggctgctgg

SEQ ID NO: 228296 - DNA, 20 bp, Homo sapiens
aggagcctgcggctgctggc

SEQ ID NO: 228297 - DNA, 17 bp, Homo sapiens
aggagcgggcagggccg

SEQ ID NO: 228298 - DNA, 19 bp, Homo sapiens
aggagctcaggtggggagt

SEQ ID NO: 228299 - DNA, 22 bp, Homo sapiens
aggagctcaggtggggagtcca

SEQ ID NO: 228300 - DNA, 21 bp, Homo sapiens
aggagctgatttccaggcccc

SEQ ID NO: 228301 - DNA, 22 bp, Homo sapiens
aggagctgatttccaggcccct

SEQ ID NO: 228302 - DNA, 16 bp, Homo sapiens
aggagctgctggcttg

SEQ ID NO: 228303 - DNA, 21 bp, Homo sapiens
aggagctgctggcttgcagtg

SEQ ID NO: 228304 - DNA, 14 bp, Homo sapiens
aggagctggctggc

SEQ ID NO: 228305 - DNA, 10 bp, Homo sapiens
aggagctggg

SEQ ID NO: 228306 - DNA, 18 bp, Homo sapiens
aggagctggggagggaga

SEQ ID NO: 228307 - DNA, 17 bp, Homo sapiens
aggagcttacctcccac

SEQ ID NO: 228308 - DNA, 18 bp, Homo sapiens
aggagcttacctcccacc

SEQ ID NO: 228309 - DNA, 15 bp, Homo sapiens
aggaggaagcagaat

SEQ ID NO: 228310 - DNA, 18 bp, Homo sapiens
aggaggaagggactggtc

SEQ ID NO: 228311 - DNA, 12 bp, Homo sapiens
aggaggacaggg

SEQ ID NO: 228312 - DNA, 21 bp, Homo sapiens
aggaggagacagtcaggaagc

SEQ ID NO: 228313 - DNA, 16 bp, Homo sapiens
aggaggaggagatggc

SEQ ID NO: 228314 - DNA, 15 bp, Homo sapiens
aggaggatccgggct

SEQ ID NO: 228315 - DNA, 18 bp, Homo sapiens
aggaggatccgggctttg

SEQ ID NO: 228316 - DNA, 20 bp, Homo sapiens
aggaggcagaaagcagaggc

SEQ ID NO: 228317 - DNA, 20 bp, Homo sapiens
aggaggcagtggcttggagc

SEQ ID NO: 228318 - DNA, 12 bp, Homo sapiens
aggaggcccctg

SEQ ID NO: 228319 - DNA, 21 bp, Homo sapiens
aggaggctggaggaagggggg

SEQ ID NO: 228320 - DNA, 16 bp, Homo sapiens
aggaggctggcaggta

SEQ ID NO: 228321 - DNA, 17 bp, Homo sapiens
aggagggagccttgtga

SEQ ID NO: 228322 - DNA, 13 bp, Homo sapiens
aggagggagctgc

SEQ ID NO: 228323 - DNA, 16 bp, Homo sapiens
aggagggatagagacg

SEQ ID NO: 228324 - DNA, 18 bp, Homo sapiens
aggagggcagagccatgg

SEQ ID NO: 228325 - DNA, 23 bp, Homo sapiens
aggagggcatcagctttccctgg

SEQ ID NO: 228326 - DNA, 17 bp, Homo sapiens
aggagggggaggacgga

SEQ ID NO: 228327 - DNA, 15 bp, Homo sapiens
aggaggggtaaatat

SEQ ID NO: 228328 - DNA, 20 bp, Homo sapiens
aggaggggtaaatatatgtt

SEQ ID NO: 228329 - DNA, 15 bp, Homo sapiens
aggaggggtctgcct

SEQ ID NO: 228330 - DNA, 17 bp, Homo sapiens
aggaggggtctgcctcc

SEQ ID NO: 228331 - DNA, 21 bp, Homo sapiens
aggaggggtctgcctcccacg

SEQ ID NO: 228332 - DNA, 23 bp, Homo sapiens
aggagggttcctcttaggtcaga

SEQ ID NO: 228333 - DNA, 15 bp, Homo sapiens
aggaggtcccaggaa

SEQ ID NO: 228334 - DNA, 17 bp, Homo sapiens
aggaggtcccaggaagt

SEQ ID NO: 228335 - DNA, 13 bp, Homo sapiens
aggaggtggacat

SEQ ID NO: 228336 - DNA, 13 bp, Homo sapiens
aggaggtgggtga

SEQ ID NO: 228337 - DNA, 21 bp, Homo sapiens
aggaggtgtgatagagccttt

SEQ ID NO: 228338 - DNA, 20 bp, Homo sapiens
aggaggtgtggagtggaggg

SEQ ID NO: 228339 - DNA, 23 bp, Homo sapiens
aggaggtgtggagtggaggggtc

SEQ ID NO: 228340 - DNA, 17 bp, Homo sapiens
aggaggttggtgactga

SEQ ID NO: 228341 - DNA, 22 bp, Homo sapiens
aggagtccaggccatggaggca

SEQ ID NO: 228342 - DNA, 16 bp, Homo sapiens
aggagtctctgccacc

SEQ ID NO: 228343 - DNA, 20 bp, Homo sapiens
aggagtctctgccacccact

SEQ ID NO: 228344 - DNA, 21 bp, Homo sapiens
aggagtgattgaaccagctca

SEQ ID NO: 228345 - DNA, 16 bp, Homo sapiens
aggagtgcatggccac

SEQ ID NO: 228346 - DNA, 23 bp, Homo sapiens
aggagtgcatggccacagccacc

SEQ ID NO: 228347 - DNA, 23 bp, Homo sapiens
aggagtggcagctgtcccctctc

SEQ ID NO: 228348 - DNA, 14 bp, Homo sapiens
aggagtgggctctg

SEQ ID NO: 228349 - DNA, 16 bp, Homo sapiens
aggagttaatgatcgt

SEQ ID NO: 228350 - DNA, 17 bp, Homo sapiens
aggagttcaagaccagt

SEQ ID NO: 228351 - DNA, 12 bp, Homo sapiens
aggagttcaatg

SEQ ID NO: 228352 - DNA, 18 bp, Homo sapiens
aggagttcaatgatctag

SEQ ID NO: 228353 - DNA, 19 bp, Homo sapiens
aggagttcaatgatctagg

SEQ ID NO: 228354 - DNA, 20 bp, Homo sapiens
aggagttgagtacagtgagg

SEQ ID NO: 228355 - DNA, 13 bp, Homo sapiens
aggagttgctcct

SEQ ID NO: 228356 - DNA, 22 bp, Homo sapiens
aggagttgtttctgacccactg

SEQ ID NO: 228357 - DNA, 21 bp, Homo sapiens
aggagtttgagacaagccctg

SEQ ID NO: 228358 - DNA, 24 bp, Homo sapiens
aggagtttgagacaagccctggca

SEQ ID NO: 228359 - DNA, 16 bp, Homo sapiens
aggataaggagactga

SEQ ID NO: 228360 - DNA, 14 bp, Homo sapiens
aggataggaaaaga

SEQ ID NO: 228361 - DNA, 18 bp, Homo sapiens
aggatcacttaagcccag

SEQ ID NO: 228362 - DNA, 19 bp, Homo sapiens
aggatcacttgagcccagg

SEQ ID NO: 228363 - DNA, 14 bp, Homo sapiens
aggatcccactggc

SEQ ID NO: 228364 - DNA, 15 bp, Homo sapiens
aggatccgctgccac

SEQ ID NO: 228365 - DNA, 22 bp, Homo sapiens
aggatccgtgctgtctcctttg

SEQ ID NO: 228366 - DNA, 15 bp, Homo sapiens
aggatcctcctggag

SEQ ID NO: 228367 - DNA, 12 bp, Homo sapiens
aggatcctgcag

SEQ ID NO: 228368 - DNA, 13 bp, Homo sapiens
aggatcctgcagg

SEQ ID NO: 228369 - DNA, 21 bp, Homo sapiens
aggatgaaagacaaagaagga

SEQ ID NO: 228370 - DNA, 21 bp, Homo sapiens
aggatgaagaacacagcatgt

SEQ ID NO: 228371 - DNA, 12 bp, Homo sapiens
aggatgaatgta

SEQ ID NO: 228372 - DNA, 19 bp, Homo sapiens
aggatgacccggggcagct

SEQ ID NO: 228373 - DNA, 16 bp, Homo sapiens
aggatgagctggaagg

SEQ ID NO: 228374 - DNA, 21 bp, Homo sapiens
aggatgaggccgctagaggcc

SEQ ID NO: 228375 - DNA, 19 bp, Homo sapiens
aggatgatgtaattaaaaa

SEQ ID NO: 228376 - DNA, 20 bp, Homo sapiens
aggatgattgtacagaatca

SEQ ID NO: 228377 - DNA, 18 bp, Homo sapiens
aggatgcacggtttctgt

SEQ ID NO: 228378 - DNA, 20 bp, Homo sapiens
aggatgctgaagtacagtcc

SEQ ID NO: 228379 - DNA, 14 bp, Homo sapiens
aggatgcttctgct

SEQ ID NO: 228380 - DNA, 18 bp, Homo sapiens
aggatgcttctgctcaca

SEQ ID NO: 228381 - DNA, 19 bp, Homo sapiens
aggatggaggggtggtcct

SEQ ID NO: 228382 - DNA, 21 bp, Homo sapiens
aggatggatagaaggaaacat

SEQ ID NO: 228383 - DNA, 12 bp, Homo sapiens
aggatgttctgg

SEQ ID NO: 228384 - DNA, 17 bp, Homo sapiens
aggattaatatattgaa

SEQ ID NO: 228385 - DNA, 15 bp, Homo sapiens
aggattccagttgcg

SEQ ID NO: 228386 - DNA, 15 bp, Homo sapiens
aggattctttcccca

SEQ ID NO: 228387 - DNA, 21 bp, Homo sapiens
aggattctttccccagaggct

SEQ ID NO: 228388 - DNA, 18 bp, Homo sapiens
aggattgtacgtgggaga

SEQ ID NO: 228389 - DNA, 19 bp, Homo sapiens
aggattgtacgtgggagag

SEQ ID NO: 228390 - DNA, 23 bp, Homo sapiens
aggattgtttctggtgactgcag

SEQ ID NO: 228391 - DNA, 19 bp, Homo sapiens
aggatttaaaaactggaac

SEQ ID NO: 228392 - DNA, 18 bp, Homo sapiens
aggatttaacagtcattt

SEQ ID NO: 228393 - DNA, 19 bp, Homo sapiens
aggatttcatgatttcatt

SEQ ID NO: 228394 - DNA, 20 bp, Homo sapiens
aggatttcatgatttcattt

SEQ ID NO: 228395 - DNA, 14 bp, Homo sapiens
aggatttggttttt

SEQ ID NO: 228396 - DNA, 19 bp, Homo sapiens
aggattttaacaaaagcaa

SEQ ID NO: 228397 - DNA, 20 bp, Homo sapiens
aggattttggaaaagaaaca

SEQ ID NO: 228398 - DNA, 17 bp, Homo sapiens
aggattttgtattgcca

SEQ ID NO: 228399 - DNA, 16 bp, Homo sapiens
aggattttgtgttttt

SEQ ID NO: 228400 - DNA, 17 bp, Homo sapiens
aggatttttttctgagc

SEQ ID NO: 228401 - DNA, 14 bp, Homo sapiens
aggcaaaaccttgt

SEQ ID NO: 228402 - DNA, 13 bp, Homo sapiens
aggcaaacaatcc

SEQ ID NO: 228403 - DNA, 20 bp, Homo sapiens
aggcaaaggccagcagcaga

SEQ ID NO: 228404 - DNA, 19 bp, Homo sapiens
aggcaaatataagctggga

SEQ ID NO: 228405 - DNA, 13 bp, Homo sapiens
aggcaaatgtcca

SEQ ID NO: 228406 - DNA, 21 bp, Homo sapiens
aggcaacacctgtggataaaa

SEQ ID NO: 228407 - DNA, 19 bp, Homo sapiens
aggcaacattacaaacaaa

SEQ ID NO: 228408 - DNA, 22 bp, Homo sapiens
aggcaacattacaaacaaagga

SEQ ID NO: 228409 - DNA, 17 bp, Homo sapiens
aggcaactagtggagag

SEQ ID NO: 228410 - DNA, 22 bp, Homo sapiens
aggcaactagtggagagaactg

SEQ ID NO: 228411 - DNA, 19 bp, Homo sapiens
aggcaactgaacaaaaaaa

SEQ ID NO: 228412 - DNA, 20 bp, Homo sapiens
aggcaacttttcatttttgc

SEQ ID NO: 228413 - DNA, 13 bp, Homo sapiens
aggcaagagaaat

SEQ ID NO: 228414 - DNA, 14 bp, Homo sapiens
aggcaagagaaatg

SEQ ID NO: 228415 - DNA, 19 bp, Homo sapiens
aggcaagcccctcagccct

SEQ ID NO: 228416 - DNA, 21 bp, Homo sapiens
aggcaagcccctcagcccttg

SEQ ID NO: 228417 - DNA, 18 bp, Homo sapiens
aggcaaggcagctcccag

SEQ ID NO: 228418 - DNA, 13 bp, Homo sapiens
aggcaaggctgcc

SEQ ID NO: 228419 - DNA, 20 bp, Homo sapiens
aggcaaggctgccggctgca

SEQ ID NO: 228420 - DNA, 17 bp, Homo sapiens
aggcaaggctgtcaatt

SEQ ID NO: 228421 - DNA, 15 bp, Homo sapiens
aggcaagtttctagc

SEQ ID NO: 228422 - DNA, 18 bp, Homo sapiens
aggcacaaaaccagaagt

SEQ ID NO: 228423 - DNA, 14 bp, Homo sapiens
aggcacatgtgttc

SEQ ID NO: 228424 - DNA, 20 bp, Homo sapiens
aggcaccagctctgtggcct

SEQ ID NO: 228425 - DNA, 12 bp, Homo sapiens
aggcaccattca

SEQ ID NO: 228426 - DNA, 19 bp, Homo sapiens
aggcaccattcaggaacct

SEQ ID NO: 228427 - DNA, 21 bp, Homo sapiens
aggcaccgcagcctgtcagcc

SEQ ID NO: 228428 - DNA, 13 bp, Homo sapiens
aggcaccggcgct

SEQ ID NO: 228429 - DNA, 14 bp, Homo sapiens
aggcaccggcgctg

SEQ ID NO: 228430 - DNA, 20 bp, Homo sapiens
aggcaccggcgctgcaggta

SEQ ID NO: 228431 - DNA, 13 bp, Homo sapiens
aggcacctgctgg

SEQ ID NO: 228432 - DNA, 16 bp, Homo sapiens
aggcacctgctggaaa

SEQ ID NO: 228433 - DNA, 20 bp, Homo sapiens
aggcacctggcctgctggga

SEQ ID NO: 228434 - DNA, 13 bp, Homo sapiens
aggcacctgggct

SEQ ID NO: 228435 - DNA, 20 bp, Homo sapiens
aggcactgccttctcctctc

SEQ ID NO: 228436 - DNA, 16 bp, Homo sapiens
aggcactgctgcccag

SEQ ID NO: 228437 - DNA, 17 bp, Homo sapiens
aggcagaaagcagaggc

SEQ ID NO: 228438 - DNA, 23 bp, Homo sapiens
aggcagaaagcagaggctggcct

SEQ ID NO: 228439 - DNA, 16 bp, Homo sapiens
aggcagaacctggtgg

SEQ ID NO: 228440 - DNA, 17 bp, Homo sapiens
aggcagaacctggtggc

SEQ ID NO: 228441 - DNA, 21 bp, Homo sapiens
aggcagaatggtgggctccag

SEQ ID NO: 228442 - DNA, 15 bp, Homo sapiens
aggcagacacatgct

SEQ ID NO: 228443 - DNA, 16 bp, Homo sapiens
aggcagacgatgtcaa

SEQ ID NO: 228444 - DNA, 14 bp, Homo sapiens
aggcagagacaata

SEQ ID NO: 228445 - DNA, 22 bp, Homo sapiens
aggcagagattgggggggcttg

SEQ ID NO: 228446 - DNA, 13 bp, Homo sapiens
aggcagaggacag

SEQ ID NO: 228447 - DNA, 22 bp, Homo sapiens
aggcagagtctcattctgttgc

SEQ ID NO: 228448 - DNA, 21 bp, Homo sapiens
aggcagagtgccccacctgcc

SEQ ID NO: 228449 - DNA, 15 bp, Homo sapiens
aggcagatctgtgcc

SEQ ID NO: 228450 - DNA, 20 bp, Homo sapiens
aggcagatctgtgccccatg

SEQ ID NO: 228451 - DNA, 15 bp, Homo sapiens
aggcagcaacaggac

SEQ ID NO: 228452 - DNA, 17 bp, Homo sapiens
aggcagcaacaggacca

SEQ ID NO: 228453 - DNA, 21 bp, Homo sapiens
aggcagcaacaggaccaggag

SEQ ID NO: 228454 - DNA, 15 bp, Homo sapiens
aggcagccccctcca

SEQ ID NO: 228455 - DNA, 11 bp, Homo sapiens
aggcagcctcc

SEQ ID NO: 228456 - DNA, 20 bp, Homo sapiens
aggcagcctccagagccagc

SEQ ID NO: 228457 - DNA, 21 bp, Homo sapiens
aggcagcctccagagccagcc

SEQ ID NO: 228458 - DNA, 14 bp, Homo sapiens
aggcagcctctctg

SEQ ID NO: 228459 - DNA, 11 bp, Homo sapiens
aggcagcctgc

SEQ ID NO: 228460 - DNA, 13 bp, Homo sapiens
aggcaggaaggat

SEQ ID NO: 228461 - DNA, 16 bp, Homo sapiens
aggcaggaagtcagga

SEQ ID NO: 228462 - DNA, 18 bp, Homo sapiens
aggcaggaagtcaggagc

SEQ ID NO: 228463 - DNA, 22 bp, Homo sapiens
aggcaggaagtcaggagccagc

SEQ ID NO: 228464 - DNA, 18 bp, Homo sapiens
aggcaggaggtgggtgag

SEQ ID NO: 228465 - DNA, 13 bp, Homo sapiens
aggcaggagtggc

SEQ ID NO: 228466 - DNA, 15 bp, Homo sapiens
aggcaggagtggcag

SEQ ID NO: 228467 - DNA, 20 bp, Homo sapiens
aggcaggatcaaagacacac

SEQ ID NO: 228468 - DNA, 22 bp, Homo sapiens
aggcaggccaaggccttctcct

SEQ ID NO: 228469 - DNA, 13 bp, Homo sapiens
aggcaggcctttc

SEQ ID NO: 228470 - DNA, 14 bp, Homo sapiens
aggcaggcctttcc

SEQ ID NO: 228471 - DNA, 15 bp, Homo sapiens
aggcaggcctttcct

SEQ ID NO: 228472 - DNA, 12 bp, Homo sapiens
aggcagggaggg

SEQ ID NO: 228473 - DNA, 14 bp, Homo sapiens
aggcagggatttga

SEQ ID NO: 228474 - DNA, 15 bp, Homo sapiens
aggcagggatttgag

SEQ ID NO: 228475 - DNA, 12 bp, Homo sapiens
aggcaggggctg

SEQ ID NO: 228476 - DNA, 21 bp, Homo sapiens
aggcaggggctgggcagaggg

SEQ ID NO: 228477 - DNA, 23 bp, Homo sapiens
aggcaggggctgggcagagggga

SEQ ID NO: 228478 - DNA, 23 bp, Homo sapiens
aggcagggttttatctctgtcta

SEQ ID NO: 228479 - DNA, 19 bp, Homo sapiens
aggcagtatggcggaggcc

SEQ ID NO: 228480 - DNA, 23 bp, Homo sapiens
aggcagtattccctttttaaatg

SEQ ID NO: 228481 - DNA, 11 bp, Homo sapiens
aggcagtctga

SEQ ID NO: 228482 - DNA, 15 bp, Homo sapiens
aggcagtctttgctc

SEQ ID NO: 228483 - DNA, 21 bp, Homo sapiens
aggcagtgaacacactcagca

SEQ ID NO: 228484 - DNA, 14 bp, Homo sapiens
aggcagtgcatgtg

SEQ ID NO: 228485 - DNA, 12 bp, Homo sapiens
aggcagtggcag

SEQ ID NO: 228486 - DNA, 22 bp, Homo sapiens
aggcagtgttcctcaccaataa

SEQ ID NO: 228487 - DNA, 23 bp, Homo sapiens
aggcagtttttgttccttcctgc

SEQ ID NO: 228488 - DNA, 18 bp, Homo sapiens
aggcatactctccaggat

SEQ ID NO: 228489 - DNA, 18 bp, Homo sapiens
aggcataggcctgggtgc

SEQ ID NO: 228490 - DNA, 18 bp, Homo sapiens
aggcatctaagacattca

SEQ ID NO: 228491 - DNA, 15 bp, Homo sapiens
aggcatctcctctcc

SEQ ID NO: 228492 - DNA, 17 bp, Homo sapiens
aggcatctcctctcccc

SEQ ID NO: 228493 - DNA, 18 bp, Homo sapiens
aggcatctcctctcccca

SEQ ID NO: 228494 - DNA, 16 bp, Homo sapiens
aggcatctgtaagaag

SEQ ID NO: 228495 - DNA, 18 bp, Homo sapiens
aggcatctgtaagaagta

SEQ ID NO: 228496 - DNA, 19 bp, Homo sapiens
aggcatctgtaagaagtag

SEQ ID NO: 228497 - DNA, 14 bp, Homo sapiens
aggcatgacagctg

SEQ ID NO: 228498 - DNA, 13 bp, Homo sapiens
aggcatgaccctg

SEQ ID NO: 228499 - DNA, 22 bp, Homo sapiens
tgctcctcagggtccctcagga

SEQ ID NO: 228500 - DNA, 13 bp, Homo sapiens
tgctcctcctgcc

SEQ ID NO: 228501 - DNA, 15 bp, Homo sapiens
tgctcctcctgccct

SEQ ID NO: 228502 - DNA, 16 bp, Homo sapiens
tgctcctcctgccctg

SEQ ID NO: 228503 - DNA, 13 bp, Homo sapiens
tgctcctcggcca

SEQ ID NO: 228504 - DNA, 15 bp, Homo sapiens
tgctcctcggccaga

SEQ ID NO: 228505 - DNA, 14 bp, Homo sapiens
tgctcctggagcct

SEQ ID NO: 228506 - DNA, 20 bp, Homo sapiens
tgctcctggagcctttgaat

SEQ ID NO: 228507 - DNA, 16 bp, Homo sapiens
tgctcctgtttaactc

SEQ ID NO: 228508 - DNA, 15 bp, Homo sapiens
tgctccttgaataag

SEQ ID NO: 228509 - DNA, 19 bp, Homo sapiens
tgctccttggcacccccat

SEQ ID NO: 228510 - DNA, 22 bp, Homo sapiens
tgctccttggcacccccatgct

SEQ ID NO: 228511 - DNA, 20 bp, Homo sapiens
tgctccttggcctagtcaga

SEQ ID NO: 228512 - DNA, 12 bp, Homo sapiens
tgctcggacaca

SEQ ID NO: 228513 - DNA, 22 bp, Homo sapiens
tgctcggacacagttttgtctt

SEQ ID NO: 228514 - DNA, 15 bp, Homo sapiens
tgctcggccgtcttc

SEQ ID NO: 228515 - DNA, 17 bp, Homo sapiens
tgctctaagcacacgga

SEQ ID NO: 228516 - DNA, 12 bp, Homo sapiens
tgctctagccag

SEQ ID NO: 228517 - DNA, 22 bp, Homo sapiens
tgctctagccaggagtctgtgc

SEQ ID NO: 228518 - DNA, 14 bp, Homo sapiens
tgctctagctggca

SEQ ID NO: 228519 - DNA, 16 bp, Homo sapiens
tgctctagctggcagg

SEQ ID NO: 228520 - DNA, 17 bp, Homo sapiens
tgctctagctggcagga

SEQ ID NO: 228521 - DNA, 20 bp, Homo sapiens
tgctctcccctgccctgctg

SEQ ID NO: 228522 - DNA, 18 bp, Homo sapiens
tgctctcctcttgccact

SEQ ID NO: 228523 - DNA, 22 bp, Homo sapiens
tgctctcctcttgccactgcct

SEQ ID NO: 228524 - DNA, 14 bp, Homo sapiens
tgctctccttcact

SEQ ID NO: 228525 - DNA, 16 bp, Homo sapiens
tgctctctacccagcc

SEQ ID NO: 228526 - DNA, 20 bp, Homo sapiens
tgctctgaatgggagccaga

SEQ ID NO: 228527 - DNA, 18 bp, Homo sapiens
tgctctgagaagaggagc

SEQ ID NO: 228528 - DNA, 18 bp, Homo sapiens
tgctctgcagcccacaga

SEQ ID NO: 228529 - DNA, 19 bp, Homo sapiens
tgctctgcagcccacagag

SEQ ID NO: 228530 - DNA, 15 bp, Homo sapiens
tgctctgcccagagc

SEQ ID NO: 228531 - DNA, 17 bp, Homo sapiens
tgctctgcccagagctg

SEQ ID NO: 228532 - DNA, 20 bp, Homo sapiens
tgctctgcccagagctgggt

SEQ ID NO: 228533 - DNA, 22 bp, Homo sapiens
tgctctgcccagagctgggtga

SEQ ID NO: 228534 - DNA, 12 bp, Homo sapiens
tgctctgcccct

SEQ ID NO: 228535 - DNA, 13 bp, Homo sapiens
tgctctgcccctt

SEQ ID NO: 228536 - DNA, 14 bp, Homo sapiens
tgctctgccccttg

SEQ ID NO: 228537 - DNA, 18 bp, Homo sapiens
tgctctgctggtcttcaa

SEQ ID NO: 228538 - DNA, 15 bp, Homo sapiens
tgctctggaagcctg

SEQ ID NO: 228539 - DNA, 16 bp, Homo sapiens
tgctctggcggcttcc

SEQ ID NO: 228540 - DNA, 23 bp, Homo sapiens
tgctctggcggcttcctgtccac

SEQ ID NO: 228541 - DNA, 19 bp, Homo sapiens
tgctctggctggagaggaa

SEQ ID NO: 228542 - DNA, 12 bp, Homo sapiens
tgctctggggat

SEQ ID NO: 228543 - DNA, 20 bp, Homo sapiens
tgctctggggatttctggga

SEQ ID NO: 228544 - DNA, 17 bp, Homo sapiens
tgctcttatgccatttg

SEQ ID NO: 228545 - DNA, 13 bp, Homo sapiens
tgctcttctctta

SEQ ID NO: 228546 - DNA, 15 bp, Homo sapiens
tgctcttgcatctgg

SEQ ID NO: 228547 - DNA, 14 bp, Homo sapiens
tgctctttcctgcc

SEQ ID NO: 228548 - DNA, 16 bp, Homo sapiens
tgctctttcctgccct

SEQ ID NO: 228549 - DNA, 14 bp, Homo sapiens
tgctctttctctgc

SEQ ID NO: 228550 - DNA, 15 bp, Homo sapiens
tgctctttctctgcc

SEQ ID NO: 228551 - DNA, 17 bp, Homo sapiens
tgctctttctctgccag

SEQ ID NO: 228552 - DNA, 16 bp, Homo sapiens
tgctctttgtggcagt

SEQ ID NO: 228553 - DNA, 20 bp, Homo sapiens
tgctcttttggtggggagca

SEQ ID NO: 228554 - DNA, 22 bp, Homo sapiens
tgctcttttggtggggagcact

SEQ ID NO: 228555 - DNA, 20 bp, Homo sapiens
tgctgaaaaccatctggcct

SEQ ID NO: 228556 - DNA, 21 bp, Homo sapiens
tgctgaaaaccatctggcctg

SEQ ID NO: 228557 - DNA, 15 bp, Homo sapiens
tgctgaacaaaaaat

SEQ ID NO: 228558 - DNA, 14 bp, Homo sapiens
tgctgaacagtgga

SEQ ID NO: 228559 - DNA, 22 bp, Homo sapiens
tgctgaactaagttttgtgtgt

SEQ ID NO: 228560 - DNA, 15 bp, Homo sapiens
tgctgaactgtgcat

SEQ ID NO: 228561 - DNA, 18 bp, Homo sapiens
tgctgaagcttattaatg

SEQ ID NO: 228562 - DNA, 22 bp, Homo sapiens
tgctgaaggtggggattgccca

SEQ ID NO: 228563 - DNA, 19 bp, Homo sapiens
tgctgaatatctgttcact

SEQ ID NO: 228564 - DNA, 16 bp, Homo sapiens
tgctgaccccaggaag

SEQ ID NO: 228565 - DNA, 18 bp, Homo sapiens
tgctgaccccaggaagtg

SEQ ID NO: 228566 - DNA, 22 bp, Homo sapiens
tgctgaccttggaggaatgaca

SEQ ID NO: 228567 - DNA, 14 bp, Homo sapiens
tgctgacttctgag

SEQ ID NO: 228568 - DNA, 15 bp, Homo sapiens
tgctgagaaatgggg

SEQ ID NO: 228569 - DNA, 14 bp, Homo sapiens
tgctgagaagcttt

SEQ ID NO: 228570 - DNA, 17 bp, Homo sapiens
tgctgagagcccccacc

SEQ ID NO: 228571 - DNA, 19 bp, Homo sapiens
tgctgagcaccctctccgg

SEQ ID NO: 228572 - DNA, 15 bp, Homo sapiens
tgctgagcttagcct

SEQ ID NO: 228573 - DNA, 18 bp, Homo sapiens
tgctgagcttagccttgt

SEQ ID NO: 228574 - DNA, 23 bp, Homo sapiens
tgctgagcttagccttgtgccct

SEQ ID NO: 228575 - DNA, 15 bp, Homo sapiens
tgctgaggactccct

SEQ ID NO: 228576 - DNA, 15 bp, Homo sapiens
tgctgatcgccttat

SEQ ID NO: 228577 - DNA, 21 bp, Homo sapiens
tgctgatggcttgacatgtgc

SEQ ID NO: 228578 - DNA, 23 bp, Homo sapiens
tgctgatggcttgacatgtgcaa

SEQ ID NO: 228579 - DNA, 24 bp, Homo sapiens
tgctgatggcttgacatgtgcaat

SEQ ID NO: 228580 - DNA, 15 bp, Homo sapiens
tgctgcaccagagtg

SEQ ID NO: 228581 - DNA, 16 bp, Homo sapiens
tgctgcaccagagtga

SEQ ID NO: 228582 - DNA, 17 bp, Homo sapiens
tgctgcacctgaggccc

SEQ ID NO: 228583 - DNA, 19 bp, Homo sapiens
tgctgcagacaaaaagaac

SEQ ID NO: 228584 - DNA, 23 bp, Homo sapiens
tgctgccaagtcctgcctttggg

SEQ ID NO: 228585 - DNA, 15 bp, Homo sapiens
tgctgccacacttca

SEQ ID NO: 228586 - DNA, 19 bp, Homo sapiens
tgctgccaccaaatctgtc

SEQ ID NO: 228587 - DNA, 21 bp, Homo sapiens
tgctgccaccaaatctgtcta

SEQ ID NO: 228588 - DNA, 12 bp, Homo sapiens
tgctgccatgcc

SEQ ID NO: 228589 - DNA, 15 bp, Homo sapiens
tgctgccatgccact

SEQ ID NO: 228590 - DNA, 18 bp, Homo sapiens
tgctgccatttttgcaaa

SEQ ID NO: 228591 - DNA, 11 bp, Homo sapiens
tgctgcccacg

SEQ ID NO: 228592 - DNA, 16 bp, Homo sapiens
tgctgcccacggccac

SEQ ID NO: 228593 - DNA, 16 bp, Homo sapiens
tgctgcccccagaccc

SEQ ID NO: 228594 - DNA, 19 bp, Homo sapiens
tgctgccccgttccctgtc

SEQ ID NO: 228595 - DNA, 15 bp, Homo sapiens
tgctgcctcaggaat

SEQ ID NO: 228596 - DNA, 12 bp, Homo sapiens
tgctgcctcccc

SEQ ID NO: 228597 - DNA, 13 bp, Homo sapiens
tgctgcctcccca

SEQ ID NO: 228598 - DNA, 14 bp, Homo sapiens
tgctgcctctgaaa

SEQ ID NO: 228599 - DNA, 23 bp, Homo sapiens
tgctgcctgcccgcacagcagcc

SEQ ID NO: 228600 - DNA, 12 bp, Homo sapiens
tgctgcctgcct

SEQ ID NO: 228601 - DNA, 14 bp, Homo sapiens
tgctgcctgcctgt

SEQ ID NO: 228602 - DNA, 16 bp, Homo sapiens
tgctgccttcagggag

SEQ ID NO: 228603 - DNA, 20 bp, Homo sapiens
tgctgccttctgacggccct

SEQ ID NO: 228604 - DNA, 21 bp, Homo sapiens
tgctgccttctgacggccctg

SEQ ID NO: 228605 - DNA, 22 bp, Homo sapiens
tgctgccttctgacggccctgc

SEQ ID NO: 228606 - DNA, 23 bp, Homo sapiens
tgctgccttctgacggccctgca

SEQ ID NO: 228607 - DNA, 15 bp, Homo sapiens
tgctgcgcccttccc

SEQ ID NO: 228608 - DNA, 23 bp, Homo sapiens
tgctgcgggtgggtatcccacct

SEQ ID NO: 228609 - DNA, 20 bp, Homo sapiens
tgctgcgtcagaccagtact

SEQ ID NO: 228610 - DNA, 18 bp, Homo sapiens
tgctgctaccgccctggg

SEQ ID NO: 228611 - DNA, 20 bp, Homo sapiens
tgctgctaccgccctgggct

SEQ ID NO: 228612 - DNA, 22 bp, Homo sapiens
tgctgctaccgccctgggctgg

SEQ ID NO: 228613 - DNA, 19 bp, Homo sapiens
tgctgctatcctgccaaaa

SEQ ID NO: 228614 - DNA, 15 bp, Homo sapiens
tgctgctatgaaaat

SEQ ID NO: 228615 - DNA, 14 bp, Homo sapiens
tgctgctccccacc

SEQ ID NO: 228616 - DNA, 23 bp, Homo sapiens
tgctgctcccgcctgattggggc

SEQ ID NO: 228617 - DNA, 21 bp, Homo sapiens
tgctgctcctcggccagagct

SEQ ID NO: 228618 - DNA, 23 bp, Homo sapiens
tgctgctcctcggccagagctcc

SEQ ID NO: 228619 - DNA, 21 bp, Homo sapiens
tgctgctcctctttcccctcc

SEQ ID NO: 228620 - DNA, 20 bp, Homo sapiens
tgctgctcgggaaggcctga

SEQ ID NO: 228621 - DNA, 13 bp, Homo sapiens
tgctgctgcctcc

SEQ ID NO: 228622 - DNA, 16 bp, Homo sapiens
tgctgctgctgcgccc

SEQ ID NO: 228623 - DNA, 13 bp, Homo sapiens
tgctgctggacag

SEQ ID NO: 228624 - DNA, 18 bp, Homo sapiens
tgctgctgtaactgctga

SEQ ID NO: 228625 - DNA, 21 bp, Homo sapiens
tgctgctgtaactgctgagcc

SEQ ID NO: 228626 - DNA, 22 bp, Homo sapiens
tgctgctgtaactgctgagcca

SEQ ID NO: 228627 - DNA, 14 bp, Homo sapiens
tgctgctgtgcctg

SEQ ID NO: 228628 - DNA, 14 bp, Homo sapiens
tgctgctgtggaaa

SEQ ID NO: 228629 - DNA, 15 bp, Homo sapiens
tgctgcttccctctg

SEQ ID NO: 228630 - DNA, 12 bp, Homo sapiens
tgctgcttccta

SEQ ID NO: 228631 - DNA, 17 bp, Homo sapiens
tgctgcttctgggcctg

SEQ ID NO: 228632 - DNA, 24 bp, Homo sapiens
tgctgcttctgggcctgatggaga

SEQ ID NO: 228633 - DNA, 19 bp, Homo sapiens
aggcatgcgaatgagctgg

SEQ ID NO: 228634 - DNA, 15 bp, Homo sapiens
aggcatgctcccagc

SEQ ID NO: 228635 - DNA, 18 bp, Homo sapiens
aggcatggcccagcctgg

SEQ ID NO: 228636 - DNA, 21 bp, Homo sapiens
aggcatggcccagcctggagc

SEQ ID NO: 228637 - DNA, 22 bp, Homo sapiens
aggcattcccagaggtggggaa

SEQ ID NO: 228638 - DNA, 22 bp, Homo sapiens
aggcattctttagtctacatag

SEQ ID NO: 228639 - DNA, 21 bp, Homo sapiens
aggcattgtttttaagaaaaa

SEQ ID NO: 228640 - DNA, 17 bp, Homo sapiens
aggccaaatgcacaagc

SEQ ID NO: 228641 - DNA, 16 bp, Homo sapiens
aggccaagcctgcagc

SEQ ID NO: 228642 - DNA, 13 bp, Homo sapiens
aggccaaggcctc

SEQ ID NO: 228643 - DNA, 14 bp, Homo sapiens
aggccaaggcctca

SEQ ID NO: 228644 - DNA, 15 bp, Homo sapiens
aggccacacgctgcc

SEQ ID NO: 228645 - DNA, 16 bp, Homo sapiens
aggccacacgctgccc

SEQ ID NO: 228646 - DNA, 17 bp, Homo sapiens
aggccacacgctgccca

SEQ ID NO: 228647 - DNA, 20 bp, Homo sapiens
aggccacacgctgcccaggc

SEQ ID NO: 228648 - DNA, 18 bp, Homo sapiens
aggccacatgagtcccag

SEQ ID NO: 228649 - DNA, 22 bp, Homo sapiens
aggccaccatctgtaccctgct

SEQ ID NO: 228650 - DNA, 20 bp, Homo sapiens
aggccacccactgtggggca

SEQ ID NO: 228651 - DNA, 19 bp, Homo sapiens
aggccacctgcccccttct

SEQ ID NO: 228652 - DNA, 22 bp, Homo sapiens
aggccacctgcccccttctccc

SEQ ID NO: 228653 - DNA, 13 bp, Homo sapiens
aggccacggcagc

SEQ ID NO: 228654 - DNA, 22 bp, Homo sapiens
aggccacgggggaggccgaggc

SEQ ID NO: 228655 - DNA, 23 bp, Homo sapiens
aggccacgggggaggccgaggca

SEQ ID NO: 228656 - DNA, 20 bp, Homo sapiens
aggccacgtatagtcctagc

SEQ ID NO: 228657 - DNA, 19 bp, Homo sapiens
aggccacttgctcagacga

SEQ ID NO: 228658 - DNA, 16 bp, Homo sapiens
aggccagagtggcctg

SEQ ID NO: 228659 - DNA, 20 bp, Homo sapiens
aggccagagtggcctggcca

SEQ ID NO: 228660 - DNA, 21 bp, Homo sapiens
aggccagagtggcctggccag

SEQ ID NO: 228661 - DNA, 20 bp, Homo sapiens
aggccagcgaggcgaggctg

SEQ ID NO: 228662 - DNA, 19 bp, Homo sapiens
aggccagcgtgaaggacct

SEQ ID NO: 228663 - DNA, 18 bp, Homo sapiens
aggccagcttcgtgctgg

SEQ ID NO: 228664 - DNA, 13 bp, Homo sapiens
aggccaggccctc

SEQ ID NO: 228665 - DNA, 13 bp, Homo sapiens
aggccaggggctt

SEQ ID NO: 228666 - DNA, 16 bp, Homo sapiens
aggccaggggcttttg

SEQ ID NO: 228667 - DNA, 17 bp, Homo sapiens
aggccagtggacagagg

SEQ ID NO: 228668 - DNA, 20 bp, Homo sapiens
aggccagtggacagagggag

SEQ ID NO: 228669 - DNA, 16 bp, Homo sapiens
aggccatctgtaaata

SEQ ID NO: 228670 - DNA, 17 bp, Homo sapiens
aggccatctgtaaatat

SEQ ID NO: 228671 - DNA, 23 bp, Homo sapiens
aggccatctgtaaatatcccaga

SEQ ID NO: 228672 - DNA, 22 bp, Homo sapiens
aggccatgggggcccctcggca

SEQ ID NO: 228673 - DNA, 15 bp, Homo sapiens
aggccatgtgagcca

SEQ ID NO: 228674 - DNA, 20 bp, Homo sapiens
aggccatgtgagccaccgct

SEQ ID NO: 228675 - DNA, 22 bp, Homo sapiens
aggccattccctgtaggagtaa

SEQ ID NO: 228676 - DNA, 22 bp, Homo sapiens
aggcccaaattatcaagctaat

SEQ ID NO: 228677 - DNA, 23 bp, Homo sapiens
aggcccaaattatcaagctaata

SEQ ID NO: 228678 - DNA, 20 bp, Homo sapiens
aggcccaagagcagagtctg

SEQ ID NO: 228679 - DNA, 21 bp, Homo sapiens
aggcccaagagcagagtctgg

SEQ ID NO: 228680 - DNA, 22 bp, Homo sapiens
aggcccaagagcagagtctggg

SEQ ID NO: 228681 - DNA, 16 bp, Homo sapiens
aggcccagagagctga

SEQ ID NO: 228682 - DNA, 18 bp, Homo sapiens
aggcccagaggagccaag

SEQ ID NO: 228683 - DNA, 13 bp, Homo sapiens
aggcccagcctgg

SEQ ID NO: 228684 - DNA, 17 bp, Homo sapiens
aggcccagcctggcccc

SEQ ID NO: 228685 - DNA, 18 bp, Homo sapiens
aggcccagcctggcccca

SEQ ID NO: 228686 - DNA, 14 bp, Homo sapiens
aggcccagcctgtc

SEQ ID NO: 228687 - DNA, 18 bp, Homo sapiens
aggcccagcctgtcctgg

SEQ ID NO: 228688 - DNA, 19 bp, Homo sapiens
aggcccagcctgtcctggt

SEQ ID NO: 228689 - DNA, 21 bp, Homo sapiens
aggcccagcctgtcctggtac

SEQ ID NO: 228690 - DNA, 19 bp, Homo sapiens
aggcccatctcaggtgcca

SEQ ID NO: 228691 - DNA, 21 bp, Homo sapiens
aggcccatctcaggtgccact

SEQ ID NO: 228692 - DNA, 18 bp, Homo sapiens
aggcccatgggcagaaga

SEQ ID NO: 228693 - DNA, 23 bp, Homo sapiens
aggcccatgggcagaagatagag

SEQ ID NO: 228694 - DNA, 12 bp, Homo sapiens
aggccccagcca

SEQ ID NO: 228695 - DNA, 18 bp, Homo sapiens
aggccccagccaagtgcc

SEQ ID NO: 228696 - DNA, 15 bp, Homo sapiens
aggccccagcctcca

SEQ ID NO: 228697 - DNA, 22 bp, Homo sapiens
aggcccccaaacatagcccctg

SEQ ID NO: 228698 - DNA, 20 bp, Homo sapiens
aggcccccaaattgccttca

SEQ ID NO: 228699 - DNA, 13 bp, Homo sapiens
aggcccccggagg

SEQ ID NO: 228700 - DNA, 16 bp, Homo sapiens
aggcccctgaggactg

SEQ ID NO: 228701 - DNA, 20 bp, Homo sapiens
aggcccctgaggactggaga

SEQ ID NO: 228702 - DNA, 12 bp, Homo sapiens
aggcccctggcc

SEQ ID NO: 228703 - DNA, 16 bp, Homo sapiens
aggcccctggcccagc

SEQ ID NO: 228704 - DNA, 21 bp, Homo sapiens
aggcccggcccagcctaggcc

SEQ ID NO: 228705 - DNA, 16 bp, Homo sapiens
aggccctccatgggct

SEQ ID NO: 228706 - DNA, 17 bp, Homo sapiens
aggccctccatgggcta

SEQ ID NO: 228707 - DNA, 17 bp, Homo sapiens
aggccctcctgctggct

SEQ ID NO: 228708 - DNA, 11 bp, Homo sapiens
aggccctgcag

SEQ ID NO: 228709 - DNA, 13 bp, Homo sapiens
aggccctgcagtg

SEQ ID NO: 228710 - DNA, 19 bp, Homo sapiens
aggccctggtggagaggcc

SEQ ID NO: 228711 - DNA, 13 bp, Homo sapiens
aggccctgtctgt

SEQ ID NO: 228712 - DNA, 18 bp, Homo sapiens
aggcccttcctctccact

SEQ ID NO: 228713 - DNA, 13 bp, Homo sapiens
aggcccttgtcct

SEQ ID NO: 228714 - DNA, 21 bp, Homo sapiens
aggcccttgtcctgccagctg

SEQ ID NO: 228715 - DNA, 15 bp, Homo sapiens
tgctgcttgtgcctc

SEQ ID NO: 228716 - DNA, 15 bp, Homo sapiens
tgctgctttccttcg

SEQ ID NO: 228717 - DNA, 18 bp, Homo sapiens
tgctgctttttggcacag

SEQ ID NO: 228718 - DNA, 21 bp, Homo sapiens
tgctggaccaaggtgcggacc

SEQ ID NO: 228719 - DNA, 16 bp, Homo sapiens
tgctggagtgctggct

SEQ ID NO: 228720 - DNA, 17 bp, Homo sapiens
tgctggataaaatgagg

SEQ ID NO: 228721 - DNA, 16 bp, Homo sapiens
tgctggatattttcaa

SEQ ID NO: 228722 - DNA, 12 bp, Homo sapiens
tgctggccccaa

SEQ ID NO: 228723 - DNA, 24 bp, Homo sapiens
tgctggcccctcacctgggcacct

SEQ ID NO: 228724 - DNA, 22 bp, Homo sapiens
tgctggcctcccaataaagctg

SEQ ID NO: 228725 - DNA, 20 bp, Homo sapiens
tgctggcctgcgcctgcacc

SEQ ID NO: 228726 - DNA, 14 bp, Homo sapiens
tgctggcctggatc

SEQ ID NO: 228727 - DNA, 16 bp, Homo sapiens
tgctggcctggatctc

SEQ ID NO: 228728 - DNA, 22 bp, Homo sapiens
tgctggctccacgccctgggga

SEQ ID NO: 228729 - DNA, 23 bp, Homo sapiens
tgctggctccacgccctggggag

SEQ ID NO: 228730 - DNA, 15 bp, Homo sapiens
tgctggctcccaggg

SEQ ID NO: 228731 - DNA, 21 bp, Homo sapiens
tgctggctgcccagacccctc

SEQ ID NO: 228732 - DNA, 21 bp, Homo sapiens
tgctggctgccttagaacctt

SEQ ID NO: 228733 - DNA, 20 bp, Homo sapiens
tgctgggaaccccgcagccc

SEQ ID NO: 228734 - DNA, 13 bp, Homo sapiens
tgctgggacagct

SEQ ID NO: 228735 - DNA, 17 bp, Homo sapiens
tgctgggacagctaggc

SEQ ID NO: 228736 - DNA, 20 bp, Homo sapiens
tgctgggactgagccagtcc

SEQ ID NO: 228737 - DNA, 17 bp, Homo sapiens
tgctgggccagtggctg

SEQ ID NO: 228738 - DNA, 19 bp, Homo sapiens
tgctgggccagtggctggg

SEQ ID NO: 228739 - DNA, 12 bp, Homo sapiens
tgctgggcccag

SEQ ID NO: 228740 - DNA, 20 bp, Homo sapiens
tgctggggcatgtgtgcctg

SEQ ID NO: 228741 - DNA, 21 bp, Homo sapiens
tgctggggcatgtgtgcctgt

SEQ ID NO: 228742 - DNA, 10 bp, Homo sapiens
tgctggggct

SEQ ID NO: 228743 - DNA, 21 bp, Homo sapiens
tgctggggtacacagtgagag

SEQ ID NO: 228744 - DNA, 14 bp, Homo sapiens
tgctgggtgggaat

SEQ ID NO: 228745 - DNA, 15 bp, Homo sapiens
tgctgggtttccaca

SEQ ID NO: 228746 - DNA, 19 bp, Homo sapiens
tgctgggtttccacacagc

SEQ ID NO: 228747 - DNA, 21 bp, Homo sapiens
tgctgggtttccacacagcct

SEQ ID NO: 228748 - DNA, 22 bp, Homo sapiens
tgctggtaatttgtatctgaag

SEQ ID NO: 228749 - DNA, 18 bp, Homo sapiens
tgctggttgttgccaggt

SEQ ID NO: 228750 - DNA, 20 bp, Homo sapiens
tgctggttgttgccaggttg

SEQ ID NO: 228751 - DNA, 15 bp, Homo sapiens
tgctggttttcctaa

SEQ ID NO: 228752 - DNA, 22 bp, Homo sapiens
tgctggttttcctaaatgcagt

SEQ ID NO: 228753 - DNA, 16 bp, Homo sapiens
tgctgtaaataaaaat

SEQ ID NO: 228754 - DNA, 18 bp, Homo sapiens
tgctgtaaataaaaatag

SEQ ID NO: 228755 - DNA, 19 bp, Homo sapiens
tgctgtaactgctgagcca

SEQ ID NO: 228756 - DNA, 15 bp, Homo sapiens
tgctgtaagcacctg

SEQ ID NO: 228757 - DNA, 13 bp, Homo sapiens
tgctgtagagact

SEQ ID NO: 228758 - DNA, 14 bp, Homo sapiens
tgctgtagagactt

SEQ ID NO: 228759 - DNA, 20 bp, Homo sapiens
tgctgtccccttccaggggt

SEQ ID NO: 228760 - DNA, 13 bp, Homo sapiens
tgctgtccctcct

SEQ ID NO: 228761 - DNA, 17 bp, Homo sapiens
tgctgtcccttacgtga

SEQ ID NO: 228762 - DNA, 16 bp, Homo sapiens
tgctgtgaaacagtgt

SEQ ID NO: 228763 - DNA, 15 bp, Homo sapiens
tgctgtgaaatgact

SEQ ID NO: 228764 - DNA, 18 bp, Homo sapiens
tgctgtgaacaagtgaac

SEQ ID NO: 228765 - DNA, 22 bp, Homo sapiens
tgctgtgacaataagtttgaac

SEQ ID NO: 228766 - DNA, 13 bp, Homo sapiens
tgctgtgaggctg

SEQ ID NO: 228767 - DNA, 14 bp, Homo sapiens
tgctgtgaggctgt

SEQ ID NO: 228768 - DNA, 11 bp, Homo sapiens
tgctgtgccaa

SEQ ID NO: 228769 - DNA, 15 bp, Homo sapiens
tgctgtgccaggagg

SEQ ID NO: 228770 - DNA, 11 bp, Homo sapiens
tgctgtgcctg

SEQ ID NO: 228771 - DNA, 12 bp, Homo sapiens
tgctgtgcctgc

SEQ ID NO: 228772 - DNA, 18 bp, Homo sapiens
tgctgtgcctgctagagc

SEQ ID NO: 228773 - DNA, 18 bp, Homo sapiens
tgctgtgctctttgaaga

SEQ ID NO: 228774 - DNA, 20 bp, Homo sapiens
tgctgtgggtattcaccacc

SEQ ID NO: 228775 - DNA, 19 bp, Homo sapiens
tgctgtgggtcagtgtgcc

SEQ ID NO: 228776 - DNA, 14 bp, Homo sapiens
tgctgtggtctctt

SEQ ID NO: 228777 - DNA, 13 bp, Homo sapiens
tgctgttcattga

SEQ ID NO: 228778 - DNA, 15 bp, Homo sapiens
tgctgttgccatagc

SEQ ID NO: 228779 - DNA, 17 bp, Homo sapiens
tgctgtttagcttcctc

SEQ ID NO: 228780 - DNA, 18 bp, Homo sapiens
tgctgtttagcttcctcc

SEQ ID NO: 228781 - DNA, 19 bp, Homo sapiens
tgctgtttagcttcctcca

SEQ ID NO: 228782 - DNA, 15 bp, Homo sapiens
tgctgttttgttctg

SEQ ID NO: 228783 - DNA, 19 bp, Homo sapiens
tgcttaaaaatcattgatt

SEQ ID NO: 228784 - DNA, 12 bp, Homo sapiens
tgcttaaaagac

SEQ ID NO: 228785 - DNA, 13 bp, Homo sapiens
tgcttaaacaaag

SEQ ID NO: 228786 - DNA, 16 bp, Homo sapiens
tgcttaaacaaagtga

SEQ ID NO: 228787 - DNA, 16 bp, Homo sapiens
tgcttaagcagaagca

SEQ ID NO: 228788 - DNA, 11 bp, Homo sapiens
tgcttaataaa

SEQ ID NO: 228789 - DNA, 18 bp, Homo sapiens
tgcttaattgtgaacagc

SEQ ID NO: 228790 - DNA, 19 bp, Homo sapiens
tgcttaatttctaaagata

SEQ ID NO: 228791 - DNA, 21 bp, Homo sapiens
tgcttacaattccctgctgtc

SEQ ID NO: 228792 - DNA, 17 bp, Homo sapiens
tgcttacatttttacaa

SEQ ID NO: 228793 - DNA, 18 bp, Homo sapiens
tggacacttaattctgtt

SEQ ID NO: 228794 - DNA, 20 bp, Homo sapiens
tggacacttaattctgttct

SEQ ID NO: 228795 - DNA, 14 bp, Homo sapiens
tggacagacacaga

SEQ ID NO: 228796 - DNA, 18 bp, Homo sapiens
tggacagagggagaaggg

SEQ ID NO: 228797 - DNA, 18 bp, Homo sapiens
tggacagcaaaaccattg

SEQ ID NO: 228798 - DNA, 21 bp, Homo sapiens
tggacagcaaaaccattgctt

SEQ ID NO: 228799 - DNA, 17 bp, Homo sapiens
tggacagggccagggtt

SEQ ID NO: 228800 - DNA, 13 bp, Homo sapiens
tggacaggtctgg

SEQ ID NO: 228801 - DNA, 14 bp, Homo sapiens
tggacaggtctggg

SEQ ID NO: 228802 - DNA, 16 bp, Homo sapiens
tggacaggtctgggag

SEQ ID NO: 228803 - DNA, 19 bp, Homo sapiens
tggacatcctcttctgctt

SEQ ID NO: 228804 - DNA, 16 bp, Homo sapiens
tggacatcgatatgaa

SEQ ID NO: 228805 - DNA, 19 bp, Homo sapiens
tggacatcgatatgaaaaa

SEQ ID NO: 228806 - DNA, 19 bp, Homo sapiens
tggaccaccagccccagca

SEQ ID NO: 228807 - DNA, 21 bp, Homo sapiens
tggaccaccagccccagcaag

SEQ ID NO: 228808 - DNA, 15 bp, Homo sapiens
tggaccagcctcctg

SEQ ID NO: 228809 - DNA, 14 bp, Homo sapiens
tggacccagcaggg

SEQ ID NO: 228810 - DNA, 16 bp, Homo sapiens
tggacccagcaggggc

SEQ ID NO: 228811 - DNA, 19 bp, Homo sapiens
tggacccctgaattcaatg

SEQ ID NO: 228812 - DNA, 14 bp, Homo sapiens
tggaccgggtgggc

SEQ ID NO: 228813 - DNA, 16 bp, Homo sapiens
tggaccgggtgggcct

SEQ ID NO: 228814 - DNA, 15 bp, Homo sapiens
tggacctctcttgtg

SEQ ID NO: 228815 - DNA, 17 bp, Homo sapiens
tggacctgcctcctgcc

SEQ ID NO: 228816 - DNA, 19 bp, Homo sapiens
tggacctgcctcctgcctg

SEQ ID NO: 228817 - DNA, 15 bp, Homo sapiens
tggacgcctggctcc

SEQ ID NO: 228818 - DNA, 17 bp, Homo sapiens
tggacgcctggctccag

SEQ ID NO: 228819 - DNA, 22 bp, Homo sapiens
tggactccaggatcctcctgga

SEQ ID NO: 228820 - DNA, 18 bp, Homo sapiens
tggactccctccccaccc

SEQ ID NO: 228821 - DNA, 15 bp, Homo sapiens
tggactcctctgtcc

SEQ ID NO: 228822 - DNA, 13 bp, Homo sapiens
tggactctcaggg

SEQ ID NO: 228823 - DNA, 14 bp, Homo sapiens
tggactctgtgctc

SEQ ID NO: 228824 - DNA, 17 bp, Homo sapiens
tggactctgtggggcca

SEQ ID NO: 228825 - DNA, 14 bp, Homo sapiens
tggactctgtgtga

SEQ ID NO: 228826 - DNA, 15 bp, Homo sapiens
tggactcttgctctt

SEQ ID NO: 228827 - DNA, 18 bp, Homo sapiens
tggactcttgctctttct

SEQ ID NO: 228828 - DNA, 18 bp, Homo sapiens
tggactgaagcctgcagg

SEQ ID NO: 228829 - DNA, 18 bp, Homo sapiens
tggactggaggtgggcat

SEQ ID NO: 228830 - DNA, 14 bp, Homo sapiens
tggactggcccttg

SEQ ID NO: 228831 - DNA, 17 bp, Homo sapiens
tggactggcccttgccc

SEQ ID NO: 228832 - DNA, 22 bp, Homo sapiens
tggactggctagagtcctcact

SEQ ID NO: 228833 - DNA, 16 bp, Homo sapiens
tggactggtggcccct

SEQ ID NO: 228834 - DNA, 15 bp, Homo sapiens
tggactgtgatgcca

SEQ ID NO: 228835 - DNA, 21 bp, Homo sapiens
tggactgtgatgccacacaga

SEQ ID NO: 228836 - DNA, 15 bp, Homo sapiens
tggactgtggcctca

SEQ ID NO: 228837 - DNA, 16 bp, Homo sapiens
tggactgtggcctcag

SEQ ID NO: 228838 - DNA, 18 bp, Homo sapiens
tggactgtggcctcagga

SEQ ID NO: 228839 - DNA, 16 bp, Homo sapiens
tggacttaattatgct

SEQ ID NO: 228840 - DNA, 15 bp, Homo sapiens
tggacttcctggggc

SEQ ID NO: 228841 - DNA, 14 bp, Homo sapiens
tggacttgtatgct

SEQ ID NO: 228842 - DNA, 20 bp, Homo sapiens
tggactttatttaatttcat

SEQ ID NO: 228843 - DNA, 12 bp, Homo sapiens
tggactttcaaa

SEQ ID NO: 228844 - DNA, 22 bp, Homo sapiens
tggactttggaaggaggtgcct

SEQ ID NO: 228845 - DNA, 19 bp, Homo sapiens
tggacttttcgttaacatt

SEQ ID NO: 228846 - DNA, 20 bp, Homo sapiens
tggacttttcgttaacattg

SEQ ID NO: 228847 - DNA, 14 bp, Homo sapiens
tggagaaaatggac

SEQ ID NO: 228848 - DNA, 13 bp, Homo sapiens
tggagaaaggatg

SEQ ID NO: 228849 - DNA, 20 bp, Homo sapiens
tggagaaaggatggcagcct

SEQ ID NO: 228850 - DNA, 17 bp, Homo sapiens
tggagaaattatttaat

SEQ ID NO: 228851 - DNA, 23 bp, Homo sapiens
tggagaacgccagtctcccaggc

SEQ ID NO: 228852 - DNA, 15 bp, Homo sapiens
tggagaaggaaaagg

SEQ ID NO: 228853 - DNA, 15 bp, Homo sapiens
tggagaatgccagcc

SEQ ID NO: 228854 - DNA, 16 bp, Homo sapiens
tggagaatgccagccc

SEQ ID NO: 228855 - DNA, 20 bp, Homo sapiens
tggagacaatgcagatgcca

SEQ ID NO: 228856 - DNA, 22 bp, Homo sapiens
tggagacaattacaagacgggg

SEQ ID NO: 228857 - DNA, 20 bp, Homo sapiens
tggatacaccgaatgaccag

SEQ ID NO: 228858 - DNA, 15 bp, Homo sapiens
tggatacctgtgtgt

SEQ ID NO: 228859 - DNA, 17 bp, Homo sapiens
tggatactgcccggggc

SEQ ID NO: 228860 - DNA, 22 bp, Homo sapiens
tggatagaaaattatgcagctt

SEQ ID NO: 228861 - DNA, 14 bp, Homo sapiens
tggatagatgccct

SEQ ID NO: 228862 - DNA, 19 bp, Homo sapiens
tggataggagcttccagat

SEQ ID NO: 228863 - DNA, 22 bp, Homo sapiens
tggataggtcgggtgttaaagt

SEQ ID NO: 228864 - DNA, 16 bp, Homo sapiens
tggatatcgtcatttt

SEQ ID NO: 228865 - DNA, 16 bp, Homo sapiens
tggatatctgttagat

SEQ ID NO: 228866 - DNA, 16 bp, Homo sapiens
tggatcacacacatgg

SEQ ID NO: 228867 - DNA, 16 bp, Homo sapiens
tggatcatgaaaagtg

SEQ ID NO: 228868 - DNA, 19 bp, Homo sapiens
tggatccccagtgaaaact

SEQ ID NO: 228869 - DNA, 17 bp, Homo sapiens
tggatcccctctgtcta

SEQ ID NO: 228870 - DNA, 15 bp, Homo sapiens
tggatctatcacctg

SEQ ID NO: 228871 - DNA, 16 bp, Homo sapiens
tggatctatcacctgt

SEQ ID NO: 228872 - DNA, 18 bp, Homo sapiens
tggatctatcacctgtca

SEQ ID NO: 228873 - DNA, 20 bp, Homo sapiens
tggatctatcacctgtcatc

SEQ ID NO: 228874 - DNA, 19 bp, Homo sapiens
tggatctccccactctagg

SEQ ID NO: 228875 - DNA, 19 bp, Homo sapiens
tggatctgctccatgcaga

SEQ ID NO: 228876 - DNA, 20 bp, Homo sapiens
tggatctgctccatgcagat

SEQ ID NO: 228877 - DNA, 12 bp, Homo sapiens
tggatctggagt

SEQ ID NO: 228878 - DNA, 11 bp, Homo sapiens
tggatctgggc

SEQ ID NO: 228879 - DNA, 15 bp, Homo sapiens
tggatctgggcacaa

SEQ ID NO: 228880 - DNA, 14 bp, Homo sapiens
tggatgaaattttc

SEQ ID NO: 228881 - DNA, 23 bp, Homo sapiens
tggatgaagattctcctgtgcta

SEQ ID NO: 228882 - DNA, 16 bp, Homo sapiens
tggatgacaaagaaaa

SEQ ID NO: 228883 - DNA, 13 bp, Homo sapiens
tggatgattcttt

SEQ ID NO: 228884 - DNA, 16 bp, Homo sapiens
tggatgcctcagccca

SEQ ID NO: 228885 - DNA, 15 bp, Homo sapiens
tggatggccgggctg

SEQ ID NO: 228886 - DNA, 20 bp, Homo sapiens
tggatggccgggctgctgct

SEQ ID NO: 228887 - DNA, 17 bp, Homo sapiens
tggatgggagtgggcac

SEQ ID NO: 228888 - DNA, 19 bp, Homo sapiens
tggatgggcattgggctga

SEQ ID NO: 228889 - DNA, 22 bp, Homo sapiens
tggatgggcattgggctgacac

SEQ ID NO: 228890 - DNA, 21 bp, Homo sapiens
tggatggggcccaggggcttt

SEQ ID NO: 228891 - DNA, 18 bp, Homo sapiens
tggatgggggtgcaggca

SEQ ID NO: 228892 - DNA, 20 bp, Homo sapiens
tggatgggggtgcaggcagc

SEQ ID NO: 228893 - DNA, 17 bp, Homo sapiens
tggatggtgacttttga

SEQ ID NO: 228894 - DNA, 18 bp, Homo sapiens
tggatggtgacttttgaa

SEQ ID NO: 228895 - DNA, 17 bp, Homo sapiens
tggatgtaatatagggt

SEQ ID NO: 228896 - DNA, 18 bp, Homo sapiens
tggatgtagtctgaggcc

SEQ ID NO: 228897 - DNA, 15 bp, Homo sapiens
tggatgtcttccttg

SEQ ID NO: 228898 - DNA, 17 bp, Homo sapiens
tggatgtgtaaatggag

SEQ ID NO: 228899 - DNA, 14 bp, Homo sapiens
tggatgtgtggggc

SEQ ID NO: 228900 - DNA, 13 bp, Homo sapiens
tggattattcatt

SEQ ID NO: 228901 - DNA, 17 bp, Homo sapiens
tggattattcatttaaa

SEQ ID NO: 228902 - DNA, 20 bp, Homo sapiens
tggattattcatttaaaatg

SEQ ID NO: 228903 - DNA, 12 bp, Homo sapiens
tggattcacttc

SEQ ID NO: 228904 - DNA, 18 bp, Homo sapiens
tggattcattacagctta

SEQ ID NO: 228905 - DNA, 14 bp, Homo sapiens
tggattcccctgga

SEQ ID NO: 228906 - DNA, 16 bp, Homo sapiens
tggattctatatttca

SEQ ID NO: 228907 - DNA, 19 bp, Homo sapiens
tggattctcagatatttat

SEQ ID NO: 228908 - DNA, 13 bp, Homo sapiens
tggattgagggta

SEQ ID NO: 228909 - DNA, 17 bp, Homo sapiens
tggattgcacgtggcct

SEQ ID NO: 228910 - DNA, 15 bp, Homo sapiens
tggatttgacacact

SEQ ID NO: 228911 - DNA, 16 bp, Homo sapiens
tggatttgacacactc

SEQ ID NO: 228912 - DNA, 17 bp, Homo sapiens
tggatttgcatttttgt

SEQ ID NO: 228913 - DNA, 18 bp, Homo sapiens
tggatttgcctgtgccac

SEQ ID NO: 228914 - DNA, 19 bp, Homo sapiens
tggattttctattgttact

SEQ ID NO: 228915 - DNA, 19 bp, Homo sapiens
tggattttctttctatgta

SEQ ID NO: 228916 - DNA, 14 bp, Homo sapiens
tggattttgtggct

SEQ ID NO: 228917 - DNA, 14 bp, Homo sapiens
tggatttttacaaa

SEQ ID NO: 228918 - DNA, 21 bp, Homo sapiens
tggatttttacaaataaagat

SEQ ID NO: 228919 - DNA, 17 bp, Homo sapiens
tggcaaaaatggctaga

SEQ ID NO: 228920 - DNA, 21 bp, Homo sapiens
tggcaaaatatggtttggttt

SEQ ID NO: 228921 - DNA, 17 bp, Homo sapiens
tggcaaacaccattatt

SEQ ID NO: 228922 - DNA, 17 bp, Homo sapiens
tggcaaacatgtgcaac

SEQ ID NO: 228923 - DNA, 19 bp, Homo sapiens
tggcaagaaagctggtaaa

SEQ ID NO: 228924 - DNA, 15 bp, Homo sapiens
tggcaagagctcttt

SEQ ID NO: 228925 - DNA, 22 bp, Homo sapiens
tggcaagattgaagtctgatat

SEQ ID NO: 228926 - DNA, 15 bp, Homo sapiens
tggcaagcagggaaa

SEQ ID NO: 228927 - DNA, 21 bp, Homo sapiens
tggcaagcagggaaagctcca

SEQ ID NO: 228928 - DNA, 22 bp, Homo sapiens
tggcaagcagggaaagctccac

SEQ ID NO: 228929 - DNA, 15 bp, Homo sapiens
tggcaaggtgggttc

SEQ ID NO: 228930 - DNA, 23 bp, Homo sapiens
tggcaataaatgtcccaaataaa

SEQ ID NO: 228931 - DNA, 22 bp, Homo sapiens
tggcaataggacaaaacgggtt

SEQ ID NO: 228932 - DNA, 15 bp, Homo sapiens
tggcaatagtgtgtt

SEQ ID NO: 228933 - DNA, 22 bp, Homo sapiens
tccactcagggctggcccgggg

SEQ ID NO: 228934 - DNA, 16 bp, Homo sapiens
tccactccatatttat

SEQ ID NO: 228935 - DNA, 13 bp, Homo sapiens
tccactcccctca

SEQ ID NO: 228936 - DNA, 19 bp, Homo sapiens
tccactcccctcatccact

SEQ ID NO: 228937 - DNA, 22 bp, Homo sapiens
tccactcctcccaactctggcc

SEQ ID NO: 228938 - DNA, 14 bp, Homo sapiens
tccactccttcctg

SEQ ID NO: 228939 - DNA, 21 bp, Homo sapiens
tccactccttcctgccacctg

SEQ ID NO: 228940 - DNA, 21 bp, Homo sapiens
tccactctcggggcccttggg

SEQ ID NO: 228941 - DNA, 20 bp, Homo sapiens
tccactgacctggaagagct

SEQ ID NO: 228942 - DNA, 13 bp, Homo sapiens
tccactgccttcg

SEQ ID NO: 228943 - DNA, 15 bp, Homo sapiens
tccactgccttcgat

SEQ ID NO: 228944 - DNA, 12 bp, Homo sapiens
tccactggagaa

SEQ ID NO: 228945 - DNA, 21 bp, Homo sapiens
tccacttagaaattgcatttc

SEQ ID NO: 228946 - DNA, 23 bp, Homo sapiens
tccacttagaaattgcatttcct

SEQ ID NO: 228947 - DNA, 19 bp, Homo sapiens
tccacttagagaacaaagg

SEQ ID NO: 228948 - DNA, 21 bp, Homo sapiens
tccacttctggtcccctgtgg

SEQ ID NO: 228949 - DNA, 18 bp, Homo sapiens
tccactttcccttcccct

SEQ ID NO: 228950 - DNA, 15 bp, Homo sapiens
tccactttcctctct

SEQ ID NO: 228951 - DNA, 17 bp, Homo sapiens
tccactttcctctctct

SEQ ID NO: 228952 - DNA, 13 bp, Homo sapiens
tccactttgttct

SEQ ID NO: 228953 - DNA, 22 bp, Homo sapiens
tccagaaaggatatttaagaaa

SEQ ID NO: 228954 - DNA, 23 bp, Homo sapiens
tgtaatatctttaaatgatgtac

SEQ ID NO: 228955 - DNA, 15 bp, Homo sapiens
tgtaatatgatttta

SEQ ID NO: 228956 - DNA, 20 bp, Homo sapiens
tgtaatattctctgatgttt

SEQ ID NO: 228957 - DNA, 19 bp, Homo sapiens
tgtaatatttcttcaagtg

SEQ ID NO: 228958 - DNA, 17 bp, Homo sapiens
tgtaatcatataataaa

SEQ ID NO: 228959 - DNA, 21 bp, Homo sapiens
tgtaatcatttatcttatcta

SEQ ID NO: 228960 - DNA, 19 bp, Homo sapiens
tgtaatcccagcactttgg

SEQ ID NO: 228961 - DNA, 23 bp, Homo sapiens
tgtaatcccagcactttgggagg

SEQ ID NO: 228962 - DNA, 14 bp, Homo sapiens
tgtcacagaggcag

SEQ ID NO: 228963 - DNA, 15 bp, Homo sapiens
tgtcacagctcttgt

SEQ ID NO: 228964 - DNA, 16 bp, Homo sapiens
tgtcacagctcttgtt

SEQ ID NO: 228965 - DNA, 13 bp, Homo sapiens
tgtcaccaagaag

SEQ ID NO: 228966 - DNA, 14 bp, Homo sapiens
tgtcaccagttaaa

SEQ ID NO: 228967 - DNA, 18 bp, Homo sapiens
tgtcaccagttaaaagca

SEQ ID NO: 228968 - DNA, 22 bp, Homo sapiens
tgtcacccagcaaggcacaggc

SEQ ID NO: 228969 - DNA, 18 bp, Homo sapiens
tgtcaccctgagcatctg

SEQ ID NO: 228970 - DNA, 14 bp, Homo sapiens
tgtcaccctgcaga

SEQ ID NO: 228971 - DNA, 16 bp, Homo sapiens
tgtcaccctgcagagc

SEQ ID NO: 228972 - DNA, 17 bp, Homo sapiens
tgtcaccggccttgtga

SEQ ID NO: 228973 - DNA, 12 bp, Homo sapiens
tgtcacctttct

SEQ ID NO: 228974 - DNA, 15 bp, Homo sapiens
tgtcactacaaaaat

SEQ ID NO: 228975 - DNA, 19 bp, Homo sapiens
tgtcactacaaaaatacaa

SEQ ID NO: 228976 - DNA, 12 bp, Homo sapiens
tgtcactactgg

SEQ ID NO: 228977 - DNA, 13 bp, Homo sapiens
tgtcactactggt

SEQ ID NO: 228978 - DNA, 15 bp, Homo sapiens
tgtcactcagctgag

SEQ ID NO: 228979 - DNA, 18 bp, Homo sapiens
tgtcactggaacctccct

SEQ ID NO: 228980 - DNA, 19 bp, Homo sapiens
tgtcactggaacctccctg

SEQ ID NO: 228981 - DNA, 22 bp, Homo sapiens
tgtcacttcgcgtgccctcgct

SEQ ID NO: 228982 - DNA, 19 bp, Homo sapiens
tgtcacttgactcttgaat

SEQ ID NO: 228983 - DNA, 15 bp, Homo sapiens
tgtcactttgctctg

SEQ ID NO: 228984 - DNA, 16 bp, Homo sapiens
tgtcactttgctctgg

SEQ ID NO: 228985 - DNA, 18 bp, Homo sapiens
tgtcactttgctctgggt

SEQ ID NO: 228986 - DNA, 20 bp, Homo sapiens
tgtcacttttttcctgtcaa

SEQ ID NO: 228987 - DNA, 21 bp, Homo sapiens
tgtcagaaaccagttatgtga

SEQ ID NO: 228988 - DNA, 18 bp, Homo sapiens
tgtcagaagcctccaagc

SEQ ID NO: 228989 - DNA, 20 bp, Homo sapiens
tgtcagaccttcttccacag

SEQ ID NO: 228990 - DNA, 11 bp, Homo sapiens
tgtcagagctg

SEQ ID NO: 228991 - DNA, 16 bp, Homo sapiens
tgtcagagctgggagt

SEQ ID NO: 228992 - DNA, 21 bp, Homo sapiens
tgtcagataatcggtgcagcg

SEQ ID NO: 228993 - DNA, 20 bp, Homo sapiens
tgtcagccaacattgccttg

SEQ ID NO: 228994 - DNA, 13 bp, Homo sapiens
tgtcagccttgca

SEQ ID NO: 228995 - DNA, 13 bp, Homo sapiens
tgtcagcgtttct

SEQ ID NO: 228996 - DNA, 21 bp, Homo sapiens
tgtcagctactaatgatgttt

SEQ ID NO: 228997 - DNA, 23 bp, Homo sapiens
tgtcagctactgcggaaaaggaa

SEQ ID NO: 228998 - DNA, 13 bp, Homo sapiens
tgtcagcttccca

SEQ ID NO: 228999 - DNA, 14 bp, Homo sapiens
tgtcagcttcccaa

SEQ ID NO: 229000 - DNA, 14 bp, Homo sapiens
tgtcagctttgact

SEQ ID NO: 229001 - DNA, 17 bp, Homo sapiens
tgtcaggagagccctct

SEQ ID NO: 229002 - DNA, 18 bp, Homo sapiens
tgtcaggcagtagcagct

SEQ ID NO: 229003 - DNA, 20 bp, Homo sapiens
tgtcaggcagtagcagctgt

SEQ ID NO: 229004 - DNA, 23 bp, Homo sapiens
tgtcaggctctgaatctctcaaa

SEQ ID NO: 229005 - DNA, 15 bp, Homo sapiens
tgtcagtgtgactga

SEQ ID NO: 229006 - DNA, 20 bp, Homo sapiens
tgtcagtgtgactgatctct

SEQ ID NO: 229007 - DNA, 19 bp, Homo sapiens
tgtcagtttgtgaagtgat

SEQ ID NO: 229008 - DNA, 23 bp, Homo sapiens
tgtcataccaggccgccccagcc

SEQ ID NO: 229009 - DNA, 15 bp, Homo sapiens
tgtcatactctgtgt

SEQ ID NO: 229010 - DNA, 18 bp, Homo sapiens
tgtcatactctgtgtaat

SEQ ID NO: 229011 - DNA, 13 bp, Homo sapiens
tgtcatcactccc

SEQ ID NO: 229012 - DNA, 16 bp, Homo sapiens
tgtcatcagaagataa

SEQ ID NO: 229013 - DNA, 17 bp, Homo sapiens
tgtcatcagaagataac

SEQ ID NO: 229014 - DNA, 16 bp, Homo sapiens
tgtcatcagtaagtat

SEQ ID NO: 229015 - DNA, 21 bp, Homo sapiens
tgtcatccacacaacaccagg

SEQ ID NO: 229016 - DNA, 14 bp, Homo sapiens
tgtcatctgaggag

SEQ ID NO: 229017 - DNA, 20 bp, Homo sapiens
tgtcatctgggccaccagct

SEQ ID NO: 229018 - DNA, 11 bp, Homo sapiens
tgtcatctttt

SEQ ID NO: 229019 - DNA, 20 bp, Homo sapiens
tgtcatgatttcaatgattg

SEQ ID NO: 229020 - DNA, 23 bp, Homo sapiens
tgtcatgcggtttccaaggtgca

SEQ ID NO: 229021 - DNA, 14 bp, Homo sapiens
tgtcatggtgatgc

SEQ ID NO: 229022 - DNA, 18 bp, Homo sapiens
tgtcatggtgatgcaagt

SEQ ID NO: 229023 - DNA, 21 bp, Homo sapiens
tgtcatggtgatgcaagtcac

SEQ ID NO: 229024 - DNA, 22 bp, Homo sapiens
tgtcatggtgatgcaagtcact

SEQ ID NO: 229025 - DNA, 17 bp, Homo sapiens
tgtcatgtaccatcaat

SEQ ID NO: 229026 - DNA, 21 bp, Homo sapiens
tgtcatgtactgacaactgtt

SEQ ID NO: 229027 - DNA, 19 bp, Homo sapiens
tgtcatgtgaatccctcaa

SEQ ID NO: 229028 - DNA, 12 bp, Homo sapiens
tgtcatgtgtat

SEQ ID NO: 229029 - DNA, 16 bp, Homo sapiens
tgtcattatgtagaaa

SEQ ID NO: 229030 - DNA, 18 bp, Homo sapiens
tgtcattatttgataaca

SEQ ID NO: 229031 - DNA, 21 bp, Homo sapiens
tgtcattatttgataacattt

SEQ ID NO: 229032 - DNA, 13 bp, Homo sapiens
tgtcattgcttta

SEQ ID NO: 229033 - DNA, 14 bp, Homo sapiens
tgtcattgctttac

SEQ ID NO: 229034 - DNA, 20 bp, Homo sapiens
tgtcatttctactttgacta

SEQ ID NO: 229035 - DNA, 14 bp, Homo sapiens
tgtcatttctttta

SEQ ID NO: 229036 - DNA, 15 bp, Homo sapiens
tgtcatttgctaatg

SEQ ID NO: 229037 - DNA, 20 bp, Homo sapiens
tgtcatttgctaatgaattt

SEQ ID NO: 229038 - DNA, 14 bp, Homo sapiens
tgtcatttttaata

SEQ ID NO: 229039 - DNA, 19 bp, Homo sapiens
tgtccaaaggaggctggca

SEQ ID NO: 229040 - DNA, 15 bp, Homo sapiens
tgtccaaatttaatg

SEQ ID NO: 229041 - DNA, 21 bp, Homo sapiens
tgtccaaatttaatgtagaca

SEQ ID NO: 229042 - DNA, 18 bp, Homo sapiens
tgtccaagcatcagcaag

SEQ ID NO: 229043 - DNA, 19 bp, Homo sapiens
tgtccaagcatcagcaaga

SEQ ID NO: 229044 - DNA, 21 bp, Homo sapiens
tgtccaagttcttcacctcta

SEQ ID NO: 229045 - DNA, 15 bp, Homo sapiens
tgtccacaaatgtcc

SEQ ID NO: 229046 - DNA, 21 bp, Homo sapiens
tgtccacatctaacaaagtca

SEQ ID NO: 229047 - DNA, 17 bp, Homo sapiens
tgtccacccccgcctcc

SEQ ID NO: 229048 - DNA, 13 bp, Homo sapiens
tgtccacctgtgc

SEQ ID NO: 229049 - DNA, 19 bp, Homo sapiens
tgtccacctgtgctgctgc

SEQ ID NO: 229050 - DNA, 18 bp, Homo sapiens
tgtccactctcggggccc

SEQ ID NO: 229051 - DNA, 19 bp, Homo sapiens
tgtccactctcggggccct

SEQ ID NO: 229052 - DNA, 21 bp, Homo sapiens
tgtccagaagaatattcagga

SEQ ID NO: 229053 - DNA, 12 bp, Homo sapiens
tgtccagagaca

SEQ ID NO: 229054 - DNA, 20 bp, Homo sapiens
tgtccagagacatgggcctc

SEQ ID NO: 229055 - DNA, 11 bp, Homo sapiens
tgtccagagag

SEQ ID NO: 229056 - DNA, 12 bp, Homo sapiens
tgtccagcagct

SEQ ID NO: 229057 - DNA, 13 bp, Homo sapiens
tgtccagcagctg

SEQ ID NO: 229058 - DNA, 14 bp, Homo sapiens
tgtccagcagctgc

SEQ ID NO: 229059 - DNA, 23 bp, Homo sapiens
tgtccagcctgggcagccaggct

SEQ ID NO: 229060 - DNA, 18 bp, Homo sapiens
tgtccaggagaccttcca

SEQ ID NO: 229061 - DNA, 21 bp, Homo sapiens
tgtccaggcactgctgcccag

SEQ ID NO: 229062 - DNA, 12 bp, Homo sapiens
tgtccaggccac

SEQ ID NO: 229063 - DNA, 14 bp, Homo sapiens
tgtccagggcttca

SEQ ID NO: 229064 - DNA, 17 bp, Homo sapiens
tgtccagggcttcagat

SEQ ID NO: 229065 - DNA, 19 bp, Homo sapiens
tgtccataagagaaatggt

SEQ ID NO: 229066 - DNA, 21 bp, Homo sapiens
tgtccatatcagacctctgat

SEQ ID NO: 229067 - DNA, 21 bp, Homo sapiens
tgtccatgcctacagataatt

SEQ ID NO: 229068 - DNA, 16 bp, Homo sapiens
tgtccatgtgaaattt

SEQ ID NO: 229069 - DNA, 12 bp, Homo sapiens
tgtccatgtgtg

SEQ ID NO: 229070 - DNA, 17 bp, Homo sapiens
tgtccattatctgctgt

SEQ ID NO: 229071 - DNA, 18 bp, Homo sapiens
tgtccattatctgctgtt

SEQ ID NO: 229072 - DNA, 21 bp, Homo sapiens
tgtccattatctgctgttcct

SEQ ID NO: 229073 - DNA, 12 bp, Homo sapiens
tgtcccacaaaa

SEQ ID NO: 229074 - DNA, 19 bp, Homo sapiens
tgtcccacaaaatatttct

SEQ ID NO: 229075 - DNA, 20 bp, Homo sapiens
tgtcccacagcttggggcca

SEQ ID NO: 229076 - DNA, 16 bp, Homo sapiens
tgtcccaccaactctg

SEQ ID NO: 229077 - DNA, 22 bp, Homo sapiens
tgtcccaccaactctgcactcc

SEQ ID NO: 229078 - DNA, 22 bp, Homo sapiens
tgtcccagagcttattggccac

SEQ ID NO: 229079 - DNA, 23 bp, Homo sapiens
tgtcccagaggttatctgcctgg

SEQ ID NO: 229080 - DNA, 24 bp, Homo sapiens
tgtcccagaggttatctgcctggc

SEQ ID NO: 229081 - DNA, 13 bp, Homo sapiens
tgtcccagcccct

SEQ ID NO: 229082 - DNA, 13 bp, Homo sapiens
tgtcccagtgaac

SEQ ID NO: 229083 - DNA, 23 bp, Homo sapiens
tgtcccatgaccttgacgtgtgt

SEQ ID NO: 229084 - DNA, 16 bp, Homo sapiens
tgtcccattctagatc

SEQ ID NO: 229085 - DNA, 21 bp, Homo sapiens
tgtcccattctagatcctgca

SEQ ID NO: 229086 - DNA, 13 bp, Homo sapiens
tgtcccatttatt

SEQ ID NO: 229087 - DNA, 16 bp, Homo sapiens
tgtcccatttattatt

SEQ ID NO: 229088 - DNA, 12 bp, Homo sapiens
tgtccccagggc

SEQ ID NO: 229089 - DNA, 15 bp, Homo sapiens
tgtccccagggcccc

SEQ ID NO: 229090 - DNA, 15 bp, Homo sapiens
tgtccccaggggcac

SEQ ID NO: 229091 - DNA, 16 bp, Homo sapiens
tgtccccaggggcaca

SEQ ID NO: 229092 - DNA, 17 bp, Homo sapiens
tgtccccaggggcacac

SEQ ID NO: 229093 - DNA, 9 bp, Homo sapiens
tgtccccca

SEQ ID NO: 229094 - DNA, 23 bp, Homo sapiens
tgtcccccaaggttttggagtca

SEQ ID NO: 229095 - DNA, 13 bp, Homo sapiens
tgtcccccacctc

SEQ ID NO: 229096 - DNA, 20 bp, Homo sapiens
tgtcccccacctcttttcct

SEQ ID NO: 229097 - DNA, 14 bp, Homo sapiens
tgtctgtggtccag

SEQ ID NO: 229098 - DNA, 16 bp, Homo sapiens
tgtctgtggtccagaa

SEQ ID NO: 229099 - DNA, 21 bp, Homo sapiens
tgtctgtgtgcaagtgtgtgc

SEQ ID NO: 229100 - DNA, 22 bp, Homo sapiens
tgtctgttaccatgtcactgtg

SEQ ID NO: 229101 - DNA, 23 bp, Homo sapiens
tgtctgttaccatgtcactgtgg

SEQ ID NO: 229102 - DNA, 15 bp, Homo sapiens
tgtcttaaataaaac

SEQ ID NO: 229103 - DNA, 14 bp, Homo sapiens
tgtcttagagagag

SEQ ID NO: 229104 - DNA, 22 bp, Homo sapiens
tgtcttagagagagagagagcg

SEQ ID NO: 229105 - DNA, 22 bp, Homo sapiens
tgtcttataagaaaacatgtaa

SEQ ID NO: 229106 - DNA, 18 bp, Homo sapiens
tgtcttcaaccctgccct

SEQ ID NO: 229107 - DNA, 20 bp, Homo sapiens
tgtcttcaaccctgccctgc

SEQ ID NO: 229108 - DNA, 21 bp, Homo sapiens
tgtcttcaaccctgccctgca

SEQ ID NO: 229109 - DNA, 20 bp, Homo sapiens
tgtcttcaatttgtataaaa

SEQ ID NO: 229110 - DNA, 18 bp, Homo sapiens
tgtcttcagatcctgctg

SEQ ID NO: 229111 - DNA, 19 bp, Homo sapiens
tgtcttcaggagaatgtgc

SEQ ID NO: 229112 - DNA, 21 bp, Homo sapiens
tgtcttcatccttagcaacag

SEQ ID NO: 229113 - DNA, 16 bp, Homo sapiens
tgtcttccaggcccag

SEQ ID NO: 229114 - DNA, 12 bp, Homo sapiens
tgtcttccataa

SEQ ID NO: 229115 - DNA, 13 bp, Homo sapiens
tgtcttccccacc

SEQ ID NO: 229116 - DNA, 15 bp, Homo sapiens
tgtcttccccacctt

SEQ ID NO: 229117 - DNA, 13 bp, Homo sapiens
tgtcttccttttc

SEQ ID NO: 229118 - DNA, 16 bp, Homo sapiens
tgtcttcgtacagttc

SEQ ID NO: 229119 - DNA, 17 bp, Homo sapiens
tgtcttctccctgcaca

SEQ ID NO: 229120 - DNA, 12 bp, Homo sapiens
tgtcttctctcc

SEQ ID NO: 229121 - DNA, 15 bp, Homo sapiens
tgtcttctctccact

SEQ ID NO: 229122 - DNA, 13 bp, Homo sapiens
tgtcttctgcctg

SEQ ID NO: 229123 - DNA, 14 bp, Homo sapiens
tgtcttggcactgt

SEQ ID NO: 229124 - DNA, 11 bp, Homo sapiens
tgtctttaaaa

SEQ ID NO: 229125 - DNA, 15 bp, Homo sapiens
tgtctttaaaatgat

SEQ ID NO: 229126 - DNA, 14 bp, Homo sapiens
tgtctttatgattt

SEQ ID NO: 229127 - DNA, 16 bp, Homo sapiens
tgtctttcagatacat

SEQ ID NO: 229128 - DNA, 19 bp, Homo sapiens
tgtctttcagcattaggct

SEQ ID NO: 229129 - DNA, 14 bp, Homo sapiens
tgtctttctttgct

SEQ ID NO: 229130 - DNA, 12 bp, Homo sapiens
tgtctttgctgt

SEQ ID NO: 229131 - DNA, 20 bp, Homo sapiens
tgtctttggcttcagaattg

SEQ ID NO: 229132 - DNA, 15 bp, Homo sapiens
tgtcttttgttctct

SEQ ID NO: 229133 - DNA, 13 bp, Homo sapiens
tgtctttttcctt

SEQ ID NO: 229134 - DNA, 18 bp, Homo sapiens
tgtctttttccttcctga

SEQ ID NO: 229135 - DNA, 17 bp, Homo sapiens
tgtctttttctggactg

SEQ ID NO: 229136 - DNA, 23 bp, Homo sapiens
tgtctttttctggactgaagcct

SEQ ID NO: 229137 - DNA, 18 bp, Homo sapiens
tgtcttttttttcatcct

SEQ ID NO: 229138 - DNA, 13 bp, Homo sapiens
tgtgaaaatgggt

SEQ ID NO: 229139 - DNA, 22 bp, Homo sapiens
tgtgaaacagggagctatgaga

SEQ ID NO: 229140 - DNA, 16 bp, Homo sapiens
tgtgaaagtatgtgat

SEQ ID NO: 229141 - DNA, 14 bp, Homo sapiens
tgtgaaatgaaaac

SEQ ID NO: 229142 - DNA, 18 bp, Homo sapiens
tgtgaaatttacagttac

SEQ ID NO: 229143 - DNA, 18 bp, Homo sapiens
tgtgaaccaactgcctta

SEQ ID NO: 229144 - DNA, 21 bp, Homo sapiens
tgtgaacgatttagaaagaag

SEQ ID NO: 229145 - DNA, 22 bp, Homo sapiens
tgtgaagatcacgttccttccc

SEQ ID NO: 229146 - DNA, 15 bp, Homo sapiens
tgtgaagcatgcttt

SEQ ID NO: 229147 - DNA, 22 bp, Homo sapiens
tgtgaagcatgctttgctgcta

SEQ ID NO: 229148 - DNA, 22 bp, Homo sapiens
tgtgaagcctgtcgtgttctct

SEQ ID NO: 229149 - DNA, 16 bp, Homo sapiens
tgtgaagtgattgaca

SEQ ID NO: 229150 - DNA, 20 bp, Homo sapiens
tgtgaagtttacattgtaaa

SEQ ID NO: 229151 - DNA, 12 bp, Homo sapiens
tgtgaataaatt

SEQ ID NO: 229152 - DNA, 17 bp, Homo sapiens
tgtgaataataaataca

SEQ ID NO: 229153 - DNA, 18 bp, Homo sapiens
tgtgaatcgcaaggcctg

SEQ ID NO: 229154 - DNA, 23 bp, Homo sapiens
tgtgaatgttgtcctgtgtcatc

SEQ ID NO: 229155 - DNA, 18 bp, Homo sapiens
tgtgaattaaaaaagctc

SEQ ID NO: 229156 - DNA, 19 bp, Homo sapiens
tgtgaattctgtgaagaat

SEQ ID NO: 229157 - DNA, 16 bp, Homo sapiens
tgtgaattgataataa

SEQ ID NO: 229158 - DNA, 23 bp, Homo sapiens
tgtgaatttcttcactgttgaaa

SEQ ID NO: 229159 - DNA, 18 bp, Homo sapiens
tgtgacaaaggatgaaga

SEQ ID NO: 229160 - DNA, 20 bp, Homo sapiens
tgtgacaaaggatgaagaac

SEQ ID NO: 229161 - DNA, 19 bp, Homo sapiens
tgtgacaacctttgtgtaa

SEQ ID NO: 229162 - DNA, 21 bp, Homo sapiens
tgtgacaacctttgtgtaata

SEQ ID NO: 229163 - DNA, 23 bp, Homo sapiens
tgtgacaacctttgtgtaataaa

SEQ ID NO: 229164 - DNA, 21 bp, Homo sapiens
tgtgacaggaagcccaaggca

SEQ ID NO: 229165 - DNA, 17 bp, Homo sapiens
tgtgacatgcgggctgg

SEQ ID NO: 229166 - DNA, 21 bp, Homo sapiens
tgtgacatgcgggctgggcag

SEQ ID NO: 229167 - DNA, 15 bp, Homo sapiens
tgtgacatgttttat

SEQ ID NO: 229168 - DNA, 16 bp, Homo sapiens
tgtgacattccacaga

SEQ ID NO: 229169 - DNA, 13 bp, Homo sapiens
tgtgacccaccag

SEQ ID NO: 229170 - DNA, 14 bp, Homo sapiens
tgtgacccaccagt

SEQ ID NO: 229171 - DNA, 15 bp, Homo sapiens
tgtgacccaccagtg

SEQ ID NO: 229172 - DNA, 17 bp, Homo sapiens
tgtgacccaccagtgcc

SEQ ID NO: 229173 - DNA, 13 bp, Homo sapiens
tgtgaccctctca

SEQ ID NO: 229174 - DNA, 16 bp, Homo sapiens
tgtgaccggggtcctg

SEQ ID NO: 229175 - DNA, 19 bp, Homo sapiens
tgtgacgggggttggggtg

SEQ ID NO: 229176 - DNA, 22 bp, Homo sapiens
tgtgacgggggttggggtgggg

SEQ ID NO: 229177 - DNA, 15 bp, Homo sapiens
tgtgactagtgctga

SEQ ID NO: 229178 - DNA, 17 bp, Homo sapiens
tgtgactagtgctgaag

SEQ ID NO: 229179 - DNA, 18 bp, Homo sapiens
tgtgactatatagagatg

SEQ ID NO: 229180 - DNA, 18 bp, Homo sapiens
tgtgactcagtgtatttt

SEQ ID NO: 229181 - DNA, 16 bp, Homo sapiens
tgtgactcattcccag

SEQ ID NO: 229182 - DNA, 21 bp, Homo sapiens
tgtgactcgcttagctgaaac

SEQ ID NO: 229183 - DNA, 16 bp, Homo sapiens
tgtgactgatctctcg

SEQ ID NO: 229184 - DNA, 13 bp, Homo sapiens
tgtgagaccccca

SEQ ID NO: 229185 - DNA, 14 bp, Homo sapiens
tgtgagacccccac

SEQ ID NO: 229186 - DNA, 15 bp, Homo sapiens
tgtgagacccccaca

SEQ ID NO: 229187 - DNA, 13 bp, Homo sapiens
tgtgagagaaagt

SEQ ID NO: 229188 - DNA, 22 bp, Homo sapiens
tgtgagagagttgctcctcagg

SEQ ID NO: 229189 - DNA, 13 bp, Homo sapiens
tgtgagagcccat

SEQ ID NO: 229190 - DNA, 16 bp, Homo sapiens
tgtgagataacttcct

SEQ ID NO: 229191 - DNA, 17 bp, Homo sapiens
tgtgagataacttcctt

SEQ ID NO: 229192 - DNA, 18 bp, Homo sapiens
tgtgagataacttccttc

SEQ ID NO: 229193 - DNA, 19 bp, Homo sapiens
tgtgagataacttccttca

SEQ ID NO: 229194 - DNA, 14 bp, Homo sapiens
tgtgagcagcctcc

SEQ ID NO: 229195 - DNA, 22 bp, Homo sapiens
tgtgagccaaagagaaaagatt

SEQ ID NO: 229196 - DNA, 19 bp, Homo sapiens
tgtgagcgagcctggcagg

SEQ ID NO: 229197 - DNA, 20 bp, Homo sapiens
tgtgaggagctgctggcttg

SEQ ID NO: 229198 - DNA, 14 bp, Homo sapiens
tgtgaggctgtcct

SEQ ID NO: 229199 - DNA, 17 bp, Homo sapiens
tgtgagggacatgctca

SEQ ID NO: 229200 - DNA, 22 bp, Homo sapiens
tgtgagggacatgctcacctct

SEQ ID NO: 229201 - DNA, 22 bp, Homo sapiens
tgtgagggatggggagcagctg

SEQ ID NO: 229202 - DNA, 14 bp, Homo sapiens
tgtgagggcagcac

SEQ ID NO: 229203 - DNA, 16 bp, Homo sapiens
tgtgagggcagcactg

SEQ ID NO: 229204 - DNA, 19 bp, Homo sapiens
tgtgagggcagcactggga

SEQ ID NO: 229205 - DNA, 17 bp, Homo sapiens
tgtgaggtttcacctcc

SEQ ID NO: 229206 - DNA, 15 bp, Homo sapiens
tgtgagtaagagctg

SEQ ID NO: 229207 - DNA, 13 bp, Homo sapiens
tgtgagtatgtgt

SEQ ID NO: 229208 - DNA, 14 bp, Homo sapiens
tgtgagtatgtgtg

SEQ ID NO: 229209 - DNA, 17 bp, Homo sapiens
tgtgagtatgtgtggtt

SEQ ID NO: 229210 - DNA, 22 bp, Homo sapiens
tgtggaaggcacactgagcaag

SEQ ID NO: 229211 - DNA, 23 bp, Homo sapiens
tgtggaaggcacccgccctttcc

SEQ ID NO: 229212 - DNA, 18 bp, Homo sapiens
tgtggaagggactaggag

SEQ ID NO: 229213 - DNA, 17 bp, Homo sapiens
tgtggaattacataaca

SEQ ID NO: 229214 - DNA, 14 bp, Homo sapiens
tgtggactgtgatg

SEQ ID NO: 229215 - DNA, 14 bp, Homo sapiens
tgtggagaggagag

SEQ ID NO: 229216 - DNA, 15 bp, Homo sapiens
tgtggagaggagaga

SEQ ID NO: 229217 - DNA, 20 bp, Homo sapiens
tgtggagagggaatgtgaaa

SEQ ID NO: 229218 - DNA, 21 bp, Homo sapiens
tgtggagaggggtgcacccac

SEQ ID NO: 229219 - DNA, 18 bp, Homo sapiens
tgtggagagtgagaataa

SEQ ID NO: 229220 - DNA, 20 bp, Homo sapiens
tgtggagagtgagaataatt

SEQ ID NO: 229221 - DNA, 18 bp, Homo sapiens
tgtggagcacgtggagat

SEQ ID NO: 229222 - DNA, 19 bp, Homo sapiens
tgtggagctgcttccagtt

SEQ ID NO: 229223 - DNA, 13 bp, Homo sapiens
tgtggaggtggct

SEQ ID NO: 229224 - DNA, 15 bp, Homo sapiens
tgtggagtactggac

SEQ ID NO: 229225 - DNA, 16 bp, Homo sapiens
tgtggagtggaggggt

SEQ ID NO: 229226 - DNA, 16 bp, Homo sapiens
tgtggagtggggcagt

SEQ ID NO: 229227 - DNA, 18 bp, Homo sapiens
tgtggagttattcactct

SEQ ID NO: 229228 - DNA, 12 bp, Homo sapiens
tgtggataaaac

SEQ ID NO: 229229 - DNA, 17 bp, Homo sapiens
tgtggataagggagagt

SEQ ID NO: 229230 - DNA, 13 bp, Homo sapiens
tgtggatgctctt

SEQ ID NO: 229231 - DNA, 15 bp, Homo sapiens
tgtggattcagcttc

SEQ ID NO: 229232 - DNA, 14 bp, Homo sapiens
tgtggcaaacattt

SEQ ID NO: 229233 - DNA, 15 bp, Homo sapiens
tgtggcaaagtgctg

SEQ ID NO: 229234 - DNA, 20 bp, Homo sapiens
tgtggcaaagtgctgtaccc

SEQ ID NO: 229235 - DNA, 22 bp, Homo sapiens
tgtggcacagacttctggaagg

SEQ ID NO: 229236 - DNA, 16 bp, Homo sapiens
tgtggcacgcacctgt

SEQ ID NO: 229237 - DNA, 15 bp, Homo sapiens
tgtggcagaaaagag

SEQ ID NO: 229238 - DNA, 20 bp, Homo sapiens
tgtccccccctaactttctt

SEQ ID NO: 229239 - DNA, 23 bp, Homo sapiens
tgtccccgccttccctcactctt

SEQ ID NO: 229240 - DNA, 23 bp, Homo sapiens
tgtcccctatggggatggtccac

SEQ ID NO: 229241 - DNA, 20 bp, Homo sapiens
tgtcccctccttccagcctg

SEQ ID NO: 229242 - DNA, 13 bp, Homo sapiens
tgtcccctgtccc

SEQ ID NO: 229243 - DNA, 14 bp, Homo sapiens
tgtccccttcccct

SEQ ID NO: 229244 - DNA, 15 bp, Homo sapiens
tgtcccgccttcctc

SEQ ID NO: 229245 - DNA, 17 bp, Homo sapiens
tgtcccggttcaccttg

SEQ ID NO: 229246 - DNA, 17 bp, Homo sapiens
tgtccctaccactgagc

SEQ ID NO: 229247 - DNA, 20 bp, Homo sapiens
tgtccctaccgagtctcttc

SEQ ID NO: 229248 - DNA, 14 bp, Homo sapiens
tgtccctaggtcag

SEQ ID NO: 229249 - DNA, 21 bp, Homo sapiens
tgtccctcactgttgaatttt

SEQ ID NO: 229250 - DNA, 17 bp, Homo sapiens
tgtccctctcactcccc

SEQ ID NO: 229251 - DNA, 11 bp, Homo sapiens
tgtccctgccc

SEQ ID NO: 229252 - DNA, 16 bp, Homo sapiens
tgtccctgtccctgcc

SEQ ID NO: 229253 - DNA, 19 bp, Homo sapiens
tgtcccttacgtgagtcct

SEQ ID NO: 229254 - DNA, 23 bp, Homo sapiens
tgtcccttacgtgagtcctggca

SEQ ID NO: 229255 - DNA, 14 bp, Homo sapiens
tgtccctttcccta

SEQ ID NO: 229256 - DNA, 17 bp, Homo sapiens
tgtccctttcttggcca

SEQ ID NO: 229257 - DNA, 12 bp, Homo sapiens
tgtcccttttcc

SEQ ID NO: 229258 - DNA, 13 bp, Homo sapiens
tgtccgagaacta

SEQ ID NO: 229259 - DNA, 15 bp, Homo sapiens
tgtccgcctctgccc

SEQ ID NO: 229260 - DNA, 23 bp, Homo sapiens
tgtccgcctctgcccgcagagcc

SEQ ID NO: 229261 - DNA, 18 bp, Homo sapiens
tgtccgctctctcatgtg

SEQ ID NO: 229262 - DNA, 21 bp, Homo sapiens
tgtccgctgctgctttccttc

SEQ ID NO: 229263 - DNA, 18 bp, Homo sapiens
tgtccgttgacgtgacca

SEQ ID NO: 229264 - DNA, 16 bp, Homo sapiens
tgtcctaaggacacac

SEQ ID NO: 229265 - DNA, 18 bp, Homo sapiens
tgtcctaaggacacacta

SEQ ID NO: 229266 - DNA, 21 bp, Homo sapiens
tgtcctacccgcccgcgtcca

SEQ ID NO: 229267 - DNA, 22 bp, Homo sapiens
tgtcctacccgcccgcgtccaa

SEQ ID NO: 229268 - DNA, 22 bp, Homo sapiens
tgtcctcagagggtccctaggt

SEQ ID NO: 229269 - DNA, 15 bp, Homo sapiens
tgtcctcattcttct

SEQ ID NO: 229270 - DNA, 15 bp, Homo sapiens
tgtcctccaccacaa

SEQ ID NO: 229271 - DNA, 19 bp, Homo sapiens
tgtcctccagaagcctctg

SEQ ID NO: 229272 - DNA, 20 bp, Homo sapiens
tgtcctccagaagcctctgg

SEQ ID NO: 229273 - DNA, 23 bp, Homo sapiens
tgtcctccagaagcctctggcta

SEQ ID NO: 229274 - DNA, 14 bp, Homo sapiens
tgtcctccccttgg

SEQ ID NO: 229275 - DNA, 16 bp, Homo sapiens
tgtcctctcagaactc

SEQ ID NO: 229276 - DNA, 21 bp, Homo sapiens
tgtcctctcagaactcctgtg

SEQ ID NO: 229277 - DNA, 17 bp, Homo sapiens
tgtcctctgtcagtcat

SEQ ID NO: 229278 - DNA, 15 bp, Homo sapiens
tgtcctcttgctcaa

SEQ ID NO: 229279 - DNA, 16 bp, Homo sapiens
tgtcctctttcagaaa

SEQ ID NO: 229280 - DNA, 15 bp, Homo sapiens
tgtcctgactgtcct

SEQ ID NO: 229281 - DNA, 20 bp, Homo sapiens
tgtcctgagccccctgcacc

SEQ ID NO: 229282 - DNA, 18 bp, Homo sapiens
tgtcctgatggtcagctc

SEQ ID NO: 229283 - DNA, 19 bp, Homo sapiens
tgtcctgcagagctggggg

SEQ ID NO: 229284 - DNA, 13 bp, Homo sapiens
tgtcctgccagct

SEQ ID NO: 229285 - DNA, 15 bp, Homo sapiens
tgtcctgccagctgc

SEQ ID NO: 229286 - DNA, 18 bp, Homo sapiens
tgtcctgctcacgtctgt

SEQ ID NO: 229287 - DNA, 17 bp, Homo sapiens
tgtcctggttagcagag

SEQ ID NO: 229288 - DNA, 18 bp, Homo sapiens
tgtccttcagagctcttc

SEQ ID NO: 229289 - DNA, 22 bp, Homo sapiens
tgtccttcattccgttaggaat

SEQ ID NO: 229290 - DNA, 16 bp, Homo sapiens
tgtccttcccacggcc

SEQ ID NO: 229291 - DNA, 19 bp, Homo sapiens
tgtccttctctcacctcct

SEQ ID NO: 229292 - DNA, 13 bp, Homo sapiens
tgtccttcttcct

SEQ ID NO: 229293 - DNA, 20 bp, Homo sapiens
tgtccttcttcctcaagtct

SEQ ID NO: 229294 - DNA, 18 bp, Homo sapiens
tgtcctttccctccactc

SEQ ID NO: 229295 - DNA, 15 bp, Homo sapiens
tgtcctttctccagg

SEQ ID NO: 229296 - DNA, 16 bp, Homo sapiens
tgtcctttctccaggc

SEQ ID NO: 229297 - DNA, 18 bp, Homo sapiens
tgtcctttctccaggccc

SEQ ID NO: 229298 - DNA, 22 bp, Homo sapiens
tgtcctttgagaaagaaataat

SEQ ID NO: 229299 - DNA, 13 bp, Homo sapiens
tgtcgccgtccct

SEQ ID NO: 229300 - DNA, 22 bp, Homo sapiens
tgtcgcctgcggactccatggc

SEQ ID NO: 229301 - DNA, 19 bp, Homo sapiens
tgtcgtttcattcattttg

SEQ ID NO: 229302 - DNA, 22 bp, Homo sapiens
tgtcgtttcattcattttgtgt

SEQ ID NO: 229303 - DNA, 16 bp, Homo sapiens
tgtctaaaagattctt

SEQ ID NO: 229304 - DNA, 17 bp, Homo sapiens
tgtctaaaagattcttt

SEQ ID NO: 229305 - DNA, 19 bp, Homo sapiens
tgtctaaagagctttagtc

SEQ ID NO: 229306 - DNA, 20 bp, Homo sapiens
tgtctaacctacgaccccag

SEQ ID NO: 229307 - DNA, 21 bp, Homo sapiens
tgtctaacctacgaccccaga

SEQ ID NO: 229308 - DNA, 15 bp, Homo sapiens
tgtctaagatagtaa

SEQ ID NO: 229309 - DNA, 17 bp, Homo sapiens
tgtctaatgcattaact

SEQ ID NO: 229310 - DNA, 13 bp, Homo sapiens
tgtctaattaaaa

SEQ ID NO: 229311 - DNA, 15 bp, Homo sapiens
tgtctacaaaagcaa

SEQ ID NO: 229312 - DNA, 16 bp, Homo sapiens
tgtctagaatcctgct

SEQ ID NO: 229313 - DNA, 19 bp, Homo sapiens
tgtctagaatcctgcttta

SEQ ID NO: 229314 - DNA, 14 bp, Homo sapiens
tgtctagaggcaac

SEQ ID NO: 229315 - DNA, 15 bp, Homo sapiens
tgtctagcaaagcca

SEQ ID NO: 229316 - DNA, 20 bp, Homo sapiens
tgtctaggtctcctcagggt

SEQ ID NO: 229317 - DNA, 19 bp, Homo sapiens
tgtctagtagaacaatgta

SEQ ID NO: 229318 - DNA, 16 bp, Homo sapiens
tgtctagtttgcatac

SEQ ID NO: 229319 - DNA, 21 bp, Homo sapiens
tgtctagtttgcatacttcct

SEQ ID NO: 229320 - DNA, 22 bp, Homo sapiens
tgtctataatcccagcactttg

SEQ ID NO: 229321 - DNA, 15 bp, Homo sapiens
tgtctattctgagcc

SEQ ID NO: 229322 - DNA, 16 bp, Homo sapiens
tgtctattctgagcct

SEQ ID NO: 229323 - DNA, 21 bp, Homo sapiens
tgtctcaagagggcactggtg

SEQ ID NO: 229324 - DNA, 15 bp, Homo sapiens
tgtctcagcctccca

SEQ ID NO: 229325 - DNA, 17 bp, Homo sapiens
tgtctcagtccacctga

SEQ ID NO: 229326 - DNA, 14 bp, Homo sapiens
tgtctcattgccag

SEQ ID NO: 229327 - DNA, 17 bp, Homo sapiens
tgtctcattttgtatgt

SEQ ID NO: 229328 - DNA, 21 bp, Homo sapiens
tgtctcattttgtatgtatgt

SEQ ID NO: 229329 - DNA, 17 bp, Homo sapiens
tgtctccagacccccac

SEQ ID NO: 229330 - DNA, 19 bp, Homo sapiens
tgtctccagacccccaccc

SEQ ID NO: 229331 - DNA, 18 bp, Homo sapiens
tgtctccagggcccccac

SEQ ID NO: 229332 - DNA, 19 bp, Homo sapiens
tgtctccagggcccccacc

SEQ ID NO: 229333 - DNA, 12 bp, Homo sapiens
tgtctcccctct

SEQ ID NO: 229334 - DNA, 23 bp, Homo sapiens
tgtctccctataatgctggagcg

SEQ ID NO: 229335 - DNA, 14 bp, Homo sapiens
tgtctcctctgtca

SEQ ID NO: 229336 - DNA, 15 bp, Homo sapiens
tgtctctaacttatt

SEQ ID NO: 229337 - DNA, 21 bp, Homo sapiens
tgtctctacaaaaaaaatcaa

SEQ ID NO: 229338 - DNA, 21 bp, Homo sapiens
tgtctctacccactatgcaca

SEQ ID NO: 229339 - DNA, 18 bp, Homo sapiens
tgtctctatcttgcatct

SEQ ID NO: 229340 - DNA, 15 bp, Homo sapiens
tgtctctcccacccc

SEQ ID NO: 229341 - DNA, 22 bp, Homo sapiens
tgtctctcccaccccggcctcc

SEQ ID NO: 229342 - DNA, 19 bp, Homo sapiens
tgtctctccctaccctctt

SEQ ID NO: 229343 - DNA, 13 bp, Homo sapiens
tgtctctgagagt

SEQ ID NO: 229344 - DNA, 15 bp, Homo sapiens
tgtctctgataaaag

SEQ ID NO: 229345 - DNA, 13 bp, Homo sapiens
tgtctctgccatg

SEQ ID NO: 229346 - DNA, 19 bp, Homo sapiens
tgtctctggcgtgtgggta

SEQ ID NO: 229347 - DNA, 17 bp, Homo sapiens
tgtctcttagaaatact

SEQ ID NO: 229348 - DNA, 15 bp, Homo sapiens
tgtctcttgaaaaat

SEQ ID NO: 229349 - DNA, 14 bp, Homo sapiens
tgtctcttttctct

SEQ ID NO: 229350 - DNA, 16 bp, Homo sapiens
tgtctgaagtcactgc

SEQ ID NO: 229351 - DNA, 17 bp, Homo sapiens
tgtctgaagtcactgca

SEQ ID NO: 229352 - DNA, 18 bp, Homo sapiens
tgtctgaagtcactgcac

SEQ ID NO: 229353 - DNA, 19 bp, Homo sapiens
tgtctgaagtcactgcaca

SEQ ID NO: 229354 - DNA, 15 bp, Homo sapiens
tgtctgagagaccat

SEQ ID NO: 229355 - DNA, 18 bp, Homo sapiens
tgtctgaggcctcatccc

SEQ ID NO: 229356 - DNA, 13 bp, Homo sapiens
tgtctgcaacatg

SEQ ID NO: 229357 - DNA, 21 bp, Homo sapiens
tgtgtgtatcaccctcagctg

SEQ ID NO: 229358 - DNA, 16 bp, Homo sapiens
tgtgtgtctctatctt

SEQ ID NO: 229359 - DNA, 12 bp, Homo sapiens
tgtgtgtctctg

SEQ ID NO: 229360 - DNA, 12 bp, Homo sapiens
tgtgtgtggaag

SEQ ID NO: 229361 - DNA, 14 bp, Homo sapiens
tgtgtgtgtatgtt

SEQ ID NO: 229362 - DNA, 14 bp, Homo sapiens
tgtgtgtgtctcta

SEQ ID NO: 229363 - DNA, 16 bp, Homo sapiens
tgtgtgttgccacagg

SEQ ID NO: 229364 - DNA, 19 bp, Homo sapiens
tgtgtgttgccacaggaca

SEQ ID NO: 229365 - DNA, 20 bp, Homo sapiens
tgtgtgttgccacaggacac

SEQ ID NO: 229366 - DNA, 16 bp, Homo sapiens
tgtgtgtttaaataaa

SEQ ID NO: 229367 - DNA, 23 bp, Homo sapiens
tgtgtgtttattgtcaaagtggt

SEQ ID NO: 229368 - DNA, 19 bp, Homo sapiens
tgtgttagtgtctgtccat

SEQ ID NO: 229369 - DNA, 13 bp, Homo sapiens
tgtgttcaatctg

SEQ ID NO: 229370 - DNA, 13 bp, Homo sapiens
tgtgttcagttcc

SEQ ID NO: 229371 - DNA, 19 bp, Homo sapiens
tgtgttccaactgccccca

SEQ ID NO: 229372 - DNA, 24 bp, Homo sapiens
tgtgttcctggcaatagtgtgttc

SEQ ID NO: 229373 - DNA, 21 bp, Homo sapiens
tgtgttcgtggagccacaggc

SEQ ID NO: 229374 - DNA, 15 bp, Homo sapiens
tgtgttcgttcttgt

SEQ ID NO: 229375 - DNA, 19 bp, Homo sapiens
tgtgttctgtttgttaaaa

SEQ ID NO: 229376 - DNA, 18 bp, Homo sapiens
tgtgttcttttgatacat

SEQ ID NO: 229377 - DNA, 16 bp, Homo sapiens
tgtgttgactgctgct

SEQ ID NO: 229378 - DNA, 23 bp, Homo sapiens
tgtgttgactgctgctccccacc

SEQ ID NO: 229379 - DNA, 16 bp, Homo sapiens
tgtgttgcataaacaa

SEQ ID NO: 229380 - DNA, 23 bp, Homo sapiens
tgtgttgcataaacaatccaaat

SEQ ID NO: 229381 - DNA, 18 bp, Homo sapiens
tgtgttgccacaggacac

SEQ ID NO: 229382 - DNA, 18 bp, Homo sapiens
tgtgttgccatgtgtgct

SEQ ID NO: 229383 - DNA, 22 bp, Homo sapiens
tgtgttgccattttgtctggct

SEQ ID NO: 229384 - DNA, 14 bp, Homo sapiens
tgtgttgggcccca

SEQ ID NO: 229385 - DNA, 13 bp, Homo sapiens
tgtgttgtgatag

SEQ ID NO: 229386 - DNA, 13 bp, Homo sapiens
tgtgttgttgctt

SEQ ID NO: 229387 - DNA, 14 bp, Homo sapiens
tgtgttgttgcttt

SEQ ID NO: 229388 - DNA, 12 bp, Homo sapiens
tgtgttgtttga

SEQ ID NO: 229389 - DNA, 18 bp, Homo sapiens
tgtgtttaaataaagtat

SEQ ID NO: 229390 - DNA, 11 bp, Homo sapiens
tgtgtttcagg

SEQ ID NO: 229391 - DNA, 21 bp, Homo sapiens
tgtgtttccctagactctgta

SEQ ID NO: 229392 - DNA, 15 bp, Homo sapiens
tgtgtttctaaaact

SEQ ID NO: 229393 - DNA, 18 bp, Homo sapiens
tgtgtttctaaaactatg

SEQ ID NO: 229394 - DNA, 13 bp, Homo sapiens
tgtgtttgaaaca

SEQ ID NO: 229395 - DNA, 21 bp, Homo sapiens
tgtgtttgcttaaacaaagtg

SEQ ID NO: 229396 - DNA, 18 bp, Homo sapiens
tgtgtttggttctggggc

SEQ ID NO: 229397 - DNA, 13 bp, Homo sapiens
tgtgttttgcttt

SEQ ID NO: 229398 - DNA, 15 bp, Homo sapiens
tgtgtttttaataaa

SEQ ID NO: 229399 - DNA, 19 bp, Homo sapiens
tgtgtttttattgttaact

SEQ ID NO: 229400 - DNA, 16 bp, Homo sapiens
tgtgtttttctttttc

SEQ ID NO: 229401 - DNA, 18 bp, Homo sapiens
tgtgttttttttcctttg

SEQ ID NO: 229402 - DNA, 17 bp, Homo sapiens
tgttaaaacaaattaaa

SEQ ID NO: 229403 - DNA, 20 bp, Homo sapiens
tgttaaagaggcgtcttgta

SEQ ID NO: 229404 - DNA, 22 bp, Homo sapiens
tgttaaagaggcgtcttgtatt

SEQ ID NO: 229405 - DNA, 15 bp, Homo sapiens
tgttaaataaggcct

SEQ ID NO: 229406 - DNA, 16 bp, Homo sapiens
tgttaacactgtaata

SEQ ID NO: 229407 - DNA, 19 bp, Homo sapiens
tgttaacactgtaatatct

SEQ ID NO: 229408 - DNA, 19 bp, Homo sapiens
tgttaaccaaataaaacat

SEQ ID NO: 229409 - DNA, 15 bp, Homo sapiens
tgttaacctcagtgt

SEQ ID NO: 229410 - DNA, 17 bp, Homo sapiens
tgttaacctcagtgtca

SEQ ID NO: 229411 - DNA, 23 bp, Homo sapiens
tgttaactagtgtttctgcagag

SEQ ID NO: 229412 - DNA, 23 bp, Homo sapiens
tgttaagcagctaaattttctga

SEQ ID NO: 229413 - DNA, 12 bp, Homo sapiens
tgttaagctcag

SEQ ID NO: 229414 - DNA, 15 bp, Homo sapiens
tgttaagtatgtgta

SEQ ID NO: 229415 - DNA, 20 bp, Homo sapiens
tgttaagtgcttttaaactg

SEQ ID NO: 229416 - DNA, 12 bp, Homo sapiens
tgttaataaagg

SEQ ID NO: 229417 - DNA, 23 bp, Homo sapiens
tgttaatatatataatacttaaa

SEQ ID NO: 229418 - DNA, 23 bp, Homo sapiens
tgttaatattaatttatatttgt

SEQ ID NO: 229419 - DNA, 14 bp, Homo sapiens
tgttaatcatcttc

SEQ ID NO: 229420 - DNA, 14 bp, Homo sapiens
tgttaatgaaaatg

SEQ ID NO: 229421 - DNA, 17 bp, Homo sapiens
tgttaatgaaaatgtca

SEQ ID NO: 229422 - DNA, 15 bp, Homo sapiens
tgttaattcagcact

SEQ ID NO: 229423 - DNA, 22 bp, Homo sapiens
tgttaattcagcactgatttca

SEQ ID NO: 229424 - DNA, 22 bp, Homo sapiens
tgttaattctagatcagagagc

SEQ ID NO: 229425 - DNA, 23 bp, Homo sapiens
tgttacaggcaccgagaatgttg

SEQ ID NO: 229426 - DNA, 15 bp, Homo sapiens
tgttacattattatc

SEQ ID NO: 229427 - DNA, 14 bp, Homo sapiens
tgttaccttaaaac

SEQ ID NO: 229428 - DNA, 13 bp, Homo sapiens
tgttactgatcat

SEQ ID NO: 229429 - DNA, 16 bp, Homo sapiens
tgttacttaaatagca

SEQ ID NO: 229430 - DNA, 14 bp, Homo sapiens
tgttacttacctaa

SEQ ID NO: 229431 - DNA, 13 bp, Homo sapiens
tgttactttggaa

SEQ ID NO: 229432 - DNA, 12 bp, Homo sapiens
tgttagagaggt

SEQ ID NO: 229433 - DNA, 18 bp, Homo sapiens
tgttagagtccaacgtgg

SEQ ID NO: 229434 - DNA, 23 bp, Homo sapiens
tgttagagtccaacgtggggcag

SEQ ID NO: 229435 - DNA, 14 bp, Homo sapiens
tgttagctgggaag

SEQ ID NO: 229436 - DNA, 12 bp, Homo sapiens
tgttaggggaaa

SEQ ID NO: 229437 - DNA, 16 bp, Homo sapiens
tgttaggggaaaatag

SEQ ID NO: 229438 - DNA, 22 bp, Homo sapiens
tgttagtactatatctgtttta

SEQ ID NO: 229439 - DNA, 14 bp, Homo sapiens
tgttagtagaaatt

SEQ ID NO: 229440 - DNA, 15 bp, Homo sapiens
tgttagtcatttgct

SEQ ID NO: 229441 - DNA, 15 bp, Homo sapiens
tgttagtgggaagag

SEQ ID NO: 229442 - DNA, 20 bp, Homo sapiens
tgttataaaatctgtattgc

SEQ ID NO: 229443 - DNA, 21 bp, Homo sapiens
tgttataaaatctgtattgct

SEQ ID NO: 229444 - DNA, 23 bp, Homo sapiens
tgttataactctgcactactcct

SEQ ID NO: 229445 - DNA, 22 bp, Homo sapiens
tgttatcagtacaattctttgt

SEQ ID NO: 229446 - DNA, 12 bp, Homo sapiens
tgttatcttgtg

SEQ ID NO: 229447 - DNA, 15 bp, Homo sapiens
tgttatgaacatgca

SEQ ID NO: 229448 - DNA, 13 bp, Homo sapiens
tgttatgactcca

SEQ ID NO: 229449 - DNA, 17 bp, Homo sapiens
tgttatgactccagaat

SEQ ID NO: 229450 - DNA, 15 bp, Homo sapiens
tgttccctgcaccct

SEQ ID NO: 229451 - DNA, 16 bp, Homo sapiens
tgttccctgcaccctg

SEQ ID NO: 229452 - DNA, 21 bp, Homo sapiens
tgttccctgctgggtgggaat

SEQ ID NO: 229453 - DNA, 15 bp, Homo sapiens
tgttccgttcatctg

SEQ ID NO: 229454 - DNA, 23 bp, Homo sapiens
tgttcctaaaaatctgtggcaag

SEQ ID NO: 229455 - DNA, 14 bp, Homo sapiens
tgttcctagagtag

SEQ ID NO: 229456 - DNA, 12 bp, Homo sapiens
tgttcctgcctt

SEQ ID NO: 229457 - DNA, 19 bp, Homo sapiens
tgttcctgctccatgactg

SEQ ID NO: 229458 - DNA, 16 bp, Homo sapiens
tgttcctgctttctct

SEQ ID NO: 229459 - DNA, 14 bp, Homo sapiens
tgttcctggcctca

SEQ ID NO: 229460 - DNA, 12 bp, Homo sapiens
tgttcctgtgtt

SEQ ID NO: 229461 - DNA, 21 bp, Homo sapiens
tgttccttatgatattctcat

SEQ ID NO: 229462 - DNA, 19 bp, Homo sapiens
tgttcgtggagccacaggc

SEQ ID NO: 229463 - DNA, 22 bp, Homo sapiens
tgttctagacttccccatcccg

SEQ ID NO: 229464 - DNA, 19 bp, Homo sapiens
tgttctagttagcaggaaa

SEQ ID NO: 229465 - DNA, 20 bp, Homo sapiens
tgttctatagcagtcatcat

SEQ ID NO: 229466 - DNA, 21 bp, Homo sapiens
tgttctattaatcacctctct

SEQ ID NO: 229467 - DNA, 22 bp, Homo sapiens
tgttctattaatcacctctctg

SEQ ID NO: 229468 - DNA, 21 bp, Homo sapiens
tgttctcaatgcttttctagc

SEQ ID NO: 229469 - DNA, 13 bp, Homo sapiens
tgttctcagagct

SEQ ID NO: 229470 - DNA, 21 bp, Homo sapiens
tgttctcagagctccacagaa

SEQ ID NO: 229471 - DNA, 22 bp, Homo sapiens
tgttctcagagctccacagaag

SEQ ID NO: 229472 - DNA, 11 bp, Homo sapiens
tgttctcctcc

SEQ ID NO: 229473 - DNA, 15 bp, Homo sapiens
tgttctgacattaac

SEQ ID NO: 229474 - DNA, 16 bp, Homo sapiens
tgttctgacattaaca

SEQ ID NO: 229475 - DNA, 10 bp, Homo sapiens
tgttctgagc

SEQ ID NO: 229476 - DNA, 15 bp, Homo sapiens
tgttctgatattaat

SEQ ID NO: 229477 - DNA, 22 bp, Homo sapiens
tgttctgcagagacttctagga

SEQ ID NO: 229478 - DNA, 16 bp, Homo sapiens
tgttctggctttacat

SEQ ID NO: 229479 - DNA, 23 bp, Homo sapiens
tgttctggtggccccagctgtga

SEQ ID NO: 229480 - DNA, 22 bp, Homo sapiens
tgttctgtaatggaactgaccc

SEQ ID NO: 229481 - DNA, 12 bp, Homo sapiens
tgttctgtgtcc

SEQ ID NO: 229482 - DNA, 16 bp, Homo sapiens
tgttctgtgtctgctg

SEQ ID NO: 229483 - DNA, 21 bp, Homo sapiens
tgttctgtttgttaaaactgg

SEQ ID NO: 229484 - DNA, 13 bp, Homo sapiens
tgttctgttttgt

SEQ ID NO: 229485 - DNA, 14 bp, Homo sapiens
tgttcttccccaca

SEQ ID NO: 229486 - DNA, 21 bp, Homo sapiens
tgttcttgctgagcaccctct

SEQ ID NO: 229487 - DNA, 21 bp, Homo sapiens
tgttcttgtaaaactgtgaca

SEQ ID NO: 229488 - DNA, 22 bp, Homo sapiens
tgttcttgtaaaactgtgacat

SEQ ID NO: 229489 - DNA, 23 bp, Homo sapiens
tgttctttcctttcatcctcagc

SEQ ID NO: 229490 - DNA, 14 bp, Homo sapiens
tgttcttttctggt

SEQ ID NO: 229491 - DNA, 12 bp, Homo sapiens
tgttcttttgat

SEQ ID NO: 229492 - DNA, 14 bp, Homo sapiens
tgttgaaattatgt

SEQ ID NO: 229493 - DNA, 21 bp, Homo sapiens
tgttgaaattatgtatgttta

SEQ ID NO: 229494 - DNA, 18 bp, Homo sapiens
tgttgaagtcaaatttgg

SEQ ID NO: 229495 - DNA, 19 bp, Homo sapiens
tgttgacatccaagcttcc

SEQ ID NO: 229496 - DNA, 13 bp, Homo sapiens
tgttgagctgttt

SEQ ID NO: 229497 - DNA, 19 bp, Homo sapiens
tgttgaggtggtctgaatg

SEQ ID NO: 229498 - DNA, 16 bp, Homo sapiens
tgttgagtatttgctg

SEQ ID NO: 229499 - DNA, 14 bp, Homo sapiens
tgttgagtgttcat

SEQ ID NO: 229500 - DNA, 20 bp, Homo sapiens
tgttgagttggacacactgt

SEQ ID NO: 229501 - DNA, 19 bp, Homo sapiens
tgttgatgggccttcagat

SEQ ID NO: 229502 - DNA, 11 bp, Homo sapiens
tgttgattatt

SEQ ID NO: 229503 - DNA, 21 bp, Homo sapiens
tgttgattctttcaatccaca

SEQ ID NO: 229504 - DNA, 22 bp, Homo sapiens
tgttgattctttcaatccacag

SEQ ID NO: 229505 - DNA, 20 bp, Homo sapiens
tgttgattgcaggaataagg

SEQ ID NO: 229506 - DNA, 15 bp, Homo sapiens
tgttgcacagtccct

SEQ ID NO: 229507 - DNA, 16 bp, Homo sapiens
tgttgcactgaaaacc

SEQ ID NO: 229508 - DNA, 14 bp, Homo sapiens
tgttgccaaagctg

SEQ ID NO: 229509 - DNA, 17 bp, Homo sapiens
tgttgccaactaagccc

SEQ ID NO: 229510 - DNA, 16 bp, Homo sapiens
tgttgccacaggacac

SEQ ID NO: 229511 - DNA, 14 bp, Homo sapiens
tgttgccatagccc

SEQ ID NO: 229512 - DNA, 21 bp, Homo sapiens
tgttgcccaggctggagtgca

SEQ ID NO: 229513 - DNA, 22 bp, Homo sapiens
tgttgcccgtggatctgggcac

SEQ ID NO: 229514 - DNA, 21 bp, Homo sapiens
tgttgccctttctgtaccatt

SEQ ID NO: 229515 - DNA, 12 bp, Homo sapiens
tgttgcctcctc

SEQ ID NO: 229516 - DNA, 13 bp, Homo sapiens
tgttgcctcctct

SEQ ID NO: 229517 - DNA, 14 bp, Homo sapiens
tgttgcctcctctc

SEQ ID NO: 229518 - DNA, 15 bp, Homo sapiens
tgttgcctcctctct

SEQ ID NO: 229519 - DNA, 21 bp, Homo sapiens
tgttgcctcctctctccctgc

SEQ ID NO: 229520 - DNA, 19 bp, Homo sapiens
tgttgctcaaaaaatgagc

SEQ ID NO: 229521 - DNA, 21 bp, Homo sapiens
tgttgctcaaatctattcaga

SEQ ID NO: 229522 - DNA, 23 bp, Homo sapiens
tgttgctcagcaaggggctctgc

SEQ ID NO: 229523 - DNA, 14 bp, Homo sapiens
tgttgctcagtctc

SEQ ID NO: 229524 - DNA, 18 bp, Homo sapiens
tgttgctcttggaaagct

SEQ ID NO: 229525 - DNA, 15 bp, Homo sapiens
tgttgcttagatgag

SEQ ID NO: 229526 - DNA, 24 bp, Homo sapiens
tgttggaactctgtgcaggtgctg

SEQ ID NO: 229527 - DNA, 21 bp, Homo sapiens
tgttggcccctctgctgtcct

SEQ ID NO: 229528 - DNA, 17 bp, Homo sapiens
tgttggcccttccagtg

SEQ ID NO: 229529 - DNA, 16 bp, Homo sapiens
tgttggcctccggcct

SEQ ID NO: 229530 - DNA, 16 bp, Homo sapiens
tgttggctgctcccca

SEQ ID NO: 229531 - DNA, 13 bp, Homo sapiens
tgttgggacctgc

SEQ ID NO: 229532 - DNA, 17 bp, Homo sapiens
tgttgggacctgctgct

SEQ ID NO: 229533 - DNA, 19 bp, Homo sapiens
tgttgggacctgctgctcc

SEQ ID NO: 229534 - DNA, 23 bp, Homo sapiens
tgttggtctttctaatgtagcta

SEQ ID NO: 229535 - DNA, 23 bp, Homo sapiens
tgttggtgcgaaagtaaaaacac

SEQ ID NO: 229536 - DNA, 18 bp, Homo sapiens
ttaagcactttgaaaata

SEQ ID NO: 229537 - DNA, 15 bp, Homo sapiens
ttaagcagaagcatt

SEQ ID NO: 229538 - DNA, 19 bp, Homo sapiens
ttaagcagcctttctgtgg

SEQ ID NO: 229539 - DNA, 18 bp, Homo sapiens
ttaagcagtaaaaactgt

SEQ ID NO: 229540 - DNA, 18 bp, Homo sapiens
ttaagcatgagtggcctt

SEQ ID NO: 229541 - DNA, 22 bp, Homo sapiens
ttaagcattttactgtctgtaa

SEQ ID NO: 229542 - DNA, 12 bp, Homo sapiens
ttaagcccagga

SEQ ID NO: 229543 - DNA, 13 bp, Homo sapiens
ttaagcccaggag

SEQ ID NO: 229544 - DNA, 14 bp, Homo sapiens
ttaagctccagctt

SEQ ID NO: 229545 - DNA, 13 bp, Homo sapiens
ttaaggaagaaaa

SEQ ID NO: 229546 - DNA, 14 bp, Homo sapiens
ttaaggagaggaga

SEQ ID NO: 229547 - DNA, 15 bp, Homo sapiens
ttaaggcaactgaac

SEQ ID NO: 229548 - DNA, 22 bp, Homo sapiens
ttaaggcaactgaacaaaaaaa

SEQ ID NO: 229549 - DNA, 10 bp, Homo sapiens
ttaagggcat

SEQ ID NO: 229550 - DNA, 19 bp, Homo sapiens
ttaagggcatgttgggata

SEQ ID NO: 229551 - DNA, 14 bp, Homo sapiens
ttaagtatcagaaa

SEQ ID NO: 229552 - DNA, 14 bp, Homo sapiens
ttaagtatcttttt

SEQ ID NO: 229553 - DNA, 17 bp, Homo sapiens
ttaagtcgctgaacaat

SEQ ID NO: 229554 - DNA, 19 bp, Homo sapiens
ttaagtctaaatatttcct

SEQ ID NO: 229555 - DNA, 14 bp, Homo sapiens
ttaagtgacataga

SEQ ID NO: 229556 - DNA, 20 bp, Homo sapiens
ttaagtgcttggttgaaaag

SEQ ID NO: 229557 - DNA, 20 bp, Homo sapiens
ttaataaaaaaacaatcatt

SEQ ID NO: 229558 - DNA, 13 bp, Homo sapiens
ttaataaaattga

SEQ ID NO: 229559 - DNA, 13 bp, Homo sapiens
ttaataaagacag

SEQ ID NO: 229560 - DNA, 13 bp, Homo sapiens
ttaataaaggttt

SEQ ID NO: 229561 - DNA, 16 bp, Homo sapiens
ttaatacctttaaata

SEQ ID NO: 229562 - DNA, 20 bp, Homo sapiens
ttaatacctttaaatatcat

SEQ ID NO: 229563 - DNA, 18 bp, Homo sapiens
ttaatactgtattgctgt

SEQ ID NO: 229564 - DNA, 22 bp, Homo sapiens
ttaatagcttttattgtataaa

SEQ ID NO: 229565 - DNA, 17 bp, Homo sapiens
ttaataggaggacagaa

SEQ ID NO: 229566 - DNA, 18 bp, Homo sapiens
ttaatagtactattaaca

SEQ ID NO: 229567 - DNA, 18 bp, Homo sapiens
ttaatatactaaccattt

SEQ ID NO: 229568 - DNA, 23 bp, Homo sapiens
ttaatatactcagggattccttc

SEQ ID NO: 229569 - DNA, 22 bp, Homo sapiens
ttaatcaatcatgccctgcctt

SEQ ID NO: 229570 - DNA, 21 bp, Homo sapiens
ttaatcagaaaccccacttcc

SEQ ID NO: 229571 - DNA, 12 bp, Homo sapiens
ttaatcagtgtg

SEQ ID NO: 229572 - DNA, 16 bp, Homo sapiens
ttaatcatatcaactt

SEQ ID NO: 229573 - DNA, 21 bp, Homo sapiens
ttaatcatatcaacttaattc

SEQ ID NO: 229574 - DNA, 14 bp, Homo sapiens
ttaatcatttccag

SEQ ID NO: 229575 - DNA, 16 bp, Homo sapiens
ttaatcatttccagca

SEQ ID NO: 229576 - DNA, 15 bp, Homo sapiens
ttaatcctttaactc

SEQ ID NO: 229577 - DNA, 23 bp, Homo sapiens
ttaatcggttgaccctactgtgg

SEQ ID NO: 229578 - DNA, 22 bp, Homo sapiens
ttaatctagagctatgcacacc

SEQ ID NO: 229579 - DNA, 14 bp, Homo sapiens
ttaatctctaaaat

SEQ ID NO: 229580 - DNA, 15 bp, Homo sapiens
ttaatctctaaaatt

SEQ ID NO: 229581 - DNA, 20 bp, Homo sapiens
ttaatctctaaaattctagt

SEQ ID NO: 229582 - DNA, 15 bp, Homo sapiens
ttaatcttcagtttt

SEQ ID NO: 229583 - DNA, 17 bp, Homo sapiens
ttaatcttctctcttga

SEQ ID NO: 229584 - DNA, 22 bp, Homo sapiens
ttaatctttattttattattca

SEQ ID NO: 229585 - DNA, 14 bp, Homo sapiens
ttaatgaaaatgtc

SEQ ID NO: 229586 - DNA, 15 bp, Homo sapiens
ttaatgaaaatgtca

SEQ ID NO: 229587 - DNA, 16 bp, Homo sapiens
ttaatgaaaatgtcag

SEQ ID NO: 229588 - DNA, 23 bp, Homo sapiens
ttaatgatcaacaatttaatgta

SEQ ID NO: 229589 - DNA, 21 bp, Homo sapiens
ttaatggacttatttcttcaa

SEQ ID NO: 229590 - DNA, 15 bp, Homo sapiens
ttaatggcatgtaat

SEQ ID NO: 229591 - DNA, 19 bp, Homo sapiens
ttaatggctagtactgtat

SEQ ID NO: 229592 - DNA, 13 bp, Homo sapiens
ttaatgtaaaatt

SEQ ID NO: 229593 - DNA, 18 bp, Homo sapiens
ttaatgtaaaattcatag

SEQ ID NO: 229594 - DNA, 19 bp, Homo sapiens
ttaatgtgtatttactgta

SEQ ID NO: 229595 - DNA, 22 bp, Homo sapiens
ttaatgttctgaataatttctt

SEQ ID NO: 229596 - DNA, 17 bp, Homo sapiens
ttaatgttttgtacaat

SEQ ID NO: 229597 - DNA, 11 bp, Homo sapiens
ttaatgttttt

SEQ ID NO: 229598 - DNA, 19 bp, Homo sapiens
ttaattaggggttgctaag

SEQ ID NO: 229599 - DNA, 20 bp, Homo sapiens
ttaattaggggttgctaaga

SEQ ID NO: 229600 - DNA, 13 bp, Homo sapiens
ttaccaactttct

SEQ ID NO: 229601 - DNA, 14 bp, Homo sapiens
ttaccaactttctg

SEQ ID NO: 229602 - DNA, 16 bp, Homo sapiens
ttaccaactttctgta

SEQ ID NO: 229603 - DNA, 18 bp, Homo sapiens
ttaccaactttctgtaaa

SEQ ID NO: 229604 - DNA, 19 bp, Homo sapiens
ttaccagccccccacccca

SEQ ID NO: 229605 - DNA, 13 bp, Homo sapiens
ttaccatcttaat

SEQ ID NO: 229606 - DNA, 16 bp, Homo sapiens
ttaccatcttaatctt

SEQ ID NO: 229607 - DNA, 17 bp, Homo sapiens
ttaccatcttaatcttt

SEQ ID NO: 229608 - DNA, 13 bp, Homo sapiens
ttaccatttgtaa

SEQ ID NO: 229609 - DNA, 14 bp, Homo sapiens
ttaccatttgtaat

SEQ ID NO: 229610 - DNA, 17 bp, Homo sapiens
ttacccaataagataca

SEQ ID NO: 229611 - DNA, 13 bp, Homo sapiens
ttaccccagctcc

SEQ ID NO: 229612 - DNA, 13 bp, Homo sapiens
ttacccctcattt

SEQ ID NO: 229613 - DNA, 16 bp, Homo sapiens
ttaccctactggctgt

SEQ ID NO: 229614 - DNA, 17 bp, Homo sapiens
ttaccctactggctgta

SEQ ID NO: 229615 - DNA, 12 bp, Homo sapiens
ttaccctccctg

SEQ ID NO: 229616 - DNA, 16 bp, Homo sapiens
ttaccctccctgtccc

SEQ ID NO: 229617 - DNA, 12 bp, Homo sapiens
ttacccttctgt

SEQ ID NO: 229618 - DNA, 16 bp, Homo sapiens
ttacccttctgtgccc

SEQ ID NO: 229619 - DNA, 17 bp, Homo sapiens
ttacccttctgtgccca

SEQ ID NO: 229620 - DNA, 19 bp, Homo sapiens
ttacccttctgtgcccagc

SEQ ID NO: 229621 - DNA, 21 bp, Homo sapiens
ttacccttctgtgcccagctc

SEQ ID NO: 229622 - DNA, 20 bp, Homo sapiens
ttacctaaacagatataaat

SEQ ID NO: 229623 - DNA, 21 bp, Homo sapiens
ttacctaaacagatataaatg

SEQ ID NO: 229624 - DNA, 18 bp, Homo sapiens
ttacctaagtgacatttg

SEQ ID NO: 229625 - DNA, 16 bp, Homo sapiens
ttacctaccacagtgt

SEQ ID NO: 229626 - DNA, 18 bp, Homo sapiens
ttacctaccacagtgtct

SEQ ID NO: 229627 - DNA, 21 bp, Homo sapiens
ttacctgtaatagcctcacct

SEQ ID NO: 229628 - DNA, 23 bp, Homo sapiens
ttaccttattgagcgtgattctg

SEQ ID NO: 229629 - DNA, 23 bp, Homo sapiens
ttaccttcacatgtcctattact

SEQ ID NO: 229630 - DNA, 20 bp, Homo sapiens
ttacgcacacgtacttaaat

SEQ ID NO: 229631 - DNA, 13 bp, Homo sapiens
ttacgtgagtcct

SEQ ID NO: 229632 - DNA, 14 bp, Homo sapiens
ttacgtgagtcctg

SEQ ID NO: 229633 - DNA, 21 bp, Homo sapiens
ttactaaacattttgttattg

SEQ ID NO: 229634 - DNA, 22 bp, Homo sapiens
ttactaaagatatcagagctct

SEQ ID NO: 229635 - DNA, 14 bp, Homo sapiens
ttactaaagcagtg

SEQ ID NO: 229636 - DNA, 17 bp, Homo sapiens
ttactaaagcagtgttt

SEQ ID NO: 229637 - DNA, 18 bp, Homo sapiens
ttactaaagcagtgtttt

SEQ ID NO: 229638 - DNA, 19 bp, Homo sapiens
ttactaaagcagtgttttc

SEQ ID NO: 229639 - DNA, 14 bp, Homo sapiens
ttactaaatctact

SEQ ID NO: 229640 - DNA, 23 bp, Homo sapiens
ttactaaatctactcttaaatat

SEQ ID NO: 229641 - DNA, 15 bp, Homo sapiens
ttactaaattgtata

SEQ ID NO: 229642 - DNA, 17 bp, Homo sapiens
ttactaagccacaagaa

SEQ ID NO: 229643 - DNA, 21 bp, Homo sapiens
ttactaagccacaagaaattt

SEQ ID NO: 229644 - DNA, 22 bp, Homo sapiens
ttactaagccacaagaaatttg

SEQ ID NO: 229645 - DNA, 20 bp, Homo sapiens
ttactacccaaatctaaata

SEQ ID NO: 229646 - DNA, 22 bp, Homo sapiens
ttactactattctgttaaaatc

SEQ ID NO: 229647 - DNA, 17 bp, Homo sapiens
ttactactgcaagttca

SEQ ID NO: 229648 - DNA, 22 bp, Homo sapiens
ttactatcttttcatttatcaa

SEQ ID NO: 229649 - DNA, 17 bp, Homo sapiens
ttactattaactctgca

SEQ ID NO: 229650 - DNA, 14 bp, Homo sapiens
ttactattaagcag

SEQ ID NO: 229651 - DNA, 20 bp, Homo sapiens
ttactattcccactttcatt

SEQ ID NO: 229652 - DNA, 21 bp, Homo sapiens
ttactattccctttgacttca

SEQ ID NO: 229653 - DNA, 15 bp, Homo sapiens
ttactcaccaaaaag

SEQ ID NO: 229654 - DNA, 22 bp, Homo sapiens
ttagtttgtatgccaagtgaga

SEQ ID NO: 229655 - DNA, 17 bp, Homo sapiens
ttagttttagttgcaga

SEQ ID NO: 229656 - DNA, 15 bp, Homo sapiens
ttagttttgttccaa

SEQ ID NO: 229657 - DNA, 12 bp, Homo sapiens
ttataaacacat

SEQ ID NO: 229658 - DNA, 19 bp, Homo sapiens
ttataaacagataatgctt

SEQ ID NO: 229659 - DNA, 21 bp, Homo sapiens
ttataaatcatattgatgaaa

SEQ ID NO: 229660 - DNA, 23 bp, Homo sapiens
ttataaatcatattgatgaaaag

SEQ ID NO: 229661 - DNA, 12 bp, Homo sapiens
ttataaatgtgt

SEQ ID NO: 229662 - DNA, 16 bp, Homo sapiens
ttataacaattgattt

SEQ ID NO: 229663 - DNA, 17 bp, Homo sapiens
ttataacagcattcttg

SEQ ID NO: 229664 - DNA, 14 bp, Homo sapiens
ttataacattgtaa

SEQ ID NO: 229665 - DNA, 17 bp, Homo sapiens
ttataacattgtaaatg

SEQ ID NO: 229666 - DNA, 16 bp, Homo sapiens
ttataagaaaacatgt

SEQ ID NO: 229667 - DNA, 17 bp, Homo sapiens
ttataagaaaacatgta

SEQ ID NO: 229668 - DNA, 17 bp, Homo sapiens
ttataagcattgaaatt

SEQ ID NO: 229669 - DNA, 23 bp, Homo sapiens
ttataagctatgtcactaccctc

SEQ ID NO: 229670 - DNA, 11 bp, Homo sapiens
ttataaggact

SEQ ID NO: 229671 - DNA, 16 bp, Homo sapiens
ttataaggactgcatg

SEQ ID NO: 229672 - DNA, 18 bp, Homo sapiens
ttataataatgttaacat

SEQ ID NO: 229673 - DNA, 17 bp, Homo sapiens
ttataatttctacccat

SEQ ID NO: 229674 - DNA, 21 bp, Homo sapiens
ttataatttttttattactga

SEQ ID NO: 229675 - DNA, 16 bp, Homo sapiens
ttataatttttttcaa

SEQ ID NO: 229676 - DNA, 16 bp, Homo sapiens
ttatacagacctaata

SEQ ID NO: 229677 - DNA, 19 bp, Homo sapiens
ttatacagacctaatatca

SEQ ID NO: 229678 - DNA, 20 bp, Homo sapiens
ttatacagacctaatatcat

SEQ ID NO: 229679 - DNA, 15 bp, Homo sapiens
ttatacatctgtatt

SEQ ID NO: 229680 - DNA, 18 bp, Homo sapiens
ttataccaagagtatgag

SEQ ID NO: 229681 - DNA, 15 bp, Homo sapiens
ttataccagcaaaag

SEQ ID NO: 229682 - DNA, 19 bp, Homo sapiens
ttatactatttattaaaac

SEQ ID NO: 229683 - DNA, 20 bp, Homo sapiens
ttatacttaaacagcttttt

SEQ ID NO: 229684 - DNA, 13 bp, Homo sapiens
ttatacttcaaaa

SEQ ID NO: 229685 - DNA, 23 bp, Homo sapiens
ttatagaatatttattacctctg

SEQ ID NO: 229686 - DNA, 17 bp, Homo sapiens
ttatagcaaacttggaa

SEQ ID NO: 229687 - DNA, 24 bp, Homo sapiens
ttatagcacgaagctatgagaata

SEQ ID NO: 229688 - DNA, 19 bp, Homo sapiens
ttatagcatgtaatattaa

SEQ ID NO: 229689 - DNA, 18 bp, Homo sapiens
ttatagtatatctggaca

SEQ ID NO: 229690 - DNA, 15 bp, Homo sapiens
ttatagtttatacag

SEQ ID NO: 229691 - DNA, 17 bp, Homo sapiens
ttatagtttatacagtt

SEQ ID NO: 229692 - DNA, 14 bp, Homo sapiens
ttatagtttcaagc

SEQ ID NO: 229693 - DNA, 12 bp, Homo sapiens
ttatagtttgta

SEQ ID NO: 229694 - DNA, 15 bp, Homo sapiens
ttatagtttgtacat

SEQ ID NO: 229695 - DNA, 18 bp, Homo sapiens
ttatataaatgtaaaaat

SEQ ID NO: 229696 - DNA, 23 bp, Homo sapiens
ttatatacctggcttttacttta

SEQ ID NO: 229697 - DNA, 12 bp, Homo sapiens
ttatatataaaa

SEQ ID NO: 229698 - DNA, 15 bp, Homo sapiens
ttatatataaaataa

SEQ ID NO: 229699 - DNA, 22 bp, Homo sapiens
ttatatataaaataaatatact

SEQ ID NO: 229700 - DNA, 16 bp, Homo sapiens
ttatatatatgctact

SEQ ID NO: 229701 - DNA, 15 bp, Homo sapiens
ttatatatttgaaag

SEQ ID NO: 229702 - DNA, 17 bp, Homo sapiens
ttatatggcccagcctt

SEQ ID NO: 229703 - DNA, 18 bp, Homo sapiens
ttatattgagacaaaaat

SEQ ID NO: 229704 - DNA, 23 bp, Homo sapiens
ttatatttccctaaaatacattt

SEQ ID NO: 229705 - DNA, 13 bp, Homo sapiens
ttatatttgtctc

SEQ ID NO: 229706 - DNA, 14 bp, Homo sapiens
ttatattttatact

SEQ ID NO: 229707 - DNA, 15 bp, Homo sapiens
ttatattttctatat

SEQ ID NO: 229708 - DNA, 17 bp, Homo sapiens
ttatatttttaataaaa

SEQ ID NO: 229709 - DNA, 19 bp, Homo sapiens
ttatatttttaataaaagt

SEQ ID NO: 229710 - DNA, 22 bp, Homo sapiens
ttatcaagcagagacctttgtt

SEQ ID NO: 229711 - DNA, 20 bp, Homo sapiens
ttatcaagctaataaaatat

SEQ ID NO: 229712 - DNA, 13 bp, Homo sapiens
ttatcacacaaag

SEQ ID NO: 229713 - DNA, 18 bp, Homo sapiens
ttatcacattatttgcat

SEQ ID NO: 229714 - DNA, 21 bp, Homo sapiens
ttatcagattgcttttgtgca

SEQ ID NO: 229715 - DNA, 14 bp, Homo sapiens
ttatcagtgaatat

SEQ ID NO: 229716 - DNA, 19 bp, Homo sapiens
ttatcagtgaatataaatg

SEQ ID NO: 229717 - DNA, 23 bp, Homo sapiens
ttatcagtgatggtctcacagag

SEQ ID NO: 229718 - DNA, 15 bp, Homo sapiens
ttatcatttaagatt

SEQ ID NO: 229719 - DNA, 11 bp, Homo sapiens
ttatcatttct

SEQ ID NO: 229720 - DNA, 20 bp, Homo sapiens
ttatcatttctactgaagtt

SEQ ID NO: 229721 - DNA, 16 bp, Homo sapiens
ttatcattttcaaaat

SEQ ID NO: 229722 - DNA, 14 bp, Homo sapiens
ttatccaaatcttg

SEQ ID NO: 229723 - DNA, 12 bp, Homo sapiens
ttatccctgctt

SEQ ID NO: 229724 - DNA, 19 bp, Homo sapiens
ttatcctaaaacaaatagt

SEQ ID NO: 229725 - DNA, 21 bp, Homo sapiens
ttatcctagttccattcttgg

SEQ ID NO: 229726 - DNA, 16 bp, Homo sapiens
ttatcggaagcagtgc

SEQ ID NO: 229727 - DNA, 23 bp, Homo sapiens
ttatcgggagcagtgtcttccat

SEQ ID NO: 229728 - DNA, 14 bp, Homo sapiens
ttatctacccagtc

SEQ ID NO: 229729 - DNA, 21 bp, Homo sapiens
ttatctagcaagaagattcta

SEQ ID NO: 229730 - DNA, 21 bp, Homo sapiens
ttatctatttgtatatataca

SEQ ID NO: 229731 - DNA, 13 bp, Homo sapiens
ttatctcacaaat

SEQ ID NO: 229732 - DNA, 16 bp, Homo sapiens
ttatctccctgcttca

SEQ ID NO: 229733 - DNA, 22 bp, Homo sapiens
ttatctccctgcttcatatctc

SEQ ID NO: 229734 - DNA, 16 bp, Homo sapiens
ttatctctttctctct

SEQ ID NO: 229735 - DNA, 14 bp, Homo sapiens
ttatctgcctggcc

SEQ ID NO: 229736 - DNA, 15 bp, Homo sapiens
ttatctgcctggcct

SEQ ID NO: 229737 - DNA, 13 bp, Homo sapiens
ttatctgtcttta

SEQ ID NO: 229738 - DNA, 20 bp, Homo sapiens
ttatctgtctttatgatttc

SEQ ID NO: 229739 - DNA, 18 bp, Homo sapiens
ttatctgtgcgtgaaaca

SEQ ID NO: 229740 - DNA, 19 bp, Homo sapiens
ttatctgtgcgtgaaacac

SEQ ID NO: 229741 - DNA, 13 bp, Homo sapiens
ttatcttctgttt

SEQ ID NO: 229742 - DNA, 17 bp, Homo sapiens
ttatcttggactgacat

SEQ ID NO: 229743 - DNA, 22 bp, Homo sapiens
ttcaaaatcagtgatgggagta

SEQ ID NO: 229744 - DNA, 13 bp, Homo sapiens
ttcaaaatgcatg

SEQ ID NO: 229745 - DNA, 14 bp, Homo sapiens
ttcaaaatgcatgt

SEQ ID NO: 229746 - DNA, 17 bp, Homo sapiens
ttcaaaatgcatgtgat

SEQ ID NO: 229747 - DNA, 21 bp, Homo sapiens
ttcaaaatgcatgtgattggc

SEQ ID NO: 229748 - DNA, 22 bp, Homo sapiens
ttcaaaatgttaataaaggttt

SEQ ID NO: 229749 - DNA, 16 bp, Homo sapiens
ttcaaaattaaatctg

SEQ ID NO: 229750 - DNA, 16 bp, Homo sapiens
ttcaaacacacagtat

SEQ ID NO: 229751 - DNA, 17 bp, Homo sapiens
ttcaaacagcatcaaaa

SEQ ID NO: 229752 - DNA, 22 bp, Homo sapiens
ttcaaacagcatcaaaatacaa

SEQ ID NO: 229753 - DNA, 18 bp, Homo sapiens
ttcaaactactgtacatt

SEQ ID NO: 229754 - DNA, 18 bp, Homo sapiens
ttcaaagaacccccctcc

SEQ ID NO: 229755 - DNA, 11 bp, Homo sapiens
ttcaaagctga

SEQ ID NO: 229756 - DNA, 11 bp, Homo sapiens
ttcaaaggctt

SEQ ID NO: 229757 - DNA, 23 bp, Homo sapiens
ttcaaatccttccaaaaattatt

SEQ ID NO: 229758 - DNA, 13 bp, Homo sapiens
ttcaaatgcaaaa

SEQ ID NO: 229759 - DNA, 16 bp, Homo sapiens
ttcaaattcctgcaaa

SEQ ID NO: 229760 - DNA, 13 bp, Homo sapiens
ttcaacaaatgat

SEQ ID NO: 229761 - DNA, 15 bp, Homo sapiens
ttcaacatcaatgtt

SEQ ID NO: 229762 - DNA, 21 bp, Homo sapiens
ttcaacatcaatgttcattgt

SEQ ID NO: 229763 - DNA, 15 bp, Homo sapiens
ttcaaccattcccca

SEQ ID NO: 229764 - DNA, 14 bp, Homo sapiens
ttcaaccctgccct

SEQ ID NO: 229765 - DNA, 17 bp, Homo sapiens
ttcaacctagaaacctt

SEQ ID NO: 229766 - DNA, 17 bp, Homo sapiens
ttcaactgaccagcctc

SEQ ID NO: 229767 - DNA, 16 bp, Homo sapiens
ttcaacttcaggaaag

SEQ ID NO: 229768 - DNA, 14 bp, Homo sapiens
ttcaagaaaataaa

SEQ ID NO: 229769 - DNA, 18 bp, Homo sapiens
ttcaagaaagatatctat

SEQ ID NO: 229770 - DNA, 24 bp, Homo sapiens
ttcaagaaagatatctatgactgt

SEQ ID NO: 229771 - DNA, 13 bp, Homo sapiens
ttcagaagttgtt

SEQ ID NO: 229772 - DNA, 14 bp, Homo sapiens
ttcagaataaatgg

SEQ ID NO: 229773 - DNA, 18 bp, Homo sapiens
ttcagaatcaaacctttt

SEQ ID NO: 229774 - DNA, 23 bp, Homo sapiens
ttcagaattatacagacctaata

SEQ ID NO: 229775 - DNA, 15 bp, Homo sapiens
ttcagacaagcaaca

SEQ ID NO: 229776 - DNA, 15 bp, Homo sapiens
ttcagacactttgga

SEQ ID NO: 229777 - DNA, 10 bp, Homo sapiens
ttcagacagg

SEQ ID NO: 229778 - DNA, 16 bp, Homo sapiens
ttcagacccctgcctg

SEQ ID NO: 229779 - DNA, 18 bp, Homo sapiens
ttcagacccctgcctgga

SEQ ID NO: 229780 - DNA, 23 bp, Homo sapiens
ttcagagaagtcagttggagaaa

SEQ ID NO: 229781 - DNA, 16 bp, Homo sapiens
ttcagagactggcagc

SEQ ID NO: 229782 - DNA, 20 bp, Homo sapiens
ttcagagactggcagccagg

SEQ ID NO: 229783 - DNA, 22 bp, Homo sapiens
ttcagagccagtgaaggagcca

SEQ ID NO: 229784 - DNA, 13 bp, Homo sapiens
ttcagagccctcg

SEQ ID NO: 229785 - DNA, 20 bp, Homo sapiens
ttcagagtgaatcatccaga

SEQ ID NO: 229786 - DNA, 13 bp, Homo sapiens
ttcagatcctacc

SEQ ID NO: 229787 - DNA, 13 bp, Homo sapiens
ttcagatgtgcat

SEQ ID NO: 229788 - DNA, 15 bp, Homo sapiens
ttcagattggacata

SEQ ID NO: 229789 - DNA, 20 bp, Homo sapiens
ttcagatttaccataatgtt

SEQ ID NO: 229790 - DNA, 17 bp, Homo sapiens
ttcagcacccccaccca

SEQ ID NO: 229791 - DNA, 12 bp, Homo sapiens
ttccattaattt

SEQ ID NO: 229792 - DNA, 16 bp, Homo sapiens
ttccattaatttcaac

SEQ ID NO: 229793 - DNA, 14 bp, Homo sapiens
ttccattatgattc

SEQ ID NO: 229794 - DNA, 16 bp, Homo sapiens
ttccattccagaatat

SEQ ID NO: 229795 - DNA, 16 bp, Homo sapiens
ttccattctttcttcc

SEQ ID NO: 229796 - DNA, 17 bp, Homo sapiens
ttccattcttttaaatg

SEQ ID NO: 229797 - DNA, 16 bp, Homo sapiens
ttccattgctcccagt

SEQ ID NO: 229798 - DNA, 11 bp, Homo sapiens
ttccatttctg

SEQ ID NO: 229799 - DNA, 16 bp, Homo sapiens
ttccatttcttcagag

SEQ ID NO: 229800 - DNA, 23 bp, Homo sapiens
ttccattttggcgctattacaaa

SEQ ID NO: 229801 - DNA, 21 bp, Homo sapiens
ttccatttttactaaagcagt

SEQ ID NO: 229802 - DNA, 22 bp, Homo sapiens
ttccatttttactaaagcagtg

SEQ ID NO: 229803 - DNA, 18 bp, Homo sapiens
ttcccaaaccaagtgcct

SEQ ID NO: 229804 - DNA, 20 bp, Homo sapiens
ttcccaaactacagaataat

SEQ ID NO: 229805 - DNA, 18 bp, Homo sapiens
ttcccaactcactgtgct

SEQ ID NO: 229806 - DNA, 16 bp, Homo sapiens
ttcccaactttggaaa

SEQ ID NO: 229807 - DNA, 21 bp, Homo sapiens
ttcccaagagtggtggcagct

SEQ ID NO: 229808 - DNA, 21 bp, Homo sapiens
ttcccaaggccagtctgaacc

SEQ ID NO: 229809 - DNA, 14 bp, Homo sapiens
ttcccacacatatt

SEQ ID NO: 229810 - DNA, 21 bp, Homo sapiens
ttcccacctccctgcccaggc

SEQ ID NO: 229811 - DNA, 18 bp, Homo sapiens
ttcccacgacaaaaacaa

SEQ ID NO: 229812 - DNA, 22 bp, Homo sapiens
ttcccacgttgacaccaagaaa

SEQ ID NO: 229813 - DNA, 15 bp, Homo sapiens
ttcccactgtccttt

SEQ ID NO: 229814 - DNA, 23 bp, Homo sapiens
ttcccactgtcctttctccaggc

SEQ ID NO: 229815 - DNA, 18 bp, Homo sapiens
ttcccagatagtcccagc

SEQ ID NO: 229816 - DNA, 21 bp, Homo sapiens
ttcccagcaaagttttcagat

SEQ ID NO: 229817 - DNA, 18 bp, Homo sapiens
ttcccagctggcagcgcc

SEQ ID NO: 229818 - DNA, 17 bp, Homo sapiens
ttcccaggccagcgagg

SEQ ID NO: 229819 - DNA, 23 bp, Homo sapiens
ttcccataacataaaagtgctac

SEQ ID NO: 229820 - DNA, 16 bp, Homo sapiens
ttcccataattttctt

SEQ ID NO: 229821 - DNA, 18 bp, Homo sapiens
ttcccataattttcttca

SEQ ID NO: 229822 - DNA, 16 bp, Homo sapiens
ttcccatgactgcacc

SEQ ID NO: 229823 - DNA, 19 bp, Homo sapiens
ttcccatgactgcacccag

SEQ ID NO: 229824 - DNA, 23 bp, Homo sapiens
ttcccattactttaatactcacc

SEQ ID NO: 229825 - DNA, 13 bp, Homo sapiens
ttcccatttgtaa

SEQ ID NO: 229826 - DNA, 15 bp, Homo sapiens
ttcccatttgtaatg

SEQ ID NO: 229827 - DNA, 16 bp, Homo sapiens
ttccccaacgaaaagc

SEQ ID NO: 229828 - DNA, 16 bp, Homo sapiens
ttccccactcccgtga

SEQ ID NO: 229829 - DNA, 19 bp, Homo sapiens
ttccccactctgctcccag

SEQ ID NO: 229830 - DNA, 21 bp, Homo sapiens
ttccccactgacagcctccca

SEQ ID NO: 229831 - DNA, 18 bp, Homo sapiens
ttccccactgcctgccca

SEQ ID NO: 229832 - DNA, 16 bp, Homo sapiens
ttccccatatttgtgt

SEQ ID NO: 229833 - DNA, 19 bp, Homo sapiens
ttccccatatttgtgttca

SEQ ID NO: 229834 - DNA, 18 bp, Homo sapiens
ttcccccaacctcagact

SEQ ID NO: 229835 - DNA, 14 bp, Homo sapiens
ttcccccactaccg

SEQ ID NO: 229836 - DNA, 13 bp, Homo sapiens
ttcccccagccct

SEQ ID NO: 229837 - DNA, 20 bp, Homo sapiens
ttcccccagccctgtggaag

SEQ ID NO: 229838 - DNA, 17 bp, Homo sapiens
ttcccccatgtggctga

SEQ ID NO: 229839 - DNA, 18 bp, Homo sapiens
ttcccccatgtggctgaa

SEQ ID NO: 229840 - DNA, 21 bp, Homo sapiens
ttccccccactctccccacac

SEQ ID NO: 229841 - DNA, 15 bp, Homo sapiens
ttcccccttcccctg

SEQ ID NO: 229842 - DNA, 15 bp, Homo sapiens
ttcccctaagtggat

SEQ ID NO: 229843 - DNA, 18 bp, Homo sapiens
ttcccctcattgcattta

SEQ ID NO: 229844 - DNA, 19 bp, Homo sapiens
ttcccctcccacctctcct

SEQ ID NO: 229845 - DNA, 17 bp, Homo sapiens
ttcccctccttctccct

SEQ ID NO: 229846 - DNA, 18 bp, Homo sapiens
ttcccctccttctccctt

SEQ ID NO: 229847 - DNA, 18 bp, Homo sapiens
ttcccctcctttgtcttt

SEQ ID NO: 229848 - DNA, 19 bp, Homo sapiens
ttcccctgctgaccttgga

SEQ ID NO: 229849 - DNA, 21 bp, Homo sapiens
ttcccctggaccacacctccg

SEQ ID NO: 229850 - DNA, 13 bp, Homo sapiens
ttcccctgtcctg

SEQ ID NO: 229851 - DNA, 18 bp, Homo sapiens
ttccccttgaacctcatt

SEQ ID NO: 229852 - DNA, 19 bp, Homo sapiens
ttccccttgaacctcatta

SEQ ID NO: 229853 - DNA, 20 bp, Homo sapiens
ttccccttgaacctcattaa

SEQ ID NO: 229854 - DNA, 14 bp, Homo sapiens
ttccccttggcttc

SEQ ID NO: 229855 - DNA, 23 bp, Homo sapiens
ttcccgagcaaagtctaaagttt

SEQ ID NO: 229856 - DNA, 16 bp, Homo sapiens
ttcccgcctcagcctc

SEQ ID NO: 229857 - DNA, 14 bp, Homo sapiens
ttcccgctcagccc

SEQ ID NO: 229858 - DNA, 22 bp, Homo sapiens
ttcccgctcagccctccctgcc

SEQ ID NO: 229859 - DNA, 19 bp, Homo sapiens
ttcccggagcacagccctg

SEQ ID NO: 229860 - DNA, 14 bp, Homo sapiens
ttcccggctggact

SEQ ID NO: 229861 - DNA, 22 bp, Homo sapiens
ttccctaaaatacatttaaaac

SEQ ID NO: 229862 - DNA, 15 bp, Homo sapiens
ttccctaagccaagg

SEQ ID NO: 229863 - DNA, 19 bp, Homo sapiens
ttccctacccacagggcct

SEQ ID NO: 229864 - DNA, 14 bp, Homo sapiens
ttccctacctcagg

SEQ ID NO: 229865 - DNA, 13 bp, Homo sapiens
ttccctacgagga

SEQ ID NO: 229866 - DNA, 21 bp, Homo sapiens
ttccctactaacatcccaata

SEQ ID NO: 229867 - DNA, 22 bp, Homo sapiens
ttccctagaaagccatattcca

SEQ ID NO: 229868 - DNA, 17 bp, Homo sapiens
ttccctcactcttcctc

SEQ ID NO: 229869 - DNA, 19 bp, Homo sapiens
ttccctcactcttcctcat

SEQ ID NO: 229870 - DNA, 17 bp, Homo sapiens
ttccctcagtgtgaagc

SEQ ID NO: 229871 - DNA, 14 bp, Homo sapiens
ttccctcctgacaa

SEQ ID NO: 229872 - DNA, 11 bp, Homo sapiens
ttccctctcta

SEQ ID NO: 229873 - DNA, 19 bp, Homo sapiens
ttccctctgctcctggagc

SEQ ID NO: 229874 - DNA, 14 bp, Homo sapiens
ttccctctttcctg

SEQ ID NO: 229875 - DNA, 15 bp, Homo sapiens
ttccctgcaccctgg

SEQ ID NO: 229876 - DNA, 14 bp, Homo sapiens
ttccctgcatccct

SEQ ID NO: 229877 - DNA, 16 bp, Homo sapiens
ttccctggaattcacc

SEQ ID NO: 229878 - DNA, 11 bp, Homo sapiens
ttccctggacc

SEQ ID NO: 229879 - DNA, 14 bp, Homo sapiens
ttccctggtccaga

SEQ ID NO: 229880 - DNA, 20 bp, Homo sapiens
ttccctgttctttaagactt

SEQ ID NO: 229881 - DNA, 15 bp, Homo sapiens
ttcccttagcctctc

SEQ ID NO: 229882 - DNA, 17 bp, Homo sapiens
ttcccttagcctctccc

SEQ ID NO: 229883 - DNA, 18 bp, Homo sapiens
ttcccttagcctctccca

SEQ ID NO: 229884 - DNA, 13 bp, Homo sapiens
ttcccttcagtac

SEQ ID NO: 229885 - DNA, 15 bp, Homo sapiens
ttcccttcccttcca

SEQ ID NO: 229886 - DNA, 17 bp, Homo sapiens
ttcccttccggtgcgtg

SEQ ID NO: 229887 - DNA, 20 bp, Homo sapiens
ttcccttctccttccaactg

SEQ ID NO: 229888 - DNA, 11 bp, Homo sapiens
ttcccttggaa

SEQ ID NO: 229889 - DNA, 11 bp, Homo sapiens
ttcccttggcc

SEQ ID NO: 229890 - DNA, 14 bp, Homo sapiens
ttccctttgacttc

SEQ ID NO: 229891 - DNA, 16 bp, Homo sapiens
ttccctttgctccacc

SEQ ID NO: 229892 - DNA, 18 bp, Homo sapiens
ttccctttgctccacccc

SEQ ID NO: 229893 - DNA, 18 bp, Homo sapiens
ttccctttgttgctgtct

SEQ ID NO: 229894 - DNA, 15 bp, Homo sapiens
ttccctttttaaatg

SEQ ID NO: 229895 - DNA, 17 bp, Homo sapiens
ttccctttttaaatgag

SEQ ID NO: 229896 - DNA, 21 bp, Homo sapiens
ttccgaagaccttctgaagat

SEQ ID NO: 229897 - DNA, 23 bp, Homo sapiens
ttccgaagagggaatggatgggg

SEQ ID NO: 229898 - DNA, 20 bp, Homo sapiens
ttccgacaaccgatgctcca

SEQ ID NO: 229899 - DNA, 22 bp, Homo sapiens
ttccgacaaccgatgctccagc

SEQ ID NO: 229900 - DNA, 12 bp, Homo sapiens
ttccgctcccac

SEQ ID NO: 229901 - DNA, 13 bp, Homo sapiens
ttccgctctgagg

SEQ ID NO: 229902 - DNA, 18 bp, Homo sapiens
ttccggggaggagccttg

SEQ ID NO: 229903 - DNA, 13 bp, Homo sapiens
ttccgtctcctct

SEQ ID NO: 229904 - DNA, 14 bp, Homo sapiens
ttccgtctcctctc

SEQ ID NO: 229905 - DNA, 17 bp, Homo sapiens
ttccgtgagctcaaact

SEQ ID NO: 229906 - DNA, 18 bp, Homo sapiens
ttccgtgggtcatcccag

SEQ ID NO: 229907 - DNA, 13 bp, Homo sapiens
ttccgttcatctg

SEQ ID NO: 229908 - DNA, 16 bp, Homo sapiens
ttccgttcatctgagg

SEQ ID NO: 229909 - DNA, 19 bp, Homo sapiens
ttccgttcatctgaggagt

SEQ ID NO: 229910 - DNA, 17 bp, Homo sapiens
ttccgttgtacatgttc

SEQ ID NO: 229911 - DNA, 23 bp, Homo sapiens
ttcctaaatatccaaagactgta

SEQ ID NO: 229912 - DNA, 19 bp, Homo sapiens
ttcctaacacagcatgtgt

SEQ ID NO: 229913 - DNA, 13 bp, Homo sapiens
ttcctaacttatt

SEQ ID NO: 229914 - DNA, 20 bp, Homo sapiens
ttcctaatcagaaattttta

SEQ ID NO: 229915 - DNA, 23 bp, Homo sapiens
ttcctaatcagaaatttttatca

SEQ ID NO: 229916 - DNA, 14 bp, Homo sapiens
ttcctacaatatat

SEQ ID NO: 229917 - DNA, 14 bp, Homo sapiens
ttcctacagcccct

SEQ ID NO: 229918 - DNA, 16 bp, Homo sapiens
ttcctacccaaccact

SEQ ID NO: 229919 - DNA, 13 bp, Homo sapiens
ttcctaccctctc

SEQ ID NO: 229920 - DNA, 22 bp, Homo sapiens
ttcctacttaaacaaaaacttt

SEQ ID NO: 229921 - DNA, 17 bp, Homo sapiens
ttcctagataaaaagat

SEQ ID NO: 229922 - DNA, 19 bp, Homo sapiens
ttcctagatggcagtcact

SEQ ID NO: 229923 - DNA, 20 bp, Homo sapiens
ttcctagtatacccactgca

SEQ ID NO: 229924 - DNA, 22 bp, Homo sapiens
ttcgatgtacagtctcaatttt

SEQ ID NO: 229925 - DNA, 23 bp, Homo sapiens
ttcgatgtacagtctcaattttg

SEQ ID NO: 229926 - DNA, 17 bp, Homo sapiens
ttcgcagtgcccagtga

SEQ ID NO: 229927 - DNA, 15 bp, Homo sapiens
ttcgctattcccagg

SEQ ID NO: 229928 - DNA, 12 bp, Homo sapiens
ttcggaggaggt

SEQ ID NO: 229929 - DNA, 14 bp, Homo sapiens
ttcggcaccttccc

SEQ ID NO: 229930 - DNA, 15 bp, Homo sapiens
ttcggggtgaagcaa

SEQ ID NO: 229931 - DNA, 19 bp, Homo sapiens
ttcggttctccagaatgta

SEQ ID NO: 229932 - DNA, 15 bp, Homo sapiens
ttcgtacagttcttc

SEQ ID NO: 229933 - DNA, 22 bp, Homo sapiens
ttcgtacagttcttcgggaaga

SEQ ID NO: 229934 - DNA, 23 bp, Homo sapiens
ttcgtacagttcttcgggaagag

SEQ ID NO: 229935 - DNA, 12 bp, Homo sapiens
ttcgtctgtccc

SEQ ID NO: 229936 - DNA, 14 bp, Homo sapiens
ttcgtcttctaatt

SEQ ID NO: 229937 - DNA, 16 bp, Homo sapiens
ttcgtcttctaatttc

SEQ ID NO: 229938 - DNA, 23 bp, Homo sapiens
ttcgtgaataagttgattctgtc

SEQ ID NO: 229939 - DNA, 16 bp, Homo sapiens
ttcgtgcactctgcta

SEQ ID NO: 229940 - DNA, 14 bp, Homo sapiens
ttcgtgcatttgtg

SEQ ID NO: 229941 - DNA, 13 bp, Homo sapiens
ttcgtgcattttt

SEQ ID NO: 229942 - DNA, 20 bp, Homo sapiens
ttcgtgtagtggaagagcag

SEQ ID NO: 229943 - DNA, 17 bp, Homo sapiens
ttcgtgtctctcccacc

SEQ ID NO: 229944 - DNA, 21 bp, Homo sapiens
ttcgtgtctctcccaccccgg

SEQ ID NO: 229945 - DNA, 16 bp, Homo sapiens
ttcgtgtgtgcgcccc

SEQ ID NO: 229946 - DNA, 18 bp, Homo sapiens
ttcgtgtgtgcgcccctc

SEQ ID NO: 229947 - DNA, 15 bp, Homo sapiens
ttcgttcttgttctg

SEQ ID NO: 229948 - DNA, 20 bp, Homo sapiens
ttcgttggttgtttctctga

SEQ ID NO: 229949 - DNA, 14 bp, Homo sapiens
ttctaaaaagtcaa

SEQ ID NO: 229950 - DNA, 18 bp, Homo sapiens
ttctaaaaattgtgatca

SEQ ID NO: 229951 - DNA, 13 bp, Homo sapiens
ttctaaactgttt

SEQ ID NO: 229952 - DNA, 19 bp, Homo sapiens
ttctaaactgttttcatgt

SEQ ID NO: 229953 - DNA, 21 bp, Homo sapiens
ttctaaactgttttcatgtgt

SEQ ID NO: 229954 - DNA, 20 bp, Homo sapiens
ttctaaaggcctcttccttg

SEQ ID NO: 229955 - DNA, 15 bp, Homo sapiens
ttctaaatgaatgtt

SEQ ID NO: 229956 - DNA, 20 bp, Homo sapiens
ttctaaatgcatatcctgag

SEQ ID NO: 229957 - DNA, 23 bp, Homo sapiens
ttctaaatgcatatcctgagcca

SEQ ID NO: 229958 - DNA, 19 bp, Homo sapiens
ttctaacaaaaaaatatat

SEQ ID NO: 229959 - DNA, 22 bp, Homo sapiens
ttctaacagatcagaacatgaa

SEQ ID NO: 229960 - DNA, 17 bp, Homo sapiens
ttctaagcttatttcta

SEQ ID NO: 229961 - DNA, 18 bp, Homo sapiens
ttctaaggatagcctttg

SEQ ID NO: 229962 - DNA, 21 bp, Homo sapiens
ttctaaggatagcctttgtag

SEQ ID NO: 229963 - DNA, 18 bp, Homo sapiens
ttctaagttatttacttt

SEQ ID NO: 229964 - DNA, 16 bp, Homo sapiens
ttctaataaatatact

SEQ ID NO: 229965 - DNA, 13 bp, Homo sapiens
ttctaatataatg

SEQ ID NO: 229966 - DNA, 22 bp, Homo sapiens
ttctaatatatttttatattta

SEQ ID NO: 229967 - DNA, 13 bp, Homo sapiens
ttctaatgtcttc

SEQ ID NO: 229968 - DNA, 16 bp, Homo sapiens
ttctaatttgaatgaa

SEQ ID NO: 229969 - DNA, 17 bp, Homo sapiens
ttctaatttgctgctga

SEQ ID NO: 229970 - DNA, 13 bp, Homo sapiens
ttctaattttgtg

SEQ ID NO: 229971 - DNA, 16 bp, Homo sapiens
ttctaattttgtgctc

SEQ ID NO: 229972 - DNA, 17 bp, Homo sapiens
ttctaattttgtgctct

SEQ ID NO: 229973 - DNA, 15 bp, Homo sapiens
ttctacaaccagagc

SEQ ID NO: 229974 - DNA, 16 bp, Homo sapiens
ttctacaaccagagcc

SEQ ID NO: 229975 - DNA, 22 bp, Homo sapiens
ttctacacctgttgcacctcag

SEQ ID NO: 229976 - DNA, 14 bp, Homo sapiens
ttctacatgactgg

SEQ ID NO: 229977 - DNA, 21 bp, Homo sapiens
ttctacctttttttctctcct

SEQ ID NO: 229978 - DNA, 15 bp, Homo sapiens
ttctacgtataaata

SEQ ID NO: 229979 - DNA, 19 bp, Homo sapiens
ttctactttttccttcctg

SEQ ID NO: 229980 - DNA, 18 bp, Homo sapiens
ttctagaaaagcttccta

SEQ ID NO: 229981 - DNA, 22 bp, Homo sapiens
ttctagaattataagtcacaaa

SEQ ID NO: 229982 - DNA, 16 bp, Homo sapiens
ttctagacactgaagg

SEQ ID NO: 229983 - DNA, 18 bp, Homo sapiens
ttctagacactgaaggca

SEQ ID NO: 229984 - DNA, 15 bp, Homo sapiens
ttctagacgcccctc

SEQ ID NO: 229985 - DNA, 17 bp, Homo sapiens
ttctagacgcccctccc

SEQ ID NO: 229986 - DNA, 14 bp, Homo sapiens
ttctagacttcccc

SEQ ID NO: 229987 - DNA, 15 bp, Homo sapiens
ttctagacttcccca

SEQ ID NO: 229988 - DNA, 21 bp, Homo sapiens
ttctagagagggaattctctt

SEQ ID NO: 229989 - DNA, 16 bp, Homo sapiens
ttctagatatgagaaa

SEQ ID NO: 229990 - DNA, 17 bp, Homo sapiens
ttctagatcagagagca

SEQ ID NO: 229991 - DNA, 14 bp, Homo sapiens
ttctagatcctgca

SEQ ID NO: 229992 - DNA, 15 bp, Homo sapiens
ttctagatcctgcac

SEQ ID NO: 229993 - DNA, 21 bp, Homo sapiens
ttctagatcctgcaccccagc

SEQ ID NO: 229994 - DNA, 22 bp, Homo sapiens
ttctagatcctgcaccccagca

SEQ ID NO: 229995 - DNA, 14 bp, Homo sapiens
ttctagattcactg

SEQ ID NO: 229996 - DNA, 17 bp, Homo sapiens
ttctagattcactgtct

SEQ ID NO: 229997 - DNA, 15 bp, Homo sapiens
ttctagcaggcagga

SEQ ID NO: 229998 - DNA, 12 bp, Homo sapiens
ttctagctgttg

SEQ ID NO: 229999 - DNA, 16 bp, Homo sapiens
ttctaggaggatgctg

SEQ ID NO: 230000 - DNA, 20 bp, Homo sapiens
ttctaggaggatgctgtgcc

SEQ ID NO: 230001 - DNA, 16 bp, Homo sapiens
ttctaggcatctcctc

SEQ ID NO: 230002 - DNA, 16 bp, Homo sapiens
ttctaggggagaagag

SEQ ID NO: 230003 - DNA, 23 bp, Homo sapiens
ttctagtctcctttgcactgagg

SEQ ID NO: 230004 - DNA, 11 bp, Homo sapiens
ttctagttcaa

SEQ ID NO: 230005 - DNA, 22 bp, Homo sapiens
ttctataaattcaacacttatt

SEQ ID NO: 230006 - DNA, 12 bp, Homo sapiens
ttctatactgtt

SEQ ID NO: 230007 - DNA, 13 bp, Homo sapiens
ttctatactgttt

SEQ ID NO: 230008 - DNA, 24 bp, Homo sapiens
ttctatactgtttgtaatatacag

SEQ ID NO: 230009 - DNA, 23 bp, Homo sapiens
ttctatagcagattgtgtaacaa

SEQ ID NO: 230010 - DNA, 19 bp, Homo sapiens
ttctatagcagtcatcatt

SEQ ID NO: 230011 - DNA, 16 bp, Homo sapiens
ttctatatttgtaact

SEQ ID NO: 230012 - DNA, 23 bp, Homo sapiens
ttctatatttgtaactttgcatg

SEQ ID NO: 230013 - DNA, 14 bp, Homo sapiens
ttctatcacatatt

SEQ ID NO: 230014 - DNA, 17 bp, Homo sapiens
ttctatcacatatttga

SEQ ID NO: 230015 - DNA, 16 bp, Homo sapiens
ttctatccccaagctg

SEQ ID NO: 230016 - DNA, 17 bp, Homo sapiens
ttctatccccaagctgg

SEQ ID NO: 230017 - DNA, 17 bp, Homo sapiens
ttctatctgcaaatagt

SEQ ID NO: 230018 - DNA, 19 bp, Homo sapiens
ttctatgcctgtatttcca

SEQ ID NO: 230019 - DNA, 18 bp, Homo sapiens
ttctatggattcacttct

SEQ ID NO: 230020 - DNA, 14 bp, Homo sapiens
ttctattccttctg

SEQ ID NO: 230021 - DNA, 18 bp, Homo sapiens
ttctattgtattatttgg

SEQ ID NO: 230022 - DNA, 21 bp, Homo sapiens
ttctattgtattatttggagt

SEQ ID NO: 230023 - DNA, 19 bp, Homo sapiens
ttctattgttactctggtt

SEQ ID NO: 230024 - DNA, 18 bp, Homo sapiens
ttctcaaagatctgaatt

SEQ ID NO: 230025 - DNA, 19 bp, Homo sapiens
ttctcaaagtttttacagt

SEQ ID NO: 230026 - DNA, 20 bp, Homo sapiens
ttctcaaagtttttacagtg

SEQ ID NO: 230027 - DNA, 21 bp, Homo sapiens
ttctcaaagtttttacagtgt

SEQ ID NO: 230028 - DNA, 15 bp, Homo sapiens
ttctcaagtgcctta

SEQ ID NO: 230029 - DNA, 18 bp, Homo sapiens
ttctcacatctgtccaga

SEQ ID NO: 230030 - DNA, 17 bp, Homo sapiens
ttctcactatgtttctc

SEQ ID NO: 230031 - DNA, 18 bp, Homo sapiens
ttctcactatgtttctca

SEQ ID NO: 230032 - DNA, 23 bp, Homo sapiens
ttctcactccctttgtggacttt

SEQ ID NO: 230033 - DNA, 16 bp, Homo sapiens
ttctcagaacagctga

SEQ ID NO: 230034 - DNA, 17 bp, Homo sapiens
ttctcagaacagctgaa

SEQ ID NO: 230035 - DNA, 15 bp, Homo sapiens
ttctcagaagtgaaa

SEQ ID NO: 230036 - DNA, 16 bp, Homo sapiens
ttctcagaagtgaaaa

SEQ ID NO: 230037 - DNA, 17 bp, Homo sapiens
ttctcagagcatgtgtc

SEQ ID NO: 230038 - DNA, 15 bp, Homo sapiens
ttctcagagccaagt

SEQ ID NO: 230039 - DNA, 20 bp, Homo sapiens
ttctcagatatttatatttt

SEQ ID NO: 230040 - DNA, 20 bp, Homo sapiens
ttctcagcaagtgtacagta

SEQ ID NO: 230041 - DNA, 14 bp, Homo sapiens
ttctcagctccact

SEQ ID NO: 230042 - DNA, 18 bp, Homo sapiens
ttctcagctccactctga

SEQ ID NO: 230043 - DNA, 21 bp, Homo sapiens
ttctcagctccactctgaagt

SEQ ID NO: 230044 - DNA, 21 bp, Homo sapiens
ttctcaggaggtgtctcctac

SEQ ID NO: 230045 - DNA, 17 bp, Homo sapiens
ttctcagtttttgctga

SEQ ID NO: 230046 - DNA, 20 bp, Homo sapiens
ttctcataggaaaagtacat

SEQ ID NO: 230047 - DNA, 11 bp, Homo sapiens
ttctcatgcac

SEQ ID NO: 230048 - DNA, 15 bp, Homo sapiens
ttctcatgcactgca

SEQ ID NO: 230049 - DNA, 16 bp, Homo sapiens
ttgtactttgtttttc

SEQ ID NO: 230050 - DNA, 19 bp, Homo sapiens
ttgtagcaggtttcactat

SEQ ID NO: 230051 - DNA, 16 bp, Homo sapiens
ttgtagcatttcttga

SEQ ID NO: 230052 - DNA, 15 bp, Homo sapiens
ttgtagctagtttaa

SEQ ID NO: 230053 - DNA, 21 bp, Homo sapiens
ttgtagctagtttaaaattat

SEQ ID NO: 230054 - DNA, 22 bp, Homo sapiens
ttgtagctcttagtcctccctg

SEQ ID NO: 230055 - DNA, 19 bp, Homo sapiens
ttgtaggaatctgccttcc

SEQ ID NO: 230056 - DNA, 16 bp, Homo sapiens
ttgtagggatgccttt

SEQ ID NO: 230057 - DNA, 19 bp, Homo sapiens
ttgtaggggtcaaagaaat

SEQ ID NO: 230058 - DNA, 19 bp, Homo sapiens
ttgtaggtcaatgaaatat

SEQ ID NO: 230059 - DNA, 19 bp, Homo sapiens
ttgtaggtgcaagatggaa

SEQ ID NO: 230060 - DNA, 23 bp, Homo sapiens
ttgtagttaatttattaagtctg

SEQ ID NO: 230061 - DNA, 19 bp, Homo sapiens
ttgtagttacctactgagt

SEQ ID NO: 230062 - DNA, 14 bp, Homo sapiens
ttgtataacttctt

SEQ ID NO: 230063 - DNA, 15 bp, Homo sapiens
ttgtataattatgaa

SEQ ID NO: 230064 - DNA, 23 bp, Homo sapiens
ttgtataccatgatgcatggagt

SEQ ID NO: 230065 - DNA, 15 bp, Homo sapiens
ttgtataggccatct

SEQ ID NO: 230066 - DNA, 14 bp, Homo sapiens
ttgtatagtgtaaa

SEQ ID NO: 230067 - DNA, 23 bp, Homo sapiens
ttgtatagttttataaaactcag

SEQ ID NO: 230068 - DNA, 22 bp, Homo sapiens
ttgtatcaaactcgtctgatgt

SEQ ID NO: 230069 - DNA, 21 bp, Homo sapiens
ttgtatctctgaagcatgttt

SEQ ID NO: 230070 - DNA, 14 bp, Homo sapiens
ttgtatcttaaatc

SEQ ID NO: 230071 - DNA, 15 bp, Homo sapiens
ttgtatcttaaatct

SEQ ID NO: 230072 - DNA, 19 bp, Homo sapiens
ttgtatgaagtacttttaa

SEQ ID NO: 230073 - DNA, 13 bp, Homo sapiens
ttgtatgatgtgt

SEQ ID NO: 230074 - DNA, 14 bp, Homo sapiens
ttgtatgatgtgtt

SEQ ID NO: 230075 - DNA, 20 bp, Homo sapiens
ttgtatgatgtgttgtgata

SEQ ID NO: 230076 - DNA, 20 bp, Homo sapiens
ttgtatgcctttaaatctgt

SEQ ID NO: 230077 - DNA, 22 bp, Homo sapiens
ttgtatgcctttaaatctgtga

SEQ ID NO: 230078 - DNA, 23 bp, Homo sapiens
ttgtatgcctttaaatctgtgat

SEQ ID NO: 230079 - DNA, 13 bp, Homo sapiens
ttgtatgctgccc

SEQ ID NO: 230080 - DNA, 13 bp, Homo sapiens
ttgtatgtatgtg

SEQ ID NO: 230081 - DNA, 14 bp, Homo sapiens
ttgtatgtatgtgt

SEQ ID NO: 230082 - DNA, 15 bp, Homo sapiens
ttgtatgttatgaac

SEQ ID NO: 230083 - DNA, 14 bp, Homo sapiens
ttgtattaaagaca

SEQ ID NO: 230084 - DNA, 14 bp, Homo sapiens
ttgtattacatcta

SEQ ID NO: 230085 - DNA, 16 bp, Homo sapiens
ttgtattatcagtgaa

SEQ ID NO: 230086 - DNA, 23 bp, Homo sapiens
ttgtattatcagtgaatataaat

SEQ ID NO: 230087 - DNA, 18 bp, Homo sapiens
ttgtattatttggagtta

SEQ ID NO: 230088 - DNA, 15 bp, Homo sapiens
ttgtattcctgcctt

SEQ ID NO: 230089 - DNA, 21 bp, Homo sapiens
ttgtattctctgtccagggct

SEQ ID NO: 230090 - DNA, 21 bp, Homo sapiens
ttgtatttcttttatatataa

SEQ ID NO: 230091 - DNA, 13 bp, Homo sapiens
ttgtattttgtac

SEQ ID NO: 230092 - DNA, 13 bp, Homo sapiens
ttgtatttttgaa

SEQ ID NO: 230093 - DNA, 22 bp, Homo sapiens
ttgtcaaagtggtgagaggcat

SEQ ID NO: 230094 - DNA, 22 bp, Homo sapiens
ttgtcaaatgtcattatgtaga

SEQ ID NO: 230095 - DNA, 14 bp, Homo sapiens
ttgtcaacttcagt

SEQ ID NO: 230096 - DNA, 14 bp, Homo sapiens
ttgtcaatattaaa

SEQ ID NO: 230097 - DNA, 16 bp, Homo sapiens
ttgtcacaacactgaa

SEQ ID NO: 230098 - DNA, 18 bp, Homo sapiens
ttgtcacaacactgaacc

SEQ ID NO: 230099 - DNA, 23 bp, Homo sapiens
ttgtcacaatcctaacacattat

SEQ ID NO: 230100 - DNA, 22 bp, Homo sapiens
ttgtcactggaacctccctggg

SEQ ID NO: 230101 - DNA, 20 bp, Homo sapiens
ttgtcacttctgctgtacag

SEQ ID NO: 230102 - DNA, 21 bp, Homo sapiens
ttgttctagacttccccatcc

SEQ ID NO: 230103 - DNA, 18 bp, Homo sapiens
ttgttctgggtgatttct

SEQ ID NO: 230104 - DNA, 22 bp, Homo sapiens
ttgttctgggtgatttctagaa

SEQ ID NO: 230105 - DNA, 23 bp, Homo sapiens
ttgttctgtggttttcccctccc

SEQ ID NO: 230106 - DNA, 14 bp, Homo sapiens
ttgttgaaactaaa

SEQ ID NO: 230107 - DNA, 14 bp, Homo sapiens
ttgttgacttattt

SEQ ID NO: 230108 - DNA, 16 bp, Homo sapiens
ttgttgagtctctgaa

SEQ ID NO: 230109 - DNA, 23 bp, Homo sapiens
ttgttgatgggcacttgagaact

SEQ ID NO: 230110 - DNA, 20 bp, Homo sapiens
ttgttgccaggttgcagctg

SEQ ID NO: 230111 - DNA, 22 bp, Homo sapiens
ttgttgccaggttgcagctgct

SEQ ID NO: 230112 - DNA, 14 bp, Homo sapiens
ttgttgtattcctg

SEQ ID NO: 230113 - DNA, 15 bp, Homo sapiens
ttgttgttttatata

SEQ ID NO: 230114 - DNA, 12 bp, Homo sapiens
ttgtttaattgt

SEQ ID NO: 230115 - DNA, 15 bp, Homo sapiens
ttgtttacatgagtt

SEQ ID NO: 230116 - DNA, 20 bp, Homo sapiens
ttgtttatttatcagtgaca

SEQ ID NO: 230117 - DNA, 15 bp, Homo sapiens
ttgtttccctgctgg

SEQ ID NO: 230118 - DNA, 23 bp, Homo sapiens
ttgtttcctgtgcccatcatctc

SEQ ID NO: 230119 - DNA, 13 bp, Homo sapiens
ttgtttctatact

SEQ ID NO: 230120 - DNA, 11 bp, Homo sapiens
ttgtttgctgc

SEQ ID NO: 230121 - DNA, 14 bp, Homo sapiens
ttgtttgctgcttt

SEQ ID NO: 230122 - DNA, 15 bp, Homo sapiens
ttgtttgcttattgt

SEQ ID NO: 230123 - DNA, 21 bp, Homo sapiens
ttgtttgggtatcctgcccag

SEQ ID NO: 230124 - DNA, 14 bp, Homo sapiens
ttgtttggtacttt

SEQ ID NO: 230125 - DNA, 10 bp, Homo sapiens
ttgtttgttt

SEQ ID NO: 230126 - DNA, 23 bp, Homo sapiens
ttgtttgttttgttttttagttc

SEQ ID NO: 230127 - DNA, 16 bp, Homo sapiens
ttgttttaaggaagaa

SEQ ID NO: 230128 - DNA, 11 bp, Homo sapiens
ttgttttctgt

SEQ ID NO: 230129 - DNA, 23 bp, Homo sapiens
ttgttttcttcttcagtgaagca

SEQ ID NO: 230130 - DNA, 14 bp, Homo sapiens
ttgttttgcacttt

SEQ ID NO: 230131 - DNA, 16 bp, Homo sapiens
ttgtttttatatatta

SEQ ID NO: 230132 - DNA, 22 bp, Homo sapiens
ttgtttttatatattataagtt

SEQ ID NO: 230133 - DNA, 18 bp, Homo sapiens
ttgtttttccatgtgttt

SEQ ID NO: 230134 - DNA, 13 bp, Homo sapiens
ttgttttttcata

SEQ ID NO: 230135 - DNA, 19 bp, Homo sapiens
ttgttttttcatagtgcct

SEQ ID NO: 230136 - DNA, 19 bp, Homo sapiens
tttaaaaaaataatataaa

SEQ ID NO: 230137 - DNA, 20 bp, Homo sapiens
tttaaaaaataactaccaag

SEQ ID NO: 230138 - DNA, 13 bp, Homo sapiens
tttaaaaactgga

SEQ ID NO: 230139 - DNA, 10 bp, Homo sapiens
tttaaaaaga

SEQ ID NO: 230140 - DNA, 16 bp, Homo sapiens
tttaaaaagaagaaaa

SEQ ID NO: 230141 - DNA, 13 bp, Homo sapiens
tttaaaaaggcct

SEQ ID NO: 230142 - DNA, 14 bp, Homo sapiens
tttaaaaaggcctt

SEQ ID NO: 230143 - DNA, 17 bp, Homo sapiens
tttaaaaagttaactct

SEQ ID NO: 230144 - DNA, 19 bp, Homo sapiens
tttaaaaatctttcagaat

SEQ ID NO: 230145 - DNA, 19 bp, Homo sapiens
tttaaaaatgcatgataat

SEQ ID NO: 230146 - DNA, 20 bp, Homo sapiens
tttaaaacaagaaagtttcc

SEQ ID NO: 230147 - DNA, 21 bp, Homo sapiens
tttaaaacaagaaagtttccc

SEQ ID NO: 230148 - DNA, 14 bp, Homo sapiens
tttaaaacatggca

SEQ ID NO: 230149 - DNA, 12 bp, Homo sapiens
tttaaaagactt

SEQ ID NO: 230150 - DNA, 23 bp, Homo sapiens
tttaaaagaggaaattaaataat

SEQ ID NO: 230151 - DNA, 19 bp, Homo sapiens
tttaaaagcaaaactgcaa

SEQ ID NO: 230152 - DNA, 19 bp, Homo sapiens
tttaaaaggtattttgaat

SEQ ID NO: 230153 - DNA, 17 bp, Homo sapiens
tttaaaataagttaaag

SEQ ID NO: 230154 - DNA, 21 bp, Homo sapiens
tttaaaatggacttttgttca

SEQ ID NO: 230155 - DNA, 18 bp, Homo sapiens
tttaaaatgtagaagaaa

SEQ ID NO: 230156 - DNA, 13 bp, Homo sapiens
tttaaaattatta

SEQ ID NO: 230157 - DNA, 18 bp, Homo sapiens
tttaaacttcttaactgg

SEQ ID NO: 230158 - DNA, 11 bp, Homo sapiens
tttaaagaaaa

SEQ ID NO: 230159 - DNA, 12 bp, Homo sapiens
tttaaagaataa

SEQ ID NO: 230160 - DNA, 13 bp, Homo sapiens
tttaaagaataaa

SEQ ID NO: 230161 - DNA, 15 bp, Homo sapiens
tttaaagaataaagt

SEQ ID NO: 230162 - DNA, 12 bp, Homo sapiens
tttaaagactta

SEQ ID NO: 230163 - DNA, 17 bp, Homo sapiens
tttaaaggacaaacagt

SEQ ID NO: 230164 - DNA, 19 bp, Homo sapiens
tttaaaggacaaacagtga

SEQ ID NO: 230165 - DNA, 21 bp, Homo sapiens
tttaaagggagccatgctctt

SEQ ID NO: 230166 - DNA, 20 bp, Homo sapiens
tttaaagttttatatgcata

SEQ ID NO: 230167 - DNA, 13 bp, Homo sapiens
tttaaataaagta

SEQ ID NO: 230168 - DNA, 21 bp, Homo sapiens
tttaaataaagtatcatgcat

SEQ ID NO: 230169 - DNA, 14 bp, Homo sapiens
tttaaataccagta

SEQ ID NO: 230170 - DNA, 17 bp, Homo sapiens
tttaaatataaatgttt

SEQ ID NO: 230171 - DNA, 15 bp, Homo sapiens
tttaaatataattct

SEQ ID NO: 230172 - DNA, 18 bp, Homo sapiens
tttaaatataattctgta

SEQ ID NO: 230173 - DNA, 16 bp, Homo sapiens
tttaaatcagatacct

SEQ ID NO: 230174 - DNA, 22 bp, Homo sapiens
tttaaatgaattaaatattgaa

SEQ ID NO: 230175 - DNA, 23 bp, Homo sapiens
tttaaatgaattaaatattgaaa

SEQ ID NO: 230176 - DNA, 16 bp, Homo sapiens
tttaaatgattccaaa

SEQ ID NO: 230177 - DNA, 18 bp, Homo sapiens
tttaaatgattccaaata

SEQ ID NO: 230178 - DNA, 17 bp, Homo sapiens
tttaaatggaataatta

SEQ ID NO: 230179 - DNA, 20 bp, Homo sapiens
tttaaatggaataattagct

SEQ ID NO: 230180 - DNA, 20 bp, Homo sapiens
tttaaattataaggactgca

SEQ ID NO: 230181 - DNA, 22 bp, Homo sapiens
tttaaattataaggactgcatg

SEQ ID NO: 230182 - DNA, 12 bp, Homo sapiens
tttaaattatat

SEQ ID NO: 230183 - DNA, 14 bp, Homo sapiens
tttaaattatatga

SEQ ID NO: 230184 - DNA, 17 bp, Homo sapiens
tttaaattctcagtcat

SEQ ID NO: 230185 - DNA, 14 bp, Homo sapiens
tttaaattgttcct

SEQ ID NO: 230186 - DNA, 21 bp, Homo sapiens
tttaaattttccattaatttc

SEQ ID NO: 230187 - DNA, 19 bp, Homo sapiens
tttaacaaaacaagaaaga

SEQ ID NO: 230188 - DNA, 20 bp, Homo sapiens
tttaacaaaacaagaaagaa

SEQ ID NO: 230189 - DNA, 16 bp, Homo sapiens
tttaacaaaagcaaga

SEQ ID NO: 230190 - DNA, 11 bp, Homo sapiens
tttagttgaat

SEQ ID NO: 230191 - DNA, 13 bp, Homo sapiens
tttagttgagtct

SEQ ID NO: 230192 - DNA, 19 bp, Homo sapiens
tttagttgcagactcagtt

SEQ ID NO: 230193 - DNA, 18 bp, Homo sapiens
tttagtttgttaattgat

SEQ ID NO: 230194 - DNA, 13 bp, Homo sapiens
tttataaattaaa

SEQ ID NO: 230195 - DNA, 15 bp, Homo sapiens
tttataaattaaata

SEQ ID NO: 230196 - DNA, 18 bp, Homo sapiens
tttataaattaaatatat

SEQ ID NO: 230197 - DNA, 14 bp, Homo sapiens
tttataacaattga

SEQ ID NO: 230198 - DNA, 16 bp, Homo sapiens
tttataaccccagcct

SEQ ID NO: 230199 - DNA, 17 bp, Homo sapiens
tttataaccccagcctg

SEQ ID NO: 230200 - DNA, 16 bp, Homo sapiens
tttataactcatcata

SEQ ID NO: 230201 - DNA, 19 bp, Homo sapiens
tttatacagttttaaagaa

SEQ ID NO: 230202 - DNA, 16 bp, Homo sapiens
tttatactgcacttta

SEQ ID NO: 230203 - DNA, 12 bp, Homo sapiens
tttatagggctt

SEQ ID NO: 230204 - DNA, 18 bp, Homo sapiens
tttatagtttatacagtt

SEQ ID NO: 230205 - DNA, 19 bp, Homo sapiens
tttatagtttgtacatgca

SEQ ID NO: 230206 - DNA, 21 bp, Homo sapiens
tttatataatgcatgtattca

SEQ ID NO: 230207 - DNA, 16 bp, Homo sapiens
tttatatagcttgaaa

SEQ ID NO: 230208 - DNA, 15 bp, Homo sapiens
tttatatataaaata

SEQ ID NO: 230209 - DNA, 18 bp, Homo sapiens
tttatatataaaataaat

SEQ ID NO: 230210 - DNA, 19 bp, Homo sapiens
tttatatatgaagtaagtt

SEQ ID NO: 230211 - DNA, 15 bp, Homo sapiens
tttatatatttataa

SEQ ID NO: 230212 - DNA, 12 bp, Homo sapiens
tttatatgtctt

SEQ ID NO: 230213 - DNA, 17 bp, Homo sapiens
tttatatgtcttgcaaa

SEQ ID NO: 230214 - DNA, 18 bp, Homo sapiens
tttatattacttttgtaa

SEQ ID NO: 230215 - DNA, 22 bp, Homo sapiens
tttatattcagagatgtaccat

SEQ ID NO: 230216 - DNA, 23 bp, Homo sapiens
tttatattcatcaaataaacctt

SEQ ID NO: 230217 - DNA, 17 bp, Homo sapiens
tttatattgtttttata

SEQ ID NO: 230218 - DNA, 18 bp, Homo sapiens
tttatatttaattattaa

SEQ ID NO: 230219 - DNA, 14 bp, Homo sapiens
tttatatttagtta

SEQ ID NO: 230220 - DNA, 16 bp, Homo sapiens
tttcagtaatagctga

SEQ ID NO: 230221 - DNA, 17 bp, Homo sapiens
tttcagtaatagctgaa

SEQ ID NO: 230222 - DNA, 13 bp, Homo sapiens
tttcagtaccaaa

SEQ ID NO: 230223 - DNA, 15 bp, Homo sapiens
tttcagtaccaaaga

SEQ ID NO: 230224 - DNA, 14 bp, Homo sapiens
tttcagtatactgt

SEQ ID NO: 230225 - DNA, 21 bp, Homo sapiens
tttcagtattttggagaaatt

SEQ ID NO: 230226 - DNA, 19 bp, Homo sapiens
tttcagtgctttctcaaaa

SEQ ID NO: 230227 - DNA, 14 bp, Homo sapiens
tttcataaggcctg

SEQ ID NO: 230228 - DNA, 19 bp, Homo sapiens
tttcatagttctgttaaat

SEQ ID NO: 230229 - DNA, 15 bp, Homo sapiens
tttcatatgctgtat

SEQ ID NO: 230230 - DNA, 22 bp, Homo sapiens
tttcatatgttgctcagtctcc

SEQ ID NO: 230231 - DNA, 23 bp, Homo sapiens
tttcatgaccactgggcctgcta

SEQ ID NO: 230232 - DNA, 19 bp, Homo sapiens
tttcatgattagacaatgt

SEQ ID NO: 230233 - DNA, 21 bp, Homo sapiens
tttcatgattagacaatgtgg

SEQ ID NO: 230234 - DNA, 20 bp, Homo sapiens
tttcatggtgaaaatgtact

SEQ ID NO: 230235 - DNA, 23 bp, Homo sapiens
tttcatgtgatctattactctga

SEQ ID NO: 230236 - DNA, 20 bp, Homo sapiens
tttcatgtgttgcaaattat

SEQ ID NO: 230237 - DNA, 23 bp, Homo sapiens
tttcatgtgttgcaaattattct

SEQ ID NO: 230238 - DNA, 13 bp, Homo sapiens
tttcattctcatt

SEQ ID NO: 230239 - DNA, 22 bp, Homo sapiens
tttcattgagggaaaacataat

SEQ ID NO: 230240 - DNA, 23 bp, Homo sapiens
tttcattgagggaaaacataata

SEQ ID NO: 230241 - DNA, 14 bp, Homo sapiens
tttcatttcaactg

SEQ ID NO: 230242 - DNA, 13 bp, Homo sapiens
tttcattttctct

SEQ ID NO: 230243 - DNA, 15 bp, Homo sapiens
tttcattttctctcc

SEQ ID NO: 230244 - DNA, 16 bp, Homo sapiens
tttcatttttcatttt

SEQ ID NO: 230245 - DNA, 22 bp, Homo sapiens
tttccaacaaacttactgtcag

SEQ ID NO: 230246 - DNA, 18 bp, Homo sapiens
tttccaacaccacagaca

SEQ ID NO: 230247 - DNA, 20 bp, Homo sapiens
tttccaacaccacagacaca

SEQ ID NO: 230248 - DNA, 19 bp, Homo sapiens
tttccacaaaatctgtcca

SEQ ID NO: 230249 - DNA, 16 bp, Homo sapiens
tttccacacagcctgt

SEQ ID NO: 230250 - DNA, 13 bp, Homo sapiens
tttccacacaggc

SEQ ID NO: 230251 - DNA, 20 bp, Homo sapiens
tttccacagttgctgctcct

SEQ ID NO: 230252 - DNA, 15 bp, Homo sapiens
tttccaccaaattct

SEQ ID NO: 230253 - DNA, 22 bp, Homo sapiens
tttccaccaagggtatctgctg

SEQ ID NO: 230254 - DNA, 23 bp, Homo sapiens
tttccaccaagggtatctgctgc

SEQ ID NO: 230255 - DNA, 22 bp, Homo sapiens
tttccaccccctccctggcctg

SEQ ID NO: 230256 - DNA, 17 bp, Homo sapiens
tttccagaaattcttca

SEQ ID NO: 230257 - DNA, 21 bp, Homo sapiens
tttccagaaggccacaggcca

SEQ ID NO: 230258 - DNA, 21 bp, Homo sapiens
tttccagaattgagagatgtt

SEQ ID NO: 230259 - DNA, 14 bp, Homo sapiens
tttccagtattgaa

SEQ ID NO: 230260 - DNA, 15 bp, Homo sapiens
tttccagtctccacc

SEQ ID NO: 230261 - DNA, 20 bp, Homo sapiens
tttccagtctccaccaggaa

SEQ ID NO: 230262 - DNA, 21 bp, Homo sapiens
tttccattcttttaaatgggt

SEQ ID NO: 230263 - DNA, 19 bp, Homo sapiens
tttccatttcttcagaggg

SEQ ID NO: 230264 - DNA, 15 bp, Homo sapiens
tttccatttttgtca

SEQ ID NO: 230265 - DNA, 22 bp, Homo sapiens
tttcccacccactagccctctt

SEQ ID NO: 230266 - DNA, 17 bp, Homo sapiens
tttcccagccctttcca

SEQ ID NO: 230267 - DNA, 18 bp, Homo sapiens
tttcccagccctttccag

SEQ ID NO: 230268 - DNA, 14 bp, Homo sapiens
tttcccataatttt

SEQ ID NO: 230269 - DNA, 17 bp, Homo sapiens
tttcccatcaccccttc

SEQ ID NO: 230270 - DNA, 19 bp, Homo sapiens
tttcccatcaccccttccc

SEQ ID NO: 230271 - DNA, 20 bp, Homo sapiens
tttcccatcaccccttcccc

SEQ ID NO: 230272 - DNA, 18 bp, Homo sapiens
tttccccaattatcctcc

SEQ ID NO: 230273 - DNA, 23 bp, Homo sapiens
tttccccagaccgatccttccca

SEQ ID NO: 230274 - DNA, 20 bp, Homo sapiens
tttccccagaggctcccaat

SEQ ID NO: 230275 - DNA, 21 bp, Homo sapiens
tttccccattcattcctgatg

SEQ ID NO: 230276 - DNA, 17 bp, Homo sapiens
tttcccctcctttgtct

SEQ ID NO: 230277 - DNA, 14 bp, Homo sapiens
tttcccctgtcctg

SEQ ID NO: 230278 - DNA, 22 bp, Homo sapiens
tttccctactaacatcccaata

SEQ ID NO: 230279 - DNA, 13 bp, Homo sapiens
tttccctgacctc

SEQ ID NO: 230280 - DNA, 16 bp, Homo sapiens
tttccctgctggccaa

SEQ ID NO: 230281 - DNA, 12 bp, Homo sapiens
tttccctggctc

SEQ ID NO: 230282 - DNA, 13 bp, Homo sapiens
tttccctggctca

SEQ ID NO: 230283 - DNA, 14 bp, Homo sapiens
tttccctgtttgcc

SEQ ID NO: 230284 - DNA, 13 bp, Homo sapiens
tttccgcggcggc

SEQ ID NO: 230285 - DNA, 18 bp, Homo sapiens
tttccgtgagctcaaact

SEQ ID NO: 230286 - DNA, 17 bp, Homo sapiens
tttcctaaatgcagtga

SEQ ID NO: 230287 - DNA, 13 bp, Homo sapiens
tttcctaacaaaa

SEQ ID NO: 230288 - DNA, 20 bp, Homo sapiens
tttcctaatgagatatatct

SEQ ID NO: 230289 - DNA, 23 bp, Homo sapiens
tttcctagatggcagtcactgaa

SEQ ID NO: 230290 - DNA, 21 bp, Homo sapiens
tttcctcaggctgctggagga

SEQ ID NO: 230291 - DNA, 12 bp, Homo sapiens
tttcctccccag

SEQ ID NO: 230292 - DNA, 17 bp, Homo sapiens
tttcctcccttctgata

SEQ ID NO: 230293 - DNA, 22 bp, Homo sapiens
tttcctcccttgggttctgata

SEQ ID NO: 230294 - DNA, 14 bp, Homo sapiens
tttcctcctgggca

SEQ ID NO: 230295 - DNA, 18 bp, Homo sapiens
tttcctcgcctaggcctg

SEQ ID NO: 230296 - DNA, 19 bp, Homo sapiens
tttcctctattgatgtaca

SEQ ID NO: 230297 - DNA, 20 bp, Homo sapiens
tttcctctattgatgtacag

SEQ ID NO: 230298 - DNA, 13 bp, Homo sapiens
tttcctctctctc

SEQ ID NO: 230299 - DNA, 12 bp, Homo sapiens
tttcctctgagc

SEQ ID NO: 230300 - DNA, 15 bp, Homo sapiens
tttcctcttccttct

SEQ ID NO: 230301 - DNA, 12 bp, Homo sapiens
tttcctcttctg

SEQ ID NO: 230302 - DNA, 15 bp, Homo sapiens
tttcctgcatctttc

SEQ ID NO: 230303 - DNA, 16 bp, Homo sapiens
tttcctgcatctttca

SEQ ID NO: 230304 - DNA, 20 bp, Homo sapiens
tttcctggacatcctcttct

SEQ ID NO: 230305 - DNA, 17 bp, Homo sapiens
tttcctgtcttctttct

SEQ ID NO: 230306 - DNA, 16 bp, Homo sapiens
tttccttaaactgtgt

SEQ ID NO: 230307 - DNA, 23 bp, Homo sapiens
tttccttaaactgtgtggactgt

SEQ ID NO: 230308 - DNA, 19 bp, Homo sapiens
tttccttccatccctaccc

SEQ ID NO: 230309 - DNA, 13 bp, Homo sapiens
tttccttcctgcc

SEQ ID NO: 230310 - DNA, 14 bp, Homo sapiens
tttccttcctgccc

SEQ ID NO: 230311 - DNA, 21 bp, Homo sapiens
tttccttcctgccctgtacct

SEQ ID NO: 230312 - DNA, 20 bp, Homo sapiens
tttcctttagatcaaggcaa

SEQ ID NO: 230313 - DNA, 19 bp, Homo sapiens
tttcctttcatcctcagca

SEQ ID NO: 230314 - DNA, 14 bp, Homo sapiens
tttcctttctgtat

SEQ ID NO: 230315 - DNA, 22 bp, Homo sapiens
tttcctttcttttttttcttgg

SEQ ID NO: 230316 - DNA, 16 bp, Homo sapiens
tttcctttgccgtgtt

SEQ ID NO: 230317 - DNA, 23 bp, Homo sapiens
tttcctttgtcatcattgtatat

SEQ ID NO: 230318 - DNA, 23 bp, Homo sapiens
tttcggaaatacactacaaatgt

SEQ ID NO: 230319 - DNA, 16 bp, Homo sapiens
tttcgtgcatttgtga

SEQ ID NO: 230320 - DNA, 18 bp, Homo sapiens
tttcgttaacattgacca

SEQ ID NO: 230321 - DNA, 19 bp, Homo sapiens
tttcgttaacattgaccaa

SEQ ID NO: 230322 - DNA, 12 bp, Homo sapiens
tttcgtttgttt

SEQ ID NO: 230323 - DNA, 22 bp, Homo sapiens
tttctaaaaagtcaattcatct

SEQ ID NO: 230324 - DNA, 15 bp, Homo sapiens
tttctaaactgtttt

SEQ ID NO: 230325 - DNA, 18 bp, Homo sapiens
tttctaaactgttttcat

SEQ ID NO: 230326 - DNA, 21 bp, Homo sapiens
tttctaaactgttttcatgtg

SEQ ID NO: 230327 - DNA, 21 bp, Homo sapiens
tttctaacaaaaaaatatatt

SEQ ID NO: 230328 - DNA, 22 bp, Homo sapiens
tttctaacactagtctgtgtgc

SEQ ID NO: 230329 - DNA, 18 bp, Homo sapiens
tttctaagctttcttaca

SEQ ID NO: 230330 - DNA, 19 bp, Homo sapiens
tttctaaggatagcctttg

SEQ ID NO: 230331 - DNA, 13 bp, Homo sapiens
tttctaagtattt

SEQ ID NO: 230332 - DNA, 13 bp, Homo sapiens
tttaataataaaa

SEQ ID NO: 230333 - DNA, 14 bp, Homo sapiens
tttaatacagcagt

SEQ ID NO: 230334 - DNA, 14 bp, Homo sapiens
tttaatacagggta

SEQ ID NO: 230335 - DNA, 20 bp, Homo sapiens
tttaatagtcattccaaata

SEQ ID NO: 230336 - DNA, 15 bp, Homo sapiens
tttaatataaagcct

SEQ ID NO: 230337 - DNA, 15 bp, Homo sapiens
tttaatatactgcat

SEQ ID NO: 230338 - DNA, 22 bp, Homo sapiens
tttaatattgagaaagaaacta

SEQ ID NO: 230339 - DNA, 14 bp, Homo sapiens
tttaatatttatgt

SEQ ID NO: 230340 - DNA, 13 bp, Homo sapiens
tttaatcatttcc

SEQ ID NO: 230341 - DNA, 22 bp, Homo sapiens
tttaatggacttatttcttcaa

SEQ ID NO: 230342 - DNA, 14 bp, Homo sapiens
tttaatgtaaaatt

SEQ ID NO: 230343 - DNA, 14 bp, Homo sapiens
tttaatgtacaagt

SEQ ID NO: 230344 - DNA, 21 bp, Homo sapiens
tttaattaggggttgctaaga

SEQ ID NO: 230345 - DNA, 11 bp, Homo sapiens
tttaattatta

SEQ ID NO: 230346 - DNA, 19 bp, Homo sapiens
tttaattgtaattgtctca

SEQ ID NO: 230347 - DNA, 20 bp, Homo sapiens
tttaattgtaattgtctcaa

SEQ ID NO: 230348 - DNA, 14 bp, Homo sapiens
tttaatttcataaa

SEQ ID NO: 230349 - DNA, 19 bp, Homo sapiens
tttaatttgatgaaagctg

SEQ ID NO: 230350 - DNA, 21 bp, Homo sapiens
tttaatttgatgaaagctgat

SEQ ID NO: 230351 - DNA, 22 bp, Homo sapiens
tttaatttgatgaaagctgatt

SEQ ID NO: 230352 - DNA, 18 bp, Homo sapiens
tttaatttgggcatctct

SEQ ID NO: 230353 - DNA, 19 bp, Homo sapiens
tttaatttttaaaagactt

SEQ ID NO: 230354 - DNA, 20 bp, Homo sapiens
tttacaaaagaggagcactt

SEQ ID NO: 230355 - DNA, 19 bp, Homo sapiens
tttacaaaatgaatgcatt

SEQ ID NO: 230356 - DNA, 16 bp, Homo sapiens
tttacaataaataatc

SEQ ID NO: 230357 - DNA, 21 bp, Homo sapiens
tttacaatcagccacattcta

SEQ ID NO: 230358 - DNA, 14 bp, Homo sapiens
tttacagaattgct

SEQ ID NO: 230359 - DNA, 19 bp, Homo sapiens
tttacagaattgcttgttt

SEQ ID NO: 230360 - DNA, 18 bp, Homo sapiens
tttacagcactactctgt

SEQ ID NO: 230361 - DNA, 23 bp, Homo sapiens
tttacagctcttggcattttcct

SEQ ID NO: 230362 - DNA, 15 bp, Homo sapiens
tttacagtccttcaa

SEQ ID NO: 230363 - DNA, 18 bp, Homo sapiens
tttacatcttttgggaag

SEQ ID NO: 230364 - DNA, 15 bp, Homo sapiens
tttacatgtctcata

SEQ ID NO: 230365 - DNA, 13 bp, Homo sapiens
tttacattgtaaa

SEQ ID NO: 230366 - DNA, 21 bp, Homo sapiens
tttacattttcagtaccaaag

SEQ ID NO: 230367 - DNA, 14 bp, Homo sapiens
tttaccatttgtaa

SEQ ID NO: 230368 - DNA, 19 bp, Homo sapiens
tttaccatttgtaataaag

SEQ ID NO: 230369 - DNA, 13 bp, Homo sapiens
tttaccctccctg

SEQ ID NO: 230370 - DNA, 16 bp, Homo sapiens
tttaccgttcacttcc

SEQ ID NO: 230371 - DNA, 20 bp, Homo sapiens
tttacctcactggtgcattt

SEQ ID NO: 230372 - DNA, 22 bp, Homo sapiens
tttacctgaagtctttgtacag

SEQ ID NO: 230373 - DNA, 16 bp, Homo sapiens
tttaccttcatttcat

SEQ ID NO: 230374 - DNA, 19 bp, Homo sapiens
tttaccttgaacaatcaag

SEQ ID NO: 230375 - DNA, 19 bp, Homo sapiens
tttacgtagtcatcaacaa

SEQ ID NO: 230376 - DNA, 13 bp, Homo sapiens
tttacgtagtgta

SEQ ID NO: 230377 - DNA, 20 bp, Homo sapiens
tttactaagccacaagaaat

SEQ ID NO: 230378 - DNA, 15 bp, Homo sapiens
tttactaagtaaaag

SEQ ID NO: 230379 - DNA, 16 bp, Homo sapiens
tttactactattctgt

SEQ ID NO: 230380 - DNA, 17 bp, Homo sapiens
tttactactattctgtt

SEQ ID NO: 230381 - DNA, 18 bp, Homo sapiens
tttactccccttgagctg

SEQ ID NO: 230382 - DNA, 20 bp, Homo sapiens
tttactcccttcctggcctc

SEQ ID NO: 230383 - DNA, 14 bp, Homo sapiens
tttactgacaagaa

SEQ ID NO: 230384 - DNA, 17 bp, Homo sapiens
tttactgagcttctctg

SEQ ID NO: 230385 - DNA, 13 bp, Homo sapiens
tttactgctgtca

SEQ ID NO: 230386 - DNA, 15 bp, Homo sapiens
tttactggctgtgtg

SEQ ID NO: 230387 - DNA, 13 bp, Homo sapiens
tttactgtctgta

SEQ ID NO: 230388 - DNA, 19 bp, Homo sapiens
tttacttcttatacatttg

SEQ ID NO: 230389 - DNA, 13 bp, Homo sapiens
tttacttttcaca

SEQ ID NO: 230390 - DNA, 13 bp, Homo sapiens
tttagaaattaca

SEQ ID NO: 230391 - DNA, 17 bp, Homo sapiens
tttagaaattacaagtt

SEQ ID NO: 230392 - DNA, 19 bp, Homo sapiens
tttagaaattacaagtttc

SEQ ID NO: 230393 - DNA, 17 bp, Homo sapiens
tttagaacagaaaacaa

SEQ ID NO: 230394 - DNA, 18 bp, Homo sapiens
tttagaacagaaaacaac

SEQ ID NO: 230395 - DNA, 22 bp, Homo sapiens
tttagaacagaaaacaacaaaa

SEQ ID NO: 230396 - DNA, 21 bp, Homo sapiens
tttagacaaccatagaactgt

SEQ ID NO: 230397 - DNA, 21 bp, Homo sapiens
tttagagaaaataaatttaac

SEQ ID NO: 230398 - DNA, 21 bp, Homo sapiens
tttagagataagagttggctg

SEQ ID NO: 230399 - DNA, 18 bp, Homo sapiens
tttagagattaatttgtg

SEQ ID NO: 230400 - DNA, 20 bp, Homo sapiens
tttagagcagttaacatctg

SEQ ID NO: 230401 - DNA, 13 bp, Homo sapiens
tttagagtaaact

SEQ ID NO: 230402 - DNA, 21 bp, Homo sapiens
tttagagtatgcaagaagaat

SEQ ID NO: 230403 - DNA, 22 bp, Homo sapiens
tttagagtatgcaagaagaata

SEQ ID NO: 230404 - DNA, 20 bp, Homo sapiens
tttagatcaaggcaaaaata

SEQ ID NO: 230405 - DNA, 21 bp, Homo sapiens
tttagattcctacttaaacaa

SEQ ID NO: 230406 - DNA, 18 bp, Homo sapiens
tttagcagttctgcaaat

SEQ ID NO: 230407 - DNA, 12 bp, Homo sapiens
tttagcatgtgt

SEQ ID NO: 230408 - DNA, 13 bp, Homo sapiens
tttagcattaaaa

SEQ ID NO: 230409 - DNA, 17 bp, Homo sapiens
tttagcattaaaaataa

SEQ ID NO: 230410 - DNA, 18 bp, Homo sapiens
tttagccaaacccttgtc

SEQ ID NO: 230411 - DNA, 17 bp, Homo sapiens
tttagctagtatcttca

SEQ ID NO: 230412 - DNA, 18 bp, Homo sapiens
tttagctagtatcttcaa

SEQ ID NO: 230413 - DNA, 13 bp, Homo sapiens
tttagcttcctcc

SEQ ID NO: 230414 - DNA, 21 bp, Homo sapiens
tttaggaatgctcaatgtgct

SEQ ID NO: 230415 - DNA, 16 bp, Homo sapiens
tttaggagaaaccagc

SEQ ID NO: 230416 - DNA, 11 bp, Homo sapiens
tttaggagaag

SEQ ID NO: 230417 - DNA, 16 bp, Homo sapiens
tttagggaagcaggga

SEQ ID NO: 230418 - DNA, 15 bp, Homo sapiens
tttagggatctgggg

SEQ ID NO: 230419 - DNA, 15 bp, Homo sapiens
tttagggctgtagac

SEQ ID NO: 230420 - DNA, 19 bp, Homo sapiens
tttagtagctgataaagaa

SEQ ID NO: 230421 - DNA, 21 bp, Homo sapiens
tttagtagctgataaagaaac

SEQ ID NO: 230422 - DNA, 17 bp, Homo sapiens
tttagtgattgctttta

SEQ ID NO: 230423 - DNA, 22 bp, Homo sapiens
tttagtgccggctgtggagcaa

SEQ ID NO: 230424 - DNA, 19 bp, Homo sapiens
tttagtggtggtgtctcac

SEQ ID NO: 230425 - DNA, 13 bp, Homo sapiens
tttagtgtggttt

SEQ ID NO: 230426 - DNA, 13 bp, Homo sapiens
tttagttatagtt

SEQ ID NO: 230427 - DNA, 18 bp, Homo sapiens
tttagttgaaaaatctag

SEQ ID NO: 230428 - DNA, 21 bp, Homo sapiens
tgtagttctttgttcctgctt

SEQ ID NO: 230429 - DNA, 16 bp, Homo sapiens
tgtagttttacttggt

SEQ ID NO: 230430 - DNA, 13 bp, Homo sapiens
tgtcacaataaat

SEQ ID NO: 230431 - DNA, 21 bp, Homo sapiens
tgtcacaatcctaacacatta

SEQ ID NO: 230432 - DNA, 17 bp, Homo sapiens
tttgagacaagccctgg

SEQ ID NO: 230433 - DNA, 19 bp, Homo sapiens
tttgagacaagccctggca

SEQ ID NO: 230434 - DNA, 13 bp, Homo sapiens
tttgagacaggag

SEQ ID NO: 230435 - DNA, 19 bp, Homo sapiens
tttgagagagagaaccttt

SEQ ID NO: 230436 - DNA, 18 bp, Homo sapiens
agggactgtacctgtagg

SEQ ID NO: 230437 - DNA, 20 bp, Homo sapiens
agggactgtatttctgtgga

SEQ ID NO: 230438 - DNA, 21 bp, Homo sapiens
agggactgtatttctgtggaa

SEQ ID NO: 230439 - DNA, 13 bp, Homo sapiens
agggagaagggag

SEQ ID NO: 230440 - DNA, 14 bp, Homo sapiens
agggagaagggaga

SEQ ID NO: 230441 - DNA, 18 bp, Homo sapiens
agggagacaatctaaaaa

SEQ ID NO: 230442 - DNA, 12 bp, Homo sapiens
agggagacccaa

SEQ ID NO: 230443 - DNA, 12 bp, Homo sapiens
agggagaccctg

SEQ ID NO: 230444 - DNA, 16 bp, Homo sapiens
agggagagacctcatc

SEQ ID NO: 230445 - DNA, 22 bp, Homo sapiens
agggagattcaaaaaaaaaata

SEQ ID NO: 230446 - DNA, 15 bp, Homo sapiens
agggagcaagacaga

SEQ ID NO: 230447 - DNA, 18 bp, Homo sapiens
agggagcaagacagagac

SEQ ID NO: 230448 - DNA, 13 bp, Homo sapiens
agggagcccctcc

SEQ ID NO: 230449 - DNA, 19 bp, Homo sapiens
agggagcgcggcagccctg

SEQ ID NO: 230450 - DNA, 21 bp, Homo sapiens
agggaggaatcgaggaaccag

SEQ ID NO: 230451 - DNA, 22 bp, Homo sapiens
agggaggaatcgaggaaccaga

SEQ ID NO: 230452 - DNA, 23 bp, Homo sapiens
agggaggaatcgaggaaccagag

SEQ ID NO: 230453 - DNA, 22 bp, Homo sapiens
agggaggacccacactgctaca

SEQ ID NO: 230454 - DNA, 15 bp, Homo sapiens
agggagggctgaccc

SEQ ID NO: 230455 - DNA, 16 bp, Homo sapiens
agggaggggaggtggc

SEQ ID NO: 230456 - DNA, 13 bp, Homo sapiens
agggaggggctga

SEQ ID NO: 230457 - DNA, 15 bp, Homo sapiens
agggaggggctgagt

SEQ ID NO: 230458 - DNA, 21 bp, Homo sapiens
agggaggggctgagtctggct

SEQ ID NO: 230459 - DNA, 24 bp, Homo sapiens
agggagggggcgctcaggacccag

SEQ ID NO: 230460 - DNA, 17 bp, Homo sapiens
agggaggtttgtgagag

SEQ ID NO: 230461 - DNA, 18 bp, Homo sapiens
agggaggtttgtgagagc

SEQ ID NO: 230462 - DNA, 15 bp, Homo sapiens
agggagtacctgctg

SEQ ID NO: 230463 - DNA, 15 bp, Homo sapiens
agggagtcccctccc

SEQ ID NO: 230464 - DNA, 22 bp, Homo sapiens
agggagtcccctccccggccct

SEQ ID NO: 230465 - DNA, 13 bp, Homo sapiens
agggatctgggga

SEQ ID NO: 230466 - DNA, 18 bp, Homo sapiens
agggatctggggaaggac

SEQ ID NO: 230467 - DNA, 16 bp, Homo sapiens
agggatgaggtgctgg

SEQ ID NO: 230468 - DNA, 17 bp, Homo sapiens
agggatgaggtgctggg

SEQ ID NO: 230469 - DNA, 23 bp, Homo sapiens
agggatgaggtgctgggagggat

SEQ ID NO: 230470 - DNA, 20 bp, Homo sapiens
agggatgccataccttgaga

SEQ ID NO: 230471 - DNA, 23 bp, Homo sapiens
agggatgctatctcgctagccat

SEQ ID NO: 230472 - DNA, 24 bp, Homo sapiens
agggatgggatttcatgtaaccaa

SEQ ID NO: 230473 - DNA, 17 bp, Homo sapiens
agggatggggccacagc

SEQ ID NO: 230474 - DNA, 20 bp, Homo sapiens
agggatgtgggaatctccca

SEQ ID NO: 230475 - DNA, 19 bp, Homo sapiens
agggattcaggctgcttgg

SEQ ID NO: 230476 - DNA, 20 bp, Homo sapiens
agggattctgggcttggggt

SEQ ID NO: 230477 - DNA, 17 bp, Homo sapiens
agggattgaacacaggc

SEQ ID NO: 230478 - DNA, 18 bp, Homo sapiens
agggattgaacacaggca

SEQ ID NO: 230479 - DNA, 12 bp, Homo sapiens
agggatttgagg

SEQ ID NO: 230480 - DNA, 13 bp, Homo sapiens
agggcaaatctgc

SEQ ID NO: 230481 - DNA, 17 bp, Homo sapiens
agggcactctctgccag

SEQ ID NO: 230482 - DNA, 22 bp, Homo sapiens
agggcactctctgccagctcca

SEQ ID NO: 230483 - DNA, 17 bp, Homo sapiens
agggcactggtggcccg

SEQ ID NO: 230484 - DNA, 15 bp, Homo sapiens
agggcagagccatgg

SEQ ID NO: 230485 - DNA, 21 bp, Homo sapiens
agggcagcactgggaagctgg

SEQ ID NO: 230486 - DNA, 22 bp, Homo sapiens
agggcagcactgggaagctgga

SEQ ID NO: 230487 - DNA, 13 bp, Homo sapiens
agggcagcagccg

SEQ ID NO: 230488 - DNA, 17 bp, Homo sapiens
agggcagcctgtgggag

SEQ ID NO: 230489 - DNA, 19 bp, Homo sapiens
agggcagcctgtgggagaa

SEQ ID NO: 230490 - DNA, 20 bp, Homo sapiens
agggcagcctgtgggagaag

SEQ ID NO: 230491 - DNA, 21 bp, Homo sapiens
agggcagcctgtgggagaagg

SEQ ID NO: 230492 - DNA, 16 bp, Homo sapiens
agggcagtacctggga

SEQ ID NO: 230493 - DNA, 18 bp, Homo sapiens
agggcagtacctgggaaa

SEQ ID NO: 230494 - DNA, 15 bp, Homo sapiens
agggcataatgatga

SEQ ID NO: 230495 - DNA, 19 bp, Homo sapiens
agggcataatgatgatggg

SEQ ID NO: 230496 - DNA, 20 bp, Homo sapiens
agggcatcagctttccctgg

SEQ ID NO: 230497 - DNA, 21 bp, Homo sapiens
agggcatcagctttccctggc

SEQ ID NO: 230498 - DNA, 14 bp, Homo sapiens
agggcatcaggcac

SEQ ID NO: 230499 - DNA, 16 bp, Homo sapiens
agggcatcaggcactg

SEQ ID NO: 230500 - DNA, 18 bp, Homo sapiens
agggcatccttctgcctt

SEQ ID NO: 230501 - DNA, 19 bp, Homo sapiens
aggggcccttgggacagcc

SEQ ID NO: 230502 - DNA, 21 bp, Homo sapiens
aggggcccttgggacagccag

SEQ ID NO: 230503 - DNA, 22 bp, Homo sapiens
aggggccgagtccaggagcccc

SEQ ID NO: 230504 - DNA, 23 bp, Homo sapiens
aggggccgagtccaggagcccca

SEQ ID NO: 230505 - DNA, 14 bp, Homo sapiens
aggggcctagggag

SEQ ID NO: 230506 - DNA, 16 bp, Homo sapiens
aggggcctagggagcc

SEQ ID NO: 230507 - DNA, 20 bp, Homo sapiens
aggggcctctgaaatttccc

SEQ ID NO: 230508 - DNA, 18 bp, Homo sapiens
aggggcctctggctgcct

SEQ ID NO: 230509 - DNA, 19 bp, Homo sapiens
aggggcctctggctgcctg

SEQ ID NO: 230510 - DNA, 20 bp, Homo sapiens
aggggcggcaggagggaggt

SEQ ID NO: 230511 - DNA, 13 bp, Homo sapiens
aggggcggggcag

SEQ ID NO: 230512 - DNA, 14 bp, Homo sapiens
aggggcggggcagg

SEQ ID NO: 230513 - DNA, 13 bp, Homo sapiens
aggggcggggcca

SEQ ID NO: 230514 - DNA, 14 bp, Homo sapiens
aggggcggggccag

SEQ ID NO: 230515 - DNA, 15 bp, Homo sapiens
aggggctatcccttc

SEQ ID NO: 230516 - DNA, 19 bp, Homo sapiens
aggggctatcccttctcag

SEQ ID NO: 230517 - DNA, 18 bp, Homo sapiens
aggggctgagtctggcta

SEQ ID NO: 230518 - DNA, 18 bp, Homo sapiens
aggggctgcatcctcagc

SEQ ID NO: 230519 - DNA, 23 bp, Homo sapiens
aggggctgcatcctcagccccag

SEQ ID NO: 230520 - DNA, 12 bp, Homo sapiens
aggggctgctgg

SEQ ID NO: 230521 - DNA, 13 bp, Homo sapiens
aggggctgctggg

SEQ ID NO: 230522 - DNA, 20 bp, Homo sapiens
aggggctgctggggcatgtg

SEQ ID NO: 230523 - DNA, 15 bp, Homo sapiens
aggggctggactggc

SEQ ID NO: 230524 - DNA, 18 bp, Homo sapiens
aggggctggactggctgt

SEQ ID NO: 230525 - DNA, 20 bp, Homo sapiens
aggggctgtccaatcacatt

SEQ ID NO: 230526 - DNA, 16 bp, Homo sapiens
aggggcttggagcaga

SEQ ID NO: 230527 - DNA, 19 bp, Homo sapiens
agggggccacctccccagg

SEQ ID NO: 230528 - DNA, 16 bp, Homo sapiens
agggggcccttccaga

SEQ ID NO: 230529 - DNA, 21 bp, Homo sapiens
agggggcccttccagattggg

SEQ ID NO: 230530 - DNA, 20 bp, Homo sapiens
agggggctattccctggaga

SEQ ID NO: 230531 - DNA, 11 bp, Homo sapiens
agggggctctc

SEQ ID NO: 230532 - DNA, 19 bp, Homo sapiens
aggggggaacatgcatttt

SEQ ID NO: 230533 - DNA, 14 bp, Homo sapiens
aggggggagctggg

SEQ ID NO: 230534 - DNA, 12 bp, Homo sapiens
aggggggttggg

SEQ ID NO: 230535 - DNA, 19 bp, Homo sapiens
agggggtaatggaggccaa

SEQ ID NO: 230536 - DNA, 21 bp, Homo sapiens
agggggtaatggaggccaagc

SEQ ID NO: 230537 - DNA, 22 bp, Homo sapiens
agggggtaatggaggccaagcc

SEQ ID NO: 230538 - DNA, 21 bp, Homo sapiens
agggggtcatttcagagccct

SEQ ID NO: 230539 - DNA, 19 bp, Homo sapiens
agggggttacaaactgcaa

SEQ ID NO: 230540 - DNA, 14 bp, Homo sapiens
aggggtaaatatat

SEQ ID NO: 230541 - DNA, 16 bp, Homo sapiens
aggggtaaatatatgt

SEQ ID NO: 230542 - DNA, 17 bp, Homo sapiens
aggggtaaatatatgtt

SEQ ID NO: 230543 - DNA, 18 bp, Homo sapiens
aggggtaaatatatgttt

SEQ ID NO: 230544 - DNA, 22 bp, Homo sapiens
aggggtatgttccctcttgtcc

SEQ ID NO: 230545 - DNA, 23 bp, Homo sapiens
aggggtatgttccctcttgtccc

SEQ ID NO: 230546 - DNA, 21 bp, Homo sapiens
aggggtcaagttattaatttc

SEQ ID NO: 230547 - DNA, 24 bp, Homo sapiens
aggggtcagggaccaaggacccct

SEQ ID NO: 230548 - DNA, 22 bp, Homo sapiens
aggggtccgatgtttgaggagg

SEQ ID NO: 230549 - DNA, 18 bp, Homo sapiens
aggggtctccctgagcct

SEQ ID NO: 230550 - DNA, 14 bp, Homo sapiens
aggggtctgcctcc

SEQ ID NO: 230551 - DNA, 22 bp, Homo sapiens
aggggtgcgctcacctgcagcc

SEQ ID NO: 230552 - DNA, 14 bp, Homo sapiens
aggggtgctgcctt

SEQ ID NO: 230553 - DNA, 15 bp, Homo sapiens
aggggttcgagacca

SEQ ID NO: 230554 - DNA, 17 bp, Homo sapiens
aggggtttggtctggga

SEQ ID NO: 230555 - DNA, 15 bp, Homo sapiens
agggtaaattattca

SEQ ID NO: 230556 - DNA, 16 bp, Homo sapiens
agggtaattttctaac

SEQ ID NO: 230557 - DNA, 15 bp, Homo sapiens
agggtagaaggaaag

SEQ ID NO: 230558 - DNA, 14 bp, Homo sapiens
agggtagagcaaag

SEQ ID NO: 230559 - DNA, 21 bp, Homo sapiens
agggtagcctggcttttctgg

SEQ ID NO: 230560 - DNA, 13 bp, Homo sapiens
agggtaggcaagg

SEQ ID NO: 230561 - DNA, 21 bp, Homo sapiens
agggtatccaagttggactgg

SEQ ID NO: 230562 - DNA, 22 bp, Homo sapiens
agggtatctgctgcctctgaaa

SEQ ID NO: 230563 - DNA, 16 bp, Homo sapiens
agggtcattttccttt

SEQ ID NO: 230564 - DNA, 19 bp, Homo sapiens
agggtcattttcctttctg

SEQ ID NO: 230565 - DNA, 20 bp, Homo sapiens
agggtccgcaccagctgctc

SEQ ID NO: 230566 - DNA, 22 bp, Homo sapiens
agggtccgcaccagctgctctg

SEQ ID NO: 230567 - DNA, 24 bp, Homo sapiens
agggtccgcaccagctgctctgcc

SEQ ID NO: 230568 - DNA, 20 bp, Homo sapiens
agggtcctacggagggacca

SEQ ID NO: 230569 - DNA, 18 bp, Homo sapiens
agggtcctgattctccct

SEQ ID NO: 230570 - DNA, 21 bp, Homo sapiens
agggtcctggctcctgagggg

SEQ ID NO: 230571 - DNA, 14 bp, Homo sapiens
agggtccttccctc

SEQ ID NO: 230572 - DNA, 16 bp, Homo sapiens
agggtccttccctctc

SEQ ID NO: 230573 - DNA, 17 bp, Homo sapiens
agggtccttccctctcc

SEQ ID NO: 230574 - DNA, 14 bp, Homo sapiens
agggtctgctcttt

SEQ ID NO: 230575 - DNA, 20 bp, Homo sapiens
agggtctgctctttctctgc

SEQ ID NO: 230576 - DNA, 13 bp, Homo sapiens
agggtcttgctgt

SEQ ID NO: 230577 - DNA, 17 bp, Homo sapiens
agggtcttgggctactg

SEQ ID NO: 230578 - DNA, 21 bp, Homo sapiens
agggtcttgggctactggcag

SEQ ID NO: 230579 - DNA, 13 bp, Homo sapiens
agggtctttactg

SEQ ID NO: 230580 - DNA, 15 bp, Homo sapiens
agggtctttactggg

SEQ ID NO: 230581 - DNA, 13 bp, Homo sapiens
agggtgacatccc

SEQ ID NO: 230582 - DNA, 15 bp, Homo sapiens
agggtgacatcccag

SEQ ID NO: 230583 - DNA, 17 bp, Homo sapiens
agggtgacatcccagga

SEQ ID NO: 230584 - DNA, 18 bp, Homo sapiens
agggtgacatcccaggag

SEQ ID NO: 230585 - DNA, 23 bp, Homo sapiens
agggtgacatcccaggaggggcc

SEQ ID NO: 230586 - DNA, 13 bp, Homo sapiens
agggtgaggcgtg

SEQ ID NO: 230587 - DNA, 14 bp, Homo sapiens
agggtgaggcgtgg

SEQ ID NO: 230588 - DNA, 15 bp, Homo sapiens
agggtgaggcgtggg

SEQ ID NO: 230589 - DNA, 17 bp, Homo sapiens
agggtgccctttggggt

SEQ ID NO: 230590 - DNA, 15 bp, Homo sapiens
agggtgcctgctctc

SEQ ID NO: 230591 - DNA, 17 bp, Homo sapiens
agggtgctgcttccctc

SEQ ID NO: 230592 - DNA, 12 bp, Homo sapiens
agggtggacaga

SEQ ID NO: 230593 - DNA, 14 bp, Homo sapiens
agggtggacagaag

SEQ ID NO: 230594 - DNA, 18 bp, Homo sapiens
agggtggaggaaggtgct

SEQ ID NO: 230595 - DNA, 19 bp, Homo sapiens
agggtggaggaaggtgctg

SEQ ID NO: 230596 - DNA, 23 bp, Homo sapiens
agggtggaggaaggtgctgagct

SEQ ID NO: 230597 - DNA, 14 bp, Homo sapiens
agggtggcaggtga

SEQ ID NO: 230598 - DNA, 18 bp, Homo sapiens
agggtgggatgagcctct

SEQ ID NO: 230599 - DNA, 15 bp, Homo sapiens
agggtgggccccagc

SEQ ID NO: 230600 - DNA, 11 bp, Homo sapiens
agggtgggggg

SEQ ID NO: 230601 - DNA, 21 bp, Homo sapiens
agggttaaagaaaggcagaga

SEQ ID NO: 230602 - DNA, 17 bp, Homo sapiens
agggttccactggagaa

SEQ ID NO: 230603 - DNA, 13 bp, Homo sapiens
agggttccagaca

SEQ ID NO: 230604 - DNA, 14 bp, Homo sapiens
agggttccagacag

SEQ ID NO: 230605 - DNA, 15 bp, Homo sapiens
agggttccagacagg

SEQ ID NO: 230606 - DNA, 18 bp, Homo sapiens
agggttcccccagccctg

SEQ ID NO: 230607 - DNA, 16 bp, Homo sapiens
agggttctaacctttc

SEQ ID NO: 230608 - DNA, 20 bp, Homo sapiens
agggttctcctctcccctct

SEQ ID NO: 230609 - DNA, 13 bp, Homo sapiens
agggttctgtatt

SEQ ID NO: 230610 - DNA, 21 bp, Homo sapiens
agggttgaaggcagtctgaac

SEQ ID NO: 230611 - DNA, 19 bp, Homo sapiens
agggttgatatattctttc

SEQ ID NO: 230612 - DNA, 16 bp, Homo sapiens
agggttgctggagcct

SEQ ID NO: 230613 - DNA, 17 bp, Homo sapiens
agggttggggaggggcg

SEQ ID NO: 230614 - DNA, 17 bp, Homo sapiens
agggtttccaccttggc

SEQ ID NO: 230615 - DNA, 14 bp, Homo sapiens
agggttttggcctg

SEQ ID NO: 230616 - DNA, 16 bp, Homo sapiens
agggttttggcctgcc

SEQ ID NO: 230617 - DNA, 13 bp, Homo sapiens
agggttttgtatt

SEQ ID NO: 230618 - DNA, 16 bp, Homo sapiens
aggtaaatacaatggt

SEQ ID NO: 230619 - DNA, 18 bp, Homo sapiens
aggtaatcaatgaatatt

SEQ ID NO: 230620 - DNA, 18 bp, Homo sapiens
aggtacccaaggtcacat

SEQ ID NO: 230621 - DNA, 21 bp, Homo sapiens
aggtacggtgagactctgagg

SEQ ID NO: 230622 - DNA, 20 bp, Homo sapiens
aggtactgatcctgtttctt

SEQ ID NO: 230623 - DNA, 13 bp, Homo sapiens
aggtacttcctcc

SEQ ID NO: 230624 - DNA, 16 bp, Homo sapiens
aggtacttcctcctga

SEQ ID NO: 230625 - DNA, 20 bp, Homo sapiens
aggtagaccaggatttctaa

SEQ ID NO: 230626 - DNA, 21 bp, Homo sapiens
aggtagatcgcttgagcccag

SEQ ID NO: 230627 - DNA, 14 bp, Homo sapiens
aggtagccaccacc

SEQ ID NO: 230628 - DNA, 19 bp, Homo sapiens
aggtagccctggccagagg

SEQ ID NO: 230629 - DNA, 20 bp, Homo sapiens
aggtagccctggccagaggc

SEQ ID NO: 230630 - DNA, 14 bp, Homo sapiens
aggtagcgagctgc

SEQ ID NO: 230631 - DNA, 17 bp, Homo sapiens
aggtaggcccttgtcct

SEQ ID NO: 230632 - DNA, 18 bp, Homo sapiens
aggtaggcccttgtcctg

SEQ ID NO: 230633 - DNA, 21 bp, Homo sapiens
aggtaggcccttgtcctgcca

SEQ ID NO: 230634 - DNA, 22 bp, Homo sapiens
aggtaggcccttgtcctgccag

SEQ ID NO: 230635 - DNA, 16 bp, Homo sapiens
aggtcaggagttccta

SEQ ID NO: 230636 - DNA, 20 bp, Homo sapiens
aggtcaggagttcctaacca

SEQ ID NO: 230637 - DNA, 15 bp, Homo sapiens
aggtcagtacccacc

SEQ ID NO: 230638 - DNA, 18 bp, Homo sapiens
aggtcagtacccacctga

SEQ ID NO: 230639 - DNA, 17 bp, Homo sapiens
aggtcatcccggggcca

SEQ ID NO: 230640 - DNA, 13 bp, Homo sapiens
aggtccaagggcc

SEQ ID NO: 230641 - DNA, 17 bp, Homo sapiens
aggtccactccctgctc

SEQ ID NO: 230642 - DNA, 19 bp, Homo sapiens
aggtccactccctgctcca

SEQ ID NO: 230643 - DNA, 20 bp, Homo sapiens
aggtccactccctgctccac

SEQ ID NO: 230644 - DNA, 19 bp, Homo sapiens
aggtcccacgtctggccag

SEQ ID NO: 230645 - DNA, 20 bp, Homo sapiens
aggtcccagaatggaaaaaa

SEQ ID NO: 230646 - DNA, 19 bp, Homo sapiens
aggtcccgagccccctgtc

SEQ ID NO: 230647 - DNA, 16 bp, Homo sapiens
aggtccgagctctgtc

SEQ ID NO: 230648 - DNA, 17 bp, Homo sapiens
aggtccgagctctgtcc

SEQ ID NO: 230649 - DNA, 18 bp, Homo sapiens
aggtccgagctctgtcct

SEQ ID NO: 230650 - DNA, 17 bp, Homo sapiens
aggtccgagtcttttta

SEQ ID NO: 230651 - DNA, 13 bp, Homo sapiens
aggtcctctcagt

SEQ ID NO: 230652 - DNA, 13 bp, Homo sapiens
aggtcctgccctc

SEQ ID NO: 230653 - DNA, 21 bp, Homo sapiens
aggtcctttccttctcgtctt

SEQ ID NO: 230654 - DNA, 15 bp, Homo sapiens
aggtcgggctcagct

SEQ ID NO: 230655 - DNA, 17 bp, Homo sapiens
aggtcgtataatttagt

SEQ ID NO: 230656 - DNA, 13 bp, Homo sapiens
aggtctcactgct

SEQ ID NO: 230657 - DNA, 12 bp, Homo sapiens
aggtctccaccc

SEQ ID NO: 230658 - DNA, 15 bp, Homo sapiens
aggtctccacccctc

SEQ ID NO: 230659 - DNA, 16 bp, Homo sapiens
aggtctccacccctca

SEQ ID NO: 230660 - DNA, 17 bp, Homo sapiens
aggtctccacccctcaa

SEQ ID NO: 230661 - DNA, 23 bp, Homo sapiens
aggtctccacccctcaagccagg

SEQ ID NO: 230662 - DNA, 21 bp, Homo sapiens
aggtctccttactctgagccc

SEQ ID NO: 230663 - DNA, 19 bp, Homo sapiens
aggtctctgccggctcttt

SEQ ID NO: 230664 - DNA, 15 bp, Homo sapiens
aggtctcttgaggga

SEQ ID NO: 230665 - DNA, 16 bp, Homo sapiens
aggtctcttgagggag

SEQ ID NO: 230666 - DNA, 16 bp, Homo sapiens
aggtctgcacacataa

SEQ ID NO: 230667 - DNA, 13 bp, Homo sapiens
aggtctgcatttt

SEQ ID NO: 230668 - DNA, 16 bp, Homo sapiens
aggtctgcattttctc

SEQ ID NO: 230669 - DNA, 20 bp, Homo sapiens
aggtcttggttagagaagta

SEQ ID NO: 230670 - DNA, 18 bp, Homo sapiens
aggtctttacttatgcac

SEQ ID NO: 230671 - DNA, 22 bp, Homo sapiens
aggtctttgaaatatgcatgta

SEQ ID NO: 230672 - DNA, 14 bp, Homo sapiens
aggtcttttacata

SEQ ID NO: 230673 - DNA, 21 bp, Homo sapiens
aggtcttttacatacagtgat

SEQ ID NO: 230674 - DNA, 16 bp, Homo sapiens
aggtcttttgacatgt

SEQ ID NO: 230675 - DNA, 14 bp, Homo sapiens
aggtgaaacacaca

SEQ ID NO: 230676 - DNA, 22 bp, Homo sapiens
aggtgaacactcatgcggccca

SEQ ID NO: 230677 - DNA, 20 bp, Homo sapiens
aggtgaacgctcagcgctgg

SEQ ID NO: 230678 - DNA, 11 bp, Homo sapiens
aggtgaataac

SEQ ID NO: 230679 - DNA, 17 bp, Homo sapiens
aggtgaatgtcttcctt

SEQ ID NO: 230680 - DNA, 15 bp, Homo sapiens
aggtgacactatagt

SEQ ID NO: 230681 - DNA, 22 bp, Homo sapiens
aggtgaccgcccagctctccca

SEQ ID NO: 230682 - DNA, 21 bp, Homo sapiens
aggtgaggcgttctcctgctt

SEQ ID NO: 230683 - DNA, 22 bp, Homo sapiens
aggtgaggcgttctcctgcttg

SEQ ID NO: 230684 - DNA, 17 bp, Homo sapiens
aggtgatagcattgctt

SEQ ID NO: 230685 - DNA, 22 bp, Homo sapiens
aggtgatatccattctttctga

SEQ ID NO: 230686 - DNA, 15 bp, Homo sapiens
aggtgatccacctgc

SEQ ID NO: 230687 - DNA, 19 bp, Homo sapiens
aggtgatggaggtatttga

SEQ ID NO: 230688 - DNA, 20 bp, Homo sapiens
aggtgatggaggtatttgaa

SEQ ID NO: 230689 - DNA, 17 bp, Homo sapiens
aggtgatgggggcatgg

SEQ ID NO: 230690 - DNA, 17 bp, Homo sapiens
aggtgattaaatattta

SEQ ID NO: 230691 - DNA, 21 bp, Homo sapiens
aggtgcacattttccacggaa

SEQ ID NO: 230692 - DNA, 15 bp, Homo sapiens
aggtgcagatgggct

SEQ ID NO: 230693 - DNA, 16 bp, Homo sapiens
aggtgcagatgggctg

SEQ ID NO: 230694 - DNA, 17 bp, Homo sapiens
aggtgcagatgggctgt

SEQ ID NO: 230695 - DNA, 23 bp, Homo sapiens
aggtgcagttcccccaacctcag

SEQ ID NO: 230696 - DNA, 22 bp, Homo sapiens
aggtgcatgccttcataaatta

SEQ ID NO: 230697 - DNA, 19 bp, Homo sapiens
aggtgccaccaataaaaat

SEQ ID NO: 230698 - DNA, 20 bp, Homo sapiens
aggtgccaccaataaaaatc

SEQ ID NO: 230699 - DNA, 12 bp, Homo sapiens
aggtgccactcc

SEQ ID NO: 230700 - DNA, 16 bp, Homo sapiens
aggtgccactccctga

SEQ ID NO: 230701 - DNA, 11 bp, Homo sapiens
aggtgcccagg

SEQ ID NO: 230702 - DNA, 21 bp, Homo sapiens
aggtgcccagtcttgagtggg

SEQ ID NO: 230703 - DNA, 15 bp, Homo sapiens
aggtgccgtgagcag

SEQ ID NO: 230704 - DNA, 16 bp, Homo sapiens
aggtgccgtgagcagg

SEQ ID NO: 230705 - DNA, 15 bp, Homo sapiens
aggtgctaaaaggaa

SEQ ID NO: 230706 - DNA, 18 bp, Homo sapiens
aggtgctaaaaggaatag

SEQ ID NO: 230707 - DNA, 22 bp, Homo sapiens
aggtgctagggtgcctgctctc

SEQ ID NO: 230708 - DNA, 17 bp, Homo sapiens
aggtgctgagcttagcc

SEQ ID NO: 230709 - DNA, 18 bp, Homo sapiens
aggtgctgagcttagcct

SEQ ID NO: 230710 - DNA, 20 bp, Homo sapiens
aggtgctgagcttagccttg

SEQ ID NO: 230711 - DNA, 12 bp, Homo sapiens
aggtgctgcctt

SEQ ID NO: 230712 - DNA, 17 bp, Homo sapiens
aggtgctggaggcagac

SEQ ID NO: 230713 - DNA, 11 bp, Homo sapiens
aggtgctggcc

SEQ ID NO: 230714 - DNA, 14 bp, Homo sapiens
aggtgctgttgtca

SEQ ID NO: 230715 - DNA, 21 bp, Homo sapiens
aggtgctgttgtcattgcttt

SEQ ID NO: 230716 - DNA, 21 bp, Homo sapiens
aggtggaacaggaggaactgg

SEQ ID NO: 230717 - DNA, 13 bp, Homo sapiens
aggtggaggtggg

SEQ ID NO: 230718 - DNA, 15 bp, Homo sapiens
aggtggccacagcag

SEQ ID NO: 230719 - DNA, 14 bp, Homo sapiens
aggtggccactcca

SEQ ID NO: 230720 - DNA, 17 bp, Homo sapiens
aggtggccactccagac

SEQ ID NO: 230721 - DNA, 18 bp, Homo sapiens
aggtggccaggcctgcca

SEQ ID NO: 230722 - DNA, 20 bp, Homo sapiens
aggtggccaggcctgccagc

SEQ ID NO: 230723 - DNA, 15 bp, Homo sapiens
aggtggccagggctc

SEQ ID NO: 230724 - DNA, 18 bp, Homo sapiens
aggtggccagggctccac

SEQ ID NO: 230725 - DNA, 19 bp, Homo sapiens
aggtggccagggctccacg

SEQ ID NO: 230726 - DNA, 16 bp, Homo sapiens
aggtggcctaaggctg

SEQ ID NO: 230727 - DNA, 18 bp, Homo sapiens
aggtggcctaaggctgct

SEQ ID NO: 230728 - DNA, 18 bp, Homo sapiens
aggtggctcagtgccacc

SEQ ID NO: 230729 - DNA, 13 bp, Homo sapiens
aggtgggaggccc

SEQ ID NO: 230730 - DNA, 19 bp, Homo sapiens
aggtgggcactggattagt

SEQ ID NO: 230731 - DNA, 13 bp, Homo sapiens
aggtgggcagctg

SEQ ID NO: 230732 - DNA, 15 bp, Homo sapiens
aggtgggcagctggg

SEQ ID NO: 230733 - DNA, 18 bp, Homo sapiens
aggtgggcagctgggccc

SEQ ID NO: 230734 - DNA, 12 bp, Homo sapiens
aggtgggcatgc

SEQ ID NO: 230735 - DNA, 19 bp, Homo sapiens
aggtgggcatgccaccctc

SEQ ID NO: 230736 - DNA, 15 bp, Homo sapiens
aggtgggccagcccc

SEQ ID NO: 230737 - DNA, 15 bp, Homo sapiens
aggtgggccttgcta

SEQ ID NO: 230738 - DNA, 17 bp, Homo sapiens
aggtggggaagagagcc

SEQ ID NO: 230739 - DNA, 20 bp, Homo sapiens
aggtggggaagagagcctgc

SEQ ID NO: 230740 - DNA, 21 bp, Homo sapiens
aggtggggagtccagggctcc

SEQ ID NO: 230741 - DNA, 22 bp, Homo sapiens
aggtggggagtccagggctccc

SEQ ID NO: 230742 - DNA, 21 bp, Homo sapiens
aggtggggcgggaaagccagt

SEQ ID NO: 230743 - DNA, 21 bp, Homo sapiens
aggtgggggagcctggagccc

SEQ ID NO: 230744 - DNA, 22 bp, Homo sapiens
aggtgggggagcctggagcccc

SEQ ID NO: 230745 - DNA, 23 bp, Homo sapiens
aggtgggggagcctggagcccct

SEQ ID NO: 230746 - DNA, 16 bp, Homo sapiens
aggtgggggtctggcc

SEQ ID NO: 230747 - DNA, 18 bp, Homo sapiens
aggtgggggttggctggg

SEQ ID NO: 230748 - DNA, 15 bp, Homo sapiens
aggtggggtgaagct

SEQ ID NO: 230749 - DNA, 17 bp, Homo sapiens
aggtggggtgaagctgg

SEQ ID NO: 230750 - DNA, 21 bp, Homo sapiens
aggtggggtgaagctggggac

SEQ ID NO: 230751 - DNA, 21 bp, Homo sapiens
aggtgggtcaactccaaggca

SEQ ID NO: 230752 - DNA, 13 bp, Homo sapiens
aggtgggtcttgg

SEQ ID NO: 230753 - DNA, 15 bp, Homo sapiens
aggtgggttccaggg

SEQ ID NO: 230754 - DNA, 17 bp, Homo sapiens
aggtggtagctctgagc

SEQ ID NO: 230755 - DNA, 19 bp, Homo sapiens
aggtggtagctctgagccc

SEQ ID NO: 230756 - DNA, 20 bp, Homo sapiens
aggtggtagctctgagccct

SEQ ID NO: 230757 - DNA, 15 bp, Homo sapiens
aggtggtcttggaga

SEQ ID NO: 230758 - DNA, 20 bp, Homo sapiens
aggtggtcttggagaggagg

SEQ ID NO: 230759 - DNA, 12 bp, Homo sapiens
agtgatttgcta

SEQ ID NO: 230760 - DNA, 16 bp, Homo sapiens
agtgatttgctatcat

SEQ ID NO: 230761 - DNA, 17 bp, Homo sapiens
agtgatttgtaatatga

SEQ ID NO: 230762 - DNA, 24 bp, Homo sapiens
agtgcaaccacacacctcaccaga

SEQ ID NO: 230763 - DNA, 15 bp, Homo sapiens
agtgcaatttcttct

SEQ ID NO: 230764 - DNA, 13 bp, Homo sapiens
agtgcacccactc

SEQ ID NO: 230765 - DNA, 19 bp, Homo sapiens
agtgcagaacacctggccg

SEQ ID NO: 230766 - DNA, 15 bp, Homo sapiens
agtgcagaggctgag

SEQ ID NO: 230767 - DNA, 17 bp, Homo sapiens
agtgcagatctgtgctc

SEQ ID NO: 230768 - DNA, 14 bp, Homo sapiens
agtgcagcccttcc

SEQ ID NO: 230769 - DNA, 18 bp, Homo sapiens
agtgcagcccttcctcct

SEQ ID NO: 230770 - DNA, 20 bp, Homo sapiens
agtgcagcccttcctcctga

SEQ ID NO: 230771 - DNA, 21 bp, Homo sapiens
agtgcagcccttcctcctgaa

SEQ ID NO: 230772 - DNA, 14 bp, Homo sapiens
agtgcagctgattt

SEQ ID NO: 230773 - DNA, 14 bp, Homo sapiens
agtgcatctcagcc

SEQ ID NO: 230774 - DNA, 15 bp, Homo sapiens
agtgcatctcagccc

SEQ ID NO: 230775 - DNA, 16 bp, Homo sapiens
agtgcatctcagccca

SEQ ID NO: 230776 - DNA, 15 bp, Homo sapiens
agtgcatggccacag

SEQ ID NO: 230777 - DNA, 18 bp, Homo sapiens
agtgcatgtgaagcatgc

SEQ ID NO: 230778 - DNA, 16 bp, Homo sapiens
agtgcatttctgaata

SEQ ID NO: 230779 - DNA, 14 bp, Homo sapiens
agtgccaaacttgg

SEQ ID NO: 230780 - DNA, 18 bp, Homo sapiens
agtgccacctatgcctgt

SEQ ID NO: 230781 - DNA, 20 bp, Homo sapiens
agtgccacctatgcctgtgg

SEQ ID NO: 230782 - DNA, 21 bp, Homo sapiens
agtgccacctatgcctgtggt

SEQ ID NO: 230783 - DNA, 23 bp, Homo sapiens
agtgccacctatgcctgtggtga

SEQ ID NO: 230784 - DNA, 23 bp, Homo sapiens
agtgccaggctgcggtgggcagc

SEQ ID NO: 230785 - DNA, 17 bp, Homo sapiens
agtgccaggtggctcag

SEQ ID NO: 230786 - DNA, 10 bp, Homo sapiens
agtgcccaaa

SEQ ID NO: 230787 - DNA, 18 bp, Homo sapiens
agtgcccaaagtggggag

SEQ ID NO: 230788 - DNA, 19 bp, Homo sapiens
agtgcccaaagtggggagg

SEQ ID NO: 230789 - DNA, 20 bp, Homo sapiens
agtgcccagtgatggcatta

SEQ ID NO: 230790 - DNA, 23 bp, Homo sapiens
agtgcccagtgatggcattactc

SEQ ID NO: 230791 - DNA, 14 bp, Homo sapiens
agtgccccacctgc

SEQ ID NO: 230792 - DNA, 16 bp, Homo sapiens
agtgccccagaaatgc

SEQ ID NO: 230793 - DNA, 21 bp, Homo sapiens
agtgcccctcccatggcccag

SEQ ID NO: 230794 - DNA, 22 bp, Homo sapiens
agtgcccctcccatggcccagc

SEQ ID NO: 230795 - DNA, 12 bp, Homo sapiens
agtgcccctgct

SEQ ID NO: 230796 - DNA, 20 bp, Homo sapiens
agtgcccctgctgcctcccc

SEQ ID NO: 230797 - DNA, 21 bp, Homo sapiens
agtgcccttttgtatcttaag

SEQ ID NO: 230798 - DNA, 14 bp, Homo sapiens
agtgccggctgtgg

SEQ ID NO: 230799 - DNA, 18 bp, Homo sapiens
agtgccggctgtggagca

SEQ ID NO: 230800 - DNA, 17 bp, Homo sapiens
agtgcctcagcgctgcc

SEQ ID NO: 230801 - DNA, 19 bp, Homo sapiens
agtgcctcagcgctgccca

SEQ ID NO: 230802 - DNA, 21 bp, Homo sapiens
agtgcctcagcgctgcccaca

SEQ ID NO: 230803 - DNA, 14 bp, Homo sapiens
agtgcctcgaggca

SEQ ID NO: 230804 - DNA, 16 bp, Homo sapiens
agtgcctgcagcatct

SEQ ID NO: 230805 - DNA, 13 bp, Homo sapiens
agtgcctgggaat

SEQ ID NO: 230806 - DNA, 17 bp, Homo sapiens
agtgccttacacaatgg

SEQ ID NO: 230807 - DNA, 18 bp, Homo sapiens
agtgccttacacaatggt

SEQ ID NO: 230808 - DNA, 13 bp, Homo sapiens
agtgccttccata

SEQ ID NO: 230809 - DNA, 12 bp, Homo sapiens
agtgccttctct

SEQ ID NO: 230810 - DNA, 15 bp, Homo sapiens
agtgccttgagctgc

SEQ ID NO: 230811 - DNA, 16 bp, Homo sapiens
agtgccttgagctgcc

SEQ ID NO: 230812 - DNA, 17 bp, Homo sapiens
agtgccttgagctgcct

SEQ ID NO: 230813 - DNA, 21 bp, Homo sapiens
agtgccttggggaatttcctc

SEQ ID NO: 230814 - DNA, 14 bp, Homo sapiens
agtgcctttcccca

SEQ ID NO: 230815 - DNA, 22 bp, Homo sapiens
agtgcctttctgcagtttttca

SEQ ID NO: 230816 - DNA, 14 bp, Homo sapiens
agtgcctttttcct

SEQ ID NO: 230817 - DNA, 18 bp, Homo sapiens
agtgcgatgtttcaggag

SEQ ID NO: 230818 - DNA, 18 bp, Homo sapiens
agtgcgctcttggtccct

SEQ ID NO: 230819 - DNA, 19 bp, Homo sapiens
agtgcgctcttggtccctg

SEQ ID NO: 230820 - DNA, 21 bp, Homo sapiens
agtgctagtgagctgggcatg

SEQ ID NO: 230821 - DNA, 14 bp, Homo sapiens
agtgctcagttcca

SEQ ID NO: 230822 - DNA, 18 bp, Homo sapiens
agtgctctttgtggcagt

SEQ ID NO: 230823 - DNA, 12 bp, Homo sapiens
agtgctgaagct

SEQ ID NO: 230824 - DNA, 16 bp, Homo sapiens
agtgctgaagcttatt

SEQ ID NO: 230825 - DNA, 19 bp, Homo sapiens
agtgctgagtctgtgaata

SEQ ID NO: 230826 - DNA, 17 bp, Homo sapiens
agtgctgccatgccact

SEQ ID NO: 230827 - DNA, 19 bp, Homo sapiens
agtgctgccatgccactgc

SEQ ID NO: 230828 - DNA, 22 bp, Homo sapiens
agtgctgccatgccactgccag

SEQ ID NO: 230829 - DNA, 13 bp, Homo sapiens
agtgctgcttctc

SEQ ID NO: 230830 - DNA, 15 bp, Homo sapiens
agtgctgcttctctt

SEQ ID NO: 230831 - DNA, 18 bp, Homo sapiens
agtgctggaatggggacc

SEQ ID NO: 230832 - DNA, 21 bp, Homo sapiens
agtgctggaatggggacctgg

SEQ ID NO: 230833 - DNA, 12 bp, Homo sapiens
agtgctggctcc

SEQ ID NO: 230834 - DNA, 22 bp, Homo sapiens
agtgctggctccacgccctggg

SEQ ID NO: 230835 - DNA, 23 bp, Homo sapiens
agtgctggctccacgccctgggg

SEQ ID NO: 230836 - DNA, 20 bp, Homo sapiens
agtgctgggattacaggcgt

SEQ ID NO: 230837 - DNA, 12 bp, Homo sapiens
agtgctgggccc

SEQ ID NO: 230838 - DNA, 16 bp, Homo sapiens
agtgcttaaaaatcat

SEQ ID NO: 230839 - DNA, 19 bp, Homo sapiens
agtgcttaaaaatcattga

SEQ ID NO: 230840 - DNA, 21 bp, Homo sapiens
agtgcttcttactattaagca

SEQ ID NO: 230841 - DNA, 14 bp, Homo sapiens
agtgcttcttgtaa

SEQ ID NO: 230842 - DNA, 22 bp, Homo sapiens
agtgcttcttgtaatatttctt

SEQ ID NO: 230843 - DNA, 20 bp, Homo sapiens
agtgcttgccaccaccagat

SEQ ID NO: 230844 - DNA, 17 bp, Homo sapiens
agtgcttggctgcccca

SEQ ID NO: 230845 - DNA, 19 bp, Homo sapiens
agtgcttggctgccccaca

SEQ ID NO: 230846 - DNA, 20 bp, Homo sapiens
agtgctttgctggagtcctg

SEQ ID NO: 230847 - DNA, 17 bp, Homo sapiens
agtgcttttaaactgga

SEQ ID NO: 230848 - DNA, 15 bp, Homo sapiens
agtggaaaaaagaga

SEQ ID NO: 230849 - DNA, 20 bp, Homo sapiens
agtggaaaaaagagaaaaac

SEQ ID NO: 230850 - DNA, 16 bp, Homo sapiens
agtggaaaaagaaatt

SEQ ID NO: 230851 - DNA, 21 bp, Homo sapiens
agtggaaaaagaaattctgtt

SEQ ID NO: 230852 - DNA, 16 bp, Homo sapiens
agtggaaaatgcaatg

SEQ ID NO: 230853 - DNA, 20 bp, Homo sapiens
agtggaaagattgtgtctgg

SEQ ID NO: 230854 - DNA, 23 bp, Homo sapiens
agtggaacagtcacccttctggg

SEQ ID NO: 230855 - DNA, 17 bp, Homo sapiens
agtggaagagcagcctg

SEQ ID NO: 230856 - DNA, 21 bp, Homo sapiens
agtggaaggtctattggccaa

SEQ ID NO: 230857 - DNA, 18 bp, Homo sapiens
agtggaccttgagaccac

SEQ ID NO: 230858 - DNA, 14 bp, Homo sapiens
agtggactgtgtcc

SEQ ID NO: 230859 - DNA, 18 bp, Homo sapiens
agtggactttccaccccc

SEQ ID NO: 230860 - DNA, 21 bp, Homo sapiens
agtggatagatgccctgctag

SEQ ID NO: 230861 - DNA, 18 bp, Homo sapiens
agtggattggctttgtgc

SEQ ID NO: 230862 - DNA, 21 bp, Homo sapiens
agtggcaagaccaaaatgaca

SEQ ID NO: 230863 - DNA, 23 bp, Homo sapiens
agtggcaagaccaaaatgacaat

SEQ ID NO: 230864 - DNA, 18 bp, Homo sapiens
agtggcagcaaaggaaga

SEQ ID NO: 230865 - DNA, 23 bp, Homo sapiens
agtggcagccatgcctcatgcca

SEQ ID NO: 230866 - DNA, 22 bp, Homo sapiens
agtggcagctgtcccctctccc

SEQ ID NO: 230867 - DNA, 20 bp, Homo sapiens
agtggcagtgaaaaatatgt

SEQ ID NO: 230868 - DNA, 15 bp, Homo sapiens
agtggcatggctcca

SEQ ID NO: 230869 - DNA, 18 bp, Homo sapiens
agtggcatggctccagtc

SEQ ID NO: 230870 - DNA, 21 bp, Homo sapiens
agtggccagaccagagctctg

SEQ ID NO: 230871 - DNA, 12 bp, Homo sapiens
agtggccaggca

SEQ ID NO: 230872 - DNA, 13 bp, Homo sapiens
agtggccaggcag

SEQ ID NO: 230873 - DNA, 17 bp, Homo sapiens
agtggccaggcagggag

SEQ ID NO: 230874 - DNA, 16 bp, Homo sapiens
agtggccccatccagc

SEQ ID NO: 230875 - DNA, 23 bp, Homo sapiens
agtggccccatccagcatgtgtg

SEQ ID NO: 230876 - DNA, 18 bp, Homo sapiens
agtggcccctcacctggg

SEQ ID NO: 230877 - DNA, 22 bp, Homo sapiens
agtggcccctcacctgggcctt

SEQ ID NO: 230878 - DNA, 20 bp, Homo sapiens
agtggccgaaccccccactc

SEQ ID NO: 230879 - DNA, 13 bp, Homo sapiens
agtggcctggcca

SEQ ID NO: 230880 - DNA, 14 bp, Homo sapiens
agtggcctggccag

SEQ ID NO: 230881 - DNA, 15 bp, Homo sapiens
agtggcctggccagg

SEQ ID NO: 230882 - DNA, 20 bp, Homo sapiens
agtggcctggccaggagctc

SEQ ID NO: 230883 - DNA, 23 bp, Homo sapiens
agtggcctggctccgctgtgtgg

SEQ ID NO: 230884 - DNA, 16 bp, Homo sapiens
agtggctaattcaatt

SEQ ID NO: 230885 - DNA, 21 bp, Homo sapiens
agttacaccgttgttgtttta

SEQ ID NO: 230886 - DNA, 14 bp, Homo sapiens
agttactggtttca

SEQ ID NO: 230887 - DNA, 14 bp, Homo sapiens
agttactgttcatg

SEQ ID NO: 230888 - DNA, 15 bp, Homo sapiens
agttacttgtctgag

SEQ ID NO: 230889 - DNA, 18 bp, Homo sapiens
agttacttgtctgaggcc

SEQ ID NO: 230890 - DNA, 13 bp, Homo sapiens
agttagcccggcc

SEQ ID NO: 230891 - DNA, 23 bp, Homo sapiens
agttagcccggccaaggacactg

SEQ ID NO: 230892 - DNA, 12 bp, Homo sapiens
agttagccctca

SEQ ID NO: 230893 - DNA, 17 bp, Homo sapiens
agttaggaaataaaacc

SEQ ID NO: 230894 - DNA, 18 bp, Homo sapiens
agttaggaaataaaacct

SEQ ID NO: 230895 - DNA, 16 bp, Homo sapiens
agttaggatagcattt

SEQ ID NO: 230896 - DNA, 18 bp, Homo sapiens
agttaggatagcattttt

SEQ ID NO: 230897 - DNA, 16 bp, Homo sapiens
agttagtagcatgttg

SEQ ID NO: 230898 - DNA, 18 bp, Homo sapiens
agttatcaactttagcta

SEQ ID NO: 230899 - DNA, 21 bp, Homo sapiens
agttatggcctatacactatt

SEQ ID NO: 230900 - DNA, 13 bp, Homo sapiens
agttatgtgaatg

SEQ ID NO: 230901 - DNA, 15 bp, Homo sapiens
agttatgtgaatgat

SEQ ID NO: 230902 - DNA, 17 bp, Homo sapiens
agttattgaatcttaat

SEQ ID NO: 230903 - DNA, 18 bp, Homo sapiens
agttatttacttttacca

SEQ ID NO: 230904 - DNA, 22 bp, Homo sapiens
agttatttatgcctctgtattt

SEQ ID NO: 230905 - DNA, 12 bp, Homo sapiens
agttattttcag

SEQ ID NO: 230906 - DNA, 13 bp, Homo sapiens
agttcaaacaaga

SEQ ID NO: 230907 - DNA, 18 bp, Homo sapiens
agttcaaattttgcattg

SEQ ID NO: 230908 - DNA, 15 bp, Homo sapiens
agttcaatctcccgc

SEQ ID NO: 230909 - DNA, 11 bp, Homo sapiens
agttcaatgat

SEQ ID NO: 230910 - DNA, 14 bp, Homo sapiens
agttcaatgatcta

SEQ ID NO: 230911 - DNA, 16 bp, Homo sapiens
agttcaatgatctagg

SEQ ID NO: 230912 - DNA, 21 bp, Homo sapiens
agttcaatgatctaggtttaa

SEQ ID NO: 230913 - DNA, 22 bp, Homo sapiens
agttcacaccctgcaaggccca

SEQ ID NO: 230914 - DNA, 17 bp, Homo sapiens
agttcactacagcatca

SEQ ID NO: 230915 - DNA, 16 bp, Homo sapiens
agttcactataaatgg

SEQ ID NO: 230916 - DNA, 18 bp, Homo sapiens
agttcagcaccaccctag

SEQ ID NO: 230917 - DNA, 16 bp, Homo sapiens
agttcagctgcttctc

SEQ ID NO: 230918 - DNA, 23 bp, Homo sapiens
agttcagttcctctttgcatgga

SEQ ID NO: 230919 - DNA, 24 bp, Homo sapiens
agttcagttcctctttgcatggaa

SEQ ID NO: 230920 - DNA, 15 bp, Homo sapiens
agttcatagtttctg

SEQ ID NO: 230921 - DNA, 17 bp, Homo sapiens
agttcatagtttctgta

SEQ ID NO: 230922 - DNA, 13 bp, Homo sapiens
agttcatcttgaa

SEQ ID NO: 230923 - DNA, 16 bp, Homo sapiens
agttcatgttgctcag

SEQ ID NO: 230924 - DNA, 19 bp, Homo sapiens
agttccacttaacacatga

SEQ ID NO: 230925 - DNA, 21 bp, Homo sapiens
agttccacttagagaacaaag

SEQ ID NO: 230926 - DNA, 19 bp, Homo sapiens
agttccagttttgttttga

SEQ ID NO: 230927 - DNA, 15 bp, Homo sapiens
agttcccccaacctc

SEQ ID NO: 230928 - DNA, 15 bp, Homo sapiens
agttcccccagtacc

SEQ ID NO: 230929 - DNA, 22 bp, Homo sapiens
agttcccccagtacctccaagc

SEQ ID NO: 230930 - DNA, 21 bp, Homo sapiens
agttcccggagcacagccctg

SEQ ID NO: 230931 - DNA, 20 bp, Homo sapiens
agttccctgtctcttgaaaa

SEQ ID NO: 230932 - DNA, 13 bp, Homo sapiens
agttcccttggcc

SEQ ID NO: 230933 - DNA, 15 bp, Homo sapiens
agttccgtctcctct

SEQ ID NO: 230934 - DNA, 18 bp, Homo sapiens
agttcctagcaagttgac

SEQ ID NO: 230935 - DNA, 21 bp, Homo sapiens
agttcctctttgcatggaatt

SEQ ID NO: 230936 - DNA, 23 bp, Homo sapiens
agttcctgtcccttctcttaatt

SEQ ID NO: 230937 - DNA, 19 bp, Homo sapiens
agttccttaggagatgtca

SEQ ID NO: 230938 - DNA, 22 bp, Homo sapiens
agttctaagttcatgtttgtaa

SEQ ID NO: 230939 - DNA, 15 bp, Homo sapiens
agttctacataagta

SEQ ID NO: 230940 - DNA, 18 bp, Homo sapiens
agttctagcatagtaaac

SEQ ID NO: 230941 - DNA, 23 bp, Homo sapiens
agttctatttctatctgcaaata

SEQ ID NO: 230942 - DNA, 19 bp, Homo sapiens
agttctcactatgtttctc

SEQ ID NO: 230943 - DNA, 20 bp, Homo sapiens
agttctcactgttccctctg

SEQ ID NO: 230944 - DNA, 12 bp, Homo sapiens
agttctcatcca

SEQ ID NO: 230945 - DNA, 13 bp, Homo sapiens
agttctcatccac

SEQ ID NO: 230946 - DNA, 23 bp, Homo sapiens
agttctcatccacagaggccagg

SEQ ID NO: 230947 - DNA, 12 bp, Homo sapiens
agttctctcctt

SEQ ID NO: 230948 - DNA, 19 bp, Homo sapiens
agttctgaaaactgtttat

SEQ ID NO: 230949 - DNA, 13 bp, Homo sapiens
agttctggcaaga

SEQ ID NO: 230950 - DNA, 21 bp, Homo sapiens
agttctgtgcctccccccaga

SEQ ID NO: 230951 - DNA, 13 bp, Homo sapiens
agttctgttaaat

SEQ ID NO: 230952 - DNA, 14 bp, Homo sapiens
agttcttcacctct

SEQ ID NO: 230953 - DNA, 19 bp, Homo sapiens
agttctttctcgtgggtaa

SEQ ID NO: 230954 - DNA, 18 bp, Homo sapiens
agttctttgctgcccctg

SEQ ID NO: 230955 - DNA, 20 bp, Homo sapiens
agttctttgctgcccctgtc

SEQ ID NO: 230956 - DNA, 13 bp, Homo sapiens
agttctttgttcc

SEQ ID NO: 230957 - DNA, 23 bp, Homo sapiens
agttctttgttcctgctttctct

SEQ ID NO: 230958 - DNA, 20 bp, Homo sapiens
agttgaaaaaagaagtttgg

SEQ ID NO: 230959 - DNA, 19 bp, Homo sapiens
agttgaatgacaacagaag

SEQ ID NO: 230960 - DNA, 11 bp, Homo sapiens
agttgaccttt

SEQ ID NO: 230961 - DNA, 17 bp, Homo sapiens
agttgacctttatttat

SEQ ID NO: 230962 - DNA, 20 bp, Homo sapiens
agttgacctttatttattaa

SEQ ID NO: 230963 - DNA, 17 bp, Homo sapiens
agttgagacgctgttgc

SEQ ID NO: 230964 - DNA, 13 bp, Homo sapiens
agttgagcacagg

SEQ ID NO: 230965 - DNA, 17 bp, Homo sapiens
agttgaggggagaggaa

SEQ ID NO: 230966 - DNA, 19 bp, Homo sapiens
agttgagtcttcacattta

SEQ ID NO: 230967 - DNA, 22 bp, Homo sapiens
agttgagtcttcacatttagaa

SEQ ID NO: 230968 - DNA, 16 bp, Homo sapiens
agttgatatgtaacag

SEQ ID NO: 230969 - DNA, 15 bp, Homo sapiens
agttgatcatgcagg

SEQ ID NO: 230970 - DNA, 15 bp, Homo sapiens
agttgatgttgcatt

SEQ ID NO: 230971 - DNA, 16 bp, Homo sapiens
agttgatgttgcattt

SEQ ID NO: 230972 - DNA, 18 bp, Homo sapiens
agttgcaattgaattaaa

SEQ ID NO: 230973 - DNA, 23 bp, Homo sapiens
agttgcagactcagtttgtcaga

SEQ ID NO: 230974 - DNA, 13 bp, Homo sapiens
agttgcagtaaag

SEQ ID NO: 230975 - DNA, 20 bp, Homo sapiens
agttgccatgtagacccctt

SEQ ID NO: 230976 - DNA, 15 bp, Homo sapiens
agttgcgtgtctgtt

SEQ ID NO: 230977 - DNA, 19 bp, Homo sapiens
agttgctagcaacaactta

SEQ ID NO: 230978 - DNA, 13 bp, Homo sapiens
ataaaaataatta

SEQ ID NO: 230979 - DNA, 22 bp, Homo sapiens
ataaaaatattgtgttgtgaat

SEQ ID NO: 230980 - DNA, 23 bp, Homo sapiens
ataaaaatattgtgttgtgaatg

SEQ ID NO: 230981 - DNA, 14 bp, Homo sapiens
ataaaaattctgaa

SEQ ID NO: 230982 - DNA, 22 bp, Homo sapiens
ataaaacaaaaccaagccttgg

SEQ ID NO: 230983 - DNA, 11 bp, Homo sapiens
ataaaactatt

SEQ ID NO: 230984 - DNA, 12 bp, Homo sapiens
ataaaactattt

SEQ ID NO: 230985 - DNA, 21 bp, Homo sapiens
ataaaactatttaaaattggc

SEQ ID NO: 230986 - DNA, 19 bp, Homo sapiens
ataaaactcagttaaaatg

SEQ ID NO: 230987 - DNA, 14 bp, Homo sapiens
ataaaacttatgct

SEQ ID NO: 230988 - DNA, 15 bp, Homo sapiens
ataaaagaaaaaata

SEQ ID NO: 230989 - DNA, 14 bp, Homo sapiens
ataaaagatacatt

SEQ ID NO: 230990 - DNA, 15 bp, Homo sapiens
ataaaagatacattt

SEQ ID NO: 230991 - DNA, 13 bp, Homo sapiens
ataaaagccttgg

SEQ ID NO: 230992 - DNA, 14 bp, Homo sapiens
ataaaagccttggg

SEQ ID NO: 230993 - DNA, 12 bp, Homo sapiens
ataaaaggaagt

SEQ ID NO: 230994 - DNA, 20 bp, Homo sapiens
ataaaaggataggaaaagat

SEQ ID NO: 230995 - DNA, 16 bp, Homo sapiens
ataaaagttttctcca

SEQ ID NO: 230996 - DNA, 18 bp, Homo sapiens
ataaaagttttttaataa

SEQ ID NO: 230997 - DNA, 9 bp, Homo sapiens
ataaaataa

SEQ ID NO: 230998 - DNA, 13 bp, Homo sapiens
ataaaataaagta

SEQ ID NO: 230999 - DNA, 16 bp, Homo sapiens
ataaaataaagtatat

SEQ ID NO: 231000 - DNA, 13 bp, Homo sapiens
ataaaataaataa

SEQ ID NO: 231001 - DNA, 13 bp, Homo sapiens
ataaaataaatat

SEQ ID NO: 231002 - DNA, 18 bp, Homo sapiens
ataaaataaatatactaa

SEQ ID NO: 231003 - DNA, 18 bp, Homo sapiens
ataaaataagtaacatat

SEQ ID NO: 231004 - DNA, 22 bp, Homo sapiens
ataaaataagtcctaaagtgaa

SEQ ID NO: 231005 - DNA, 23 bp, Homo sapiens
ataaaatactgcttttgcaaaca

SEQ ID NO: 231006 - DNA, 15 bp, Homo sapiens
ataaaatatcattca

SEQ ID NO: 231007 - DNA, 20 bp, Homo sapiens
ataaaatatcattcagcaac

SEQ ID NO: 231008 - DNA, 11 bp, Homo sapiens
ataaaatctgt

SEQ ID NO: 231009 - DNA, 14 bp, Homo sapiens
ataaaatcttcaac

SEQ ID NO: 231010 - DNA, 15 bp, Homo sapiens
ataaaatcttcaact

SEQ ID NO: 231011 - DNA, 18 bp, Homo sapiens
ataaaatctttccatctc

SEQ ID NO: 231012 - DNA, 19 bp, Homo sapiens
ataaaatctttccatctca

SEQ ID NO: 231013 - DNA, 12 bp, Homo sapiens
ataaaatgaata

SEQ ID NO: 231014 - DNA, 17 bp, Homo sapiens
ataaaatgcactgacca

SEQ ID NO: 231015 - DNA, 21 bp, Homo sapiens
ataaaatggtgttttcatgta

SEQ ID NO: 231016 - DNA, 12 bp, Homo sapiens
ataaaatgtaaa

SEQ ID NO: 231017 - DNA, 19 bp, Homo sapiens
ataaaatgtattcaagcaa

SEQ ID NO: 231018 - DNA, 14 bp, Homo sapiens
ataaaatgttcctt

SEQ ID NO: 231019 - DNA, 16 bp, Homo sapiens
ataaaattatggtgaa

SEQ ID NO: 231020 - DNA, 19 bp, Homo sapiens
ataaaattatggtgaaatt

SEQ ID NO: 231021 - DNA, 22 bp, Homo sapiens
ataaaatttaaaaaactcctgt

SEQ ID NO: 231022 - DNA, 14 bp, Homo sapiens
ataaacaacagtac

SEQ ID NO: 231023 - DNA, 16 bp, Homo sapiens
ataaacaacttaatgt

SEQ ID NO: 231024 - DNA, 14 bp, Homo sapiens
ataaacacatagat

SEQ ID NO: 231025 - DNA, 15 bp, Homo sapiens
agtctcttctccact

SEQ ID NO: 231026 - DNA, 17 bp, Homo sapiens
agtctcttgattcataa

SEQ ID NO: 231027 - DNA, 21 bp, Homo sapiens
agtctcttggactaagaagat

SEQ ID NO: 231028 - DNA, 21 bp, Homo sapiens
agtctctttttttggcccagg

SEQ ID NO: 231029 - DNA, 23 bp, Homo sapiens
agtctctttttttggcccaggcc

SEQ ID NO: 231030 - DNA, 17 bp, Homo sapiens
agtctgaacccttgtgc

SEQ ID NO: 231031 - DNA, 18 bp, Homo sapiens
agtctgaacccttgtgct

SEQ ID NO: 231032 - DNA, 15 bp, Homo sapiens
agtctgaaggagagg

SEQ ID NO: 231033 - DNA, 14 bp, Homo sapiens
agtctgacaggaag

SEQ ID NO: 231034 - DNA, 16 bp, Homo sapiens
agtctgacaggaagac

SEQ ID NO: 231035 - DNA, 23 bp, Homo sapiens
agtctgagaaggctaaagaagac

SEQ ID NO: 231036 - DNA, 15 bp, Homo sapiens
agtctgagcccccgg

SEQ ID NO: 231037 - DNA, 18 bp, Homo sapiens
agtctgaggcacctgcat

SEQ ID NO: 231038 - DNA, 16 bp, Homo sapiens
ataatggctaactttt

SEQ ID NO: 231039 - DNA, 18 bp, Homo sapiens
ataatggtttactgctgt

SEQ ID NO: 231040 - DNA, 20 bp, Homo sapiens
ataatggtttactgctgtca

SEQ ID NO: 231041 - DNA, 22 bp, Homo sapiens
ataatgtataaagaacaaggta

SEQ ID NO: 231042 - DNA, 18 bp, Homo sapiens
ataatgtcctttccctgg

SEQ ID NO: 231043 - DNA, 12 bp, Homo sapiens
ataatgtgttaa

SEQ ID NO: 231044 - DNA, 12 bp, Homo sapiens
ataatgttaaca

SEQ ID NO: 231045 - DNA, 20 bp, Homo sapiens
ataatgttagtagcactgag

SEQ ID NO: 231046 - DNA, 12 bp, Homo sapiens
ataatgttcctt

SEQ ID NO: 231047 - DNA, 17 bp, Homo sapiens
ataatgttccttagtgg

SEQ ID NO: 231048 - DNA, 21 bp, Homo sapiens
ataatgttctttaatgttgtc

SEQ ID NO: 231049 - DNA, 14 bp, Homo sapiens
ataatgttgttatt

SEQ ID NO: 231050 - DNA, 23 bp, Homo sapiens
ataatgtttccctcaagaacaaa

SEQ ID NO: 231051 - DNA, 18 bp, Homo sapiens
ataattaaatgaaatact

SEQ ID NO: 231052 - DNA, 19 bp, Homo sapiens
ataattaaattttaatgta

SEQ ID NO: 231053 - DNA, 21 bp, Homo sapiens
ataattatcggaagcagtgcc

SEQ ID NO: 231054 - DNA, 22 bp, Homo sapiens
ataattatcggaagcagtgcct

SEQ ID NO: 231055 - DNA, 12 bp, Homo sapiens
ataattatggga

SEQ ID NO: 231056 - DNA, 14 bp, Homo sapiens
ataattatgggaac

SEQ ID NO: 231057 - DNA, 22 bp, Homo sapiens
ataattatgggaacaagtgtac

SEQ ID NO: 231058 - DNA, 15 bp, Homo sapiens
ataattatgtttacc

SEQ ID NO: 231059 - DNA, 17 bp, Homo sapiens
ataattatttatttaat

SEQ ID NO: 231060 - DNA, 21 bp, Homo sapiens
ataattatttatttaataaca

SEQ ID NO: 231061 - DNA, 19 bp, Homo sapiens
ataattccctatcttttag

SEQ ID NO: 231062 - DNA, 21 bp, Homo sapiens
ataattctattgaaagttttt

SEQ ID NO: 231063 - DNA, 20 bp, Homo sapiens
ataattgtggagaggagaga

SEQ ID NO: 231064 - DNA, 22 bp, Homo sapiens
ataatttaagccaataaataat

SEQ ID NO: 231065 - DNA, 18 bp, Homo sapiens
ataatttacctgaagtct

SEQ ID NO: 231066 - DNA, 16 bp, Homo sapiens
ataatttgcatattct

SEQ ID NO: 231067 - DNA, 18 bp, Homo sapiens
ataattttaaaattgcag

SEQ ID NO: 231068 - DNA, 12 bp, Homo sapiens
ataattttatga

SEQ ID NO: 231069 - DNA, 22 bp, Homo sapiens
ataattttcttcatgcaatgac

SEQ ID NO: 231070 - DNA, 23 bp, Homo sapiens
ataattttcttcatgcaatgaca

SEQ ID NO: 231071 - DNA, 16 bp, Homo sapiens
ataatttttaaaagag

SEQ ID NO: 231072 - DNA, 21 bp, Homo sapiens
ataattttttagttaaaatct

SEQ ID NO: 231073 - DNA, 23 bp, Homo sapiens
ataattttttagttaaaatctat

SEQ ID NO: 231074 - DNA, 15 bp, Homo sapiens
ataattttttattca

SEQ ID NO: 231075 - DNA, 14 bp, Homo sapiens
atacaaaaatatat

SEQ ID NO: 231076 - DNA, 18 bp, Homo sapiens
atacaaaaatatattaaa

SEQ ID NO: 231077 - DNA, 18 bp, Homo sapiens
atacaaaataaaattatg

SEQ ID NO: 231078 - DNA, 21 bp, Homo sapiens
atacaactttggaatttgaag

SEQ ID NO: 231079 - DNA, 22 bp, Homo sapiens
atacaagccattctaaggaaat

SEQ ID NO: 231080 - DNA, 18 bp, Homo sapiens
atacaaggagggcctctg

SEQ ID NO: 231081 - DNA, 17 bp, Homo sapiens
atacaagtttcagacag

SEQ ID NO: 231082 - DNA, 19 bp, Homo sapiens
atacaagtttcagacaggg

SEQ ID NO: 231083 - DNA, 12 bp, Homo sapiens
atacaataaact

SEQ ID NO: 231084 - DNA, 14 bp, Homo sapiens
atacaatcagctgc

SEQ ID NO: 231085 - DNA, 16 bp, Homo sapiens
atacaatcagctgctt

SEQ ID NO: 231086 - DNA, 11 bp, Homo sapiens
atacaattaaa

SEQ ID NO: 231087 - DNA, 18 bp, Homo sapiens
atacaattcagttttagt

SEQ ID NO: 231088 - DNA, 10 bp, Homo sapiens
atacacacac

SEQ ID NO: 231089 - DNA, 21 bp, Homo sapiens
atacaccacctcactcctgtt

SEQ ID NO: 231090 - DNA, 19 bp, Homo sapiens
atacactacaaatgttaaa

SEQ ID NO: 231091 - DNA, 22 bp, Homo sapiens
atacacttacactttatgcaca

SEQ ID NO: 231092 - DNA, 18 bp, Homo sapiens
atacagacactaagttat

SEQ ID NO: 231093 - DNA, 14 bp, Homo sapiens
atacagataacatt

SEQ ID NO: 231094 - DNA, 21 bp, Homo sapiens
atacagatccgcatgtgtctg

SEQ ID NO: 231095 - DNA, 21 bp, Homo sapiens
atagtggccagaccagagctc

SEQ ID NO: 231096 - DNA, 17 bp, Homo sapiens
atagtggttcttggaaa

SEQ ID NO: 231097 - DNA, 21 bp, Homo sapiens
atagtggttcttggaaaaatg

SEQ ID NO: 231098 - DNA, 18 bp, Homo sapiens
atagtgtataccacctgt

SEQ ID NO: 231099 - DNA, 14 bp, Homo sapiens
atagtgtgttctga

SEQ ID NO: 231100 - DNA, 19 bp, Homo sapiens
atagtgtgttctgattaga

SEQ ID NO: 231101 - DNA, 21 bp, Homo sapiens
atagtgtgttctgattagaaa

SEQ ID NO: 231102 - DNA, 22 bp, Homo sapiens
atagttaagcgtgcataagtta

SEQ ID NO: 231103 - DNA, 23 bp, Homo sapiens
atagttaatgaaggtgtgctaca

SEQ ID NO: 231104 - DNA, 20 bp, Homo sapiens
atagttaattgtggctttat

SEQ ID NO: 231105 - DNA, 19 bp, Homo sapiens
atagttaccgatggtgtcc

SEQ ID NO: 231106 - DNA, 23 bp, Homo sapiens
atagttaggatagcatttttgat

SEQ ID NO: 231107 - DNA, 21 bp, Homo sapiens
atagttattttaataccttta

SEQ ID NO: 231108 - DNA, 13 bp, Homo sapiens
atagttcaggatt

SEQ ID NO: 231109 - DNA, 21 bp, Homo sapiens
atagttctatcaggaaaacaa

SEQ ID NO: 231110 - DNA, 19 bp, Homo sapiens
atagttctgttaaatattt

SEQ ID NO: 231111 - DNA, 18 bp, Homo sapiens
atagttgtctttctttgc

SEQ ID NO: 231112 - DNA, 19 bp, Homo sapiens
atagttgtctttctttgct

SEQ ID NO: 231113 - DNA, 14 bp, Homo sapiens
atagtttacatgta

SEQ ID NO: 231114 - DNA, 14 bp, Homo sapiens
atagtttcagatat

SEQ ID NO: 231115 - DNA, 12 bp, Homo sapiens
atagtttctgta

SEQ ID NO: 231116 - DNA, 19 bp, Homo sapiens
atagtttctgtaattggct

SEQ ID NO: 231117 - DNA, 18 bp, Homo sapiens
atagttttacattaacat

SEQ ID NO: 231118 - DNA, 23 bp, Homo sapiens
atagttttgctaggtataaaaaa

SEQ ID NO: 231119 - DNA, 23 bp, Homo sapiens
atataaaaaccccaaactgttga

SEQ ID NO: 231120 - DNA, 17 bp, Homo sapiens
atataaaaagaaaagat

SEQ ID NO: 231121 - DNA, 22 bp, Homo sapiens
atataaaaataattaaaacaaa

SEQ ID NO: 231122 - DNA, 12 bp, Homo sapiens
atataaaataaa

SEQ ID NO: 231123 - DNA, 13 bp, Homo sapiens
atataaaataaat

SEQ ID NO: 231124 - DNA, 14 bp, Homo sapiens
atataaaataaata

SEQ ID NO: 231125 - DNA, 18 bp, Homo sapiens
atataaaataaatatact

SEQ ID NO: 231126 - DNA, 15 bp, Homo sapiens
atataaaatgtattc

SEQ ID NO: 231127 - DNA, 18 bp, Homo sapiens
atataaaatgtattcaag

SEQ ID NO: 231128 - DNA, 20 bp, Homo sapiens
atataaaatgtattcaagca

SEQ ID NO: 231129 - DNA, 15 bp, Homo sapiens
atataaacaatgttc

SEQ ID NO: 231130 - DNA, 14 bp, Homo sapiens
atataaataaagca

SEQ ID NO: 231131 - DNA, 14 bp, Homo sapiens
atataaatgaatga

SEQ ID NO: 231132 - DNA, 18 bp, Homo sapiens
atataaatggctggtttt

SEQ ID NO: 231133 - DNA, 16 bp, Homo sapiens
atataaatggtgagaa

SEQ ID NO: 231134 - DNA, 23 bp, Homo sapiens
atataaatggtgagaattaaaat

SEQ ID NO: 231135 - DNA, 17 bp, Homo sapiens
atataaattaagacttt

SEQ ID NO: 231136 - DNA, 12 bp, Homo sapiens
atataaattaat

SEQ ID NO: 231137 - DNA, 20 bp, Homo sapiens
atataacaatatatgatata

SEQ ID NO: 231138 - DNA, 20 bp, Homo sapiens
atataactgccttaaaactt

SEQ ID NO: 231139 - DNA, 21 bp, Homo sapiens
atataacttaaaaatgtaaat

SEQ ID NO: 231140 - DNA, 14 bp, Homo sapiens
atataagattttct

SEQ ID NO: 231141 - DNA, 12 bp, Homo sapiens
atataagctgtt

SEQ ID NO: 231142 - DNA, 15 bp, Homo sapiens
atataagcttaaaat

SEQ ID NO: 231143 - DNA, 23 bp, Homo sapiens
atataagcttaaaataagtgaat

SEQ ID NO: 231144 - DNA, 13 bp, Homo sapiens
atataagcttttt

SEQ ID NO: 231145 - DNA, 17 bp, Homo sapiens
atataagttaaagagac

SEQ ID NO: 231146 - DNA, 19 bp, Homo sapiens
atataagttaaagagacaa

SEQ ID NO: 231147 - DNA, 12 bp, Homo sapiens
atataataaagt

SEQ ID NO: 231148 - DNA, 21 bp, Homo sapiens
atataataaatgtacattaat

SEQ ID NO: 231149 - DNA, 17 bp, Homo sapiens
atataatacttaaaaat

SEQ ID NO: 231150 - DNA, 15 bp, Homo sapiens
atataatatatgttt

SEQ ID NO: 231151 - DNA, 18 bp, Homo sapiens
atataatggcctcttaaa

SEQ ID NO: 231152 - DNA, 17 bp, Homo sapiens
atataatggtttactgc

SEQ ID NO: 231153 - DNA, 22 bp, Homo sapiens
atataatgttgttatttaaaga

SEQ ID NO: 231154 - DNA, 17 bp, Homo sapiens
atataattctgtaaatg

SEQ ID NO: 231155 - DNA, 11 bp, Homo sapiens
atatacaatta

SEQ ID NO: 231156 - DNA, 22 bp, Homo sapiens
atatacagatgaaaatttgaga

SEQ ID NO: 231157 - DNA, 20 bp, Homo sapiens
atatacagcaggatgtgcct

SEQ ID NO: 231158 - DNA, 14 bp, Homo sapiens
atatacataacagg

SEQ ID NO: 231159 - DNA, 18 bp, Homo sapiens
atctaaatagatactttt

SEQ ID NO: 231160 - DNA, 16 bp, Homo sapiens
atctaagacattcacc

SEQ ID NO: 231161 - DNA, 15 bp, Homo sapiens
atctaaggcatgctc

SEQ ID NO: 231162 - DNA, 19 bp, Homo sapiens
atctaaggcatgctcccag

SEQ ID NO: 231163 - DNA, 23 bp, Homo sapiens
atctaagtcagtttcacatattt

SEQ ID NO: 231164 - DNA, 15 bp, Homo sapiens
atctaatctcttatt

SEQ ID NO: 231165 - DNA, 21 bp, Homo sapiens
atctaatctcttattctaata

SEQ ID NO: 231166 - DNA, 17 bp, Homo sapiens
atctaatgcttgtttat

SEQ ID NO: 231167 - DNA, 16 bp, Homo sapiens
atctaattattttgca

SEQ ID NO: 231168 - DNA, 16 bp, Homo sapiens
atctacagaacaaaga

SEQ ID NO: 231169 - DNA, 14 bp, Homo sapiens
atctactagaacct

SEQ ID NO: 231170 - DNA, 18 bp, Homo sapiens
atctacttcatagctcct

SEQ ID NO: 231171 - DNA, 15 bp, Homo sapiens
atctagaacattcag

SEQ ID NO: 231172 - DNA, 18 bp, Homo sapiens
atctagagctatgcacac

SEQ ID NO: 231173 - DNA, 20 bp, Homo sapiens
atctagagctatgcacacca

SEQ ID NO: 231174 - DNA, 22 bp, Homo sapiens
atctagatcaattaattcttaa

SEQ ID NO: 231175 - DNA, 15 bp, Homo sapiens
atctagcaagaagat

SEQ ID NO: 231176 - DNA, 21 bp, Homo sapiens
atctagcaagaagattctaaa

SEQ ID NO: 231177 - DNA, 12 bp, Homo sapiens
atctaggtttaa

SEQ ID NO: 231178 - DNA, 22 bp, Homo sapiens
atctaggtttaactcagatcac

SEQ ID NO: 231179 - DNA, 22 bp, Homo sapiens
atctagtgcagctgattttaac

SEQ ID NO: 231180 - DNA, 12 bp, Homo sapiens
atctataaagcg

SEQ ID NO: 231181 - DNA, 19 bp, Homo sapiens
atctatagtatagaatgaa

SEQ ID NO: 231182 - DNA, 20 bp, Homo sapiens
atctatagtatagaatgaac

SEQ ID NO: 231183 - DNA, 14 bp, Homo sapiens
atctatatatacat

SEQ ID NO: 231184 - DNA, 16 bp, Homo sapiens
atctatatatacatat

SEQ ID NO: 231185 - DNA, 13 bp, Homo sapiens
atctatcacctgt

SEQ ID NO: 231186 - DNA, 14 bp, Homo sapiens
atctatcacctgtc

SEQ ID NO: 231187 - DNA, 16 bp, Homo sapiens
atctatcacctgtcat

SEQ ID NO: 231188 - DNA, 17 bp, Homo sapiens
atctattgggttcatta

SEQ ID NO: 231189 - DNA, 19 bp, Homo sapiens
atctattgggttcattatt

SEQ ID NO: 231190 - DNA, 16 bp, Homo sapiens
atctatttattaagtt

SEQ ID NO: 231191 - DNA, 14 bp, Homo sapiens
atctatttattgga

SEQ ID NO: 231192 - DNA, 22 bp, Homo sapiens
atctcaatgtgcaataacttgt

SEQ ID NO: 231193 - DNA, 16 bp, Homo sapiens
atctcacacagctggg

SEQ ID NO: 231194 - DNA, 18 bp, Homo sapiens
atctcacagatcttcaac

SEQ ID NO: 231195 - DNA, 17 bp, Homo sapiens
atctcacttaatacaga

SEQ ID NO: 231196 - DNA, 19 bp, Homo sapiens
atctcacttttctccatga

SEQ ID NO: 231197 - DNA, 20 bp, Homo sapiens
atctcagataaagtgaccag

SEQ ID NO: 231198 - DNA, 10 bp, Homo sapiens
atctcagcac

SEQ ID NO: 231199 - DNA, 12 bp, Homo sapiens
atctcagcctcc

SEQ ID NO: 231200 - DNA, 16 bp, Homo sapiens
atctcagcctcctgag

SEQ ID NO: 231201 - DNA, 20 bp, Homo sapiens
atctcagcctcctgagcctg

SEQ ID NO: 231202 - DNA, 18 bp, Homo sapiens
atctcagctcactgcaag

SEQ ID NO: 231203 - DNA, 23 bp, Homo sapiens
atctcaggataaagtttgctaag

SEQ ID NO: 231204 - DNA, 14 bp, Homo sapiens
atctcaggccacct

SEQ ID NO: 231205 - DNA, 14 bp, Homo sapiens
atctcaggtgccac

SEQ ID NO: 231206 - DNA, 19 bp, Homo sapiens
atctcatccccaaactgta

SEQ ID NO: 231207 - DNA, 21 bp, Homo sapiens
atctcattacagctcattcgc

SEQ ID NO: 231208 - DNA, 22 bp, Homo sapiens
atctcattgcaaaaatatttta

SEQ ID NO: 231209 - DNA, 13 bp, Homo sapiens
atctccaaagctt

SEQ ID NO: 231210 - DNA, 23 bp, Homo sapiens
atctccaagatagcatcccatct

SEQ ID NO: 231211 - DNA, 18 bp, Homo sapiens
atctccaaggatcctctc

SEQ ID NO: 231212 - DNA, 18 bp, Homo sapiens
atctccaggcccagcctg

SEQ ID NO: 231213 - DNA, 20 bp, Homo sapiens
atctccaggcccagcctggc

SEQ ID NO: 231214 - DNA, 23 bp, Homo sapiens
atctccaggcccagcctggcccc

SEQ ID NO: 231215 - DNA, 21 bp, Homo sapiens
atctccagggagcaagacaga

SEQ ID NO: 231216 - DNA, 20 bp, Homo sapiens
atctccagggagtcccctcc

SEQ ID NO: 231217 - DNA, 18 bp, Homo sapiens
atctccagtattcttgtc

SEQ ID NO: 231218 - DNA, 20 bp, Homo sapiens
atctccatcatatgcctgac

SEQ ID NO: 231219 - DNA, 13 bp, Homo sapiens
atctcccagactt

SEQ ID NO: 231220 - DNA, 19 bp, Homo sapiens
atctcccagacttgtttcc

SEQ ID NO: 231221 - DNA, 20 bp, Homo sapiens
atctcccagacttgtttcct

SEQ ID NO: 231222 - DNA, 13 bp, Homo sapiens
atctccccactct

SEQ ID NO: 231223 - DNA, 15 bp, Homo sapiens
atctccccaggcctc

SEQ ID NO: 231224 - DNA, 17 bp, Homo sapiens
atctccccaggcctcca

SEQ ID NO: 231225 - DNA, 22 bp, Homo sapiens
atctccccaggcctccagcctc

SEQ ID NO: 231226 - DNA, 23 bp, Homo sapiens
atctcccctcctcacagttgcca

SEQ ID NO: 231227 - DNA, 13 bp, Homo sapiens
atctccctgcttc

SEQ ID NO: 231228 - DNA, 15 bp, Homo sapiens
atctccgtggctttg

SEQ ID NO: 231229 - DNA, 14 bp, Homo sapiens
atctcctatctttt

SEQ ID NO: 231230 - DNA, 20 bp, Homo sapiens
atctcctggtagcatgacct

SEQ ID NO: 231231 - DNA, 21 bp, Homo sapiens
atctcctggtagcatgacctt

SEQ ID NO: 231232 - DNA, 15 bp, Homo sapiens
atctcctgtgcatgg

SEQ ID NO: 231233 - DNA, 18 bp, Homo sapiens
atctcctgtgcatgggtg

SEQ ID NO: 231234 - DNA, 16 bp, Homo sapiens
atctccttcagaagtt

SEQ ID NO: 231235 - DNA, 16 bp, Homo sapiens
atctccttgtcttttt

SEQ ID NO: 231236 - DNA, 17 bp, Homo sapiens
atctcgaagtcttccat

SEQ ID NO: 231237 - DNA, 17 bp, Homo sapiens
atctcgagccccctgga

SEQ ID NO: 231238 - DNA, 15 bp, Homo sapiens
atctcgtgggagagc

SEQ ID NO: 231239 - DNA, 13 bp, Homo sapiens
atctctaatatgg

SEQ ID NO: 231240 - DNA, 15 bp, Homo sapiens
atctctaatatggca

SEQ ID NO: 231241 - DNA, 17 bp, Homo sapiens
atctctactaaaaatac

SEQ ID NO: 231242 - DNA, 20 bp, Homo sapiens
atctctactaccacaaggaa

SEQ ID NO: 231243 - DNA, 18 bp, Homo sapiens
atctctagaattttaagt

SEQ ID NO: 231244 - DNA, 15 bp, Homo sapiens
atctctcaaaacttg

SEQ ID NO: 231245 - DNA, 14 bp, Homo sapiens
atctctcaaaatgt

SEQ ID NO: 231246 - DNA, 16 bp, Homo sapiens
atctctcaaaatgtgc

SEQ ID NO: 231247 - DNA, 17 bp, Homo sapiens
atctctcaaaatgtgcc

SEQ ID NO: 231248 - DNA, 14 bp, Homo sapiens
atctctcaggagca

SEQ ID NO: 231249 - DNA, 21 bp, Homo sapiens
atctctcaggagcacaggcag

SEQ ID NO: 231250 - DNA, 13 bp, Homo sapiens
atctctctccctt

SEQ ID NO: 231251 - DNA, 21 bp, Homo sapiens
atctctctctgttgtgttcgt

SEQ ID NO: 231252 - DNA, 17 bp, Homo sapiens
atctctgaacttcagct

SEQ ID NO: 231253 - DNA, 13 bp, Homo sapiens
atctctgaagcat

SEQ ID NO: 231254 - DNA, 15 bp, Homo sapiens
atctctgattaaatt

SEQ ID NO: 231255 - DNA, 13 bp, Homo sapiens
atctctgcctttg

SEQ ID NO: 231256 - DNA, 12 bp, Homo sapiens
atctctgctgaa

SEQ ID NO: 231257 - DNA, 14 bp, Homo sapiens
atctctgctgcttc

SEQ ID NO: 231258 - DNA, 21 bp, Homo sapiens
atctctgctgcttctgggcct

SEQ ID NO: 231259 - DNA, 22 bp, Homo sapiens
atctctgctgcttctgggcctg

SEQ ID NO: 231260 - DNA, 15 bp, Homo sapiens
atctctggagtgtgt

SEQ ID NO: 231261 - DNA, 17 bp, Homo sapiens
atctctgggctgagcct

SEQ ID NO: 231262 - DNA, 22 bp, Homo sapiens
atctctgtgactcgcttagctg

SEQ ID NO: 231263 - DNA, 14 bp, Homo sapiens
atctcttattctaa

SEQ ID NO: 231264 - DNA, 16 bp, Homo sapiens
atctcttattttacaa

SEQ ID NO: 231265 - DNA, 22 bp, Homo sapiens
atctcttcctacccaaccactc

SEQ ID NO: 231266 - DNA, 14 bp, Homo sapiens
atctcttcttcctt

SEQ ID NO: 231267 - DNA, 14 bp, Homo sapiens
atctctttctctct

SEQ ID NO: 231268 - DNA, 23 bp, Homo sapiens
atctctttctctctttccatctc

SEQ ID NO: 231269 - DNA, 22 bp, Homo sapiens
atctctttgttctaaagatgga

SEQ ID NO: 231270 - DNA, 13 bp, Homo sapiens
atctgaactctca

SEQ ID NO: 231271 - DNA, 21 bp, Homo sapiens
atctgaagagctattatataa

SEQ ID NO: 231272 - DNA, 13 bp, Homo sapiens
atctgaaggagat

SEQ ID NO: 231273 - DNA, 15 bp, Homo sapiens
atctgaaggttctgg

SEQ ID NO: 231274 - DNA, 15 bp, Homo sapiens
atctgaagtgtctaa

SEQ ID NO: 231275 - DNA, 21 bp, Homo sapiens
atctgaagtgtctaatgcatt

SEQ ID NO: 231276 - DNA, 22 bp, Homo sapiens
atctgaagtgtctaatgcatta

SEQ ID NO: 231277 - DNA, 19 bp, Homo sapiens
atctgacatgattccttcc

SEQ ID NO: 231278 - DNA, 15 bp, Homo sapiens
atctgaggagtccaa

SEQ ID NO: 231279 - DNA, 20 bp, Homo sapiens
atctgagggcactctctgcc

SEQ ID NO: 231280 - DNA, 20 bp, Homo sapiens
atctgatcacccccctgctt

SEQ ID NO: 231281 - DNA, 19 bp, Homo sapiens
atctgatcccataaagaaa

SEQ ID NO: 231282 - DNA, 13 bp, Homo sapiens
atctgcaaatagt

SEQ ID NO: 231283 - DNA, 14 bp, Homo sapiens
atctgcaatatgaa

SEQ ID NO: 231284 - DNA, 12 bp, Homo sapiens
atctgcaatttg

SEQ ID NO: 231285 - DNA, 19 bp, Homo sapiens
atctgcagctctttcttct

SEQ ID NO: 231286 - DNA, 12 bp, Homo sapiens
atctgcagggag

SEQ ID NO: 231287 - DNA, 23 bp, Homo sapiens
atctgcatgtaaaatcttcagct

SEQ ID NO: 231288 - DNA, 16 bp, Homo sapiens
atcttggactgacatt

SEQ ID NO: 231289 - DNA, 21 bp, Homo sapiens
atcttggtagttctgtgcctc

SEQ ID NO: 231290 - DNA, 15 bp, Homo sapiens
atcttgtcatgtgta

SEQ ID NO: 231291 - DNA, 14 bp, Homo sapiens
atcttgtctctggg

SEQ ID NO: 231292 - DNA, 14 bp, Homo sapiens
atcttgtcttttcc

SEQ ID NO: 231293 - DNA, 20 bp, Homo sapiens
atcttgtgctagaatacttt

SEQ ID NO: 231294 - DNA, 14 bp, Homo sapiens
atctttaaatataa

SEQ ID NO: 231295 - DNA, 21 bp, Homo sapiens
atctttatacttaaacagctt

SEQ ID NO: 231296 - DNA, 22 bp, Homo sapiens
atctttatacttaaacagcttt

SEQ ID NO: 231297 - DNA, 16 bp, Homo sapiens
atctttatcattaaac

SEQ ID NO: 231298 - DNA, 22 bp, Homo sapiens
atctttatcattaaacatgaat

SEQ ID NO: 231299 - DNA, 22 bp, Homo sapiens
atctttattttagtcttgatgt

SEQ ID NO: 231300 - DNA, 15 bp, Homo sapiens
atctttcagcctgct

SEQ ID NO: 231301 - DNA, 20 bp, Homo sapiens
atctttcatagttctgttaa

SEQ ID NO: 231302 - DNA, 20 bp, Homo sapiens
atctttccatctcattacag

SEQ ID NO: 231303 - DNA, 15 bp, Homo sapiens
atctttctacagaga

SEQ ID NO: 231304 - DNA, 18 bp, Homo sapiens
atctttctatataaaatg

SEQ ID NO: 231305 - DNA, 18 bp, Homo sapiens
atctttctttacctgaga

SEQ ID NO: 231306 - DNA, 22 bp, Homo sapiens
atctttctttacctgagaccag

SEQ ID NO: 231307 - DNA, 12 bp, Homo sapiens
atctttgcactg

SEQ ID NO: 231308 - DNA, 20 bp, Homo sapiens
atctttgccttgggctgctc

SEQ ID NO: 231309 - DNA, 16 bp, Homo sapiens
atctttgcttccttgc

SEQ ID NO: 231310 - DNA, 12 bp, Homo sapiens
atgactggctgt

SEQ ID NO: 231311 - DNA, 10 bp, Homo sapiens
atgactgggc

SEQ ID NO: 231312 - DNA, 12 bp, Homo sapiens
atgactgggcct

SEQ ID NO: 231313 - DNA, 16 bp, Homo sapiens
atgactgtcccattct

SEQ ID NO: 231314 - DNA, 19 bp, Homo sapiens
atgacttcatttctgatgt

SEQ ID NO: 231315 - DNA, 12 bp, Homo sapiens
atgacttcttgt

SEQ ID NO: 231316 - DNA, 16 bp, Homo sapiens
atgagaaaaaaacagc

SEQ ID NO: 231317 - DNA, 14 bp, Homo sapiens
atgagaaaaaacta

SEQ ID NO: 231318 - DNA, 22 bp, Homo sapiens
atgagaaactttgatctctgct

SEQ ID NO: 231319 - DNA, 23 bp, Homo sapiens
atgagaaactttgatctctgctt

SEQ ID NO: 231320 - DNA, 19 bp, Homo sapiens
atgagaaatataaaaataa

SEQ ID NO: 231321 - DNA, 21 bp, Homo sapiens
atgagaacaagtcacagctgc

SEQ ID NO: 231322 - DNA, 13 bp, Homo sapiens
atgagaacatggt

SEQ ID NO: 231323 - DNA, 16 bp, Homo sapiens
atgagaactaaataga

SEQ ID NO: 231324 - DNA, 21 bp, Homo sapiens
atgagaagagggcctgtggga

SEQ ID NO: 231325 - DNA, 17 bp, Homo sapiens
atgagaagttaagcagc

SEQ ID NO: 231326 - DNA, 18 bp, Homo sapiens
atgagaagttaagcagcc

SEQ ID NO: 231327 - DNA, 18 bp, Homo sapiens
atgagaatgtcatttgct

SEQ ID NO: 231328 - DNA, 19 bp, Homo sapiens
atgagaatgtcatttgcta

SEQ ID NO: 231329 - DNA, 21 bp, Homo sapiens
atgagatgggttgagtttgct

SEQ ID NO: 231330 - DNA, 19 bp, Homo sapiens
atgagattggaaaaaatta

SEQ ID NO: 231331 - DNA, 20 bp, Homo sapiens
atgagattggtcattaaata

SEQ ID NO: 231332 - DNA, 20 bp, Homo sapiens
atgagatttgccagcacagg

SEQ ID NO: 231333 - DNA, 18 bp, Homo sapiens
atgagcaaggacattgcc

SEQ ID NO: 231334 - DNA, 19 bp, Homo sapiens
atgagcaaggacattgccc

SEQ ID NO: 231335 - DNA, 21 bp, Homo sapiens
atgagcaaggacattgcccca

SEQ ID NO: 231336 - DNA, 16 bp, Homo sapiens
atgagcactcctgatt

SEQ ID NO: 231337 - DNA, 15 bp, Homo sapiens
atgagcagtccagag

SEQ ID NO: 231338 - DNA, 16 bp, Homo sapiens
atgagcatcagagagt

SEQ ID NO: 231339 - DNA, 22 bp, Homo sapiens
atgagcatcagagagtgtacat

SEQ ID NO: 231340 - DNA, 18 bp, Homo sapiens
atgagccaccgcgcccag

SEQ ID NO: 231341 - DNA, 14 bp, Homo sapiens
atgagccagacaaa

SEQ ID NO: 231342 - DNA, 13 bp, Homo sapiens
atgagcctgcccg

SEQ ID NO: 231343 - DNA, 18 bp, Homo sapiens
atgagcctgcccgctgca

SEQ ID NO: 231344 - DNA, 23 bp, Homo sapiens
atgagctatttccattccagaat

SEQ ID NO: 231345 - DNA, 15 bp, Homo sapiens
atgagctccagaccc

SEQ ID NO: 231346 - DNA, 22 bp, Homo sapiens
atgagctcgcatttgtcaatga

SEQ ID NO: 231347 - DNA, 21 bp, Homo sapiens
atgagctggaaggagtgagag

SEQ ID NO: 231348 - DNA, 12 bp, Homo sapiens
atgagctgggcc

SEQ ID NO: 231349 - DNA, 14 bp, Homo sapiens
atgaggaataatta

SEQ ID NO: 231350 - DNA, 23 bp, Homo sapiens
atgaggaataattatttatttaa

SEQ ID NO: 231351 - DNA, 22 bp, Homo sapiens
atgaggaggcagaaagcagagg

SEQ ID NO: 231352 - DNA, 14 bp, Homo sapiens
atgagggaaacaaa

SEQ ID NO: 231353 - DNA, 15 bp, Homo sapiens
atgaggggactgcat

SEQ ID NO: 231354 - DNA, 16 bp, Homo sapiens
atgaggggactgcatg

SEQ ID NO: 231355 - DNA, 22 bp, Homo sapiens
atgaggggactgcatgcaagct

SEQ ID NO: 231356 - DNA, 15 bp, Homo sapiens
atgaggggcccgagc

SEQ ID NO: 231357 - DNA, 17 bp, Homo sapiens
atgaggtaaaagagcca

SEQ ID NO: 231358 - DNA, 15 bp, Homo sapiens
atgaggtctgaaatg

SEQ ID NO: 231359 - DNA, 16 bp, Homo sapiens
atgaggtgctgggagg

SEQ ID NO: 231360 - DNA, 14 bp, Homo sapiens
atgaggttatgaga

SEQ ID NO: 231361 - DNA, 13 bp, Homo sapiens
atgagtaaataaa

SEQ ID NO: 231362 - DNA, 14 bp, Homo sapiens
atgagtaaataaac

SEQ ID NO: 231363 - DNA, 19 bp, Homo sapiens
atgagtattagttccctgt

SEQ ID NO: 231364 - DNA, 17 bp, Homo sapiens
atgagtctagtttcatt

SEQ ID NO: 231365 - DNA, 19 bp, Homo sapiens
atgagtgtcaactccagga

SEQ ID NO: 231366 - DNA, 17 bp, Homo sapiens
atgagtttaaaaaaata

SEQ ID NO: 231367 - DNA, 21 bp, Homo sapiens
atgagtttaaaaaaataacat

SEQ ID NO: 231368 - DNA, 15 bp, Homo sapiens
atgagtttatgggaa

SEQ ID NO: 231369 - DNA, 20 bp, Homo sapiens
atgagtttccagctaagcct

SEQ ID NO: 231370 - DNA, 22 bp, Homo sapiens
atgagtttgccctggtttcact

SEQ ID NO: 231371 - DNA, 20 bp, Homo sapiens
atgagtttttgatagcttta

SEQ ID NO: 231372 - DNA, 13 bp, Homo sapiens
atgataaaaggaa

SEQ ID NO: 231373 - DNA, 18 bp, Homo sapiens
atgataaaaggaagtaga

SEQ ID NO: 231374 - DNA, 12 bp, Homo sapiens
atgataaaataa

SEQ ID NO: 231375 - DNA, 13 bp, Homo sapiens
atgataaaataag

SEQ ID NO: 231376 - DNA, 19 bp, Homo sapiens
atgataaaataagtaacat

SEQ ID NO: 231377 - DNA, 20 bp, Homo sapiens
atgataaagatgtcaaatat

SEQ ID NO: 231378 - DNA, 22 bp, Homo sapiens
atgataaaggcttaggacttca

SEQ ID NO: 231379 - DNA, 23 bp, Homo sapiens
atgataatcaattattacattta

SEQ ID NO: 231380 - DNA, 22 bp, Homo sapiens
atgatactgtctaagaataatg

SEQ ID NO: 231381 - DNA, 19 bp, Homo sapiens
atgatagcgtgcagtagag

SEQ ID NO: 231382 - DNA, 14 bp, Homo sapiens
atgataggcagcac

SEQ ID NO: 231383 - DNA, 12 bp, Homo sapiens
atgatataaaca

SEQ ID NO: 231384 - DNA, 11 bp, Homo sapiens
atgatatgcat

SEQ ID NO: 231385 - DNA, 13 bp, Homo sapiens
atgatatgcatgt

SEQ ID NO: 231386 - DNA, 19 bp, Homo sapiens
atgatatgcatgtagcata

SEQ ID NO: 231387 - DNA, 15 bp, Homo sapiens
atgatatttcttgct

SEQ ID NO: 231388 - DNA, 23 bp, Homo sapiens
atgatcagaactgggaaaacagt

SEQ ID NO: 231389 - DNA, 20 bp, Homo sapiens
atgatcagctgtttgtcata

SEQ ID NO: 231390 - DNA, 22 bp, Homo sapiens
atgatcatttgcccttaaggac

SEQ ID NO: 231391 - DNA, 17 bp, Homo sapiens
atgatccagctgtgtgt

SEQ ID NO: 231392 - DNA, 22 bp, Homo sapiens
atgatccatgagtttgccctgg

SEQ ID NO: 231393 - DNA, 13 bp, Homo sapiens
atgatccctgtgt

SEQ ID NO: 231394 - DNA, 16 bp, Homo sapiens
atgatctaggtttaac

SEQ ID NO: 231395 - DNA, 15 bp, Homo sapiens
atgatctagttcctg

SEQ ID NO: 231396 - DNA, 14 bp, Homo sapiens
atgatctctctgaa

SEQ ID NO: 231397 - DNA, 12 bp, Homo sapiens
atgatctgtcaa

SEQ ID NO: 231398 - DNA, 17 bp, Homo sapiens
atgatgacgacgacaac

SEQ ID NO: 231399 - DNA, 18 bp, Homo sapiens
atgatgatgggaattgtg

SEQ ID NO: 231400 - DNA, 14 bp, Homo sapiens
atgatgatttcaga

SEQ ID NO: 231401 - DNA, 17 bp, Homo sapiens
atgatgccatgaggaac

SEQ ID NO: 231402 - DNA, 21 bp, Homo sapiens
atgatgcttgtaacaagaaaa

SEQ ID NO: 231403 - DNA, 14 bp, Homo sapiens
atgatggaaaggaa

SEQ ID NO: 231404 - DNA, 15 bp, Homo sapiens
atgatggagtcaggt

SEQ ID NO: 231405 - DNA, 17 bp, Homo sapiens
atgatgtacaggcagat

SEQ ID NO: 231406 - DNA, 18 bp, Homo sapiens
atgatgtccaacaaggaa

SEQ ID NO: 231407 - DNA, 17 bp, Homo sapiens
atgatgtccttgttatt

SEQ ID NO: 231408 - DNA, 17 bp, Homo sapiens
atgatgtcgttcatttt

SEQ ID NO: 231409 - DNA, 22 bp, Homo sapiens
atgatgtgatggaacacacaca

SEQ ID NO: 231410 - DNA, 20 bp, Homo sapiens
atgatgtggtgcctgaggtc

SEQ ID NO: 231411 - DNA, 23 bp, Homo sapiens
atgatgtggtgcctgaggtctgt

SEQ ID NO: 231412 - DNA, 15 bp, Homo sapiens
atgattaaacacctg

SEQ ID NO: 231413 - DNA, 16 bp, Homo sapiens
atgattaaacacctga

SEQ ID NO: 231414 - DNA, 21 bp, Homo sapiens
atgattaaacacctgacacat

SEQ ID NO: 231415 - DNA, 14 bp, Homo sapiens
atgattagacaatg

SEQ ID NO: 231416 - DNA, 17 bp, Homo sapiens
atgattagacaatgtgg

SEQ ID NO: 231417 - DNA, 14 bp, Homo sapiens
atgattagcaagtt

SEQ ID NO: 231418 - DNA, 22 bp, Homo sapiens
atgattaggcccgccaaacttc

SEQ ID NO: 231419 - DNA, 21 bp, Homo sapiens
atgattcaatcattttgggaa

SEQ ID NO: 231420 - DNA, 15 bp, Homo sapiens
atgattcataacaat

SEQ ID NO: 231421 - DNA, 14 bp, Homo sapiens
atgattccaaataa

SEQ ID NO: 231422 - DNA, 16 bp, Homo sapiens
atgattgaaaagaaga

SEQ ID NO: 231423 - DNA, 20 bp, Homo sapiens
atgattgaaaagaagaaagt

SEQ ID NO: 231424 - DNA, 18 bp, Homo sapiens
atgattgtaaaatagctt

SEQ ID NO: 231425 - DNA, 20 bp, Homo sapiens
atgattgtttaattgtaggt

SEQ ID NO: 231426 - DNA, 16 bp, Homo sapiens
atgatttaagcatttt

SEQ ID NO: 231427 - DNA, 18 bp, Homo sapiens
atgattttatttgacaaa

SEQ ID NO: 231428 - DNA, 16 bp, Homo sapiens
atgattttgcttttcc

SEQ ID NO: 231429 - DNA, 13 bp, Homo sapiens
atgatttttagat

SEQ ID NO: 231430 - DNA, 21 bp, Homo sapiens
atgatttttgtgtatccagta

SEQ ID NO: 231431 - DNA, 23 bp, Homo sapiens
atgcaaaaggttcactaaagcag

SEQ ID NO: 231432 - DNA, 18 bp, Homo sapiens
atgcaaaatttttttaat

SEQ ID NO: 231433 - DNA, 16 bp, Homo sapiens
atgcaaaccaggagca

SEQ ID NO: 231434 - DNA, 15 bp, Homo sapiens
atgcaaagaaaatca

SEQ ID NO: 231435 - DNA, 13 bp, Homo sapiens
atgcaaagaactc

SEQ ID NO: 231436 - DNA, 13 bp, Homo sapiens
atgcaaagtataa

SEQ ID NO: 231437 - DNA, 18 bp, Homo sapiens
atgcaaattaaagggcag

SEQ ID NO: 231438 - DNA, 20 bp, Homo sapiens
atgcaactaattcaataaaa

SEQ ID NO: 231439 - DNA, 17 bp, Homo sapiens
atgcaactccatgccta

SEQ ID NO: 231440 - DNA, 13 bp, Homo sapiens
atgcaagggactg

SEQ ID NO: 231441 - DNA, 19 bp, Homo sapiens
atgcaagtgggagatgaaa

SEQ ID NO: 231442 - DNA, 15 bp, Homo sapiens
atgcaagtgtttctg

SEQ ID NO: 231443 - DNA, 19 bp, Homo sapiens
atgcaatgacatcttcaaa

SEQ ID NO: 231444 - DNA, 21 bp, Homo sapiens
atgcaatgtcttaaataaaac

SEQ ID NO: 231445 - DNA, 14 bp, Homo sapiens
atgcacagagtcct

SEQ ID NO: 231446 - DNA, 22 bp, Homo sapiens
atgcacagatgccatggcctgt

SEQ ID NO: 231447 - DNA, 22 bp, Homo sapiens
atgcacagattaaacttcacct

SEQ ID NO: 231448 - DNA, 13 bp, Homo sapiens
atgcacatttgtg

SEQ ID NO: 231449 - DNA, 23 bp, Homo sapiens
atgcacatttgtgcataaatttc

SEQ ID NO: 231450 - DNA, 17 bp, Homo sapiens
atgcaccaagtacagcc

SEQ ID NO: 231451 - DNA, 21 bp, Homo sapiens
atgcaccaagtacagccttca

SEQ ID NO: 231452 - DNA, 15 bp, Homo sapiens
atgcacctataaata

SEQ ID NO: 231453 - DNA, 16 bp, Homo sapiens
atgcactagccaaccc

SEQ ID NO: 231454 - DNA, 21 bp, Homo sapiens
atgcactagccaacccaactg

SEQ ID NO: 231455 - DNA, 19 bp, Homo sapiens
atgcactcgcactgcaaat

SEQ ID NO: 231456 - DNA, 17 bp, Homo sapiens
atgcactcttttgagca

SEQ ID NO: 231457 - DNA, 23 bp, Homo sapiens
atgcactgacctgctccgccagg

SEQ ID NO: 231458 - DNA, 19 bp, Homo sapiens
atgcactggggtaccacat

SEQ ID NO: 231459 - DNA, 16 bp, Homo sapiens
atgcactttaaatgga

SEQ ID NO: 231460 - DNA, 17 bp, Homo sapiens
atgcactttccctagaa

SEQ ID NO: 231461 - DNA, 22 bp, Homo sapiens
atgcagaaatgtggatgctctt

SEQ ID NO: 231462 - DNA, 17 bp, Homo sapiens
atgcagatctagccagg

SEQ ID NO: 231463 - DNA, 14 bp, Homo sapiens
atgcagatgccaga

SEQ ID NO: 231464 - DNA, 15 bp, Homo sapiens
atgcagatgccagag

SEQ ID NO: 231465 - DNA, 19 bp, Homo sapiens
atgcagattcctgggcctg

SEQ ID NO: 231466 - DNA, 19 bp, Homo sapiens
atgcagcaacacccaagtc

SEQ ID NO: 231467 - DNA, 21 bp, Homo sapiens
atgcagcaacacccaagtcca

SEQ ID NO: 231468 - DNA, 13 bp, Homo sapiens
atgcagcagcttg

SEQ ID NO: 231469 - DNA, 16 bp, Homo sapiens
atgcagcatacaaaaa

SEQ ID NO: 231470 - DNA, 18 bp, Homo sapiens
atgcagcatacaaaaata

SEQ ID NO: 231471 - DNA, 15 bp, Homo sapiens
atgcagcccatgccc

SEQ ID NO: 231472 - DNA, 22 bp, Homo sapiens
atgcagcccatgcccacctgcc

SEQ ID NO: 231473 - DNA, 15 bp, Homo sapiens
atgcaggaactgaaa

SEQ ID NO: 231474 - DNA, 18 bp, Homo sapiens
atgcagtataaaatgtaa

SEQ ID NO: 231475 - DNA, 16 bp, Homo sapiens
atgcagtgctgctttg

SEQ ID NO: 231476 - DNA, 23 bp, Homo sapiens
atgcagttattagaacttagttt

SEQ ID NO: 231477 - DNA, 19 bp, Homo sapiens
atgcagttcattattttgt

SEQ ID NO: 231478 - DNA, 15 bp, Homo sapiens
atgcagttttcctta

SEQ ID NO: 231479 - DNA, 23 bp, Homo sapiens
atgcatcgttttctttgctgtgc

SEQ ID NO: 231480 - DNA, 22 bp, Homo sapiens
atgcatctcactggatgcaaag

SEQ ID NO: 231481 - DNA, 20 bp, Homo sapiens
atgcatgagaactaaataga

SEQ ID NO: 231482 - DNA, 14 bp, Homo sapiens
atgcatgagctccc

SEQ ID NO: 231483 - DNA, 16 bp, Homo sapiens
atgcatgagctccctc

SEQ ID NO: 231484 - DNA, 14 bp, Homo sapiens
atgcatgataatga

SEQ ID NO: 231485 - DNA, 20 bp, Homo sapiens
atgcatgatattgtatgtac

SEQ ID NO: 231486 - DNA, 22 bp, Homo sapiens
atgcatgatccagctgtgtgtt

SEQ ID NO: 231487 - DNA, 24 bp, Homo sapiens
atgcatgatccagctgtgtgtttt

SEQ ID NO: 231488 - DNA, 19 bp, Homo sapiens
atgcatgcttctttataaa

SEQ ID NO: 231489 - DNA, 15 bp, Homo sapiens
atgcatggcctccca

SEQ ID NO: 231490 - DNA, 17 bp, Homo sapiens
atgcatggcctcccagc

SEQ ID NO: 231491 - DNA, 14 bp, Homo sapiens
atgcatgtagcata

SEQ ID NO: 231492 - DNA, 16 bp, Homo sapiens
atgcatgtagcatata

SEQ ID NO: 231493 - DNA, 16 bp, Homo sapiens
atgcatgtattcacta

SEQ ID NO: 231494 - DNA, 20 bp, Homo sapiens
atgcatgttttatgtgcact

SEQ ID NO: 231495 - DNA, 18 bp, Homo sapiens
atgcattaacttttgtaa

SEQ ID NO: 231496 - DNA, 19 bp, Homo sapiens
atgcattggccctgacaaa

SEQ ID NO: 231497 - DNA, 18 bp, Homo sapiens
atgcattgtcttgtggag

SEQ ID NO: 231498 - DNA, 15 bp, Homo sapiens
atgcatttatgcatg

SEQ ID NO: 231499 - DNA, 13 bp, Homo sapiens
atgcatttgaggt

SEQ ID NO: 231500 - DNA, 17 bp, Homo sapiens
atgcatttgaggtcaag

SEQ ID NO: 231501 - DNA, 13 bp, Homo sapiens
atgcattttgcag

SEQ ID NO: 231502 - DNA, 18 bp, Homo sapiens
atgccaaagctagggtgg

SEQ ID NO: 231503 - DNA, 21 bp, Homo sapiens
atgccaaggaggtcccaggaa

SEQ ID NO: 231504 - DNA, 12 bp, Homo sapiens
atgccacagcca

SEQ ID NO: 231505 - DNA, 14 bp, Homo sapiens
atgccacagccaag

SEQ ID NO: 231506 - DNA, 15 bp, Homo sapiens
atgccacagccaagc

SEQ ID NO: 231507 - DNA, 15 bp, Homo sapiens
atgccaccacccacc

SEQ ID NO: 231508 - DNA, 17 bp, Homo sapiens
atgccaccctcacacac

SEQ ID NO: 231509 - DNA, 22 bp, Homo sapiens
atgccaccctcacacacacagc

SEQ ID NO: 231510 - DNA, 23 bp, Homo sapiens
atgccaccctcacacacacagct

SEQ ID NO: 231511 - DNA, 13 bp, Homo sapiens
atgccacctgcag

SEQ ID NO: 231512 - DNA, 13 bp, Homo sapiens
atgccacgtgcca

SEQ ID NO: 231513 - DNA, 14 bp, Homo sapiens
atgccactgccagg

SEQ ID NO: 231514 - DNA, 15 bp, Homo sapiens
atgccactgccaggc

SEQ ID NO: 231515 - DNA, 18 bp, Homo sapiens
atgccactgccaggcacc

SEQ ID NO: 231516 - DNA, 20 bp, Homo sapiens
atgccagagcaaagggccag

SEQ ID NO: 231517 - DNA, 12 bp, Homo sapiens
atgccagcagca

SEQ ID NO: 231518 - DNA, 13 bp, Homo sapiens
atgccagcccaaa

SEQ ID NO: 231519 - DNA, 16 bp, Homo sapiens
atgccaggacagctgc

SEQ ID NO: 231520 - DNA, 20 bp, Homo sapiens
atgccaggacagctgcaggt

SEQ ID NO: 231521 - DNA, 23 bp, Homo sapiens
atgccagtaacgcgtcttcctga

SEQ ID NO: 231522 - DNA, 16 bp, Homo sapiens
atgccataccttgaga

SEQ ID NO: 231523 - DNA, 17 bp, Homo sapiens
atgccatctgtgggcac

SEQ ID NO: 231524 - DNA, 19 bp, Homo sapiens
atgccatctgtgtcctggt

SEQ ID NO: 231525 - DNA, 14 bp, Homo sapiens
atgccatgatatca

SEQ ID NO: 231526 - DNA, 12 bp, Homo sapiens
atgccatttgtc

SEQ ID NO: 231527 - DNA, 20 bp, Homo sapiens
atgccatttgtcttttgtaa

SEQ ID NO: 231528 - DNA, 12 bp, Homo sapiens
atgccatttgtt

SEQ ID NO: 231529 - DNA, 14 bp, Homo sapiens
atgccatttgttta

SEQ ID NO: 231530 - DNA, 13 bp, Homo sapiens
atgcccacccctg

SEQ ID NO: 231531 - DNA, 20 bp, Homo sapiens
atgcccacctgcccatcaca

SEQ ID NO: 231532 - DNA, 21 bp, Homo sapiens
atgcccatttgcctttaaaaa

SEQ ID NO: 231533 - DNA, 13 bp, Homo sapiens
atgccccctttca

SEQ ID NO: 231534 - DNA, 18 bp, Homo sapiens
atgccccctttcagatgt

SEQ ID NO: 231535 - DNA, 13 bp, Homo sapiens
atgcccctcccca

SEQ ID NO: 231536 - DNA, 19 bp, Homo sapiens
atgccccttggctggatca

SEQ ID NO: 231537 - DNA, 16 bp, Homo sapiens
atgcccgcccggggag

SEQ ID NO: 231538 - DNA, 14 bp, Homo sapiens
atgcccgctgtccc

SEQ ID NO: 231539 - DNA, 18 bp, Homo sapiens
atgcccgctgtcccaggg

SEQ ID NO: 231540 - DNA, 22 bp, Homo sapiens
atgccctataacccctgcctgg

SEQ ID NO: 231541 - DNA, 23 bp, Homo sapiens
atgccctataacccctgcctgga

SEQ ID NO: 231542 - DNA, 19 bp, Homo sapiens
atgccctatcttagtagag

SEQ ID NO: 231543 - DNA, 14 bp, Homo sapiens
atgccctcagggga

SEQ ID NO: 231544 - DNA, 17 bp, Homo sapiens
atgccctcctaaatgtc

SEQ ID NO: 231545 - DNA, 20 bp, Homo sapiens
atgccctgccaagcctggag

SEQ ID NO: 231546 - DNA, 22 bp, Homo sapiens
atgccctgccttgtccctctca

SEQ ID NO: 231547 - DNA, 22 bp, Homo sapiens
atgccctgctagatgagaattc

SEQ ID NO: 231548 - DNA, 23 bp, Homo sapiens
atgccctgctctgaacacgaagc

SEQ ID NO: 231549 - DNA, 18 bp, Homo sapiens
atgccgcgggcggccagg

SEQ ID NO: 231550 - DNA, 18 bp, Homo sapiens
atgccgcggtaggtaagg

SEQ ID NO: 231551 - DNA, 14 bp, Homo sapiens
atgccgctgtgtcc

SEQ ID NO: 231552 - DNA, 16 bp, Homo sapiens
atgccgctgtgtcccc

SEQ ID NO: 231553 - DNA, 15 bp, Homo sapiens
atgtacctttcttca

SEQ ID NO: 231554 - DNA, 16 bp, Homo sapiens
atgtactatatgtata

SEQ ID NO: 231555 - DNA, 16 bp, Homo sapiens
atgtactgagaggagg

SEQ ID NO: 231556 - DNA, 16 bp, Homo sapiens
atgtactgtagttttt

SEQ ID NO: 231557 - DNA, 20 bp, Homo sapiens
atgtagaactcagcagttga

SEQ ID NO: 231558 - DNA, 16 bp, Homo sapiens
atgtagaactgttcat

SEQ ID NO: 231559 - DNA, 15 bp, Homo sapiens
atgtagaagaaagca

SEQ ID NO: 231560 - DNA, 16 bp, Homo sapiens
atgtagaagaaagcaa

SEQ ID NO: 231561 - DNA, 12 bp, Homo sapiens
atgtagaagagg

SEQ ID NO: 231562 - DNA, 18 bp, Homo sapiens
atgtagaagagggagaag

SEQ ID NO: 231563 - DNA, 20 bp, Homo sapiens
atgtagaagagggagaagga

SEQ ID NO: 231564 - DNA, 22 bp, Homo sapiens
atgtagacattatcttttggct

SEQ ID NO: 231565 - DNA, 15 bp, Homo sapiens
atgtagatacagatc

SEQ ID NO: 231566 - DNA, 21 bp, Homo sapiens
atgtagatattgttttctgta

SEQ ID NO: 231567 - DNA, 14 bp, Homo sapiens
atgtagcatataaa

SEQ ID NO: 231568 - DNA, 14 bp, Homo sapiens
atgtagcattgttc

SEQ ID NO: 231569 - DNA, 11 bp, Homo sapiens
atgtagcttcc

SEQ ID NO: 231570 - DNA, 20 bp, Homo sapiens
atgtagggcataatgatgat

SEQ ID NO: 231571 - DNA, 16 bp, Homo sapiens
atgtaggtatgaataa

SEQ ID NO: 231572 - DNA, 17 bp, Homo sapiens
atgtaggtatgaataag

SEQ ID NO: 231573 - DNA, 14 bp, Homo sapiens
atgtagtagtactt

SEQ ID NO: 231574 - DNA, 14 bp, Homo sapiens
atgtagttctttgt

SEQ ID NO: 231575 - DNA, 16 bp, Homo sapiens
atgtagttctttgttc

SEQ ID NO: 231576 - DNA, 21 bp, Homo sapiens
atgtgagtgaaagtacttcag

SEQ ID NO: 231577 - DNA, 21 bp, Homo sapiens
atgtgatacccatagcttcca

SEQ ID NO: 231578 - DNA, 22 bp, Homo sapiens
atgtgatatgtgtaatatcatt

SEQ ID NO: 231579 - DNA, 15 bp, Homo sapiens
atgtgatattttcac

SEQ ID NO: 231580 - DNA, 16 bp, Homo sapiens
atgtgatattttcaca

SEQ ID NO: 231581 - DNA, 17 bp, Homo sapiens
atgtgatattttcacat

SEQ ID NO: 231582 - DNA, 17 bp, Homo sapiens
atgtgatcaactgttca

SEQ ID NO: 231583 - DNA, 17 bp, Homo sapiens
atgtgatcatctttgct

SEQ ID NO: 231584 - DNA, 13 bp, Homo sapiens
atgtgatctatta

SEQ ID NO: 231585 - DNA, 21 bp, Homo sapiens
atgtgatctattactctgaca

SEQ ID NO: 231586 - DNA, 13 bp, Homo sapiens
atgtgatttatgc

SEQ ID NO: 231587 - DNA, 14 bp, Homo sapiens
atgtgcaaatgcaa

SEQ ID NO: 231588 - DNA, 16 bp, Homo sapiens
atgtgcaactcttgta

SEQ ID NO: 231589 - DNA, 20 bp, Homo sapiens
atgtgcaagagtatactttg

SEQ ID NO: 231590 - DNA, 21 bp, Homo sapiens
atgtgcaagagtatactttgt

SEQ ID NO: 231591 - DNA, 16 bp, Homo sapiens
atgtgcaagtgtatgc

SEQ ID NO: 231592 - DNA, 23 bp, Homo sapiens
atgtgcactgaatcgtttcatgt

SEQ ID NO: 231593 - DNA, 22 bp, Homo sapiens
atgtgcactgtcactttgctct

SEQ ID NO: 231594 - DNA, 17 bp, Homo sapiens
atgtgcaggtttgttac

SEQ ID NO: 231595 - DNA, 19 bp, Homo sapiens
atgtgcaggtttgttacat

SEQ ID NO: 231596 - DNA, 23 bp, Homo sapiens
atgtgcagtgtagcccacacttg

SEQ ID NO: 231597 - DNA, 15 bp, Homo sapiens
atgtgcagtgtcttg

SEQ ID NO: 231598 - DNA, 16 bp, Homo sapiens
atgtgcagtgtcttgt

SEQ ID NO: 231599 - DNA, 21 bp, Homo sapiens
atgtgcagtgtcttgtaacaa

SEQ ID NO: 231600 - DNA, 14 bp, Homo sapiens
atgtgccaattttg

SEQ ID NO: 231601 - DNA, 20 bp, Homo sapiens
atgtgccaattttgtcacag

SEQ ID NO: 231602 - DNA, 16 bp, Homo sapiens
atgtgcccagtcatga

SEQ ID NO: 231603 - DNA, 14 bp, Homo sapiens
atgtgcccccagac

SEQ ID NO: 231604 - DNA, 15 bp, Homo sapiens
atgtgcccctggccc

SEQ ID NO: 231605 - DNA, 16 bp, Homo sapiens
atgtgcccctggccca

SEQ ID NO: 231606 - DNA, 17 bp, Homo sapiens
atgtgcctgcaccagga

SEQ ID NO: 231607 - DNA, 19 bp, Homo sapiens
atgtgcctgcaccaggaga

SEQ ID NO: 231608 - DNA, 22 bp, Homo sapiens
atgtgcctgtaatctttttctc

SEQ ID NO: 231609 - DNA, 16 bp, Homo sapiens
atgtgcgtgctgtctg

SEQ ID NO: 231610 - DNA, 18 bp, Homo sapiens
atgtgcgtgtgtgcaagt

SEQ ID NO: 231611 - DNA, 16 bp, Homo sapiens
atgtgctcatcagaaa

SEQ ID NO: 231612 - DNA, 15 bp, Homo sapiens
atgtgctgggtgcct

SEQ ID NO: 231613 - DNA, 18 bp, Homo sapiens
atgtgctgggtgcctccc

SEQ ID NO: 231614 - DNA, 19 bp, Homo sapiens
atgtgctgggtgcctccca

SEQ ID NO: 231615 - DNA, 19 bp, Homo sapiens
atgtgctgttgattctttc

SEQ ID NO: 231616 - DNA, 21 bp, Homo sapiens
atgtgctgttgattctttcaa

SEQ ID NO: 231617 - DNA, 16 bp, Homo sapiens
atgtggaaagtgaatt

SEQ ID NO: 231618 - DNA, 16 bp, Homo sapiens
atgtggaactgtagga

SEQ ID NO: 231619 - DNA, 17 bp, Homo sapiens
atgtggatacagtcatt

SEQ ID NO: 231620 - DNA, 18 bp, Homo sapiens
atgtggatggaggtgatg

SEQ ID NO: 231621 - DNA, 16 bp, Homo sapiens
atgtggcagctgtctc

SEQ ID NO: 231622 - DNA, 18 bp, Homo sapiens
atgtggccccaggtgcca

SEQ ID NO: 231623 - DNA, 10 bp, Homo sapiens
atgtggctga

SEQ ID NO: 231624 - DNA, 21 bp, Homo sapiens
atgtggcttttatttcagtgc

SEQ ID NO: 231625 - DNA, 18 bp, Homo sapiens
atgtgggaagaaacaaac

SEQ ID NO: 231626 - DNA, 17 bp, Homo sapiens
atgtgggaatctcccag

SEQ ID NO: 231627 - DNA, 13 bp, Homo sapiens
atgtgggattatg

SEQ ID NO: 231628 - DNA, 16 bp, Homo sapiens
atgtggggccaggtca

SEQ ID NO: 231629 - DNA, 23 bp, Homo sapiens
atgtgggggaaggccttgctgtc

SEQ ID NO: 231630 - DNA, 15 bp, Homo sapiens
atgtgggtgaccagg

SEQ ID NO: 231631 - DNA, 15 bp, Homo sapiens
atgtgggttgtgata

SEQ ID NO: 231632 - DNA, 23 bp, Homo sapiens
atgtggttaccgagtatctgtaa

SEQ ID NO: 231633 - DNA, 13 bp, Homo sapiens
atgtggtttatag

SEQ ID NO: 231634 - DNA, 19 bp, Homo sapiens
atgtggtttatagagggcc

SEQ ID NO: 231635 - DNA, 13 bp, Homo sapiens
atgtgtaaatgga

SEQ ID NO: 231636 - DNA, 19 bp, Homo sapiens
atgtgtaaatgttatgact

SEQ ID NO: 231637 - DNA, 21 bp, Homo sapiens
atgtgtatgtctggtaaatag

SEQ ID NO: 231638 - DNA, 15 bp, Homo sapiens
atgtgtatgtgttta

SEQ ID NO: 231639 - DNA, 20 bp, Homo sapiens
atgtgtatttccagtgcaat

SEQ ID NO: 231640 - DNA, 18 bp, Homo sapiens
atgtgtcagctgtagaaa

SEQ ID NO: 231641 - DNA, 16 bp, Homo sapiens
atgtgtcccagtgaac

SEQ ID NO: 231642 - DNA, 16 bp, Homo sapiens
atgtgtctgcaacatg

SEQ ID NO: 231643 - DNA, 22 bp, Homo sapiens
atgtgtctgtattcatacagca

SEQ ID NO: 231644 - DNA, 13 bp, Homo sapiens
atgtgtcttcaat

SEQ ID NO: 231645 - DNA, 18 bp, Homo sapiens
atgtgtgaattctgcaac

SEQ ID NO: 231646 - DNA, 21 bp, Homo sapiens
atgtgtgagataacttccttc

SEQ ID NO: 231647 - DNA, 22 bp, Homo sapiens
atgtgtgaggagctgctggctt

SEQ ID NO: 231648 - DNA, 13 bp, Homo sapiens
atgtgtgagtgtg

SEQ ID NO: 231649 - DNA, 11 bp, Homo sapiens
atgtgtgccat

SEQ ID NO: 231650 - DNA, 13 bp, Homo sapiens
atgtgtgcccaga

SEQ ID NO: 231651 - DNA, 16 bp, Homo sapiens
atgtgtggtgctaact

SEQ ID NO: 231652 - DNA, 19 bp, Homo sapiens
atgtgtgtgcaagtgtgtg

SEQ ID NO: 231653 - DNA, 21 bp, Homo sapiens
atgtgtgtgtatgtttgcaca

SEQ ID NO: 231654 - DNA, 16 bp, Homo sapiens
atgtgtgtttaaataa

SEQ ID NO: 231655 - DNA, 19 bp, Homo sapiens
atgtgtgtttaaataaagt

SEQ ID NO: 231656 - DNA, 23 bp, Homo sapiens
atgtgtgttttgctaaaggaaaa

SEQ ID NO: 231657 - DNA, 20 bp, Homo sapiens
atgtgttgacgtaagctcta

SEQ ID NO: 231658 - DNA, 16 bp, Homo sapiens
atgtgttgcaaattat

SEQ ID NO: 231659 - DNA, 20 bp, Homo sapiens
atgtgtttataattgttata

SEQ ID NO: 231660 - DNA, 21 bp, Homo sapiens
atgtgtttcaggtggaacagg

SEQ ID NO: 231661 - DNA, 14 bp, Homo sapiens
atgtgttttgcttt

SEQ ID NO: 231662 - DNA, 17 bp, Homo sapiens
atgttaaacgtcacagc

SEQ ID NO: 231663 - DNA, 18 bp, Homo sapiens
atgttaaacgtcacagca

SEQ ID NO: 231664 - DNA, 14 bp, Homo sapiens
atgttaacaacttg

SEQ ID NO: 231665 - DNA, 22 bp, Homo sapiens
atgttaacaacttgaattacaa

SEQ ID NO: 231666 - DNA, 13 bp, Homo sapiens
atgttaagcagat

SEQ ID NO: 231667 - DNA, 23 bp, Homo sapiens
atgttaagcagctaaattttctg

SEQ ID NO: 231668 - DNA, 13 bp, Homo sapiens
atgttaagctctt

SEQ ID NO: 231669 - DNA, 15 bp, Homo sapiens
atgttaagctcttta

SEQ ID NO: 231670 - DNA, 15 bp, Homo sapiens
atgttaataaaggtt

SEQ ID NO: 231671 - DNA, 23 bp, Homo sapiens
atgttaattaaagtaaaattatt

SEQ ID NO: 231672 - DNA, 19 bp, Homo sapiens
atgttaattgatagaataa

SEQ ID NO: 231673 - DNA, 13 bp, Homo sapiens
atgttacagcatc

SEQ ID NO: 231674 - DNA, 21 bp, Homo sapiens
atgttacctcctataaactta

SEQ ID NO: 231675 - DNA, 17 bp, Homo sapiens
caactgaccagcctcca

SEQ ID NO: 231676 - DNA, 19 bp, Homo sapiens
caactgaccagcctccatg

SEQ ID NO: 231677 - DNA, 15 bp, Homo sapiens
caactgagccaaaaa

SEQ ID NO: 231678 - DNA, 23 bp, Homo sapiens
caactgagccaaaaacaataaac

SEQ ID NO: 231679 - DNA, 22 bp, Homo sapiens
caactgatcatttgcagctgct

SEQ ID NO: 231680 - DNA, 21 bp, Homo sapiens
caactgatgatagacttcgaa

SEQ ID NO: 231681 - DNA, 20 bp, Homo sapiens
caactgcatcaagatgtgac

SEQ ID NO: 231682 - DNA, 23 bp, Homo sapiens
caactgcatcaagatgtgacatg

SEQ ID NO: 231683 - DNA, 17 bp, Homo sapiens
caagcctggagcccctg

SEQ ID NO: 231684 - DNA, 16 bp, Homo sapiens
caagcctgggccactg

SEQ ID NO: 231685 - DNA, 18 bp, Homo sapiens
caagcctgggccactggc

SEQ ID NO: 231686 - DNA, 22 bp, Homo sapiens
caagcctgggccactggcatct

SEQ ID NO: 231687 - DNA, 20 bp, Homo sapiens
caagccttggctcgttctct

SEQ ID NO: 231688 - DNA, 14 bp, Homo sapiens
caagcgttcctggc

SEQ ID NO: 231689 - DNA, 18 bp, Homo sapiens
caagcgttcctggccttc

SEQ ID NO: 231690 - DNA, 19 bp, Homo sapiens
caagctcagagcagcctct

SEQ ID NO: 231691 - DNA, 20 bp, Homo sapiens
caagctcagagcagcctctg

SEQ ID NO: 231692 - DNA, 20 bp, Homo sapiens
caagctccaactcccgggtt

SEQ ID NO: 231693 - DNA, 20 bp, Homo sapiens
caagctccgcctcccgggtt

SEQ ID NO: 231694 - DNA, 14 bp, Homo sapiens
caagctgcagggaa

SEQ ID NO: 231695 - DNA, 12 bp, Homo sapiens
caagctgcctcc

SEQ ID NO: 231696 - DNA, 12 bp, Homo sapiens
caagctggcagg

SEQ ID NO: 231697 - DNA, 14 bp, Homo sapiens
caagctggcaggag

SEQ ID NO: 231698 - DNA, 17 bp, Homo sapiens
caagctgtccagagaaa

SEQ ID NO: 231699 - DNA, 19 bp, Homo sapiens
caagctgtcccctctgtca

SEQ ID NO: 231700 - DNA, 19 bp, Homo sapiens
caagcttaaggagaggaga

SEQ ID NO: 231701 - DNA, 20 bp, Homo sapiens
caagcttaaggagaggagag

SEQ ID NO: 231702 - DNA, 21 bp, Homo sapiens
caagcttaaggagaggagagc

SEQ ID NO: 231703 - DNA, 23 bp, Homo sapiens
caagcttatttagcacattttga

SEQ ID NO: 231704 - DNA, 14 bp, Homo sapiens
caagcttggcagcc

SEQ ID NO: 231705 - DNA, 13 bp, Homo sapiens
caagcttgtgtac

SEQ ID NO: 231706 - DNA, 14 bp, Homo sapiens
caagcttgtttccc

SEQ ID NO: 231707 - DNA, 22 bp, Homo sapiens
caagctttcttctacaaccaga

SEQ ID NO: 231708 - DNA, 15 bp, Homo sapiens
caagcttttcctttc

SEQ ID NO: 231709 - DNA, 22 bp, Homo sapiens
caaggaaaatagtttaggagaa

SEQ ID NO: 231710 - DNA, 14 bp, Homo sapiens
caaggaaatagagg

SEQ ID NO: 231711 - DNA, 14 bp, Homo sapiens
caaggaaggaaaca

SEQ ID NO: 231712 - DNA, 21 bp, Homo sapiens
caaggaaggaaacaatggtca

SEQ ID NO: 231713 - DNA, 18 bp, Homo sapiens
caaggaatgcctgtgcca

SEQ ID NO: 231714 - DNA, 13 bp, Homo sapiens
caaggaccaggac

SEQ ID NO: 231715 - DNA, 15 bp, Homo sapiens
caaggaccaggactc

SEQ ID NO: 231716 - DNA, 16 bp, Homo sapiens
caaggaccaggactcc

SEQ ID NO: 231717 - DNA, 13 bp, Homo sapiens
caaggacccctca

SEQ ID NO: 231718 - DNA, 15 bp, Homo sapiens
caaggacccctcacc

SEQ ID NO: 231719 - DNA, 16 bp, Homo sapiens
caaggagatataaaat

SEQ ID NO: 231720 - DNA, 23 bp, Homo sapiens
caaggagatataaaatctagatc

SEQ ID NO: 231721 - DNA, 21 bp, Homo sapiens
caaggagctgatttccaggcc

SEQ ID NO: 231722 - DNA, 15 bp, Homo sapiens
caaggagggcacagg

SEQ ID NO: 231723 - DNA, 14 bp, Homo sapiens
caaggatcctctcc

SEQ ID NO: 231724 - DNA, 17 bp, Homo sapiens
caaggatcctctccact

SEQ ID NO: 231725 - DNA, 14 bp, Homo sapiens
caaggcaaatgtcc

SEQ ID NO: 231726 - DNA, 16 bp, Homo sapiens
caaggcaaatgtccaa

SEQ ID NO: 231727 - DNA, 17 bp, Homo sapiens
caaggcaaatgtccaag

SEQ ID NO: 231728 - DNA, 14 bp, Homo sapiens
caaggcaaggctgt

SEQ ID NO: 231729 - DNA, 18 bp, Homo sapiens
caaggcaaggctgtcaat

SEQ ID NO: 231730 - DNA, 13 bp, Homo sapiens
caaggcaaggggt

SEQ ID NO: 231731 - DNA, 21 bp, Homo sapiens
caaggcaaggggtgcctggga

SEQ ID NO: 231732 - DNA, 18 bp, Homo sapiens
caaggcacaggctcctgt

SEQ ID NO: 231733 - DNA, 15 bp, Homo sapiens
caaggcactgtacta

SEQ ID NO: 231734 - DNA, 18 bp, Homo sapiens
caaggcagcctccagagc

SEQ ID NO: 231735 - DNA, 19 bp, Homo sapiens
caaggcagcctccagagcc

SEQ ID NO: 231736 - DNA, 20 bp, Homo sapiens
caaggcagcctccagagcca

SEQ ID NO: 231737 - DNA, 22 bp, Homo sapiens
caaggcagcctccagagccagc

SEQ ID NO: 231738 - DNA, 15 bp, Homo sapiens
caaggcagctcccag

SEQ ID NO: 231739 - DNA, 17 bp, Homo sapiens
caaggcaggcctttcct

SEQ ID NO: 231740 - DNA, 14 bp, Homo sapiens
caaggccagagtgg

SEQ ID NO: 231741 - DNA, 17 bp, Homo sapiens
caaggccagagtggcct

SEQ ID NO: 231742 - DNA, 18 bp, Homo sapiens
caaggccagagtggcctg

SEQ ID NO: 231743 - DNA, 19 bp, Homo sapiens
caaggccagagtggcctgg

SEQ ID NO: 231744 - DNA, 21 bp, Homo sapiens
caaggccagtctgaacctgag

SEQ ID NO: 231745 - DNA, 15 bp, Homo sapiens
caaggccatctgctt

SEQ ID NO: 231746 - DNA, 12 bp, Homo sapiens
caaggccccaga

SEQ ID NO: 231747 - DNA, 17 bp, Homo sapiens
caaggccgcccacctgc

SEQ ID NO: 231748 - DNA, 18 bp, Homo sapiens
caaggccgcccacctgca

SEQ ID NO: 231749 - DNA, 24 bp, Homo sapiens
caaggccgcccacctgcatcagcc

SEQ ID NO: 231750 - DNA, 22 bp, Homo sapiens
caaggcctatgccacctgcagc

SEQ ID NO: 231751 - DNA, 16 bp, Homo sapiens
caaggcctcggcagaa

SEQ ID NO: 231752 - DNA, 17 bp, Homo sapiens
caaggcctgtgctgcat

SEQ ID NO: 231753 - DNA, 22 bp, Homo sapiens
caaggcgtccgcgcgccagcac

SEQ ID NO: 231754 - DNA, 16 bp, Homo sapiens
caaggctctcccctct

SEQ ID NO: 231755 - DNA, 16 bp, Homo sapiens
caaggctgccggctgc

SEQ ID NO: 231756 - DNA, 16 bp, Homo sapiens
caaggctgcctggaga

SEQ ID NO: 231757 - DNA, 14 bp, Homo sapiens
caaggctggccagc

SEQ ID NO: 231758 - DNA, 13 bp, Homo sapiens
caaggctgtcaat

SEQ ID NO: 231759 - DNA, 14 bp, Homo sapiens
caaggctgtcaatt

SEQ ID NO: 231760 - DNA, 21 bp, Homo sapiens
caaggctgtcaattacaggaa

SEQ ID NO: 231761 - DNA, 10 bp, Homo sapiens
caagggaggc

SEQ ID NO: 231762 - DNA, 17 bp, Homo sapiens
caagggattctgggaag

SEQ ID NO: 231763 - DNA, 16 bp, Homo sapiens
caagggcatcaggcac

SEQ ID NO: 231764 - DNA, 19 bp, Homo sapiens
caagggcatcaggcactgg

SEQ ID NO: 231765 - DNA, 20 bp, Homo sapiens
caagggcatcaggcactggt

SEQ ID NO: 231766 - DNA, 13 bp, Homo sapiens
caagggctccagc

SEQ ID NO: 231767 - DNA, 19 bp, Homo sapiens
caagggctgcttcaaactc

SEQ ID NO: 231768 - DNA, 21 bp, Homo sapiens
caagggcttacacgtggagga

SEQ ID NO: 231769 - DNA, 14 bp, Homo sapiens
caaggggccagctg

SEQ ID NO: 231770 - DNA, 16 bp, Homo sapiens
caaggggccagctgcc

SEQ ID NO: 231771 - DNA, 15 bp, Homo sapiens
caaggggctcagaac

SEQ ID NO: 231772 - DNA, 21 bp, Homo sapiens
caagggggtgtcatctgagga

SEQ ID NO: 231773 - DNA, 22 bp, Homo sapiens
caagggggtgtcatctgaggag

SEQ ID NO: 231774 - DNA, 15 bp, Homo sapiens
caaggggtgcctggg

SEQ ID NO: 231775 - DNA, 23 bp, Homo sapiens
caaggtagccctggccagaggct

SEQ ID NO: 231776 - DNA, 19 bp, Homo sapiens
caaggtccactccctgctc

SEQ ID NO: 231777 - DNA, 22 bp, Homo sapiens
caaggtccactccctgctccac

SEQ ID NO: 231778 - DNA, 16 bp, Homo sapiens
caaggtcccctccaca

SEQ ID NO: 231779 - DNA, 14 bp, Homo sapiens
caaggtcctgctca

SEQ ID NO: 231780 - DNA, 15 bp, Homo sapiens
caaggtcctgctcaa

SEQ ID NO: 231781 - DNA, 14 bp, Homo sapiens
caaggtgagagagg

SEQ ID NO: 231782 - DNA, 16 bp, Homo sapiens
caaggtgagagaggta

SEQ ID NO: 231783 - DNA, 16 bp, Homo sapiens
caaggtgctaaaagga

SEQ ID NO: 231784 - DNA, 19 bp, Homo sapiens
caaggtgctaaaaggaata

SEQ ID NO: 231785 - DNA, 17 bp, Homo sapiens
caaggtgctgttgtcat

SEQ ID NO: 231786 - DNA, 12 bp, Homo sapiens
caaggtgggcgg

SEQ ID NO: 231787 - DNA, 20 bp, Homo sapiens
caaggtgggggagcctggag

SEQ ID NO: 231788 - DNA, 21 bp, Homo sapiens
caaggtgggggagcctggagc

SEQ ID NO: 231789 - DNA, 21 bp, Homo sapiens
caaggtgggtggatcacctgt

SEQ ID NO: 231790 - DNA, 18 bp, Homo sapiens
caaggtgggttccaggga

SEQ ID NO: 231791 - DNA, 15 bp, Homo sapiens
caaggtggtcttgga

SEQ ID NO: 231792 - DNA, 21 bp, Homo sapiens
caaggtggtcttggagaggag

SEQ ID NO: 231793 - DNA, 12 bp, Homo sapiens
caaggttgctgt

SEQ ID NO: 231794 - DNA, 13 bp, Homo sapiens
caaggttgctgtt

SEQ ID NO: 231795 - DNA, 15 bp, Homo sapiens
caaggttgctgttgt

SEQ ID NO: 231796 - DNA, 16 bp, Homo sapiens
caaggttggcacccca

SEQ ID NO: 231797 - DNA, 19 bp, Homo sapiens
caaggttggcaccccagct

SEQ ID NO: 231798 - DNA, 17 bp, Homo sapiens
caaggttttggagtcag

SEQ ID NO: 231799 - DNA, 13 bp, Homo sapiens
caagtaagaagac

SEQ ID NO: 231800 - DNA, 14 bp, Homo sapiens
caagtacagccttc

SEQ ID NO: 231801 - DNA, 18 bp, Homo sapiens
caagtaccaatgctgttg

SEQ ID NO: 231802 - DNA, 18 bp, Homo sapiens
caagtagatgcctgaact

SEQ ID NO: 231803 - DNA, 14 bp, Homo sapiens
caagtaggagacac

SEQ ID NO: 231804 - DNA, 13 bp, Homo sapiens
caagtatataaag

SEQ ID NO: 231805 - DNA, 15 bp, Homo sapiens
caagtatataaagtt

SEQ ID NO: 231806 - DNA, 16 bp, Homo sapiens
caagtatgaataaaga

SEQ ID NO: 231807 - DNA, 21 bp, Homo sapiens
caagtatgaataaagacacct

SEQ ID NO: 231808 - DNA, 17 bp, Homo sapiens
caagtatgttttagcat

SEQ ID NO: 231809 - DNA, 19 bp, Homo sapiens
caatattatactaagaaaa

SEQ ID NO: 231810 - DNA, 21 bp, Homo sapiens
caatattatactaagaaaaga

SEQ ID NO: 231811 - DNA, 21 bp, Homo sapiens
caatattcctgaatgaaatat

SEQ ID NO: 231812 - DNA, 12 bp, Homo sapiens
caatatttatta

SEQ ID NO: 231813 - DNA, 17 bp, Homo sapiens
caatatttatttccaga

SEQ ID NO: 231814 - DNA, 13 bp, Homo sapiens
caatcaaacaggg

SEQ ID NO: 231815 - DNA, 23 bp, Homo sapiens
caatcaacctgcacttcatatct

SEQ ID NO: 231816 - DNA, 19 bp, Homo sapiens
caatcacgagatcttcctt

SEQ ID NO: 231817 - DNA, 20 bp, Homo sapiens
caatcacgagatcttccttc

SEQ ID NO: 231818 - DNA, 18 bp, Homo sapiens
caatcactattcttaagc

SEQ ID NO: 231819 - DNA, 19 bp, Homo sapiens
caatcactattcttaagca

SEQ ID NO: 231820 - DNA, 19 bp, Homo sapiens
caatcagcttttgttctag

SEQ ID NO: 231821 - DNA, 20 bp, Homo sapiens
caatcagcttttgttctaga

SEQ ID NO: 231822 - DNA, 21 bp, Homo sapiens
caatcagcttttgttctagac

SEQ ID NO: 231823 - DNA, 17 bp, Homo sapiens
caatcattttaattatt

SEQ ID NO: 231824 - DNA, 22 bp, Homo sapiens
caatcattttgggaaattcttg

SEQ ID NO: 231825 - DNA, 15 bp, Homo sapiens
caatccaacccatgc

SEQ ID NO: 231826 - DNA, 18 bp, Homo sapiens
caatccaacccatgcatg

SEQ ID NO: 231827 - DNA, 16 bp, Homo sapiens
caatccacagtattgt

SEQ ID NO: 231828 - DNA, 17 bp, Homo sapiens
caatcccaattctgtcc

SEQ ID NO: 231829 - DNA, 18 bp, Homo sapiens
caatcccgtgaaagaatt

SEQ ID NO: 231830 - DNA, 17 bp, Homo sapiens
caatcctaacacattat

SEQ ID NO: 231831 - DNA, 21 bp, Homo sapiens
caatcctatgtcatttctact

SEQ ID NO: 231832 - DNA, 16 bp, Homo sapiens
caatcctcactgggtg

SEQ ID NO: 231833 - DNA, 12 bp, Homo sapiens
caatcctggctc

SEQ ID NO: 231834 - DNA, 18 bp, Homo sapiens
caatcctgtgggtgaaga

SEQ ID NO: 231835 - DNA, 20 bp, Homo sapiens
caatctacgatgttaaaaca

SEQ ID NO: 231836 - DNA, 23 bp, Homo sapiens
caatctaggcgaggcgaagctga

SEQ ID NO: 231837 - DNA, 15 bp, Homo sapiens
caatctcacacagct

SEQ ID NO: 231838 - DNA, 16 bp, Homo sapiens
caatctcacacagctg

SEQ ID NO: 231839 - DNA, 17 bp, Homo sapiens
caatctcccgctgctgc

SEQ ID NO: 231840 - DNA, 14 bp, Homo sapiens
caatctctgtgact

SEQ ID NO: 231841 - DNA, 15 bp, Homo sapiens
caatctctgtgactc

SEQ ID NO: 231842 - DNA, 13 bp, Homo sapiens
caatctggcttct

SEQ ID NO: 231843 - DNA, 20 bp, Homo sapiens
caatcttaccagatgctact

SEQ ID NO: 231844 - DNA, 21 bp, Homo sapiens
caatcttaccagatgctactg

SEQ ID NO: 231845 - DNA, 11 bp, Homo sapiens
caatcttgctg

SEQ ID NO: 231846 - DNA, 12 bp, Homo sapiens
caatctttctat

SEQ ID NO: 231847 - DNA, 19 bp, Homo sapiens
caatgaaaagaaaatgtgc

SEQ ID NO: 231848 - DNA, 16 bp, Homo sapiens
caatgaaaccttcctc

SEQ ID NO: 231849 - DNA, 17 bp, Homo sapiens
caatgaaatatttgctt

SEQ ID NO: 231850 - DNA, 20 bp, Homo sapiens
caatgaagcaaacacacaga

SEQ ID NO: 231851 - DNA, 19 bp, Homo sapiens
caatgaattgaatgctcta

SEQ ID NO: 231852 - DNA, 14 bp, Homo sapiens
caatgacacagtct

SEQ ID NO: 231853 - DNA, 19 bp, Homo sapiens
caatgacacagtcttggct

SEQ ID NO: 231854 - DNA, 13 bp, Homo sapiens
caatgactgtgag

SEQ ID NO: 231855 - DNA, 19 bp, Homo sapiens
caatgagatagaagatgtt

SEQ ID NO: 231856 - DNA, 22 bp, Homo sapiens
caatgagatagaagatgtttgc

SEQ ID NO: 231857 - DNA, 18 bp, Homo sapiens
caatgaggtctgaaatgg

SEQ ID NO: 231858 - DNA, 19 bp, Homo sapiens
caatgaggtctgaaatgga

SEQ ID NO: 231859 - DNA, 20 bp, Homo sapiens
caatgaggttatgagaaaaa

SEQ ID NO: 231860 - DNA, 23 bp, Homo sapiens
caatgatctaggtttaactcaga

SEQ ID NO: 231861 - DNA, 20 bp, Homo sapiens
caatgatgattaaacacctg

SEQ ID NO: 231862 - DNA, 20 bp, Homo sapiens
caatgcatgcagccactgtg

SEQ ID NO: 231863 - DNA, 20 bp, Homo sapiens
caatgcattgtcttgtggag

SEQ ID NO: 231864 - DNA, 18 bp, Homo sapiens
caatgccacagccaagcc

SEQ ID NO: 231865 - DNA, 14 bp, Homo sapiens
caatgccctgccat

SEQ ID NO: 231866 - DNA, 16 bp, Homo sapiens
caatgccctgccatta

SEQ ID NO: 231867 - DNA, 14 bp, Homo sapiens
caatgcctgcctga

SEQ ID NO: 231868 - DNA, 15 bp, Homo sapiens
caatgcctgcctgaa

SEQ ID NO: 231869 - DNA, 22 bp, Homo sapiens
caatgcgtggcacatctaaatt

SEQ ID NO: 231870 - DNA, 17 bp, Homo sapiens
caatgctgttgtaaaca

SEQ ID NO: 231871 - DNA, 18 bp, Homo sapiens
caatgctgttgtaaacaa

SEQ ID NO: 231872 - DNA, 19 bp, Homo sapiens
caatgctttgggaggccaa

SEQ ID NO: 231873 - DNA, 20 bp, Homo sapiens
caatgctttgggaggccaag

SEQ ID NO: 231874 - DNA, 22 bp, Homo sapiens
caatgctttgggaggccaaggc

SEQ ID NO: 231875 - DNA, 21 bp, Homo sapiens
caatgcttttatatggcccag

SEQ ID NO: 231876 - DNA, 22 bp, Homo sapiens
caatgcttttctagcaactgtt

SEQ ID NO: 231877 - DNA, 22 bp, Homo sapiens
caatggagtagacccctggctg

SEQ ID NO: 231878 - DNA, 14 bp, Homo sapiens
caatggcagctaga

SEQ ID NO: 231879 - DNA, 23 bp, Homo sapiens
caatggcagctagactggagtga

SEQ ID NO: 231880 - DNA, 16 bp, Homo sapiens
caatggcgcagtgcct

SEQ ID NO: 231881 - DNA, 20 bp, Homo sapiens
caatggcgcagtgcctctgg

SEQ ID NO: 231882 - DNA, 21 bp, Homo sapiens
caatggctgggtttgggcagt

SEQ ID NO: 231883 - DNA, 14 bp, Homo sapiens
caatgggactggag

SEQ ID NO: 231884 - DNA, 17 bp, Homo sapiens
caatgggactggagtca

SEQ ID NO: 231885 - DNA, 18 bp, Homo sapiens
caatgggactggagtcag

SEQ ID NO: 231886 - DNA, 18 bp, Homo sapiens
caatgggagtgaacattt

SEQ ID NO: 231887 - DNA, 19 bp, Homo sapiens
caatggggaattttttgat

SEQ ID NO: 231888 - DNA, 20 bp, Homo sapiens
caatggggaattttttgatc

SEQ ID NO: 231889 - DNA, 17 bp, Homo sapiens
caatggggggtcttgct

SEQ ID NO: 231890 - DNA, 16 bp, Homo sapiens
caatggtgagggctga

SEQ ID NO: 231891 - DNA, 19 bp, Homo sapiens
caatggtgtagctgtcctc

SEQ ID NO: 231892 - DNA, 21 bp, Homo sapiens
caatggttgggacaatggcaa

SEQ ID NO: 231893 - DNA, 18 bp, Homo sapiens
caatggttttcttgtgtg

SEQ ID NO: 231894 - DNA, 21 bp, Homo sapiens
caatgtacaaggtatgtacag

SEQ ID NO: 231895 - DNA, 19 bp, Homo sapiens
caatgtcttaaataaaact

SEQ ID NO: 231896 - DNA, 21 bp, Homo sapiens
caatgtcttaaataaaactat

SEQ ID NO: 231897 - DNA, 23 bp, Homo sapiens
caatgtcttaaataaaactattt

SEQ ID NO: 231898 - DNA, 21 bp, Homo sapiens
caatgtgaagacactacagag

SEQ ID NO: 231899 - DNA, 17 bp, Homo sapiens
caatgtgcccagtcatg

SEQ ID NO: 231900 - DNA, 14 bp, Homo sapiens
caatgtggaaattg

SEQ ID NO: 231901 - DNA, 20 bp, Homo sapiens
caatgtggaattacataaca

SEQ ID NO: 231902 - DNA, 15 bp, Homo sapiens
caatgttcattgtaa

SEQ ID NO: 231903 - DNA, 19 bp, Homo sapiens
caatgttccgttcatctga

SEQ ID NO: 231904 - DNA, 22 bp, Homo sapiens
caatgttccgttcatctgagga

SEQ ID NO: 231905 - DNA, 19 bp, Homo sapiens
caatgttgcactgaaaacc

SEQ ID NO: 231906 - DNA, 17 bp, Homo sapiens
caatgtttcttctaggt

SEQ ID NO: 231907 - DNA, 14 bp, Homo sapiens
caatgtttgcttta

SEQ ID NO: 231908 - DNA, 22 bp, Homo sapiens
caatgttttcctttgtcatcat

SEQ ID NO: 231909 - DNA, 15 bp, Homo sapiens
caatgtttttgtgta

SEQ ID NO: 231910 - DNA, 20 bp, Homo sapiens
caatgtttttgtgtagagtg

SEQ ID NO: 231911 - DNA, 14 bp, Homo sapiens
caattaaaattaag

SEQ ID NO: 231912 - DNA, 13 bp, Homo sapiens
caattaaaggtcc

SEQ ID NO: 231913 - DNA, 20 bp, Homo sapiens
caattaaaggtcctgccctc

SEQ ID NO: 231914 - DNA, 13 bp, Homo sapiens
caattaaatgtag

SEQ ID NO: 231915 - DNA, 21 bp, Homo sapiens
caattaagttattaacatttg

SEQ ID NO: 231916 - DNA, 15 bp, Homo sapiens
caattaataaaaaat

SEQ ID NO: 231917 - DNA, 16 bp, Homo sapiens
caattacaggaagtac

SEQ ID NO: 231918 - DNA, 15 bp, Homo sapiens
caattaggaagtgta

SEQ ID NO: 231919 - DNA, 16 bp, Homo sapiens
caattaggaagtgtaa

SEQ ID NO: 231920 - DNA, 23 bp, Homo sapiens
caattaggaagtgtaacagctga

SEQ ID NO: 231921 - DNA, 17 bp, Homo sapiens
caattaggtctgcattt

SEQ ID NO: 231922 - DNA, 20 bp, Homo sapiens
caattattacatttatacat

SEQ ID NO: 231923 - DNA, 17 bp, Homo sapiens
caattatttaaagaaag

SEQ ID NO: 231924 - DNA, 18 bp, Homo sapiens
caattatttaaagaaagt

SEQ ID NO: 231925 - DNA, 20 bp, Homo sapiens
caattatttaaagaaagtga

SEQ ID NO: 231926 - DNA, 14 bp, Homo sapiens
caattcagttttag

SEQ ID NO: 231927 - DNA, 22 bp, Homo sapiens
caattcagttttagtttcaaaa

SEQ ID NO: 231928 - DNA, 20 bp, Homo sapiens
caattccaaaattccatccc

SEQ ID NO: 231929 - DNA, 18 bp, Homo sapiens
caattccagagctgtctg

SEQ ID NO: 231930 - DNA, 21 bp, Homo sapiens
caattcctcatttgttcatta

SEQ ID NO: 231931 - DNA, 14 bp, Homo sapiens
caattcctctggga

SEQ ID NO: 231932 - DNA, 15 bp, Homo sapiens
caattcctctgggaa

SEQ ID NO: 231933 - DNA, 17 bp, Homo sapiens
caattctgtccctgtcc

SEQ ID NO: 231934 - DNA, 21 bp, Homo sapiens
caattctgtccctgtccctgc

SEQ ID NO: 231935 - DNA, 23 bp, Homo sapiens
caattctgtccctgtccctgccc

SEQ ID NO: 231936 - DNA, 21 bp, Homo sapiens
caattgaattaaattaggaat

SEQ ID NO: 231937 - DNA, 18 bp, Homo sapiens
caattgcagatgccaaaa

SEQ ID NO: 231938 - DNA, 14 bp, Homo sapiens
caattgccctgcca

SEQ ID NO: 231939 - DNA, 19 bp, Homo sapiens
caattgccctgccaggctg

SEQ ID NO: 231940 - DNA, 14 bp, Homo sapiens
caattgctgcatct

SEQ ID NO: 231941 - DNA, 15 bp, Homo sapiens
cacacaacaccagga

SEQ ID NO: 231942 - DNA, 12 bp, Homo sapiens
cacacaagcagt

SEQ ID NO: 231943 - DNA, 18 bp, Homo sapiens
cacacacaaatattgctt

SEQ ID NO: 231944 - DNA, 15 bp, Homo sapiens
cacacacaacaaaaa

SEQ ID NO: 231945 - DNA, 9 bp, Homo sapiens
cacacacac

SEQ ID NO: 231946 - DNA, 10 bp, Homo sapiens
cacacacaca

SEQ ID NO: 231947 - DNA, 12 bp, Homo sapiens
cacacacacaaa

SEQ ID NO: 231948 - DNA, 16 bp, Homo sapiens
cacacacacacacaaa

SEQ ID NO: 231949 - DNA, 14 bp, Homo sapiens
cacacacacacagg

SEQ ID NO: 231950 - DNA, 16 bp, Homo sapiens
cacacacacacgcaga

SEQ ID NO: 231951 - DNA, 14 bp, Homo sapiens
cacacacacaggag

SEQ ID NO: 231952 - DNA, 13 bp, Homo sapiens
cacacacacgcac

SEQ ID NO: 231953 - DNA, 14 bp, Homo sapiens
cacacacagcctgg

SEQ ID NO: 231954 - DNA, 17 bp, Homo sapiens
cacacacagcctggcct

SEQ ID NO: 231955 - DNA, 18 bp, Homo sapiens
cacacaccctacaagttg

SEQ ID NO: 231956 - DNA, 15 bp, Homo sapiens
cacacacccttcccc

SEQ ID NO: 231957 - DNA, 17 bp, Homo sapiens
cacacacgcacgcacac

SEQ ID NO: 231958 - DNA, 15 bp, Homo sapiens
cacacacgcagacac

SEQ ID NO: 231959 - DNA, 14 bp, Homo sapiens
cacacagcctggcc

SEQ ID NO: 231960 - DNA, 13 bp, Homo sapiens
cacacagctcctc

SEQ ID NO: 231961 - DNA, 13 bp, Homo sapiens
cacacagctgggc

SEQ ID NO: 231962 - DNA, 15 bp, Homo sapiens
cacacagctgggcaa

SEQ ID NO: 231963 - DNA, 20 bp, Homo sapiens
cacacaggagtcctttcttt

SEQ ID NO: 231964 - DNA, 18 bp, Homo sapiens
cacacaggcctggcccag

SEQ ID NO: 231965 - DNA, 23 bp, Homo sapiens
cacacatataaacatcacacaca

SEQ ID NO: 231966 - DNA, 19 bp, Homo sapiens
cacacattcttaaggcaat

SEQ ID NO: 231967 - DNA, 15 bp, Homo sapiens
cacaccaaattgctg

SEQ ID NO: 231968 - DNA, 23 bp, Homo sapiens
cacaccactaaccatccccaact

SEQ ID NO: 231969 - DNA, 17 bp, Homo sapiens
cacaccactgccctgcc

SEQ ID NO: 231970 - DNA, 19 bp, Homo sapiens
cacaccactgccctgcctg

SEQ ID NO: 231971 - DNA, 22 bp, Homo sapiens
cacaccaggccgtcctcccggg

SEQ ID NO: 231972 - DNA, 14 bp, Homo sapiens
cacaccaggctgtg

SEQ ID NO: 231973 - DNA, 17 bp, Homo sapiens
cacacccatgactgccc

SEQ ID NO: 231974 - DNA, 14 bp, Homo sapiens
cacaccccacaccc

SEQ ID NO: 231975 - DNA, 19 bp, Homo sapiens
cacaccccacaccccagcc

SEQ ID NO: 231976 - DNA, 14 bp, Homo sapiens
cacaccccagccca

SEQ ID NO: 231977 - DNA, 20 bp, Homo sapiens
cacaccccagcccaccctgc

SEQ ID NO: 231978 - DNA, 19 bp, Homo sapiens
cacaccccatctctcttcc

SEQ ID NO: 231979 - DNA, 15 bp, Homo sapiens
cacacccctcagcgc

SEQ ID NO: 231980 - DNA, 13 bp, Homo sapiens
cacaccctccagc

SEQ ID NO: 231981 - DNA, 16 bp, Homo sapiens
cacaccctgcaaggcc

SEQ ID NO: 231982 - DNA, 14 bp, Homo sapiens
cacaccctgtttta

SEQ ID NO: 231983 - DNA, 15 bp, Homo sapiens
cacacccttccccac

SEQ ID NO: 231984 - DNA, 18 bp, Homo sapiens
cacacccttccccactcc

SEQ ID NO: 231985 - DNA, 17 bp, Homo sapiens
cacacctcacgctctgg

SEQ ID NO: 231986 - DNA, 13 bp, Homo sapiens
cacacctcagttc

SEQ ID NO: 231987 - DNA, 20 bp, Homo sapiens
cacacctcagttcccttggc

SEQ ID NO: 231988 - DNA, 21 bp, Homo sapiens
cacacctcagttcccttggcc

SEQ ID NO: 231989 - DNA, 13 bp, Homo sapiens
cacacctccaccc

SEQ ID NO: 231990 - DNA, 14 bp, Homo sapiens
cacacctccacccg

SEQ ID NO: 231991 - DNA, 12 bp, Homo sapiens
cacacctctggg

SEQ ID NO: 231992 - DNA, 16 bp, Homo sapiens
cacacctctgggcttc

SEQ ID NO: 231993 - DNA, 21 bp, Homo sapiens
cacacctggtctgttttctgt

SEQ ID NO: 231994 - DNA, 13 bp, Homo sapiens
cacacgcacgcac

SEQ ID NO: 231995 - DNA, 15 bp, Homo sapiens
cacacgcacgcacac

SEQ ID NO: 231996 - DNA, 17 bp, Homo sapiens
cacacgcacgcacacac

SEQ ID NO: 231997 - DNA, 15 bp, Homo sapiens
cacacgccggggctg

SEQ ID NO: 231998 - DNA, 21 bp, Homo sapiens
cacagggcctgacttttacag

SEQ ID NO: 231999 - DNA, 23 bp, Homo sapiens
cacagggcttggtggtggtagca

SEQ ID NO: 232000 - DNA, 18 bp, Homo sapiens
cacaggggaaggaaataa

SEQ ID NO: 232001 - DNA, 23 bp, Homo sapiens
cacaggggcaaagaactgcccca

SEQ ID NO: 232002 - DNA, 20 bp, Homo sapiens
cacaggggcaggcctgggac

SEQ ID NO: 232003 - DNA, 14 bp, Homo sapiens
cacaggggcggggc

SEQ ID NO: 232004 - DNA, 15 bp, Homo sapiens
cacagggtctgctct

SEQ ID NO: 232005 - DNA, 17 bp, Homo sapiens
cacagggtctgctcttt

SEQ ID NO: 232006 - DNA, 15 bp, Homo sapiens
cacagggtgttggaa

SEQ ID NO: 232007 - DNA, 16 bp, Homo sapiens
cacagggttgggccca

SEQ ID NO: 232008 - DNA, 20 bp, Homo sapiens
cacaggtgtccccagcccac

SEQ ID NO: 232009 - DNA, 15 bp, Homo sapiens
cacagtagagtaggg

SEQ ID NO: 232010 - DNA, 19 bp, Homo sapiens
cacagtattgttcttgtaa

SEQ ID NO: 232011 - DNA, 16 bp, Homo sapiens
cacagtcatgtgtcag

SEQ ID NO: 232012 - DNA, 14 bp, Homo sapiens
cacagtccctcctg

SEQ ID NO: 232013 - DNA, 22 bp, Homo sapiens
cacagtctctttaatcttcagt

SEQ ID NO: 232014 - DNA, 17 bp, Homo sapiens
cacagtgcatctcagcc

SEQ ID NO: 232015 - DNA, 12 bp, Homo sapiens
cacagtgctgct

SEQ ID NO: 232016 - DNA, 22 bp, Homo sapiens
cacagtggggcccatggcccca

SEQ ID NO: 232017 - DNA, 17 bp, Homo sapiens
cacagtgggtggcacct

SEQ ID NO: 232018 - DNA, 22 bp, Homo sapiens
cacagtgggtggcacctcctga

SEQ ID NO: 232019 - DNA, 23 bp, Homo sapiens
cacagtgggtggcacctcctgag

SEQ ID NO: 232020 - DNA, 17 bp, Homo sapiens
cacagttggctggatga

SEQ ID NO: 232021 - DNA, 20 bp, Homo sapiens
cacagttgtctattctgagc

SEQ ID NO: 232022 - DNA, 21 bp, Homo sapiens
cacagttgtctattctgagcc

SEQ ID NO: 232023 - DNA, 18 bp, Homo sapiens
cacagtttaaacacatca

SEQ ID NO: 232024 - DNA, 20 bp, Homo sapiens
cacagtttagtgctttacat

SEQ ID NO: 232025 - DNA, 19 bp, Homo sapiens
cacagtttgctatttgctt

SEQ ID NO: 232026 - DNA, 21 bp, Homo sapiens
cacagtttgctatttgcttta

SEQ ID NO: 232027 - DNA, 13 bp, Homo sapiens
cacagttttgtct

SEQ ID NO: 232028 - DNA, 14 bp, Homo sapiens
cacataaaagtaat

SEQ ID NO: 232029 - DNA, 18 bp, Homo sapiens
cacataaaagtaattaat

SEQ ID NO: 232030 - DNA, 20 bp, Homo sapiens
cacataaaagtaattaattg

SEQ ID NO: 232031 - DNA, 13 bp, Homo sapiens
cacataaatctgt

SEQ ID NO: 232032 - DNA, 19 bp, Homo sapiens
cacataaatctgtctgatt

SEQ ID NO: 232033 - DNA, 18 bp, Homo sapiens
cacataatacattccatc

SEQ ID NO: 232034 - DNA, 23 bp, Homo sapiens
cacataatacattccatcacagc

SEQ ID NO: 232035 - DNA, 15 bp, Homo sapiens
cacatacaaaagaat

SEQ ID NO: 232036 - DNA, 22 bp, Homo sapiens
cacatacgtgagggggagctga

SEQ ID NO: 232037 - DNA, 18 bp, Homo sapiens
cacatagcatgtaatggt

SEQ ID NO: 232038 - DNA, 21 bp, Homo sapiens
cacatagctagttatgtgaga

SEQ ID NO: 232039 - DNA, 22 bp, Homo sapiens
cacatagctgggatttgaactg

SEQ ID NO: 232040 - DNA, 13 bp, Homo sapiens
caccagaattagt

SEQ ID NO: 232041 - DNA, 15 bp, Homo sapiens
caccagatgagaagt

SEQ ID NO: 232042 - DNA, 16 bp, Homo sapiens
caccagcagcacaatt

SEQ ID NO: 232043 - DNA, 14 bp, Homo sapiens
caccagcagcagaa

SEQ ID NO: 232044 - DNA, 15 bp, Homo sapiens
caccagccccagcaa

SEQ ID NO: 232045 - DNA, 16 bp, Homo sapiens
caccagccccagcaag

SEQ ID NO: 232046 - DNA, 14 bp, Homo sapiens
caccagcccttccc

SEQ ID NO: 232047 - DNA, 16 bp, Homo sapiens
caccagccgccccagc

SEQ ID NO: 232048 - DNA, 20 bp, Homo sapiens
caccagccgccccagcccct

SEQ ID NO: 232049 - DNA, 14 bp, Homo sapiens
caccagcctgagcc

SEQ ID NO: 232050 - DNA, 21 bp, Homo sapiens
caccagcgtttgaggggctgg

SEQ ID NO: 232051 - DNA, 20 bp, Homo sapiens
caccagctcagccccggcca

SEQ ID NO: 232052 - DNA, 13 bp, Homo sapiens
caccagctcccaa

SEQ ID NO: 232053 - DNA, 11 bp, Homo sapiens
caccagctcgt

SEQ ID NO: 232054 - DNA, 22 bp, Homo sapiens
caccagctcgtttttcagcacc

SEQ ID NO: 232055 - DNA, 11 bp, Homo sapiens
caccagctctg

SEQ ID NO: 232056 - DNA, 13 bp, Homo sapiens
caccagctctgtg

SEQ ID NO: 232057 - DNA, 15 bp, Homo sapiens
caccagctctgtggc

SEQ ID NO: 232058 - DNA, 19 bp, Homo sapiens
caccagctctgtggcctgt

SEQ ID NO: 232059 - DNA, 21 bp, Homo sapiens
caccagctctgtggcctgtgt

SEQ ID NO: 232060 - DNA, 14 bp, Homo sapiens
caccagctgctctg

SEQ ID NO: 232061 - DNA, 16 bp, Homo sapiens
caccagctgctctgcc

SEQ ID NO: 232062 - DNA, 21 bp, Homo sapiens
caccaggacttaagacaaatg

SEQ ID NO: 232063 - DNA, 16 bp, Homo sapiens
caccaggagaaccact

SEQ ID NO: 232064 - DNA, 19 bp, Homo sapiens
caccaggagaaccactaca

SEQ ID NO: 232065 - DNA, 16 bp, Homo sapiens
caccaggctgtgggcc

SEQ ID NO: 232066 - DNA, 13 bp, Homo sapiens
caccagggactgc

SEQ ID NO: 232067 - DNA, 14 bp, Homo sapiens
caccagggactgca

SEQ ID NO: 232068 - DNA, 15 bp, Homo sapiens
caccagggactgcag

SEQ ID NO: 232069 - DNA, 15 bp, Homo sapiens
caccagggctcagct

SEQ ID NO: 232070 - DNA, 17 bp, Homo sapiens
caccagggctcagctcc

SEQ ID NO: 232071 - DNA, 19 bp, Homo sapiens
caccagggtccgcaccagc

SEQ ID NO: 232072 - DNA, 20 bp, Homo sapiens
caccagggtccgcaccagct

SEQ ID NO: 232073 - DNA, 22 bp, Homo sapiens
caccagggtccgcaccagctgc

SEQ ID NO: 232074 - DNA, 13 bp, Homo sapiens
caccagtctgtct

SEQ ID NO: 232075 - DNA, 20 bp, Homo sapiens
caccagtctgtctactgtgg

SEQ ID NO: 232076 - DNA, 17 bp, Homo sapiens
caccagtggcctcgtgg

SEQ ID NO: 232077 - DNA, 16 bp, Homo sapiens
cacccctccctctgct

SEQ ID NO: 232078 - DNA, 18 bp, Homo sapiens
cacccctccctctgctct

SEQ ID NO: 232079 - DNA, 18 bp, Homo sapiens
cacccctccgtgtggagc

SEQ ID NO: 232080 - DNA, 13 bp, Homo sapiens
cacccctcctggg

SEQ ID NO: 232081 - DNA, 15 bp, Homo sapiens
cacccctcctgggcc

SEQ ID NO: 232082 - DNA, 20 bp, Homo sapiens
cacccctcttcccccttccc

SEQ ID NO: 232083 - DNA, 13 bp, Homo sapiens
cacccctgcccag

SEQ ID NO: 232084 - DNA, 22 bp, Homo sapiens
cacccctgcccaggcagtcttt

SEQ ID NO: 232085 - DNA, 19 bp, Homo sapiens
cacccctgccggccttggc

SEQ ID NO: 232086 - DNA, 17 bp, Homo sapiens
cacccctgctgccgcca

SEQ ID NO: 232087 - DNA, 13 bp, Homo sapiens
cacccctgggcag

SEQ ID NO: 232088 - DNA, 16 bp, Homo sapiens
cacccctgggcaggcg

SEQ ID NO: 232089 - DNA, 11 bp, Homo sapiens
cacccctgtac

SEQ ID NO: 232090 - DNA, 21 bp, Homo sapiens
cacccctgtacccagccacct

SEQ ID NO: 232091 - DNA, 20 bp, Homo sapiens
cacccctgtctgcgccgctg

SEQ ID NO: 232092 - DNA, 11 bp, Homo sapiens
caccccttccc

SEQ ID NO: 232093 - DNA, 12 bp, Homo sapiens
caccccttcccc

SEQ ID NO: 232094 - DNA, 14 bp, Homo sapiens
cacccgacaccagc

SEQ ID NO: 232095 - DNA, 11 bp, Homo sapiens
cacccgcccca

SEQ ID NO: 232096 - DNA, 18 bp, Homo sapiens
cacccgccccagagactg

SEQ ID NO: 232097 - DNA, 19 bp, Homo sapiens
cacccgccccagagactgc

SEQ ID NO: 232098 - DNA, 21 bp, Homo sapiens
cacccgccccagagactgccc

SEQ ID NO: 232099 - DNA, 22 bp, Homo sapiens
cacccgccccagagactgccca

SEQ ID NO: 232100 - DNA, 18 bp, Homo sapiens
cacccgcccgcccccgcc

SEQ ID NO: 232101 - DNA, 15 bp, Homo sapiens
cacccgccctttcct

SEQ ID NO: 232102 - DNA, 20 bp, Homo sapiens
cacccgccgccactaggtgt

SEQ ID NO: 232103 - DNA, 22 bp, Homo sapiens
cacctcctccactcactccagc

SEQ ID NO: 232104 - DNA, 12 bp, Homo sapiens
cacctcctccag

SEQ ID NO: 232105 - DNA, 14 bp, Homo sapiens
cacctcctctctgc

SEQ ID NO: 232106 - DNA, 14 bp, Homo sapiens
cacctcctgagaag

SEQ ID NO: 232107 - DNA, 19 bp, Homo sapiens
cacctcctgagaaggcgag

SEQ ID NO: 232108 - DNA, 13 bp, Homo sapiens
cacctcctgcctc

SEQ ID NO: 232109 - DNA, 14 bp, Homo sapiens
cacctctagcctta

SEQ ID NO: 232110 - DNA, 13 bp, Homo sapiens
cacctctcaatat

SEQ ID NO: 232111 - DNA, 12 bp, Homo sapiens
cacctctccctc

SEQ ID NO: 232112 - DNA, 23 bp, Homo sapiens
cacctctccctcaacaagggaga

SEQ ID NO: 232113 - DNA, 13 bp, Homo sapiens
cacctctctgtct

SEQ ID NO: 232114 - DNA, 21 bp, Homo sapiens
cacctctctgtctttttcctt

SEQ ID NO: 232115 - DNA, 22 bp, Homo sapiens
cacctctgaaaacggccctctt

SEQ ID NO: 232116 - DNA, 14 bp, Homo sapiens
cacctctgctgccc

SEQ ID NO: 232117 - DNA, 20 bp, Homo sapiens
cacctctgctgcccacggcc

SEQ ID NO: 232118 - DNA, 21 bp, Homo sapiens
cacctctgctgcccacggcca

SEQ ID NO: 232119 - DNA, 19 bp, Homo sapiens
cactggccagagagggccc

SEQ ID NO: 232120 - DNA, 23 bp, Homo sapiens
cactggccagagagggcccagct

SEQ ID NO: 232121 - DNA, 21 bp, Homo sapiens
cactggccagctctggctcag

SEQ ID NO: 232122 - DNA, 18 bp, Homo sapiens
cactggccagtagctgcc

SEQ ID NO: 232123 - DNA, 13 bp, Homo sapiens
cactggccccacc

SEQ ID NO: 232124 - DNA, 14 bp, Homo sapiens
cactggccccaccc

SEQ ID NO: 232125 - DNA, 16 bp, Homo sapiens
cactggccccaccctc

SEQ ID NO: 232126 - DNA, 10 bp, Homo sapiens
cactggcctg

SEQ ID NO: 232127 - DNA, 13 bp, Homo sapiens
cactggcctgggt

SEQ ID NO: 232128 - DNA, 14 bp, Homo sapiens
cactggcctgggtc

SEQ ID NO: 232129 - DNA, 11 bp, Homo sapiens
cactggcctgt

SEQ ID NO: 232130 - DNA, 21 bp, Homo sapiens
cactggcgaagatggtctcca

SEQ ID NO: 232131 - DNA, 13 bp, Homo sapiens
cactggctgctct

SEQ ID NO: 232132 - DNA, 14 bp, Homo sapiens
cactggctggggca

SEQ ID NO: 232133 - DNA, 18 bp, Homo sapiens
cactggctggggcagagg

SEQ ID NO: 232134 - DNA, 20 bp, Homo sapiens
cactggctggggcagagggg

SEQ ID NO: 232135 - DNA, 14 bp, Homo sapiens
cactgggaagctgg

SEQ ID NO: 232136 - DNA, 16 bp, Homo sapiens
cactgggaagctggag

SEQ ID NO: 232137 - DNA, 17 bp, Homo sapiens
cactggggagtgctgga

SEQ ID NO: 232138 - DNA, 15 bp, Homo sapiens
cactgggggaacaga

SEQ ID NO: 232139 - DNA, 21 bp, Homo sapiens
cactggggtaccacatggtcc

SEQ ID NO: 232140 - DNA, 20 bp, Homo sapiens
cactgggtctcactcctgag

SEQ ID NO: 232141 - DNA, 15 bp, Homo sapiens
cactgggtggggtga

SEQ ID NO: 232142 - DNA, 18 bp, Homo sapiens
cactgggtggggtgagga

SEQ ID NO: 232143 - DNA, 21 bp, Homo sapiens
cactgggtggggtgaggacca

SEQ ID NO: 232144 - DNA, 20 bp, Homo sapiens
cactggtcatcagtattgtg

SEQ ID NO: 232145 - DNA, 19 bp, Homo sapiens
cactggtgcatttaaaatg

SEQ ID NO: 232146 - DNA, 21 bp, Homo sapiens
cactggtgcatttaaaatgga

SEQ ID NO: 232147 - DNA, 14 bp, Homo sapiens
cactggtggcatcg

SEQ ID NO: 232148 - DNA, 13 bp, Homo sapiens
cactgtaaaatga

SEQ ID NO: 232149 - DNA, 14 bp, Homo sapiens
cactgtaaaatgaa

SEQ ID NO: 232150 - DNA, 17 bp, Homo sapiens
cactgtaaaatgaaatt

SEQ ID NO: 232151 - DNA, 18 bp, Homo sapiens
cactgtaaaatgaaatta

SEQ ID NO: 232152 - DNA, 13 bp, Homo sapiens
cactgtaaaatgt

SEQ ID NO: 232153 - DNA, 18 bp, Homo sapiens
cactgtaaacccctgggt

SEQ ID NO: 232154 - DNA, 19 bp, Homo sapiens
cactgtaaacccctgggta

SEQ ID NO: 232155 - DNA, 22 bp, Homo sapiens
cactgtaatatctttaaatgat

SEQ ID NO: 232156 - DNA, 22 bp, Homo sapiens
cactgtagtaaatggcaattct

SEQ ID NO: 232157 - DNA, 23 bp, Homo sapiens
cactgtattacataaataaatta

SEQ ID NO: 232158 - DNA, 17 bp, Homo sapiens
cactgtatttgtatctc

SEQ ID NO: 232159 - DNA, 17 bp, Homo sapiens
cactgtcaagattaagt

SEQ ID NO: 232160 - DNA, 14 bp, Homo sapiens
cactgtccccctac

SEQ ID NO: 232161 - DNA, 19 bp, Homo sapiens
cactgtccccctacccacc

SEQ ID NO: 232162 - DNA, 20 bp, Homo sapiens
cactgtccctaccactgagc

SEQ ID NO: 232163 - DNA, 23 bp, Homo sapiens
cactgtccctaccactgagccct

SEQ ID NO: 232164 - DNA, 13 bp, Homo sapiens
cactgtctttcct

SEQ ID NO: 232165 - DNA, 22 bp, Homo sapiens
cactgtgcccagcccggacctt

SEQ ID NO: 232166 - DNA, 20 bp, Homo sapiens
cactgtggaacactaaagag

SEQ ID NO: 232167 - DNA, 13 bp, Homo sapiens
cactgtggccaga

SEQ ID NO: 232168 - DNA, 19 bp, Homo sapiens
cactgtggccagagctgga

SEQ ID NO: 232169 - DNA, 22 bp, Homo sapiens
cactgtggccagagctggaagg

SEQ ID NO: 232170 - DNA, 23 bp, Homo sapiens
cactgtggccagagctggaaggc

SEQ ID NO: 232171 - DNA, 22 bp, Homo sapiens
cactgtgtaaccagcagtcaca

SEQ ID NO: 232172 - DNA, 15 bp, Homo sapiens
cactgtgtatttaac

SEQ ID NO: 232173 - DNA, 20 bp, Homo sapiens
cactgtgtttatatgtcttg

SEQ ID NO: 232174 - DNA, 15 bp, Homo sapiens
cactgttatcaaaac

SEQ ID NO: 232175 - DNA, 14 bp, Homo sapiens
cactgttattttca

SEQ ID NO: 232176 - DNA, 17 bp, Homo sapiens
cactgttgaaaattatt

SEQ ID NO: 232177 - DNA, 13 bp, Homo sapiens
cactgttgaattt

SEQ ID NO: 232178 - DNA, 18 bp, Homo sapiens
cactgtttctctgctgtt

SEQ ID NO: 232179 - DNA, 12 bp, Homo sapiens
cacttaatcttc

SEQ ID NO: 232180 - DNA, 14 bp, Homo sapiens
cacttaatcttctc

SEQ ID NO: 232181 - DNA, 13 bp, Homo sapiens
cacttaattctgt

SEQ ID NO: 232182 - DNA, 18 bp, Homo sapiens
cacttacaagtaatgaat

SEQ ID NO: 232183 - DNA, 18 bp, Homo sapiens
cacttacactttatgcac

SEQ ID NO: 232184 - DNA, 18 bp, Homo sapiens
cacttacctagatttaca

SEQ ID NO: 232185 - DNA, 15 bp, Homo sapiens
cacttacttgggagg

SEQ ID NO: 232186 - DNA, 13 bp, Homo sapiens
cacttagtccact

SEQ ID NO: 232187 - DNA, 11 bp, Homo sapiens
cacttatacca

SEQ ID NO: 232188 - DNA, 16 bp, Homo sapiens
cacttattttacacag

SEQ ID NO: 232189 - DNA, 22 bp, Homo sapiens
cacttattttacacagcaattt

SEQ ID NO: 232190 - DNA, 12 bp, Homo sapiens
cacttattttct

SEQ ID NO: 232191 - DNA, 18 bp, Homo sapiens
cacttattttctgaattc

SEQ ID NO: 232192 - DNA, 14 bp, Homo sapiens
cacttcaaatcaga

SEQ ID NO: 232193 - DNA, 14 bp, Homo sapiens
cacttcacccccaa

SEQ ID NO: 232194 - DNA, 18 bp, Homo sapiens
cacttcacccccaacttc

SEQ ID NO: 232195 - DNA, 16 bp, Homo sapiens
cacttcagagagctgg

SEQ ID NO: 232196 - DNA, 17 bp, Homo sapiens
cacttcagagagctggt

SEQ ID NO: 232197 - DNA, 18 bp, Homo sapiens
cacttcagagagctggta

SEQ ID NO: 232198 - DNA, 15 bp, Homo sapiens
cacttcaggctcttc

SEQ ID NO: 232199 - DNA, 22 bp, Homo sapiens
cacttcattcttgaaagctgtg

SEQ ID NO: 232200 - DNA, 19 bp, Homo sapiens
cacttccaaaattcttatt

SEQ ID NO: 232201 - DNA, 22 bp, Homo sapiens
cacttccattgtattgtctgac

SEQ ID NO: 232202 - DNA, 17 bp, Homo sapiens
cacttcctacaagagca

SEQ ID NO: 232203 - DNA, 12 bp, Homo sapiens
cacttcctgtcc

SEQ ID NO: 232204 - DNA, 14 bp, Homo sapiens
cacttcctgtccag

SEQ ID NO: 232205 - DNA, 18 bp, Homo sapiens
cacttcctgtccagagag

SEQ ID NO: 232206 - DNA, 13 bp, Homo sapiens
cacttctccccgc

SEQ ID NO: 232207 - DNA, 19 bp, Homo sapiens
cacttctccccgcagcccg

SEQ ID NO: 232208 - DNA, 23 bp, Homo sapiens
cacttctccccgcagcccgcctg

SEQ ID NO: 232209 - DNA, 18 bp, Homo sapiens
cacttctggtcccctgtg

SEQ ID NO: 232210 - DNA, 20 bp, Homo sapiens
cacttctgtgagacccccac

SEQ ID NO: 232211 - DNA, 21 bp, Homo sapiens
cacttctgtgagacccccaca

SEQ ID NO: 232212 - DNA, 18 bp, Homo sapiens
cacttcttaaaggcctgg

SEQ ID NO: 232213 - DNA, 17 bp, Homo sapiens
cacttcttgaaacagcc

SEQ ID NO: 232214 - DNA, 16 bp, Homo sapiens
cacttgacatcaactg

SEQ ID NO: 232215 - DNA, 23 bp, Homo sapiens
cacttgcacgcccatgtgtgagt

SEQ ID NO: 232216 - DNA, 14 bp, Homo sapiens
cacttgcactgtgc

SEQ ID NO: 232217 - DNA, 12 bp, Homo sapiens
cacttgcatttc

SEQ ID NO: 232218 - DNA, 22 bp, Homo sapiens
cagaatgtaagaaaacaaaatc

SEQ ID NO: 232219 - DNA, 15 bp, Homo sapiens
cagaattagtcctca

SEQ ID NO: 232220 - DNA, 20 bp, Homo sapiens
cagaattagtcctcacagcc

SEQ ID NO: 232221 - DNA, 17 bp, Homo sapiens
cagaattgaagaaaatc

SEQ ID NO: 232222 - DNA, 19 bp, Homo sapiens
cagaattgtgcaaatggaa

SEQ ID NO: 232223 - DNA, 14 bp, Homo sapiens
cagaatttcccaaa

SEQ ID NO: 232224 - DNA, 17 bp, Homo sapiens
cagaatttcccaaagca

SEQ ID NO: 232225 - DNA, 18 bp, Homo sapiens
cagaatttcccaaagcag

SEQ ID NO: 232226 - DNA, 20 bp, Homo sapiens
cagaatttcccaaagcagtg

SEQ ID NO: 232227 - DNA, 19 bp, Homo sapiens
cagaatttctttgtcattc

SEQ ID NO: 232228 - DNA, 20 bp, Homo sapiens
cagacaaaaagaacaaaaaa

SEQ ID NO: 232229 - DNA, 12 bp, Homo sapiens
cagacaaagcgt

SEQ ID NO: 232230 - DNA, 22 bp, Homo sapiens
cagacaaagcgtggtggacatg

SEQ ID NO: 232231 - DNA, 20 bp, Homo sapiens
cagacaacaaacctgtttct

SEQ ID NO: 232232 - DNA, 16 bp, Homo sapiens
cagacaaggagagcgg

SEQ ID NO: 232233 - DNA, 23 bp, Homo sapiens
cagacaaggagagcggaggagga

SEQ ID NO: 232234 - DNA, 23 bp, Homo sapiens
cagacaaggtagccctggccaga

SEQ ID NO: 232235 - DNA, 17 bp, Homo sapiens
cagacaataaaatggaa

SEQ ID NO: 232236 - DNA, 12 bp, Homo sapiens
cagacacaatta

SEQ ID NO: 232237 - DNA, 17 bp, Homo sapiens
cagacacaattagagaa

SEQ ID NO: 232238 - DNA, 12 bp, Homo sapiens
cagacacacaac

SEQ ID NO: 232239 - DNA, 16 bp, Homo sapiens
cagacacacacacgca

SEQ ID NO: 232240 - DNA, 17 bp, Homo sapiens
cagacacacacacgcac

SEQ ID NO: 232241 - DNA, 22 bp, Homo sapiens
cagacacacacacgcacgcaca

SEQ ID NO: 232242 - DNA, 18 bp, Homo sapiens
cagacacacgcacacaca

SEQ ID NO: 232243 - DNA, 11 bp, Homo sapiens
cagacaccaca

SEQ ID NO: 232244 - DNA, 23 bp, Homo sapiens
cagacaccacagacgccacctgg

SEQ ID NO: 232245 - DNA, 11 bp, Homo sapiens
cagacactaag

SEQ ID NO: 232246 - DNA, 12 bp, Homo sapiens
cagacactaagt

SEQ ID NO: 232247 - DNA, 20 bp, Homo sapiens
cagacactccagtttgccca

SEQ ID NO: 232248 - DNA, 19 bp, Homo sapiens
cagacactttggaagtttg

SEQ ID NO: 232249 - DNA, 15 bp, Homo sapiens
cagacagacacacac

SEQ ID NO: 232250 - DNA, 16 bp, Homo sapiens
cagacagacacacaca

SEQ ID NO: 232251 - DNA, 13 bp, Homo sapiens
cagacagatccca

SEQ ID NO: 232252 - DNA, 21 bp, Homo sapiens
cagacagcaacggggaggcca

SEQ ID NO: 232253 - DNA, 15 bp, Homo sapiens
cagacaggaaaggga

SEQ ID NO: 232254 - DNA, 20 bp, Homo sapiens
cagacaggccatgtgagcca

SEQ ID NO: 232255 - DNA, 18 bp, Homo sapiens
cagacaggccctccctgt

SEQ ID NO: 232256 - DNA, 22 bp, Homo sapiens
cagacaggctcttagcagcttc

SEQ ID NO: 232257 - DNA, 20 bp, Homo sapiens
cagacagggtctgaaggact

SEQ ID NO: 232258 - DNA, 17 bp, Homo sapiens
cagacagggtggggctt

SEQ ID NO: 232259 - DNA, 13 bp, Homo sapiens
cagacatagactg

SEQ ID NO: 232260 - DNA, 16 bp, Homo sapiens
cagacatagactgcaa

SEQ ID NO: 232261 - DNA, 15 bp, Homo sapiens
cagacatcatgaatt

SEQ ID NO: 232262 - DNA, 12 bp, Homo sapiens
cagacatcctgt

SEQ ID NO: 232263 - DNA, 15 bp, Homo sapiens
cagacatctctgcac

SEQ ID NO: 232264 - DNA, 14 bp, Homo sapiens
cagacattgtattt

SEQ ID NO: 232265 - DNA, 17 bp, Homo sapiens
cagaccaccagccgccc

SEQ ID NO: 232266 - DNA, 19 bp, Homo sapiens
cagaccaccagccgcccca

SEQ ID NO: 232267 - DNA, 15 bp, Homo sapiens
cagaccagagctctg

SEQ ID NO: 232268 - DNA, 17 bp, Homo sapiens
cagaccagagctctgga

SEQ ID NO: 232269 - DNA, 18 bp, Homo sapiens
cagaccagagctgtctga

SEQ ID NO: 232270 - DNA, 16 bp, Homo sapiens
cagaccataatgttac

SEQ ID NO: 232271 - DNA, 17 bp, Homo sapiens
cagaccccatccagcca

SEQ ID NO: 232272 - DNA, 18 bp, Homo sapiens
cagacccccaccccttcc

SEQ ID NO: 232273 - DNA, 19 bp, Homo sapiens
cagacccccaccccttccc

SEQ ID NO: 232274 - DNA, 21 bp, Homo sapiens
cagacccccaccccttcccca

SEQ ID NO: 232275 - DNA, 22 bp, Homo sapiens
cagacccccaccccttccccac

SEQ ID NO: 232276 - DNA, 13 bp, Homo sapiens
cagacccccagca

SEQ ID NO: 232277 - DNA, 20 bp, Homo sapiens
cagaccccgcccctggggaa

SEQ ID NO: 232278 - DNA, 20 bp, Homo sapiens
cagacccctctggccaggat

SEQ ID NO: 232279 - DNA, 22 bp, Homo sapiens
cagacccctctggccaggatgg

SEQ ID NO: 232280 - DNA, 15 bp, Homo sapiens
cagacccctggcttt

SEQ ID NO: 232281 - DNA, 15 bp, Homo sapiens
cagaccccttggcca

SEQ ID NO: 232282 - DNA, 12 bp, Homo sapiens
cagaccctgcct

SEQ ID NO: 232283 - DNA, 18 bp, Homo sapiens
cagaccctgcctgagccc

SEQ ID NO: 232284 - DNA, 21 bp, Homo sapiens
cagacccttgaagatgtagct

SEQ ID NO: 232285 - DNA, 15 bp, Homo sapiens
cagacctaatgctcc

SEQ ID NO: 232286 - DNA, 22 bp, Homo sapiens
cagacctaggatttcatgattt

SEQ ID NO: 232287 - DNA, 16 bp, Homo sapiens
cagacctgggacttta

SEQ ID NO: 232288 - DNA, 13 bp, Homo sapiens
cagacctgggccc

SEQ ID NO: 232289 - DNA, 15 bp, Homo sapiens
cagacctgggccctg

SEQ ID NO: 232290 - DNA, 19 bp, Homo sapiens
cagacctgtcttccaagga

SEQ ID NO: 232291 - DNA, 16 bp, Homo sapiens
cagacgagacacccta

SEQ ID NO: 232292 - DNA, 21 bp, Homo sapiens
cagacgagacaccctaactct

SEQ ID NO: 232293 - DNA, 17 bp, Homo sapiens
cagacgcagcagctggg

SEQ ID NO: 232294 - DNA, 15 bp, Homo sapiens
cagacgccacctggc

SEQ ID NO: 232295 - DNA, 12 bp, Homo sapiens
cagacggacggg

SEQ ID NO: 232296 - DNA, 21 bp, Homo sapiens
cagacggacgggacagcggcc

SEQ ID NO: 232297 - DNA, 17 bp, Homo sapiens
cagacggcacccaccca

SEQ ID NO: 232298 - DNA, 17 bp, Homo sapiens
cagactcaggttccaga

SEQ ID NO: 232299 - DNA, 17 bp, Homo sapiens
cagactcagtttgtcag

SEQ ID NO: 232300 - DNA, 20 bp, Homo sapiens
cagactcatacagaaggtgg

SEQ ID NO: 232301 - DNA, 14 bp, Homo sapiens
cagagctccacaga

SEQ ID NO: 232302 - DNA, 22 bp, Homo sapiens
cagagctcccaggacgcaggga

SEQ ID NO: 232303 - DNA, 17 bp, Homo sapiens
cagagctcttcaagctg

SEQ ID NO: 232304 - DNA, 20 bp, Homo sapiens
cagagctcttcaagctgtcc

SEQ ID NO: 232305 - DNA, 19 bp, Homo sapiens
cagagctgagtcggctggg

SEQ ID NO: 232306 - DNA, 13 bp, Homo sapiens
cagagctggaagg

SEQ ID NO: 232307 - DNA, 18 bp, Homo sapiens
cagagctggaaggcaggg

SEQ ID NO: 232308 - DNA, 10 bp, Homo sapiens
cagagctggg

SEQ ID NO: 232309 - DNA, 14 bp, Homo sapiens
cagagctgggaggg

SEQ ID NO: 232310 - DNA, 17 bp, Homo sapiens
cagagcttcagggctgg

SEQ ID NO: 232311 - DNA, 15 bp, Homo sapiens
cagaggacagtgctg

SEQ ID NO: 232312 - DNA, 22 bp, Homo sapiens
cagaggacagtgctgaccccag

SEQ ID NO: 232313 - DNA, 22 bp, Homo sapiens
cagaggagagtcccagagcagg

SEQ ID NO: 232314 - DNA, 23 bp, Homo sapiens
cagaggagtgattgaaccagctc

SEQ ID NO: 232315 - DNA, 22 bp, Homo sapiens
cagaggattctgtcttccaggc

SEQ ID NO: 232316 - DNA, 21 bp, Homo sapiens
cagaggcacagccggggcctg

SEQ ID NO: 232317 - DNA, 17 bp, Homo sapiens
cagaggcagaaccctgg

SEQ ID NO: 232318 - DNA, 19 bp, Homo sapiens
cagaggcagctaaggggca

SEQ ID NO: 232319 - DNA, 13 bp, Homo sapiens
cagaggcagggcc

SEQ ID NO: 232320 - DNA, 19 bp, Homo sapiens
cagaggcagggccctgggg

SEQ ID NO: 232321 - DNA, 16 bp, Homo sapiens
cagaggcagtggcagc

SEQ ID NO: 232322 - DNA, 17 bp, Homo sapiens
cagaggcagtggcagca

SEQ ID NO: 232323 - DNA, 18 bp, Homo sapiens
cagaggcagtggcagcaa

SEQ ID NO: 232324 - DNA, 20 bp, Homo sapiens
cagaggcctagtcagccaca

SEQ ID NO: 232325 - DNA, 23 bp, Homo sapiens
cagaggcctagtcagccacatgg

SEQ ID NO: 232326 - DNA, 21 bp, Homo sapiens
cagaggcctcccccagccagg

SEQ ID NO: 232327 - DNA, 16 bp, Homo sapiens
cagaggctcctggagc

SEQ ID NO: 232328 - DNA, 18 bp, Homo sapiens
cagaggctcctggagcca

SEQ ID NO: 232329 - DNA, 21 bp, Homo sapiens
cagaggctcctggagccagcc

SEQ ID NO: 232330 - DNA, 20 bp, Homo sapiens
cagagggaaactcagatgtc

SEQ ID NO: 232331 - DNA, 18 bp, Homo sapiens
cagagggaaggggcctac

SEQ ID NO: 232332 - DNA, 17 bp, Homo sapiens
cagagggaatgttccct

SEQ ID NO: 232333 - DNA, 19 bp, Homo sapiens
cagagggaatgttccctgc

SEQ ID NO: 232334 - DNA, 21 bp, Homo sapiens
cagagggaatgttccctgcac

SEQ ID NO: 232335 - DNA, 23 bp, Homo sapiens
cagagggaatgttccctgcaccc

SEQ ID NO: 232336 - DNA, 12 bp, Homo sapiens
cagagggaccag

SEQ ID NO: 232337 - DNA, 17 bp, Homo sapiens
cagagggactgtcagct

SEQ ID NO: 232338 - DNA, 22 bp, Homo sapiens
cagagggactgtcagctgagct

SEQ ID NO: 232339 - DNA, 19 bp, Homo sapiens
cagagggactttgtataga

SEQ ID NO: 232340 - DNA, 21 bp, Homo sapiens
cagagggagaagggagaacag

SEQ ID NO: 232341 - DNA, 23 bp, Homo sapiens
cagagggaggaatcgaggaacca

SEQ ID NO: 232342 - DNA, 21 bp, Homo sapiens
cagaggggacagagttcaggg

SEQ ID NO: 232343 - DNA, 13 bp, Homo sapiens
cagaggggagagg

SEQ ID NO: 232344 - DNA, 15 bp, Homo sapiens
cagaggggagaggaa

SEQ ID NO: 232345 - DNA, 16 bp, Homo sapiens
cagaggggagaggaag

SEQ ID NO: 232346 - DNA, 17 bp, Homo sapiens
cagaggggcggggccag

SEQ ID NO: 232347 - DNA, 21 bp, Homo sapiens
cagaggggtcacgtgtaggag

SEQ ID NO: 232348 - DNA, 17 bp, Homo sapiens
cagagggtgtcgtcctg

SEQ ID NO: 232349 - DNA, 16 bp, Homo sapiens
cagaggtcccctgagg

SEQ ID NO: 232350 - DNA, 17 bp, Homo sapiens
cagaggtcccctgaggt

SEQ ID NO: 232351 - DNA, 20 bp, Homo sapiens
cagaggtctctgccggctct

SEQ ID NO: 232352 - DNA, 14 bp, Homo sapiens
cagaggtgagggag

SEQ ID NO: 232353 - DNA, 18 bp, Homo sapiens
cagaggtggctctggaat

SEQ ID NO: 232354 - DNA, 20 bp, Homo sapiens
cagaggtgggaggcccctgg

SEQ ID NO: 232355 - DNA, 23 bp, Homo sapiens
cagaggtgggaggcccctggtgg

SEQ ID NO: 232356 - DNA, 23 bp, Homo sapiens
cagaggtggggaagagagcctgc

SEQ ID NO: 232357 - DNA, 17 bp, Homo sapiens
cagaggttatctgcctg

SEQ ID NO: 232358 - DNA, 18 bp, Homo sapiens
cagaggttatctgcctgg

SEQ ID NO: 232359 - DNA, 21 bp, Homo sapiens
cagaggttatctgcctggcct

SEQ ID NO: 232360 - DNA, 15 bp, Homo sapiens
cagagtaggtgggtc

SEQ ID NO: 232361 - DNA, 21 bp, Homo sapiens
cagagtaggtgggtcttggat

SEQ ID NO: 232362 - DNA, 15 bp, Homo sapiens
cagagtatatatgta

SEQ ID NO: 232363 - DNA, 18 bp, Homo sapiens
cagagtatatatgtacag

SEQ ID NO: 232364 - DNA, 21 bp, Homo sapiens
cagagtatgtcagtccaataa

SEQ ID NO: 232365 - DNA, 18 bp, Homo sapiens
cagagtccaatttaagga

SEQ ID NO: 232366 - DNA, 14 bp, Homo sapiens
cagagtccaggccc

SEQ ID NO: 232367 - DNA, 17 bp, Homo sapiens
cagagtccggaggcagc

SEQ ID NO: 232368 - DNA, 14 bp, Homo sapiens
cagagtctcgctct

SEQ ID NO: 232369 - DNA, 17 bp, Homo sapiens
cagagtctcgctctgtc

SEQ ID NO: 232370 - DNA, 18 bp, Homo sapiens
cagagtctgacaggaaga

SEQ ID NO: 232371 - DNA, 13 bp, Homo sapiens
cagagtctgagcc

SEQ ID NO: 232372 - DNA, 14 bp, Homo sapiens
cagagtctgggcct

SEQ ID NO: 232373 - DNA, 20 bp, Homo sapiens
cagagtctgggcctctgact

SEQ ID NO: 232374 - DNA, 23 bp, Homo sapiens
cagagtgactgacggctgtgtat

SEQ ID NO: 232375 - DNA, 14 bp, Homo sapiens
cagagtgcagcagc

SEQ ID NO: 232376 - DNA, 16 bp, Homo sapiens
cagagtgccccacctg

SEQ ID NO: 232377 - DNA, 23 bp, Homo sapiens
cagagtgccccacctgccactag

SEQ ID NO: 232378 - DNA, 20 bp, Homo sapiens
cagagtggactcttccctct

SEQ ID NO: 232379 - DNA, 21 bp, Homo sapiens
cagagtggactcttccctctc

SEQ ID NO: 232380 - DNA, 20 bp, Homo sapiens
cagagtggatctggagtctg

SEQ ID NO: 232381 - DNA, 21 bp, Homo sapiens
cagagtggcctggccaggagc

SEQ ID NO: 232382 - DNA, 21 bp, Homo sapiens
cagagttattgaatcttaatt

SEQ ID NO: 232383 - DNA, 22 bp, Homo sapiens
cagagttattgaatcttaattt

SEQ ID NO: 232384 - DNA, 14 bp, Homo sapiens
cagagttcactata

SEQ ID NO: 232385 - DNA, 16 bp, Homo sapiens
cagagttcagggaggg

SEQ ID NO: 232386 - DNA, 20 bp, Homo sapiens
cagagttcagggaggggctg

SEQ ID NO: 232387 - DNA, 22 bp, Homo sapiens
cagagttcagggaggggctgag

SEQ ID NO: 232388 - DNA, 15 bp, Homo sapiens
cagagttccacagtt

SEQ ID NO: 232389 - DNA, 19 bp, Homo sapiens
cagagtttgatatgggctt

SEQ ID NO: 232390 - DNA, 15 bp, Homo sapiens
cagagtttgtagtaa

SEQ ID NO: 232391 - DNA, 20 bp, Homo sapiens
cagataagcaagagagatgt

SEQ ID NO: 232392 - DNA, 17 bp, Homo sapiens
cagataatcagcctctt

SEQ ID NO: 232393 - DNA, 18 bp, Homo sapiens
cagataatcagcctctta

SEQ ID NO: 232394 - DNA, 17 bp, Homo sapiens
cagatacatatgagtgt

SEQ ID NO: 232395 - DNA, 14 bp, Homo sapiens
cagataccagcccc

SEQ ID NO: 232396 - DNA, 21 bp, Homo sapiens
cagatactggaagttttgcat

SEQ ID NO: 232397 - DNA, 15 bp, Homo sapiens
cagatagtcccagca

SEQ ID NO: 232398 - DNA, 22 bp, Homo sapiens
cagatataaatggctggttttt

SEQ ID NO: 232399 - DNA, 23 bp, Homo sapiens
cagatataaatggctggttttta

SEQ ID NO: 232400 - DNA, 18 bp, Homo sapiens
cagatatgaacagggccc

SEQ ID NO: 232401 - DNA, 13 bp, Homo sapiens
cagatatgtatta

SEQ ID NO: 232402 - DNA, 16 bp, Homo sapiens
cagatatgtattactt

SEQ ID NO: 232403 - DNA, 14 bp, Homo sapiens
cagatattccagac

SEQ ID NO: 232404 - DNA, 18 bp, Homo sapiens
cagatattgttataaata

SEQ ID NO: 232405 - DNA, 14 bp, Homo sapiens
cagatatttatatt

SEQ ID NO: 232406 - DNA, 16 bp, Homo sapiens
cagatatttatatttt

SEQ ID NO: 232407 - DNA, 20 bp, Homo sapiens
cagatatttatatttttatt

SEQ ID NO: 232408 - DNA, 17 bp, Homo sapiens
cagatcagaacatgaaa

SEQ ID NO: 232409 - DNA, 20 bp, Homo sapiens
cagatcagaacatgaaatgc

SEQ ID NO: 232410 - DNA, 15 bp, Homo sapiens
cagatccagggactg

SEQ ID NO: 232411 - DNA, 17 bp, Homo sapiens
cagatccgcatgtgtct

SEQ ID NO: 232412 - DNA, 22 bp, Homo sapiens
cagatccgcatgtgtctgtatt

SEQ ID NO: 232413 - DNA, 11 bp, Homo sapiens
cagatcctacc

SEQ ID NO: 232414 - DNA, 14 bp, Homo sapiens
cagatcctccattt

SEQ ID NO: 232415 - DNA, 13 bp, Homo sapiens
cagatcctgctgc

SEQ ID NO: 232416 - DNA, 14 bp, Homo sapiens
cagatcctgctgcc

SEQ ID NO: 232417 - DNA, 12 bp, Homo sapiens
cagatctagcca

SEQ ID NO: 232418 - DNA, 13 bp, Homo sapiens
cagatctagccag

SEQ ID NO: 232419 - DNA, 16 bp, Homo sapiens
cagatctagccaggcc

SEQ ID NO: 232420 - DNA, 16 bp, Homo sapiens
cagccagtcttgccta

SEQ ID NO: 232421 - DNA, 22 bp, Homo sapiens
cagccatagcttgattgctcag

SEQ ID NO: 232422 - DNA, 23 bp, Homo sapiens
cagccatgagaacaaaacctctt

SEQ ID NO: 232423 - DNA, 11 bp, Homo sapiens
cagccatgcct

SEQ ID NO: 232424 - DNA, 19 bp, Homo sapiens
cagccatgcctcatgccac

SEQ ID NO: 232425 - DNA, 20 bp, Homo sapiens
cagccatgcctcatgccaca

SEQ ID NO: 232426 - DNA, 15 bp, Homo sapiens
cagccatgggccctc

SEQ ID NO: 232427 - DNA, 15 bp, Homo sapiens
cagccattcatctgg

SEQ ID NO: 232428 - DNA, 19 bp, Homo sapiens
cagccattcctgttctctt

SEQ ID NO: 232429 - DNA, 20 bp, Homo sapiens
cagccattcctgttctcttt

SEQ ID NO: 232430 - DNA, 19 bp, Homo sapiens
cagcccaaagctggagcca

SEQ ID NO: 232431 - DNA, 13 bp, Homo sapiens
cagcccaaccggg

SEQ ID NO: 232432 - DNA, 10 bp, Homo sapiens
cagcccaata

SEQ ID NO: 232433 - DNA, 16 bp, Homo sapiens
cagcccaataaaggtc

SEQ ID NO: 232434 - DNA, 14 bp, Homo sapiens
cagcccacagagga

SEQ ID NO: 232435 - DNA, 20 bp, Homo sapiens
cagcccacagaggacagtgc

SEQ ID NO: 232436 - DNA, 13 bp, Homo sapiens
cagccgccccagc

SEQ ID NO: 232437 - DNA, 15 bp, Homo sapiens
cagccgccccagccc

SEQ ID NO: 232438 - DNA, 16 bp, Homo sapiens
cagccgccccagcccc

SEQ ID NO: 232439 - DNA, 15 bp, Homo sapiens
cagccgccttccttg

SEQ ID NO: 232440 - DNA, 15 bp, Homo sapiens
cagccgcgctctgcc

SEQ ID NO: 232441 - DNA, 16 bp, Homo sapiens
cagccgcgctctgccc

SEQ ID NO: 232442 - DNA, 19 bp, Homo sapiens
cagccgcgctctgcccctc

SEQ ID NO: 232443 - DNA, 22 bp, Homo sapiens
cagccgcgctctgcccctccgt

SEQ ID NO: 232444 - DNA, 15 bp, Homo sapiens
cagccgctaggagag

SEQ ID NO: 232445 - DNA, 16 bp, Homo sapiens
cagccgctaggagaga

SEQ ID NO: 232446 - DNA, 13 bp, Homo sapiens
cagccggcacagg

SEQ ID NO: 232447 - DNA, 14 bp, Homo sapiens
cagccggcacccac

SEQ ID NO: 232448 - DNA, 17 bp, Homo sapiens
cagccggggcctgccta

SEQ ID NO: 232449 - DNA, 20 bp, Homo sapiens
cagccggggcctgcctagca

SEQ ID NO: 232450 - DNA, 14 bp, Homo sapiens
cagccggggtgggg

SEQ ID NO: 232451 - DNA, 18 bp, Homo sapiens
cagccgtcacccctgcct

SEQ ID NO: 232452 - DNA, 19 bp, Homo sapiens
cagccgtcagccaaatgta

SEQ ID NO: 232453 - DNA, 14 bp, Homo sapiens
cagccgtcccgcgt

SEQ ID NO: 232454 - DNA, 18 bp, Homo sapiens
cagcctaggggtcaggga

SEQ ID NO: 232455 - DNA, 20 bp, Homo sapiens
cagcctagtaggagctgagc

SEQ ID NO: 232456 - DNA, 17 bp, Homo sapiens
cagcctatgggggctct

SEQ ID NO: 232457 - DNA, 15 bp, Homo sapiens
cagcctcagggcttc

SEQ ID NO: 232458 - DNA, 18 bp, Homo sapiens
cagcctcagggcttcctt

SEQ ID NO: 232459 - DNA, 19 bp, Homo sapiens
cagcctcattcactgtcct

SEQ ID NO: 232460 - DNA, 12 bp, Homo sapiens
cagcctccaaga

SEQ ID NO: 232461 - DNA, 20 bp, Homo sapiens
cagcctccaagctccatctc

SEQ ID NO: 232462 - DNA, 13 bp, Homo sapiens
cagcctccagagc

SEQ ID NO: 232463 - DNA, 18 bp, Homo sapiens
cagcctccagagccagcc

SEQ ID NO: 232464 - DNA, 21 bp, Homo sapiens
cagcctccagagccagcctgg

SEQ ID NO: 232465 - DNA, 12 bp, Homo sapiens
cagcctccaggc

SEQ ID NO: 232466 - DNA, 14 bp, Homo sapiens
caggccgcatggcc

SEQ ID NO: 232467 - DNA, 15 bp, Homo sapiens
caggccgcatggccc

SEQ ID NO: 232468 - DNA, 23 bp, Homo sapiens
caggccgccccagcctctgagcc

SEQ ID NO: 232469 - DNA, 15 bp, Homo sapiens
caggccggccagcct

SEQ ID NO: 232470 - DNA, 19 bp, Homo sapiens
caggccgggctttccagaa

SEQ ID NO: 232471 - DNA, 24 bp, Homo sapiens
caggccgggctttccagaaggcca

SEQ ID NO: 232472 - DNA, 20 bp, Homo sapiens
caggccggggtggagcatgg

SEQ ID NO: 232473 - DNA, 19 bp, Homo sapiens
caggccgttccccttggct

SEQ ID NO: 232474 - DNA, 18 bp, Homo sapiens
caggcctcacctggcttc

SEQ ID NO: 232475 - DNA, 22 bp, Homo sapiens
caggcctcacctggcttcccag

SEQ ID NO: 232476 - DNA, 11 bp, Homo sapiens
caggcctccag

SEQ ID NO: 232477 - DNA, 15 bp, Homo sapiens
caggcctccagcctc

SEQ ID NO: 232478 - DNA, 17 bp, Homo sapiens
caggcctccagcctctc

SEQ ID NO: 232479 - DNA, 20 bp, Homo sapiens
caggcctcccgcatgctgcc

SEQ ID NO: 232480 - DNA, 23 bp, Homo sapiens
caggcctcccgcatgctgcctgc

SEQ ID NO: 232481 - DNA, 13 bp, Homo sapiens
caggcctccctct

SEQ ID NO: 232482 - DNA, 14 bp, Homo sapiens
caggcctccctctc

SEQ ID NO: 232483 - DNA, 19 bp, Homo sapiens
caggcctccctctctcttc

SEQ ID NO: 232484 - DNA, 22 bp, Homo sapiens
caggcctccctctctcttctgc

SEQ ID NO: 232485 - DNA, 15 bp, Homo sapiens
caggcctgaaagagg

SEQ ID NO: 232486 - DNA, 20 bp, Homo sapiens
caggcctgaaagaggctgag

SEQ ID NO: 232487 - DNA, 15 bp, Homo sapiens
caggcctgaggctgc

SEQ ID NO: 232488 - DNA, 16 bp, Homo sapiens
caggcctgaggctgct

SEQ ID NO: 232489 - DNA, 17 bp, Homo sapiens
caggcctgaggctgctg

SEQ ID NO: 232490 - DNA, 15 bp, Homo sapiens
caggcctgccaatgc

SEQ ID NO: 232491 - DNA, 19 bp, Homo sapiens
caggcctgccaatgccaca

SEQ ID NO: 232492 - DNA, 21 bp, Homo sapiens
caggcctgccaatgccacagc

SEQ ID NO: 232493 - DNA, 17 bp, Homo sapiens
caggcctgccagcccct

SEQ ID NO: 232494 - DNA, 20 bp, Homo sapiens
caggcctgcctgttcccatt

SEQ ID NO: 232495 - DNA, 13 bp, Homo sapiens
caggcctggccca

SEQ ID NO: 232496 - DNA, 16 bp, Homo sapiens
caggcctggcccagcc

SEQ ID NO: 232497 - DNA, 17 bp, Homo sapiens
caggcctggcccagcca

SEQ ID NO: 232498 - DNA, 19 bp, Homo sapiens
caggcctggcccagccagc

SEQ ID NO: 232499 - DNA, 20 bp, Homo sapiens
caggcctggcccagccagca

SEQ ID NO: 232500 - DNA, 22 bp, Homo sapiens
caggcctggcctcggggcaggg

SEQ ID NO: 232501 - DNA, 11 bp, Homo sapiens
caggcctggga

SEQ ID NO: 232502 - DNA, 13 bp, Homo sapiens
caggcctgggacc

SEQ ID NO: 232503 - DNA, 16 bp, Homo sapiens
caggcctgggacccag

SEQ ID NO: 232504 - DNA, 24 bp, Homo sapiens
caggcctgggacccagctactctg

SEQ ID NO: 232505 - DNA, 21 bp, Homo sapiens
caggcctttcaggaagggaga

SEQ ID NO: 232506 - DNA, 22 bp, Homo sapiens
caggcctttcaggaagggagag

SEQ ID NO: 232507 - DNA, 20 bp, Homo sapiens
caggcgatccacctgtctca

SEQ ID NO: 232508 - DNA, 12 bp, Homo sapiens
caggcgcagccc

SEQ ID NO: 232509 - DNA, 16 bp, Homo sapiens
caggcgcgcaccgccc

SEQ ID NO: 232510 - DNA, 19 bp, Homo sapiens
caggcgcgcaccgcccaac

SEQ ID NO: 232511 - DNA, 14 bp, Homo sapiens
caggcgctccaggc

SEQ ID NO: 232512 - DNA, 20 bp, Homo sapiens
caggcggaggggcttggagc

SEQ ID NO: 232513 - DNA, 21 bp, Homo sapiens
caggcggaggggcttggagca

SEQ ID NO: 232514 - DNA, 22 bp, Homo sapiens
caggcggaggggcttggagcag

SEQ ID NO: 232515 - DNA, 18 bp, Homo sapiens
caggcggtccccatcccc

SEQ ID NO: 232516 - DNA, 22 bp, Homo sapiens
caggcggtccccatccccacca

SEQ ID NO: 232517 - DNA, 19 bp, Homo sapiens
caggcgtagggccagggct

SEQ ID NO: 232518 - DNA, 15 bp, Homo sapiens
caggcgtgagccact

SEQ ID NO: 232519 - DNA, 20 bp, Homo sapiens
caggcgtgggacgtggtcag

SEQ ID NO: 232520 - DNA, 15 bp, Homo sapiens
caggctactctcctc

SEQ ID NO: 232521 - DNA, 18 bp, Homo sapiens
caggctactctcctcggc

SEQ ID NO: 232522 - DNA, 18 bp, Homo sapiens
caggctactggtttgtat

SEQ ID NO: 232523 - DNA, 18 bp, Homo sapiens
caggctagtccggaccca

SEQ ID NO: 232524 - DNA, 15 bp, Homo sapiens
caggctatttgttca

SEQ ID NO: 232525 - DNA, 16 bp, Homo sapiens
caggctcccctgcccg

SEQ ID NO: 232526 - DNA, 17 bp, Homo sapiens
caggctcccctgcccgc

SEQ ID NO: 232527 - DNA, 16 bp, Homo sapiens
caggctcccctggtct

SEQ ID NO: 232528 - DNA, 17 bp, Homo sapiens
caggctcccctggtctc

SEQ ID NO: 232529 - DNA, 14 bp, Homo sapiens
caggctccgggctt

SEQ ID NO: 232530 - DNA, 12 bp, Homo sapiens
cagggctcccgg

SEQ ID NO: 232531 - DNA, 18 bp, Homo sapiens
cagggctccctcctggag

SEQ ID NO: 232532 - DNA, 17 bp, Homo sapiens
cagggctctaccaagac

SEQ ID NO: 232533 - DNA, 18 bp, Homo sapiens
cagggctctaccaagaca

SEQ ID NO: 232534 - DNA, 21 bp, Homo sapiens
cagggctgacacgtccacccc

SEQ ID NO: 232535 - DNA, 15 bp, Homo sapiens
cagggctgcccctgt

SEQ ID NO: 232536 - DNA, 23 bp, Homo sapiens
cagggctgcccctgtaggttgct

SEQ ID NO: 232537 - DNA, 19 bp, Homo sapiens
cagggctgggctctgtctt

SEQ ID NO: 232538 - DNA, 20 bp, Homo sapiens
cagggctggtgtggctgctc

SEQ ID NO: 232539 - DNA, 15 bp, Homo sapiens
cagggctgtgggtgg

SEQ ID NO: 232540 - DNA, 18 bp, Homo sapiens
cagggcttacctgtacac

SEQ ID NO: 232541 - DNA, 14 bp, Homo sapiens
caggggaaaatgaa

SEQ ID NO: 232542 - DNA, 20 bp, Homo sapiens
caggggactcagccctgagg

SEQ ID NO: 232543 - DNA, 21 bp, Homo sapiens
caggggactcagccctgaggt

SEQ ID NO: 232544 - DNA, 13 bp, Homo sapiens
caggggagccagg

SEQ ID NO: 232545 - DNA, 19 bp, Homo sapiens
caggggaggctgagacgca

SEQ ID NO: 232546 - DNA, 17 bp, Homo sapiens
caggggagtctgcttgt

SEQ ID NO: 232547 - DNA, 18 bp, Homo sapiens
caggggatactgaaaaat

SEQ ID NO: 232548 - DNA, 17 bp, Homo sapiens
caggggattgaagccct

SEQ ID NO: 232549 - DNA, 20 bp, Homo sapiens
caggggcacacttccccttg

SEQ ID NO: 232550 - DNA, 22 bp, Homo sapiens
caggggcacctatgagatggcc

SEQ ID NO: 232551 - DNA, 15 bp, Homo sapiens
caggggcagaaggag

SEQ ID NO: 232552 - DNA, 12 bp, Homo sapiens
caggggcaggcc

SEQ ID NO: 232553 - DNA, 13 bp, Homo sapiens
caggggcaggcct

SEQ ID NO: 232554 - DNA, 14 bp, Homo sapiens
caggggcaggcctg

SEQ ID NO: 232555 - DNA, 16 bp, Homo sapiens
caggggcaggcctggg

SEQ ID NO: 232556 - DNA, 17 bp, Homo sapiens
caggggcaggcctggga

SEQ ID NO: 232557 - DNA, 19 bp, Homo sapiens
caggggcccaggctcccct

SEQ ID NO: 232558 - DNA, 14 bp, Homo sapiens
caggggccccagat

SEQ ID NO: 232559 - DNA, 19 bp, Homo sapiens
caggggccccagatctgcc

SEQ ID NO: 232560 - DNA, 17 bp, Homo sapiens
caggggcccctcctctg

SEQ ID NO: 232561 - DNA, 19 bp, Homo sapiens
caggggcccctcctctgtg

SEQ ID NO: 232562 - DNA, 21 bp, Homo sapiens
caggggcccctcctctgtgct

SEQ ID NO: 232563 - DNA, 23 bp, Homo sapiens
caggggcccctcctctgtgctcc

SEQ ID NO: 232564 - DNA, 17 bp, Homo sapiens
caggggcccttgggaca

SEQ ID NO: 232565 - DNA, 17 bp, Homo sapiens
caggggcggggcaggaa

SEQ ID NO: 232566 - DNA, 21 bp, Homo sapiens
caggggctatcccttctcaga

SEQ ID NO: 232567 - DNA, 19 bp, Homo sapiens
caggggctctgcttcctca

SEQ ID NO: 232568 - DNA, 13 bp, Homo sapiens
caggggctgggca

SEQ ID NO: 232569 - DNA, 16 bp, Homo sapiens
caggggctgggcagag

SEQ ID NO: 232570 - DNA, 17 bp, Homo sapiens
caggggctttggaagct

SEQ ID NO: 232571 - DNA, 21 bp, Homo sapiens
caggggctttggaagctctgt

SEQ ID NO: 232572 - DNA, 13 bp, Homo sapiens
cagggggccaggt

SEQ ID NO: 232573 - DNA, 16 bp, Homo sapiens
cagggggccaggtgca

SEQ ID NO: 232574 - DNA, 18 bp, Homo sapiens
cagggggcctgcaggccc

SEQ ID NO: 232575 - DNA, 21 bp, Homo sapiens
cagggggcctttaaagactta

SEQ ID NO: 232576 - DNA, 13 bp, Homo sapiens
caggggggagaag

SEQ ID NO: 232577 - DNA, 21 bp, Homo sapiens
caggggggttgggttccagac

SEQ ID NO: 232578 - DNA, 14 bp, Homo sapiens
caggggtcacctcc

SEQ ID NO: 232579 - DNA, 18 bp, Homo sapiens
caggggtcaccttgagag

SEQ ID NO: 232580 - DNA, 20 bp, Homo sapiens
caggggtctccctgagcctg

SEQ ID NO: 232581 - DNA, 21 bp, Homo sapiens
caggggtctccctgagcctgc

SEQ ID NO: 232582 - DNA, 15 bp, Homo sapiens
caggggtgggaggct

SEQ ID NO: 232583 - DNA, 13 bp, Homo sapiens
caggggttcgaga

SEQ ID NO: 232584 - DNA, 15 bp, Homo sapiens
caggggttgcagtga

SEQ ID NO: 232585 - DNA, 14 bp, Homo sapiens
cagggtagaaaaag

SEQ ID NO: 232586 - DNA, 22 bp, Homo sapiens
cagggtagaattgtttggcaat

SEQ ID NO: 232587 - DNA, 22 bp, Homo sapiens
cagggtagacttggagctgtcc

SEQ ID NO: 232588 - DNA, 15 bp, Homo sapiens
cagggtagagcaaag

SEQ ID NO: 232589 - DNA, 18 bp, Homo sapiens
cagggtagagcaaaggag

SEQ ID NO: 232590 - DNA, 23 bp, Homo sapiens
cagggtagataacctgtacttca

SEQ ID NO: 232591 - DNA, 17 bp, Homo sapiens
cagggtagggggcctga

SEQ ID NO: 232592 - DNA, 17 bp, Homo sapiens
cagggtcagtgtatcta

SEQ ID NO: 232593 - DNA, 17 bp, Homo sapiens
cagggtcccatttctca

SEQ ID NO: 232594 - DNA, 16 bp, Homo sapiens
cagggtccgcaccagc

SEQ ID NO: 232595 - DNA, 17 bp, Homo sapiens
cagggtccgcaccagct

SEQ ID NO: 232596 - DNA, 15 bp, Homo sapiens
cagggtctcgtcagg

SEQ ID NO: 232597 - DNA, 17 bp, Homo sapiens
cagggtctcgtcaggag

SEQ ID NO: 232598 - DNA, 19 bp, Homo sapiens
cagggtctcgtcaggaggt

SEQ ID NO: 232599 - DNA, 21 bp, Homo sapiens
cagggtctgctctttctctgc

SEQ ID NO: 232600 - DNA, 23 bp, Homo sapiens
cagggtctgctctttctctgcca

SEQ ID NO: 232601 - DNA, 22 bp, Homo sapiens
cagggtcttccctacctcaggc

SEQ ID NO: 232602 - DNA, 18 bp, Homo sapiens
cagggtctttgtgtgctg

SEQ ID NO: 232603 - DNA, 19 bp, Homo sapiens
cagggtgagcagggccctc

SEQ ID NO: 232604 - DNA, 22 bp, Homo sapiens
cagggtgcagtgtgagtgtgat

SEQ ID NO: 232605 - DNA, 20 bp, Homo sapiens
cagggtgctccctcctcagt

SEQ ID NO: 232606 - DNA, 18 bp, Homo sapiens
cagggtgggatgagcctc

SEQ ID NO: 232607 - DNA, 20 bp, Homo sapiens
cagggtggggggtgacagtg

SEQ ID NO: 232608 - DNA, 16 bp, Homo sapiens
cagggtggtgctggga

SEQ ID NO: 232609 - DNA, 23 bp, Homo sapiens
cagggtgtgaggtttcacctccg

SEQ ID NO: 232610 - DNA, 15 bp, Homo sapiens
cagggtgttggaaga

SEQ ID NO: 232611 - DNA, 22 bp, Homo sapiens
cagtgctctcctaccccacctc

SEQ ID NO: 232612 - DNA, 19 bp, Homo sapiens
cagtgctgaccccaggaag

SEQ ID NO: 232613 - DNA, 12 bp, Homo sapiens
cagtgctgccat

SEQ ID NO: 232614 - DNA, 16 bp, Homo sapiens
cagtgctgccatgcca

SEQ ID NO: 232615 - DNA, 18 bp, Homo sapiens
cagtgctgccatgccact

SEQ ID NO: 232616 - DNA, 21 bp, Homo sapiens
cagtgctgccatgccactgcc

SEQ ID NO: 232617 - DNA, 14 bp, Homo sapiens
cagtgctgcttctc

SEQ ID NO: 232618 - DNA, 18 bp, Homo sapiens
cagtgctgcttctcttgg

SEQ ID NO: 232619 - DNA, 19 bp, Homo sapiens
cagtgctgcttctcttggg

SEQ ID NO: 232620 - DNA, 13 bp, Homo sapiens
cagtgctgggccc

SEQ ID NO: 232621 - DNA, 17 bp, Homo sapiens
cagtgctgggcccagcc

SEQ ID NO: 232622 - DNA, 18 bp, Homo sapiens
cagtgctgggcccagccg

SEQ ID NO: 232623 - DNA, 18 bp, Homo sapiens
cagtgcttaatgtgaact

SEQ ID NO: 232624 - DNA, 14 bp, Homo sapiens
cagtgcttggctgc

SEQ ID NO: 232625 - DNA, 18 bp, Homo sapiens
cagtgcttggctgcccca

SEQ ID NO: 232626 - DNA, 19 bp, Homo sapiens
cagtgcttggctgccccac

SEQ ID NO: 232627 - DNA, 12 bp, Homo sapiens
cagtgcttgtaa

SEQ ID NO: 232628 - DNA, 18 bp, Homo sapiens
cagtggacagagggagaa

SEQ ID NO: 232629 - DNA, 17 bp, Homo sapiens
cagtggactttccaccc

SEQ ID NO: 232630 - DNA, 13 bp, Homo sapiens
cagtggagaatta

SEQ ID NO: 232631 - DNA, 20 bp, Homo sapiens
cagtggcacgatctcagctc

SEQ ID NO: 232632 - DNA, 15 bp, Homo sapiens
cagtggcagcaaagg

SEQ ID NO: 232633 - DNA, 18 bp, Homo sapiens
cagtggcagcaaaggaag

SEQ ID NO: 232634 - DNA, 11 bp, Homo sapiens
cagtggccagg

SEQ ID NO: 232635 - DNA, 12 bp, Homo sapiens
cagtggccaggc

SEQ ID NO: 232636 - DNA, 20 bp, Homo sapiens
cagtggccgaaccccccact

SEQ ID NO: 232637 - DNA, 13 bp, Homo sapiens
cagtggcctggct

SEQ ID NO: 232638 - DNA, 14 bp, Homo sapiens
cagtggcctggctc

SEQ ID NO: 232639 - DNA, 13 bp, Homo sapiens
cagtggctctcca

SEQ ID NO: 232640 - DNA, 12 bp, Homo sapiens
cagtggctgggt

SEQ ID NO: 232641 - DNA, 20 bp, Homo sapiens
cagtggctgggtgggcccag

SEQ ID NO: 232642 - DNA, 18 bp, Homo sapiens
cagtggctggtttctgag

SEQ ID NO: 232643 - DNA, 20 bp, Homo sapiens
cagtggcttggagcagaggt

SEQ ID NO: 232644 - DNA, 18 bp, Homo sapiens
cagtgggaatgcagtggg

SEQ ID NO: 232645 - DNA, 16 bp, Homo sapiens
cagtgggacagggcat

SEQ ID NO: 232646 - DNA, 16 bp, Homo sapiens
cagtgggagactaaga

SEQ ID NO: 232647 - DNA, 16 bp, Homo sapiens
cagtgggagccctgac

SEQ ID NO: 232648 - DNA, 12 bp, Homo sapiens
cagtgggccggc

SEQ ID NO: 232649 - DNA, 23 bp, Homo sapiens
cagtgggccggccccaggctccc

SEQ ID NO: 232650 - DNA, 13 bp, Homo sapiens
cagtggggcccat

SEQ ID NO: 232651 - DNA, 14 bp, Homo sapiens
cagtggggcccatg

SEQ ID NO: 232652 - DNA, 15 bp, Homo sapiens
cagtggggcccatgg

SEQ ID NO: 232653 - DNA, 17 bp, Homo sapiens
cagtggggcccatggcc

SEQ ID NO: 232654 - DNA, 23 bp, Homo sapiens
cagtggggcccatggccccagct

SEQ ID NO: 232655 - DNA, 13 bp, Homo sapiens
cagtggggctggg

SEQ ID NO: 232656 - DNA, 14 bp, Homo sapiens
cagtggggtctcag

SEQ ID NO: 232657 - DNA, 17 bp, Homo sapiens
cagtgggtggcacctcc

SEQ ID NO: 232658 - DNA, 20 bp, Homo sapiens
cagtgggtggcacctcctga

SEQ ID NO: 232659 - DNA, 23 bp, Homo sapiens
cagtgggtggcacctcctgagaa

SEQ ID NO: 232660 - DNA, 21 bp, Homo sapiens
cagtgtagccccaagaaggct

SEQ ID NO: 232661 - DNA, 23 bp, Homo sapiens
cagtgtatctcgaagtcttccat

SEQ ID NO: 232662 - DNA, 14 bp, Homo sapiens
cagtgtattttaaa

SEQ ID NO: 232663 - DNA, 18 bp, Homo sapiens
cagtgtcaagttgtgctt

SEQ ID NO: 232664 - DNA, 21 bp, Homo sapiens
cagtgtcattttattttttcc

SEQ ID NO: 232665 - DNA, 23 bp, Homo sapiens
cagtgtcattttattttttccct

SEQ ID NO: 232666 - DNA, 13 bp, Homo sapiens
cagtgtccccagg

SEQ ID NO: 232667 - DNA, 13 bp, Homo sapiens
cagtgtcctcagg

SEQ ID NO: 232668 - DNA, 15 bp, Homo sapiens
cagtgtcctcatcta

SEQ ID NO: 232669 - DNA, 21 bp, Homo sapiens
cagtgtcctgtgctttctgca

SEQ ID NO: 232670 - DNA, 19 bp, Homo sapiens
cagtgtcgccgtccctctg

SEQ ID NO: 232671 - DNA, 20 bp, Homo sapiens
cagtgtcgccgtccctctgc

SEQ ID NO: 232672 - DNA, 23 bp, Homo sapiens
cagtgtcgccgtccctctgcctt

SEQ ID NO: 232673 - DNA, 20 bp, Homo sapiens
cagtgtctgaaccaccctgg

SEQ ID NO: 232674 - DNA, 24 bp, Homo sapiens
cagtgtctgtatcggagacagtga

SEQ ID NO: 232675 - DNA, 21 bp, Homo sapiens
cagtgtctgtgccatggattt

SEQ ID NO: 232676 - DNA, 16 bp, Homo sapiens
cagtgtcttccataat

SEQ ID NO: 232677 - DNA, 20 bp, Homo sapiens
cagtgtcttccataatgtat

SEQ ID NO: 232678 - DNA, 12 bp, Homo sapiens
cagtgtgaagcc

SEQ ID NO: 232679 - DNA, 16 bp, Homo sapiens
cagtgtgaagcctgtc

SEQ ID NO: 232680 - DNA, 14 bp, Homo sapiens
cagtgtgccaccct

SEQ ID NO: 232681 - DNA, 16 bp, Homo sapiens
cagtgtgccaccctct

SEQ ID NO: 232682 - DNA, 21 bp, Homo sapiens
cagtgtgccaccctctgcagg

SEQ ID NO: 232683 - DNA, 22 bp, Homo sapiens
cagtgtggactgggaagcatta

SEQ ID NO: 232684 - DNA, 17 bp, Homo sapiens
cagtgtggagaggggtg

SEQ ID NO: 232685 - DNA, 15 bp, Homo sapiens
cagtgtggtgggagg

SEQ ID NO: 232686 - DNA, 16 bp, Homo sapiens
cagtgtggtgggaggg

SEQ ID NO: 232687 - DNA, 23 bp, Homo sapiens
cagtgtgtctaaatttgaatgtt

SEQ ID NO: 232688 - DNA, 14 bp, Homo sapiens
cagtgtgtctcctg

SEQ ID NO: 232689 - DNA, 15 bp, Homo sapiens
cagtgttaaatgaaa

SEQ ID NO: 232690 - DNA, 16 bp, Homo sapiens
cagtgttaaatgaaat

SEQ ID NO: 232691 - DNA, 17 bp, Homo sapiens
cagtgttaaatgaaatt

SEQ ID NO: 232692 - DNA, 16 bp, Homo sapiens
cagtgttataaaatct

SEQ ID NO: 232693 - DNA, 19 bp, Homo sapiens
cagtgttcctcaccaataa

SEQ ID NO: 232694 - DNA, 23 bp, Homo sapiens
cagtgttcctcaccaataacttc

SEQ ID NO: 232695 - DNA, 15 bp, Homo sapiens
cagtgttcgcttggc

SEQ ID NO: 232696 - DNA, 16 bp, Homo sapiens
cagtgttcgcttggct

SEQ ID NO: 232697 - DNA, 23 bp, Homo sapiens
cagtgttcgcttggctccatgct

SEQ ID NO: 232698 - DNA, 22 bp, Homo sapiens
cagtgttctgagcccccacctg

SEQ ID NO: 232699 - DNA, 16 bp, Homo sapiens
cagtgttgcctcctcc

SEQ ID NO: 232700 - DNA, 19 bp, Homo sapiens
cagtgttgcctcctcccat

SEQ ID NO: 232701 - DNA, 21 bp, Homo sapiens
cagtgttgcctcctcccatcc

SEQ ID NO: 232702 - DNA, 14 bp, Homo sapiens
cagtgttgtttgta

SEQ ID NO: 232703 - DNA, 15 bp, Homo sapiens
cagtgttgtttgtaa

SEQ ID NO: 232704 - DNA, 17 bp, Homo sapiens
cagtgttgtttgtaaat

SEQ ID NO: 232705 - DNA, 19 bp, Homo sapiens
cagtgttgtttgtaaataa

SEQ ID NO: 232706 - DNA, 20 bp, Homo sapiens
cagtgttgtttgtaaataag

SEQ ID NO: 232707 - DNA, 21 bp, Homo sapiens
cagtgttgtttgtaaataaga

SEQ ID NO: 232708 - DNA, 13 bp, Homo sapiens
cagtgtttatgac

SEQ ID NO: 232709 - DNA, 17 bp, Homo sapiens
cagtgtttcccataatt

SEQ ID NO: 232710 - DNA, 18 bp, Homo sapiens
cagtgtttcccataattt

SEQ ID NO: 232711 - DNA, 21 bp, Homo sapiens
cagtgtttcccataattttct

SEQ ID NO: 232712 - DNA, 12 bp, Homo sapiens
cagtgtttgtat

SEQ ID NO: 232713 - DNA, 12 bp, Homo sapiens
cagttaaaatgt

SEQ ID NO: 232714 - DNA, 19 bp, Homo sapiens
catcaccaccacacccctg

SEQ ID NO: 232715 - DNA, 14 bp, Homo sapiens
catcactccctgga

SEQ ID NO: 232716 - DNA, 15 bp, Homo sapiens
catcactccctggat

SEQ ID NO: 232717 - DNA, 13 bp, Homo sapiens
catcactcggctg

SEQ ID NO: 232718 - DNA, 16 bp, Homo sapiens
catcactcggctgtgg

SEQ ID NO: 232719 - DNA, 17 bp, Homo sapiens
catcactgctgtccctc

SEQ ID NO: 232720 - DNA, 18 bp, Homo sapiens
catcactgctgtccctcc

SEQ ID NO: 232721 - DNA, 19 bp, Homo sapiens
catcactgctgtccctcct

SEQ ID NO: 232722 - DNA, 15 bp, Homo sapiens
catcacttttcagtg

SEQ ID NO: 232723 - DNA, 12 bp, Homo sapiens
catcagacctgt

SEQ ID NO: 232724 - DNA, 15 bp, Homo sapiens
catcagacctgtctt

SEQ ID NO: 232725 - DNA, 19 bp, Homo sapiens
catcagacctgtcttccaa

SEQ ID NO: 232726 - DNA, 20 bp, Homo sapiens
catcagaggcctagtcagcc

SEQ ID NO: 232727 - DNA, 12 bp, Homo sapiens
catcagcccctg

SEQ ID NO: 232728 - DNA, 17 bp, Homo sapiens
catcagcccctgctgct

SEQ ID NO: 232729 - DNA, 16 bp, Homo sapiens
catcagcctctggcca

SEQ ID NO: 232730 - DNA, 12 bp, Homo sapiens
catcagctccct

SEQ ID NO: 232731 - DNA, 14 bp, Homo sapiens
catcagctctctgc

SEQ ID NO: 232732 - DNA, 19 bp, Homo sapiens
catcagctctctgcaaaga

SEQ ID NO: 232733 - DNA, 16 bp, Homo sapiens
catcagcttaatttaa

SEQ ID NO: 232734 - DNA, 20 bp, Homo sapiens
catcagctttccctggctca

SEQ ID NO: 232735 - DNA, 22 bp, Homo sapiens
catcagctttccctggctcagg

SEQ ID NO: 232736 - DNA, 11 bp, Homo sapiens
catcaggcact

SEQ ID NO: 232737 - DNA, 23 bp, Homo sapiens
catcaggcactgcgccacctgct

SEQ ID NO: 232738 - DNA, 17 bp, Homo sapiens
catcaggcttggaatga

SEQ ID NO: 232739 - DNA, 19 bp, Homo sapiens
catcaggtgatccacctgc

SEQ ID NO: 232740 - DNA, 16 bp, Homo sapiens
catcaggttccatccc

SEQ ID NO: 232741 - DNA, 17 bp, Homo sapiens
catcaggttccatcccg

SEQ ID NO: 232742 - DNA, 22 bp, Homo sapiens
catcagtggcatggctccagtc

SEQ ID NO: 232743 - DNA, 22 bp, Homo sapiens
catcagtgttaaaaaatttttg

SEQ ID NO: 232744 - DNA, 17 bp, Homo sapiens
catcagttactggtttc

SEQ ID NO: 232745 - DNA, 17 bp, Homo sapiens
catcagttcccccagta

SEQ ID NO: 232746 - DNA, 12 bp, Homo sapiens
catcataaaata

SEQ ID NO: 232747 - DNA, 22 bp, Homo sapiens
catcatagaaggagagcccagg

SEQ ID NO: 232748 - DNA, 23 bp, Homo sapiens
catcatagaggatgatgtaatta

SEQ ID NO: 232749 - DNA, 22 bp, Homo sapiens
catcatcaggcttggaatgaat

SEQ ID NO: 232750 - DNA, 14 bp, Homo sapiens
catcatctctgcct

SEQ ID NO: 232751 - DNA, 17 bp, Homo sapiens
catcattataaacgtga

SEQ ID NO: 232752 - DNA, 13 bp, Homo sapiens
catccaacctctt

SEQ ID NO: 232753 - DNA, 16 bp, Homo sapiens
catccaaggcaaacaa

SEQ ID NO: 232754 - DNA, 13 bp, Homo sapiens
catccaatcctca

SEQ ID NO: 232755 - DNA, 19 bp, Homo sapiens
catccacacaacaccagga

SEQ ID NO: 232756 - DNA, 15 bp, Homo sapiens
catccacaggattcc

SEQ ID NO: 232757 - DNA, 15 bp, Homo sapiens
catccacagttgtca

SEQ ID NO: 232758 - DNA, 12 bp, Homo sapiens
catccaccacct

SEQ ID NO: 232759 - DNA, 15 bp, Homo sapiens
catccacccagtgct

SEQ ID NO: 232760 - DNA, 17 bp, Homo sapiens
catccacccagtgctgc

SEQ ID NO: 232761 - DNA, 20 bp, Homo sapiens
catccacccagtgctgccat

SEQ ID NO: 232762 - DNA, 21 bp, Homo sapiens
catccacccagtgctgccatg

SEQ ID NO: 232763 - DNA, 22 bp, Homo sapiens
catccacccagtgctgccatgc

SEQ ID NO: 232764 - DNA, 13 bp, Homo sapiens
catccacgccaag

SEQ ID NO: 232765 - DNA, 15 bp, Homo sapiens
catccactctaccct

SEQ ID NO: 232766 - DNA, 14 bp, Homo sapiens
catccagcatgtgt

SEQ ID NO: 232767 - DNA, 20 bp, Homo sapiens
catccagcatgtgtgtgtct

SEQ ID NO: 232768 - DNA, 13 bp, Homo sapiens
catccagcctgtg

SEQ ID NO: 232769 - DNA, 15 bp, Homo sapiens
catccagcctgtgtg

SEQ ID NO: 232770 - DNA, 20 bp, Homo sapiens
catccaggcctgaggctgct

SEQ ID NO: 232771 - DNA, 15 bp, Homo sapiens
catccagtggggtct

SEQ ID NO: 232772 - DNA, 15 bp, Homo sapiens
catccatcagctccc

SEQ ID NO: 232773 - DNA, 14 bp, Homo sapiens
catccatctccagg

SEQ ID NO: 232774 - DNA, 15 bp, Homo sapiens
catccatctgtggaa

SEQ ID NO: 232775 - DNA, 21 bp, Homo sapiens
catccatgcggccggcctggg

SEQ ID NO: 232776 - DNA, 18 bp, Homo sapiens
catccatggagcacgagg

SEQ ID NO: 232777 - DNA, 18 bp, Homo sapiens
catccatgtttgtaaaac

SEQ ID NO: 232778 - DNA, 19 bp, Homo sapiens
catccatgtttgtaaaact

SEQ ID NO: 232779 - DNA, 14 bp, Homo sapiens
catcccaacagcca

SEQ ID NO: 232780 - DNA, 18 bp, Homo sapiens
catcccactccctttccc

SEQ ID NO: 232781 - DNA, 22 bp, Homo sapiens
catcccactgatatcacgggcc

SEQ ID NO: 232782 - DNA, 15 bp, Homo sapiens
catcccactggatct

SEQ ID NO: 232783 - DNA, 12 bp, Homo sapiens
catcccagcacc

SEQ ID NO: 232784 - DNA, 14 bp, Homo sapiens
catcccagcacctg

SEQ ID NO: 232785 - DNA, 18 bp, Homo sapiens
catcccagcacctgccag

SEQ ID NO: 232786 - DNA, 15 bp, Homo sapiens
catcccagcctgtgg

SEQ ID NO: 232787 - DNA, 16 bp, Homo sapiens
catcccagcctgtggt

SEQ ID NO: 232788 - DNA, 21 bp, Homo sapiens
catcccaggaggggcctctga

SEQ ID NO: 232789 - DNA, 14 bp, Homo sapiens
catccccaactcca

SEQ ID NO: 232790 - DNA, 12 bp, Homo sapiens
catccccaccag

SEQ ID NO: 232791 - DNA, 15 bp, Homo sapiens
catccccaccagctc

SEQ ID NO: 232792 - DNA, 21 bp, Homo sapiens
catccccaggggtcccagcca

SEQ ID NO: 232793 - DNA, 14 bp, Homo sapiens
catccccagttggg

SEQ ID NO: 232794 - DNA, 14 bp, Homo sapiens
catcccccaaagtt

SEQ ID NO: 232795 - DNA, 19 bp, Homo sapiens
catccccctccaaagtctt

SEQ ID NO: 232796 - DNA, 15 bp, Homo sapiens
catccccctccttgc

SEQ ID NO: 232797 - DNA, 16 bp, Homo sapiens
catccccgctggctgg

SEQ ID NO: 232798 - DNA, 14 bp, Homo sapiens
catcccctccctgc

SEQ ID NO: 232799 - DNA, 18 bp, Homo sapiens
catcccctcgtcctgtcc

SEQ ID NO: 232800 - DNA, 19 bp, Homo sapiens
catcccctcgtcctgtccc

SEQ ID NO: 232801 - DNA, 21 bp, Homo sapiens
catcccggcctcttccaccca

SEQ ID NO: 232802 - DNA, 18 bp, Homo sapiens
catccctaagaattccca

SEQ ID NO: 232803 - DNA, 12 bp, Homo sapiens
catccctacccc

SEQ ID NO: 232804 - DNA, 14 bp, Homo sapiens
catccctaccccct

SEQ ID NO: 232805 - DNA, 19 bp, Homo sapiens
catccctcggaagccgtct

SEQ ID NO: 232806 - DNA, 18 bp, Homo sapiens
catccctgccaagaactc

SEQ ID NO: 232807 - DNA, 18 bp, Homo sapiens
catccctgcttgcccgct

SEQ ID NO: 232808 - DNA, 13 bp, Homo sapiens
catccgcctctga

SEQ ID NO: 232809 - DNA, 23 bp, Homo sapiens
catccggcatgagggctgagatg

SEQ ID NO: 232810 - DNA, 16 bp, Homo sapiens
catccggcccccagag

SEQ ID NO: 232811 - DNA, 22 bp, Homo sapiens
catccgtaccatcggtcagcag

SEQ ID NO: 232812 - DNA, 13 bp, Homo sapiens
catccgtcaccag

SEQ ID NO: 232813 - DNA, 14 bp, Homo sapiens
catcctaaatattg

SEQ ID NO: 232814 - DNA, 14 bp, Homo sapiens
catcctaccaatgc

SEQ ID NO: 232815 - DNA, 18 bp, Homo sapiens
catcctaccaatgcatgc

SEQ ID NO: 232816 - DNA, 13 bp, Homo sapiens
catcctcagcaag

SEQ ID NO: 232817 - DNA, 11 bp, Homo sapiens
catcctcagcc

SEQ ID NO: 232818 - DNA, 14 bp, Homo sapiens
catcctcagcccca

SEQ ID NO: 232819 - DNA, 17 bp, Homo sapiens
catcctcagccccaggg

SEQ ID NO: 232820 - DNA, 20 bp, Homo sapiens
catcctcagccccagggccc

SEQ ID NO: 232821 - DNA, 22 bp, Homo sapiens
catcctcagccccagggccctg

SEQ ID NO: 232822 - DNA, 12 bp, Homo sapiens
catcttgtcttt

SEQ ID NO: 232823 - DNA, 22 bp, Homo sapiens
catctttatcattaaacatgaa

SEQ ID NO: 232824 - DNA, 21 bp, Homo sapiens
catctttcatagttctgttaa

SEQ ID NO: 232825 - DNA, 12 bp, Homo sapiens
catctttccaaa

SEQ ID NO: 232826 - DNA, 18 bp, Homo sapiens
catctttcccaaaaccca

SEQ ID NO: 232827 - DNA, 16 bp, Homo sapiens
catctttcctttgctc

SEQ ID NO: 232828 - DNA, 19 bp, Homo sapiens
catctttcctttgctctgg

SEQ ID NO: 232829 - DNA, 19 bp, Homo sapiens
catctttctaatctttttc

SEQ ID NO: 232830 - DNA, 22 bp, Homo sapiens
catctttgccttgggctgctcc

SEQ ID NO: 232831 - DNA, 15 bp, Homo sapiens
catcttttctacttc

SEQ ID NO: 232832 - DNA, 21 bp, Homo sapiens
catcttttgaggcttctgttc

SEQ ID NO: 232833 - DNA, 14 bp, Homo sapiens
catcttttgggaag

SEQ ID NO: 232834 - DNA, 15 bp, Homo sapiens
catcttttgggaagc

SEQ ID NO: 232835 - DNA, 21 bp, Homo sapiens
catctttttaacctgcaaaat

SEQ ID NO: 232836 - DNA, 20 bp, Homo sapiens
catctttttcccctatcctg

SEQ ID NO: 232837 - DNA, 19 bp, Homo sapiens
catgaaaaacacggcagct

SEQ ID NO: 232838 - DNA, 20 bp, Homo sapiens
catgaaaaacacggcagctg

SEQ ID NO: 232839 - DNA, 13 bp, Homo sapiens
catgaaaacattg

SEQ ID NO: 232840 - DNA, 17 bp, Homo sapiens
catgaaaacgttttatt

SEQ ID NO: 232841 - DNA, 19 bp, Homo sapiens
catgaaaacgttttattgt

SEQ ID NO: 232842 - DNA, 22 bp, Homo sapiens
catgaaaatcctaccaacctct

SEQ ID NO: 232843 - DNA, 13 bp, Homo sapiens
catgaaatatgca

SEQ ID NO: 232844 - DNA, 14 bp, Homo sapiens
catgaaatatgcat

SEQ ID NO: 232845 - DNA, 23 bp, Homo sapiens
catgaaatgccctcctaaatgtc

SEQ ID NO: 232846 - DNA, 17 bp, Homo sapiens
catgaacaaaatgaagt

SEQ ID NO: 232847 - DNA, 19 bp, Homo sapiens
catgaagaatgcattcaaa

SEQ ID NO: 232848 - DNA, 19 bp, Homo sapiens
catgaagccttgctgaact

SEQ ID NO: 232849 - DNA, 21 bp, Homo sapiens
catgaagctcagtttggctgt

SEQ ID NO: 232850 - DNA, 16 bp, Homo sapiens
catgaatccagtccag

SEQ ID NO: 232851 - DNA, 13 bp, Homo sapiens
catgaatgtaaat

SEQ ID NO: 232852 - DNA, 19 bp, Homo sapiens
catgaatgtaaatttgtac

SEQ ID NO: 232853 - DNA, 15 bp, Homo sapiens
catgaattttacatg

SEQ ID NO: 232854 - DNA, 16 bp, Homo sapiens
catgacaacttctaat

SEQ ID NO: 232855 - DNA, 15 bp, Homo sapiens
catgacaagccccag

SEQ ID NO: 232856 - DNA, 18 bp, Homo sapiens
catgacaagccccaggca

SEQ ID NO: 232857 - DNA, 19 bp, Homo sapiens
catgacaagccccaggcag

SEQ ID NO: 232858 - DNA, 14 bp, Homo sapiens
catgacagctgttc

SEQ ID NO: 232859 - DNA, 22 bp, Homo sapiens
catgacagtagcatactgatga

SEQ ID NO: 232860 - DNA, 15 bp, Homo sapiens
catgacatttctcaa

SEQ ID NO: 232861 - DNA, 17 bp, Homo sapiens
catgacatttctcaaag

SEQ ID NO: 232862 - DNA, 22 bp, Homo sapiens
catgacatttctcaaagttttt

SEQ ID NO: 232863 - DNA, 12 bp, Homo sapiens
catgaccactgg

SEQ ID NO: 232864 - DNA, 13 bp, Homo sapiens
catgaccactggg

SEQ ID NO: 232865 - DNA, 15 bp, Homo sapiens
catgaccactgggcc

SEQ ID NO: 232866 - DNA, 18 bp, Homo sapiens
catgaccagaagggaaac

SEQ ID NO: 232867 - DNA, 13 bp, Homo sapiens
catgaccaggcca

SEQ ID NO: 232868 - DNA, 19 bp, Homo sapiens
catgaccttttggcctttg

SEQ ID NO: 232869 - DNA, 16 bp, Homo sapiens
catgacgtgaatgtgt

SEQ ID NO: 232870 - DNA, 22 bp, Homo sapiens
catgactgagtctggcaaacat

SEQ ID NO: 232871 - DNA, 16 bp, Homo sapiens
catgactgcacccagc

SEQ ID NO: 232872 - DNA, 17 bp, Homo sapiens
catgactgcacccagct

SEQ ID NO: 232873 - DNA, 19 bp, Homo sapiens
catgactgcacccagctcc

SEQ ID NO: 232874 - DNA, 13 bp, Homo sapiens
catgactgcattt

SEQ ID NO: 232875 - DNA, 22 bp, Homo sapiens
catgactgccccttgcttctca

SEQ ID NO: 232876 - DNA, 13 bp, Homo sapiens
catgactggctgt

SEQ ID NO: 232877 - DNA, 16 bp, Homo sapiens
catgactggctgtctg

SEQ ID NO: 232878 - DNA, 13 bp, Homo sapiens
catgactgggcct

SEQ ID NO: 232879 - DNA, 17 bp, Homo sapiens
catgactgggcctccct

SEQ ID NO: 232880 - DNA, 20 bp, Homo sapiens
catgactgtgaccaccttct

SEQ ID NO: 232881 - DNA, 17 bp, Homo sapiens
catgagaagagggcctg

SEQ ID NO: 232882 - DNA, 21 bp, Homo sapiens
catgagaatgtcatttgctaa

SEQ ID NO: 232883 - DNA, 22 bp, Homo sapiens
catgagaatgtcatttgctaat

SEQ ID NO: 232884 - DNA, 19 bp, Homo sapiens
catgagattggtcattaaa

SEQ ID NO: 232885 - DNA, 21 bp, Homo sapiens
catgagcaccccaaggctgcg

SEQ ID NO: 232886 - DNA, 18 bp, Homo sapiens
catgagcacctccagctg

SEQ ID NO: 232887 - DNA, 13 bp, Homo sapiens
catgagcctgccc

SEQ ID NO: 232888 - DNA, 16 bp, Homo sapiens
catgagcctgcccgct

SEQ ID NO: 232889 - DNA, 22 bp, Homo sapiens
catgagctatttccattccaga

SEQ ID NO: 232890 - DNA, 14 bp, Homo sapiens
catgagctccagac

SEQ ID NO: 232891 - DNA, 23 bp, Homo sapiens
catgaggaacaaggcaaggctgt

SEQ ID NO: 232892 - DNA, 16 bp, Homo sapiens
catgagggctgagatg

SEQ ID NO: 232893 - DNA, 12 bp, Homo sapiens
catgagtcccag

SEQ ID NO: 232894 - DNA, 14 bp, Homo sapiens
catgagtcccagtg

SEQ ID NO: 232895 - DNA, 21 bp, Homo sapiens
catgagtggccttaataaata

SEQ ID NO: 232896 - DNA, 22 bp, Homo sapiens
catgagtttgccctggtttcac

SEQ ID NO: 232897 - DNA, 13 bp, Homo sapiens
catgataaaataa

SEQ ID NO: 232898 - DNA, 15 bp, Homo sapiens
catgataaaataagt

SEQ ID NO: 232899 - DNA, 23 bp, Homo sapiens
catgataaaataagtaacatata

SEQ ID NO: 232900 - DNA, 22 bp, Homo sapiens
catgatccagctgtgtgttttc

SEQ ID NO: 232901 - DNA, 16 bp, Homo sapiens
catgatgatttcagaa

SEQ ID NO: 232902 - DNA, 18 bp, Homo sapiens
catgatgctcatgactta

SEQ ID NO: 232903 - DNA, 14 bp, Homo sapiens
catgatgtctgcaa

SEQ ID NO: 232904 - DNA, 22 bp, Homo sapiens
catgatgtctgcaaaggagggc

SEQ ID NO: 232905 - DNA, 12 bp, Homo sapiens
catgatgtggag

SEQ ID NO: 232906 - DNA, 14 bp, Homo sapiens
catgattagacaat

SEQ ID NO: 232907 - DNA, 21 bp, Homo sapiens
catgattagacaatgtggaat

SEQ ID NO: 232908 - DNA, 12 bp, Homo sapiens
catgattagcaa

SEQ ID NO: 232909 - DNA, 15 bp, Homo sapiens
catgattccaagggc

SEQ ID NO: 232910 - DNA, 21 bp, Homo sapiens
catgattccaagggcccagag

SEQ ID NO: 232911 - DNA, 14 bp, Homo sapiens
catgattccttcct

SEQ ID NO: 232912 - DNA, 19 bp, Homo sapiens
catgattccttcctgttct

SEQ ID NO: 232913 - DNA, 19 bp, Homo sapiens
catgatttagggaagcagg

SEQ ID NO: 232914 - DNA, 22 bp, Homo sapiens
catgatttagggaagcagggac

SEQ ID NO: 232915 - DNA, 15 bp, Homo sapiens
catgattttggccac

SEQ ID NO: 232916 - DNA, 22 bp, Homo sapiens
catgcaaaccaggagcattttg

SEQ ID NO: 232917 - DNA, 21 bp, Homo sapiens
catgcaaagcaacgactactt

SEQ ID NO: 232918 - DNA, 14 bp, Homo sapiens
catgcaagctcagg

SEQ ID NO: 232919 - DNA, 11 bp, Homo sapiens
catgcaagtgg

SEQ ID NO: 232920 - DNA, 18 bp, Homo sapiens
catgcacaactctccaaa

SEQ ID NO: 232921 - DNA, 19 bp, Homo sapiens
catgcacacaaacacctcc

SEQ ID NO: 232922 - DNA, 13 bp, Homo sapiens
catgcactactga

SEQ ID NO: 232923 - DNA, 17 bp, Homo sapiens
catgcactcacaaagat

SEQ ID NO: 232924 - DNA, 18 bp, Homo sapiens
catgcagaaagggagcag

SEQ ID NO: 232925 - DNA, 18 bp, Homo sapiens
catgcagactcctcagat

SEQ ID NO: 232926 - DNA, 17 bp, Homo sapiens
catgcagataacagctg

SEQ ID NO: 232927 - DNA, 18 bp, Homo sapiens
catgcagatctagccagg

SEQ ID NO: 232928 - DNA, 22 bp, Homo sapiens
catgcagatctagccaggcctc

SEQ ID NO: 232929 - DNA, 19 bp, Homo sapiens
catgcagcccatgcccacc

SEQ ID NO: 232930 - DNA, 20 bp, Homo sapiens
catgcagcccatgcccacct

SEQ ID NO: 232931 - DNA, 22 bp, Homo sapiens
catgcagcccatgcccacctgc

SEQ ID NO: 232932 - DNA, 15 bp, Homo sapiens
catgcatggcctccc

SEQ ID NO: 232933 - DNA, 18 bp, Homo sapiens
catgcatggcctcccagc

SEQ ID NO: 232934 - DNA, 19 bp, Homo sapiens
catgcatggcctcccagcc

SEQ ID NO: 232935 - DNA, 19 bp, Homo sapiens
catgcatgttttatgtgca

SEQ ID NO: 232936 - DNA, 11 bp, Homo sapiens
catgcattgtt

SEQ ID NO: 232937 - DNA, 19 bp, Homo sapiens
catgcattttgcagcagtg

SEQ ID NO: 232938 - DNA, 20 bp, Homo sapiens
catgcattttgcagcagtga

SEQ ID NO: 232939 - DNA, 15 bp, Homo sapiens
catgccaccctcaca

SEQ ID NO: 232940 - DNA, 22 bp, Homo sapiens
catgccacgccccgtgtctgga

SEQ ID NO: 232941 - DNA, 14 bp, Homo sapiens
catgccactgccag

SEQ ID NO: 232942 - DNA, 17 bp, Homo sapiens
catgccactgccaggca

SEQ ID NO: 232943 - DNA, 18 bp, Homo sapiens
catgccactgccaggcac

SEQ ID NO: 232944 - DNA, 19 bp, Homo sapiens
catgccactgccaggcacc

SEQ ID NO: 232945 - DNA, 13 bp, Homo sapiens
catgccagcagca

SEQ ID NO: 232946 - DNA, 13 bp, Homo sapiens
catgccccttggc

SEQ ID NO: 232947 - DNA, 16 bp, Homo sapiens
catgccccttggctgg

SEQ ID NO: 232948 - DNA, 21 bp, Homo sapiens
catgccctgccaagcctggag

SEQ ID NO: 232949 - DNA, 20 bp, Homo sapiens
catgccctgccttgtccctc

SEQ ID NO: 232950 - DNA, 18 bp, Homo sapiens
catgccgcgggcggccag

SEQ ID NO: 232951 - DNA, 20 bp, Homo sapiens
catgccgcgggcggccaggc

SEQ ID NO: 232952 - DNA, 17 bp, Homo sapiens
catggtagactgtgaca

SEQ ID NO: 232953 - DNA, 20 bp, Homo sapiens
catggtataaggaaatatca

SEQ ID NO: 232954 - DNA, 20 bp, Homo sapiens
catggtccatttcatgtgat

SEQ ID NO: 232955 - DNA, 14 bp, Homo sapiens
catggtctcttcca

SEQ ID NO: 232956 - DNA, 11 bp, Homo sapiens
catggtgaaaa

SEQ ID NO: 232957 - DNA, 19 bp, Homo sapiens
catggtgaaaatgtactga

SEQ ID NO: 232958 - DNA, 13 bp, Homo sapiens
catggtgatgcaa

SEQ ID NO: 232959 - DNA, 19 bp, Homo sapiens
catggtgatgcaagtcact

SEQ ID NO: 232960 - DNA, 14 bp, Homo sapiens
catggtgcctctgg

SEQ ID NO: 232961 - DNA, 16 bp, Homo sapiens
catggtgcctctggag

SEQ ID NO: 232962 - DNA, 16 bp, Homo sapiens
catggtggcacgtgcc

SEQ ID NO: 232963 - DNA, 19 bp, Homo sapiens
catggtggggcatgcctgt

SEQ ID NO: 232964 - DNA, 17 bp, Homo sapiens
catggtgtgccacaggc

SEQ ID NO: 232965 - DNA, 15 bp, Homo sapiens
catggtgtgtgtctc

SEQ ID NO: 232966 - DNA, 22 bp, Homo sapiens
catggtgtttaaaatttaaatc

SEQ ID NO: 232967 - DNA, 16 bp, Homo sapiens
catggttccttccctg

SEQ ID NO: 232968 - DNA, 15 bp, Homo sapiens
catggtttaaagtca

SEQ ID NO: 232969 - DNA, 14 bp, Homo sapiens
catgtaaaacaaaa

SEQ ID NO: 232970 - DNA, 22 bp, Homo sapiens
catgtaaaacaaaaaacaatat

SEQ ID NO: 232971 - DNA, 16 bp, Homo sapiens
catgtaaaatcttcag

SEQ ID NO: 232972 - DNA, 18 bp, Homo sapiens
catgtaaaatcttcagct

SEQ ID NO: 232973 - DNA, 21 bp, Homo sapiens
catgtaaataccagactgcag

SEQ ID NO: 232974 - DNA, 22 bp, Homo sapiens
catgtaaataccagactgcagg

SEQ ID NO: 232975 - DNA, 15 bp, Homo sapiens
catgtaatattaaat

SEQ ID NO: 232976 - DNA, 19 bp, Homo sapiens
catgtaatattaaattcct

SEQ ID NO: 232977 - DNA, 20 bp, Homo sapiens
catgtacatgaagaagctaa

SEQ ID NO: 232978 - DNA, 16 bp, Homo sapiens
catgtaccagtgtact

SEQ ID NO: 232979 - DNA, 17 bp, Homo sapiens
catgtaccagtgtactg

SEQ ID NO: 232980 - DNA, 17 bp, Homo sapiens
catgtaccatcaataaa

SEQ ID NO: 232981 - DNA, 21 bp, Homo sapiens
catgtaccatcaataaagtac

SEQ ID NO: 232982 - DNA, 22 bp, Homo sapiens
catgtactgagccttgtaattc

SEQ ID NO: 232983 - DNA, 22 bp, Homo sapiens
catgtactgtagtttttcttca

SEQ ID NO: 232984 - DNA, 16 bp, Homo sapiens
catgtagaactcagca

SEQ ID NO: 232985 - DNA, 17 bp, Homo sapiens
catgtagaagagggaga

SEQ ID NO: 232986 - DNA, 18 bp, Homo sapiens
catgtagaagagggagaa

SEQ ID NO: 232987 - DNA, 20 bp, Homo sapiens
catgtaggttgtctaaaaat

SEQ ID NO: 232988 - DNA, 13 bp, Homo sapiens
catgtatagtgag

SEQ ID NO: 232989 - DNA, 22 bp, Homo sapiens
catgtatctctaatgaaattgt

SEQ ID NO: 232990 - DNA, 13 bp, Homo sapiens
catgtatgtggaa

SEQ ID NO: 232991 - DNA, 16 bp, Homo sapiens
catgtatgtggataca

SEQ ID NO: 232992 - DNA, 22 bp, Homo sapiens
catgtatgtggatacagtcatt

SEQ ID NO: 232993 - DNA, 18 bp, Homo sapiens
catgtattggcctggagg

SEQ ID NO: 232994 - DNA, 13 bp, Homo sapiens
catgtcaaagtga

SEQ ID NO: 232995 - DNA, 23 bp, Homo sapiens
catgtcaaagtgaaagacatttc

SEQ ID NO: 232996 - DNA, 13 bp, Homo sapiens
catgtcactgtgg

SEQ ID NO: 232997 - DNA, 14 bp, Homo sapiens
catgtcactgtggt

SEQ ID NO: 232998 - DNA, 17 bp, Homo sapiens
catgtccaagttcttca

SEQ ID NO: 232999 - DNA, 16 bp, Homo sapiens
catgtccctaccgagt

SEQ ID NO: 233000 - DNA, 23 bp, Homo sapiens
catgtccctaccgagtctcttct

SEQ ID NO: 233001 - DNA, 20 bp, Homo sapiens
catgtcggagtagaaattgt

SEQ ID NO: 233002 - DNA, 20 bp, Homo sapiens
catgtctctacccactatgc

SEQ ID NO: 233003 - DNA, 16 bp, Homo sapiens
catgtctctgcttcca

SEQ ID NO: 233004 - DNA, 17 bp, Homo sapiens
catgtctctgcttccat

SEQ ID NO: 233005 - DNA, 21 bp, Homo sapiens
catgtctttggcttcagaatt

SEQ ID NO: 233006 - DNA, 22 bp, Homo sapiens
catgtctttggcttcagaattg

SEQ ID NO: 233007 - DNA, 21 bp, Homo sapiens
catgtgaagcatgctttgctg

SEQ ID NO: 233008 - DNA, 20 bp, Homo sapiens
catgtgaattctgtgaagaa

SEQ ID NO: 233009 - DNA, 23 bp, Homo sapiens
catgtgactgtattacctattca

SEQ ID NO: 233010 - DNA, 17 bp, Homo sapiens
catgtgagccaccgctg

SEQ ID NO: 233011 - DNA, 23 bp, Homo sapiens
catgtgatctattactctgacat

SEQ ID NO: 233012 - DNA, 20 bp, Homo sapiens
catgtgattggcagcttcaa

SEQ ID NO: 233013 - DNA, 15 bp, Homo sapiens
catgtgcaactcttg

SEQ ID NO: 233014 - DNA, 18 bp, Homo sapiens
catgtgcaactcttgtat

SEQ ID NO: 233015 - DNA, 19 bp, Homo sapiens
catgtgcaactcttgtatt

SEQ ID NO: 233016 - DNA, 18 bp, Homo sapiens
catgtgccatctgtacat

SEQ ID NO: 233017 - DNA, 19 bp, Homo sapiens
catgtgccatctgtacata

SEQ ID NO: 233018 - DNA, 16 bp, Homo sapiens
catgtgcctgcaccag

SEQ ID NO: 233019 - DNA, 22 bp, Homo sapiens
catgtgcctgcaccaggagaca

SEQ ID NO: 233020 - DNA, 23 bp, Homo sapiens
catgtgcctgcaccaggagacag

SEQ ID NO: 233021 - DNA, 19 bp, Homo sapiens
catgtgctgtgaccattta

SEQ ID NO: 233022 - DNA, 23 bp, Homo sapiens
catgtgctgtgaccatttataat

SEQ ID NO: 233023 - DNA, 20 bp, Homo sapiens
catgtggaaagtgaatttga

SEQ ID NO: 233024 - DNA, 22 bp, Homo sapiens
catgtggaaagtgaatttgaat

SEQ ID NO: 233025 - DNA, 17 bp, Homo sapiens
catgtggcaaaatatgg

SEQ ID NO: 233026 - DNA, 12 bp, Homo sapiens
catgtggccaag

SEQ ID NO: 233027 - DNA, 17 bp, Homo sapiens
catgtggccccaggtgc

SEQ ID NO: 233028 - DNA, 15 bp, Homo sapiens
catgtggctgaagac

SEQ ID NO: 233029 - DNA, 14 bp, Homo sapiens
catgtggggaagca

SEQ ID NO: 233030 - DNA, 17 bp, Homo sapiens
catgtggggaagcaaga

SEQ ID NO: 233031 - DNA, 21 bp, Homo sapiens
catgtggggatgtttgtgctg

SEQ ID NO: 233032 - DNA, 17 bp, Homo sapiens
catgtgggtgaccaggt

SEQ ID NO: 233033 - DNA, 20 bp, Homo sapiens
catgtgggtgagccagtgga

SEQ ID NO: 233034 - DNA, 14 bp, Homo sapiens
catgtggtatgagt

SEQ ID NO: 233035 - DNA, 15 bp, Homo sapiens
catgtggtttataga

SEQ ID NO: 233036 - DNA, 22 bp, Homo sapiens
catgtgtatgagaagtactttg

SEQ ID NO: 233037 - DNA, 13 bp, Homo sapiens
catgtgtctgtat

SEQ ID NO: 233038 - DNA, 14 bp, Homo sapiens
catgtgtctgtatt

SEQ ID NO: 233039 - DNA, 23 bp, Homo sapiens
catgtgtctgtattcatacagca

SEQ ID NO: 233040 - DNA, 15 bp, Homo sapiens
catgtgtgagtgtgt

SEQ ID NO: 233041 - DNA, 21 bp, Homo sapiens
catgtgtgagtgtgtgcaagt

SEQ ID NO: 233042 - DNA, 12 bp, Homo sapiens
catgtgtgcctg

SEQ ID NO: 233043 - DNA, 16 bp, Homo sapiens
catgtgtgcctgtggc

SEQ ID NO: 233044 - DNA, 19 bp, Homo sapiens
catgtgtgcctgtggcaga

SEQ ID NO: 233045 - DNA, 17 bp, Homo sapiens
catgtgtgcgagtgtgt

SEQ ID NO: 233046 - DNA, 19 bp, Homo sapiens
catgtgtgcgagtgtgtgc

SEQ ID NO: 233047 - DNA, 13 bp, Homo sapiens
catgtgtgcgtgt

SEQ ID NO: 233048 - DNA, 18 bp, Homo sapiens
catgtgtggatgtgtaaa

SEQ ID NO: 233049 - DNA, 14 bp, Homo sapiens
catgtgtgtgtctc

SEQ ID NO: 233050 - DNA, 21 bp, Homo sapiens
catgtgttgcaaattattcta

SEQ ID NO: 233051 - DNA, 20 bp, Homo sapiens
catgtgttttaattccaata

SEQ ID NO: 233052 - DNA, 17 bp, Homo sapiens
catgttacctcctataa

SEQ ID NO: 233053 - DNA, 20 bp, Homo sapiens
catgttatatattttttgta

SEQ ID NO: 233054 - DNA, 20 bp, Homo sapiens
catgttctgagctataacat

SEQ ID NO: 233055 - DNA, 15 bp, Homo sapiens
catgttgttttttca

SEQ ID NO: 233056 - DNA, 21 bp, Homo sapiens
catgttgttttttcatagtgc

SEQ ID NO: 233057 - DNA, 13 bp, Homo sapiens
catgtttcatgtt

SEQ ID NO: 233058 - DNA, 16 bp, Homo sapiens
catgtttcatgttttg

SEQ ID NO: 233059 - DNA, 20 bp, Homo sapiens
catgtttccatcatttctgt

SEQ ID NO: 233060 - DNA, 18 bp, Homo sapiens
catgtttgtctgtgtgct

SEQ ID NO: 233061 - DNA, 20 bp, Homo sapiens
catgtttgtctgtgtgctgt

SEQ ID NO: 233062 - DNA, 22 bp, Homo sapiens
catgttttgaatgattgaagat

SEQ ID NO: 233063 - DNA, 14 bp, Homo sapiens
catgttttgctaat

SEQ ID NO: 233064 - DNA, 17 bp, Homo sapiens
catgtttttgttttctt

SEQ ID NO: 233065 - DNA, 12 bp, Homo sapiens
cattaaaaataa

SEQ ID NO: 233066 - DNA, 14 bp, Homo sapiens
cattaaaaataaaa

SEQ ID NO: 233067 - DNA, 17 bp, Homo sapiens
cattaaaaataaaagtt

SEQ ID NO: 233068 - DNA, 20 bp, Homo sapiens
cattaaaaataaaagttgta

SEQ ID NO: 233069 - DNA, 16 bp, Homo sapiens
cattaaaactgctttt

SEQ ID NO: 233070 - DNA, 23 bp, Homo sapiens
cattaaaacttaaccgcatcaga

SEQ ID NO: 233071 - DNA, 21 bp, Homo sapiens
cattaaaagttttatgtactt

SEQ ID NO: 233072 - DNA, 15 bp, Homo sapiens
cattaaacatgaatt

SEQ ID NO: 233073 - DNA, 13 bp, Homo sapiens
cattaaatccgca

SEQ ID NO: 233074 - DNA, 15 bp, Homo sapiens
cattaaatgctttga

SEQ ID NO: 233075 - DNA, 11 bp, Homo sapiens
cattaaatggt

SEQ ID NO: 233076 - DNA, 23 bp, Homo sapiens
cattaaatggtgatttcttgcta

SEQ ID NO: 233077 - DNA, 13 bp, Homo sapiens
cattaaatgtttg

SEQ ID NO: 233078 - DNA, 16 bp, Homo sapiens
cattaaccaaagaaag

SEQ ID NO: 233079 - DNA, 18 bp, Homo sapiens
cattaaccaaagaaagtg

SEQ ID NO: 233080 - DNA, 17 bp, Homo sapiens
cattaagaacaaggaat

SEQ ID NO: 233081 - DNA, 15 bp, Homo sapiens
catttctttttggga

SEQ ID NO: 233082 - DNA, 16 bp, Homo sapiens
catttgacacataaaa

SEQ ID NO: 233083 - DNA, 22 bp, Homo sapiens
catttgatgtctagataacatt

SEQ ID NO: 233084 - DNA, 20 bp, Homo sapiens
catttgatttcgatgtacag

SEQ ID NO: 233085 - DNA, 13 bp, Homo sapiens
catttgcagctgc

SEQ ID NO: 233086 - DNA, 18 bp, Homo sapiens
catttgcagctgctggtt

SEQ ID NO: 233087 - DNA, 14 bp, Homo sapiens
catttgccatgctg

SEQ ID NO: 233088 - DNA, 15 bp, Homo sapiens
catttgccatgctgc

SEQ ID NO: 233089 - DNA, 22 bp, Homo sapiens
catttgccccaacttaagttta

SEQ ID NO: 233090 - DNA, 23 bp, Homo sapiens
catttgcgcacaacttaaaaagt

SEQ ID NO: 233091 - DNA, 19 bp, Homo sapiens
catttgctgaatatgcaat

SEQ ID NO: 233092 - DNA, 15 bp, Homo sapiens
catttgctttttgct

SEQ ID NO: 233093 - DNA, 20 bp, Homo sapiens
catttggaaaccatgcacta

SEQ ID NO: 233094 - DNA, 21 bp, Homo sapiens
catttggatcctgtgtggaga

SEQ ID NO: 233095 - DNA, 15 bp, Homo sapiens
catttggattggatg

SEQ ID NO: 233096 - DNA, 18 bp, Homo sapiens
catttgggactgtcttga

SEQ ID NO: 233097 - DNA, 23 bp, Homo sapiens
catttggggcctttcccattggt

SEQ ID NO: 233098 - DNA, 15 bp, Homo sapiens
catttgggtaaatca

SEQ ID NO: 233099 - DNA, 16 bp, Homo sapiens
catttgggtaaatcat

SEQ ID NO: 233100 - DNA, 20 bp, Homo sapiens
catttggtcaagattttgaa

SEQ ID NO: 233101 - DNA, 14 bp, Homo sapiens
catttggtggctct

SEQ ID NO: 233102 - DNA, 16 bp, Homo sapiens
catttggttcttctga

SEQ ID NO: 233103 - DNA, 15 bp, Homo sapiens
catttgtaaatatta

SEQ ID NO: 233104 - DNA, 16 bp, Homo sapiens
catttgtaaatattaa

SEQ ID NO: 233105 - DNA, 13 bp, Homo sapiens
catttgtaataaa

SEQ ID NO: 233106 - DNA, 15 bp, Homo sapiens
catttgtaatgtatc

SEQ ID NO: 233107 - DNA, 22 bp, Homo sapiens
catttgtaatgtatcttattta

SEQ ID NO: 233108 - DNA, 23 bp, Homo sapiens
catttgtaatgtatcttatttat

SEQ ID NO: 233109 - DNA, 23 bp, Homo sapiens
catttgtaatttttttctagttg

SEQ ID NO: 233110 - DNA, 17 bp, Homo sapiens
catttgtacattcctga

SEQ ID NO: 233111 - DNA, 14 bp, Homo sapiens
catttgtatgttgt

SEQ ID NO: 233112 - DNA, 11 bp, Homo sapiens
catttgtgagg

SEQ ID NO: 233113 - DNA, 13 bp, Homo sapiens
catttgtgcataa

SEQ ID NO: 233114 - DNA, 20 bp, Homo sapiens
catttgtgcataaatttcca

SEQ ID NO: 233115 - DNA, 22 bp, Homo sapiens
catttgtgtttcagaaaggagt

SEQ ID NO: 233116 - DNA, 14 bp, Homo sapiens
catttgttcattaa

SEQ ID NO: 233117 - DNA, 13 bp, Homo sapiens
cattttaaataaa

SEQ ID NO: 233118 - DNA, 15 bp, Homo sapiens
cattttaaataaaag

SEQ ID NO: 233119 - DNA, 15 bp, Homo sapiens
cattttaagaaaacc

SEQ ID NO: 233120 - DNA, 16 bp, Homo sapiens
cattttactgtacaga

SEQ ID NO: 233121 - DNA, 22 bp, Homo sapiens
cattttactttttcctggctca

SEQ ID NO: 233122 - DNA, 17 bp, Homo sapiens
cattttagacagtaagt

SEQ ID NO: 233123 - DNA, 15 bp, Homo sapiens
cattttatcagacaa

SEQ ID NO: 233124 - DNA, 11 bp, Homo sapiens
cattttattac

SEQ ID NO: 233125 - DNA, 20 bp, Homo sapiens
cattttcagcatcaaacatg

SEQ ID NO: 233126 - DNA, 22 bp, Homo sapiens
cattttcagcatcaaacatgaa

SEQ ID NO: 233127 - DNA, 16 bp, Homo sapiens
cattttcagtaccaaa

SEQ ID NO: 233128 - DNA, 20 bp, Homo sapiens
cattttccacggaaacagaa

SEQ ID NO: 233129 - DNA, 15 bp, Homo sapiens
cattttccccccact

SEQ ID NO: 233130 - DNA, 17 bp, Homo sapiens
cattttccccccactct

SEQ ID NO: 233131 - DNA, 22 bp, Homo sapiens
cattttccccccactctcccca

SEQ ID NO: 233132 - DNA, 22 bp, Homo sapiens
cattttcctcgcctaggcctgt

SEQ ID NO: 233133 - DNA, 21 bp, Homo sapiens
cattttcgctttcctctggtt

SEQ ID NO: 233134 - DNA, 15 bp, Homo sapiens
cattttctaaactgt

SEQ ID NO: 233135 - DNA, 10 bp, Homo sapiens
cattttctgg

SEQ ID NO: 233136 - DNA, 14 bp, Homo sapiens
cattttgaatgtga

SEQ ID NO: 233137 - DNA, 20 bp, Homo sapiens
cattttgaatgtgatcatct

SEQ ID NO: 233138 - DNA, 14 bp, Homo sapiens
cattttgcaaaatt

SEQ ID NO: 233139 - DNA, 22 bp, Homo sapiens
cattttgcagcagtgagtctct

SEQ ID NO: 233140 - DNA, 18 bp, Homo sapiens
cattttgccacctttcct

SEQ ID NO: 233141 - DNA, 16 bp, Homo sapiens
cattttgcgatgtgtt

SEQ ID NO: 233142 - DNA, 17 bp, Homo sapiens
cattttgcgatgtgttt

SEQ ID NO: 233143 - DNA, 21 bp, Homo sapiens
cattttggcgctattacaaat

SEQ ID NO: 233144 - DNA, 15 bp, Homo sapiens
cattttgtatgtatg

SEQ ID NO: 233145 - DNA, 16 bp, Homo sapiens
cattttgtctggctgt

SEQ ID NO: 233146 - DNA, 14 bp, Homo sapiens
ccaactgctgcccc

SEQ ID NO: 233147 - DNA, 17 bp, Homo sapiens
ccaactgggcccaagac

SEQ ID NO: 233148 - DNA, 17 bp, Homo sapiens
ccaacttgtaaatacac

SEQ ID NO: 233149 - DNA, 23 bp, Homo sapiens
ccaacttgtattaaagacagagg

SEQ ID NO: 233150 - DNA, 12 bp, Homo sapiens
ccaactttccag

SEQ ID NO: 233151 - DNA, 17 bp, Homo sapiens
ccaactttctgtaaact

SEQ ID NO: 233152 - DNA, 12 bp, Homo sapiens
ccaactttgtag

SEQ ID NO: 233153 - DNA, 14 bp, Homo sapiens
ccaacttttctatt

SEQ ID NO: 233154 - DNA, 11 bp, Homo sapiens
ccaagaaaaat

SEQ ID NO: 233155 - DNA, 14 bp, Homo sapiens
ccaagaacattatc

SEQ ID NO: 233156 - DNA, 16 bp, Homo sapiens
ccaagaactctgggca

SEQ ID NO: 233157 - DNA, 17 bp, Homo sapiens
ccaagaactgaaaacat

SEQ ID NO: 233158 - DNA, 15 bp, Homo sapiens
ccaagaactgcatgg

SEQ ID NO: 233159 - DNA, 14 bp, Homo sapiens
ccaagaagccctcc

SEQ ID NO: 233160 - DNA, 15 bp, Homo sapiens
ccaagaagccctcct

SEQ ID NO: 233161 - DNA, 13 bp, Homo sapiens
ccaagaaggctgg

SEQ ID NO: 233162 - DNA, 14 bp, Homo sapiens
ccaagaaggctggg

SEQ ID NO: 233163 - DNA, 17 bp, Homo sapiens
ccaagaagtgaggcctg

SEQ ID NO: 233164 - DNA, 19 bp, Homo sapiens
ccaagaatagatgctgact

SEQ ID NO: 233165 - DNA, 20 bp, Homo sapiens
ccaagaatagatgctgactg

SEQ ID NO: 233166 - DNA, 24 bp, Homo sapiens
ccaagacagatgccccagagctgt

SEQ ID NO: 233167 - DNA, 11 bp, Homo sapiens
ccaagacagtg

SEQ ID NO: 233168 - DNA, 22 bp, Homo sapiens
ccaagacagtggcagcaaagga

SEQ ID NO: 233169 - DNA, 17 bp, Homo sapiens
ccaagacataatgcact

SEQ ID NO: 233170 - DNA, 11 bp, Homo sapiens
ccaagacattg

SEQ ID NO: 233171 - DNA, 16 bp, Homo sapiens
ccaagacattgtcaat

SEQ ID NO: 233172 - DNA, 17 bp, Homo sapiens
ccaagacattgtcaata

SEQ ID NO: 233173 - DNA, 15 bp, Homo sapiens
ccaagacctgactca

SEQ ID NO: 233174 - DNA, 18 bp, Homo sapiens
ccaagacttggcaacaga

SEQ ID NO: 233175 - DNA, 20 bp, Homo sapiens
ccaagacttggcaacagaag

SEQ ID NO: 233176 - DNA, 20 bp, Homo sapiens
ccaagacttggtgtcctttc

SEQ ID NO: 233177 - DNA, 20 bp, Homo sapiens
ccaagagcagagtctgggcc

SEQ ID NO: 233178 - DNA, 21 bp, Homo sapiens
ccaagagcagagtctgggcct

SEQ ID NO: 233179 - DNA, 17 bp, Homo sapiens
ccaagaggctagcccca

SEQ ID NO: 233180 - DNA, 23 bp, Homo sapiens
ccaagagtatgagaaatacagtg

SEQ ID NO: 233181 - DNA, 21 bp, Homo sapiens
ccaagatcattctacaagtaa

SEQ ID NO: 233182 - DNA, 13 bp, Homo sapiens
ccaagatctataa

SEQ ID NO: 233183 - DNA, 14 bp, Homo sapiens
ccaagcaagtagct

SEQ ID NO: 233184 - DNA, 22 bp, Homo sapiens
ccaagcaagtagctttccacat

SEQ ID NO: 233185 - DNA, 23 bp, Homo sapiens
ccaagcagaggttgggaggccat

SEQ ID NO: 233186 - DNA, 18 bp, Homo sapiens
ccaagcagccagccagtc

SEQ ID NO: 233187 - DNA, 23 bp, Homo sapiens
ccaagccagggatggggccacag

SEQ ID NO: 233188 - DNA, 17 bp, Homo sapiens
ccaagcccaccctggga

SEQ ID NO: 233189 - DNA, 22 bp, Homo sapiens
ccaagcccgacttgctgttttg

SEQ ID NO: 233190 - DNA, 14 bp, Homo sapiens
ccaagccgtggctt

SEQ ID NO: 233191 - DNA, 16 bp, Homo sapiens
ccaagccgtggcttcc

SEQ ID NO: 233192 - DNA, 13 bp, Homo sapiens
ccaagcctgacca

SEQ ID NO: 233193 - DNA, 17 bp, Homo sapiens
ccaagcctgcagctttc

SEQ ID NO: 233194 - DNA, 14 bp, Homo sapiens
ccaagcctggagcc

SEQ ID NO: 233195 - DNA, 16 bp, Homo sapiens
ccaagcctggagcccc

SEQ ID NO: 233196 - DNA, 15 bp, Homo sapiens
ccaagcctgggccac

SEQ ID NO: 233197 - DNA, 11 bp, Homo sapiens
ccaagccttgg

SEQ ID NO: 233198 - DNA, 13 bp, Homo sapiens
ccaagcgttcctg

SEQ ID NO: 233199 - DNA, 17 bp, Homo sapiens
ccaagctcagagcagcc

SEQ ID NO: 233200 - DNA, 18 bp, Homo sapiens
ccaagctgctctccttca

SEQ ID NO: 233201 - DNA, 22 bp, Homo sapiens
ccaagctggagtgcagtggtgc

SEQ ID NO: 233202 - DNA, 19 bp, Homo sapiens
ccaagctgtacccttgaga

SEQ ID NO: 233203 - DNA, 22 bp, Homo sapiens
ccaagcttaaggagaggagagc

SEQ ID NO: 233204 - DNA, 16 bp, Homo sapiens
ccaagcttggcagccg

SEQ ID NO: 233205 - DNA, 18 bp, Homo sapiens
ccaagcttgtttccctgc

SEQ ID NO: 233206 - DNA, 15 bp, Homo sapiens
ccaaggacactgatg

SEQ ID NO: 233207 - DNA, 14 bp, Homo sapiens
ccaaggacccctca

SEQ ID NO: 233208 - DNA, 22 bp, Homo sapiens
ccaaggagaccaagtcctggct

SEQ ID NO: 233209 - DNA, 22 bp, Homo sapiens
ccaaggagctgatttccaggcc

SEQ ID NO: 233210 - DNA, 21 bp, Homo sapiens
ccaaggaggtgggccacaccc

SEQ ID NO: 233211 - DNA, 15 bp, Homo sapiens
ccaaggatcctctcc

SEQ ID NO: 233212 - DNA, 20 bp, Homo sapiens
ccaaggatcctctccactcc

SEQ ID NO: 233213 - DNA, 14 bp, Homo sapiens
ccaaggcaaatgtc

SEQ ID NO: 233214 - DNA, 22 bp, Homo sapiens
ccaaggcaaggggtgcctggga

SEQ ID NO: 233215 - DNA, 21 bp, Homo sapiens
ccaaggcagcctccagagcca

SEQ ID NO: 233216 - DNA, 11 bp, Homo sapiens
ccaaggcaggt

SEQ ID NO: 233217 - DNA, 19 bp, Homo sapiens
ccaaggcagtgttcctcac

SEQ ID NO: 233218 - DNA, 20 bp, Homo sapiens
ccaaggccagccacaccaca

SEQ ID NO: 233219 - DNA, 15 bp, Homo sapiens
ccaaggccgcccacc

SEQ ID NO: 233220 - DNA, 19 bp, Homo sapiens
ccaaggcctatgccacctg

SEQ ID NO: 233221 - DNA, 20 bp, Homo sapiens
ccaaggcctatgccacctgc

SEQ ID NO: 233222 - DNA, 16 bp, Homo sapiens
ccaaggcctcggcaga

SEQ ID NO: 233223 - DNA, 16 bp, Homo sapiens
ccaaggccttctcctc

SEQ ID NO: 233224 - DNA, 16 bp, Homo sapiens
ccaaggctctcccctc

SEQ ID NO: 233225 - DNA, 16 bp, Homo sapiens
ccaaggctctgagcaa

SEQ ID NO: 233226 - DNA, 19 bp, Homo sapiens
ccaagggaggcccatgtga

SEQ ID NO: 233227 - DNA, 13 bp, Homo sapiens
ccaagggcccaga

SEQ ID NO: 233228 - DNA, 15 bp, Homo sapiens
ccaagggcccagagg

SEQ ID NO: 233229 - DNA, 20 bp, Homo sapiens
ccaaggggcagtctggaggg

SEQ ID NO: 233230 - DNA, 23 bp, Homo sapiens
ccaaggtcccctccacatcccag

SEQ ID NO: 233231 - DNA, 16 bp, Homo sapiens
ccaaggtctaggtgga

SEQ ID NO: 233232 - DNA, 10 bp, Homo sapiens
ccaaggtgca

SEQ ID NO: 233233 - DNA, 22 bp, Homo sapiens
ccaaggtgctaaaaggaatagg

SEQ ID NO: 233234 - DNA, 23 bp, Homo sapiens
ccaaggtggtcttggagaggagg

SEQ ID NO: 233235 - DNA, 18 bp, Homo sapiens
ccaagtaccaatgctgtt

SEQ ID NO: 233236 - DNA, 20 bp, Homo sapiens
ccaagtcaaacagtgtggct

SEQ ID NO: 233237 - DNA, 17 bp, Homo sapiens
ccaagtcaacactcttc

SEQ ID NO: 233238 - DNA, 20 bp, Homo sapiens
ccaagtcaacactcttcttg

SEQ ID NO: 233239 - DNA, 21 bp, Homo sapiens
ccaagtcaacactcttcttga

SEQ ID NO: 233240 - DNA, 21 bp, Homo sapiens
ccaagtcagctttgccttcca

SEQ ID NO: 233241 - DNA, 21 bp, Homo sapiens
ccaagtcattaaaatggaagt

SEQ ID NO: 233242 - DNA, 14 bp, Homo sapiens
ccaagtcctgcctt

SEQ ID NO: 233243 - DNA, 15 bp, Homo sapiens
ccaagtcctgccttt

SEQ ID NO: 233244 - DNA, 16 bp, Homo sapiens
ccaagtcctgcctttg

SEQ ID NO: 233245 - DNA, 13 bp, Homo sapiens
ccaagtcttcctg

SEQ ID NO: 233246 - DNA, 14 bp, Homo sapiens
ccaagtcttcctga

SEQ ID NO: 233247 - DNA, 19 bp, Homo sapiens
ccaagtgcaggctggcacc

SEQ ID NO: 233248 - DNA, 20 bp, Homo sapiens
ccaagtgcatttttatctgt

SEQ ID NO: 233249 - DNA, 13 bp, Homo sapiens
ccaagtgccttcc

SEQ ID NO: 233250 - DNA, 18 bp, Homo sapiens
ccaagtggtcaggagttg

SEQ ID NO: 233251 - DNA, 12 bp, Homo sapiens
ccaagtgtgtgt

SEQ ID NO: 233252 - DNA, 16 bp, Homo sapiens
ccaagtgtgtgtgcaa

SEQ ID NO: 233253 - DNA, 15 bp, Homo sapiens
ccaagttataaatca

SEQ ID NO: 233254 - DNA, 22 bp, Homo sapiens
ccaagttatttgatctggtgcg

SEQ ID NO: 233255 - DNA, 16 bp, Homo sapiens
ccaagttcaaagaacc

SEQ ID NO: 233256 - DNA, 18 bp, Homo sapiens
ccaagttcttcacctcta

SEQ ID NO: 233257 - DNA, 19 bp, Homo sapiens
ccaagttcttcacctctat

SEQ ID NO: 233258 - DNA, 16 bp, Homo sapiens
ccaataaaacaagaat

SEQ ID NO: 233259 - DNA, 14 bp, Homo sapiens
ccaataaaagtgac

SEQ ID NO: 233260 - DNA, 12 bp, Homo sapiens
ccaataaagaat

SEQ ID NO: 233261 - DNA, 14 bp, Homo sapiens
ccaataaaggtccc

SEQ ID NO: 233262 - DNA, 20 bp, Homo sapiens
ccaataaaggtcccttagcc

SEQ ID NO: 233263 - DNA, 12 bp, Homo sapiens
ccaataaataat

SEQ ID NO: 233264 - DNA, 13 bp, Homo sapiens
ccaataaataata

SEQ ID NO: 233265 - DNA, 16 bp, Homo sapiens
ccaataaataatatta

SEQ ID NO: 233266 - DNA, 21 bp, Homo sapiens
ccaataacttcagagaagtca

SEQ ID NO: 233267 - DNA, 22 bp, Homo sapiens
ccaataataaaaaacaagaaac

SEQ ID NO: 233268 - DNA, 12 bp, Homo sapiens
ccaatagtcata

SEQ ID NO: 233269 - DNA, 17 bp, Homo sapiens
ccaatagttgctgtccc

SEQ ID NO: 233270 - DNA, 19 bp, Homo sapiens
ccaatagttgctgtcccct

SEQ ID NO: 233271 - DNA, 22 bp, Homo sapiens
ccaattatgtgacaacctttgt

SEQ ID NO: 233272 - DNA, 16 bp, Homo sapiens
ccaattccagagctgt

SEQ ID NO: 233273 - DNA, 23 bp, Homo sapiens
ccaattcctcatttgttcattaa

SEQ ID NO: 233274 - DNA, 16 bp, Homo sapiens
ccaattgccctgccag

SEQ ID NO: 233275 - DNA, 17 bp, Homo sapiens
ccaattgccctgccagg

SEQ ID NO: 233276 - DNA, 11 bp, Homo sapiens
ccaatttaagg

SEQ ID NO: 233277 - DNA, 14 bp, Homo sapiens
ccacaaaaataaaa

SEQ ID NO: 233278 - DNA, 15 bp, Homo sapiens
ccacaaactgcctgt

SEQ ID NO: 233279 - DNA, 18 bp, Homo sapiens
ccacaaagggtagcctgg

SEQ ID NO: 233280 - DNA, 20 bp, Homo sapiens
ccacaaatcaaagcaagggc

SEQ ID NO: 233281 - DNA, 12 bp, Homo sapiens
ccacaaatgtcc

SEQ ID NO: 233282 - DNA, 20 bp, Homo sapiens
ccacaaatgtcctcagaggg

SEQ ID NO: 233283 - DNA, 19 bp, Homo sapiens
ccacaactaacaatgcctt

SEQ ID NO: 233284 - DNA, 16 bp, Homo sapiens
ccacaagagctccttg

SEQ ID NO: 233285 - DNA, 19 bp, Homo sapiens
ccacaaggctgaaaagtgc

SEQ ID NO: 233286 - DNA, 20 bp, Homo sapiens
ccacaaggctgaaaagtgct

SEQ ID NO: 233287 - DNA, 12 bp, Homo sapiens
ccacaaggctgg

SEQ ID NO: 233288 - DNA, 16 bp, Homo sapiens
ccacaaggctggccag

SEQ ID NO: 233289 - DNA, 23 bp, Homo sapiens
ccacaatgatgattaaacacctg

SEQ ID NO: 233290 - DNA, 14 bp, Homo sapiens
ccacaatggctggg

SEQ ID NO: 233291 - DNA, 13 bp, Homo sapiens
ccacaattccatt

SEQ ID NO: 233292 - DNA, 17 bp, Homo sapiens
ccacacaacaccaggac

SEQ ID NO: 233293 - DNA, 14 bp, Homo sapiens
ccacacactcgccc

SEQ ID NO: 233294 - DNA, 13 bp, Homo sapiens
ccacacagcctgt

SEQ ID NO: 233295 - DNA, 20 bp, Homo sapiens
ccacacaggcctggcccagc

SEQ ID NO: 233296 - DNA, 23 bp, Homo sapiens
ccacacaggcctggcccagccag

SEQ ID NO: 233297 - DNA, 13 bp, Homo sapiens
ccacacagtgggc

SEQ ID NO: 233298 - DNA, 22 bp, Homo sapiens
ccacacagtgggccggccccag

SEQ ID NO: 233299 - DNA, 14 bp, Homo sapiens
ccacacatgcaagg

SEQ ID NO: 233300 - DNA, 22 bp, Homo sapiens
ccacaccacaggatctgaactt

SEQ ID NO: 233301 - DNA, 12 bp, Homo sapiens
ccacacccagga

SEQ ID NO: 233302 - DNA, 13 bp, Homo sapiens
ccacaccccagcc

SEQ ID NO: 233303 - DNA, 16 bp, Homo sapiens
ccacacccctgccggc

SEQ ID NO: 233304 - DNA, 19 bp, Homo sapiens
ccacacctcagttcccttg

SEQ ID NO: 233305 - DNA, 22 bp, Homo sapiens
ccacacctcagttcccttggcc

SEQ ID NO: 233306 - DNA, 14 bp, Homo sapiens
ccacacgccggggc

SEQ ID NO: 233307 - DNA, 14 bp, Homo sapiens
ccacacgctgccca

SEQ ID NO: 233308 - DNA, 22 bp, Homo sapiens
ccacactaacctgggttccctt

SEQ ID NO: 233309 - DNA, 12 bp, Homo sapiens
ccacactgacca

SEQ ID NO: 233310 - DNA, 23 bp, Homo sapiens
ccacactgctaggtgggccagcc

SEQ ID NO: 233311 - DNA, 22 bp, Homo sapiens
ccacacttcaggctcttctcct

SEQ ID NO: 233312 - DNA, 13 bp, Homo sapiens
ccacacttcctgt

SEQ ID NO: 233313 - DNA, 23 bp, Homo sapiens
ccacacttcttgaaacagcctgg

SEQ ID NO: 233314 - DNA, 17 bp, Homo sapiens
ccacacttgctggggct

SEQ ID NO: 233315 - DNA, 20 bp, Homo sapiens
ccacacttgttccagctctt

SEQ ID NO: 233316 - DNA, 18 bp, Homo sapiens
ccacactttcactgggga

SEQ ID NO: 233317 - DNA, 18 bp, Homo sapiens
ccacagaaaccctgtttt

SEQ ID NO: 233318 - DNA, 17 bp, Homo sapiens
ccacagaacctttgtca

SEQ ID NO: 233319 - DNA, 18 bp, Homo sapiens
ccacagaacctttgtcaa

SEQ ID NO: 233320 - DNA, 18 bp, Homo sapiens
ccacagaagacacgtgtt

SEQ ID NO: 233321 - DNA, 21 bp, Homo sapiens
ccacagaatacaagccactac

SEQ ID NO: 233322 - DNA, 11 bp, Homo sapiens
ccacagacaca

SEQ ID NO: 233323 - DNA, 22 bp, Homo sapiens
ccacagacgccacctggcggcc

SEQ ID NO: 233324 - DNA, 18 bp, Homo sapiens
ccacagaggacagtgctg

SEQ ID NO: 233325 - DNA, 19 bp, Homo sapiens
ccacagaggacagtgctga

SEQ ID NO: 233326 - DNA, 13 bp, Homo sapiens
ccacagagtataa

SEQ ID NO: 233327 - DNA, 17 bp, Homo sapiens
ccacagagtgtggtccc

SEQ ID NO: 233328 - DNA, 18 bp, Homo sapiens
ccacagagttactgccac

SEQ ID NO: 233329 - DNA, 22 bp, Homo sapiens
ccacagagttactgccacggtc

SEQ ID NO: 233330 - DNA, 22 bp, Homo sapiens
ccacagagtttgtagtaaatat

SEQ ID NO: 233331 - DNA, 17 bp, Homo sapiens
ccacagcagcctctgaa

SEQ ID NO: 233332 - DNA, 13 bp, Homo sapiens
ccacagccaagcc

SEQ ID NO: 233333 - DNA, 17 bp, Homo sapiens
ccacagccaagcccacc

SEQ ID NO: 233334 - DNA, 22 bp, Homo sapiens
ccacagccaagcccaccctggg

SEQ ID NO: 233335 - DNA, 14 bp, Homo sapiens
ccacagccacctcc

SEQ ID NO: 233336 - DNA, 15 bp, Homo sapiens
ccacagcccagccac

SEQ ID NO: 233337 - DNA, 19 bp, Homo sapiens
ccacagcccagccacggac

SEQ ID NO: 233338 - DNA, 13 bp, Homo sapiens
ccacagccctgtc

SEQ ID NO: 233339 - DNA, 18 bp, Homo sapiens
ccacagctacctgagacg

SEQ ID NO: 233340 - DNA, 13 bp, Homo sapiens
ccacagctgctgg

SEQ ID NO: 233341 - DNA, 14 bp, Homo sapiens
ccacagctgctgga

SEQ ID NO: 233342 - DNA, 16 bp, Homo sapiens
ccacagctgctggaga

SEQ ID NO: 233343 - DNA, 17 bp, Homo sapiens
ccacagctgctggagaa

SEQ ID NO: 233344 - DNA, 19 bp, Homo sapiens
ccacagcttggggccatcg

SEQ ID NO: 233345 - DNA, 23 bp, Homo sapiens
ccacaggaagccgcctagtgcag

SEQ ID NO: 233346 - DNA, 16 bp, Homo sapiens
ccacaggacacagtca

SEQ ID NO: 233347 - DNA, 22 bp, Homo sapiens
ccacaggaggcaagcaagctct

SEQ ID NO: 233348 - DNA, 16 bp, Homo sapiens
ccacaggatctgaact

SEQ ID NO: 233349 - DNA, 19 bp, Homo sapiens
ccacaggatctgaactttg

SEQ ID NO: 233350 - DNA, 22 bp, Homo sapiens
ccacaggcccttcctctccact

SEQ ID NO: 233351 - DNA, 14 bp, Homo sapiens
ccacaggctgcaag

SEQ ID NO: 233352 - DNA, 12 bp, Homo sapiens
ccacagggcctg

SEQ ID NO: 233353 - DNA, 15 bp, Homo sapiens
ccacagggcctgact

SEQ ID NO: 233354 - DNA, 16 bp, Homo sapiens
ccacagggcctgactt

SEQ ID NO: 233355 - DNA, 15 bp, Homo sapiens
ccacaggggcaggcc

SEQ ID NO: 233356 - DNA, 17 bp, Homo sapiens
ccacaggggcaggcctg

SEQ ID NO: 233357 - DNA, 19 bp, Homo sapiens
ccacaggggcaggcctggg

SEQ ID NO: 233358 - DNA, 24 bp, Homo sapiens
ccacaggggctatcccttctcaga

SEQ ID NO: 233359 - DNA, 17 bp, Homo sapiens
ccacagggtgggatgag

SEQ ID NO: 233360 - DNA, 22 bp, Homo sapiens
ccacagggttcaaaatgtctgt

SEQ ID NO: 233361 - DNA, 22 bp, Homo sapiens
ccacaggtgtccccagcccact

SEQ ID NO: 233362 - DNA, 13 bp, Homo sapiens
ccacagtgctgct

SEQ ID NO: 233363 - DNA, 15 bp, Homo sapiens
ccacagtgctgcttc

SEQ ID NO: 233364 - DNA, 19 bp, Homo sapiens
ccacatagtgatggttccc

SEQ ID NO: 233365 - DNA, 13 bp, Homo sapiens
ccacatccaaaca

SEQ ID NO: 233366 - DNA, 18 bp, Homo sapiens
ccacatccaacatttcct

SEQ ID NO: 233367 - DNA, 22 bp, Homo sapiens
ccacatccaacatttcctcagg

SEQ ID NO: 233368 - DNA, 20 bp, Homo sapiens
ccacatcccactggatctgg

SEQ ID NO: 233369 - DNA, 16 bp, Homo sapiens
ccacatcccagcagcc

SEQ ID NO: 233370 - DNA, 17 bp, Homo sapiens
ccacatcccagcagccc

SEQ ID NO: 233371 - DNA, 18 bp, Homo sapiens
ccacatcccagcagccca

SEQ ID NO: 233372 - DNA, 22 bp, Homo sapiens
ccacatccccaccctcccctct

SEQ ID NO: 233373 - DNA, 23 bp, Homo sapiens
ccacatccccgctggctgggggc

SEQ ID NO: 233374 - DNA, 20 bp, Homo sapiens
ccacatcctccgtccagccg

SEQ ID NO: 233375 - DNA, 13 bp, Homo sapiens
ccacatgagtccc

SEQ ID NO: 233376 - DNA, 18 bp, Homo sapiens
ccagccaaaccctgtctg

SEQ ID NO: 233377 - DNA, 19 bp, Homo sapiens
ccagccaaaccctgtctga

SEQ ID NO: 233378 - DNA, 21 bp, Homo sapiens
ccagccaacatttaatgagca

SEQ ID NO: 233379 - DNA, 22 bp, Homo sapiens
ccagccaacttttgcatgtttt

SEQ ID NO: 233380 - DNA, 16 bp, Homo sapiens
ccagccacccagccag

SEQ ID NO: 233381 - DNA, 21 bp, Homo sapiens
ccagccaccccgggctctctg

SEQ ID NO: 233382 - DNA, 22 bp, Homo sapiens
ccagccaccccgggctctctgc

SEQ ID NO: 233383 - DNA, 15 bp, Homo sapiens
ccagccaccttcctg

SEQ ID NO: 233384 - DNA, 21 bp, Homo sapiens
ccagccaccttcctgactggg

SEQ ID NO: 233385 - DNA, 13 bp, Homo sapiens
ccagccagcaggt

SEQ ID NO: 233386 - DNA, 13 bp, Homo sapiens
ccagccagccctt

SEQ ID NO: 233387 - DNA, 21 bp, Homo sapiens
ccagccagcccttcccaggcc

SEQ ID NO: 233388 - DNA, 14 bp, Homo sapiens
ccagccaggagggg

SEQ ID NO: 233389 - DNA, 17 bp, Homo sapiens
ccagccaggaggggctg

SEQ ID NO: 233390 - DNA, 16 bp, Homo sapiens
ccagccagtcttgcct

SEQ ID NO: 233391 - DNA, 20 bp, Homo sapiens
ccagccatgggccctctgag

SEQ ID NO: 233392 - DNA, 18 bp, Homo sapiens
ccagcccacagtgctcag

SEQ ID NO: 233393 - DNA, 19 bp, Homo sapiens
ccagcccacagtgctcagt

SEQ ID NO: 233394 - DNA, 17 bp, Homo sapiens
ccagcccacatccagtg

SEQ ID NO: 233395 - DNA, 15 bp, Homo sapiens
ccagcccacccaacc

SEQ ID NO: 233396 - DNA, 20 bp, Homo sapiens
ccagcccagacccccagtgt

SEQ ID NO: 233397 - DNA, 16 bp, Homo sapiens
ccagcccagcccagct

SEQ ID NO: 233398 - DNA, 14 bp, Homo sapiens
ccagcccagctcca

SEQ ID NO: 233399 - DNA, 12 bp, Homo sapiens
ccagcccagctg

SEQ ID NO: 233400 - DNA, 14 bp, Homo sapiens
ccagcccagctgct

SEQ ID NO: 233401 - DNA, 21 bp, Homo sapiens
ccagcccagggttcccccagc

SEQ ID NO: 233402 - DNA, 22 bp, Homo sapiens
ccagcccatcttgcctccatgg

SEQ ID NO: 233403 - DNA, 14 bp, Homo sapiens
ccagccccacccag

SEQ ID NO: 233404 - DNA, 15 bp, Homo sapiens
ccagccccacccagg

SEQ ID NO: 233405 - DNA, 14 bp, Homo sapiens
ccagccccagcaag

SEQ ID NO: 233406 - DNA, 15 bp, Homo sapiens
ccagccccctggatg

SEQ ID NO: 233407 - DNA, 22 bp, Homo sapiens
ccagccccctggatgggcattg

SEQ ID NO: 233408 - DNA, 12 bp, Homo sapiens
ccagcccctccc

SEQ ID NO: 233409 - DNA, 21 bp, Homo sapiens
ccagcccctcccaccacagca

SEQ ID NO: 233410 - DNA, 15 bp, Homo sapiens
ccagccccttctccc

SEQ ID NO: 233411 - DNA, 17 bp, Homo sapiens
ccagccccttctcccag

SEQ ID NO: 233412 - DNA, 17 bp, Homo sapiens
ccagcccggcctgctcc

SEQ ID NO: 233413 - DNA, 15 bp, Homo sapiens
ccagcccggctgacc

SEQ ID NO: 233414 - DNA, 13 bp, Homo sapiens
ccagccctaggct

SEQ ID NO: 233415 - DNA, 13 bp, Homo sapiens
ccagccctccaga

SEQ ID NO: 233416 - DNA, 14 bp, Homo sapiens
ccagccctccagag

SEQ ID NO: 233417 - DNA, 22 bp, Homo sapiens
ccagccctccagagcaggagac

SEQ ID NO: 233418 - DNA, 20 bp, Homo sapiens
ccagccctccctggctgtga

SEQ ID NO: 233419 - DNA, 15 bp, Homo sapiens
ccagccctgtcctgg

SEQ ID NO: 233420 - DNA, 18 bp, Homo sapiens
ccagccctgtggaaggga

SEQ ID NO: 233421 - DNA, 13 bp, Homo sapiens
ccagccctgttct

SEQ ID NO: 233422 - DNA, 16 bp, Homo sapiens
ccagcccttcccaggc

SEQ ID NO: 233423 - DNA, 21 bp, Homo sapiens
ccagcccttcccaggccagcg

SEQ ID NO: 233424 - DNA, 24 bp, Homo sapiens
ccagcccttcccaggccagcgagg

SEQ ID NO: 233425 - DNA, 23 bp, Homo sapiens
ccagcccttccctggccccgccg

SEQ ID NO: 233426 - DNA, 15 bp, Homo sapiens
ccagcccttctgcct

SEQ ID NO: 233427 - DNA, 22 bp, Homo sapiens
ccagccctttgcaggcccagca

SEQ ID NO: 233428 - DNA, 18 bp, Homo sapiens
ccagccgccccagcccct

SEQ ID NO: 233429 - DNA, 14 bp, Homo sapiens
ccagccggggtggg

SEQ ID NO: 233430 - DNA, 20 bp, Homo sapiens
ccagccgtgagtgcagaccc

SEQ ID NO: 233431 - DNA, 20 bp, Homo sapiens
ccagccgtgatgctcaggct

SEQ ID NO: 233432 - DNA, 23 bp, Homo sapiens
ccagccgtgatgctcaggcttga

SEQ ID NO: 233433 - DNA, 17 bp, Homo sapiens
ccagcctcacccttgcg

SEQ ID NO: 233434 - DNA, 17 bp, Homo sapiens
ccagcctcagtgccact

SEQ ID NO: 233435 - DNA, 13 bp, Homo sapiens
ccagcctccaggc

SEQ ID NO: 233436 - DNA, 16 bp, Homo sapiens
ccagcctccatgctgc

SEQ ID NO: 233437 - DNA, 14 bp, Homo sapiens
ccagcctcccccag

SEQ ID NO: 233438 - DNA, 15 bp, Homo sapiens
ccagcctcccccagg

SEQ ID NO: 233439 - DNA, 13 bp, Homo sapiens
ccagcctcccctc

SEQ ID NO: 233440 - DNA, 13 bp, Homo sapiens
ccagcctctcccg

SEQ ID NO: 233441 - DNA, 14 bp, Homo sapiens
ccagcctgagccac

SEQ ID NO: 233442 - DNA, 18 bp, Homo sapiens
ccagcctgagccacagtg

SEQ ID NO: 233443 - DNA, 17 bp, Homo sapiens
ccagcctgctgagagcc

SEQ ID NO: 233444 - DNA, 16 bp, Homo sapiens
ccagcctggccacgca

SEQ ID NO: 233445 - DNA, 19 bp, Homo sapiens
ccagcctggccacgcagcc

SEQ ID NO: 233446 - DNA, 14 bp, Homo sapiens
ccagcctgggactc

SEQ ID NO: 233447 - DNA, 18 bp, Homo sapiens
ccagcctgggcagccagg

SEQ ID NO: 233448 - DNA, 23 bp, Homo sapiens
ccagcctgggcagccaggctgcc

SEQ ID NO: 233449 - DNA, 18 bp, Homo sapiens
ccagcctggggcctggca

SEQ ID NO: 233450 - DNA, 19 bp, Homo sapiens
ccagcctggggcctggcag

SEQ ID NO: 233451 - DNA, 14 bp, Homo sapiens
ccagcctgtcctgg

SEQ ID NO: 233452 - DNA, 12 bp, Homo sapiens
ccagcctgtggt

SEQ ID NO: 233453 - DNA, 19 bp, Homo sapiens
ccagcctgtggttacagtg

SEQ ID NO: 233454 - DNA, 18 bp, Homo sapiens
ccagcctgtgtgttctgt

SEQ ID NO: 233455 - DNA, 14 bp, Homo sapiens
ccagcctttcttcc

SEQ ID NO: 233456 - DNA, 19 bp, Homo sapiens
ccagcgaggcgaggctgcc

SEQ ID NO: 233457 - DNA, 23 bp, Homo sapiens
ccagcgaggcgaggctgcctctg

SEQ ID NO: 233458 - DNA, 17 bp, Homo sapiens
ccagcgagtctggagac

SEQ ID NO: 233459 - DNA, 16 bp, Homo sapiens
ccagcgcccgctgggc

SEQ ID NO: 233460 - DNA, 17 bp, Homo sapiens
ccagcgcccgctgggct

SEQ ID NO: 233461 - DNA, 19 bp, Homo sapiens
ccagcgcccgctgggctga

SEQ ID NO: 233462 - DNA, 20 bp, Homo sapiens
ccagcgcctgtgctgaggac

SEQ ID NO: 233463 - DNA, 13 bp, Homo sapiens
ccagcggcccctc

SEQ ID NO: 233464 - DNA, 21 bp, Homo sapiens
ccagcgtcccagtctctggca

SEQ ID NO: 233465 - DNA, 22 bp, Homo sapiens
ccagcgtcccagtctctggcag

SEQ ID NO: 233466 - DNA, 18 bp, Homo sapiens
ccagcgtggcctccgtga

SEQ ID NO: 233467 - DNA, 23 bp, Homo sapiens
ccagcgtggggctaacgggcgcc

SEQ ID NO: 233468 - DNA, 23 bp, Homo sapiens
ccagcgtttagtttctagaggcc

SEQ ID NO: 233469 - DNA, 21 bp, Homo sapiens
ccagctaatctgtagggctgg

SEQ ID NO: 233470 - DNA, 21 bp, Homo sapiens
ccagctacattcctcagctgc

SEQ ID NO: 233471 - DNA, 22 bp, Homo sapiens
ccagctacattcctcagctgcc

SEQ ID NO: 233472 - DNA, 23 bp, Homo sapiens
ccagctacattcctcagctgcca

SEQ ID NO: 233473 - DNA, 17 bp, Homo sapiens
ccagctactctgtccag

SEQ ID NO: 233474 - DNA, 19 bp, Homo sapiens
ccagctactctgtccaggc

SEQ ID NO: 233475 - DNA, 14 bp, Homo sapiens
ccagctacttggga

SEQ ID NO: 233476 - DNA, 16 bp, Homo sapiens
ccagctacttgggaag

SEQ ID NO: 233477 - DNA, 17 bp, Homo sapiens
ccagctacttgggaagc

SEQ ID NO: 233478 - DNA, 16 bp, Homo sapiens
ccagctacttgggagc

SEQ ID NO: 233479 - DNA, 19 bp, Homo sapiens
ccagctacttgggagcctg

SEQ ID NO: 233480 - DNA, 20 bp, Homo sapiens
ccagctacttgggagcctga

SEQ ID NO: 233481 - DNA, 23 bp, Homo sapiens
ccagctagaaagtggcagagcca

SEQ ID NO: 233482 - DNA, 13 bp, Homo sapiens
ccagctcagaggg

SEQ ID NO: 233483 - DNA, 22 bp, Homo sapiens
ccagctcagcagttcacttcct

SEQ ID NO: 233484 - DNA, 14 bp, Homo sapiens
ccagctcagccccg

SEQ ID NO: 233485 - DNA, 21 bp, Homo sapiens
ccagctcagccccggccactc

SEQ ID NO: 233486 - DNA, 14 bp, Homo sapiens
ccagctcaggggca

SEQ ID NO: 233487 - DNA, 15 bp, Homo sapiens
ccagctcaggggcag

SEQ ID NO: 233488 - DNA, 17 bp, Homo sapiens
ccagctcatctccaagg

SEQ ID NO: 233489 - DNA, 16 bp, Homo sapiens
ccagctccactcaggg

SEQ ID NO: 233490 - DNA, 18 bp, Homo sapiens
ccagctccactcagggct

SEQ ID NO: 233491 - DNA, 16 bp, Homo sapiens
ccagctccactggcct

SEQ ID NO: 233492 - DNA, 17 bp, Homo sapiens
ccagctccactggcctg

SEQ ID NO: 233493 - DNA, 22 bp, Homo sapiens
ccagctccactggcctgcccgt

SEQ ID NO: 233494 - DNA, 14 bp, Homo sapiens
ccagctccaggggc

SEQ ID NO: 233495 - DNA, 20 bp, Homo sapiens
ccagctccaggggcccttgg

SEQ ID NO: 233496 - DNA, 13 bp, Homo sapiens
ccagctccctaga

SEQ ID NO: 233497 - DNA, 15 bp, Homo sapiens
ccagctccttttctg

SEQ ID NO: 233498 - DNA, 21 bp, Homo sapiens
ccagctccttttgtccccagg

SEQ ID NO: 233499 - DNA, 23 bp, Homo sapiens
ccagctccttttgtccccagggc

SEQ ID NO: 233500 - DNA, 15 bp, Homo sapiens
ccagctctcccacat

SEQ ID NO: 233501 - DNA, 22 bp, Homo sapiens
ccagctctcccacatcccactg

SEQ ID NO: 233502 - DNA, 13 bp, Homo sapiens
ccagctctcccct

SEQ ID NO: 233503 - DNA, 17 bp, Homo sapiens
ccagctctcccctgcgc

SEQ ID NO: 233504 - DNA, 11 bp, Homo sapiens
ccagctctgtg

SEQ ID NO: 233505 - DNA, 14 bp, Homo sapiens
ccagctctttcctc

SEQ ID NO: 233506 - DNA, 13 bp, Homo sapiens
ccaggtcccagtg

SEQ ID NO: 233507 - DNA, 16 bp, Homo sapiens
ccaggtccctggacca

SEQ ID NO: 233508 - DNA, 23 bp, Homo sapiens
ccaggtcctttccttctcgtctt

SEQ ID NO: 233509 - DNA, 17 bp, Homo sapiens
ccaggtcgggctcagct

SEQ ID NO: 233510 - DNA, 23 bp, Homo sapiens
ccaggtcgggctcagctctggct

SEQ ID NO: 233511 - DNA, 21 bp, Homo sapiens
ccaggtgagtgtgagggcagc

SEQ ID NO: 233512 - DNA, 19 bp, Homo sapiens
ccaggtgcacagacgtccc

SEQ ID NO: 233513 - DNA, 19 bp, Homo sapiens
ccaggtgccaccaataaaa

SEQ ID NO: 233514 - DNA, 15 bp, Homo sapiens
ccaggtgctggaggc

SEQ ID NO: 233515 - DNA, 16 bp, Homo sapiens
ccaggtgctggaggca

SEQ ID NO: 233516 - DNA, 19 bp, Homo sapiens
ccaggtgctggaggcagac

SEQ ID NO: 233517 - DNA, 18 bp, Homo sapiens
ccaggtgtctagaggcaa

SEQ ID NO: 233518 - DNA, 15 bp, Homo sapiens
ccaggttccatccac

SEQ ID NO: 233519 - DNA, 18 bp, Homo sapiens
ccaggttccatccaccac

SEQ ID NO: 233520 - DNA, 23 bp, Homo sapiens
ccaggttccatccaccaccttgc

SEQ ID NO: 233521 - DNA, 13 bp, Homo sapiens
ccaggttgaaaga

SEQ ID NO: 233522 - DNA, 13 bp, Homo sapiens
ccacctgggagat

SEQ ID NO: 233523 - DNA, 19 bp, Homo sapiens
ccacctgggcctcccatag

SEQ ID NO: 233524 - DNA, 16 bp, Homo sapiens
ccacctgggctgggag

SEQ ID NO: 233525 - DNA, 17 bp, Homo sapiens
ccacctgggctgggaga

SEQ ID NO: 233526 - DNA, 13 bp, Homo sapiens
ccacctgtacata

SEQ ID NO: 233527 - DNA, 12 bp, Homo sapiens
ccacctgtccca

SEQ ID NO: 233528 - DNA, 13 bp, Homo sapiens
ccacctgtcccac

SEQ ID NO: 233529 - DNA, 18 bp, Homo sapiens
ccacctgtcccacctcaa

SEQ ID NO: 233530 - DNA, 12 bp, Homo sapiens
ccacctgtctca

SEQ ID NO: 233531 - DNA, 15 bp, Homo sapiens
ccacctgtctcagcc

SEQ ID NO: 233532 - DNA, 11 bp, Homo sapiens
ccacctgtctg

SEQ ID NO: 233533 - DNA, 14 bp, Homo sapiens
ccacctgtctgtct

SEQ ID NO: 233534 - DNA, 16 bp, Homo sapiens
ccacctgtctgtctgt

SEQ ID NO: 233535 - DNA, 22 bp, Homo sapiens
ccacctgtctgtctgtctgtcc

SEQ ID NO: 233536 - DNA, 17 bp, Homo sapiens
ccacctgtgctgctgca

SEQ ID NO: 233537 - DNA, 22 bp, Homo sapiens
ccacctgtgtgttcttttgata

SEQ ID NO: 233538 - DNA, 21 bp, Homo sapiens
ccaccttaccctactggctgt

SEQ ID NO: 233539 - DNA, 14 bp, Homo sapiens
ccaccttcccccaa

SEQ ID NO: 233540 - DNA, 11 bp, Homo sapiens
ccaccttccct

SEQ ID NO: 233541 - DNA, 20 bp, Homo sapiens
ccaccttccctccacctgct

SEQ ID NO: 233542 - DNA, 13 bp, Homo sapiens
ccaccttcctgac

SEQ ID NO: 233543 - DNA, 15 bp, Homo sapiens
ccaccttcctgactg

SEQ ID NO: 233544 - DNA, 18 bp, Homo sapiens
ccaccttcctgactggga

SEQ ID NO: 233545 - DNA, 20 bp, Homo sapiens
ccaccttctgtccccagccc

SEQ ID NO: 233546 - DNA, 22 bp, Homo sapiens
ccacgacaaaaacaagactgcc

SEQ ID NO: 233547 - DNA, 16 bp, Homo sapiens
ccacgagtcacctgca

SEQ ID NO: 233548 - DNA, 19 bp, Homo sapiens
ccacgagtcacctgcaagc

SEQ ID NO: 233549 - DNA, 13 bp, Homo sapiens
ccacgattttaaa

SEQ ID NO: 233550 - DNA, 17 bp, Homo sapiens
ccacgcagagccccgga

SEQ ID NO: 233551 - DNA, 14 bp, Homo sapiens
ccacgcagccagga

SEQ ID NO: 233552 - DNA, 15 bp, Homo sapiens
ccacgccccagcccg

SEQ ID NO: 233553 - DNA, 19 bp, Homo sapiens
ccacgccctccctctccca

SEQ ID NO: 233554 - DNA, 18 bp, Homo sapiens
ccacgctgtctccagacc

SEQ ID NO: 233555 - DNA, 19 bp, Homo sapiens
ccacgctgtctccagaccc

SEQ ID NO: 233556 - DNA, 20 bp, Homo sapiens
ccacgctgtctccagacccc

SEQ ID NO: 233557 - DNA, 21 bp, Homo sapiens
ccacgctgtctccagaccccc

SEQ ID NO: 233558 - DNA, 13 bp, Homo sapiens
ccacggaaacaga

SEQ ID NO: 233559 - DNA, 14 bp, Homo sapiens
ccacggaaacagaa

SEQ ID NO: 233560 - DNA, 16 bp, Homo sapiens
ccacggaaacagaact

SEQ ID NO: 233561 - DNA, 17 bp, Homo sapiens
ccacggacgctggctcc

SEQ ID NO: 233562 - DNA, 21 bp, Homo sapiens
ccacggccaccctccttcccg

SEQ ID NO: 233563 - DNA, 17 bp, Homo sapiens
ccacggccactgcagtc

SEQ ID NO: 233564 - DNA, 23 bp, Homo sapiens
ccacggccctgtcagagccgcca

SEQ ID NO: 233565 - DNA, 13 bp, Homo sapiens
ccacggcctggga

SEQ ID NO: 233566 - DNA, 12 bp, Homo sapiens
ccacggccttgt

SEQ ID NO: 233567 - DNA, 18 bp, Homo sapiens
ccacggctaagaggctgc

SEQ ID NO: 233568 - DNA, 23 bp, Homo sapiens
ccacgggcacaagacccctgctc

SEQ ID NO: 233569 - DNA, 13 bp, Homo sapiens
ccacgggggaggc

SEQ ID NO: 233570 - DNA, 18 bp, Homo sapiens
ccacgggggcctagtggc

SEQ ID NO: 233571 - DNA, 18 bp, Homo sapiens
ccacggggtcgggggagg

SEQ ID NO: 233572 - DNA, 22 bp, Homo sapiens
ccacggggtcgggggaggagca

SEQ ID NO: 233573 - DNA, 14 bp, Homo sapiens
ccacggtcctttga

SEQ ID NO: 233574 - DNA, 20 bp, Homo sapiens
ccacggtgcgtggctgtggc

SEQ ID NO: 233575 - DNA, 22 bp, Homo sapiens
ccacgtcctcgaattctcagac

SEQ ID NO: 233576 - DNA, 23 bp, Homo sapiens
ccacgtcctcgaattctcagacg

SEQ ID NO: 233577 - DNA, 17 bp, Homo sapiens
ccacgtctgccaggccc

SEQ ID NO: 233578 - DNA, 18 bp, Homo sapiens
ccacgtctgccaggccca

SEQ ID NO: 233579 - DNA, 15 bp, Homo sapiens
ccacgtctggccagg

SEQ ID NO: 233580 - DNA, 21 bp, Homo sapiens
ccacgtctggccaggcactgc

SEQ ID NO: 233581 - DNA, 20 bp, Homo sapiens
ccacgtgagagaatctgcct

SEQ ID NO: 233582 - DNA, 16 bp, Homo sapiens
ccacgtgctggagagt

SEQ ID NO: 233583 - DNA, 14 bp, Homo sapiens
ccacgttcacccct

SEQ ID NO: 233584 - DNA, 13 bp, Homo sapiens
ccactaaccatcc

SEQ ID NO: 233585 - DNA, 18 bp, Homo sapiens
ccactaaccatccccaac

SEQ ID NO: 233586 - DNA, 19 bp, Homo sapiens
ccactaagctttctccttt

SEQ ID NO: 233587 - DNA, 21 bp, Homo sapiens
ccactaagctttctcctttga

SEQ ID NO: 233588 - DNA, 15 bp, Homo sapiens
ccactaagtaacctc

SEQ ID NO: 233589 - DNA, 18 bp, Homo sapiens
ccactaatattcagtcct

SEQ ID NO: 233590 - DNA, 20 bp, Homo sapiens
ccactaatttgtcactggaa

SEQ ID NO: 233591 - DNA, 21 bp, Homo sapiens
ccactaatttgtcactggaac

SEQ ID NO: 233592 - DNA, 20 bp, Homo sapiens
ccactaccttctgacctccc

SEQ ID NO: 233593 - DNA, 22 bp, Homo sapiens
ccactaccttctgacctcccca

SEQ ID NO: 233594 - DNA, 20 bp, Homo sapiens
ccactagccctctttctctc

SEQ ID NO: 233595 - DNA, 21 bp, Homo sapiens
ccactagccctctttctctct

SEQ ID NO: 233596 - DNA, 22 bp, Homo sapiens
ccactagggtcctggccctctt

SEQ ID NO: 233597 - DNA, 16 bp, Homo sapiens
ccatctcaggccacct

SEQ ID NO: 233598 - DNA, 18 bp, Homo sapiens
ccatctcaggccacctgc

SEQ ID NO: 233599 - DNA, 23 bp, Homo sapiens
ccatctcaggtgccactccctga

SEQ ID NO: 233600 - DNA, 21 bp, Homo sapiens
ccatctccagggagcaagaca

SEQ ID NO: 233601 - DNA, 12 bp, Homo sapiens
ccatctccccag

SEQ ID NO: 233602 - DNA, 15 bp, Homo sapiens
ccatctccccaggcc

SEQ ID NO: 233603 - DNA, 17 bp, Homo sapiens
ccatctccccaggcctc

SEQ ID NO: 233604 - DNA, 18 bp, Homo sapiens
ccatctccccaggcctcc

SEQ ID NO: 233605 - DNA, 21 bp, Homo sapiens
ccatctccttcccccagccca

SEQ ID NO: 233606 - DNA, 14 bp, Homo sapiens
ccatctctccctcc

SEQ ID NO: 233607 - DNA, 18 bp, Homo sapiens
ccatctctgaacttcagc

SEQ ID NO: 233608 - DNA, 14 bp, Homo sapiens
ccatctctgctgct

SEQ ID NO: 233609 - DNA, 15 bp, Homo sapiens
ccatctgccgcctgg

SEQ ID NO: 233610 - DNA, 11 bp, Homo sapiens
ccatctgctga

SEQ ID NO: 233611 - DNA, 13 bp, Homo sapiens
ccatctgctgagc

SEQ ID NO: 233612 - DNA, 14 bp, Homo sapiens
ccatctggcctggc

SEQ ID NO: 233613 - DNA, 16 bp, Homo sapiens
ccatctggcctggcct

SEQ ID NO: 233614 - DNA, 18 bp, Homo sapiens
ccatctggcctggcctgg

SEQ ID NO: 233615 - DNA, 12 bp, Homo sapiens
ccatctgtaata

SEQ ID NO: 233616 - DNA, 13 bp, Homo sapiens
ccatctgtaatat

SEQ ID NO: 233617 - DNA, 14 bp, Homo sapiens
ccatctgtaccctg

SEQ ID NO: 233618 - DNA, 15 bp, Homo sapiens
ccatcttacttgagc

SEQ ID NO: 233619 - DNA, 17 bp, Homo sapiens
ccatcttcctgctgctg

SEQ ID NO: 233620 - DNA, 13 bp, Homo sapiens
ccatcttgcctcc

SEQ ID NO: 233621 - DNA, 23 bp, Homo sapiens
ccatcttggtagttctgtgcctc

SEQ ID NO: 233622 - DNA, 13 bp, Homo sapiens
ccatgaaacaaag

SEQ ID NO: 233623 - DNA, 13 bp, Homo sapiens
ccatgaccaggcc

SEQ ID NO: 233624 - DNA, 19 bp, Homo sapiens
ccatgaccaggccaccatc

SEQ ID NO: 233625 - DNA, 13 bp, Homo sapiens
ccatgaccttgac

SEQ ID NO: 233626 - DNA, 13 bp, Homo sapiens
ccatgactgcacc

SEQ ID NO: 233627 - DNA, 14 bp, Homo sapiens
ccatgactgcaccc

SEQ ID NO: 233628 - DNA, 15 bp, Homo sapiens
ccatgactgcatttt

SEQ ID NO: 233629 - DNA, 21 bp, Homo sapiens
ccatgactgccccttgcttct

SEQ ID NO: 233630 - DNA, 23 bp, Homo sapiens
ccatgagcctgcccgctgcaatg

SEQ ID NO: 233631 - DNA, 16 bp, Homo sapiens
ccatgaggtaaaagag

SEQ ID NO: 233632 - DNA, 14 bp, Homo sapiens
ccatgataaaataa

SEQ ID NO: 233633 - DNA, 13 bp, Homo sapiens
ccatgatagctgg

SEQ ID NO: 233634 - DNA, 16 bp, Homo sapiens
ccatgatccctgtgtt

SEQ ID NO: 233635 - DNA, 17 bp, Homo sapiens
ccatgatccctgtgttg

SEQ ID NO: 233636 - DNA, 13 bp, Homo sapiens
ccatgatgtcctt

SEQ ID NO: 233637 - DNA, 19 bp, Homo sapiens
ccatgattccaagggccca

SEQ ID NO: 233638 - DNA, 17 bp, Homo sapiens
ccatgattttggccact

SEQ ID NO: 233639 - DNA, 23 bp, Homo sapiens
ccatgattttggccactttgcag

SEQ ID NO: 233640 - DNA, 22 bp, Homo sapiens
ccatgcacacaaacacctccta

SEQ ID NO: 233641 - DNA, 17 bp, Homo sapiens
ccatgcatggcctccca

SEQ ID NO: 233642 - DNA, 20 bp, Homo sapiens
ccatgccaaagctagggtgg

SEQ ID NO: 233643 - DNA, 17 bp, Homo sapiens
ccatgccaccacccacc

SEQ ID NO: 233644 - DNA, 21 bp, Homo sapiens
ccatgccaccacccaccccaa

SEQ ID NO: 233645 - DNA, 12 bp, Homo sapiens
ccatgccactgc

SEQ ID NO: 233646 - DNA, 17 bp, Homo sapiens
ccatgccactgccaggc

SEQ ID NO: 233647 - DNA, 11 bp, Homo sapiens
ccatgccctgc

SEQ ID NO: 233648 - DNA, 18 bp, Homo sapiens
ccatgccctgccaagcct

SEQ ID NO: 233649 - DNA, 17 bp, Homo sapiens
ccatgcctacagataat

SEQ ID NO: 233650 - DNA, 17 bp, Homo sapiens
ccatgcctatttactgg

SEQ ID NO: 233651 - DNA, 17 bp, Homo sapiens
ccatgcctcatgccaca

SEQ ID NO: 233652 - DNA, 23 bp, Homo sapiens
ccatgcctcatgccacaccttct

SEQ ID NO: 233653 - DNA, 12 bp, Homo sapiens
ccatgcctgagg

SEQ ID NO: 233654 - DNA, 13 bp, Homo sapiens
ccatgcctgaggg

SEQ ID NO: 233655 - DNA, 16 bp, Homo sapiens
ccatgcctgagggtgg

SEQ ID NO: 233656 - DNA, 19 bp, Homo sapiens
ccatgcctgtccagcctgg

SEQ ID NO: 233657 - DNA, 16 bp, Homo sapiens
ccatgctcagaaatgt

SEQ ID NO: 233658 - DNA, 17 bp, Homo sapiens
ccatgctcctcactgcc

SEQ ID NO: 233659 - DNA, 22 bp, Homo sapiens
ccatgctcctcactgcccgcac

SEQ ID NO: 233660 - DNA, 13 bp, Homo sapiens
ccatgctctgccc

SEQ ID NO: 233661 - DNA, 15 bp, Homo sapiens
ccatgctctgcccca

SEQ ID NO: 233662 - DNA, 14 bp, Homo sapiens
ccatgctgcctcca

SEQ ID NO: 233663 - DNA, 19 bp, Homo sapiens
ccatgctgccttcagggag

SEQ ID NO: 233664 - DNA, 12 bp, Homo sapiens
ccatgctgctat

SEQ ID NO: 233665 - DNA, 17 bp, Homo sapiens
ccatgctgctatgaaga

SEQ ID NO: 233666 - DNA, 20 bp, Homo sapiens
ccatgctgctttttggcaca

SEQ ID NO: 233667 - DNA, 21 bp, Homo sapiens
ccatgctgctttttggcacag

SEQ ID NO: 233668 - DNA, 12 bp, Homo sapiens
ccatggaacctg

SEQ ID NO: 233669 - DNA, 23 bp, Homo sapiens
ccatggaagctggcaggagacac

SEQ ID NO: 233670 - DNA, 15 bp, Homo sapiens
ccatggactctacac

SEQ ID NO: 233671 - DNA, 13 bp, Homo sapiens
ccatggaggcaca

SEQ ID NO: 233672 - DNA, 21 bp, Homo sapiens
ccatggaggcacacagctgca

SEQ ID NO: 233673 - DNA, 15 bp, Homo sapiens
ccatggatgcatgcc

SEQ ID NO: 233674 - DNA, 16 bp, Homo sapiens
ccatggattcccctgg

SEQ ID NO: 233675 - DNA, 21 bp, Homo sapiens
ccatggcaccagccccctgga

SEQ ID NO: 233676 - DNA, 23 bp, Homo sapiens
ccatggcaccttcagactttgct

SEQ ID NO: 233677 - DNA, 18 bp, Homo sapiens
ccatggccaaggggccag

SEQ ID NO: 233678 - DNA, 12 bp, Homo sapiens
ccatggccttcc

SEQ ID NO: 233679 - DNA, 13 bp, Homo sapiens
ccatggctcaggc

SEQ ID NO: 233680 - DNA, 18 bp, Homo sapiens
ccatggctcaggcaagcc

SEQ ID NO: 233681 - DNA, 17 bp, Homo sapiens
ccatggcttcctgagaa

SEQ ID NO: 233682 - DNA, 19 bp, Homo sapiens
ccatggctttcatcctgtg

SEQ ID NO: 233683 - DNA, 21 bp, Homo sapiens
ccatgggaaatgtcaacaagt

SEQ ID NO: 233684 - DNA, 17 bp, Homo sapiens
ccatgggatatgtggtg

SEQ ID NO: 233685 - DNA, 18 bp, Homo sapiens
ccatgggcagaagataga

SEQ ID NO: 233686 - DNA, 12 bp, Homo sapiens
ccatgggccctc

SEQ ID NO: 233687 - DNA, 18 bp, Homo sapiens
ccatgggccctctgagca

SEQ ID NO: 233688 - DNA, 14 bp, Homo sapiens
ccatgggcctgggc

SEQ ID NO: 233689 - DNA, 17 bp, Homo sapiens
ccatgggctagtgtgag

SEQ ID NO: 233690 - DNA, 18 bp, Homo sapiens
ccatggggatcagagtct

SEQ ID NO: 233691 - DNA, 14 bp, Homo sapiens
ccatgggggcaggg

SEQ ID NO: 233692 - DNA, 16 bp, Homo sapiens
ccatggggttcgagac

SEQ ID NO: 233693 - DNA, 15 bp, Homo sapiens
ccatggtagactgtg

SEQ ID NO: 233694 - DNA, 16 bp, Homo sapiens
ccatggtagactgtga

SEQ ID NO: 233695 - DNA, 17 bp, Homo sapiens
ccatggtagactgtgac

SEQ ID NO: 233696 - DNA, 15 bp, Homo sapiens
ccatggtccctagca

SEQ ID NO: 233697 - DNA, 14 bp, Homo sapiens
ccatggtgcctctg

SEQ ID NO: 233698 - DNA, 23 bp, Homo sapiens
ccatgtaccagtgtactgctttc

SEQ ID NO: 233699 - DNA, 17 bp, Homo sapiens
ccatgtagaagagggag

SEQ ID NO: 233700 - DNA, 20 bp, Homo sapiens
ccatgtagaagagggagaag

SEQ ID NO: 233701 - DNA, 21 bp, Homo sapiens
ccatgtagaagagggagaagg

SEQ ID NO: 233702 - DNA, 23 bp, Homo sapiens
ccatgtccaagtccaacctgcct

SEQ ID NO: 233703 - DNA, 15 bp, Homo sapiens
ccatgtccaagttct

SEQ ID NO: 233704 - DNA, 17 bp, Homo sapiens
ccatgtcgcctctgcat

SEQ ID NO: 233705 - DNA, 15 bp, Homo sapiens
ccatgtgcctgcacc

SEQ ID NO: 233706 - DNA, 20 bp, Homo sapiens
ccatgtgcctgcaccaggag

SEQ ID NO: 233707 - DNA, 16 bp, Homo sapiens
ccatgtggccccaggt

SEQ ID NO: 233708 - DNA, 19 bp, Homo sapiens
ccatgtggccccaggtgcc

SEQ ID NO: 233709 - DNA, 21 bp, Homo sapiens
ccatgtggccccaggtgccac

SEQ ID NO: 233710 - DNA, 11 bp, Homo sapiens
ccatgtgtgag

SEQ ID NO: 233711 - DNA, 10 bp, Homo sapiens
ccatgtgtgt

SEQ ID NO: 233712 - DNA, 19 bp, Homo sapiens
ccatgtgtgtgcaagtgtg

SEQ ID NO: 233713 - DNA, 16 bp, Homo sapiens
ccatgtgttttgcttt

SEQ ID NO: 233714 - DNA, 18 bp, Homo sapiens
ccatgtgttttgctttta

SEQ ID NO: 233715 - DNA, 21 bp, Homo sapiens
cccaagtcaaacagtgtggct

SEQ ID NO: 233716 - DNA, 12 bp, Homo sapiens
cccaataaaagt

SEQ ID NO: 233717 - DNA, 19 bp, Homo sapiens
cccaataaaagtgactctc

SEQ ID NO: 233718 - DNA, 14 bp, Homo sapiens
cccaataaagctgg

SEQ ID NO: 233719 - DNA, 13 bp, Homo sapiens
cccaataaaggtc

SEQ ID NO: 233720 - DNA, 17 bp, Homo sapiens
cccaatatggtggccct

SEQ ID NO: 233721 - DNA, 20 bp, Homo sapiens
cccaatcagcttttgttcta

SEQ ID NO: 233722 - DNA, 16 bp, Homo sapiens
cccaatcgggtccaga

SEQ ID NO: 233723 - DNA, 14 bp, Homo sapiens
cccaatctttctat

SEQ ID NO: 233724 - DNA, 23 bp, Homo sapiens
cccaatctttctatataaaatgt

SEQ ID NO: 233725 - DNA, 24 bp, Homo sapiens
cccaatgctttgggaggccaaggc

SEQ ID NO: 233726 - DNA, 18 bp, Homo sapiens
cccaattaactgaagcaa

SEQ ID NO: 233727 - DNA, 22 bp, Homo sapiens
cccaatttaagagtcctgaggc

SEQ ID NO: 233728 - DNA, 12 bp, Homo sapiens
cccacaaaatat

SEQ ID NO: 233729 - DNA, 13 bp, Homo sapiens
cccacaaagcctt

SEQ ID NO: 233730 - DNA, 15 bp, Homo sapiens
cccacaagctgcctc

SEQ ID NO: 233731 - DNA, 18 bp, Homo sapiens
cccacaataatgaataat

SEQ ID NO: 233732 - DNA, 14 bp, Homo sapiens
cccacaatggctgg

SEQ ID NO: 233733 - DNA, 15 bp, Homo sapiens
cccacacactcgccc

SEQ ID NO: 233734 - DNA, 15 bp, Homo sapiens
cccacacaggcctgg

SEQ ID NO: 233735 - DNA, 17 bp, Homo sapiens
cccacacaggcctggcc

SEQ ID NO: 233736 - DNA, 20 bp, Homo sapiens
cccacacaggcctggcccag

SEQ ID NO: 233737 - DNA, 14 bp, Homo sapiens
cccacaccccagcc

SEQ ID NO: 233738 - DNA, 16 bp, Homo sapiens
cccacaccccagccca

SEQ ID NO: 233739 - DNA, 15 bp, Homo sapiens
cccacaccccgtctg

SEQ ID NO: 233740 - DNA, 19 bp, Homo sapiens
cccacaccccgtctgcccc

SEQ ID NO: 233741 - DNA, 20 bp, Homo sapiens
cccacaccccgtctgcccct

SEQ ID NO: 233742 - DNA, 22 bp, Homo sapiens
cccacaccccgtctgccccttg

SEQ ID NO: 233743 - DNA, 12 bp, Homo sapiens
cccacaccctgg

SEQ ID NO: 233744 - DNA, 16 bp, Homo sapiens
cccacacctgcctctg

SEQ ID NO: 233745 - DNA, 17 bp, Homo sapiens
cccacacgccggggctg

SEQ ID NO: 233746 - DNA, 19 bp, Homo sapiens
cccacacgccggggctggc

SEQ ID NO: 233747 - DNA, 21 bp, Homo sapiens
cccacacggactcccgggcca

SEQ ID NO: 233748 - DNA, 19 bp, Homo sapiens
cccacacttgttccagctc

SEQ ID NO: 233749 - DNA, 12 bp, Homo sapiens
cccacagagaca

SEQ ID NO: 233750 - DNA, 23 bp, Homo sapiens
cccacaggccacacgctgcccag

SEQ ID NO: 233751 - DNA, 16 bp, Homo sapiens
cccacaggcccttcct

SEQ ID NO: 233752 - DNA, 13 bp, Homo sapiens
cccacagggcctg

SEQ ID NO: 233753 - DNA, 16 bp, Homo sapiens
cccacaggttctatga

SEQ ID NO: 233754 - DNA, 21 bp, Homo sapiens
cccacagtctctccctggggt

SEQ ID NO: 233755 - DNA, 22 bp, Homo sapiens
cccacagtgctcagttgtactt

SEQ ID NO: 233756 - DNA, 23 bp, Homo sapiens
cccacagtgctcagttgtacttt

SEQ ID NO: 233757 - DNA, 19 bp, Homo sapiens
cccacatagtgatggttcc

SEQ ID NO: 233758 - DNA, 14 bp, Homo sapiens
cccacatcccactg

SEQ ID NO: 233759 - DNA, 19 bp, Homo sapiens
cccacatcccactggatct

SEQ ID NO: 233760 - DNA, 16 bp, Homo sapiens
cccaccaaactgcaca

SEQ ID NO: 233761 - DNA, 21 bp, Homo sapiens
cccaccacaactaacaatgcc

SEQ ID NO: 233762 - DNA, 12 bp, Homo sapiens
cccaccacagca

SEQ ID NO: 233763 - DNA, 21 bp, Homo sapiens
cccaccagaacgcaccccact

SEQ ID NO: 233764 - DNA, 14 bp, Homo sapiens
cccaccagctccca

SEQ ID NO: 233765 - DNA, 12 bp, Homo sapiens
cccaccagctcg

SEQ ID NO: 233766 - DNA, 20 bp, Homo sapiens
cccaccagggctcagctcct

SEQ ID NO: 233767 - DNA, 11 bp, Homo sapiens
cccaccagtgc

SEQ ID NO: 233768 - DNA, 19 bp, Homo sapiens
cccaccatgcacccctgat

SEQ ID NO: 233769 - DNA, 12 bp, Homo sapiens
cccaccattcca

SEQ ID NO: 233770 - DNA, 14 bp, Homo sapiens
cccaccattccaca

SEQ ID NO: 233771 - DNA, 17 bp, Homo sapiens
cccaccattccacatcc

SEQ ID NO: 233772 - DNA, 16 bp, Homo sapiens
cccaccattctacctg

SEQ ID NO: 233773 - DNA, 14 bp, Homo sapiens
cccacccacccctc

SEQ ID NO: 233774 - DNA, 11 bp, Homo sapiens
cccacccacct

SEQ ID NO: 233775 - DNA, 13 bp, Homo sapiens
cccacccaggagg

SEQ ID NO: 233776 - DNA, 23 bp, Homo sapiens
cccacccagggctccctcctgga

SEQ ID NO: 233777 - DNA, 13 bp, Homo sapiens
cccacccatcttc

SEQ ID NO: 233778 - DNA, 14 bp, Homo sapiens
cccacccatcttcc

SEQ ID NO: 233779 - DNA, 16 bp, Homo sapiens
cccacccatcttcctg

SEQ ID NO: 233780 - DNA, 13 bp, Homo sapiens
cccaccccaactc

SEQ ID NO: 233781 - DNA, 13 bp, Homo sapiens
cccaccccacact

SEQ ID NO: 233782 - DNA, 13 bp, Homo sapiens
cccaccccacaga

SEQ ID NO: 233783 - DNA, 12 bp, Homo sapiens
cccacccccatc

SEQ ID NO: 233784 - DNA, 13 bp, Homo sapiens
cccacccccctca

SEQ ID NO: 233785 - DNA, 14 bp, Homo sapiens
cccacccccctcat

SEQ ID NO: 233786 - DNA, 16 bp, Homo sapiens
cccacccccttctctg

SEQ ID NO: 233787 - DNA, 22 bp, Homo sapiens
cccacccccttctctgctccac

SEQ ID NO: 233788 - DNA, 17 bp, Homo sapiens
cccacccctaagtgccc

SEQ ID NO: 233789 - DNA, 21 bp, Homo sapiens
cccacccctacagcctgcaca

SEQ ID NO: 233790 - DNA, 23 bp, Homo sapiens
cccacccctaccgatggtcccag

SEQ ID NO: 233791 - DNA, 13 bp, Homo sapiens
cccacccctgtac

SEQ ID NO: 233792 - DNA, 21 bp, Homo sapiens
cccacccctgtacccagccac

SEQ ID NO: 233793 - DNA, 22 bp, Homo sapiens
cccacccctgtacccagccacc

SEQ ID NO: 233794 - DNA, 12 bp, Homo sapiens
cccaccccttcc

SEQ ID NO: 233795 - DNA, 18 bp, Homo sapiens
cccacccgccccagagac

SEQ ID NO: 233796 - DNA, 16 bp, Homo sapiens
cccacccggccacagc

SEQ ID NO: 233797 - DNA, 16 bp, Homo sapiens
cccacccgtgttctcc

SEQ ID NO: 233798 - DNA, 20 bp, Homo sapiens
cccacccgtgttctcctcca

SEQ ID NO: 233799 - DNA, 18 bp, Homo sapiens
cccaccctaatttgccct

SEQ ID NO: 233800 - DNA, 23 bp, Homo sapiens
cccaccctcgtggacacctgccc

SEQ ID NO: 233801 - DNA, 21 bp, Homo sapiens
cccaccctctggtccttctga

SEQ ID NO: 233802 - DNA, 22 bp, Homo sapiens
cccaccctgctcctcctgccct

SEQ ID NO: 233803 - DNA, 12 bp, Homo sapiens
cccaccctgctg

SEQ ID NO: 233804 - DNA, 16 bp, Homo sapiens
cccaccctgctgcctt

SEQ ID NO: 233805 - DNA, 19 bp, Homo sapiens
cccaccctgggatgggcca

SEQ ID NO: 233806 - DNA, 17 bp, Homo sapiens
cccacccttctcccctg

SEQ ID NO: 233807 - DNA, 17 bp, Homo sapiens
cccaccgaggttcccag

SEQ ID NO: 233808 - DNA, 19 bp, Homo sapiens
cccaccgaggttcccaggg

SEQ ID NO: 233809 - DNA, 17 bp, Homo sapiens
cccaccggttgcttctg

SEQ ID NO: 233810 - DNA, 18 bp, Homo sapiens
cccaccggttgcttctgg

SEQ ID NO: 233811 - DNA, 20 bp, Homo sapiens
cccaccggttgcttctggga

SEQ ID NO: 233812 - DNA, 14 bp, Homo sapiens
cccacctaccttca

SEQ ID NO: 233813 - DNA, 21 bp, Homo sapiens
cccacctcaaatgggtctggg

SEQ ID NO: 233814 - DNA, 18 bp, Homo sapiens
cccacctcatgcctggcc

SEQ ID NO: 233815 - DNA, 16 bp, Homo sapiens
cccacctccacccagc

SEQ ID NO: 233816 - DNA, 15 bp, Homo sapiens
cccacctccagccca

SEQ ID NO: 233817 - DNA, 16 bp, Homo sapiens
cccacctccagcccac

SEQ ID NO: 233818 - DNA, 18 bp, Homo sapiens
cccacctccagcccacag

SEQ ID NO: 233819 - DNA, 18 bp, Homo sapiens
cccacctccctgcccagg

SEQ ID NO: 233820 - DNA, 13 bp, Homo sapiens
cccacctcctgca

SEQ ID NO: 233821 - DNA, 22 bp, Homo sapiens
cccacctcgcggcgcagcccct

SEQ ID NO: 233822 - DNA, 15 bp, Homo sapiens
cccacctctgctgcc

SEQ ID NO: 233823 - DNA, 13 bp, Homo sapiens
cccacctcttttc

SEQ ID NO: 233824 - DNA, 16 bp, Homo sapiens
cccacctgaaagcctg

SEQ ID NO: 233825 - DNA, 13 bp, Homo sapiens
cccacctgcatca

SEQ ID NO: 233826 - DNA, 18 bp, Homo sapiens
cccacctgggccctaggc

SEQ ID NO: 233827 - DNA, 12 bp, Homo sapiens
cccacctgggct

SEQ ID NO: 233828 - DNA, 15 bp, Homo sapiens
cccacctgggctggg

SEQ ID NO: 233829 - DNA, 20 bp, Homo sapiens
cccacctggtggcctctgcc

SEQ ID NO: 233830 - DNA, 17 bp, Homo sapiens
cccaccttgttggagcc

SEQ ID NO: 233831 - DNA, 21 bp, Homo sapiens
cccaccttgttggagcctgca

SEQ ID NO: 233832 - DNA, 17 bp, Homo sapiens
cccacgaacgctcttag

SEQ ID NO: 233833 - DNA, 17 bp, Homo sapiens
cccacgcagagccccgg

SEQ ID NO: 233834 - DNA, 15 bp, Homo sapiens
cccacgctcctgccc

SEQ ID NO: 233835 - DNA, 16 bp, Homo sapiens
cccacgctcctgccct

SEQ ID NO: 233836 - DNA, 22 bp, Homo sapiens
cccacgctcctgccctcgtctc

SEQ ID NO: 233837 - DNA, 18 bp, Homo sapiens
cccacgctgggacacaga

SEQ ID NO: 233838 - DNA, 20 bp, Homo sapiens
cccacgctgggacacagacc

SEQ ID NO: 233839 - DNA, 12 bp, Homo sapiens
cccacggccacc

SEQ ID NO: 233840 - DNA, 12 bp, Homo sapiens
cccacggccact

SEQ ID NO: 233841 - DNA, 16 bp, Homo sapiens
cccaggtcccagtgcc

SEQ ID NO: 233842 - DNA, 18 bp, Homo sapiens
cccaggtgctggaggcag

SEQ ID NO: 233843 - DNA, 21 bp, Homo sapiens
cccaggtggattttgtggagg

SEQ ID NO: 233844 - DNA, 13 bp, Homo sapiens
cccaggttttctg

SEQ ID NO: 233845 - DNA, 14 bp, Homo sapiens
cccagtaagccact

SEQ ID NO: 233846 - DNA, 18 bp, Homo sapiens
cccagtacctccaagcaa

SEQ ID NO: 233847 - DNA, 22 bp, Homo sapiens
cccagtagccattttgtaactg

SEQ ID NO: 233848 - DNA, 19 bp, Homo sapiens
cccagtccaaatgtcctcc

SEQ ID NO: 233849 - DNA, 13 bp, Homo sapiens
cccagtccccgtg

SEQ ID NO: 233850 - DNA, 14 bp, Homo sapiens
cccagtccctggag

SEQ ID NO: 233851 - DNA, 20 bp, Homo sapiens
cccagtctctggcagttctg

SEQ ID NO: 233852 - DNA, 16 bp, Homo sapiens
cccagtcttgagtggg

SEQ ID NO: 233853 - DNA, 22 bp, Homo sapiens
cccagtgacacttcagagagct

SEQ ID NO: 233854 - DNA, 19 bp, Homo sapiens
cccagtgagattacagagg

SEQ ID NO: 233855 - DNA, 15 bp, Homo sapiens
cccagtgatggcatt

SEQ ID NO: 233856 - DNA, 13 bp, Homo sapiens
cccagtgcctgcc

SEQ ID NO: 233857 - DNA, 14 bp, Homo sapiens
cccagtgctgccat

SEQ ID NO: 233858 - DNA, 15 bp, Homo sapiens
cccagtgctgccatg

SEQ ID NO: 233859 - DNA, 17 bp, Homo sapiens
cccagtgctgccatgcc

SEQ ID NO: 233860 - DNA, 22 bp, Homo sapiens
cccagtgctgccatgccactgc

SEQ ID NO: 233861 - DNA, 22 bp, Homo sapiens
cccagtggaacagtcacccttc

SEQ ID NO: 233862 - DNA, 18 bp, Homo sapiens
cccagtggcctcaaccct

SEQ ID NO: 233863 - DNA, 21 bp, Homo sapiens
cccagtggcctcaaccctccc

SEQ ID NO: 233864 - DNA, 12 bp, Homo sapiens
cccagtgggagg

SEQ ID NO: 233865 - DNA, 15 bp, Homo sapiens
cccagtgggaggcgc

SEQ ID NO: 233866 - DNA, 20 bp, Homo sapiens
cccagtgggaggcgcgagcc

SEQ ID NO: 233867 - DNA, 15 bp, Homo sapiens
cccagtgtccccagg

SEQ ID NO: 233868 - DNA, 14 bp, Homo sapiens
cccagttaatcttg

SEQ ID NO: 233869 - DNA, 16 bp, Homo sapiens
cccagttagcccggcc

SEQ ID NO: 233870 - DNA, 16 bp, Homo sapiens
cccagttcatctctgc

SEQ ID NO: 233871 - DNA, 20 bp, Homo sapiens
cccagttcatctctgctgaa

SEQ ID NO: 233872 - DNA, 23 bp, Homo sapiens
cccagttcatctctgctgaacat

SEQ ID NO: 233873 - DNA, 22 bp, Homo sapiens
cccagttccttaggagatgtca

SEQ ID NO: 233874 - DNA, 18 bp, Homo sapiens
cccagttggtcaaacttg

SEQ ID NO: 233875 - DNA, 19 bp, Homo sapiens
cccatatataaattattac

SEQ ID NO: 233876 - DNA, 13 bp, Homo sapiens
cccatatttcatc

SEQ ID NO: 233877 - DNA, 15 bp, Homo sapiens
cccatcagcagcttg

SEQ ID NO: 233878 - DNA, 18 bp, Homo sapiens
cccatcatctctgccttt

SEQ ID NO: 233879 - DNA, 19 bp, Homo sapiens
cccatcatctctgcctttg

SEQ ID NO: 233880 - DNA, 13 bp, Homo sapiens
cccatccagcatg

SEQ ID NO: 233881 - DNA, 16 bp, Homo sapiens
cccatccagcatgtgt

SEQ ID NO: 233882 - DNA, 14 bp, Homo sapiens
cccatccagccagg

SEQ ID NO: 233883 - DNA, 20 bp, Homo sapiens
cccatccagtctcccaactt

SEQ ID NO: 233884 - DNA, 16 bp, Homo sapiens
cccatccatcagctcc

SEQ ID NO: 233885 - DNA, 13 bp, Homo sapiens
cccatcccacacc

SEQ ID NO: 233886 - DNA, 19 bp, Homo sapiens
cccatccccatcctccagc

SEQ ID NO: 233887 - DNA, 17 bp, Homo sapiens
cccatcccgaagccatc

SEQ ID NO: 233888 - DNA, 14 bp, Homo sapiens
cccatcctccagct

SEQ ID NO: 233889 - DNA, 19 bp, Homo sapiens
cccatcctccagcttctgg

SEQ ID NO: 233890 - DNA, 12 bp, Homo sapiens
cccatcctcccc

SEQ ID NO: 233891 - DNA, 15 bp, Homo sapiens
cccatcctccccttc

SEQ ID NO: 233892 - DNA, 18 bp, Homo sapiens
cccatcctccccttccct

SEQ ID NO: 233893 - DNA, 20 bp, Homo sapiens
cccatcggtgtccatttata

SEQ ID NO: 233894 - DNA, 23 bp, Homo sapiens
cccatctcacctctaggcctcag

SEQ ID NO: 233895 - DNA, 18 bp, Homo sapiens
cccatctcaggtgccact

SEQ ID NO: 233896 - DNA, 14 bp, Homo sapiens
cccatctccccagg

SEQ ID NO: 233897 - DNA, 15 bp, Homo sapiens
cccatctccccaggc

SEQ ID NO: 233898 - DNA, 22 bp, Homo sapiens
cccatctccccaggcctccagc

SEQ ID NO: 233899 - DNA, 15 bp, Homo sapiens
cccatctccttcccc

SEQ ID NO: 233900 - DNA, 19 bp, Homo sapiens
cccatctccttcccccagc

SEQ ID NO: 233901 - DNA, 21 bp, Homo sapiens
cccatctccttcccccagccc

SEQ ID NO: 233902 - DNA, 13 bp, Homo sapiens
cccatctctccct

SEQ ID NO: 233903 - DNA, 23 bp, Homo sapiens
cccatctctccctcccctgccat

SEQ ID NO: 233904 - DNA, 14 bp, Homo sapiens
cccatctctcttcc

SEQ ID NO: 233905 - DNA, 12 bp, Homo sapiens
cccatctgcacc

SEQ ID NO: 233906 - DNA, 18 bp, Homo sapiens
cccatctgccgcctgggg

SEQ ID NO: 233907 - DNA, 12 bp, Homo sapiens
cccatcttcctg

SEQ ID NO: 233908 - DNA, 15 bp, Homo sapiens
cccatcttcctgctg

SEQ ID NO: 233909 - DNA, 17 bp, Homo sapiens
cccatcttcctgctgct

SEQ ID NO: 233910 - DNA, 19 bp, Homo sapiens
cccatcttcctgctgctgt

SEQ ID NO: 233911 - DNA, 20 bp, Homo sapiens
cccatcttcctgctgctgta

SEQ ID NO: 233912 - DNA, 15 bp, Homo sapiens
cccatcttgcctcca

SEQ ID NO: 233913 - DNA, 16 bp, Homo sapiens
cccatgaccttgacgt

SEQ ID NO: 233914 - DNA, 15 bp, Homo sapiens
ccccagataccagcc

SEQ ID NO: 233915 - DNA, 20 bp, Homo sapiens
ccccagatagagctgggtgg

SEQ ID NO: 233916 - DNA, 18 bp, Homo sapiens
ccccagatcaccagcccg

SEQ ID NO: 233917 - DNA, 18 bp, Homo sapiens
ccccagatctgcctgggc

SEQ ID NO: 233918 - DNA, 19 bp, Homo sapiens
ccccagcattccagctctg

SEQ ID NO: 233919 - DNA, 14 bp, Homo sapiens
ccccagccaagtgc

SEQ ID NO: 233920 - DNA, 18 bp, Homo sapiens
ccccagccactcctcaac

SEQ ID NO: 233921 - DNA, 11 bp, Homo sapiens
ccccagccagc

SEQ ID NO: 233922 - DNA, 15 bp, Homo sapiens
ccccagccagccctt

SEQ ID NO: 233923 - DNA, 18 bp, Homo sapiens
ccccagccagcccttccc

SEQ ID NO: 233924 - DNA, 23 bp, Homo sapiens
ccccagccagcccttcccaggcc

SEQ ID NO: 233925 - DNA, 18 bp, Homo sapiens
ccccagcccagcccagct

SEQ ID NO: 233926 - DNA, 14 bp, Homo sapiens
ccccagccctgtgg

SEQ ID NO: 233927 - DNA, 17 bp, Homo sapiens
ccccagcccttctgcct

SEQ ID NO: 233928 - DNA, 13 bp, Homo sapiens
ccccagcctcccc

SEQ ID NO: 233929 - DNA, 20 bp, Homo sapiens
ccccagcctcccccaggctg

SEQ ID NO: 233930 - DNA, 23 bp, Homo sapiens
ccccagcctcccccaggctgcgc

SEQ ID NO: 233931 - DNA, 23 bp, Homo sapiens
ccccagcctggccacgcagccag

SEQ ID NO: 233932 - DNA, 22 bp, Homo sapiens
ccccagcgtggggctaacgggc

SEQ ID NO: 233933 - DNA, 10 bp, Homo sapiens
ccccagctga

SEQ ID NO: 233934 - DNA, 16 bp, Homo sapiens
ccccagctgacatgga

SEQ ID NO: 233935 - DNA, 18 bp, Homo sapiens
ccccagctgactgtggcc

SEQ ID NO: 233936 - DNA, 14 bp, Homo sapiens
ccccagctgctcct

SEQ ID NO: 233937 - DNA, 19 bp, Homo sapiens
ccccagctgctcctcgcag

SEQ ID NO: 233938 - DNA, 14 bp, Homo sapiens
ccccagctgggctg

SEQ ID NO: 233939 - DNA, 21 bp, Homo sapiens
ccccagctgggctgttggctg

SEQ ID NO: 233940 - DNA, 17 bp, Homo sapiens
ccccagcttttcttgcc

SEQ ID NO: 233941 - DNA, 21 bp, Homo sapiens
ccccagcttttcttgccagct

SEQ ID NO: 233942 - DNA, 15 bp, Homo sapiens
ccccaggagctcagg

SEQ ID NO: 233943 - DNA, 11 bp, Homo sapiens
ccccaggcagg

SEQ ID NO: 233944 - DNA, 14 bp, Homo sapiens
ccccaggccaggtc

SEQ ID NO: 233945 - DNA, 17 bp, Homo sapiens
ccccaggcctccagcct

SEQ ID NO: 233946 - DNA, 21 bp, Homo sapiens
ccccaggcggaggggcttgga

SEQ ID NO: 233947 - DNA, 20 bp, Homo sapiens
ccccaggctgcgcctgcccg

SEQ ID NO: 233948 - DNA, 22 bp, Homo sapiens
ccccaggctgcgcctgcccgcc

SEQ ID NO: 233949 - DNA, 13 bp, Homo sapiens
ccccagggcccct

SEQ ID NO: 233950 - DNA, 22 bp, Homo sapiens
ccccagggcccctccctctgcc

SEQ ID NO: 233951 - DNA, 13 bp, Homo sapiens
ccccagggccctg

SEQ ID NO: 233952 - DNA, 24 bp, Homo sapiens
ccccagggccctgctcaggcctca

SEQ ID NO: 233953 - DNA, 12 bp, Homo sapiens
ccccagggcctg

SEQ ID NO: 233954 - DNA, 17 bp, Homo sapiens
ccccagggcctgggggc

SEQ ID NO: 233955 - DNA, 14 bp, Homo sapiens
ccccagggctgtgg

SEQ ID NO: 233956 - DNA, 16 bp, Homo sapiens
ccccagggctgtgggt

SEQ ID NO: 233957 - DNA, 20 bp, Homo sapiens
ccccagggctgtgggtgggg

SEQ ID NO: 233958 - DNA, 16 bp, Homo sapiens
ccccaggggaaaatga

SEQ ID NO: 233959 - DNA, 14 bp, Homo sapiens
ccccaggggcacac

SEQ ID NO: 233960 - DNA, 18 bp, Homo sapiens
ccccagggttctgtattg

SEQ ID NO: 233961 - DNA, 21 bp, Homo sapiens
ccccaggtgccaccaataaaa

SEQ ID NO: 233962 - DNA, 12 bp, Homo sapiens
ccccaggtgctg

SEQ ID NO: 233963 - DNA, 22 bp, Homo sapiens
ccccaggttcagactgagctcc

SEQ ID NO: 233964 - DNA, 14 bp, Homo sapiens
ccccagtcctggtt

SEQ ID NO: 233965 - DNA, 15 bp, Homo sapiens
ccccagtcctggttc

SEQ ID NO: 233966 - DNA, 14 bp, Homo sapiens
ccccagtgcctgcc

SEQ ID NO: 233967 - DNA, 15 bp, Homo sapiens
ccccagtgcctgcca

SEQ ID NO: 233968 - DNA, 16 bp, Homo sapiens
ccccagtgcctgccac

SEQ ID NO: 233969 - DNA, 17 bp, Homo sapiens
ccccagtgcctgccact

SEQ ID NO: 233970 - DNA, 19 bp, Homo sapiens
ccccagtgcctgccactct

SEQ ID NO: 233971 - DNA, 21 bp, Homo sapiens
ccccagtgtattttgtccaag

SEQ ID NO: 233972 - DNA, 18 bp, Homo sapiens
ccccatatataaattatt

SEQ ID NO: 233973 - DNA, 18 bp, Homo sapiens
ccccatcacaaacttaaa

SEQ ID NO: 233974 - DNA, 18 bp, Homo sapiens
ccccatccagcatgtgtg

SEQ ID NO: 233975 - DNA, 15 bp, Homo sapiens
ccccatccagccagg

SEQ ID NO: 233976 - DNA, 16 bp, Homo sapiens
ccccatcccacaccct

SEQ ID NO: 233977 - DNA, 19 bp, Homo sapiens
ccccatccccttcctaaat

SEQ ID NO: 233978 - DNA, 13 bp, Homo sapiens
ccccatccctggg

SEQ ID NO: 233979 - DNA, 18 bp, Homo sapiens
ccccatcctccccttccc

SEQ ID NO: 233980 - DNA, 13 bp, Homo sapiens
ccccatccttccc

SEQ ID NO: 233981 - DNA, 14 bp, Homo sapiens
ccccatccttcccg

SEQ ID NO: 233982 - DNA, 18 bp, Homo sapiens
ccccatctccccaggcct

SEQ ID NO: 233983 - DNA, 17 bp, Homo sapiens
ccccatctctgctgctt

SEQ ID NO: 233984 - DNA, 20 bp, Homo sapiens
ccccatctctgctgcttctg

SEQ ID NO: 233985 - DNA, 14 bp, Homo sapiens
ccccatgccaccac

SEQ ID NO: 233986 - DNA, 19 bp, Homo sapiens
ccccatgccaccacccacc

SEQ ID NO: 233987 - DNA, 12 bp, Homo sapiens
ccccatgcctgt

SEQ ID NO: 233988 - DNA, 13 bp, Homo sapiens
ccccatgggcttg

SEQ ID NO: 233989 - DNA, 14 bp, Homo sapiens
ccccatgggcttgg

SEQ ID NO: 233990 - DNA, 14 bp, Homo sapiens
ccccattcagaact

SEQ ID NO: 233991 - DNA, 19 bp, Homo sapiens
ccccattcagaactctcag

SEQ ID NO: 233992 - DNA, 13 bp, Homo sapiens
ccccatttctatt

SEQ ID NO: 233993 - DNA, 13 bp, Homo sapiens
ccccatttgattt

SEQ ID NO: 233994 - DNA, 19 bp, Homo sapiens
cccccaaaccctgcttctg

SEQ ID NO: 233995 - DNA, 14 bp, Homo sapiens
cccccaacaccacc

SEQ ID NO: 233996 - DNA, 20 bp, Homo sapiens
cccccaacaccaccccttgc

SEQ ID NO: 233997 - DNA, 23 bp, Homo sapiens
cccccaaccaagtggctcccaca

SEQ ID NO: 233998 - DNA, 16 bp, Homo sapiens
cccccaaggggcagtc

SEQ ID NO: 233999 - DNA, 17 bp, Homo sapiens
cccccaccacactgaat

SEQ ID NO: 234000 - DNA, 14 bp, Homo sapiens
cccccaccagcagc

SEQ ID NO: 234001 - DNA, 16 bp, Homo sapiens
cccccaccattccaca

SEQ ID NO: 234002 - DNA, 20 bp, Homo sapiens
cccccaccattccacatccc

SEQ ID NO: 234003 - DNA, 12 bp, Homo sapiens
cccccaccccta

SEQ ID NO: 234004 - DNA, 22 bp, Homo sapiens
cccccacctgacaatggcagct

SEQ ID NO: 234005 - DNA, 15 bp, Homo sapiens
cccccacctgcctga

SEQ ID NO: 234006 - DNA, 19 bp, Homo sapiens
cccccacggccgtccctga

SEQ ID NO: 234007 - DNA, 12 bp, Homo sapiens
cccccactccct

SEQ ID NO: 234008 - DNA, 15 bp, Homo sapiens
cccccagaaagcctc

SEQ ID NO: 234009 - DNA, 20 bp, Homo sapiens
cccccagaaagcctcctgcc

SEQ ID NO: 234010 - DNA, 21 bp, Homo sapiens
cccccagaaagcctcctgccc

SEQ ID NO: 234011 - DNA, 15 bp, Homo sapiens
cccccagaccccgcc

SEQ ID NO: 234012 - DNA, 13 bp, Homo sapiens
cccccagagccag

SEQ ID NO: 234013 - DNA, 21 bp, Homo sapiens
cccccagagccagggctgtcc

SEQ ID NO: 234014 - DNA, 21 bp, Homo sapiens
cccccagatagagctgggtgg

SEQ ID NO: 234015 - DNA, 14 bp, Homo sapiens
cccccagcccaata

SEQ ID NO: 234016 - DNA, 15 bp, Homo sapiens
cccccagcccaataa

SEQ ID NO: 234017 - DNA, 12 bp, Homo sapiens
cccccagccctg

SEQ ID NO: 234018 - DNA, 12 bp, Homo sapiens
cccccagcctcc

SEQ ID NO: 234019 - DNA, 14 bp, Homo sapiens
cccccagctcaggg

SEQ ID NO: 234020 - DNA, 14 bp, Homo sapiens
cccccagctgtggg

SEQ ID NO: 234021 - DNA, 16 bp, Homo sapiens
cccccaggctgcgcct

SEQ ID NO: 234022 - DNA, 18 bp, Homo sapiens
cccccaggctgcgcctgc

SEQ ID NO: 234023 - DNA, 17 bp, Homo sapiens
cccccaggtgctggagg

SEQ ID NO: 234024 - DNA, 22 bp, Homo sapiens
cccccagtgtattttgtccaag

SEQ ID NO: 234025 - DNA, 17 bp, Homo sapiens
cccccatctccccaggc

SEQ ID NO: 234026 - DNA, 18 bp, Homo sapiens
cccccatctccccaggcc

SEQ ID NO: 234027 - DNA, 15 bp, Homo sapiens
cccccatgctgcctt

SEQ ID NO: 234028 - DNA, 14 bp, Homo sapiens
cccccatgtggctg

SEQ ID NO: 234029 - DNA, 21 bp, Homo sapiens
ccccccaagatgagctgcagc

SEQ ID NO: 234030 - DNA, 13 bp, Homo sapiens
ccccccagagcca

SEQ ID NO: 234031 - DNA, 16 bp, Homo sapiens
cccccgacactgctgc

SEQ ID NO: 234032 - DNA, 13 bp, Homo sapiens
cccccgagctggg

SEQ ID NO: 234033 - DNA, 13 bp, Homo sapiens
cccccgccacggc

SEQ ID NO: 234034 - DNA, 19 bp, Homo sapiens
cccccgccacggccaccct

SEQ ID NO: 234035 - DNA, 11 bp, Homo sapiens
cccccgccccg

SEQ ID NO: 234036 - DNA, 16 bp, Homo sapiens
cccccgccctcgctcc

SEQ ID NO: 234037 - DNA, 13 bp, Homo sapiens
cccccgccctctg

SEQ ID NO: 234038 - DNA, 15 bp, Homo sapiens
cccccgccctctgcc

SEQ ID NO: 234039 - DNA, 18 bp, Homo sapiens
cccccgccggcaggggcc

SEQ ID NO: 234040 - DNA, 16 bp, Homo sapiens
cccccgcgggttctag

SEQ ID NO: 234041 - DNA, 17 bp, Homo sapiens
cccccgcgggttctaga

SEQ ID NO: 234042 - DNA, 19 bp, Homo sapiens
ccccctaagctccaggtgc

SEQ ID NO: 234043 - DNA, 22 bp, Homo sapiens
ccctgttgagtatttgctgttt

SEQ ID NO: 234044 - DNA, 18 bp, Homo sapiens
ccctgttttctgtttctt

SEQ ID NO: 234045 - DNA, 22 bp, Homo sapiens
cccttaaaaattaaattctctc

SEQ ID NO: 234046 - DNA, 20 bp, Homo sapiens
cccttaagggttgaaggcag

SEQ ID NO: 234047 - DNA, 21 bp, Homo sapiens
cccttaccctttcctccttta

SEQ ID NO: 234048 - DNA, 13 bp, Homo sapiens
cccttacctggct

SEQ ID NO: 234049 - DNA, 15 bp, Homo sapiens
cccttacgtgagtcc

SEQ ID NO: 234050 - DNA, 14 bp, Homo sapiens
cccttacttagcat

SEQ ID NO: 234051 - DNA, 22 bp, Homo sapiens
cccttagagattgccccagagc

SEQ ID NO: 234052 - DNA, 17 bp, Homo sapiens
cccttagcctccctgaa

SEQ ID NO: 234053 - DNA, 19 bp, Homo sapiens
cccttagcctctcccaccc

SEQ ID NO: 234054 - DNA, 14 bp, Homo sapiens
cccttcaaccattc

SEQ ID NO: 234055 - DNA, 18 bp, Homo sapiens
cccttcaaccattcccca

SEQ ID NO: 234056 - DNA, 24 bp, Homo sapiens
cccttcagccgagcccagacctcc

SEQ ID NO: 234057 - DNA, 12 bp, Homo sapiens
cccttcagggcc

SEQ ID NO: 234058 - DNA, 19 bp, Homo sapiens
cccttcagggccagaagga

SEQ ID NO: 234059 - DNA, 18 bp, Homo sapiens
cccttccactgcctctgc

SEQ ID NO: 234060 - DNA, 14 bp, Homo sapiens
cccttcccacccct

SEQ ID NO: 234061 - DNA, 14 bp, Homo sapiens
cccttcccaggcca

SEQ ID NO: 234062 - DNA, 17 bp, Homo sapiens
cccttcccaggccagcg

SEQ ID NO: 234063 - DNA, 21 bp, Homo sapiens
cccttcccagtgggctgtgtt

SEQ ID NO: 234064 - DNA, 14 bp, Homo sapiens
cccttccccaagaa

SEQ ID NO: 234065 - DNA, 21 bp, Homo sapiens
cccttccccactgcctgccca

SEQ ID NO: 234066 - DNA, 10 bp, Homo sapiens
cccttcccct

SEQ ID NO: 234067 - DNA, 16 bp, Homo sapiens
cccttcccctccctgg

SEQ ID NO: 234068 - DNA, 17 bp, Homo sapiens
cccttcccctccctggc

SEQ ID NO: 234069 - DNA, 21 bp, Homo sapiens
cccttcccctgcgccctccct

SEQ ID NO: 234070 - DNA, 13 bp, Homo sapiens
cccttcccctgct

SEQ ID NO: 234071 - DNA, 16 bp, Homo sapiens
cccttcccctgtgact

SEQ ID NO: 234072 - DNA, 19 bp, Homo sapiens
cccttcccctgtgactcct

SEQ ID NO: 234073 - DNA, 15 bp, Homo sapiens
cccttccctgctttg

SEQ ID NO: 234074 - DNA, 17 bp, Homo sapiens
cccttcccttattttta

SEQ ID NO: 234075 - DNA, 14 bp, Homo sapiens
cccttcccttccac

SEQ ID NO: 234076 - DNA, 18 bp, Homo sapiens
cccttcctaaatatccaa

SEQ ID NO: 234077 - DNA, 21 bp, Homo sapiens
cccttcctccgctcccctttc

SEQ ID NO: 234078 - DNA, 13 bp, Homo sapiens
cccttcctcctga

SEQ ID NO: 234079 - DNA, 21 bp, Homo sapiens
cccttcctcctgaagcctctg

SEQ ID NO: 234080 - DNA, 16 bp, Homo sapiens
cccttcctctccactg

SEQ ID NO: 234081 - DNA, 20 bp, Homo sapiens
cccttcctctccactgcctt

SEQ ID NO: 234082 - DNA, 22 bp, Homo sapiens
cccttcctggcctcactggctg

SEQ ID NO: 234083 - DNA, 18 bp, Homo sapiens
cccttcctgtcctgctca

SEQ ID NO: 234084 - DNA, 14 bp, Homo sapiens
cccttcctgtctgg

SEQ ID NO: 234085 - DNA, 17 bp, Homo sapiens
cccttctacactctcct

SEQ ID NO: 234086 - DNA, 16 bp, Homo sapiens
cccttctaccttcctg

SEQ ID NO: 234087 - DNA, 17 bp, Homo sapiens
cccttctactttttcct

SEQ ID NO: 234088 - DNA, 21 bp, Homo sapiens
cccttctactttttccttcct

SEQ ID NO: 234089 - DNA, 22 bp, Homo sapiens
cccttctactttttccttcctg

SEQ ID NO: 234090 - DNA, 13 bp, Homo sapiens
cccttctcccaca

SEQ ID NO: 234091 - DNA, 14 bp, Homo sapiens
cccttctcccacac

SEQ ID NO: 234092 - DNA, 13 bp, Homo sapiens
cccttctcccctg

SEQ ID NO: 234093 - DNA, 15 bp, Homo sapiens
cccttctcccctgca

SEQ ID NO: 234094 - DNA, 21 bp, Homo sapiens
cccttctcccctgcactgtaa

SEQ ID NO: 234095 - DNA, 15 bp, Homo sapiens
cccttctcccctgcc

SEQ ID NO: 234096 - DNA, 21 bp, Homo sapiens
cccttctctcttttcttctca

SEQ ID NO: 234097 - DNA, 15 bp, Homo sapiens
cccttctctgctcca

SEQ ID NO: 234098 - DNA, 20 bp, Homo sapiens
cccttctctgctccaccaca

SEQ ID NO: 234099 - DNA, 16 bp, Homo sapiens
cccttctttgcttctt

SEQ ID NO: 234100 - DNA, 19 bp, Homo sapiens
cccttctttttcttctttt

SEQ ID NO: 234101 - DNA, 21 bp, Homo sapiens
cccttgaagaggggaggggcc

SEQ ID NO: 234102 - DNA, 19 bp, Homo sapiens
cccttgaatctgcagggag

SEQ ID NO: 234103 - DNA, 12 bp, Homo sapiens
cccttgagacct

SEQ ID NO: 234104 - DNA, 17 bp, Homo sapiens
ccgagggcggccaggga

SEQ ID NO: 234105 - DNA, 17 bp, Homo sapiens
ccgagggtcctggctcc

SEQ ID NO: 234106 - DNA, 20 bp, Homo sapiens
ccgagtagctgggattacag

SEQ ID NO: 234107 - DNA, 19 bp, Homo sapiens
ccgagtccaggagccccag

SEQ ID NO: 234108 - DNA, 14 bp, Homo sapiens
ccgagtctcttctc

SEQ ID NO: 234109 - DNA, 20 bp, Homo sapiens
ccgagtctcttctccactgg

SEQ ID NO: 234110 - DNA, 13 bp, Homo sapiens
ccgatgagctggt

SEQ ID NO: 234111 - DNA, 15 bp, Homo sapiens
ccgatgctccagcca

SEQ ID NO: 234112 - DNA, 22 bp, Homo sapiens
ccgatgctccagccaacccctg

SEQ ID NO: 234113 - DNA, 13 bp, Homo sapiens
ccgatggagcccc

SEQ ID NO: 234114 - DNA, 15 bp, Homo sapiens
ccgcaaatccatacc

SEQ ID NO: 234115 - DNA, 16 bp, Homo sapiens
ccgcaaatccataccc

SEQ ID NO: 234116 - DNA, 13 bp, Homo sapiens
ccgcacaccctca

SEQ ID NO: 234117 - DNA, 19 bp, Homo sapiens
ccgcacaccctcactctgc

SEQ ID NO: 234118 - DNA, 20 bp, Homo sapiens
ccgcacaccctcactctgcc

SEQ ID NO: 234119 - DNA, 23 bp, Homo sapiens
ccgcacaccctcactctgccagg

SEQ ID NO: 234120 - DNA, 13 bp, Homo sapiens
ccgcacagcagcc

SEQ ID NO: 234121 - DNA, 14 bp, Homo sapiens
ccgcacagcagcct

SEQ ID NO: 234122 - DNA, 13 bp, Homo sapiens
ccgcaccagctgc

SEQ ID NO: 234123 - DNA, 16 bp, Homo sapiens
ccgcaccagctgctct

SEQ ID NO: 234124 - DNA, 19 bp, Homo sapiens
ccgcaccagctgctctgcc

SEQ ID NO: 234125 - DNA, 20 bp, Homo sapiens
ccgcaccccgatgtggacct

SEQ ID NO: 234126 - DNA, 12 bp, Homo sapiens
ccgcagcaccag

SEQ ID NO: 234127 - DNA, 14 bp, Homo sapiens
ccgcagcaccagcc

SEQ ID NO: 234128 - DNA, 16 bp, Homo sapiens
ccgcagcaccagcctg

SEQ ID NO: 234129 - DNA, 19 bp, Homo sapiens
ccgcagcaccagcctgagc

SEQ ID NO: 234130 - DNA, 20 bp, Homo sapiens
ccgcagcaccagcctgagcc

SEQ ID NO: 234131 - DNA, 14 bp, Homo sapiens
ccgcagcccgcctg

SEQ ID NO: 234132 - DNA, 16 bp, Homo sapiens
ccgcagcccgcctgcc

SEQ ID NO: 234133 - DNA, 21 bp, Homo sapiens
ccgcagcccgtgaagcagtgc

SEQ ID NO: 234134 - DNA, 19 bp, Homo sapiens
ccgcagggcgctccggcag

SEQ ID NO: 234135 - DNA, 20 bp, Homo sapiens
ccgcagggcgctccggcaga

SEQ ID NO: 234136 - DNA, 13 bp, Homo sapiens
ccgcagtccccag

SEQ ID NO: 234137 - DNA, 15 bp, Homo sapiens
ccgcagtccccagcc

SEQ ID NO: 234138 - DNA, 13 bp, Homo sapiens
ccgcatatgcatg

SEQ ID NO: 234139 - DNA, 15 bp, Homo sapiens
ccgcatatgcatgcc

SEQ ID NO: 234140 - DNA, 18 bp, Homo sapiens
ccgcatatgcatgccagg

SEQ ID NO: 234141 - DNA, 19 bp, Homo sapiens
ccgcatatgcatgccaggc

SEQ ID NO: 234142 - DNA, 23 bp, Homo sapiens
ccgcatatgcatgccaggctggg

SEQ ID NO: 234143 - DNA, 14 bp, Homo sapiens
ccgcatcctccagg

SEQ ID NO: 234144 - DNA, 19 bp, Homo sapiens
ccgcatgacaactgaaggc

SEQ ID NO: 234145 - DNA, 17 bp, Homo sapiens
ccgcatgctgcctgcct

SEQ ID NO: 234146 - DNA, 19 bp, Homo sapiens
ccgcatgctgcctgcctcc

SEQ ID NO: 234147 - DNA, 21 bp, Homo sapiens
ccgcatgctgcctgcctccgg

SEQ ID NO: 234148 - DNA, 22 bp, Homo sapiens
ccgcatgctgcctgcctccggc

SEQ ID NO: 234149 - DNA, 13 bp, Homo sapiens
ccgcatggcccct

SEQ ID NO: 234150 - DNA, 15 bp, Homo sapiens
ccgcatggcccctcc

SEQ ID NO: 234151 - DNA, 18 bp, Homo sapiens
ccgcatgtctgcatggca

SEQ ID NO: 234152 - DNA, 15 bp, Homo sapiens
ccgcatgtgtctgta

SEQ ID NO: 234153 - DNA, 18 bp, Homo sapiens
ccgcatgtgtctgtattc

SEQ ID NO: 234154 - DNA, 21 bp, Homo sapiens
ccgccacatccccgctggctg

SEQ ID NO: 234155 - DNA, 12 bp, Homo sapiens
ccgccacggcca

SEQ ID NO: 234156 - DNA, 19 bp, Homo sapiens
ccgccacggccaccctcct

SEQ ID NO: 234157 - DNA, 16 bp, Homo sapiens
ccgccagccagtggcc

SEQ ID NO: 234158 - DNA, 18 bp, Homo sapiens
ccgccagcctcagtgcca

SEQ ID NO: 234159 - DNA, 23 bp, Homo sapiens
ccgcccaaagagaaatcacaggg

SEQ ID NO: 234160 - DNA, 18 bp, Homo sapiens
ccgcccaacccccacctc

SEQ ID NO: 234161 - DNA, 18 bp, Homo sapiens
ccgcccacccacaccccg

SEQ ID NO: 234162 - DNA, 14 bp, Homo sapiens
ccgcccacctctgc

SEQ ID NO: 234163 - DNA, 16 bp, Homo sapiens
ccgcccacctctgctg

SEQ ID NO: 234164 - DNA, 12 bp, Homo sapiens
ccgcccacctgg

SEQ ID NO: 234165 - DNA, 13 bp, Homo sapiens
ccgcccacctggg

SEQ ID NO: 234166 - DNA, 15 bp, Homo sapiens
ccgcccactgtcctg

SEQ ID NO: 234167 - DNA, 16 bp, Homo sapiens
ccgcccactgtcctgg

SEQ ID NO: 234168 - DNA, 19 bp, Homo sapiens
ccgcccagctctcccacat

SEQ ID NO: 234169 - DNA, 12 bp, Homo sapiens
ccgccccagaga

SEQ ID NO: 234170 - DNA, 14 bp, Homo sapiens
ccgccccagagact

SEQ ID NO: 234171 - DNA, 20 bp, Homo sapiens
ccgccccagagactgcccac

SEQ ID NO: 234172 - DNA, 12 bp, Homo sapiens
ccgccccagagc

SEQ ID NO: 234173 - DNA, 13 bp, Homo sapiens
ccgccccagagct

SEQ ID NO: 234174 - DNA, 14 bp, Homo sapiens
ccgccccagagctc

SEQ ID NO: 234175 - DNA, 14 bp, Homo sapiens
ccgccccagcctct

SEQ ID NO: 234176 - DNA, 12 bp, Homo sapiens
ccgcccccaccc

SEQ ID NO: 234177 - DNA, 13 bp, Homo sapiens
ccgcccccacccc

SEQ ID NO: 234178 - DNA, 15 bp, Homo sapiens
ccgccccccagagcc

SEQ ID NO: 234179 - DNA, 17 bp, Homo sapiens
ccgccccccagagccag

SEQ ID NO: 234180 - DNA, 21 bp, Homo sapiens
ccgccccccagagccagggct

SEQ ID NO: 234181 - DNA, 14 bp, Homo sapiens
ccgcccccgccctc

SEQ ID NO: 234182 - DNA, 17 bp, Homo sapiens
ccgcccccgccctcgct

SEQ ID NO: 234183 - DNA, 13 bp, Homo sapiens
ccgcccctgggga

SEQ ID NO: 234184 - DNA, 12 bp, Homo sapiens
ccgcccgccccc

SEQ ID NO: 234185 - DNA, 13 bp, Homo sapiens
ccgcccggggagt

SEQ ID NO: 234186 - DNA, 14 bp, Homo sapiens
ccgccctcctcgct

SEQ ID NO: 234187 - DNA, 18 bp, Homo sapiens
ccgccctcctcgctgtgc

SEQ ID NO: 234188 - DNA, 20 bp, Homo sapiens
ccgccctcctcgctgtgcca

SEQ ID NO: 234189 - DNA, 12 bp, Homo sapiens
ccgccctcctct

SEQ ID NO: 234190 - DNA, 13 bp, Homo sapiens
ccgccctcctctg

SEQ ID NO: 234191 - DNA, 16 bp, Homo sapiens
ccgccctcctctgccc

SEQ ID NO: 234192 - DNA, 13 bp, Homo sapiens
ccgccctcgctcc

SEQ ID NO: 234193 - DNA, 17 bp, Homo sapiens
ccgccctgggctctggg

SEQ ID NO: 234194 - DNA, 13 bp, Homo sapiens
ccgccctgggctg

SEQ ID NO: 234195 - DNA, 15 bp, Homo sapiens
ccgccctgggctgga

SEQ ID NO: 234196 - DNA, 22 bp, Homo sapiens
ccgccctgggctggactggagg

SEQ ID NO: 234197 - DNA, 15 bp, Homo sapiens
ccgccgcctcgggcc

SEQ ID NO: 234198 - DNA, 16 bp, Homo sapiens
ccgccggcaggggccc

SEQ ID NO: 234199 - DNA, 16 bp, Homo sapiens
ccgccggttggccggc

SEQ ID NO: 234200 - DNA, 14 bp, Homo sapiens
ccgcctcagcctct

SEQ ID NO: 234201 - DNA, 12 bp, Homo sapiens
ccgcctccactc

SEQ ID NO: 234202 - DNA, 11 bp, Homo sapiens
ccgcctcctcc

SEQ ID NO: 234203 - DNA, 16 bp, Homo sapiens
ccgcctctgagccagg

SEQ ID NO: 234204 - DNA, 21 bp, Homo sapiens
ccgcctgccgtgcatggctcc

SEQ ID NO: 234205 - DNA, 22 bp, Homo sapiens
ccgcctgcttcacacccctcag

SEQ ID NO: 234206 - DNA, 21 bp, Homo sapiens
ccgcctggcagaactgagctc

SEQ ID NO: 234207 - DNA, 12 bp, Homo sapiens
ccgcctggcagg

SEQ ID NO: 234208 - DNA, 16 bp, Homo sapiens
ccgccttcctcctcca

SEQ ID NO: 234209 - DNA, 23 bp, Homo sapiens
ccgccttccttgaccttcctctg

SEQ ID NO: 234210 - DNA, 13 bp, Homo sapiens
ccgcgagggcctg

SEQ ID NO: 234211 - DNA, 15 bp, Homo sapiens
ccgcgagggcctgcg

SEQ ID NO: 234212 - DNA, 13 bp, Homo sapiens
ccgcgctctgccc

SEQ ID NO: 234213 - DNA, 17 bp, Homo sapiens
ccgcgctctgcccctcc

SEQ ID NO: 234214 - DNA, 16 bp, Homo sapiens
ccgcgggcggccaggc

SEQ ID NO: 234215 - DNA, 16 bp, Homo sapiens
ccgcgggttctagacg

SEQ ID NO: 234216 - DNA, 20 bp, Homo sapiens
ccgcgtccaaccccggggca

SEQ ID NO: 234217 - DNA, 21 bp, Homo sapiens
ccgcgtgacggacatccaggc

SEQ ID NO: 234218 - DNA, 22 bp, Homo sapiens
ccgcgttcaagacttgagcgga

SEQ ID NO: 234219 - DNA, 10 bp, Homo sapiens
ccgctaattc

SEQ ID NO: 234220 - DNA, 15 bp, Homo sapiens
ccgctagaggcctga

SEQ ID NO: 234221 - DNA, 16 bp, Homo sapiens
ccgctagaggcctgag

SEQ ID NO: 234222 - DNA, 13 bp, Homo sapiens
ccgctcaccctcc

SEQ ID NO: 234223 - DNA, 13 bp, Homo sapiens
ccgctcagccctc

SEQ ID NO: 234224 - DNA, 20 bp, Homo sapiens
cctaccagcgcccgctgggc

SEQ ID NO: 234225 - DNA, 21 bp, Homo sapiens
cctaccagtcgccctctgtgc

SEQ ID NO: 234226 - DNA, 15 bp, Homo sapiens
cctaccatgctgctt

SEQ ID NO: 234227 - DNA, 16 bp, Homo sapiens
cctacccacagggcct

SEQ ID NO: 234228 - DNA, 20 bp, Homo sapiens
cctacccacagggcctgact

SEQ ID NO: 234229 - DNA, 18 bp, Homo sapiens
cctacccaccgatggagc

SEQ ID NO: 234230 - DNA, 12 bp, Homo sapiens
cctaccccacac

SEQ ID NO: 234231 - DNA, 18 bp, Homo sapiens
cctaccccacaccaggcc

SEQ ID NO: 234232 - DNA, 13 bp, Homo sapiens
cctaccccacctc

SEQ ID NO: 234233 - DNA, 17 bp, Homo sapiens
cctacccgcccgcgtcc

SEQ ID NO: 234234 - DNA, 14 bp, Homo sapiens
cctaccctttccca

SEQ ID NO: 234235 - DNA, 19 bp, Homo sapiens
cctaccgagtctcttctcc

SEQ ID NO: 234236 - DNA, 17 bp, Homo sapiens
cctacctcaacctgtaa

SEQ ID NO: 234237 - DNA, 21 bp, Homo sapiens
cctacctgattggtgcaaccc

SEQ ID NO: 234238 - DNA, 14 bp, Homo sapiens
cctacctgtgaatc

SEQ ID NO: 234239 - DNA, 17 bp, Homo sapiens
cctacctgttcagtgtc

SEQ ID NO: 234240 - DNA, 19 bp, Homo sapiens
cctaccttcatttcaggag

SEQ ID NO: 234241 - DNA, 19 bp, Homo sapiens
cctaccttgagaccctctt

SEQ ID NO: 234242 - DNA, 22 bp, Homo sapiens
cctaccttgagaccctcttctc

SEQ ID NO: 234243 - DNA, 17 bp, Homo sapiens
cctactaacatcccaat

SEQ ID NO: 234244 - DNA, 19 bp, Homo sapiens
cctactaggagaggggggc

SEQ ID NO: 234245 - DNA, 12 bp, Homo sapiens
cctactctgtgt

SEQ ID NO: 234246 - DNA, 22 bp, Homo sapiens
cctactctgtgtaaatattttt

SEQ ID NO: 234247 - DNA, 17 bp, Homo sapiens
cctactgcttcctctga

SEQ ID NO: 234248 - DNA, 18 bp, Homo sapiens
cctactgtctccttccca

SEQ ID NO: 234249 - DNA, 19 bp, Homo sapiens
cctactgtctccttcccac

SEQ ID NO: 234250 - DNA, 17 bp, Homo sapiens
cctacttccaggttctg

SEQ ID NO: 234251 - DNA, 14 bp, Homo sapiens
cctacttcctcctc

SEQ ID NO: 234252 - DNA, 20 bp, Homo sapiens
cctactttatgtatggagct

SEQ ID NO: 234253 - DNA, 22 bp, Homo sapiens
cctagaaacctttatccctgct

SEQ ID NO: 234254 - DNA, 13 bp, Homo sapiens
cctagaaagccat

SEQ ID NO: 234255 - DNA, 13 bp, Homo sapiens
cctagaagtcttc

SEQ ID NO: 234256 - DNA, 22 bp, Homo sapiens
cctagactctgtaaccacctct

SEQ ID NO: 234257 - DNA, 13 bp, Homo sapiens
cctagacttgaaa

SEQ ID NO: 234258 - DNA, 18 bp, Homo sapiens
cctagagcatctgtccca

SEQ ID NO: 234259 - DNA, 17 bp, Homo sapiens
cctagaggcgagccagg

SEQ ID NO: 234260 - DNA, 20 bp, Homo sapiens
cctagaggcgagccaggcaa

SEQ ID NO: 234261 - DNA, 17 bp, Homo sapiens
cctagataaaaagatgg

SEQ ID NO: 234262 - DNA, 15 bp, Homo sapiens
cctagatggttccct

SEQ ID NO: 234263 - DNA, 21 bp, Homo sapiens
cctagcactttgggaggctga

SEQ ID NO: 234264 - DNA, 13 bp, Homo sapiens
cctagcccaccct

SEQ ID NO: 234265 - DNA, 17 bp, Homo sapiens
cctagcccaccctgctg

SEQ ID NO: 234266 - DNA, 20 bp, Homo sapiens
cctagcccaccctgctgcct

SEQ ID NO: 234267 - DNA, 23 bp, Homo sapiens
cctagcttatctccctgcttcat

SEQ ID NO: 234268 - DNA, 13 bp, Homo sapiens
cctaggaccagtt

SEQ ID NO: 234269 - DNA, 21 bp, Homo sapiens
cctaggagagccaacctcggc

SEQ ID NO: 234270 - DNA, 17 bp, Homo sapiens
cctaggagctggctggc

SEQ ID NO: 234271 - DNA, 22 bp, Homo sapiens
cctaggagctggctggcaggtg

SEQ ID NO: 234272 - DNA, 14 bp, Homo sapiens
cctaggagctgggg

SEQ ID NO: 234273 - DNA, 20 bp, Homo sapiens
cctaggagttgagtacagtg

SEQ ID NO: 234274 - DNA, 18 bp, Homo sapiens
cctaggcatactctccag

SEQ ID NO: 234275 - DNA, 19 bp, Homo sapiens
cctaggcatactctccagg

SEQ ID NO: 234276 - DNA, 20 bp, Homo sapiens
cctaggcatactctccagga

SEQ ID NO: 234277 - DNA, 22 bp, Homo sapiens
cctaggcatactctccaggatt

SEQ ID NO: 234278 - DNA, 12 bp, Homo sapiens
cctaggcctcag

SEQ ID NO: 234279 - DNA, 17 bp, Homo sapiens
cctaggctacccttgcc

SEQ ID NO: 234280 - DNA, 11 bp, Homo sapiens
cctagggagcc

SEQ ID NO: 234281 - DNA, 14 bp, Homo sapiens
cctagggctgggtg

SEQ ID NO: 234282 - DNA, 21 bp, Homo sapiens
cctaggggtgcgctcacctgc

SEQ ID NO: 234283 - DNA, 22 bp, Homo sapiens
cctaggggtgcgctcacctgca

SEQ ID NO: 234284 - DNA, 21 bp, Homo sapiens
cctagggtcttgggggtcagg

SEQ ID NO: 234285 - DNA, 19 bp, Homo sapiens
cctagggttgcttgggcca

SEQ ID NO: 234286 - DNA, 16 bp, Homo sapiens
cctaggtctccacccc

SEQ ID NO: 234287 - DNA, 17 bp, Homo sapiens
cctaggtctccacccct

SEQ ID NO: 234288 - DNA, 21 bp, Homo sapiens
cctaggtgggtcaactccaag

SEQ ID NO: 234289 - DNA, 15 bp, Homo sapiens
cctagtactctctgc

SEQ ID NO: 234290 - DNA, 20 bp, Homo sapiens
cctagtactctctgctctag

SEQ ID NO: 234291 - DNA, 21 bp, Homo sapiens
cctagtactctctgctctagc

SEQ ID NO: 234292 - DNA, 22 bp, Homo sapiens
cctagtactctctgctctagcc

SEQ ID NO: 234293 - DNA, 20 bp, Homo sapiens
cctagtagctgggatgacag

SEQ ID NO: 234294 - DNA, 18 bp, Homo sapiens
cctagtaggagctgagct

SEQ ID NO: 234295 - DNA, 18 bp, Homo sapiens
cctagtatacccactgca

SEQ ID NO: 234296 - DNA, 15 bp, Homo sapiens
cctagtatctggctg

SEQ ID NO: 234297 - DNA, 14 bp, Homo sapiens
cctagtcccttccc

SEQ ID NO: 234298 - DNA, 15 bp, Homo sapiens
cctagtcccttcccc

SEQ ID NO: 234299 - DNA, 12 bp, Homo sapiens
cctagtctttgg

SEQ ID NO: 234300 - DNA, 19 bp, Homo sapiens
cctagtgacccggaggcca

SEQ ID NO: 234301 - DNA, 14 bp, Homo sapiens
cctagtgcagagag

SEQ ID NO: 234302 - DNA, 20 bp, Homo sapiens
cctagtggcttcagcccctg

SEQ ID NO: 234303 - DNA, 22 bp, Homo sapiens
cctagtggcttcagcccctggg

SEQ ID NO: 234304 - DNA, 13 bp, Homo sapiens
cctagtgggagcc

SEQ ID NO: 234305 - DNA, 16 bp, Homo sapiens
cctagtgggagcccag

SEQ ID NO: 234306 - DNA, 21 bp, Homo sapiens
cctagtgggagcccagcacac

SEQ ID NO: 234307 - DNA, 14 bp, Homo sapiens
cctagtggggaggg

SEQ ID NO: 234308 - DNA, 21 bp, Homo sapiens
cctagttcatccaatcctcac

SEQ ID NO: 234309 - DNA, 22 bp, Homo sapiens
cctagttctttgcattcgtcct

SEQ ID NO: 234310 - DNA, 14 bp, Homo sapiens
cctagtttccctga

SEQ ID NO: 234311 - DNA, 17 bp, Homo sapiens
cctataacccctgcctg

SEQ ID NO: 234312 - DNA, 13 bp, Homo sapiens
cctataatgctgg

SEQ ID NO: 234313 - DNA, 20 bp, Homo sapiens
cctataccccttacttagca

SEQ ID NO: 234314 - DNA, 20 bp, Homo sapiens
cctataccctaggtctccac

SEQ ID NO: 234315 - DNA, 20 bp, Homo sapiens
cctatagaaatgtattttga

SEQ ID NO: 234316 - DNA, 22 bp, Homo sapiens
cctatatgtggcattcctttct

SEQ ID NO: 234317 - DNA, 14 bp, Homo sapiens
cctatatttcctct

SEQ ID NO: 234318 - DNA, 15 bp, Homo sapiens
cctatatttcctctt

SEQ ID NO: 234319 - DNA, 15 bp, Homo sapiens
cctatcatcagttag

SEQ ID NO: 234320 - DNA, 13 bp, Homo sapiens
cctatccatcctg

SEQ ID NO: 234321 - DNA, 16 bp, Homo sapiens
cctatccccaggccag

SEQ ID NO: 234322 - DNA, 16 bp, Homo sapiens
cctatcctgcaccctc

SEQ ID NO: 234323 - DNA, 14 bp, Homo sapiens
cctatcctgttctt

SEQ ID NO: 234324 - DNA, 20 bp, Homo sapiens
cctatccttggagagcagct

SEQ ID NO: 234325 - DNA, 22 bp, Homo sapiens
cctatccttggagagcagctgg

SEQ ID NO: 234326 - DNA, 23 bp, Homo sapiens
cctatccttggagagcagctggc

SEQ ID NO: 234327 - DNA, 16 bp, Homo sapiens
cctatccttggcacca

SEQ ID NO: 234328 - DNA, 17 bp, Homo sapiens
cctatccttggcaccaa

SEQ ID NO: 234329 - DNA, 20 bp, Homo sapiens
cctatctcgtgggagagcca

SEQ ID NO: 234330 - DNA, 23 bp, Homo sapiens
cctatctggaaaaaaaaaaatat

SEQ ID NO: 234331 - DNA, 19 bp, Homo sapiens
cctatcttttatttcattc

SEQ ID NO: 234332 - DNA, 14 bp, Homo sapiens
cctatgaaagcaac

SEQ ID NO: 234333 - DNA, 16 bp, Homo sapiens
cctatgaccataaaat

SEQ ID NO: 234334 - DNA, 18 bp, Homo sapiens
cctatgagatggccatgc

SEQ ID NO: 234335 - DNA, 20 bp, Homo sapiens
cctatgagatggccatgctc

SEQ ID NO: 234336 - DNA, 16 bp, Homo sapiens
cctatgcccaggtacc

SEQ ID NO: 234337 - DNA, 20 bp, Homo sapiens
cctatgcctgtggtgaagtg

SEQ ID NO: 234338 - DNA, 20 bp, Homo sapiens
cctatgctgcctaggctgac

SEQ ID NO: 234339 - DNA, 22 bp, Homo sapiens
cctatgctggggtacacagtga

SEQ ID NO: 234340 - DNA, 23 bp, Homo sapiens
cctatgtcctaaggacacactaa

SEQ ID NO: 234341 - DNA, 15 bp, Homo sapiens
cctatgtggcagctg

SEQ ID NO: 234342 - DNA, 11 bp, Homo sapiens
cctatgtttgc

SEQ ID NO: 234343 - DNA, 22 bp, Homo sapiens
cctattctattgcagttataga

SEQ ID NO: 234344 - DNA, 20 bp, Homo sapiens
cctattgccaggaatgtttc

SEQ ID NO: 234345 - DNA, 23 bp, Homo sapiens
cctctggctagaggccagcccca

SEQ ID NO: 234346 - DNA, 13 bp, Homo sapiens
cctctggctgcct

SEQ ID NO: 234347 - DNA, 19 bp, Homo sapiens
cctctggctgcctggccca

SEQ ID NO: 234348 - DNA, 14 bp, Homo sapiens
cctctgggccctgc

SEQ ID NO: 234349 - DNA, 21 bp, Homo sapiens
cctctgggccctgcaggaggc

SEQ ID NO: 234350 - DNA, 10 bp, Homo sapiens
cctctgggct

SEQ ID NO: 234351 - DNA, 11 bp, Homo sapiens
cctctgggctt

SEQ ID NO: 234352 - DNA, 18 bp, Homo sapiens
cctctggggctctagggt

SEQ ID NO: 234353 - DNA, 11 bp, Homo sapiens
cctctgggtga

SEQ ID NO: 234354 - DNA, 18 bp, Homo sapiens
cctctgggtgagtggctg

SEQ ID NO: 234355 - DNA, 16 bp, Homo sapiens
cctctggtgttcctgg

SEQ ID NO: 234356 - DNA, 13 bp, Homo sapiens
cctctggttccac

SEQ ID NO: 234357 - DNA, 19 bp, Homo sapiens
cctctggttcttcatttat

SEQ ID NO: 234358 - DNA, 18 bp, Homo sapiens
cctctggtttggggcgag

SEQ ID NO: 234359 - DNA, 18 bp, Homo sapiens
cctctgtagctccctcct

SEQ ID NO: 234360 - DNA, 23 bp, Homo sapiens
cctctgtagctccctcctcccat

SEQ ID NO: 234361 - DNA, 17 bp, Homo sapiens
cctctgtccaggcactg

SEQ ID NO: 234362 - DNA, 14 bp, Homo sapiens
cctctgtgcctaat

SEQ ID NO: 234363 - DNA, 15 bp, Homo sapiens
cctctgtgctccctc

SEQ ID NO: 234364 - DNA, 22 bp, Homo sapiens
cctctgtgctccctcggtcacc

SEQ ID NO: 234365 - DNA, 20 bp, Homo sapiens
cctctgttctggtggcccca

SEQ ID NO: 234366 - DNA, 15 bp, Homo sapiens
cctctgttgtcctcc

SEQ ID NO: 234367 - DNA, 17 bp, Homo sapiens
cctcttaggtcccggga

SEQ ID NO: 234368 - DNA, 20 bp, Homo sapiens
cctcttcaccccggcaggcc

SEQ ID NO: 234369 - DNA, 19 bp, Homo sapiens
cctcttccaggaagcacag

SEQ ID NO: 234370 - DNA, 20 bp, Homo sapiens
cctcttccaggaagcacagg

SEQ ID NO: 234371 - DNA, 21 bp, Homo sapiens
cctcttccaggaagcacaggc

SEQ ID NO: 234372 - DNA, 22 bp, Homo sapiens
cctcttccaggaagcacaggcc

SEQ ID NO: 234373 - DNA, 24 bp, Homo sapiens
cctcttccaggaagcacaggccag

SEQ ID NO: 234374 - DNA, 17 bp, Homo sapiens
cctcttcccatgactgc

SEQ ID NO: 234375 - DNA, 23 bp, Homo sapiens
cctcttcccatgactgcacccag

SEQ ID NO: 234376 - DNA, 13 bp, Homo sapiens
cctcttccccaga

SEQ ID NO: 234377 - DNA, 15 bp, Homo sapiens
cctcttcccccttcc

SEQ ID NO: 234378 - DNA, 21 bp, Homo sapiens
cctcttcccccttcccctgcg

SEQ ID NO: 234379 - DNA, 18 bp, Homo sapiens
cctcttcccttagcctct

SEQ ID NO: 234380 - DNA, 20 bp, Homo sapiens
cctcttcccttagcctctcc

SEQ ID NO: 234381 - DNA, 23 bp, Homo sapiens
cctcttcccttagcctctcccac

SEQ ID NO: 234382 - DNA, 19 bp, Homo sapiens
cctcttcctccaaagcctg

SEQ ID NO: 234383 - DNA, 19 bp, Homo sapiens
cctcttcctccctcattcc

SEQ ID NO: 234384 - DNA, 20 bp, Homo sapiens
cctcttcctggagccccaga

SEQ ID NO: 234385 - DNA, 13 bp, Homo sapiens
cctcttcctgtag

SEQ ID NO: 234386 - DNA, 20 bp, Homo sapiens
cctcttcctgtagtgcccct

SEQ ID NO: 234387 - DNA, 16 bp, Homo sapiens
cctcttccttgctgtg

SEQ ID NO: 234388 - DNA, 21 bp, Homo sapiens
cctcttctatctaatccttaa

SEQ ID NO: 234389 - DNA, 15 bp, Homo sapiens
cctcttctcaagtgc

SEQ ID NO: 234390 - DNA, 17 bp, Homo sapiens
cctcttctcaagtgcct

SEQ ID NO: 234391 - DNA, 19 bp, Homo sapiens
cctcttctcaagtgcctta

SEQ ID NO: 234392 - DNA, 20 bp, Homo sapiens
cctcttctgcttaggagaga

SEQ ID NO: 234393 - DNA, 19 bp, Homo sapiens
cctcttgagaggggtgaga

SEQ ID NO: 234394 - DNA, 17 bp, Homo sapiens
cctcttgagcagtggct

SEQ ID NO: 234395 - DNA, 16 bp, Homo sapiens
cctcttgccccccacc

SEQ ID NO: 234396 - DNA, 14 bp, Homo sapiens
cctcttgcctctct

SEQ ID NO: 234397 - DNA, 16 bp, Homo sapiens
cctcttgcctctctca

SEQ ID NO: 234398 - DNA, 17 bp, Homo sapiens
cctcttgcggtcccttc

SEQ ID NO: 234399 - DNA, 18 bp, Homo sapiens
cctcttgcggtcccttct

SEQ ID NO: 234400 - DNA, 17 bp, Homo sapiens
cctcttgctcagagcta

SEQ ID NO: 234401 - DNA, 13 bp, Homo sapiens
cctcttgctggtg

SEQ ID NO: 234402 - DNA, 14 bp, Homo sapiens
cctcttgctggtgc

SEQ ID NO: 234403 - DNA, 15 bp, Homo sapiens
cctcttgctggtgca

SEQ ID NO: 234404 - DNA, 14 bp, Homo sapiens
cctcttgggagacg

SEQ ID NO: 234405 - DNA, 19 bp, Homo sapiens
cctcttgtccctttcccta

SEQ ID NO: 234406 - DNA, 13 bp, Homo sapiens
cctcttgtgctca

SEQ ID NO: 234407 - DNA, 15 bp, Homo sapiens
cctcttgtgctgagt

SEQ ID NO: 234408 - DNA, 19 bp, Homo sapiens
cctctttactcccttcctg

SEQ ID NO: 234409 - DNA, 17 bp, Homo sapiens
cctctttcagaaaacag

SEQ ID NO: 234410 - DNA, 23 bp, Homo sapiens
cctctttcagaaaacagaaaaaa

SEQ ID NO: 234411 - DNA, 14 bp, Homo sapiens
cctctttcccctcc

SEQ ID NO: 234412 - DNA, 18 bp, Homo sapiens
cctctttcccctcctttg

SEQ ID NO: 234413 - DNA, 22 bp, Homo sapiens
cctctttcccctcctttgtctt

SEQ ID NO: 234414 - DNA, 17 bp, Homo sapiens
cctctttcctctctggc

SEQ ID NO: 234415 - DNA, 13 bp, Homo sapiens
cctctttctctct

SEQ ID NO: 234416 - DNA, 14 bp, Homo sapiens
cctctttctctctg

SEQ ID NO: 234417 - DNA, 16 bp, Homo sapiens
cctctttctctctgtg

SEQ ID NO: 234418 - DNA, 19 bp, Homo sapiens
cctctttctctctgtgtgg

SEQ ID NO: 234419 - DNA, 21 bp, Homo sapiens
cctctttctctctgtgtggca

SEQ ID NO: 234420 - DNA, 22 bp, Homo sapiens
cctctttgtgtttttgttgttg

SEQ ID NO: 234421 - DNA, 23 bp, Homo sapiens
cctctttgtgtttttgttgttgt

SEQ ID NO: 234422 - DNA, 16 bp, Homo sapiens
cctcttttccctctct

SEQ ID NO: 234423 - DNA, 21 bp, Homo sapiens
cctgaaaacgaaggggccccg

SEQ ID NO: 234424 - DNA, 22 bp, Homo sapiens
cctgaaaatgtttttctgccag

SEQ ID NO: 234425 - DNA, 13 bp, Homo sapiens
cctgaaaattgta

SEQ ID NO: 234426 - DNA, 13 bp, Homo sapiens
cctgaaacacttt

SEQ ID NO: 234427 - DNA, 23 bp, Homo sapiens
cctgaaacccagtaattctaccc

SEQ ID NO: 234428 - DNA, 15 bp, Homo sapiens
cctgaaagaggctga

SEQ ID NO: 234429 - DNA, 12 bp, Homo sapiens
cgcccacctgcc

SEQ ID NO: 234430 - DNA, 13 bp, Homo sapiens
cgcccacctgccc

SEQ ID NO: 234431 - DNA, 16 bp, Homo sapiens
cgcccacctgcccagt

SEQ ID NO: 234432 - DNA, 14 bp, Homo sapiens
cgcccactgtcctg

SEQ ID NO: 234433 - DNA, 17 bp, Homo sapiens
cgcccactgtcctgggc

SEQ ID NO: 234434 - DNA, 22 bp, Homo sapiens
cgcccactgtcctgggcgccct

SEQ ID NO: 234435 - DNA, 18 bp, Homo sapiens
cgcccagacaccacagac

SEQ ID NO: 234436 - DNA, 17 bp, Homo sapiens
cgcccattcgtctgtcc

SEQ ID NO: 234437 - DNA, 22 bp, Homo sapiens
cgcccattcgtctgtcccagag

SEQ ID NO: 234438 - DNA, 17 bp, Homo sapiens
cgccccagagactgccc

SEQ ID NO: 234439 - DNA, 22 bp, Homo sapiens
cgccccagagactgcccaccct

SEQ ID NO: 234440 - DNA, 21 bp, Homo sapiens
cgccccagatcaccagcccgg

SEQ ID NO: 234441 - DNA, 18 bp, Homo sapiens
cgccccatccctgcttgc

SEQ ID NO: 234442 - DNA, 23 bp, Homo sapiens
cgcccccacccctacagcctgca

SEQ ID NO: 234443 - DNA, 22 bp, Homo sapiens
cgccccccagagccagggctgt

SEQ ID NO: 234444 - DNA, 14 bp, Homo sapiens
cgccccgcccccac

SEQ ID NO: 234445 - DNA, 22 bp, Homo sapiens
cgcccctccagtgttgcctcct

SEQ ID NO: 234446 - DNA, 18 bp, Homo sapiens
cgcccctcgctgctgcta

SEQ ID NO: 234447 - DNA, 11 bp, Homo sapiens
cgcccctgggg

SEQ ID NO: 234448 - DNA, 21 bp, Homo sapiens
cgcccctggggaaatagcctc

SEQ ID NO: 234449 - DNA, 22 bp, Homo sapiens
cgcccgcccaccccgctgcctg

SEQ ID NO: 234450 - DNA, 14 bp, Homo sapiens
cgcccgcccccgcc

SEQ ID NO: 234451 - DNA, 15 bp, Homo sapiens
cgcccgccctcctct

SEQ ID NO: 234452 - DNA, 14 bp, Homo sapiens
cgcccgggcccaga

SEQ ID NO: 234453 - DNA, 16 bp, Homo sapiens
cgcccgggcccagagg

SEQ ID NO: 234454 - DNA, 18 bp, Homo sapiens
cgcccgggcccagaggag

SEQ ID NO: 234455 - DNA, 13 bp, Homo sapiens
cgccctccctccc

SEQ ID NO: 234456 - DNA, 21 bp, Homo sapiens
cgccctccctccctccacacc

SEQ ID NO: 234457 - DNA, 23 bp, Homo sapiens
cgccctccctctcccaggcccga

SEQ ID NO: 234458 - DNA, 12 bp, Homo sapiens
cgccctcctctg

SEQ ID NO: 234459 - DNA, 23 bp, Homo sapiens
cgccctcctctgccccctccccc

SEQ ID NO: 234460 - DNA, 11 bp, Homo sapiens
cgccctctgcc

SEQ ID NO: 234461 - DNA, 14 bp, Homo sapiens
cgccctctgtgcct

SEQ ID NO: 234462 - DNA, 17 bp, Homo sapiens
cgccctctgtgcctaat

SEQ ID NO: 234463 - DNA, 19 bp, Homo sapiens
cgccctgcgttggagccac

SEQ ID NO: 234464 - DNA, 18 bp, Homo sapiens
cgccctgggctctgggtt

SEQ ID NO: 234465 - DNA, 12 bp, Homo sapiens
cgccctgggctg

SEQ ID NO: 234466 - DNA, 15 bp, Homo sapiens
cgccctgggctggac

SEQ ID NO: 234467 - DNA, 13 bp, Homo sapiens
cgccctttccttg

SEQ ID NO: 234468 - DNA, 15 bp, Homo sapiens
cgccctttccttgcc

SEQ ID NO: 234469 - DNA, 16 bp, Homo sapiens
cgccctttccttgcct

SEQ ID NO: 234470 - DNA, 18 bp, Homo sapiens
cgccgcctcgggccgcct

SEQ ID NO: 234471 - DNA, 12 bp, Homo sapiens
cgccggcagggg

SEQ ID NO: 234472 - DNA, 17 bp, Homo sapiens
cgccggcaggggcccct

SEQ ID NO: 234473 - DNA, 23 bp, Homo sapiens
cgccggggctggccctgccctcc

SEQ ID NO: 234474 - DNA, 16 bp, Homo sapiens
cgccggttggccggct

SEQ ID NO: 234475 - DNA, 14 bp, Homo sapiens
cgccgtccctctgc

SEQ ID NO: 234476 - DNA, 21 bp, Homo sapiens
cctgagcctgccccagctggg

SEQ ID NO: 234477 - DNA, 12 bp, Homo sapiens
cctgagcctgtc

SEQ ID NO: 234478 - DNA, 15 bp, Homo sapiens
cctgagcctgtctct

SEQ ID NO: 234479 - DNA, 16 bp, Homo sapiens
cctgagccttagaatc

SEQ ID NO: 234480 - DNA, 15 bp, Homo sapiens
cctgagctccaccct

SEQ ID NO: 234481 - DNA, 17 bp, Homo sapiens
cctgagctccaccctcc

SEQ ID NO: 234482 - DNA, 15 bp, Homo sapiens
cctgagctggggcca

SEQ ID NO: 234483 - DNA, 16 bp, Homo sapiens
cctgagctggggccac

SEQ ID NO: 234484 - DNA, 17 bp, Homo sapiens
cctgagctggggccaca

SEQ ID NO: 234485 - DNA, 17 bp, Homo sapiens
cctgagcttggccagaa

SEQ ID NO: 234486 - DNA, 18 bp, Homo sapiens
cctgagcttggccagaag

SEQ ID NO: 234487 - DNA, 21 bp, Homo sapiens
cctgagcttggccagaagggg

SEQ ID NO: 234488 - DNA, 15 bp, Homo sapiens
cctgagctttggaca

SEQ ID NO: 234489 - DNA, 18 bp, Homo sapiens
cctgagctttggacacac

SEQ ID NO: 234490 - DNA, 23 bp, Homo sapiens
cctgagctttggacacacacagc

SEQ ID NO: 234491 - DNA, 18 bp, Homo sapiens
cctgagctttggacgcac

SEQ ID NO: 234492 - DNA, 22 bp, Homo sapiens
cctgaggacaggggcatctctg

SEQ ID NO: 234493 - DNA, 16 bp, Homo sapiens
cctgaggacctttctg

SEQ ID NO: 234494 - DNA, 17 bp, Homo sapiens
cctgaggactggagacc

SEQ ID NO: 234495 - DNA, 16 bp, Homo sapiens
cctgaggatgagctgg

SEQ ID NO: 234496 - DNA, 17 bp, Homo sapiens
cctgaggatgagctgga

SEQ ID NO: 234497 - DNA, 14 bp, Homo sapiens
cctgaggcagaacc

SEQ ID NO: 234498 - DNA, 15 bp, Homo sapiens
cctgaggcagaacct

SEQ ID NO: 234499 - DNA, 14 bp, Homo sapiens
cctgaggcaggaga

SEQ ID NO: 234500 - DNA, 21 bp, Homo sapiens
cctgaggcaggagaatcgctt

SEQ ID NO: 234501 - DNA, 16 bp, Homo sapiens
cctgaggcccagcaga

SEQ ID NO: 234502 - DNA, 18 bp, Homo sapiens
cctgaggcccagcagagc

SEQ ID NO: 234503 - DNA, 21 bp, Homo sapiens
cctgaggcccagcagagccgt

SEQ ID NO: 234504 - DNA, 18 bp, Homo sapiens
cctgagggcccctctgcc

SEQ ID NO: 234505 - DNA, 20 bp, Homo sapiens
cctgagggcccctctgccca

SEQ ID NO: 234506 - DNA, 23 bp, Homo sapiens
cctgagggcccctctgcccagct

SEQ ID NO: 234507 - DNA, 17 bp, Homo sapiens
cctgaggggatatccct

SEQ ID NO: 234508 - DNA, 21 bp, Homo sapiens
cctgaggggatatccctatgt

SEQ ID NO: 234509 - DNA, 22 bp, Homo sapiens
cctgaggggcatctgcccctcc

SEQ ID NO: 234510 - DNA, 23 bp, Homo sapiens
cctgaggggcatctgcccctccc

SEQ ID NO: 234511 - DNA, 16 bp, Homo sapiens
cctgagggtggagact

SEQ ID NO: 234512 - DNA, 17 bp, Homo sapiens
cctgagggtttccacct

SEQ ID NO: 234513 - DNA, 20 bp, Homo sapiens
cctgagtagctggattacag

SEQ ID NO: 234514 - DNA, 14 bp, Homo sapiens
cctgagtccccacc

SEQ ID NO: 234515 - DNA, 15 bp, Homo sapiens
cctgagtcggcccca

SEQ ID NO: 234516 - DNA, 18 bp, Homo sapiens
cctgagtcggccccacat

SEQ ID NO: 234517 - DNA, 22 bp, Homo sapiens
cctgagtcggccccacatggga

SEQ ID NO: 234518 - DNA, 15 bp, Homo sapiens
cctgagtctcctgtg

SEQ ID NO: 234519 - DNA, 18 bp, Homo sapiens
cctgagtctcctgtgccc

SEQ ID NO: 234520 - DNA, 23 bp, Homo sapiens
cctgagtctgctatattttcatg

SEQ ID NO: 234521 - DNA, 13 bp, Homo sapiens
cctgagtgggctg

SEQ ID NO: 234522 - DNA, 17 bp, Homo sapiens
cctgagtgggctgggcc

SEQ ID NO: 234523 - DNA, 18 bp, Homo sapiens
cctgagtgggctgggccc

SEQ ID NO: 234524 - DNA, 14 bp, Homo sapiens
cctgagtggggcca

SEQ ID NO: 234525 - DNA, 21 bp, Homo sapiens
cctgagtggtgaggggccact

SEQ ID NO: 234526 - DNA, 22 bp, Homo sapiens
cctgagttggcgttgtgggcag

SEQ ID NO: 234527 - DNA, 19 bp, Homo sapiens
cctgagtttcaagtatcct

SEQ ID NO: 234528 - DNA, 15 bp, Homo sapiens
cctgatactgggtac

SEQ ID NO: 234529 - DNA, 22 bp, Homo sapiens
cctgatactgggtacaagagcc

SEQ ID NO: 234530 - DNA, 18 bp, Homo sapiens
cctgatagtcacctgctg

SEQ ID NO: 234531 - DNA, 18 bp, Homo sapiens
cctgatcccactcctagg

SEQ ID NO: 234532 - DNA, 19 bp, Homo sapiens
cctgatcccactcctagga

SEQ ID NO: 234533 - DNA, 12 bp, Homo sapiens
cctgatgcccct

SEQ ID NO: 234534 - DNA, 13 bp, Homo sapiens
cctgatgctgccc

SEQ ID NO: 234535 - DNA, 22 bp, Homo sapiens
cctgatgctgccccgttccctg

SEQ ID NO: 234536 - DNA, 23 bp, Homo sapiens
cctgatgctgccccgttccctgt

SEQ ID NO: 234537 - DNA, 13 bp, Homo sapiens
cctgatggccaag

SEQ ID NO: 234538 - DNA, 14 bp, Homo sapiens
cctgatggccaaga

SEQ ID NO: 234539 - DNA, 16 bp, Homo sapiens
cctgatggccaagagc

SEQ ID NO: 234540 - DNA, 19 bp, Homo sapiens
cctgatggccaagagcatc

SEQ ID NO: 234541 - DNA, 16 bp, Homo sapiens
cctgatgttaaaattc

SEQ ID NO: 234542 - DNA, 14 bp, Homo sapiens
cctgatgtttttcc

SEQ ID NO: 234543 - DNA, 13 bp, Homo sapiens
cctgattctccct

SEQ ID NO: 234544 - DNA, 18 bp, Homo sapiens
cctgattgctctggaagc

SEQ ID NO: 234545 - DNA, 23 bp, Homo sapiens
cctgattgctctggaagcctgct

SEQ ID NO: 234546 - DNA, 17 bp, Homo sapiens
cctgattggggcctcac

SEQ ID NO: 234547 - DNA, 21 bp, Homo sapiens
cctgattggggcctcacccag

SEQ ID NO: 234548 - DNA, 14 bp, Homo sapiens
cctgatttgctgtt

SEQ ID NO: 234549 - DNA, 16 bp, Homo sapiens
cctgatttgctgtttt

SEQ ID NO: 234550 - DNA, 15 bp, Homo sapiens
cctgattttgtagtt

SEQ ID NO: 234551 - DNA, 14 bp, Homo sapiens
cctggaccagcctc

SEQ ID NO: 234552 - DNA, 15 bp, Homo sapiens
cctggaccagcctcc

SEQ ID NO: 234553 - DNA, 14 bp, Homo sapiens
cctggacctgcctc

SEQ ID NO: 234554 - DNA, 16 bp, Homo sapiens
cctggacctgcctcct

SEQ ID NO: 234555 - DNA, 13 bp, Homo sapiens
cctggactggccc

SEQ ID NO: 234556 - DNA, 14 bp, Homo sapiens
cctggactggccct

SEQ ID NO: 234557 - DNA, 17 bp, Homo sapiens
cctggactggcccttgc

SEQ ID NO: 234558 - DNA, 22 bp, Homo sapiens
cctggactggcccttgcccaac

SEQ ID NO: 234559 - DNA, 17 bp, Homo sapiens
cctggactttcctgcaa

SEQ ID NO: 234560 - DNA, 19 bp, Homo sapiens
cctggactttcctgcaact

SEQ ID NO: 234561 - DNA, 12 bp, Homo sapiens
cctggagaaagg

SEQ ID NO: 234562 - DNA, 13 bp, Homo sapiens
cctggagaaagga

SEQ ID NO: 234563 - DNA, 17 bp, Homo sapiens
cctggagaaaggatggc

SEQ ID NO: 234564 - DNA, 16 bp, Homo sapiens
cctggagaactagaga

SEQ ID NO: 234565 - DNA, 23 bp, Homo sapiens
cctggagcagcagctgaggcccc

SEQ ID NO: 234566 - DNA, 13 bp, Homo sapiens
cctggagcccaca

SEQ ID NO: 234567 - DNA, 20 bp, Homo sapiens
cctggagcccctgtgtggga

SEQ ID NO: 234568 - DNA, 15 bp, Homo sapiens
cctggagctcctggg

SEQ ID NO: 234569 - DNA, 18 bp, Homo sapiens
cctggagctgtccttcat

SEQ ID NO: 234570 - DNA, 20 bp, Homo sapiens
cctggaggtggggttgggat

SEQ ID NO: 234571 - DNA, 17 bp, Homo sapiens
cctggataaaaaagaaa

SEQ ID NO: 234572 - DNA, 16 bp, Homo sapiens
cctggatgggcattgg

SEQ ID NO: 234573 - DNA, 22 bp, Homo sapiens
cctggatgggggtgcaggcagc

SEQ ID NO: 234574 - DNA, 21 bp, Homo sapiens
cctggatgtcccctgtcccac

SEQ ID NO: 234575 - DNA, 22 bp, Homo sapiens
cctggatgtcccctgtcccacc

SEQ ID NO: 234576 - DNA, 18 bp, Homo sapiens
cctggatgtgtggggcat

SEQ ID NO: 234577 - DNA, 20 bp, Homo sapiens
cctggatgtgtggggcatgg

SEQ ID NO: 234578 - DNA, 12 bp, Homo sapiens
cctggcaatagt

SEQ ID NO: 234579 - DNA, 21 bp, Homo sapiens
cctggcaatagtgtgttctga

SEQ ID NO: 234580 - DNA, 21 bp, Homo sapiens
cctggcacagaaagggcagct

SEQ ID NO: 234581 - DNA, 22 bp, Homo sapiens
cctggcacagaaagggcagctt

SEQ ID NO: 234582 - DNA, 16 bp, Homo sapiens
cctggcacagggcagt

SEQ ID NO: 234583 - DNA, 17 bp, Homo sapiens
cctggcacagggcagtg

SEQ ID NO: 234584 - DNA, 20 bp, Homo sapiens
cctggcagaactgagctcct

SEQ ID NO: 234585 - DNA, 23 bp, Homo sapiens
cctggcagaactgagctcctctg

SEQ ID NO: 234586 - DNA, 14 bp, Homo sapiens
cctggcagagaaga

SEQ ID NO: 234587 - DNA, 15 bp, Homo sapiens
cctggcagagaagag

SEQ ID NO: 234588 - DNA, 19 bp, Homo sapiens
cctggcagccgtgccttca

SEQ ID NO: 234589 - DNA, 18 bp, Homo sapiens
cctggcagggcaggcaga

SEQ ID NO: 234590 - DNA, 16 bp, Homo sapiens
cctggcaggtggaact

SEQ ID NO: 234591 - DNA, 14 bp, Homo sapiens
cctggccacccttg

SEQ ID NO: 234592 - DNA, 19 bp, Homo sapiens
cctggccacgcagccagga

SEQ ID NO: 234593 - DNA, 16 bp, Homo sapiens
cctggccaggagctct

SEQ ID NO: 234594 - DNA, 18 bp, Homo sapiens
cctggccaggagctcttc

SEQ ID NO: 234595 - DNA, 14 bp, Homo sapiens
cctggccaggcaga

SEQ ID NO: 234596 - DNA, 14 bp, Homo sapiens
cctggccatctctg

SEQ ID NO: 234597 - DNA, 12 bp, Homo sapiens
cctggcccagcc

SEQ ID NO: 234598 - DNA, 14 bp, Homo sapiens
cctggcccagccag

SEQ ID NO: 234599 - DNA, 16 bp, Homo sapiens
cctggcccagccagca

SEQ ID NO: 234600 - DNA, 21 bp, Homo sapiens
cctggcccagcggcccctccc

SEQ ID NO: 234601 - DNA, 16 bp, Homo sapiens
cctggcccatctcagc

SEQ ID NO: 234602 - DNA, 12 bp, Homo sapiens
cctggcccccag

SEQ ID NO: 234603 - DNA, 16 bp, Homo sapiens
cctggcccccctccag

SEQ ID NO: 234604 - DNA, 23 bp, Homo sapiens
cctggcccccctccaggcatgct

SEQ ID NO: 234605 - DNA, 19 bp, Homo sapiens
cctggccccgggctctggc

SEQ ID NO: 234606 - DNA, 22 bp, Homo sapiens
cctggccccgggctctggccac

SEQ ID NO: 234607 - DNA, 21 bp, Homo sapiens
cctggcccctccagaccctgc

SEQ ID NO: 234608 - DNA, 22 bp, Homo sapiens
cctggcccctccagaccctgcc

SEQ ID NO: 234609 - DNA, 18 bp, Homo sapiens
cctggcccctcccacatc

SEQ ID NO: 234610 - DNA, 15 bp, Homo sapiens
cctggccctcttctt

SEQ ID NO: 234611 - DNA, 13 bp, Homo sapiens
cctggccctgccc

SEQ ID NO: 234612 - DNA, 16 bp, Homo sapiens
cctggccctgccctga

SEQ ID NO: 234613 - DNA, 22 bp, Homo sapiens
cctggccgggtcaccctgtgac

SEQ ID NO: 234614 - DNA, 16 bp, Homo sapiens
cctggcctatttaagc

SEQ ID NO: 234615 - DNA, 23 bp, Homo sapiens
cctggcctcaagccatcttcccg

SEQ ID NO: 234616 - DNA, 15 bp, Homo sapiens
cctggcctcactggc

SEQ ID NO: 234617 - DNA, 18 bp, Homo sapiens
cctggcctcactggctgg

SEQ ID NO: 234618 - DNA, 19 bp, Homo sapiens
cctggcctcactggctggg

SEQ ID NO: 234619 - DNA, 21 bp, Homo sapiens
cctggcctcactggctggggc

SEQ ID NO: 234620 - DNA, 17 bp, Homo sapiens
cctggcctcccctgcgg

SEQ ID NO: 234621 - DNA, 12 bp, Homo sapiens
cctggcctgagc

SEQ ID NO: 234622 - DNA, 14 bp, Homo sapiens
cctggcctgagctg

SEQ ID NO: 234623 - DNA, 16 bp, Homo sapiens
cctggcctgagctggg

SEQ ID NO: 234624 - DNA, 19 bp, Homo sapiens
cctggcctgagctggggcc

SEQ ID NO: 234625 - DNA, 14 bp, Homo sapiens
cctggcctgctggg

SEQ ID NO: 234626 - DNA, 15 bp, Homo sapiens
cctggcctgctggga

SEQ ID NO: 234627 - DNA, 18 bp, Homo sapiens
cctggcctgctgggaacc

SEQ ID NO: 234628 - DNA, 12 bp, Homo sapiens
cctggcctggct

SEQ ID NO: 234629 - DNA, 12 bp, Homo sapiens
cctggcctggtc

SEQ ID NO: 234630 - DNA, 19 bp, Homo sapiens
cctggcctgttctgttttg

SEQ ID NO: 234631 - DNA, 14 bp, Homo sapiens
cctggccttctgaa

SEQ ID NO: 234632 - DNA, 16 bp, Homo sapiens
cctggccttctgaact

SEQ ID NO: 234633 - DNA, 14 bp, Homo sapiens
cctggcgggcagcc

SEQ ID NO: 234634 - DNA, 17 bp, Homo sapiens
cctggcgggcagcccct

SEQ ID NO: 234635 - DNA, 18 bp, Homo sapiens
cctggcgggcagcccctg

SEQ ID NO: 234636 - DNA, 21 bp, Homo sapiens
cctggcgggcagcccctgctg

SEQ ID NO: 234637 - DNA, 19 bp, Homo sapiens
cctggctacatcccagcct

SEQ ID NO: 234638 - DNA, 15 bp, Homo sapiens
cctggctcacagcca

SEQ ID NO: 234639 - DNA, 17 bp, Homo sapiens
cctggctcacagccacc

SEQ ID NO: 234640 - DNA, 23 bp, Homo sapiens
cctggctcacagccaccacctgg

SEQ ID NO: 234641 - DNA, 12 bp, Homo sapiens
cctggctcagcc

SEQ ID NO: 234642 - DNA, 16 bp, Homo sapiens
cctggctccaggctcc

SEQ ID NO: 234643 - DNA, 17 bp, Homo sapiens
cctggctccaggctcca

SEQ ID NO: 234644 - DNA, 18 bp, Homo sapiens
cctggctcccaagggagg

SEQ ID NO: 234645 - DNA, 17 bp, Homo sapiens
cctggctcccacaggcc

SEQ ID NO: 234646 - DNA, 15 bp, Homo sapiens
cctggctcccaggac

SEQ ID NO: 234647 - DNA, 22 bp, Homo sapiens
cctggctcccatgaccatactg

SEQ ID NO: 234648 - DNA, 17 bp, Homo sapiens
cctggctctgtggcttg

SEQ ID NO: 234649 - DNA, 22 bp, Homo sapiens
cctggctgcgaactgtgcagtt

SEQ ID NO: 234650 - DNA, 16 bp, Homo sapiens
cctggctggggacttg

SEQ ID NO: 234651 - DNA, 23 bp, Homo sapiens
cctggctgtgcacattctccctt

SEQ ID NO: 234652 - DNA, 12 bp, Homo sapiens
cctggctgtgga

SEQ ID NO: 234653 - DNA, 17 bp, Homo sapiens
cctggctgtggaggcct

SEQ ID NO: 234654 - DNA, 13 bp, Homo sapiens
cctggcttcccag

SEQ ID NO: 234655 - DNA, 18 bp, Homo sapiens
cctggcttcccaggaccc

SEQ ID NO: 234656 - DNA, 16 bp, Homo sapiens
cctggcttgcttgccg

SEQ ID NO: 234657 - DNA, 17 bp, Homo sapiens
cctggctttgcccaacc

SEQ ID NO: 234658 - DNA, 21 bp, Homo sapiens
cctggctttgcccaacctcag

SEQ ID NO: 234659 - DNA, 22 bp, Homo sapiens
cctggctttgcccaacctcagc

SEQ ID NO: 234660 - DNA, 15 bp, Homo sapiens
cctggcttttacttt

SEQ ID NO: 234661 - DNA, 16 bp, Homo sapiens
cctggcttttacttta

SEQ ID NO: 234662 - DNA, 17 bp, Homo sapiens
cctggcttttcactgct

SEQ ID NO: 234663 - DNA, 18 bp, Homo sapiens
cctggcttttcactgctg

SEQ ID NO: 234664 - DNA, 21 bp, Homo sapiens
cctggcttttcactgctggct

SEQ ID NO: 234665 - DNA, 16 bp, Homo sapiens
cctgggaaaggaccca

SEQ ID NO: 234666 - DNA, 18 bp, Homo sapiens
cctgggaaggagggagct

SEQ ID NO: 234667 - DNA, 17 bp, Homo sapiens
cctgggagatgctggga

SEQ ID NO: 234668 - DNA, 23 bp, Homo sapiens
cctgggagatgctgggaccctcg

SEQ ID NO: 234669 - DNA, 21 bp, Homo sapiens
cctgggatcagtggggcccca

SEQ ID NO: 234670 - DNA, 19 bp, Homo sapiens
cctgggcaacagagcaaga

SEQ ID NO: 234671 - DNA, 21 bp, Homo sapiens
cctgggcaacagagtgagacc

SEQ ID NO: 234672 - DNA, 21 bp, Homo sapiens
cctgggcaagtgaggcaagag

SEQ ID NO: 234673 - DNA, 15 bp, Homo sapiens
cctgggcacccacct

SEQ ID NO: 234674 - DNA, 19 bp, Homo sapiens
cctgggcacccacctccac

SEQ ID NO: 234675 - DNA, 17 bp, Homo sapiens
cctgggcacctggggag

SEQ ID NO: 234676 - DNA, 18 bp, Homo sapiens
cctgggcagccaggctgc

SEQ ID NO: 234677 - DNA, 16 bp, Homo sapiens
cctgggcagcccagag

SEQ ID NO: 234678 - DNA, 17 bp, Homo sapiens
cctgggcagcccagaga

SEQ ID NO: 234679 - DNA, 19 bp, Homo sapiens
cctgggcagcccagagaga

SEQ ID NO: 234680 - DNA, 18 bp, Homo sapiens
cctgggcagtgcccacca

SEQ ID NO: 234681 - DNA, 19 bp, Homo sapiens
cctgggcagtgcccaccat

SEQ ID NO: 234682 - DNA, 14 bp, Homo sapiens
cctgggcatcccca

SEQ ID NO: 234683 - DNA, 22 bp, Homo sapiens
cctgggcatgtttgtctgtgtg

SEQ ID NO: 234684 - DNA, 11 bp, Homo sapiens
cctgggccacc

SEQ ID NO: 234685 - DNA, 14 bp, Homo sapiens
cctgggccaccctt

SEQ ID NO: 234686 - DNA, 14 bp, Homo sapiens
cctgggccactggc

SEQ ID NO: 234687 - DNA, 14 bp, Homo sapiens
cctgggccagggtc

SEQ ID NO: 234688 - DNA, 15 bp, Homo sapiens
cctgggccagggtct

SEQ ID NO: 234689 - DNA, 12 bp, Homo sapiens
cctgggcccagg

SEQ ID NO: 234690 - DNA, 13 bp, Homo sapiens
cctgggcccctcc

SEQ ID NO: 234691 - DNA, 19 bp, Homo sapiens
cctgggcccctccctacct

SEQ ID NO: 234692 - DNA, 19 bp, Homo sapiens
cctgggcccgggcaggcca

SEQ ID NO: 234693 - DNA, 20 bp, Homo sapiens
cctgggcccgggcaggccag

SEQ ID NO: 234694 - DNA, 13 bp, Homo sapiens
cctgggccctggt

SEQ ID NO: 234695 - DNA, 12 bp, Homo sapiens
cctgggcctccc

SEQ ID NO: 234696 - DNA, 14 bp, Homo sapiens
cctgggcctcccgt

SEQ ID NO: 234697 - DNA, 22 bp, Homo sapiens
cctgggcctcccgtccgtccgc

SEQ ID NO: 234698 - DNA, 17 bp, Homo sapiens
cctgggcctcctgggaa

SEQ ID NO: 234699 - DNA, 13 bp, Homo sapiens
cctgggcctgctt

SEQ ID NO: 234700 - DNA, 23 bp, Homo sapiens
cctgggcctgcttttccaggatc

SEQ ID NO: 234701 - DNA, 12 bp, Homo sapiens
cctgggcctgtc

SEQ ID NO: 234702 - DNA, 13 bp, Homo sapiens
cctgggcctgtgc

SEQ ID NO: 234703 - DNA, 19 bp, Homo sapiens
cctgggcctgtgcagcagc

SEQ ID NO: 234704 - DNA, 19 bp, Homo sapiens
cctgggccttctcagctct

SEQ ID NO: 234705 - DNA, 14 bp, Homo sapiens
cctgggcctttcct

SEQ ID NO: 234706 - DNA, 23 bp, Homo sapiens
cctgggctcaagcaatcctcctg

SEQ ID NO: 234707 - DNA, 14 bp, Homo sapiens
cctgggctctgggt

SEQ ID NO: 234708 - DNA, 15 bp, Homo sapiens
cctgggctggactgg

SEQ ID NO: 234709 - DNA, 18 bp, Homo sapiens
cctgggctggactggagg

SEQ ID NO: 234710 - DNA, 15 bp, Homo sapiens
cctgggctgggagaa

SEQ ID NO: 234711 - DNA, 22 bp, Homo sapiens
cctgggctgggagaaggtgctt

SEQ ID NO: 234712 - DNA, 15 bp, Homo sapiens
cctgggctttctgga

SEQ ID NO: 234713 - DNA, 18 bp, Homo sapiens
cctggggaccatgtgatt

SEQ ID NO: 234714 - DNA, 19 bp, Homo sapiens
cctggggaggctgagactg

SEQ ID NO: 234715 - DNA, 20 bp, Homo sapiens
cctggggaggctgagactgc

SEQ ID NO: 234716 - DNA, 18 bp, Homo sapiens
cctggggagtgggacaga

SEQ ID NO: 234717 - DNA, 23 bp, Homo sapiens
cctggggagtgggacagagtctg

SEQ ID NO: 234718 - DNA, 24 bp, Homo sapiens
cctggggagtgggacagagtctgg

SEQ ID NO: 234719 - DNA, 13 bp, Homo sapiens
cctggggcctctt

SEQ ID NO: 234720 - DNA, 16 bp, Homo sapiens
cctggggcctggcagg

SEQ ID NO: 234721 - DNA, 14 bp, Homo sapiens
cctggggctccggt

SEQ ID NO: 234722 - DNA, 20 bp, Homo sapiens
cctggggctcctttctccag

SEQ ID NO: 234723 - DNA, 21 bp, Homo sapiens
cctggggctcctttctccagc

SEQ ID NO: 234724 - DNA, 14 bp, Homo sapiens
cctggggctgggcc

SEQ ID NO: 234725 - DNA, 17 bp, Homo sapiens
cctggggctgggccccc

SEQ ID NO: 234726 - DNA, 18 bp, Homo sapiens
cctgggggcagtgactgg

SEQ ID NO: 234727 - DNA, 19 bp, Homo sapiens
cctgggggcagtgactggc

SEQ ID NO: 234728 - DNA, 14 bp, Homo sapiens
cctggggggcacag

SEQ ID NO: 234729 - DNA, 18 bp, Homo sapiens
cctgggggtcccaggatc

SEQ ID NO: 234730 - DNA, 15 bp, Homo sapiens
cctgggggtggggga

SEQ ID NO: 234731 - DNA, 22 bp, Homo sapiens
cctgggggttctttcttcctct

SEQ ID NO: 234732 - DNA, 17 bp, Homo sapiens
cctggggtccccactcc

SEQ ID NO: 234733 - DNA, 23 bp, Homo sapiens
cctggggtctctgagcagtgggg

SEQ ID NO: 234734 - DNA, 19 bp, Homo sapiens
cctggggtggcgtctgcct

SEQ ID NO: 234735 - DNA, 20 bp, Homo sapiens
cctggggtttccacacaggc

SEQ ID NO: 234736 - DNA, 21 bp, Homo sapiens
cctggggtttccacacaggcc

SEQ ID NO: 234737 - DNA, 17 bp, Homo sapiens
cctgggtctgtgtctct

SEQ ID NO: 234738 - DNA, 19 bp, Homo sapiens
cctgggtgacagagcgaga

SEQ ID NO: 234739 - DNA, 20 bp, Homo sapiens
cctgggtgagaatcctgcct

SEQ ID NO: 234740 - DNA, 22 bp, Homo sapiens
cctgggtgagaatcctgcctct

SEQ ID NO: 234741 - DNA, 23 bp, Homo sapiens
cctgggtgagaatcctgcctctc

SEQ ID NO: 234742 - DNA, 18 bp, Homo sapiens
cctgggtggatcggcctc

SEQ ID NO: 234743 - DNA, 13 bp, Homo sapiens
cctgggttccctt

SEQ ID NO: 234744 - DNA, 16 bp, Homo sapiens
cctggtacagcagggt

SEQ ID NO: 234745 - DNA, 16 bp, Homo sapiens
cctggtaggaaagcac

SEQ ID NO: 234746 - DNA, 21 bp, Homo sapiens
cctggtatgggtttctcccag

SEQ ID NO: 234747 - DNA, 19 bp, Homo sapiens
cctggtatgtgcctgcgtt

SEQ ID NO: 234748 - DNA, 14 bp, Homo sapiens
cctggtccaggctt

SEQ ID NO: 234749 - DNA, 17 bp, Homo sapiens
cctggtccccccaaatc

SEQ ID NO: 234750 - DNA, 21 bp, Homo sapiens
cctggtccctcgtccacaggg

SEQ ID NO: 234751 - DNA, 17 bp, Homo sapiens
cctggtctggagcccct

SEQ ID NO: 234752 - DNA, 20 bp, Homo sapiens
cctggtgaggaagctccagt

SEQ ID NO: 234753 - DNA, 18 bp, Homo sapiens
cctggtgaggcccagcct

SEQ ID NO: 234754 - DNA, 19 bp, Homo sapiens
cctggtgaggcccagcctg

SEQ ID NO: 234755 - DNA, 19 bp, Homo sapiens
cctggtgcactggccccac

SEQ ID NO: 234756 - DNA, 20 bp, Homo sapiens
cctggtgcgctgtgctccag

SEQ ID NO: 234757 - DNA, 15 bp, Homo sapiens
cctggtgctgccaca

SEQ ID NO: 234758 - DNA, 17 bp, Homo sapiens
cctggtggagaggcctc

SEQ ID NO: 234759 - DNA, 17 bp, Homo sapiens
cgtgacagtgcctggga

SEQ ID NO: 234760 - DNA, 17 bp, Homo sapiens
cgtgaccaattgccctg

SEQ ID NO: 234761 - DNA, 18 bp, Homo sapiens
cgtgaccaattgccctgc

SEQ ID NO: 234762 - DNA, 19 bp, Homo sapiens
cgtgaccaattgccctgcc

SEQ ID NO: 234763 - DNA, 21 bp, Homo sapiens
cgtgaccaattgccctgccag

SEQ ID NO: 234764 - DNA, 19 bp, Homo sapiens
cgtgacccttcagggccag

SEQ ID NO: 234765 - DNA, 18 bp, Homo sapiens
cgtgaccggcccgccacc

SEQ ID NO: 234766 - DNA, 12 bp, Homo sapiens
cgtgagaagcat

SEQ ID NO: 234767 - DNA, 20 bp, Homo sapiens
cgtgagcaggaaggcctggg

SEQ ID NO: 234768 - DNA, 17 bp, Homo sapiens
cgtgagtcctggcatgg

SEQ ID NO: 234769 - DNA, 18 bp, Homo sapiens
cgtgatccacccacctcg

SEQ ID NO: 234770 - DNA, 13 bp, Homo sapiens
cgtgatcttggct

SEQ ID NO: 234771 - DNA, 13 bp, Homo sapiens
cgtgattgaccct

SEQ ID NO: 234772 - DNA, 18 bp, Homo sapiens
cgtgcaaaacatgctacc

SEQ ID NO: 234773 - DNA, 17 bp, Homo sapiens
cgtgcactctgctaatc

SEQ ID NO: 234774 - DNA, 16 bp, Homo sapiens
cgtgcagactggaggg

SEQ ID NO: 234775 - DNA, 20 bp, Homo sapiens
cgtgcatggctcctgtctgg

SEQ ID NO: 234776 - DNA, 13 bp, Homo sapiens
cgtgcatgtgcac

SEQ ID NO: 234777 - DNA, 12 bp, Homo sapiens
cgtgcatttgtg

SEQ ID NO: 234778 - DNA, 14 bp, Homo sapiens
cgtgccaggagcaa

SEQ ID NO: 234779 - DNA, 22 bp, Homo sapiens
cgtgccaggagcaatgggactg

SEQ ID NO: 234780 - DNA, 21 bp, Homo sapiens
cgtgccattgtactccagcct

SEQ ID NO: 234781 - DNA, 21 bp, Homo sapiens
cgtgccattgtctttcctccc

SEQ ID NO: 234782 - DNA, 20 bp, Homo sapiens
cgtgcccagtggctgctcct

SEQ ID NO: 234783 - DNA, 18 bp, Homo sapiens
cgtgcccccctcctccag

SEQ ID NO: 234784 - DNA, 14 bp, Homo sapiens
cgtgcccgcccacc

SEQ ID NO: 234785 - DNA, 22 bp, Homo sapiens
cgtgcccgcccacctctgctgc

SEQ ID NO: 234786 - DNA, 12 bp, Homo sapiens
cgtgccctctgt

SEQ ID NO: 234787 - DNA, 13 bp, Homo sapiens
cgtgcgcagccgc

SEQ ID NO: 234788 - DNA, 20 bp, Homo sapiens
cgtgcgcagccgcgctctgc

SEQ ID NO: 234789 - DNA, 19 bp, Homo sapiens
cgtgcggcccgtgcgcagc

SEQ ID NO: 234790 - DNA, 15 bp, Homo sapiens
cgtgcgtgtctctgc

SEQ ID NO: 234791 - DNA, 14 bp, Homo sapiens
cgtgctaaattttc

SEQ ID NO: 234792 - DNA, 12 bp, Homo sapiens
cgtgctggagag

SEQ ID NO: 234793 - DNA, 15 bp, Homo sapiens
cgtggaaagggtgct

SEQ ID NO: 234794 - DNA, 16 bp, Homo sapiens
cgtggactctgtgctc

SEQ ID NO: 234795 - DNA, 20 bp, Homo sapiens
cgtggagagctggtgcccgg

SEQ ID NO: 234796 - DNA, 23 bp, Homo sapiens
cgtggagatagtgccaggtggct

SEQ ID NO: 234797 - DNA, 15 bp, Homo sapiens
cgtggagatgtcttc

SEQ ID NO: 234798 - DNA, 16 bp, Homo sapiens
cgtggagatgtcttcg

SEQ ID NO: 234799 - DNA, 22 bp, Homo sapiens
cgtggagcaggcggtggggaga

SEQ ID NO: 234800 - DNA, 18 bp, Homo sapiens
cgtggagccacaggcaga

SEQ ID NO: 234801 - DNA, 22 bp, Homo sapiens
cgtggaggaatgctcccccatc

SEQ ID NO: 234802 - DNA, 17 bp, Homo sapiens
cgtggcaactgtggaag

SEQ ID NO: 234803 - DNA, 21 bp, Homo sapiens
cgtggcagataatcagcctct

SEQ ID NO: 234804 - DNA, 22 bp, Homo sapiens
cgtggcagataatcagcctctt

SEQ ID NO: 234805 - DNA, 19 bp, Homo sapiens
cgtggcttcccgctcagcc

SEQ ID NO: 234806 - DNA, 21 bp, Homo sapiens
cgtggcttcccgctcagccct

SEQ ID NO: 234807 - DNA, 16 bp, Homo sapiens
cgtgggagaggcagaa

SEQ ID NO: 234808 - DNA, 18 bp, Homo sapiens
cgtgggatccagagagaa

SEQ ID NO: 234809 - DNA, 13 bp, Homo sapiens
cgtgggccatggc

SEQ ID NO: 234810 - DNA, 18 bp, Homo sapiens
cgtggggcagcacagaga

SEQ ID NO: 234811 - DNA, 14 bp, Homo sapiens
cgtggtagaagcca

SEQ ID NO: 234812 - DNA, 21 bp, Homo sapiens
cgtggtgatcaattaaatgta

SEQ ID NO: 234813 - DNA, 13 bp, Homo sapiens
cgtggttcagaga

SEQ ID NO: 234814 - DNA, 17 bp, Homo sapiens
cgtggttcagagactgg

SEQ ID NO: 234815 - DNA, 22 bp, Homo sapiens
cgtggttcagagactggcagcc

SEQ ID NO: 234816 - DNA, 19 bp, Homo sapiens
cgtgtagcgtcctgaggaa

SEQ ID NO: 234817 - DNA, 17 bp, Homo sapiens
cgtgtaggagtgagaag

SEQ ID NO: 234818 - DNA, 16 bp, Homo sapiens
cgtgtatcctggggct

SEQ ID NO: 234819 - DNA, 13 bp, Homo sapiens
cgtgtccccccag

SEQ ID NO: 234820 - DNA, 16 bp, Homo sapiens
cgtgtccctcctcttc

SEQ ID NO: 234821 - DNA, 21 bp, Homo sapiens
cgtgtcggttcttcctggaag

SEQ ID NO: 234822 - DNA, 13 bp, Homo sapiens
cgtgtctctgcca

SEQ ID NO: 234823 - DNA, 22 bp, Homo sapiens
cgtgtctgtatttatgtgtgag

SEQ ID NO: 234824 - DNA, 16 bp, Homo sapiens
cgtgtgcatgagaatg

SEQ ID NO: 234825 - DNA, 16 bp, Homo sapiens
cgtgtgcgtgcatgtg

SEQ ID NO: 234826 - DNA, 17 bp, Homo sapiens
cgtgtgtccatgtgtgt

SEQ ID NO: 234827 - DNA, 15 bp, Homo sapiens
cgtgtgtccctgtgg

SEQ ID NO: 234828 - DNA, 16 bp, Homo sapiens
cgtgtgtctcatgcca

SEQ ID NO: 234829 - DNA, 20 bp, Homo sapiens
cgtgtgtgtgtgtgtatgtg

SEQ ID NO: 234830 - DNA, 23 bp, Homo sapiens
cgtgtgttgccattttgtctggc

SEQ ID NO: 234831 - DNA, 18 bp, Homo sapiens
cgtgttctcctccaaatg

SEQ ID NO: 234832 - DNA, 17 bp, Homo sapiens
cgttaactgtgtatgta

SEQ ID NO: 234833 - DNA, 19 bp, Homo sapiens
cgttaactgtgtatgtaca

SEQ ID NO: 234834 - DNA, 19 bp, Homo sapiens
cgttaggaataacactgca

SEQ ID NO: 234835 - DNA, 22 bp, Homo sapiens
cgttatctcattgcaaaaatat

SEQ ID NO: 234836 - DNA, 23 bp, Homo sapiens
cgttcaagacttgagcggagccc

SEQ ID NO: 234837 - DNA, 18 bp, Homo sapiens
cgttcacttccccttcca

SEQ ID NO: 234838 - DNA, 19 bp, Homo sapiens
cgttcacttccccttccaa

SEQ ID NO: 234839 - DNA, 11 bp, Homo sapiens
cgttcatttgt

SEQ ID NO: 234840 - DNA, 19 bp, Homo sapiens
ctgcaaattgtagcccagt

SEQ ID NO: 234841 - DNA, 20 bp, Homo sapiens
ctgcaacaggaactgtgaga

SEQ ID NO: 234842 - DNA, 12 bp, Homo sapiens
ctgcaacatgga

SEQ ID NO: 234843 - DNA, 13 bp, Homo sapiens
ctgcaactagcca

SEQ ID NO: 234844 - DNA, 18 bp, Homo sapiens
ctgcaactagccaaggct

SEQ ID NO: 234845 - DNA, 14 bp, Homo sapiens
ctgcaacttctgcc

SEQ ID NO: 234846 - DNA, 15 bp, Homo sapiens
ctgcaacttctgtcc

SEQ ID NO: 234847 - DNA, 16 bp, Homo sapiens
ctgcaacttctgtccc

SEQ ID NO: 234848 - DNA, 23 bp, Homo sapiens
ctgcaagagtgggctttccaggg

SEQ ID NO: 234849 - DNA, 20 bp, Homo sapiens
ctgcaagcacatctgcattt

SEQ ID NO: 234850 - DNA, 14 bp, Homo sapiens
ctgcaagccccagg

SEQ ID NO: 234851 - DNA, 20 bp, Homo sapiens
ctgcaagccccagggcctgg

SEQ ID NO: 234852 - DNA, 14 bp, Homo sapiens
ctgcaagctgcagg

SEQ ID NO: 234853 - DNA, 14 bp, Homo sapiens
ctgcaaggcccaca

SEQ ID NO: 234854 - DNA, 17 bp, Homo sapiens
ctgcaaggcccacagga

SEQ ID NO: 234855 - DNA, 23 bp, Homo sapiens
ctgcaagtccatagctgagctgg

SEQ ID NO: 234856 - DNA, 18 bp, Homo sapiens
ctgcaagttcaagactga

SEQ ID NO: 234857 - DNA, 19 bp, Homo sapiens
ctgcaagttcaagactgaa

SEQ ID NO: 234858 - DNA, 16 bp, Homo sapiens
ctgcaatacattaaaa

SEQ ID NO: 234859 - DNA, 20 bp, Homo sapiens
ctgcaatacattaaaataac

SEQ ID NO: 234860 - DNA, 15 bp, Homo sapiens
ctgcaatagagactg

SEQ ID NO: 234861 - DNA, 14 bp, Homo sapiens
ctgcaatctccagg

SEQ ID NO: 234862 - DNA, 21 bp, Homo sapiens
ctgcaatctccagggctgccc

SEQ ID NO: 234863 - DNA, 22 bp, Homo sapiens
ctgcaatctccagggctgcccc

SEQ ID NO: 234864 - DNA, 16 bp, Homo sapiens
ctgcaatgcctagact

SEQ ID NO: 234865 - DNA, 15 bp, Homo sapiens
ctgcaatgttttcct

SEQ ID NO: 234866 - DNA, 19 bp, Homo sapiens
ctgcaatttgtttaaagaa

SEQ ID NO: 234867 - DNA, 14 bp, Homo sapiens
ctgcaattttctaa

SEQ ID NO: 234868 - DNA, 19 bp, Homo sapiens
ctgcacaagccagggtgtg

SEQ ID NO: 234869 - DNA, 13 bp, Homo sapiens
ctgcacacacagc

SEQ ID NO: 234870 - DNA, 16 bp, Homo sapiens
ctgcacacacctgcct

SEQ ID NO: 234871 - DNA, 14 bp, Homo sapiens
ctgcacacataaca

SEQ ID NO: 234872 - DNA, 18 bp, Homo sapiens
ctgcacacataacacaca

SEQ ID NO: 234873 - DNA, 21 bp, Homo sapiens
ctgcacaccagttactgttca

SEQ ID NO: 234874 - DNA, 15 bp, Homo sapiens
ctgcacactgacata

SEQ ID NO: 234875 - DNA, 13 bp, Homo sapiens
ctgcacagcccaa

SEQ ID NO: 234876 - DNA, 17 bp, Homo sapiens
ctgcacagcccaaccag

SEQ ID NO: 234877 - DNA, 18 bp, Homo sapiens
ctgcacagtgcatctcag

SEQ ID NO: 234878 - DNA, 21 bp, Homo sapiens
ctgcacagtgcatctcagccc

SEQ ID NO: 234879 - DNA, 23 bp, Homo sapiens
ctgcacattagagggacagccaa

SEQ ID NO: 234880 - DNA, 15 bp, Homo sapiens
ctgcacattcctggc

SEQ ID NO: 234881 - DNA, 16 bp, Homo sapiens
ctgcacattcctggcc

SEQ ID NO: 234882 - DNA, 22 bp, Homo sapiens
ctgcacattcctggccccgggc

SEQ ID NO: 234883 - DNA, 21 bp, Homo sapiens
ctgcaccaacctcactgccct

SEQ ID NO: 234884 - DNA, 14 bp, Homo sapiens
ctgcaccagagtga

SEQ ID NO: 234885 - DNA, 15 bp, Homo sapiens
ctgcaccagagtgaa

SEQ ID NO: 234886 - DNA, 22 bp, Homo sapiens
ctgcaccagagtgaaagggcta

SEQ ID NO: 234887 - DNA, 14 bp, Homo sapiens
ctgcaccagcaggt

SEQ ID NO: 234888 - DNA, 17 bp, Homo sapiens
ctgcaccagcaggtgcc

SEQ ID NO: 234889 - DNA, 18 bp, Homo sapiens
ctgcaccagcccttccct

SEQ ID NO: 234890 - DNA, 20 bp, Homo sapiens
ctgcaccagcccttccctgc

SEQ ID NO: 234891 - DNA, 12 bp, Homo sapiens
ctgcacccaccc

SEQ ID NO: 234892 - DNA, 14 bp, Homo sapiens
ctgcacccacccct

SEQ ID NO: 234893 - DNA, 17 bp, Homo sapiens
ctgcaccccagcattcc

SEQ ID NO: 234894 - DNA, 13 bp, Homo sapiens
ctgcaccctctgc

SEQ ID NO: 234895 - DNA, 18 bp, Homo sapiens
ctgcaccctggaaagggg

SEQ ID NO: 234896 - DNA, 20 bp, Homo sapiens
ctgcaccgcggcgcctccgc

SEQ ID NO: 234897 - DNA, 15 bp, Homo sapiens
ctgcacctcctaccc

SEQ ID NO: 234898 - DNA, 19 bp, Homo sapiens
ctgcacctcctaccctccc

SEQ ID NO: 234899 - DNA, 14 bp, Homo sapiens
ctgcacctgaggcc

SEQ ID NO: 234900 - DNA, 15 bp, Homo sapiens
ctgcacctgcgcctg

SEQ ID NO: 234901 - DNA, 14 bp, Homo sapiens
ctgcacctgtgcag

SEQ ID NO: 234902 - DNA, 21 bp, Homo sapiens
ctgcactaaaacccatcttcc

SEQ ID NO: 234903 - DNA, 15 bp, Homo sapiens
ctgcactcacaggct

SEQ ID NO: 234904 - DNA, 21 bp, Homo sapiens
ctgcactccagcctgggtgac

SEQ ID NO: 234905 - DNA, 17 bp, Homo sapiens
ctgcactccatggccac

SEQ ID NO: 234906 - DNA, 18 bp, Homo sapiens
ctgcactccatggccacc

SEQ ID NO: 234907 - DNA, 11 bp, Homo sapiens
ctgcactgtaa

SEQ ID NO: 234908 - DNA, 16 bp, Homo sapiens
ctgcacttcagacacc

SEQ ID NO: 234909 - DNA, 18 bp, Homo sapiens
ctgcacttggtgctgctt

SEQ ID NO: 234910 - DNA, 18 bp, Homo sapiens
ctgcagacaaaaagaaca

SEQ ID NO: 234911 - DNA, 21 bp, Homo sapiens
ctgcagactcgttctcgtgac

SEQ ID NO: 234912 - DNA, 22 bp, Homo sapiens
ctgcagactcgttctcgtgacc

SEQ ID NO: 234913 - DNA, 15 bp, Homo sapiens
ctgcagagctatggt

SEQ ID NO: 234914 - DNA, 12 bp, Homo sapiens
ctgcagagctgg

SEQ ID NO: 234915 - DNA, 14 bp, Homo sapiens
ctgcagaggcagca

SEQ ID NO: 234916 - DNA, 18 bp, Homo sapiens
ctgcagaggcagcaggag

SEQ ID NO: 234917 - DNA, 14 bp, Homo sapiens
ctgcagcagagcct

SEQ ID NO: 234918 - DNA, 13 bp, Homo sapiens
ctgcagcccacag

SEQ ID NO: 234919 - DNA, 15 bp, Homo sapiens
ctgcagcccacagag

SEQ ID NO: 234920 - DNA, 18 bp, Homo sapiens
ctgcagcccacagaggac

SEQ ID NO: 234921 - DNA, 15 bp, Homo sapiens
ctgcagcccagaacg

SEQ ID NO: 234922 - DNA, 24 bp, Homo sapiens
ctgcagcccggcgccaccatcctg

SEQ ID NO: 234923 - DNA, 14 bp, Homo sapiens
ctgcagcccttggg

SEQ ID NO: 234924 - DNA, 12 bp, Homo sapiens
ctgcctggagaa

SEQ ID NO: 234925 - DNA, 17 bp, Homo sapiens
ctgcctggagaaaggat

SEQ ID NO: 234926 - DNA, 20 bp, Homo sapiens
ctgcctggagaaaggatggc

SEQ ID NO: 234927 - DNA, 15 bp, Homo sapiens
ctgcctggatttctt

SEQ ID NO: 234928 - DNA, 19 bp, Homo sapiens
ctgcctggatttcttccta

SEQ ID NO: 234929 - DNA, 15 bp, Homo sapiens
ctgcctggccaggca

SEQ ID NO: 234930 - DNA, 17 bp, Homo sapiens
ctgcctggccaggcaga

SEQ ID NO: 234931 - DNA, 21 bp, Homo sapiens
ctgcctggccaggcagatctg

SEQ ID NO: 234932 - DNA, 16 bp, Homo sapiens
ctgcctggcccccagc

SEQ ID NO: 234933 - DNA, 12 bp, Homo sapiens
ctgcctggcctg

SEQ ID NO: 234934 - DNA, 15 bp, Homo sapiens
ctgcctggcctggct

SEQ ID NO: 234935 - DNA, 18 bp, Homo sapiens
ctgcctggcctggctccc

SEQ ID NO: 234936 - DNA, 16 bp, Homo sapiens
ctgcctggcgggcagc

SEQ ID NO: 234937 - DNA, 12 bp, Homo sapiens
ctgcctgggaac

SEQ ID NO: 234938 - DNA, 11 bp, Homo sapiens
ctgcctgggcc

SEQ ID NO: 234939 - DNA, 15 bp, Homo sapiens
ctgcctgtagttagg

SEQ ID NO: 234940 - DNA, 16 bp, Homo sapiens
ctgcctgtccctctca

SEQ ID NO: 234941 - DNA, 19 bp, Homo sapiens
ctgcctgtgcatgacctga

SEQ ID NO: 234942 - DNA, 21 bp, Homo sapiens
ctgcctgtggccttgcccgcc

SEQ ID NO: 234943 - DNA, 18 bp, Homo sapiens
ctgcctgttataactctg

SEQ ID NO: 234944 - DNA, 16 bp, Homo sapiens
ctgccttagaggagcc

SEQ ID NO: 234945 - DNA, 11 bp, Homo sapiens
ctgccttccag

SEQ ID NO: 234946 - DNA, 13 bp, Homo sapiens
ctgccttccagcc

SEQ ID NO: 234947 - DNA, 16 bp, Homo sapiens
ctgccttccagcccag

SEQ ID NO: 234948 - DNA, 19 bp, Homo sapiens
ctgccttccagcccagacc

SEQ ID NO: 234949 - DNA, 14 bp, Homo sapiens
ctgccttccaggcg

SEQ ID NO: 234950 - DNA, 23 bp, Homo sapiens
ctgccttccaggcgtagggccag

SEQ ID NO: 234951 - DNA, 12 bp, Homo sapiens
ctgccttcctca

SEQ ID NO: 234952 - DNA, 19 bp, Homo sapiens
ctgccttctcccctccaag

SEQ ID NO: 234953 - DNA, 18 bp, Homo sapiens
ctgccttctcctctctgg

SEQ ID NO: 234954 - DNA, 21 bp, Homo sapiens
ctgccttctcctctctgggcc

SEQ ID NO: 234955 - DNA, 18 bp, Homo sapiens
ctgccttctgacggccct

SEQ ID NO: 234956 - DNA, 23 bp, Homo sapiens
ctgccttctgacggccctgcaat

SEQ ID NO: 234957 - DNA, 14 bp, Homo sapiens
ctgccttctgggca

SEQ ID NO: 234958 - DNA, 20 bp, Homo sapiens
ctgccttgatggagaaggaa

SEQ ID NO: 234959 - DNA, 14 bp, Homo sapiens
ctgccttgtgtaca

SEQ ID NO: 234960 - DNA, 20 bp, Homo sapiens
ctgcctttagtcgctgagga

SEQ ID NO: 234961 - DNA, 17 bp, Homo sapiens
ctgcctttctcccccga

SEQ ID NO: 234962 - DNA, 17 bp, Homo sapiens
ctgcctttcttccatca

SEQ ID NO: 234963 - DNA, 15 bp, Homo sapiens
ctgcgaaacccagcg

SEQ ID NO: 234964 - DNA, 16 bp, Homo sapiens
ctgcgaactctcagga

SEQ ID NO: 234965 - DNA, 17 bp, Homo sapiens
ctgcgagcaacagtgcc

SEQ ID NO: 234966 - DNA, 18 bp, Homo sapiens
ctgcgagcaacagtgccc

SEQ ID NO: 234967 - DNA, 13 bp, Homo sapiens
ctgcgattttatc

SEQ ID NO: 234968 - DNA, 14 bp, Homo sapiens
ctgcgcaggccctc

SEQ ID NO: 234969 - DNA, 13 bp, Homo sapiens
ctgcgccctccct

SEQ ID NO: 234970 - DNA, 14 bp, Homo sapiens
ctgcgccctccctc

SEQ ID NO: 234971 - DNA, 19 bp, Homo sapiens
ctgcgcccttgtgccctgc

SEQ ID NO: 234972 - DNA, 13 bp, Homo sapiens
ctgcgctcctctg

SEQ ID NO: 234973 - DNA, 18 bp, Homo sapiens
ctgcgctcctctgcagcc

SEQ ID NO: 234974 - DNA, 20 bp, Homo sapiens
ctgcgctcctctgcagcctg

SEQ ID NO: 234975 - DNA, 14 bp, Homo sapiens
ctgcggaaaaggaa

SEQ ID NO: 234976 - DNA, 21 bp, Homo sapiens
ctgcggcacccttgcgctttt

SEQ ID NO: 234977 - DNA, 15 bp, Homo sapiens
ctgcggcctgctgga

SEQ ID NO: 234978 - DNA, 14 bp, Homo sapiens
ctgcgggcccagct

SEQ ID NO: 234979 - DNA, 21 bp, Homo sapiens
ccttgctgccaagtcctgcct

SEQ ID NO: 234980 - DNA, 18 bp, Homo sapiens
ccttgctgtagagacttc

SEQ ID NO: 234981 - DNA, 18 bp, Homo sapiens
ccttgctttctcttctaa

SEQ ID NO: 234982 - DNA, 17 bp, Homo sapiens
ccttggaaacctgccct

SEQ ID NO: 234983 - DNA, 18 bp, Homo sapiens
ccttggaaacctgccctg

SEQ ID NO: 234984 - DNA, 20 bp, Homo sapiens
ccttggaaacctgccctgcc

SEQ ID NO: 234985 - DNA, 22 bp, Homo sapiens
ccttggacggggacacggcctc

SEQ ID NO: 234986 - DNA, 14 bp, Homo sapiens
ccttggagagcagc

SEQ ID NO: 234987 - DNA, 19 bp, Homo sapiens
ccttggagagcagctggct

SEQ ID NO: 234988 - DNA, 22 bp, Homo sapiens
ccttggagagcagctggctctc

SEQ ID NO: 234989 - DNA, 13 bp, Homo sapiens
ccttggagagctc

SEQ ID NO: 234990 - DNA, 13 bp, Homo sapiens
ccttggagcaggc

SEQ ID NO: 234991 - DNA, 14 bp, Homo sapiens
ccttggagcaggca

SEQ ID NO: 234992 - DNA, 16 bp, Homo sapiens
ccttggaggaatgaca

SEQ ID NO: 234993 - DNA, 20 bp, Homo sapiens
ccttggatttgcatttttgt

SEQ ID NO: 234994 - DNA, 21 bp, Homo sapiens
ccttggatttgcatttttgta

SEQ ID NO: 234995 - DNA, 20 bp, Homo sapiens
ccttggcaccaaagatgcag

SEQ ID NO: 234996 - DNA, 17 bp, Homo sapiens
ccttggccacggcctgg

SEQ ID NO: 234997 - DNA, 11 bp, Homo sapiens
ccttggcccag

SEQ ID NO: 234998 - DNA, 12 bp, Homo sapiens
ccttggcccagc

SEQ ID NO: 234999 - DNA, 21 bp, Homo sapiens
ccttggcccagcagcggccca

SEQ ID NO: 235000 - DNA, 15 bp, Homo sapiens
ccttggcctagccca

SEQ ID NO: 235001 - DNA, 15 bp, Homo sapiens
ccttggcctgtctca

SEQ ID NO: 235002 - DNA, 22 bp, Homo sapiens
ccttggcctgtctcatccccag

SEQ ID NO: 235003 - DNA, 18 bp, Homo sapiens
ccttggcgtgtgtccctg

SEQ ID NO: 235004 - DNA, 12 bp, Homo sapiens
ccttgggacagc

SEQ ID NO: 235005 - DNA, 21 bp, Homo sapiens
ccttgggacagccagagctgg

SEQ ID NO: 235006 - DNA, 17 bp, Homo sapiens
ccttgggatgggcacag

SEQ ID NO: 235007 - DNA, 19 bp, Homo sapiens
ccttgggatgggcacaggc

SEQ ID NO: 235008 - DNA, 14 bp, Homo sapiens
ccttgggcacggga

SEQ ID NO: 235009 - DNA, 11 bp, Homo sapiens
ccttgggcagt

SEQ ID NO: 235010 - DNA, 15 bp, Homo sapiens
ccttgggcctttcag

SEQ ID NO: 235011 - DNA, 12 bp, Homo sapiens
ccttgggctcct

SEQ ID NO: 235012 - DNA, 16 bp, Homo sapiens
ccttgggctcctggct

SEQ ID NO: 235013 - DNA, 17 bp, Homo sapiens
ccttgggctcctggctg

SEQ ID NO: 235014 - DNA, 22 bp, Homo sapiens
ccttggggaatttcctctattg

SEQ ID NO: 235015 - DNA, 23 bp, Homo sapiens
ccttggggaatttcctctattga

SEQ ID NO: 235016 - DNA, 23 bp, Homo sapiens
ccttggggaggggtcagctctgg

SEQ ID NO: 235017 - DNA, 15 bp, Homo sapiens
ccttggggccagact

SEQ ID NO: 235018 - DNA, 22 bp, Homo sapiens
ccttggggccagactggctgca

SEQ ID NO: 235019 - DNA, 15 bp, Homo sapiens
ccttggggcctggct

SEQ ID NO: 235020 - DNA, 16 bp, Homo sapiens
ccttggggcctggctt

SEQ ID NO: 235021 - DNA, 21 bp, Homo sapiens
ccttgggtgagtggcctgcta

SEQ ID NO: 235022 - DNA, 19 bp, Homo sapiens
ccttgggttccaaccaggc

SEQ ID NO: 235023 - DNA, 13 bp, Homo sapiens
ccttggttcctcc

SEQ ID NO: 235024 - DNA, 19 bp, Homo sapiens
ccttgtaattctaaatgaa

SEQ ID NO: 235025 - DNA, 19 bp, Homo sapiens
ccttgtacagaaccagcac

SEQ ID NO: 235026 - DNA, 20 bp, Homo sapiens
ccttgtccaggtctcactgc

SEQ ID NO: 235027 - DNA, 18 bp, Homo sapiens
ccttgtctcttcctctgc

SEQ ID NO: 235028 - DNA, 15 bp, Homo sapiens
ccttgtctgctgctc

SEQ ID NO: 235029 - DNA, 21 bp, Homo sapiens
ccttgtgactcagtgtatttt

SEQ ID NO: 235030 - DNA, 16 bp, Homo sapiens
ccttgtgccctgcctc

SEQ ID NO: 235031 - DNA, 18 bp, Homo sapiens
ccttgtgccctgcctcca

SEQ ID NO: 235032 - DNA, 21 bp, Homo sapiens
ccttgttcctagagtagagtg

SEQ ID NO: 235033 - DNA, 16 bp, Homo sapiens
ccttgttggagcctgc

SEQ ID NO: 235034 - DNA, 18 bp, Homo sapiens
ccttgttggagcctgcag

SEQ ID NO: 235035 - DNA, 17 bp, Homo sapiens
ccttgttggtcagagga

SEQ ID NO: 235036 - DNA, 16 bp, Homo sapiens
ccttgtttgttttatt

SEQ ID NO: 235037 - DNA, 13 bp, Homo sapiens
cctttaagagaaa

SEQ ID NO: 235038 - DNA, 22 bp, Homo sapiens
cctttagaaactgagtcctgtt

SEQ ID NO: 235039 - DNA, 12 bp, Homo sapiens
cctttaggcagg

SEQ ID NO: 235040 - DNA, 16 bp, Homo sapiens
cctttaggcaggaagt

SEQ ID NO: 235041 - DNA, 14 bp, Homo sapiens
cctttatccctgct

SEQ ID NO: 235042 - DNA, 21 bp, Homo sapiens
cctttatccctgcttatctga

SEQ ID NO: 235043 - DNA, 23 bp, Homo sapiens
cctttattaatgaactgtgacag

SEQ ID NO: 235044 - DNA, 12 bp, Homo sapiens
cctttattcttt

SEQ ID NO: 235045 - DNA, 11 bp, Homo sapiens
cctttatttat

SEQ ID NO: 235046 - DNA, 14 bp, Homo sapiens
cgaccgcctgcttc

SEQ ID NO: 235047 - DNA, 14 bp, Homo sapiens
cgaccttggccgca

SEQ ID NO: 235048 - DNA, 16 bp, Homo sapiens
cgaccttggccgcacc

SEQ ID NO: 235049 - DNA, 14 bp, Homo sapiens
cgacggctcctccc

SEQ ID NO: 235050 - DNA, 11 bp, Homo sapiens
cgactcaggat

SEQ ID NO: 235051 - DNA, 18 bp, Homo sapiens
cgactctatagactctag

SEQ ID NO: 235052 - DNA, 10 bp, Homo sapiens
cgactctgct

SEQ ID NO: 235053 - DNA, 14 bp, Homo sapiens
cgactcttcctgca

SEQ ID NO: 235054 - DNA, 18 bp, Homo sapiens
cgactcttcctgcaaagg

SEQ ID NO: 235055 - DNA, 22 bp, Homo sapiens
cgacttcttcggaggtggcagc

SEQ ID NO: 235056 - DNA, 21 bp, Homo sapiens
cgacttgctgttttgttctgt

SEQ ID NO: 235057 - DNA, 23 bp, Homo sapiens
cgacttgggacggaagtggcctg

SEQ ID NO: 235058 - DNA, 21 bp, Homo sapiens
cgagacaccctaactcttgct

SEQ ID NO: 235059 - DNA, 19 bp, Homo sapiens
cgagacattgggaggggct

SEQ ID NO: 235060 - DNA, 13 bp, Homo sapiens
cgagaccagtctg

SEQ ID NO: 235061 - DNA, 19 bp, Homo sapiens
cgagacccttgcattagaa

SEQ ID NO: 235062 - DNA, 19 bp, Homo sapiens
cgagactcctcgggcaagg

SEQ ID NO: 235063 - DNA, 18 bp, Homo sapiens
cgagactgagaggcagaa

SEQ ID NO: 235064 - DNA, 21 bp, Homo sapiens
cgagagctcttagtttttaaa

SEQ ID NO: 235065 - DNA, 19 bp, Homo sapiens
cgagagggctgagcccctc

SEQ ID NO: 235066 - DNA, 22 bp, Homo sapiens
cgagagggctgagcccctcctc

SEQ ID NO: 235067 - DNA, 15 bp, Homo sapiens
cgagatcttccttcc

SEQ ID NO: 235068 - DNA, 16 bp, Homo sapiens
cgagatgtgacccacc

SEQ ID NO: 235069 - DNA, 18 bp, Homo sapiens
cgagatgtgacccaccag

SEQ ID NO: 235070 - DNA, 23 bp, Homo sapiens
cgagcaaatcctggcaagtgacc

SEQ ID NO: 235071 - DNA, 13 bp, Homo sapiens
cgagcaacagtgc

SEQ ID NO: 235072 - DNA, 15 bp, Homo sapiens
cgagcaacagtgccc

SEQ ID NO: 235073 - DNA, 15 bp, Homo sapiens
cgagcactggccaga

SEQ ID NO: 235074 - DNA, 16 bp, Homo sapiens
cgagcactggccagag

SEQ ID NO: 235075 - DNA, 18 bp, Homo sapiens
cgagcactggccagagag

SEQ ID NO: 235076 - DNA, 21 bp, Homo sapiens
cgagcatcccccaaagttcac

SEQ ID NO: 235077 - DNA, 19 bp, Homo sapiens
cgagccatgatgtggagtg

SEQ ID NO: 235078 - DNA, 13 bp, Homo sapiens
cgagcccagctac

SEQ ID NO: 235079 - DNA, 13 bp, Homo sapiens
cgagcccttagcc

SEQ ID NO: 235080 - DNA, 15 bp, Homo sapiens
cgagcccttagcctt

SEQ ID NO: 235081 - DNA, 16 bp, Homo sapiens
cgagccgagctctcct

SEQ ID NO: 235082 - DNA, 24 bp, Homo sapiens
cgagccgcctctggttccactcag

SEQ ID NO: 235083 - DNA, 14 bp, Homo sapiens
cgagcctaatgaaa

SEQ ID NO: 235084 - DNA, 15 bp, Homo sapiens
cgagcctaatgaaag

SEQ ID NO: 235085 - DNA, 16 bp, Homo sapiens
cgagcgacggctcctc

SEQ ID NO: 235086 - DNA, 17 bp, Homo sapiens
cgagcgcgtgccttccc

SEQ ID NO: 235087 - DNA, 21 bp, Homo sapiens
cgagctccttgggtcctgcaa

SEQ ID NO: 235088 - DNA, 17 bp, Homo sapiens
cgagctcgtgtatcctg

SEQ ID NO: 235089 - DNA, 18 bp, Homo sapiens
cgagctcgtgtatcctgg

SEQ ID NO: 235090 - DNA, 20 bp, Homo sapiens
cgagctcgtgtatcctgggg

SEQ ID NO: 235091 - DNA, 14 bp, Homo sapiens
cgagctctcctggg

SEQ ID NO: 235092 - DNA, 17 bp, Homo sapiens
cgagctctcctgggcca

SEQ ID NO: 235093 - DNA, 18 bp, Homo sapiens
cgagctctcctgggccag

SEQ ID NO: 235094 - DNA, 17 bp, Homo sapiens
cgagctctgtcctctgt

SEQ ID NO: 235095 - DNA, 15 bp, Homo sapiens
cgagctgctctgcta

SEQ ID NO: 235096 - DNA, 12 bp, Homo sapiens
cgagctgggggc

SEQ ID NO: 235097 - DNA, 13 bp, Homo sapiens
cgagctgggggcc

SEQ ID NO: 235098 - DNA, 20 bp, Homo sapiens
cgagctgggggccatgagct

SEQ ID NO: 235099 - DNA, 22 bp, Homo sapiens
cgagctggtgcattacagagag

SEQ ID NO: 235100 - DNA, 23 bp, Homo sapiens
cgagctggtgcattacagagagg

SEQ ID NO: 235101 - DNA, 20 bp, Homo sapiens
cgaggaaacgaaacccactc

SEQ ID NO: 235102 - DNA, 15 bp, Homo sapiens
cgaggaaccagagcc

SEQ ID NO: 235103 - DNA, 16 bp, Homo sapiens
cgaggaaccagagcca

SEQ ID NO: 235104 - DNA, 14 bp, Homo sapiens
cgaggaagggccag

SEQ ID NO: 235105 - DNA, 16 bp, Homo sapiens
cgaggaagggccagag

SEQ ID NO: 235106 - DNA, 21 bp, Homo sapiens
cgaggaagggccagagcctgg

SEQ ID NO: 235107 - DNA, 16 bp, Homo sapiens
cgaggcaccggcgctg

SEQ ID NO: 235108 - DNA, 22 bp, Homo sapiens
cgaggcaccggcgctgcaggta

SEQ ID NO: 235109 - DNA, 13 bp, Homo sapiens
cgaggcagaggac

SEQ ID NO: 235110 - DNA, 22 bp, Homo sapiens
cgaggcagcaacaggaccagga

SEQ ID NO: 235111 - DNA, 16 bp, Homo sapiens
cgaggcaggggctggg

SEQ ID NO: 235112 - DNA, 20 bp, Homo sapiens
cgaggcaggggctgggcaga

SEQ ID NO: 235113 - DNA, 23 bp, Homo sapiens
cgaggccttcagaaaagacactt

SEQ ID NO: 235114 - DNA, 17 bp, Homo sapiens
cgaggcgaagctgagcg

SEQ ID NO: 235115 - DNA, 17 bp, Homo sapiens
cgaggcgaggctgcctc

SEQ ID NO: 235116 - DNA, 18 bp, Homo sapiens
cgaggcgatgccacgctt

SEQ ID NO: 235117 - DNA, 18 bp, Homo sapiens
cgaggcgggggagcctgg

SEQ ID NO: 235118 - DNA, 19 bp, Homo sapiens
cgaggcgggggagcctgga

SEQ ID NO: 235119 - DNA, 22 bp, Homo sapiens
cgaggcgggggagcctggagcc

SEQ ID NO: 235120 - DNA, 19 bp, Homo sapiens
ctgcgggtgggtatcccac

SEQ ID NO: 235121 - DNA, 14 bp, Homo sapiens
ctgcggtgaggcag

SEQ ID NO: 235122 - DNA, 18 bp, Homo sapiens
ctgcggtgaggcagggga

SEQ ID NO: 235123 - DNA, 16 bp, Homo sapiens
ctgcggtgggcagcca

SEQ ID NO: 235124 - DNA, 18 bp, Homo sapiens
ctgcgtaggagagaacag

SEQ ID NO: 235125 - DNA, 21 bp, Homo sapiens
ctgcgtcagaccagtactggg

SEQ ID NO: 235126 - DNA, 13 bp, Homo sapiens
ctgcgtcatggct

SEQ ID NO: 235127 - DNA, 13 bp, Homo sapiens
ctgcgtcccactg

SEQ ID NO: 235128 - DNA, 18 bp, Homo sapiens
ctgcgtcccactgagtct

SEQ ID NO: 235129 - DNA, 19 bp, Homo sapiens
ctgcgtcctgacgccctgc

SEQ ID NO: 235130 - DNA, 20 bp, Homo sapiens
ctgcgtcctgacgccctgcg

SEQ ID NO: 235131 - DNA, 21 bp, Homo sapiens
ctgcgtggcctggggctgccg

SEQ ID NO: 235132 - DNA, 13 bp, Homo sapiens
ctgcgttctgata

SEQ ID NO: 235133 - DNA, 17 bp, Homo sapiens
ctgcgttggagccactc

SEQ ID NO: 235134 - DNA, 23 bp, Homo sapiens
ctgcgttggagccactcctgtcc

SEQ ID NO: 235135 - DNA, 16 bp, Homo sapiens
ctgctaaggctcctcc

SEQ ID NO: 235136 - DNA, 14 bp, Homo sapiens
ctgctaataaatga

SEQ ID NO: 235137 - DNA, 19 bp, Homo sapiens
ctgctaataaatgaccagt

SEQ ID NO: 235138 - DNA, 20 bp, Homo sapiens
ctgctaataaatgaccagtt

SEQ ID NO: 235139 - DNA, 12 bp, Homo sapiens
ctgctacacttc

SEQ ID NO: 235140 - DNA, 16 bp, Homo sapiens
ctgctacacttctgat

SEQ ID NO: 235141 - DNA, 18 bp, Homo sapiens
ctgctacagtagctgtgg

SEQ ID NO: 235142 - DNA, 19 bp, Homo sapiens
ctgctaccatgaagtgaaa

SEQ ID NO: 235143 - DNA, 18 bp, Homo sapiens
ctgctaccgccctgggct

SEQ ID NO: 235144 - DNA, 20 bp, Homo sapiens
ctgctactacccgagcccag

SEQ ID NO: 235145 - DNA, 21 bp, Homo sapiens
ctgctactacccgagcccagc

SEQ ID NO: 235146 - DNA, 22 bp, Homo sapiens
ctgctactacccgagcccagct

SEQ ID NO: 235147 - DNA, 23 bp, Homo sapiens
ctgctactacccgagcccagcta

SEQ ID NO: 235148 - DNA, 14 bp, Homo sapiens
ctgctagagcaacc

SEQ ID NO: 235149 - DNA, 19 bp, Homo sapiens
ctgctagagcaacccctgt

SEQ ID NO: 235150 - DNA, 15 bp, Homo sapiens
ctgctagctgtagaa

SEQ ID NO: 235151 - DNA, 16 bp, Homo sapiens
ctgctaggcgctgggg

SEQ ID NO: 235152 - DNA, 23 bp, Homo sapiens
ctgctatattttcatgacttttc

SEQ ID NO: 235153 - DNA, 13 bp, Homo sapiens
ctgctatgaaaat

SEQ ID NO: 235154 - DNA, 22 bp, Homo sapiens
ctgctatgctgttcattgatga

SEQ ID NO: 235155 - DNA, 14 bp, Homo sapiens
ctgctatgtctgtg

SEQ ID NO: 235156 - DNA, 18 bp, Homo sapiens
ctgctatttcccaagctg

SEQ ID NO: 235157 - DNA, 21 bp, Homo sapiens
ctgctcaactctacccctgct

SEQ ID NO: 235158 - DNA, 22 bp, Homo sapiens
ctgctcaactctacccctgctc

SEQ ID NO: 235159 - DNA, 20 bp, Homo sapiens
ctgctcaagaagacatggag

SEQ ID NO: 235160 - DNA, 17 bp, Homo sapiens
ctgctcacattccctct

SEQ ID NO: 235161 - DNA, 21 bp, Homo sapiens
ctgctcacattccctctcatc

SEQ ID NO: 235162 - DNA, 14 bp, Homo sapiens
ctgctcaggcctca

SEQ ID NO: 235163 - DNA, 23 bp, Homo sapiens
ctgctcaggcctcacctggcttc

SEQ ID NO: 235164 - DNA, 11 bp, Homo sapiens
ctgctccacca

SEQ ID NO: 235165 - DNA, 14 bp, Homo sapiens
ctgctccacccttg

SEQ ID NO: 235166 - DNA, 18 bp, Homo sapiens
ctgctccacccttggcct

SEQ ID NO: 235167 - DNA, 19 bp, Homo sapiens
ctgctccacccttggcctg

SEQ ID NO: 235168 - DNA, 15 bp, Homo sapiens
ctgctccatgactgg

SEQ ID NO: 235169 - DNA, 19 bp, Homo sapiens
ctgctccatgactggctgt

SEQ ID NO: 235170 - DNA, 16 bp, Homo sapiens
ctgctccatgcagatc

SEQ ID NO: 235171 - DNA, 22 bp, Homo sapiens
ctgctccatgcagatctagcca

SEQ ID NO: 235172 - DNA, 14 bp, Homo sapiens
ctgctccatgggca

SEQ ID NO: 235173 - DNA, 23 bp, Homo sapiens
ctgctccatttataaccccagcc

SEQ ID NO: 235174 - DNA, 23 bp, Homo sapiens
ctgctcccagatgccttctagat

SEQ ID NO: 235175 - DNA, 16 bp, Homo sapiens
ctgctcccagcagccc

SEQ ID NO: 235176 - DNA, 12 bp, Homo sapiens
ctgctcccagcc

SEQ ID NO: 235177 - DNA, 13 bp, Homo sapiens
ctgctcccagcct

SEQ ID NO: 235178 - DNA, 22 bp, Homo sapiens
ctgctcccagcctgctgagagc

SEQ ID NO: 235179 - DNA, 15 bp, Homo sapiens
ctgctcccattcctc

SEQ ID NO: 235180 - DNA, 17 bp, Homo sapiens
ctgctcccctccctcct

SEQ ID NO: 235181 - DNA, 16 bp, Homo sapiens
ctgctccgtgtgtctc

SEQ ID NO: 235182 - DNA, 18 bp, Homo sapiens
ctgctccgtgtgtctcat

SEQ ID NO: 235183 - DNA, 19 bp, Homo sapiens
ctgctccgtgtgtctcatg

SEQ ID NO: 235184 - DNA, 21 bp, Homo sapiens
ctgctccgtgtgtctcatgcc

SEQ ID NO: 235185 - DNA, 14 bp, Homo sapiens
ctgctcctcaggaa

SEQ ID NO: 235186 - DNA, 14 bp, Homo sapiens
ctgctcctcatggt

SEQ ID NO: 235187 - DNA, 14 bp, Homo sapiens
ctgctcctcgcagt

SEQ ID NO: 235188 - DNA, 14 bp, Homo sapiens
ctgctcctcggcca

SEQ ID NO: 235189 - DNA, 19 bp, Homo sapiens
ctgctcctcggccagagct

SEQ ID NO: 235190 - DNA, 18 bp, Homo sapiens
ctgctcctctttcccctc

SEQ ID NO: 235191 - DNA, 15 bp, Homo sapiens
ctgctcctgaaaaat

SEQ ID NO: 235192 - DNA, 13 bp, Homo sapiens
ctgctcctggagc

SEQ ID NO: 235193 - DNA, 15 bp, Homo sapiens
ctgctcctggagcct

SEQ ID NO: 235194 - DNA, 21 bp, Homo sapiens
ctgctccttggcacccccatg

SEQ ID NO: 235195 - DNA, 15 bp, Homo sapiens
ctgctcgggaaggcc

SEQ ID NO: 235196 - DNA, 20 bp, Homo sapiens
ctgctcgggaaggcctgagg

SEQ ID NO: 235197 - DNA, 21 bp, Homo sapiens
ctgctcgggaaggcctgaggg

SEQ ID NO: 235198 - DNA, 16 bp, Homo sapiens
ctgctctagccaggag

SEQ ID NO: 235199 - DNA, 16 bp, Homo sapiens
ctgctctagctggcag

SEQ ID NO: 235200 - DNA, 20 bp, Homo sapiens
ctgctctagctggcaggaca

SEQ ID NO: 235201 - DNA, 22 bp, Homo sapiens
ctgctctagctggcaggacaca

SEQ ID NO: 235202 - DNA, 14 bp, Homo sapiens
ctgctctcctcttg

SEQ ID NO: 235203 - DNA, 17 bp, Homo sapiens
ctgctctccttgccctg

SEQ ID NO: 235204 - DNA, 18 bp, Homo sapiens
ctgctctccttgccctgg

SEQ ID NO: 235205 - DNA, 19 bp, Homo sapiens
ctgctctccttgccctggg

SEQ ID NO: 235206 - DNA, 20 bp, Homo sapiens
ctgctctccttgccctgggc

SEQ ID NO: 235207 - DNA, 22 bp, Homo sapiens
ctgctctccttgccctgggcca

SEQ ID NO: 235208 - DNA, 17 bp, Homo sapiens
ctgctctctacccagcc

SEQ ID NO: 235209 - DNA, 16 bp, Homo sapiens
ctgctctgaacacgaa

SEQ ID NO: 235210 - DNA, 17 bp, Homo sapiens
ctgctctgcagcccaca

SEQ ID NO: 235211 - DNA, 18 bp, Homo sapiens
ctgctctgcagcccacag

SEQ ID NO: 235212 - DNA, 12 bp, Homo sapiens
ctgctctgccca

SEQ ID NO: 235213 - DNA, 14 bp, Homo sapiens
ctgctctgcccaga

SEQ ID NO: 235214 - DNA, 21 bp, Homo sapiens
ctgctctgcccagagctgggt

SEQ ID NO: 235215 - DNA, 11 bp, Homo sapiens
ctgctctgcta

SEQ ID NO: 235216 - DNA, 20 bp, Homo sapiens
ctgctctgtccaattccaga

SEQ ID NO: 235217 - DNA, 18 bp, Homo sapiens
ctgctctgtcttggtcct

SEQ ID NO: 235218 - DNA, 16 bp, Homo sapiens
ctgctctgtgcctggg

SEQ ID NO: 235219 - DNA, 21 bp, Homo sapiens
ctgctcttatgccatttgttt

SEQ ID NO: 235220 - DNA, 20 bp, Homo sapiens
ctgctcttgcatctgggcca

SEQ ID NO: 235221 - DNA, 14 bp, Homo sapiens
ctgctctttctctg

SEQ ID NO: 235222 - DNA, 21 bp, Homo sapiens
ctgctctttctctgccagtga

SEQ ID NO: 235223 - DNA, 23 bp, Homo sapiens
ctgctgaaaaccatctggcctgg

SEQ ID NO: 235224 - DNA, 23 bp, Homo sapiens
ctgctgaccttggaggaatgaca

SEQ ID NO: 235225 - DNA, 15 bp, Homo sapiens
ctgctgacttctgag

SEQ ID NO: 235226 - DNA, 18 bp, Homo sapiens
ctgctgacttctgagcag

SEQ ID NO: 235227 - DNA, 13 bp, Homo sapiens
ctgctgagagccc

SEQ ID NO: 235228 - DNA, 12 bp, Homo sapiens
ctgctgagccac

SEQ ID NO: 235229 - DNA, 22 bp, Homo sapiens
ctgctgagccactcgcagtcgc

SEQ ID NO: 235230 - DNA, 21 bp, Homo sapiens
ctgctgagctctgacctgccc

SEQ ID NO: 235231 - DNA, 21 bp, Homo sapiens
ctgctgagggaccttggagag

SEQ ID NO: 235232 - DNA, 20 bp, Homo sapiens
ctgctgataatgtatatgaa

SEQ ID NO: 235233 - DNA, 16 bp, Homo sapiens
ctgctgcatagctcta

SEQ ID NO: 235234 - DNA, 22 bp, Homo sapiens
ctgctgccaccaaatctgtcta

SEQ ID NO: 235235 - DNA, 11 bp, Homo sapiens
ctgctgcccac

SEQ ID NO: 235236 - DNA, 14 bp, Homo sapiens
ctgctgccccagct

SEQ ID NO: 235237 - DNA, 15 bp, Homo sapiens
ctgctgccccagctg

SEQ ID NO: 235238 - DNA, 19 bp, Homo sapiens
ctgctgccgcctcccagcc

SEQ ID NO: 235239 - DNA, 21 bp, Homo sapiens
ctgctgccgcctcccagcctg

SEQ ID NO: 235240 - DNA, 17 bp, Homo sapiens
ctgctgcctccctgggg

SEQ ID NO: 235241 - DNA, 15 bp, Homo sapiens
ctgctgcctctgaaa

SEQ ID NO: 235242 - DNA, 11 bp, Homo sapiens
ctgctgcctgc

SEQ ID NO: 235243 - DNA, 22 bp, Homo sapiens
ctgctgcctgcccgcacagcag

SEQ ID NO: 235244 - DNA, 23 bp, Homo sapiens
ctgctgccttctgacggccctgc

SEQ ID NO: 235245 - DNA, 17 bp, Homo sapiens
ctgctgcgcccttacct

SEQ ID NO: 235246 - DNA, 20 bp, Homo sapiens
ctgctgcgtcagaccagtac

SEQ ID NO: 235247 - DNA, 21 bp, Homo sapiens
ctgctgctaatcttcagggca

SEQ ID NO: 235248 - DNA, 16 bp, Homo sapiens
ctgctgctcctcggcc

SEQ ID NO: 235249 - DNA, 22 bp, Homo sapiens
ctgctgctcctcggccagagct

SEQ ID NO: 235250 - DNA, 14 bp, Homo sapiens
ctgctgctcctctt

SEQ ID NO: 235251 - DNA, 18 bp, Homo sapiens
ctgctgctcgggaaggcc

SEQ ID NO: 235252 - DNA, 14 bp, Homo sapiens
ctgctgctgcctcc

SEQ ID NO: 235253 - DNA, 18 bp, Homo sapiens
ctgctgctgcctccctgg

SEQ ID NO: 235254 - DNA, 16 bp, Homo sapiens
ctgctgctgcgccctt

SEQ ID NO: 235255 - DNA, 20 bp, Homo sapiens
ctgctgctgcgcccttacct

SEQ ID NO: 235256 - DNA, 16 bp, Homo sapiens
ctgctgctgctgcgcc

SEQ ID NO: 235257 - DNA, 13 bp, Homo sapiens
ctgctgctggtca

SEQ ID NO: 235258 - DNA, 18 bp, Homo sapiens
ctgctgctggtcaccccc

SEQ ID NO: 235259 - DNA, 14 bp, Homo sapiens
ctgctgcttcctaa

SEQ ID NO: 235260 - DNA, 15 bp, Homo sapiens
ctgctgcttctgggc

SEQ ID NO: 235261 - DNA, 19 bp, Homo sapiens
ctgctgcttctgggcctga

SEQ ID NO: 235262 - DNA, 13 bp, Homo sapiens
ctgctgcttctta

SEQ ID NO: 235263 - DNA, 15 bp, Homo sapiens
ctgctggacagtatc

SEQ ID NO: 235264 - DNA, 21 bp, Homo sapiens
ctgctggatgtcaccaagaag

SEQ ID NO: 235265 - DNA, 17 bp, Homo sapiens
ctgctggccaaagtcag

SEQ ID NO: 235266 - DNA, 22 bp, Homo sapiens
ctgctggcccagccaaaccctg

SEQ ID NO: 235267 - DNA, 17 bp, Homo sapiens
ctgctggcccctcacct

SEQ ID NO: 235268 - DNA, 19 bp, Homo sapiens
ctgctggccgggcacagct

SEQ ID NO: 235269 - DNA, 22 bp, Homo sapiens
ctgctggcgggaatactcttgg

SEQ ID NO: 235270 - DNA, 15 bp, Homo sapiens
ctgctggctgcctta

SEQ ID NO: 235271 - DNA, 14 bp, Homo sapiens
ctgctggcttgcag

SEQ ID NO: 235272 - DNA, 17 bp, Homo sapiens
ctgctgggaaccccgca

SEQ ID NO: 235273 - DNA, 19 bp, Homo sapiens
ctgctgggaaccccgcagc

SEQ ID NO: 235274 - DNA, 20 bp, Homo sapiens
ctgctgggaaccccgcagcc

SEQ ID NO: 235275 - DNA, 12 bp, Homo sapiens
ctgctgggaagt

SEQ ID NO: 235276 - DNA, 12 bp, Homo sapiens
ctgctggggagt

SEQ ID NO: 235277 - DNA, 15 bp, Homo sapiens
ctgctggggcatgtg

SEQ ID NO: 235278 - DNA, 17 bp, Homo sapiens
ctgctggggcatgtgtg

SEQ ID NO: 235279 - DNA, 18 bp, Homo sapiens
ctgctggggcatgtgtgc

SEQ ID NO: 235280 - DNA, 19 bp, Homo sapiens
ctgctggggcatgtgtgcc

SEQ ID NO: 235281 - DNA, 20 bp, Homo sapiens
ctgctggggcatgtgtgcct

SEQ ID NO: 235282 - DNA, 22 bp, Homo sapiens
ctgctggggcatgtgtgcctgt

SEQ ID NO: 235283 - DNA, 22 bp, Homo sapiens
ctgctgggtgggaatgcgctct

SEQ ID NO: 235284 - DNA, 20 bp, Homo sapiens
ctgctggtaatttgtatctg

SEQ ID NO: 235285 - DNA, 18 bp, Homo sapiens
ctgctggttgttgccagg

SEQ ID NO: 235286 - DNA, 19 bp, Homo sapiens
ctgctggttgttgccaggt

SEQ ID NO: 235287 - DNA, 17 bp, Homo sapiens
ctgctgtaactgctgag

SEQ ID NO: 235288 - DNA, 18 bp, Homo sapiens
ctgctgtaactgctgagc

SEQ ID NO: 235289 - DNA, 21 bp, Homo sapiens
ctgctgtaactgctgagccac

SEQ ID NO: 235290 - DNA, 23 bp, Homo sapiens
ctgctgtaactgctgagccactc

SEQ ID NO: 235291 - DNA, 17 bp, Homo sapiens
ctgctgtccctcctgag

SEQ ID NO: 235292 - DNA, 15 bp, Homo sapiens
ctgctgtcctgcagt

SEQ ID NO: 235293 - DNA, 22 bp, Homo sapiens
ctgctgtgaacaagtgaacaca

SEQ ID NO: 235294 - DNA, 12 bp, Homo sapiens
ctgctgtgctct

SEQ ID NO: 235295 - DNA, 17 bp, Homo sapiens
ctgctgtgctctgggga

SEQ ID NO: 235296 - DNA, 18 bp, Homo sapiens
ctgctgtgggtcagtgtg

SEQ ID NO: 235297 - DNA, 21 bp, Homo sapiens
ctgctgtgggtcagtgtgcca

SEQ ID NO: 235298 - DNA, 19 bp, Homo sapiens
ctgctgttctttaaatgcg

SEQ ID NO: 235299 - DNA, 24 bp, Homo sapiens
ctgctgttttatgtcatactctgt

SEQ ID NO: 235300 - DNA, 23 bp, Homo sapiens
ctgcttaatgtcagtctacaggc

SEQ ID NO: 235301 - DNA, 18 bp, Homo sapiens
ctgcttacaattccctgc

SEQ ID NO: 235302 - DNA, 16 bp, Homo sapiens
ctgcttagaacccttc

SEQ ID NO: 235303 - DNA, 20 bp, Homo sapiens
ctgcttagaacccttctgct

SEQ ID NO: 235304 - DNA, 22 bp, Homo sapiens
ctgcttagaacccttctgcttt

SEQ ID NO: 235305 - DNA, 16 bp, Homo sapiens
ctgcttaggagagacc

SEQ ID NO: 235306 - DNA, 17 bp, Homo sapiens
ctgcttagtgtccctta

SEQ ID NO: 235307 - DNA, 16 bp, Homo sapiens
ctgcttatctgaaact

SEQ ID NO: 235308 - DNA, 17 bp, Homo sapiens
ctgcttcacacccctca

SEQ ID NO: 235309 - DNA, 21 bp, Homo sapiens
ctgcttcacacccctcagcgc

SEQ ID NO: 235310 - DNA, 19 bp, Homo sapiens
ctgcttcacggactctttg

SEQ ID NO: 235311 - DNA, 23 bp, Homo sapiens
ctgcttcacggactctttgctgt

SEQ ID NO: 235312 - DNA, 14 bp, Homo sapiens
ctgcttcatatctc

SEQ ID NO: 235313 - DNA, 11 bp, Homo sapiens
ctgcttccagg

SEQ ID NO: 235314 - DNA, 12 bp, Homo sapiens
ctgcttccagga

SEQ ID NO: 235315 - DNA, 20 bp, Homo sapiens
ctgcttccatggcttcctga

SEQ ID NO: 235316 - DNA, 11 bp, Homo sapiens
ctgcttcccac

SEQ ID NO: 235317 - DNA, 16 bp, Homo sapiens
ctgcttcccacctccc

SEQ ID NO: 235318 - DNA, 19 bp, Homo sapiens
ctgcttcccacctccctgc

SEQ ID NO: 235319 - DNA, 22 bp, Homo sapiens
ctgcttcccacctccctgccca

SEQ ID NO: 235320 - DNA, 24 bp, Homo sapiens
ctgcttcccacctccctgcccagg

SEQ ID NO: 235321 - DNA, 20 bp, Homo sapiens
ctgcttccctctgcctgtcc

SEQ ID NO: 235322 - DNA, 14 bp, Homo sapiens
ctgcttcctaactt

SEQ ID NO: 235323 - DNA, 16 bp, Homo sapiens
ctgcttctaagatgcc

SEQ ID NO: 235324 - DNA, 11 bp, Homo sapiens
ctgcttctcca

SEQ ID NO: 235325 - DNA, 14 bp, Homo sapiens
ctgcttctccacct

SEQ ID NO: 235326 - DNA, 19 bp, Homo sapiens
ctgcttctccacctccccc

SEQ ID NO: 235327 - DNA, 10 bp, Homo sapiens
ctgcttctgc

SEQ ID NO: 235328 - DNA, 11 bp, Homo sapiens
ctgcttctgct

SEQ ID NO: 235329 - DNA, 13 bp, Homo sapiens
ctgcttctgctgc

SEQ ID NO: 235330 - DNA, 13 bp, Homo sapiens
ctgcttctgggcc

SEQ ID NO: 235331 - DNA, 16 bp, Homo sapiens
ctgcttctgtgcattt

SEQ ID NO: 235332 - DNA, 23 bp, Homo sapiens
ctgcttctgtgcatttgtgtctg

SEQ ID NO: 235333 - DNA, 21 bp, Homo sapiens
ctgcttgataggaattcatct

SEQ ID NO: 235334 - DNA, 16 bp, Homo sapiens
ctgcttgcccgctccc

SEQ ID NO: 235335 - DNA, 18 bp, Homo sapiens
ctgcttgcccgctcccac

SEQ ID NO: 235336 - DNA, 20 bp, Homo sapiens
ctgcttgccgactggctgtg

SEQ ID NO: 235337 - DNA, 20 bp, Homo sapiens
ctgcttgcttgctttttaat

SEQ ID NO: 235338 - DNA, 16 bp, Homo sapiens
ctgcttggctgtcccc

SEQ ID NO: 235339 - DNA, 14 bp, Homo sapiens
ctgcttggggcctg

SEQ ID NO: 235340 - DNA, 15 bp, Homo sapiens
ctgcttggggcctgg

SEQ ID NO: 235341 - DNA, 16 bp, Homo sapiens
ctgcttggggcctggc

SEQ ID NO: 235342 - DNA, 17 bp, Homo sapiens
ctgcttggggcctggcg

SEQ ID NO: 235343 - DNA, 20 bp, Homo sapiens
ctgcttgtactaagccagga

SEQ ID NO: 235344 - DNA, 13 bp, Homo sapiens
ctgcttgtcatcc

SEQ ID NO: 235345 - DNA, 15 bp, Homo sapiens
ctgcttgtgcctccc

SEQ ID NO: 235346 - DNA, 20 bp, Homo sapiens
ctgcttgtgcctcccttccc

SEQ ID NO: 235347 - DNA, 17 bp, Homo sapiens
ctgcttgtgttgggccc

SEQ ID NO: 235348 - DNA, 19 bp, Homo sapiens
ctgcttgtgttgggcccca

SEQ ID NO: 235349 - DNA, 20 bp, Homo sapiens
ctgctttacaggatcatgta

SEQ ID NO: 235350 - DNA, 13 bp, Homo sapiens
ctgctttccttcg

SEQ ID NO: 235351 - DNA, 12 bp, Homo sapiens
ctgctttctaat

SEQ ID NO: 235352 - DNA, 20 bp, Homo sapiens
ctgctttctattacccctca

SEQ ID NO: 235353 - DNA, 17 bp, Homo sapiens
ctgctttcttgccacac

SEQ ID NO: 235354 - DNA, 12 bp, Homo sapiens
ctgctttgcttc

SEQ ID NO: 235355 - DNA, 13 bp, Homo sapiens
ctgctttgcttct

SEQ ID NO: 235356 - DNA, 14 bp, Homo sapiens
ctgctttgcttctt

SEQ ID NO: 235357 - DNA, 16 bp, Homo sapiens
ctgctttgggctgccc

SEQ ID NO: 235358 - DNA, 18 bp, Homo sapiens
ctgcttttccctaagcca

SEQ ID NO: 235359 - DNA, 22 bp, Homo sapiens
ctgcttttttttttccagcaag

SEQ ID NO: 235360 - DNA, 18 bp, Homo sapiens
ctggaaaacatagagtag

SEQ ID NO: 235361 - DNA, 19 bp, Homo sapiens
ctggaaaatctgtaaaaaa

SEQ ID NO: 235362 - DNA, 20 bp, Homo sapiens
ctggaaaatctgtaaaaaag

SEQ ID NO: 235363 - DNA, 23 bp, Homo sapiens
ctggaaaatctgtaaaaaagaaa

SEQ ID NO: 235364 - DNA, 15 bp, Homo sapiens
ctggaaagagctgtt

SEQ ID NO: 235365 - DNA, 19 bp, Homo sapiens
ctggaaagaggagaaggag

SEQ ID NO: 235366 - DNA, 21 bp, Homo sapiens
ctggaaagaggagaaggagag

SEQ ID NO: 235367 - DNA, 16 bp, Homo sapiens
ctggaaattctgcctt

SEQ ID NO: 235368 - DNA, 20 bp, Homo sapiens
ctggaaattcttccctgggg

SEQ ID NO: 235369 - DNA, 21 bp, Homo sapiens
ctggaaattcttccctggggg

SEQ ID NO: 235370 - DNA, 22 bp, Homo sapiens
ctggaaattcttccctgggggt

SEQ ID NO: 235371 - DNA, 17 bp, Homo sapiens
ctggaacactaatgagg

SEQ ID NO: 235372 - DNA, 21 bp, Homo sapiens
ctggaaccagcaagtcccaga

SEQ ID NO: 235373 - DNA, 14 bp, Homo sapiens
ctggaacctccctg

SEQ ID NO: 235374 - DNA, 22 bp, Homo sapiens
ctggaacggtgaaggtgacagc

SEQ ID NO: 235375 - DNA, 21 bp, Homo sapiens
ctggaagaacatcaagatacc

SEQ ID NO: 235376 - DNA, 22 bp, Homo sapiens
ctggaagagctgggtaccaggc

SEQ ID NO: 235377 - DNA, 14 bp, Homo sapiens
ctggaagcctgctg

SEQ ID NO: 235378 - DNA, 12 bp, Homo sapiens
ctggaaggcagg

SEQ ID NO: 235379 - DNA, 17 bp, Homo sapiens
ctggaaggcagggcaga

SEQ ID NO: 235380 - DNA, 18 bp, Homo sapiens
ctggaaggcagggcagag

SEQ ID NO: 235381 - DNA, 21 bp, Homo sapiens
ctggaaggcagggcagaggga

SEQ ID NO: 235382 - DNA, 13 bp, Homo sapiens
ctggaaggctggc

SEQ ID NO: 235383 - DNA, 15 bp, Homo sapiens
ctggaaggctggctg

SEQ ID NO: 235384 - DNA, 16 bp, Homo sapiens
ctggaaggctggctga

SEQ ID NO: 235385 - DNA, 17 bp, Homo sapiens
ctggaaggctggctgag

SEQ ID NO: 235386 - DNA, 20 bp, Homo sapiens
ctggaagttttgcatttatg

SEQ ID NO: 235387 - DNA, 16 bp, Homo sapiens
ctggaatcccagctcc

SEQ ID NO: 235388 - DNA, 19 bp, Homo sapiens
ctggaatgaagcatgtagc

SEQ ID NO: 235389 - DNA, 16 bp, Homo sapiens
ctggaatgcattcact

SEQ ID NO: 235390 - DNA, 20 bp, Homo sapiens
ctggaatgtaatcaatgttt

SEQ ID NO: 235391 - DNA, 22 bp, Homo sapiens
ctggaattcagcaccctgggtg

SEQ ID NO: 235392 - DNA, 15 bp, Homo sapiens
ctggacacccctgct

SEQ ID NO: 235393 - DNA, 13 bp, Homo sapiens
ctggacaggtctg

SEQ ID NO: 235394 - DNA, 14 bp, Homo sapiens
ctggacaggtctgg

SEQ ID NO: 235395 - DNA, 20 bp, Homo sapiens
ctggacagtatcactgtctt

SEQ ID NO: 235396 - DNA, 14 bp, Homo sapiens
ctggacatattccc

SEQ ID NO: 235397 - DNA, 13 bp, Homo sapiens
ctggaccaaagct

SEQ ID NO: 235398 - DNA, 14 bp, Homo sapiens
ctggaccaaagctg

SEQ ID NO: 235399 - DNA, 17 bp, Homo sapiens
ctggaccaccagcccca

SEQ ID NO: 235400 - DNA, 18 bp, Homo sapiens
ctggaccaccagccccag

SEQ ID NO: 235401 - DNA, 22 bp, Homo sapiens
ctggacctccccctcttggtcc

SEQ ID NO: 235402 - DNA, 13 bp, Homo sapiens
ctggacctctctt

SEQ ID NO: 235403 - DNA, 12 bp, Homo sapiens
ctggacctgcct

SEQ ID NO: 235404 - DNA, 19 bp, Homo sapiens
ctggactcctctgtccagg

SEQ ID NO: 235405 - DNA, 23 bp, Homo sapiens
ctggactcctctgtccaggcact

SEQ ID NO: 235406 - DNA, 13 bp, Homo sapiens
ctggactctgccc

SEQ ID NO: 235407 - DNA, 14 bp, Homo sapiens
ctggactctgcccc

SEQ ID NO: 235408 - DNA, 15 bp, Homo sapiens
ctggactctgcccca

SEQ ID NO: 235409 - DNA, 18 bp, Homo sapiens
ctggactctgccccaatc

SEQ ID NO: 235410 - DNA, 17 bp, Homo sapiens
ctggactctgtggggcc

SEQ ID NO: 235411 - DNA, 20 bp, Homo sapiens
ctggactctgtggggccaca

SEQ ID NO: 235412 - DNA, 21 bp, Homo sapiens
ctggactctgtggggccacac

SEQ ID NO: 235413 - DNA, 16 bp, Homo sapiens
ctggactgaagcctgc

SEQ ID NO: 235414 - DNA, 19 bp, Homo sapiens
ctggactgaagcctgcagg

SEQ ID NO: 235415 - DNA, 22 bp, Homo sapiens
ctggactgaagcctgcaggagt

SEQ ID NO: 235416 - DNA, 17 bp, Homo sapiens
ctggactggaggtgggc

SEQ ID NO: 235417 - DNA, 22 bp, Homo sapiens
ctggactggaggtgggcatgcc

SEQ ID NO: 235418 - DNA, 20 bp, Homo sapiens
ctggactggcccttgcccaa

SEQ ID NO: 235419 - DNA, 16 bp, Homo sapiens
ctggactggctgtcct

SEQ ID NO: 235420 - DNA, 12 bp, Homo sapiens
ctggactgtcct

SEQ ID NO: 235421 - DNA, 13 bp, Homo sapiens
ctggactgtccta

SEQ ID NO: 235422 - DNA, 18 bp, Homo sapiens
ctggactgtcctaggtga

SEQ ID NO: 235423 - DNA, 20 bp, Homo sapiens
ctggactgtcttctccctgc

SEQ ID NO: 235424 - DNA, 18 bp, Homo sapiens
ctggacttggcccctgcc

SEQ ID NO: 235425 - DNA, 19 bp, Homo sapiens
ctggacttggcccctgcca

SEQ ID NO: 235426 - DNA, 14 bp, Homo sapiens
ctggactttcctgc

SEQ ID NO: 235427 - DNA, 15 bp, Homo sapiens
ctggactttcctgca

SEQ ID NO: 235428 - DNA, 17 bp, Homo sapiens
ctggacttttgcagctt

SEQ ID NO: 235429 - DNA, 12 bp, Homo sapiens
ctggagaaagga

SEQ ID NO: 235430 - DNA, 14 bp, Homo sapiens
ctggagaccaggac

SEQ ID NO: 235431 - DNA, 20 bp, Homo sapiens
ctggagaccaggactctgcc

SEQ ID NO: 235432 - DNA, 21 bp, Homo sapiens
ctggagaccgcttcacccctg

SEQ ID NO: 235433 - DNA, 22 bp, Homo sapiens
ctggagaccggaattgagaggt

SEQ ID NO: 235434 - DNA, 14 bp, Homo sapiens
ctggagacttcctc

SEQ ID NO: 235435 - DNA, 17 bp, Homo sapiens
ctggagaggctaacctc

SEQ ID NO: 235436 - DNA, 12 bp, Homo sapiens
ctggagaggtta

SEQ ID NO: 235437 - DNA, 16 bp, Homo sapiens
ctggagcagcagctga

SEQ ID NO: 235438 - DNA, 19 bp, Homo sapiens
ctggagcagcagctgaggc

SEQ ID NO: 235439 - DNA, 15 bp, Homo sapiens
ctggagcatcccagg

SEQ ID NO: 235440 - DNA, 22 bp, Homo sapiens
ctggagccaatggtgagggctg

SEQ ID NO: 235441 - DNA, 13 bp, Homo sapiens
ctggagccacctg

SEQ ID NO: 235442 - DNA, 19 bp, Homo sapiens
ctggagccacctgtcccac

SEQ ID NO: 235443 - DNA, 21 bp, Homo sapiens
ctggagccacctgtcccacct

SEQ ID NO: 235444 - DNA, 22 bp, Homo sapiens
ctggagccacctgtcccacctc

SEQ ID NO: 235445 - DNA, 16 bp, Homo sapiens
ctggagccagcagggc

SEQ ID NO: 235446 - DNA, 22 bp, Homo sapiens
ctggagccagccaccctaactg

SEQ ID NO: 235447 - DNA, 12 bp, Homo sapiens
ctggagcccaca

SEQ ID NO: 235448 - DNA, 16 bp, Homo sapiens
ctggagcctgagtcag

SEQ ID NO: 235449 - DNA, 21 bp, Homo sapiens
ctggagcgtttgctgtgccag

SEQ ID NO: 235450 - DNA, 14 bp, Homo sapiens
ctggagctcctgct

SEQ ID NO: 235451 - DNA, 14 bp, Homo sapiens
ctggagctcctggg

SEQ ID NO: 235452 - DNA, 16 bp, Homo sapiens
ctggagctgtccttca

SEQ ID NO: 235453 - DNA, 23 bp, Homo sapiens
ctggagctgtccttcattccgtt

SEQ ID NO: 235454 - DNA, 17 bp, Homo sapiens
ctggagctttgcagcca

SEQ ID NO: 235455 - DNA, 15 bp, Homo sapiens
ctggaggaacttgct

SEQ ID NO: 235456 - DNA, 14 bp, Homo sapiens
ctggaggcagactc

SEQ ID NO: 235457 - DNA, 15 bp, Homo sapiens
ctggaggcagactcg

SEQ ID NO: 235458 - DNA, 21 bp, Homo sapiens
ctggaggcagactcgagggcc

SEQ ID NO: 235459 - DNA, 21 bp, Homo sapiens
ctggaggggacgctggtagag

SEQ ID NO: 235460 - DNA, 14 bp, Homo sapiens
ctggaggggcatgg

SEQ ID NO: 235461 - DNA, 16 bp, Homo sapiens
ctggaggtaaggcctt

SEQ ID NO: 235462 - DNA, 17 bp, Homo sapiens
ctggaggtacgaaaaga

SEQ ID NO: 235463 - DNA, 16 bp, Homo sapiens
ctggaggtgggcatgc

SEQ ID NO: 235464 - DNA, 23 bp, Homo sapiens
ctggaggtgggcatgccaccctc

SEQ ID NO: 235465 - DNA, 20 bp, Homo sapiens
ctggaggtggggttgggatt

SEQ ID NO: 235466 - DNA, 16 bp, Homo sapiens
ctggagtcagatgagc

SEQ ID NO: 235467 - DNA, 19 bp, Homo sapiens
ctggagtcctgttctcaga

SEQ ID NO: 235468 - DNA, 20 bp, Homo sapiens
ctggagtcctgttctcagag

SEQ ID NO: 235469 - DNA, 21 bp, Homo sapiens
ctggagtcctgttctcagagc

SEQ ID NO: 235470 - DNA, 23 bp, Homo sapiens
ctggagtcctgttctcagagctc

SEQ ID NO: 235471 - DNA, 20 bp, Homo sapiens
ctggagtctgaaggagagga

SEQ ID NO: 235472 - DNA, 21 bp, Homo sapiens
ctggagtctgaaggagaggag

SEQ ID NO: 235473 - DNA, 24 bp, Homo sapiens
ctggagtgaggcttccaggctctt

SEQ ID NO: 235474 - DNA, 12 bp, Homo sapiens
ctggagtgcagg

SEQ ID NO: 235475 - DNA, 16 bp, Homo sapiens
ctggagtgcagggagg

SEQ ID NO: 235476 - DNA, 14 bp, Homo sapiens
ctggagtgcagtgg

SEQ ID NO: 235477 - DNA, 18 bp, Homo sapiens
ctggagtgcgctcttggt

SEQ ID NO: 235478 - DNA, 19 bp, Homo sapiens
ctggagtgcgctcttggtc

SEQ ID NO: 235479 - DNA, 23 bp, Homo sapiens
ctggagtgcgctcttggtccctg

SEQ ID NO: 235480 - DNA, 24 bp, Homo sapiens
ctggagtgcgctcttggtccctgg

SEQ ID NO: 235481 - DNA, 14 bp, Homo sapiens
ctggagtgctgctt

SEQ ID NO: 235482 - DNA, 15 bp, Homo sapiens
ctggagtgctgcttg

SEQ ID NO: 235483 - DNA, 23 bp, Homo sapiens
ctggagtgctgcttgtgcctccc

SEQ ID NO: 235484 - DNA, 14 bp, Homo sapiens
ctggagtgctggct

SEQ ID NO: 235485 - DNA, 20 bp, Homo sapiens
ctggagtggaaggtctattg

SEQ ID NO: 235486 - DNA, 20 bp, Homo sapiens
ctggagtggtaacaagagga

SEQ ID NO: 235487 - DNA, 16 bp, Homo sapiens
ctggagttacattaat

SEQ ID NO: 235488 - DNA, 12 bp, Homo sapiens
ctggataaaaaa

SEQ ID NO: 235489 - DNA, 21 bp, Homo sapiens
ctggatatcgtcattttgcag

SEQ ID NO: 235490 - DNA, 17 bp, Homo sapiens
ctggatccatcaggcca

SEQ ID NO: 235491 - DNA, 22 bp, Homo sapiens
ctggatgaaataactccttctt

SEQ ID NO: 235492 - DNA, 18 bp, Homo sapiens
ctggatgccaaggagccc

SEQ ID NO: 235493 - DNA, 19 bp, Homo sapiens
ctggatggatctgctccat

SEQ ID NO: 235494 - DNA, 23 bp, Homo sapiens
ctggatggatctgctccatgcag

SEQ ID NO: 235495 - DNA, 13 bp, Homo sapiens
ctggatggccggg

SEQ ID NO: 235496 - DNA, 20 bp, Homo sapiens
ctggatggccgggctgctgc

SEQ ID NO: 235497 - DNA, 18 bp, Homo sapiens
ctggatgtcaccaagaag

SEQ ID NO: 235498 - DNA, 17 bp, Homo sapiens
ctggatgtcccctgtcc

SEQ ID NO: 235499 - DNA, 20 bp, Homo sapiens
ctggatgtcccctgtcccac

SEQ ID NO: 235500 - DNA, 13 bp, Homo sapiens
ctggatttcttcc

SEQ ID NO: 235501 - DNA, 18 bp, Homo sapiens
ctggatttgggagctctg

SEQ ID NO: 235502 - DNA, 17 bp, Homo sapiens
ctggattttctttctat

SEQ ID NO: 235503 - DNA, 13 bp, Homo sapiens
ctggcaagcaggg

SEQ ID NO: 235504 - DNA, 21 bp, Homo sapiens
ctggcaaggtgggttccaggg

SEQ ID NO: 235505 - DNA, 16 bp, Homo sapiens
ctggcaagtgacccag

SEQ ID NO: 235506 - DNA, 15 bp, Homo sapiens
ctggcaatagtgtgt

SEQ ID NO: 235507 - DNA, 20 bp, Homo sapiens
ctggcaatagtgtgttctga

SEQ ID NO: 235508 - DNA, 19 bp, Homo sapiens
ctggcacagaaagggcagc

SEQ ID NO: 235509 - DNA, 22 bp, Homo sapiens
ctggcacagaaagggcagcttc

SEQ ID NO: 235510 - DNA, 22 bp, Homo sapiens
ctggcacagacttcacacagca

SEQ ID NO: 235511 - DNA, 23 bp, Homo sapiens
ctggcacatttccccagacctga

SEQ ID NO: 235512 - DNA, 22 bp, Homo sapiens
ctggcacgggtgtcgaggcagg

SEQ ID NO: 235513 - DNA, 20 bp, Homo sapiens
ctggcactgactgggcatag

SEQ ID NO: 235514 - DNA, 21 bp, Homo sapiens
ctggcactggatgcagaaaca

SEQ ID NO: 235515 - DNA, 13 bp, Homo sapiens
ctggcagaactga

SEQ ID NO: 235516 - DNA, 18 bp, Homo sapiens
ctggcagaactgagctcc

SEQ ID NO: 235517 - DNA, 13 bp, Homo sapiens
ctggcagccaggg

SEQ ID NO: 235518 - DNA, 16 bp, Homo sapiens
ctggcagccagggagc

SEQ ID NO: 235519 - DNA, 13 bp, Homo sapiens
ctggcagccgtgc

SEQ ID NO: 235520 - DNA, 22 bp, Homo sapiens
ctggctgagtggaatgcaggga

SEQ ID NO: 235521 - DNA, 23 bp, Homo sapiens
ctggctgagtggaatgcagggaa

SEQ ID NO: 235522 - DNA, 14 bp, Homo sapiens
ctggctgcacagcc

SEQ ID NO: 235523 - DNA, 16 bp, Homo sapiens
ctggctgcacagccca

SEQ ID NO: 235524 - DNA, 21 bp, Homo sapiens
ctggctgcacagcccaaccag

SEQ ID NO: 235525 - DNA, 14 bp, Homo sapiens
ctggctgccaggcg

SEQ ID NO: 235526 - DNA, 17 bp, Homo sapiens
ctggctgccaggcgttg

SEQ ID NO: 235527 - DNA, 13 bp, Homo sapiens
ctggctgcccaga

SEQ ID NO: 235528 - DNA, 18 bp, Homo sapiens
ctggctgccccaacctgc

SEQ ID NO: 235529 - DNA, 11 bp, Homo sapiens
ctggctgcctg

SEQ ID NO: 235530 - DNA, 16 bp, Homo sapiens
ctggctgcctggccca

SEQ ID NO: 235531 - DNA, 13 bp, Homo sapiens
ctggctggagagg

SEQ ID NO: 235532 - DNA, 13 bp, Homo sapiens
ctggctggcaggt

SEQ ID NO: 235533 - DNA, 22 bp, Homo sapiens
ctggctggggacttggccgctt

SEQ ID NO: 235534 - DNA, 14 bp, Homo sapiens
ctggctggggcaga

SEQ ID NO: 235535 - DNA, 21 bp, Homo sapiens
ctggctgggtcgcccctcctc

SEQ ID NO: 235536 - DNA, 18 bp, Homo sapiens
ctggctggtaagggccaa

SEQ ID NO: 235537 - DNA, 20 bp, Homo sapiens
ctggctgtctgcctgtattt

SEQ ID NO: 235538 - DNA, 19 bp, Homo sapiens
ctggctgtgagcagcctcc

SEQ ID NO: 235539 - DNA, 21 bp, Homo sapiens
ctggctgtgcacattctccct

SEQ ID NO: 235540 - DNA, 22 bp, Homo sapiens
ctggctgtggaggcctgatgct

SEQ ID NO: 235541 - DNA, 23 bp, Homo sapiens
ctggctgtggaggcctgatgctg

SEQ ID NO: 235542 - DNA, 22 bp, Homo sapiens
ctggctgtggcccctccttctc

SEQ ID NO: 235543 - DNA, 22 bp, Homo sapiens
ctggctgttggcccctctgctg

SEQ ID NO: 235544 - DNA, 17 bp, Homo sapiens
ctggcttccagcgggcc

SEQ ID NO: 235545 - DNA, 19 bp, Homo sapiens
ctggcttccagcgggccct

SEQ ID NO: 235546 - DNA, 23 bp, Homo sapiens
ctggcttccagcgggccctctgc

SEQ ID NO: 235547 - DNA, 13 bp, Homo sapiens
ctggcttcccagg

SEQ ID NO: 235548 - DNA, 14 bp, Homo sapiens
ctggcttcccagga

SEQ ID NO: 235549 - DNA, 15 bp, Homo sapiens
ctggcttccgctgtc

SEQ ID NO: 235550 - DNA, 15 bp, Homo sapiens
ctggcttctccctgg

SEQ ID NO: 235551 - DNA, 21 bp, Homo sapiens
ctggcttctccctggactctg

SEQ ID NO: 235552 - DNA, 18 bp, Homo sapiens
ctggcttctgcttgtcat

SEQ ID NO: 235553 - DNA, 14 bp, Homo sapiens
ctggcttgctccag

SEQ ID NO: 235554 - DNA, 14 bp, Homo sapiens
ctggctttgacatg

SEQ ID NO: 235555 - DNA, 23 bp, Homo sapiens
ctggctttgacatgaaaagatag

SEQ ID NO: 235556 - DNA, 14 bp, Homo sapiens
ctggctttgcccaa

SEQ ID NO: 235557 - DNA, 21 bp, Homo sapiens
ctggctttgcccaacctcagc

SEQ ID NO: 235558 - DNA, 22 bp, Homo sapiens
ctggctttgcccaacctcagca

SEQ ID NO: 235559 - DNA, 15 bp, Homo sapiens
ctggcttttcactgc

SEQ ID NO: 235560 - DNA, 17 bp, Homo sapiens
ctggcttttcactgctg

SEQ ID NO: 235561 - DNA, 14 bp, Homo sapiens
ctggcttttctggc

SEQ ID NO: 235562 - DNA, 22 bp, Homo sapiens
ctggcttttctggctggggatg

SEQ ID NO: 235563 - DNA, 19 bp, Homo sapiens
ctggctttttcccagccct

SEQ ID NO: 235564 - DNA, 15 bp, Homo sapiens
ctgggaaaacagtga

SEQ ID NO: 235565 - DNA, 20 bp, Homo sapiens
ctgggaaaggacccacccat

SEQ ID NO: 235566 - DNA, 17 bp, Homo sapiens
ctgggaaccccgcagcc

SEQ ID NO: 235567 - DNA, 21 bp, Homo sapiens
ctgggaaccccgcagcccgtg

SEQ ID NO: 235568 - DNA, 19 bp, Homo sapiens
ctgggaacccgactgtgaa

SEQ ID NO: 235569 - DNA, 19 bp, Homo sapiens
ctgggaactcccaagaaca

SEQ ID NO: 235570 - DNA, 17 bp, Homo sapiens
ctgggaagataggctct

SEQ ID NO: 235571 - DNA, 18 bp, Homo sapiens
ctgggaagataggctctg

SEQ ID NO: 235572 - DNA, 13 bp, Homo sapiens
ctgggaagatgct

SEQ ID NO: 235573 - DNA, 14 bp, Homo sapiens
ctgggaagctggag

SEQ ID NO: 235574 - DNA, 20 bp, Homo sapiens
ctgggaagcttgagcctccc

SEQ ID NO: 235575 - DNA, 20 bp, Homo sapiens
ctgggaaggacataaaaggt

SEQ ID NO: 235576 - DNA, 13 bp, Homo sapiens
ctgggaaggagga

SEQ ID NO: 235577 - DNA, 14 bp, Homo sapiens
ctgggaaggaggga

SEQ ID NO: 235578 - DNA, 18 bp, Homo sapiens
ctgggaaggagggagctg

SEQ ID NO: 235579 - DNA, 22 bp, Homo sapiens
ctgggaaggctactcaccttga

SEQ ID NO: 235580 - DNA, 20 bp, Homo sapiens
ctgggaaggggcgtgtccct

SEQ ID NO: 235581 - DNA, 21 bp, Homo sapiens
ctgggaatggaaggctttgcc

SEQ ID NO: 235582 - DNA, 19 bp, Homo sapiens
ctgggaatgtattattctg

SEQ ID NO: 235583 - DNA, 19 bp, Homo sapiens
ctgggaccctcggggcagg

SEQ ID NO: 235584 - DNA, 14 bp, Homo sapiens
ctgggacctgtgtt

SEQ ID NO: 235585 - DNA, 15 bp, Homo sapiens
ctgggacctgtgttc

SEQ ID NO: 235586 - DNA, 15 bp, Homo sapiens
ctgggactcattcac

SEQ ID NO: 235587 - DNA, 23 bp, Homo sapiens
ctgggactctcctcctcccctcc

SEQ ID NO: 235588 - DNA, 14 bp, Homo sapiens
ctgggacttccttg

SEQ ID NO: 235589 - DNA, 18 bp, Homo sapiens
ctgggacttccttgctct

SEQ ID NO: 235590 - DNA, 18 bp, Homo sapiens
ctgggagaaaagccagat

SEQ ID NO: 235591 - DNA, 21 bp, Homo sapiens
ctgggagaaaagccagatgac

SEQ ID NO: 235592 - DNA, 22 bp, Homo sapiens
ctgggagaaccaaaaagaggct

SEQ ID NO: 235593 - DNA, 21 bp, Homo sapiens
ctgggagaaggtgcttgggct

SEQ ID NO: 235594 - DNA, 12 bp, Homo sapiens
ctgggagagcca

SEQ ID NO: 235595 - DNA, 16 bp, Homo sapiens
ctgggagagccaaggc

SEQ ID NO: 235596 - DNA, 19 bp, Homo sapiens
ctgggagagccaaggccta

SEQ ID NO: 235597 - DNA, 23 bp, Homo sapiens
ctgggagagctggtggtgcagcc

SEQ ID NO: 235598 - DNA, 12 bp, Homo sapiens
ctgggagaggat

SEQ ID NO: 235599 - DNA, 13 bp, Homo sapiens
ctgggagagtgag

SEQ ID NO: 235600 - DNA, 15 bp, Homo sapiens
ctgggagctctgcag

SEQ ID NO: 235601 - DNA, 12 bp, Homo sapiens
ctgggaggcagg

SEQ ID NO: 235602 - DNA, 17 bp, Homo sapiens
ctgggaggggtgctgcc

SEQ ID NO: 235603 - DNA, 14 bp, Homo sapiens
ctgggagtcagagc

SEQ ID NO: 235604 - DNA, 15 bp, Homo sapiens
ctgggagtcagagcc

SEQ ID NO: 235605 - DNA, 17 bp, Homo sapiens
ctgggagtcagagccct

SEQ ID NO: 235606 - DNA, 18 bp, Homo sapiens
ctgggatcagctggtgtc

SEQ ID NO: 235607 - DNA, 14 bp, Homo sapiens
ctgggatgtagaac

SEQ ID NO: 235608 - DNA, 16 bp, Homo sapiens
ctgggatgtagaactt

SEQ ID NO: 235609 - DNA, 17 bp, Homo sapiens
ctgggatgtagaacttc

SEQ ID NO: 235610 - DNA, 11 bp, Homo sapiens
ctgggattagg

SEQ ID NO: 235611 - DNA, 17 bp, Homo sapiens
ctgggattctactttaa

SEQ ID NO: 235612 - DNA, 19 bp, Homo sapiens
ctgggatttcttcgctgct

SEQ ID NO: 235613 - DNA, 20 bp, Homo sapiens
ctgggatttgaactgagccg

SEQ ID NO: 235614 - DNA, 13 bp, Homo sapiens
ctgggcaaagcca

SEQ ID NO: 235615 - DNA, 15 bp, Homo sapiens
ctgggcaacagagca

SEQ ID NO: 235616 - DNA, 15 bp, Homo sapiens
ctgggcaaggtgagg

SEQ ID NO: 235617 - DNA, 14 bp, Homo sapiens
ctgggcacccacct

SEQ ID NO: 235618 - DNA, 17 bp, Homo sapiens
ctgggcaccctcccacc

SEQ ID NO: 235619 - DNA, 17 bp, Homo sapiens
ctgggcacctggggagt

SEQ ID NO: 235620 - DNA, 19 bp, Homo sapiens
ctgggcacggctccgaggg

SEQ ID NO: 235621 - DNA, 21 bp, Homo sapiens
ctgggcacggctccgagggcg

SEQ ID NO: 235622 - DNA, 14 bp, Homo sapiens
ctgggcactgggcc

SEQ ID NO: 235623 - DNA, 11 bp, Homo sapiens
ctgggcagagg

SEQ ID NO: 235624 - DNA, 15 bp, Homo sapiens
ctgggcagaggggag

SEQ ID NO: 235625 - DNA, 22 bp, Homo sapiens
ctgggcagaggggagaggaagc

SEQ ID NO: 235626 - DNA, 13 bp, Homo sapiens
ctgggcagcccag

SEQ ID NO: 235627 - DNA, 19 bp, Homo sapiens
ctgggcagggccgcagggc

SEQ ID NO: 235628 - DNA, 16 bp, Homo sapiens
ctgggcaggtcctggg

SEQ ID NO: 235629 - DNA, 18 bp, Homo sapiens
ctgggcaggtcctgggga

SEQ ID NO: 235630 - DNA, 19 bp, Homo sapiens
ctgggcaggtcctggggag

SEQ ID NO: 235631 - DNA, 15 bp, Homo sapiens
ctgggcatccccagc

SEQ ID NO: 235632 - DNA, 16 bp, Homo sapiens
ctgggcatccccagcc

SEQ ID NO: 235633 - DNA, 19 bp, Homo sapiens
ctgggcatccccagccccc

SEQ ID NO: 235634 - DNA, 13 bp, Homo sapiens
ctgggccaccagc

SEQ ID NO: 235635 - DNA, 12 bp, Homo sapiens
ctgggccaccct

SEQ ID NO: 235636 - DNA, 16 bp, Homo sapiens
ctgggccacccttcac

SEQ ID NO: 235637 - DNA, 15 bp, Homo sapiens
ctgggccagcccagg

SEQ ID NO: 235638 - DNA, 14 bp, Homo sapiens
ctgggccagggtct

SEQ ID NO: 235639 - DNA, 16 bp, Homo sapiens
ctgggccagggtctcg

SEQ ID NO: 235640 - DNA, 18 bp, Homo sapiens
ctgggcccagaggcacag

SEQ ID NO: 235641 - DNA, 19 bp, Homo sapiens
ctgggcccagaggcacagc

SEQ ID NO: 235642 - DNA, 22 bp, Homo sapiens
ctgggcccagaggcacagccgg

SEQ ID NO: 235643 - DNA, 13 bp, Homo sapiens
ctgggcccaggca

SEQ ID NO: 235644 - DNA, 17 bp, Homo sapiens
ctgggcccaggcagcac

SEQ ID NO: 235645 - DNA, 15 bp, Homo sapiens
ctgggcccaggggct

SEQ ID NO: 235646 - DNA, 16 bp, Homo sapiens
ctgggccccacctact

SEQ ID NO: 235647 - DNA, 17 bp, Homo sapiens
ctgggccccccagctca

SEQ ID NO: 235648 - DNA, 12 bp, Homo sapiens
ctgggcccctcc

SEQ ID NO: 235649 - DNA, 22 bp, Homo sapiens
ctgggcccctccctacctcaac

SEQ ID NO: 235650 - DNA, 17 bp, Homo sapiens
ctgggcccgggcaggcc

SEQ ID NO: 235651 - DNA, 13 bp, Homo sapiens
ctgggccctaggc

SEQ ID NO: 235652 - DNA, 14 bp, Homo sapiens
ctgggccctaggca

SEQ ID NO: 235653 - DNA, 18 bp, Homo sapiens
ctgggccctctgtccaca

SEQ ID NO: 235654 - DNA, 12 bp, Homo sapiens
ctgggccctgca

SEQ ID NO: 235655 - DNA, 22 bp, Homo sapiens
ctgtgaccaccttctgtcccca

SEQ ID NO: 235656 - DNA, 17 bp, Homo sapiens
ctgtgaccatttataat

SEQ ID NO: 235657 - DNA, 21 bp, Homo sapiens
ctgtgaccctctcactttggt

SEQ ID NO: 235658 - DNA, 14 bp, Homo sapiens
ctgtgaccggggtc

SEQ ID NO: 235659 - DNA, 21 bp, Homo sapiens
ctgtgaccggggtcctgaggc

SEQ ID NO: 235660 - DNA, 23 bp, Homo sapiens
ctgtgaccggggtcctgaggctg

SEQ ID NO: 235661 - DNA, 15 bp, Homo sapiens
ctgtgacctgtgggg

SEQ ID NO: 235662 - DNA, 17 bp, Homo sapiens
ctgtgactcattcccag

SEQ ID NO: 235663 - DNA, 20 bp, Homo sapiens
ctgtgactcgcttagctgaa

SEQ ID NO: 235664 - DNA, 14 bp, Homo sapiens
ctgtgactgagggc

SEQ ID NO: 235665 - DNA, 21 bp, Homo sapiens
ctgtgactgatgttaggctgg

SEQ ID NO: 235666 - DNA, 15 bp, Homo sapiens
ctgtgactgtttttg

SEQ ID NO: 235667 - DNA, 18 bp, Homo sapiens
ctgtgacttaagaagcct

SEQ ID NO: 235668 - DNA, 15 bp, Homo sapiens
ctgtgagacccccac

SEQ ID NO: 235669 - DNA, 18 bp, Homo sapiens
ctgtgagacccccacacc

SEQ ID NO: 235670 - DNA, 23 bp, Homo sapiens
ctgtgagacccccacacctcagt

SEQ ID NO: 235671 - DNA, 17 bp, Homo sapiens
ctgtgagacgaggcagg

SEQ ID NO: 235672 - DNA, 18 bp, Homo sapiens
ctgtgagcaaagtgcagg

SEQ ID NO: 235673 - DNA, 15 bp, Homo sapiens
ctgtgagcagcctcc

SEQ ID NO: 235674 - DNA, 17 bp, Homo sapiens
ctgtgagcagcctccac

SEQ ID NO: 235675 - DNA, 18 bp, Homo sapiens
ctgtgagcatccttccca

SEQ ID NO: 235676 - DNA, 19 bp, Homo sapiens
ctgtgagcatccttcccag

SEQ ID NO: 235677 - DNA, 17 bp, Homo sapiens
ctgtgaggaatgctctg

SEQ ID NO: 235678 - DNA, 16 bp, Homo sapiens
ctgtgaggcggcagct

SEQ ID NO: 235679 - DNA, 17 bp, Homo sapiens
ctgtgaggcggcagctg

SEQ ID NO: 235680 - DNA, 20 bp, Homo sapiens
ctgtgaggtgataggcaagg

SEQ ID NO: 235681 - DNA, 22 bp, Homo sapiens
ctgtgagtgacatcggttcagg

SEQ ID NO: 235682 - DNA, 20 bp, Homo sapiens
ctgtgagttctgttgtgttt

SEQ ID NO: 235683 - DNA, 15 bp, Homo sapiens
ctgtgatcatttatt

SEQ ID NO: 235684 - DNA, 22 bp, Homo sapiens
ctgtgatggatggacacaaaaa

SEQ ID NO: 235685 - DNA, 21 bp, Homo sapiens
ctgtgatttatttggagtgga

SEQ ID NO: 235686 - DNA, 23 bp, Homo sapiens
ctgtgatttatttggagtggagg

SEQ ID NO: 235687 - DNA, 15 bp, Homo sapiens
ctgtgcaaacagtgt

SEQ ID NO: 235688 - DNA, 13 bp, Homo sapiens
ctgtgcagagact

SEQ ID NO: 235689 - DNA, 13 bp, Homo sapiens
ctgtgcagcagcc

SEQ ID NO: 235690 - DNA, 16 bp, Homo sapiens
ctgtgcagcagcccag

SEQ ID NO: 235691 - DNA, 20 bp, Homo sapiens
ctgtgcagcagcccagcttc

SEQ ID NO: 235692 - DNA, 19 bp, Homo sapiens
ctgtgcatcaaccaggaag

SEQ ID NO: 235693 - DNA, 20 bp, Homo sapiens
ctgtgcatcaaccaggaaga

SEQ ID NO: 235694 - DNA, 22 bp, Homo sapiens
ctgtgcatcaaccaggaagagt

SEQ ID NO: 235695 - DNA, 15 bp, Homo sapiens
ctgtgccaagggcag

SEQ ID NO: 235696 - DNA, 17 bp, Homo sapiens
ctgtgccaataaaagtt

SEQ ID NO: 235697 - DNA, 18 bp, Homo sapiens
ctgtgccacccaccaggg

SEQ ID NO: 235698 - DNA, 22 bp, Homo sapiens
ctgtgccaggactgtgactcat

SEQ ID NO: 235699 - DNA, 14 bp, Homo sapiens
ctgtgccaggaggc

SEQ ID NO: 235700 - DNA, 16 bp, Homo sapiens
ctgtgccaggaggcgg

SEQ ID NO: 235701 - DNA, 14 bp, Homo sapiens
ctgtgccaggctga

SEQ ID NO: 235702 - DNA, 15 bp, Homo sapiens
ctgtgccatggattt

SEQ ID NO: 235703 - DNA, 19 bp, Homo sapiens
ctgtgcccacccagggccc

SEQ ID NO: 235704 - DNA, 17 bp, Homo sapiens
ctgtgcccagagatggg

SEQ ID NO: 235705 - DNA, 15 bp, Homo sapiens
ctgtgcccagctcag

SEQ ID NO: 235706 - DNA, 22 bp, Homo sapiens
ctgtgcccatcatctctgcctt

SEQ ID NO: 235707 - DNA, 23 bp, Homo sapiens
ctgtgcccatcatctctgccttt

SEQ ID NO: 235708 - DNA, 14 bp, Homo sapiens
ctgtgcccttgctg

SEQ ID NO: 235709 - DNA, 15 bp, Homo sapiens
ctgtgcccttgctgg

SEQ ID NO: 235710 - DNA, 14 bp, Homo sapiens
ctgtgcctaataaa

SEQ ID NO: 235711 - DNA, 17 bp, Homo sapiens
ctgtgcctccccccaga

SEQ ID NO: 235712 - DNA, 21 bp, Homo sapiens
ctgtgcctccccccagacccc

SEQ ID NO: 235713 - DNA, 15 bp, Homo sapiens
ctgtgcctctgcctg

SEQ ID NO: 235714 - DNA, 17 bp, Homo sapiens
ctgtgcctctgcctgtc

SEQ ID NO: 235715 - DNA, 18 bp, Homo sapiens
ctgtgcctgctagagcaa

SEQ ID NO: 235716 - DNA, 14 bp, Homo sapiens
ctgtgcctggagct

SEQ ID NO: 235717 - DNA, 17 bp, Homo sapiens
ctgtgcctggagctcct

SEQ ID NO: 235718 - DNA, 19 bp, Homo sapiens
ctgtgcctggagctcctgg

SEQ ID NO: 235719 - DNA, 20 bp, Homo sapiens
ctgtgcctggagctcctggg

SEQ ID NO: 235720 - DNA, 12 bp, Homo sapiens
ctgtgcctggga

SEQ ID NO: 235721 - DNA, 13 bp, Homo sapiens
ctgtgcctgggat

SEQ ID NO: 235722 - DNA, 21 bp, Homo sapiens
ctgtgcctgggatcagtgggg

SEQ ID NO: 235723 - DNA, 14 bp, Homo sapiens
ctgtgcgtgaaaca

SEQ ID NO: 235724 - DNA, 16 bp, Homo sapiens
ctgtgcgtgaaacaca

SEQ ID NO: 235725 - DNA, 16 bp, Homo sapiens
ctgtgcgttttagagt

SEQ ID NO: 235726 - DNA, 17 bp, Homo sapiens
ctgtgctacagagaaaa

SEQ ID NO: 235727 - DNA, 15 bp, Homo sapiens
ctgtgctcacccatt

SEQ ID NO: 235728 - DNA, 16 bp, Homo sapiens
ctgtgctcacccattg

SEQ ID NO: 235729 - DNA, 22 bp, Homo sapiens
ctgtgctcacccattgtctcat

SEQ ID NO: 235730 - DNA, 18 bp, Homo sapiens
ctgtgctcatcggagact

SEQ ID NO: 235731 - DNA, 19 bp, Homo sapiens
ctgtgctcatcggagactg

SEQ ID NO: 235732 - DNA, 14 bp, Homo sapiens
ctgtgctccagcag

SEQ ID NO: 235733 - DNA, 19 bp, Homo sapiens
ctgtgctccagcagtgctg

SEQ ID NO: 235734 - DNA, 20 bp, Homo sapiens
ctgtgctctggggatttctg

SEQ ID NO: 235735 - DNA, 16 bp, Homo sapiens
ctgtgctcttttggtg

SEQ ID NO: 235736 - DNA, 13 bp, Homo sapiens
ctgtgctgggcca

SEQ ID NO: 235737 - DNA, 14 bp, Homo sapiens
ctgtgctgggccag

SEQ ID NO: 235738 - DNA, 21 bp, Homo sapiens
ctgtgctgggccagtggctgg

SEQ ID NO: 235739 - DNA, 12 bp, Homo sapiens
ctgtgctgtgcc

SEQ ID NO: 235740 - DNA, 13 bp, Homo sapiens
ctgtgctgtgcct

SEQ ID NO: 235741 - DNA, 16 bp, Homo sapiens
ctgtgctgttgtctgc

SEQ ID NO: 235742 - DNA, 17 bp, Homo sapiens
ctgtgcttcaattaata

SEQ ID NO: 235743 - DNA, 14 bp, Homo sapiens
ctgtgcttgctcct

SEQ ID NO: 235744 - DNA, 14 bp, Homo sapiens
ctgtggaacactaa

SEQ ID NO: 235745 - DNA, 20 bp, Homo sapiens
ctgtggagcaaaaggcagct

SEQ ID NO: 235746 - DNA, 21 bp, Homo sapiens
ctgtggagcaaaaggcagctc

SEQ ID NO: 235747 - DNA, 15 bp, Homo sapiens
ctgtggagcccgcac

SEQ ID NO: 235748 - DNA, 20 bp, Homo sapiens
ctgtggattcagcttctgtt

SEQ ID NO: 235749 - DNA, 12 bp, Homo sapiens
ctgtggattcta

SEQ ID NO: 235750 - DNA, 13 bp, Homo sapiens
ctgtggattctat

SEQ ID NO: 235751 - DNA, 14 bp, Homo sapiens
ctgtggattctata

SEQ ID NO: 235752 - DNA, 16 bp, Homo sapiens
ctgtggattctatatt

SEQ ID NO: 235753 - DNA, 12 bp, Homo sapiens
ctgtggcacaga

SEQ ID NO: 235754 - DNA, 22 bp, Homo sapiens
ctgtggcacagacttctggaag

SEQ ID NO: 235755 - DNA, 18 bp, Homo sapiens
ctgtggcaggccagctgt

SEQ ID NO: 235756 - DNA, 22 bp, Homo sapiens
ctgtggcattgttgatgctcac

SEQ ID NO: 235757 - DNA, 16 bp, Homo sapiens
ctgtggccagagcacc

SEQ ID NO: 235758 - DNA, 20 bp, Homo sapiens
ctgtggccagagcacctcag

SEQ ID NO: 235759 - DNA, 18 bp, Homo sapiens
ctgtggccagagctggaa

SEQ ID NO: 235760 - DNA, 23 bp, Homo sapiens
ctgtggccagagctggaaggcag

SEQ ID NO: 235761 - DNA, 15 bp, Homo sapiens
ctgtggccccctccg

SEQ ID NO: 235762 - DNA, 14 bp, Homo sapiens
ctgtggcccctcct

SEQ ID NO: 235763 - DNA, 18 bp, Homo sapiens
ctgtggcccctccttctc

SEQ ID NO: 235764 - DNA, 23 bp, Homo sapiens
ctgtggcccctccttctcccctc

SEQ ID NO: 235765 - DNA, 17 bp, Homo sapiens
ctgtggccgtctcctcc

SEQ ID NO: 235766 - DNA, 14 bp, Homo sapiens
ctgtggcctgtgtc

SEQ ID NO: 235767 - DNA, 15 bp, Homo sapiens
ctgtggcctgtgtcc

SEQ ID NO: 235768 - DNA, 17 bp, Homo sapiens
ctgtggcctgtgtccag

SEQ ID NO: 235769 - DNA, 19 bp, Homo sapiens
ctgtggcctgtgtccagca

SEQ ID NO: 235770 - DNA, 24 bp, Homo sapiens
ctgtggcctgtgtccagcagctgc

SEQ ID NO: 235771 - DNA, 14 bp, Homo sapiens
ctgtggctctgcat

SEQ ID NO: 235772 - DNA, 12 bp, Homo sapiens
ctgtgggactgg

SEQ ID NO: 235773 - DNA, 16 bp, Homo sapiens
ctgtgggactggccca

SEQ ID NO: 235774 - DNA, 22 bp, Homo sapiens
ctgtgggactggcccacccctc

SEQ ID NO: 235775 - DNA, 14 bp, Homo sapiens
ctgtgggagcctgc

SEQ ID NO: 235776 - DNA, 21 bp, Homo sapiens
ctgtgggagtccactttcctc

SEQ ID NO: 235777 - DNA, 23 bp, Homo sapiens
ctgtgggagtccactttcctctc

SEQ ID NO: 235778 - DNA, 22 bp, Homo sapiens
ctgtgggcacgctgtgggcagg

SEQ ID NO: 235779 - DNA, 20 bp, Homo sapiens
ctgtgggcctcaaggacttg

SEQ ID NO: 235780 - DNA, 15 bp, Homo sapiens
ctgtgggcttggcct

SEQ ID NO: 235781 - DNA, 18 bp, Homo sapiens
ctgtgggcttggccttgt

SEQ ID NO: 235782 - DNA, 21 bp, Homo sapiens
ctgtgggcttggccttgtgtc

SEQ ID NO: 235783 - DNA, 16 bp, Homo sapiens
ctgtggggagctggtg

SEQ ID NO: 235784 - DNA, 17 bp, Homo sapiens
ctgtggggagctggtgg

SEQ ID NO: 235785 - DNA, 22 bp, Homo sapiens
ctgtggggagctggtgggggca

SEQ ID NO: 235786 - DNA, 17 bp, Homo sapiens
ctgtggggatttctccc

SEQ ID NO: 235787 - DNA, 20 bp, Homo sapiens
ctgtggggatttctcccagc

SEQ ID NO: 235788 - DNA, 15 bp, Homo sapiens
ctgtggggcaagcct

SEQ ID NO: 235789 - DNA, 15 bp, Homo sapiens
ctgggccctgcagga

SEQ ID NO: 235790 - DNA, 16 bp, Homo sapiens
ctgggccctgcaggag

SEQ ID NO: 235791 - DNA, 17 bp, Homo sapiens
ctgggccctgcaggagg

SEQ ID NO: 235792 - DNA, 20 bp, Homo sapiens
ctgggccctgcaggaggcct

SEQ ID NO: 235793 - DNA, 21 bp, Homo sapiens
ctgggccctgcaggaggcctg

SEQ ID NO: 235794 - DNA, 12 bp, Homo sapiens
ctgggccctggt

SEQ ID NO: 235795 - DNA, 12 bp, Homo sapiens
ctgggcctcccg

SEQ ID NO: 235796 - DNA, 14 bp, Homo sapiens
ctgggcctcccgtc

SEQ ID NO: 235797 - DNA, 24 bp, Homo sapiens
ctgggcctcctctaacaggggctg

SEQ ID NO: 235798 - DNA, 20 bp, Homo sapiens
ctgggcctctgactctgagt

SEQ ID NO: 235799 - DNA, 12 bp, Homo sapiens
ctgggcctgatg

SEQ ID NO: 235800 - DNA, 14 bp, Homo sapiens
ctgggcctgatgga

SEQ ID NO: 235801 - DNA, 23 bp, Homo sapiens
ctgggcctgcttttccaggatcc

SEQ ID NO: 235802 - DNA, 11 bp, Homo sapiens
ctgggcctggg

SEQ ID NO: 235803 - DNA, 13 bp, Homo sapiens
ctgggcctgtccc

SEQ ID NO: 235804 - DNA, 13 bp, Homo sapiens
ctgggcctgtctc

SEQ ID NO: 235805 - DNA, 14 bp, Homo sapiens
ctgggcctgtctca

SEQ ID NO: 235806 - DNA, 18 bp, Homo sapiens
ctgggcctgtctcagatt

SEQ ID NO: 235807 - DNA, 23 bp, Homo sapiens
ctgggcctgtgcagcagcccagc

SEQ ID NO: 235808 - DNA, 17 bp, Homo sapiens
ctgggcctgttgccctt

SEQ ID NO: 235809 - DNA, 15 bp, Homo sapiens
ctgggccttctcagc

SEQ ID NO: 235810 - DNA, 16 bp, Homo sapiens
ctgggccttctcagct

SEQ ID NO: 235811 - DNA, 16 bp, Homo sapiens
ctgggcctttcctgtg

SEQ ID NO: 235812 - DNA, 17 bp, Homo sapiens
ctgggcctttcctgtgc

SEQ ID NO: 235813 - DNA, 16 bp, Homo sapiens
ctgggcgccctggaag

SEQ ID NO: 235814 - DNA, 18 bp, Homo sapiens
ctgggcgccctggaagcc

SEQ ID NO: 235815 - DNA, 15 bp, Homo sapiens
ctgggcgcggtggct

SEQ ID NO: 235816 - DNA, 24 bp, Homo sapiens
ctgggctcaagcaatcctcctgag

SEQ ID NO: 235817 - DNA, 17 bp, Homo sapiens
ctgggctcaagcagtct

SEQ ID NO: 235818 - DNA, 17 bp, Homo sapiens
ctgggctcagggctgga

SEQ ID NO: 235819 - DNA, 20 bp, Homo sapiens
ctgggctcctggaaccaatc

SEQ ID NO: 235820 - DNA, 15 bp, Homo sapiens
ctgggctctgccacc

SEQ ID NO: 235821 - DNA, 17 bp, Homo sapiens
ctgggctctgccaccct

SEQ ID NO: 235822 - DNA, 21 bp, Homo sapiens
ctgggctctgccaccctacct

SEQ ID NO: 235823 - DNA, 12 bp, Homo sapiens
ctgggctgagcc

SEQ ID NO: 235824 - DNA, 17 bp, Homo sapiens
ctgggctgccatgtgaa

SEQ ID NO: 235825 - DNA, 12 bp, Homo sapiens
ctgggctggact

SEQ ID NO: 235826 - DNA, 15 bp, Homo sapiens
ctgggctggactgga

SEQ ID NO: 235827 - DNA, 19 bp, Homo sapiens
ctgggctggactggaggtg

SEQ ID NO: 235828 - DNA, 13 bp, Homo sapiens
ctgggctggcaga

SEQ ID NO: 235829 - DNA, 22 bp, Homo sapiens
ctgggctggccagttggaacca

SEQ ID NO: 235830 - DNA, 15 bp, Homo sapiens
ctgggctgttggctg

SEQ ID NO: 235831 - DNA, 17 bp, Homo sapiens
ctgggctgttggctggg

SEQ ID NO: 235832 - DNA, 18 bp, Homo sapiens
ctgggctgttggctgggg

SEQ ID NO: 235833 - DNA, 22 bp, Homo sapiens
ctgggcttcagggtatcccaga

SEQ ID NO: 235834 - DNA, 17 bp, Homo sapiens
ctgggcttggggtgtgg

SEQ ID NO: 235835 - DNA, 23 bp, Homo sapiens
ctgggctttttttttctctttct

SEQ ID NO: 235836 - DNA, 14 bp, Homo sapiens
ctggggaaggacca

SEQ ID NO: 235837 - DNA, 20 bp, Homo sapiens
ctggggaagggaaccagccc

SEQ ID NO: 235838 - DNA, 14 bp, Homo sapiens
ctggggaccaggag

SEQ ID NO: 235839 - DNA, 17 bp, Homo sapiens
ctggggaccaggagcta

SEQ ID NO: 235840 - DNA, 17 bp, Homo sapiens
ctggggaccatgtgatt

SEQ ID NO: 235841 - DNA, 13 bp, Homo sapiens
ctggggactctgc

SEQ ID NO: 235842 - DNA, 19 bp, Homo sapiens
ctggggactctgcttggct

SEQ ID NO: 235843 - DNA, 19 bp, Homo sapiens
ctggggagaccgagtgtgg

SEQ ID NO: 235844 - DNA, 15 bp, Homo sapiens
ctggggagcagctga

SEQ ID NO: 235845 - DNA, 14 bp, Homo sapiens
ctggggaggctgag

SEQ ID NO: 235846 - DNA, 22 bp, Homo sapiens
ctggggaggctgagactgcaga

SEQ ID NO: 235847 - DNA, 15 bp, Homo sapiens
ctggggagtgctgga

SEQ ID NO: 235848 - DNA, 20 bp, Homo sapiens
ctggggagtgggacagagtc

SEQ ID NO: 235849 - DNA, 19 bp, Homo sapiens
ctggggatcccgtgctgga

SEQ ID NO: 235850 - DNA, 22 bp, Homo sapiens
ctggggatggagaatgccagcc

SEQ ID NO: 235851 - DNA, 16 bp, Homo sapiens
ctggggatttctggga

SEQ ID NO: 235852 - DNA, 20 bp, Homo sapiens
ctggggcagaggggcagccg

SEQ ID NO: 235853 - DNA, 22 bp, Homo sapiens
ctggggccacaaatcaaagcaa

SEQ ID NO: 235854 - DNA, 16 bp, Homo sapiens
ctggggcccctcggct

SEQ ID NO: 235855 - DNA, 12 bp, Homo sapiens
ctggggcccctt

SEQ ID NO: 235856 - DNA, 19 bp, Homo sapiens
ctggggccgaggggccagg

SEQ ID NO: 235857 - DNA, 13 bp, Homo sapiens
ctggggccgggct

SEQ ID NO: 235858 - DNA, 12 bp, Homo sapiens
ctggggcctctt

SEQ ID NO: 235859 - DNA, 14 bp, Homo sapiens
ctggggcctggacc

SEQ ID NO: 235860 - DNA, 16 bp, Homo sapiens
ctggggcctggacctg

SEQ ID NO: 235861 - DNA, 17 bp, Homo sapiens
ctggggcctggacctgc

SEQ ID NO: 235862 - DNA, 18 bp, Homo sapiens
ctggggcctggacctgcc

SEQ ID NO: 235863 - DNA, 16 bp, Homo sapiens
ctggggcctggcctat

SEQ ID NO: 235864 - DNA, 21 bp, Homo sapiens
ctggggcctggcctatttaag

SEQ ID NO: 235865 - DNA, 23 bp, Homo sapiens
ctggggcctggcctatttaagcc

SEQ ID NO: 235866 - DNA, 16 bp, Homo sapiens
ctggggcggtcaataa

SEQ ID NO: 235867 - DNA, 20 bp, Homo sapiens
ctggggctcctttctccagc

SEQ ID NO: 235868 - DNA, 14 bp, Homo sapiens
ctggggctctggga

SEQ ID NO: 235869 - DNA, 15 bp, Homo sapiens
ctggggctctgggat

SEQ ID NO: 235870 - DNA, 23 bp, Homo sapiens
ctggggctgagtgcagaggctga

SEQ ID NO: 235871 - DNA, 12 bp, Homo sapiens
ctggggctgggg

SEQ ID NO: 235872 - DNA, 18 bp, Homo sapiens
ctggggctggggtgagag

SEQ ID NO: 235873 - DNA, 23 bp, Homo sapiens
ctggggctggggtgagagaggaa

SEQ ID NO: 235874 - DNA, 19 bp, Homo sapiens
ctggggcttctcctgaccc

SEQ ID NO: 235875 - DNA, 13 bp, Homo sapiens
ctggggcttgcta

SEQ ID NO: 235876 - DNA, 20 bp, Homo sapiens
ctggggcttttgtgccagga

SEQ ID NO: 235877 - DNA, 22 bp, Homo sapiens
ctggggcttttgtgccaggagt

SEQ ID NO: 235878 - DNA, 13 bp, Homo sapiens
ctgggggactggg

SEQ ID NO: 235879 - DNA, 22 bp, Homo sapiens
ctgggggactgggagtcagagc

SEQ ID NO: 235880 - DNA, 13 bp, Homo sapiens
ctgggggcagtga

SEQ ID NO: 235881 - DNA, 21 bp, Homo sapiens
ctgggggcatgggggaggctc

SEQ ID NO: 235882 - DNA, 16 bp, Homo sapiens
ctgggggccatgagct

SEQ ID NO: 235883 - DNA, 18 bp, Homo sapiens
ctgggggccatgagctcc

SEQ ID NO: 235884 - DNA, 20 bp, Homo sapiens
ctgggggccatgagctccag

SEQ ID NO: 235885 - DNA, 13 bp, Homo sapiens
ctgggggcctctg

SEQ ID NO: 235886 - DNA, 16 bp, Homo sapiens
ctgggggcctctgcct

SEQ ID NO: 235887 - DNA, 21 bp, Homo sapiens
ctgggggcctctgcctccagg

SEQ ID NO: 235888 - DNA, 18 bp, Homo sapiens
ctggggggcacagccaga

SEQ ID NO: 235889 - DNA, 12 bp, Homo sapiens
ctggggggctgt

SEQ ID NO: 235890 - DNA, 20 bp, Homo sapiens
ctgggggttctttcttcctc

SEQ ID NO: 235891 - DNA, 23 bp, Homo sapiens
ctgggggttctttcttcctctgc

SEQ ID NO: 235892 - DNA, 18 bp, Homo sapiens
ctggggtacttctgtgtt

SEQ ID NO: 235893 - DNA, 14 bp, Homo sapiens
ctggggtgccctcc

SEQ ID NO: 235894 - DNA, 14 bp, Homo sapiens
ctggggtggggctt

SEQ ID NO: 235895 - DNA, 16 bp, Homo sapiens
ctggggtggggcttgg

SEQ ID NO: 235896 - DNA, 21 bp, Homo sapiens
ctggggtggttggaggcctgg

SEQ ID NO: 235897 - DNA, 13 bp, Homo sapiens
ctgggtaactgtc

SEQ ID NO: 235898 - DNA, 15 bp, Homo sapiens
ctgggtaatgtgaag

SEQ ID NO: 235899 - DNA, 16 bp, Homo sapiens
ctgggtacaagagcca

SEQ ID NO: 235900 - DNA, 17 bp, Homo sapiens
ctgggtaccaggccacc

SEQ ID NO: 235901 - DNA, 16 bp, Homo sapiens
ctgggtcaccttcctg

SEQ ID NO: 235902 - DNA, 15 bp, Homo sapiens
ctgggtcgcccctcc

SEQ ID NO: 235903 - DNA, 16 bp, Homo sapiens
ctgggtcgcccctcct

SEQ ID NO: 235904 - DNA, 17 bp, Homo sapiens
ctgggtcgcccctcctc

SEQ ID NO: 235905 - DNA, 17 bp, Homo sapiens
ctgggtcggccctgccc

SEQ ID NO: 235906 - DNA, 15 bp, Homo sapiens
ctgggtctgtgtctc

SEQ ID NO: 235907 - DNA, 13 bp, Homo sapiens
ctgggtgacagag

SEQ ID NO: 235908 - DNA, 22 bp, Homo sapiens
ctgggtgacagagcaagactct

SEQ ID NO: 235909 - DNA, 19 bp, Homo sapiens
ctgggtgatcaccacatct

SEQ ID NO: 235910 - DNA, 15 bp, Homo sapiens
ctgggtgccattccc

SEQ ID NO: 235911 - DNA, 12 bp, Homo sapiens
ctgggtgcccac

SEQ ID NO: 235912 - DNA, 15 bp, Homo sapiens
ctgggtgcccacagc

SEQ ID NO: 235913 - DNA, 13 bp, Homo sapiens
ctgggtgctctgg

SEQ ID NO: 235914 - DNA, 15 bp, Homo sapiens
ctgggtgctggctgc

SEQ ID NO: 235915 - DNA, 15 bp, Homo sapiens
ctgggtgggcccaga

SEQ ID NO: 235916 - DNA, 13 bp, Homo sapiens
ctgggtggggaca

SEQ ID NO: 235917 - DNA, 21 bp, Homo sapiens
ctgggtggggtgaggaccact

SEQ ID NO: 235918 - DNA, 18 bp, Homo sapiens
ctgggttcagaaatgctg

SEQ ID NO: 235919 - DNA, 17 bp, Homo sapiens
ctgggttcttgttttat

SEQ ID NO: 235920 - DNA, 23 bp, Homo sapiens
ctgggtttacaacaaacactgtg

SEQ ID NO: 235921 - DNA, 17 bp, Homo sapiens
ctgggtttccacacagc

SEQ ID NO: 235922 - DNA, 20 bp, Homo sapiens
ctgggtttccacacagcctg

SEQ ID NO: 235923 - DNA, 18 bp, Homo sapiens
ctgggtttgggcagtgga

SEQ ID NO: 235924 - DNA, 20 bp, Homo sapiens
ctgggtttgggcagtggaga

SEQ ID NO: 235925 - DNA, 20 bp, Homo sapiens
ctggtaaacattcctccagc

SEQ ID NO: 235926 - DNA, 23 bp, Homo sapiens
ctggtaaacattcctccagcctc

SEQ ID NO: 235927 - DNA, 16 bp, Homo sapiens
ctggtaacctgtggtg

SEQ ID NO: 235928 - DNA, 15 bp, Homo sapiens
ctggtaagggccaag

SEQ ID NO: 235929 - DNA, 18 bp, Homo sapiens
ctggtaatttgtatctga

SEQ ID NO: 235930 - DNA, 14 bp, Homo sapiens
ctggtacagcaggg

SEQ ID NO: 235931 - DNA, 23 bp, Homo sapiens
ctggtagatagaaataaatagct

SEQ ID NO: 235932 - DNA, 13 bp, Homo sapiens
ctggtagcatgac

SEQ ID NO: 235933 - DNA, 14 bp, Homo sapiens
ctggtagcatgacc

SEQ ID NO: 235934 - DNA, 17 bp, Homo sapiens
ctggtaggaagaggtac

SEQ ID NO: 235935 - DNA, 23 bp, Homo sapiens
ctggtaggaatagcatgtcacta

SEQ ID NO: 235936 - DNA, 21 bp, Homo sapiens
ctggtagttagtagcatgttg

SEQ ID NO: 235937 - DNA, 18 bp, Homo sapiens
ctggtatgaacttgagga

SEQ ID NO: 235938 - DNA, 20 bp, Homo sapiens
ctggtatgaacttgaggaca

SEQ ID NO: 235939 - DNA, 21 bp, Homo sapiens
ctggtatgtgcctgcgttctg

SEQ ID NO: 235940 - DNA, 17 bp, Homo sapiens
ctggtcaacccgctgct

SEQ ID NO: 235941 - DNA, 18 bp, Homo sapiens
ctggtcaacccgctgctt

SEQ ID NO: 235942 - DNA, 19 bp, Homo sapiens
ctggtcaacttgagcatgt

SEQ ID NO: 235943 - DNA, 14 bp, Homo sapiens
ctggtcactgccat

SEQ ID NO: 235944 - DNA, 14 bp, Homo sapiens
ctggtccacacacc

SEQ ID NO: 235945 - DNA, 20 bp, Homo sapiens
ctggtccaggccaggcctca

SEQ ID NO: 235946 - DNA, 14 bp, Homo sapiens
ctggtccaggcttg

SEQ ID NO: 235947 - DNA, 15 bp, Homo sapiens
ctggtccagggaagc

SEQ ID NO: 235948 - DNA, 19 bp, Homo sapiens
ctggtccatgatggagtca

SEQ ID NO: 235949 - DNA, 18 bp, Homo sapiens
ctggtccctcgtccacag

SEQ ID NO: 235950 - DNA, 14 bp, Homo sapiens
ctggtcctgtgtgc

SEQ ID NO: 235951 - DNA, 20 bp, Homo sapiens
ctggtccttctgaccccact

SEQ ID NO: 235952 - DNA, 16 bp, Homo sapiens
ctggtcgtttgaccac

SEQ ID NO: 235953 - DNA, 17 bp, Homo sapiens
ctggtctattttgattt

SEQ ID NO: 235954 - DNA, 21 bp, Homo sapiens
ctggtctcaaactcctgggct

SEQ ID NO: 235955 - DNA, 14 bp, Homo sapiens
ctggtctggagccc

SEQ ID NO: 235956 - DNA, 18 bp, Homo sapiens
ctggtcttgaactcctga

SEQ ID NO: 235957 - DNA, 15 bp, Homo sapiens
ctggtcttgagatgt

SEQ ID NO: 235958 - DNA, 13 bp, Homo sapiens
ctggtgacaggca

SEQ ID NO: 235959 - DNA, 18 bp, Homo sapiens
ctggtgacaggcagacac

SEQ ID NO: 235960 - DNA, 19 bp, Homo sapiens
ctggtgacaggcagacaca

SEQ ID NO: 235961 - DNA, 15 bp, Homo sapiens
ctggtgactgcagcc

SEQ ID NO: 235962 - DNA, 23 bp, Homo sapiens
ctggtgagatacccagagagaaa

SEQ ID NO: 235963 - DNA, 20 bp, Homo sapiens
ctggtgaggcccagcctgtc

SEQ ID NO: 235964 - DNA, 20 bp, Homo sapiens
ctggtgcacatgacatttgt

SEQ ID NO: 235965 - DNA, 15 bp, Homo sapiens
ctggtgcattacaga

SEQ ID NO: 235966 - DNA, 21 bp, Homo sapiens
ctggtgccaatcctgtaggca

SEQ ID NO: 235967 - DNA, 13 bp, Homo sapiens
ctggtgccagcct

SEQ ID NO: 235968 - DNA, 14 bp, Homo sapiens
ctggtgccagcctt

SEQ ID NO: 235969 - DNA, 21 bp, Homo sapiens
ctggtgccagccttcctctgc

SEQ ID NO: 235970 - DNA, 14 bp, Homo sapiens
ctggtgcccggaga

SEQ ID NO: 235971 - DNA, 21 bp, Homo sapiens
ctggtgcgctgtgctccagca

SEQ ID NO: 235972 - DNA, 15 bp, Homo sapiens
ctggtgcgtgtggcc

SEQ ID NO: 235973 - DNA, 16 bp, Homo sapiens
ctggtgcgtgtggccc

SEQ ID NO: 235974 - DNA, 21 bp, Homo sapiens
ctggtgcgtgtggccctgtgg

SEQ ID NO: 235975 - DNA, 17 bp, Homo sapiens
ctggtggatggtgactt

SEQ ID NO: 235976 - DNA, 20 bp, Homo sapiens
ctggtggcatcgtagaagag

SEQ ID NO: 235977 - DNA, 15 bp, Homo sapiens
ctggtggcccctgcc

SEQ ID NO: 235978 - DNA, 20 bp, Homo sapiens
ctggtggcccgacagcctgg

SEQ ID NO: 235979 - DNA, 21 bp, Homo sapiens
ctggtggcccgacagcctggc

SEQ ID NO: 235980 - DNA, 12 bp, Homo sapiens
ctggtggctgga

SEQ ID NO: 235981 - DNA, 15 bp, Homo sapiens
ctggtggctggaggc

SEQ ID NO: 235982 - DNA, 15 bp, Homo sapiens
ctggtgggaaaatgt

SEQ ID NO: 235983 - DNA, 23 bp, Homo sapiens
ctggtgggatctgtgcccagaga

SEQ ID NO: 235984 - DNA, 24 bp, Homo sapiens
ctggtgggatctgtgcccagagat

SEQ ID NO: 235985 - DNA, 21 bp, Homo sapiens
ctggtgggcaccaagagccaa

SEQ ID NO: 235986 - DNA, 19 bp, Homo sapiens
ctggtgggctattgaagat

SEQ ID NO: 235987 - DNA, 12 bp, Homo sapiens
ctggtggggctg

SEQ ID NO: 235988 - DNA, 17 bp, Homo sapiens
ctggtggggctgagcct

SEQ ID NO: 235989 - DNA, 18 bp, Homo sapiens
ctggtggggctgagcctg

SEQ ID NO: 235990 - DNA, 22 bp, Homo sapiens
ctggtggggctgagcctgaggc

SEQ ID NO: 235991 - DNA, 15 bp, Homo sapiens
ctggtgggggcatcc

SEQ ID NO: 235992 - DNA, 21 bp, Homo sapiens
ctggtggggtgtgcatgccac

SEQ ID NO: 235993 - DNA, 23 bp, Homo sapiens
ctggtggggtgtgcatgccacgc

SEQ ID NO: 235994 - DNA, 22 bp, Homo sapiens
ctggtggggtgtgttccaactg

SEQ ID NO: 235995 - DNA, 17 bp, Homo sapiens
ctggtgggtggagtcag

SEQ ID NO: 235996 - DNA, 22 bp, Homo sapiens
ctggtgggtggagtcaggcttc

SEQ ID NO: 235997 - DNA, 19 bp, Homo sapiens
ctggtgtcactctgcctct

SEQ ID NO: 235998 - DNA, 12 bp, Homo sapiens
ctggtgtcccct

SEQ ID NO: 235999 - DNA, 16 bp, Homo sapiens
ctggtgtccccttccc

SEQ ID NO: 236000 - DNA, 17 bp, Homo sapiens
ctggtgtccccttcccc

SEQ ID NO: 236001 - DNA, 18 bp, Homo sapiens
ctggtgtccccttcccct

SEQ ID NO: 236002 - DNA, 16 bp, Homo sapiens
ctggtgttcctggcct

SEQ ID NO: 236003 - DNA, 21 bp, Homo sapiens
ctggttactcagctccctgga

SEQ ID NO: 236004 - DNA, 21 bp, Homo sapiens
ctggttatcctgtgctacaga

SEQ ID NO: 236005 - DNA, 17 bp, Homo sapiens
ctggttcagtgggaatg

SEQ ID NO: 236006 - DNA, 20 bp, Homo sapiens
ctggttccctctttcctgtg

SEQ ID NO: 236007 - DNA, 17 bp, Homo sapiens
ctggttccggaatcctg

SEQ ID NO: 236008 - DNA, 18 bp, Homo sapiens
ctggttccggaatcctgt

SEQ ID NO: 236009 - DNA, 16 bp, Homo sapiens
ctggttccttaagtgg

SEQ ID NO: 236010 - DNA, 20 bp, Homo sapiens
ctggttccttaagtggctgt

SEQ ID NO: 236011 - DNA, 17 bp, Homo sapiens
ctggttctccatcccca

SEQ ID NO: 236012 - DNA, 13 bp, Homo sapiens
ctggttcttgcct

SEQ ID NO: 236013 - DNA, 14 bp, Homo sapiens
ctggttcttgcctt

SEQ ID NO: 236014 - DNA, 15 bp, Homo sapiens
ctggttcttgccttc

SEQ ID NO: 236015 - DNA, 15 bp, Homo sapiens
ctggttggaggccct

SEQ ID NO: 236016 - DNA, 23 bp, Homo sapiens
ctggttggaggcccttttctggc

SEQ ID NO: 236017 - DNA, 15 bp, Homo sapiens
ctggttgtatttcta

SEQ ID NO: 236018 - DNA, 22 bp, Homo sapiens
ctggttgtatttctatatttat

SEQ ID NO: 236019 - DNA, 15 bp, Homo sapiens
ctggttgtcattttt

SEQ ID NO: 236020 - DNA, 14 bp, Homo sapiens
ctggttgttgccag

SEQ ID NO: 236021 - DNA, 19 bp, Homo sapiens
ctggtttgactcattaatt

SEQ ID NO: 236022 - DNA, 21 bp, Homo sapiens
ctggtttgtttctcaagcgct

SEQ ID NO: 236023 - DNA, 14 bp, Homo sapiens
ctggttttggtttc

SEQ ID NO: 236024 - DNA, 23 bp, Homo sapiens
ctggtttttctgttccctgctgg

SEQ ID NO: 236025 - DNA, 13 bp, Homo sapiens
ctgtaaaaaagaa

SEQ ID NO: 236026 - DNA, 19 bp, Homo sapiens
ctgtaaaaaagaaaaacaa

SEQ ID NO: 236027 - DNA, 22 bp, Homo sapiens
ctgtaaaaacacaaatgtgtac

SEQ ID NO: 236028 - DNA, 14 bp, Homo sapiens
ctgtaaaactttat

SEQ ID NO: 236029 - DNA, 15 bp, Homo sapiens
ctgtaaaatgtggga

SEQ ID NO: 236030 - DNA, 21 bp, Homo sapiens
ctgtaaaatgtgggattatgg

SEQ ID NO: 236031 - DNA, 17 bp, Homo sapiens
ctgtaaacactcagctg

SEQ ID NO: 236032 - DNA, 18 bp, Homo sapiens
ctgtaaacactcagctgt

SEQ ID NO: 236033 - DNA, 19 bp, Homo sapiens
ctgtaaacactcagctgtt

SEQ ID NO: 236034 - DNA, 22 bp, Homo sapiens
ctgtaaacccctgggtaactgt

SEQ ID NO: 236035 - DNA, 22 bp, Homo sapiens
ctgtaaactcaaaacttaacat

SEQ ID NO: 236036 - DNA, 18 bp, Homo sapiens
ctgtaaataaaaatagct

SEQ ID NO: 236037 - DNA, 11 bp, Homo sapiens
ctgtaaataac

SEQ ID NO: 236038 - DNA, 12 bp, Homo sapiens
ctgtaaatacaa

SEQ ID NO: 236039 - DNA, 13 bp, Homo sapiens
ctgtaaatacaaa

SEQ ID NO: 236040 - DNA, 23 bp, Homo sapiens
ctgtaaatatcccagagaacaat

SEQ ID NO: 236041 - DNA, 18 bp, Homo sapiens
ctgtaaatcctagacttg

SEQ ID NO: 236042 - DNA, 21 bp, Homo sapiens
ctgtaaatcctagacttgaaa

SEQ ID NO: 236043 - DNA, 22 bp, Homo sapiens
ctgtaaatgaagggtcatttct

SEQ ID NO: 236044 - DNA, 21 bp, Homo sapiens
ctgtaaatttaactgcatata

SEQ ID NO: 236045 - DNA, 21 bp, Homo sapiens
ctgtaacacagctgagagact

SEQ ID NO: 236046 - DNA, 22 bp, Homo sapiens
ctgtaacatcactatccatgca

SEQ ID NO: 236047 - DNA, 18 bp, Homo sapiens
ctgtaaccacctctctgt

SEQ ID NO: 236048 - DNA, 20 bp, Homo sapiens
ctgtaaccacctctctgtct

SEQ ID NO: 236049 - DNA, 17 bp, Homo sapiens
ctgtaacctgaagtcaa

SEQ ID NO: 236050 - DNA, 15 bp, Homo sapiens
ctgtaactcagacat

SEQ ID NO: 236051 - DNA, 19 bp, Homo sapiens
ctgtaactcagacattcca

SEQ ID NO: 236052 - DNA, 17 bp, Homo sapiens
ctgtaactgctgagcca

SEQ ID NO: 236053 - DNA, 22 bp, Homo sapiens
ctgtaagaagagactgggaaga

SEQ ID NO: 236054 - DNA, 16 bp, Homo sapiens
ctgtaagactgataat

SEQ ID NO: 236055 - DNA, 19 bp, Homo sapiens
ctgtaagattttattttca

SEQ ID NO: 236056 - DNA, 20 bp, Homo sapiens
ctgtaagcattctgagctgg

SEQ ID NO: 236057 - DNA, 16 bp, Homo sapiens
ctggcagcgcctcccg

SEQ ID NO: 236058 - DNA, 19 bp, Homo sapiens
ctggcagctcctctccttg

SEQ ID NO: 236059 - DNA, 24 bp, Homo sapiens
ctggcagctcctctccttgggctc

SEQ ID NO: 236060 - DNA, 13 bp, Homo sapiens
ctggcagctctcc

SEQ ID NO: 236061 - DNA, 16 bp, Homo sapiens
ctggcagctctccagt

SEQ ID NO: 236062 - DNA, 17 bp, Homo sapiens
ctggcaggagacactgg

SEQ ID NO: 236063 - DNA, 23 bp, Homo sapiens
ctggcaggagacactggtctcag

SEQ ID NO: 236064 - DNA, 22 bp, Homo sapiens
ctggcaggagagagccttggcc

SEQ ID NO: 236065 - DNA, 19 bp, Homo sapiens
ctggcaggagggtggcact

SEQ ID NO: 236066 - DNA, 20 bp, Homo sapiens
ctggcagggcaggcagagct

SEQ ID NO: 236067 - DNA, 20 bp, Homo sapiens
ctggcaggtgcagatgggct

SEQ ID NO: 236068 - DNA, 16 bp, Homo sapiens
ctggcaggtggccagg

SEQ ID NO: 236069 - DNA, 21 bp, Homo sapiens
ctggcaggtggccagggctcc

SEQ ID NO: 236070 - DNA, 21 bp, Homo sapiens
ctggcatagccctcctgagca

SEQ ID NO: 236071 - DNA, 23 bp, Homo sapiens
ctggcatagccctcctgagcacc

SEQ ID NO: 236072 - DNA, 18 bp, Homo sapiens
ctggcatctgacacaaaa

SEQ ID NO: 236073 - DNA, 21 bp, Homo sapiens
ctggcatgacactctagtgac

SEQ ID NO: 236074 - DNA, 16 bp, Homo sapiens
ctggcatgggaatgaa

SEQ ID NO: 236075 - DNA, 18 bp, Homo sapiens
ctggcatgggaatgaatg

SEQ ID NO: 236076 - DNA, 20 bp, Homo sapiens
ctggccaaatatgcactttc

SEQ ID NO: 236077 - DNA, 23 bp, Homo sapiens
ctggccacaatcctccccaccag

SEQ ID NO: 236078 - DNA, 13 bp, Homo sapiens
ctggccaccctgg

SEQ ID NO: 236079 - DNA, 17 bp, Homo sapiens
ctggccaccctggcccg

SEQ ID NO: 236080 - DNA, 16 bp, Homo sapiens
ctggccacctctctcc

SEQ ID NO: 236081 - DNA, 14 bp, Homo sapiens
ctggccacgcagcc

SEQ ID NO: 236082 - DNA, 15 bp, Homo sapiens
ctggccacgcagcca

SEQ ID NO: 236083 - DNA, 15 bp, Homo sapiens
ctggccagagagggc

SEQ ID NO: 236084 - DNA, 23 bp, Homo sapiens
ctggccagagagggcccagctgt

SEQ ID NO: 236085 - DNA, 15 bp, Homo sapiens
ctggccagcaaggca

SEQ ID NO: 236086 - DNA, 12 bp, Homo sapiens
ctggccagcctg

SEQ ID NO: 236087 - DNA, 17 bp, Homo sapiens
ctggccagcctggggcc

SEQ ID NO: 236088 - DNA, 13 bp, Homo sapiens
ctggccaggagct

SEQ ID NO: 236089 - DNA, 17 bp, Homo sapiens
ctggccaggagctcttc

SEQ ID NO: 236090 - DNA, 12 bp, Homo sapiens
ctggccaggatg

SEQ ID NO: 236091 - DNA, 23 bp, Homo sapiens
ctggccaggatggaggggtggtc

SEQ ID NO: 236092 - DNA, 17 bp, Homo sapiens
ctggccaggcactgcct

SEQ ID NO: 236093 - DNA, 13 bp, Homo sapiens
ctggccatctctg

SEQ ID NO: 236094 - DNA, 13 bp, Homo sapiens
ctggcccacccct

SEQ ID NO: 236095 - DNA, 15 bp, Homo sapiens
ctggcccacccctct

SEQ ID NO: 236096 - DNA, 17 bp, Homo sapiens
ctggcccacccctcttc

SEQ ID NO: 236097 - DNA, 14 bp, Homo sapiens
ctggcccacgccct

SEQ ID NO: 236098 - DNA, 17 bp, Homo sapiens
ctggcccacgccctccc

SEQ ID NO: 236099 - DNA, 22 bp, Homo sapiens
ctggcccacgccctccctctcc

SEQ ID NO: 236100 - DNA, 13 bp, Homo sapiens
ctggcccagccaa

SEQ ID NO: 236101 - DNA, 23 bp, Homo sapiens
ctggcccagccaaaccctgtctg

SEQ ID NO: 236102 - DNA, 14 bp, Homo sapiens
ctggcccagcggcc

SEQ ID NO: 236103 - DNA, 13 bp, Homo sapiens
ctggcccaggaga

SEQ ID NO: 236104 - DNA, 17 bp, Homo sapiens
ctggcccatctcagcct

SEQ ID NO: 236105 - DNA, 15 bp, Homo sapiens
ctggccccaaatgtt

SEQ ID NO: 236106 - DNA, 12 bp, Homo sapiens
ctggccccaccc

SEQ ID NO: 236107 - DNA, 23 bp, Homo sapiens
ctggccccaccctcgtggacacc

SEQ ID NO: 236108 - DNA, 19 bp, Homo sapiens
ctggccccaggcggagggg

SEQ ID NO: 236109 - DNA, 21 bp, Homo sapiens
ctggccccaggcggaggggct

SEQ ID NO: 236110 - DNA, 16 bp, Homo sapiens
ctggcccccctccagg

SEQ ID NO: 236111 - DNA, 17 bp, Homo sapiens
ctggcccccctccaggc

SEQ ID NO: 236112 - DNA, 20 bp, Homo sapiens
ctggccccgggctctggcca

SEQ ID NO: 236113 - DNA, 23 bp, Homo sapiens
ctggccccgggctctggccaccc

SEQ ID NO: 236114 - DNA, 18 bp, Homo sapiens
ctggcccctagaatcagc

SEQ ID NO: 236115 - DNA, 20 bp, Homo sapiens
ctggcccctccagaccctgc

SEQ ID NO: 236116 - DNA, 21 bp, Homo sapiens
ctggcccctccagaccctgcc

SEQ ID NO: 236117 - DNA, 22 bp, Homo sapiens
ctggcccctccagaccctgcct

SEQ ID NO: 236118 - DNA, 21 bp, Homo sapiens
ctggcccgcccctcgctgctg

SEQ ID NO: 236119 - DNA, 14 bp, Homo sapiens
ctggccctctgtgt

SEQ ID NO: 236120 - DNA, 14 bp, Homo sapiens
ctggccctgccctc

SEQ ID NO: 236121 - DNA, 17 bp, Homo sapiens
ctggccctgccctgagg

SEQ ID NO: 236122 - DNA, 22 bp, Homo sapiens
ctggcccttgcccaactcccag

SEQ ID NO: 236123 - DNA, 23 bp, Homo sapiens
ctggcccttgcccaactcccagc

SEQ ID NO: 236124 - DNA, 15 bp, Homo sapiens
ctggccgggcacagc

SEQ ID NO: 236125 - DNA, 21 bp, Homo sapiens
ctggccgggttggaggcctca

SEQ ID NO: 236126 - DNA, 22 bp, Homo sapiens
ctggccgggttggaggcctcac

SEQ ID NO: 236127 - DNA, 15 bp, Homo sapiens
ctggcctcactggct

SEQ ID NO: 236128 - DNA, 17 bp, Homo sapiens
ctggcctcactggctgg

SEQ ID NO: 236129 - DNA, 20 bp, Homo sapiens
ctggcctcactggctggggc

SEQ ID NO: 236130 - DNA, 22 bp, Homo sapiens
ctggcctcagccagctgcccac

SEQ ID NO: 236131 - DNA, 13 bp, Homo sapiens
ctggcctcccctg

SEQ ID NO: 236132 - DNA, 14 bp, Homo sapiens
ctggcctcccctgc

SEQ ID NO: 236133 - DNA, 18 bp, Homo sapiens
ctggcctcggggcagggc

SEQ ID NO: 236134 - DNA, 15 bp, Homo sapiens
ctggcctctgtgcca

SEQ ID NO: 236135 - DNA, 22 bp, Homo sapiens
ctggcctcttcctccctccctg

SEQ ID NO: 236136 - DNA, 12 bp, Homo sapiens
ctggcctgagct

SEQ ID NO: 236137 - DNA, 21 bp, Homo sapiens
ctggcctgagctggggccaca

SEQ ID NO: 236138 - DNA, 18 bp, Homo sapiens
ctggcctgcgcctgcacc

SEQ ID NO: 236139 - DNA, 20 bp, Homo sapiens
ctggcctgcgcctgcacctg

SEQ ID NO: 236140 - DNA, 14 bp, Homo sapiens
ctggcctgctggga

SEQ ID NO: 236141 - DNA, 13 bp, Homo sapiens
ctggcctggcctg

SEQ ID NO: 236142 - DNA, 16 bp, Homo sapiens
ctggcctggcctggcc

SEQ ID NO: 236143 - DNA, 17 bp, Homo sapiens
ctggcctggctccccac

SEQ ID NO: 236144 - DNA, 20 bp, Homo sapiens
ctggcctgggtggggcaggg

SEQ ID NO: 236145 - DNA, 22 bp, Homo sapiens
ctggcctgggtggggcagggcc

SEQ ID NO: 236146 - DNA, 19 bp, Homo sapiens
ctggccttctgaactccat

SEQ ID NO: 236147 - DNA, 19 bp, Homo sapiens
ctggccttgaaaccacctt

SEQ ID NO: 236148 - DNA, 18 bp, Homo sapiens
ctggccttggttcctcca

SEQ ID NO: 236149 - DNA, 19 bp, Homo sapiens
ctggcgaagatggtctcca

SEQ ID NO: 236150 - DNA, 18 bp, Homo sapiens
ctggcggaacctggctgc

SEQ ID NO: 236151 - DNA, 19 bp, Homo sapiens
ctggcggaacctggctgcg

SEQ ID NO: 236152 - DNA, 18 bp, Homo sapiens
ctggcggccctaagccac

SEQ ID NO: 236153 - DNA, 15 bp, Homo sapiens
ctggcggcgcagagg

SEQ ID NO: 236154 - DNA, 13 bp, Homo sapiens
ctggcggcttcct

SEQ ID NO: 236155 - DNA, 14 bp, Homo sapiens
ctggcggcttcctg

SEQ ID NO: 236156 - DNA, 19 bp, Homo sapiens
ctggcggcttcctgtccac

SEQ ID NO: 236157 - DNA, 13 bp, Homo sapiens
ctggcgggcagcc

SEQ ID NO: 236158 - DNA, 14 bp, Homo sapiens
ctggcgggcagccc

SEQ ID NO: 236159 - DNA, 21 bp, Homo sapiens
ctggcgggcagcccctgctgg

SEQ ID NO: 236160 - DNA, 13 bp, Homo sapiens
ctggcgtctgtct

SEQ ID NO: 236161 - DNA, 22 bp, Homo sapiens
ctggcgtggggggagctctggt

SEQ ID NO: 236162 - DNA, 17 bp, Homo sapiens
ctggctacgacttggga

SEQ ID NO: 236163 - DNA, 20 bp, Homo sapiens
ctggctacgacttgggacgg

SEQ ID NO: 236164 - DNA, 18 bp, Homo sapiens
ctggctagagtcctcact

SEQ ID NO: 236165 - DNA, 21 bp, Homo sapiens
ctggctagagtcctcactccc

SEQ ID NO: 236166 - DNA, 22 bp, Homo sapiens
ctggctagagtcctcactccca

SEQ ID NO: 236167 - DNA, 16 bp, Homo sapiens
ctggctaggggccgag

SEQ ID NO: 236168 - DNA, 16 bp, Homo sapiens
ctggctcacagactgg

SEQ ID NO: 236169 - DNA, 15 bp, Homo sapiens
ctggctcacagccac

SEQ ID NO: 236170 - DNA, 21 bp, Homo sapiens
ctggctccacgccctggggag

SEQ ID NO: 236171 - DNA, 15 bp, Homo sapiens
ctggctcccacaggc

SEQ ID NO: 236172 - DNA, 18 bp, Homo sapiens
ctggctcccacaggccct

SEQ ID NO: 236173 - DNA, 22 bp, Homo sapiens
ctggctccccacgagtcacctg

SEQ ID NO: 236174 - DNA, 16 bp, Homo sapiens
ctggctccctgggacc

SEQ ID NO: 236175 - DNA, 16 bp, Homo sapiens
ctggctccgctgtgtg

SEQ ID NO: 236176 - DNA, 13 bp, Homo sapiens
ctggctcctgtgt

SEQ ID NO: 236177 - DNA, 17 bp, Homo sapiens
ctggctcggacccaccc

SEQ ID NO: 236178 - DNA, 20 bp, Homo sapiens
ctggctcggacccaccccaa

SEQ ID NO: 236179 - DNA, 22 bp, Homo sapiens
ctggctcggacccaccccaact

SEQ ID NO: 236180 - DNA, 23 bp, Homo sapiens
ctggctcggacccaccccaactc

SEQ ID NO: 236181 - DNA, 16 bp, Homo sapiens
ctggctctctccagga

SEQ ID NO: 236182 - DNA, 16 bp, Homo sapiens
ctggctctgtcaccgc

SEQ ID NO: 236183 - DNA, 21 bp, Homo sapiens
ctggctctgtcaccgccatgc

SEQ ID NO: 236184 - DNA, 22 bp, Homo sapiens
ctggctctgtcaccgccatgca

SEQ ID NO: 236185 - DNA, 18 bp, Homo sapiens
ctggctctgtggcttgct

SEQ ID NO: 236186 - DNA, 14 bp, Homo sapiens
ctggctgaaaatca

SEQ ID NO: 236187 - DNA, 20 bp, Homo sapiens
ctggctgaggcttgggccca

SEQ ID NO: 236188 - DNA, 23 bp, Homo sapiens
ctggctgaggcttgggcccagta

SEQ ID NO: 236189 - DNA, 21 bp, Homo sapiens
ctggctgagtggaatgcaggg

SEQ ID NO: 236190 - DNA, 15 bp, Homo sapiens
ctgtaaggactcagt

SEQ ID NO: 236191 - DNA, 19 bp, Homo sapiens
ctgtaaggactcagtgttg

SEQ ID NO: 236192 - DNA, 15 bp, Homo sapiens
ctgtaatatctattt

SEQ ID NO: 236193 - DNA, 19 bp, Homo sapiens
ctgtaatcatataataaat

SEQ ID NO: 236194 - DNA, 18 bp, Homo sapiens
ctgtaatttcagctagtt

SEQ ID NO: 236195 - DNA, 20 bp, Homo sapiens
ctgtaatttttttcttatat

SEQ ID NO: 236196 - DNA, 18 bp, Homo sapiens
ctgtacacaccctccagc

SEQ ID NO: 236197 - DNA, 20 bp, Homo sapiens
ctgtacacaccctccagcac

SEQ ID NO: 236198 - DNA, 17 bp, Homo sapiens
ctgtacaccatagttta

SEQ ID NO: 236199 - DNA, 20 bp, Homo sapiens
ctgtacagattgctgcttct

SEQ ID NO: 236200 - DNA, 23 bp, Homo sapiens
ctgtacatattactgttgcattt

SEQ ID NO: 236201 - DNA, 20 bp, Homo sapiens
ctgtacatatttgagactag

SEQ ID NO: 236202 - DNA, 15 bp, Homo sapiens
ctgtacattgtggga

SEQ ID NO: 236203 - DNA, 15 bp, Homo sapiens
ctgtacccagccacc

SEQ ID NO: 236204 - DNA, 22 bp, Homo sapiens
ctgtacccagccaccttcctga

SEQ ID NO: 236205 - DNA, 22 bp, Homo sapiens
ctgtacctctctctgctcctca

SEQ ID NO: 236206 - DNA, 20 bp, Homo sapiens
ctgtactcagagcagagcaa

SEQ ID NO: 236207 - DNA, 16 bp, Homo sapiens
ctgtactcctcccagg

SEQ ID NO: 236208 - DNA, 14 bp, Homo sapiens
ctgtactgagttct

SEQ ID NO: 236209 - DNA, 16 bp, Homo sapiens
ctgtactggccagtgt

SEQ ID NO: 236210 - DNA, 15 bp, Homo sapiens
ctgtacttcaagtta

SEQ ID NO: 236211 - DNA, 22 bp, Homo sapiens
ctgtagaaaggttgattctcat

SEQ ID NO: 236212 - DNA, 15 bp, Homo sapiens
ctgtagactagtgcc

SEQ ID NO: 236213 - DNA, 14 bp, Homo sapiens
ctgtagagacttcc

SEQ ID NO: 236214 - DNA, 22 bp, Homo sapiens
ctgtagagcagggcaagtaaca

SEQ ID NO: 236215 - DNA, 16 bp, Homo sapiens
ctgtagagccagcctt

SEQ ID NO: 236216 - DNA, 17 bp, Homo sapiens
ctgtagagccagccttg

SEQ ID NO: 236217 - DNA, 18 bp, Homo sapiens
ctgtagattgcttctgta

SEQ ID NO: 236218 - DNA, 19 bp, Homo sapiens
ctgtagattgcttctgtag

SEQ ID NO: 236219 - DNA, 19 bp, Homo sapiens
ctgtagccatggctcaggc

SEQ ID NO: 236220 - DNA, 15 bp, Homo sapiens
ctgtagctattcttt

SEQ ID NO: 236221 - DNA, 16 bp, Homo sapiens
ctgtagctattctttg

SEQ ID NO: 236222 - DNA, 19 bp, Homo sapiens
ctgtagctcccgagctact

SEQ ID NO: 236223 - DNA, 15 bp, Homo sapiens
ctgtagctccctcct

SEQ ID NO: 236224 - DNA, 16 bp, Homo sapiens
ctgtagctccctcctc

SEQ ID NO: 236225 - DNA, 17 bp, Homo sapiens
ctgtagcttatatttga

SEQ ID NO: 236226 - DNA, 15 bp, Homo sapiens
ctgtaggaaacagaa

SEQ ID NO: 236227 - DNA, 18 bp, Homo sapiens
ctgtaggaaacagaaaag

SEQ ID NO: 236228 - DNA, 17 bp, Homo sapiens
ctgtaggactatataaa

SEQ ID NO: 236229 - DNA, 16 bp, Homo sapiens
ctgtaggagagactgg

SEQ ID NO: 236230 - DNA, 19 bp, Homo sapiens
ctgtaggagagactggcca

SEQ ID NO: 236231 - DNA, 22 bp, Homo sapiens
ctgtaggagcaggtgaataaag

SEQ ID NO: 236232 - DNA, 15 bp, Homo sapiens
ctgtagggctggacc

SEQ ID NO: 236233 - DNA, 16 bp, Homo sapiens
ctgtaggtatagaaga

SEQ ID NO: 236234 - DNA, 14 bp, Homo sapiens
ctgtagtaattgtt

SEQ ID NO: 236235 - DNA, 21 bp, Homo sapiens
ctgtagtagccctttctgtgt

SEQ ID NO: 236236 - DNA, 23 bp, Homo sapiens
ctgtagtcccacttacttgggag

SEQ ID NO: 236237 - DNA, 18 bp, Homo sapiens
ctgtagtgagaaactgat

SEQ ID NO: 236238 - DNA, 19 bp, Homo sapiens
ctgtagtgagaaactgatt

SEQ ID NO: 236239 - DNA, 14 bp, Homo sapiens
ctgtagttaggaaa

SEQ ID NO: 236240 - DNA, 15 bp, Homo sapiens
ctgtagttaggaaat

SEQ ID NO: 236241 - DNA, 21 bp, Homo sapiens
ctgtagttaggaaataaaacc

SEQ ID NO: 236242 - DNA, 19 bp, Homo sapiens
ctgtatacaaacaggtgct

SEQ ID NO: 236243 - DNA, 18 bp, Homo sapiens
ctgtataggtagatccag

SEQ ID NO: 236244 - DNA, 19 bp, Homo sapiens
ctgtataggtagatccaga

SEQ ID NO: 236245 - DNA, 20 bp, Homo sapiens
ctgtataggtagatccagat

SEQ ID NO: 236246 - DNA, 14 bp, Homo sapiens
ctgtatatacattt

SEQ ID NO: 236247 - DNA, 15 bp, Homo sapiens
ctgtatatgttgtaa

SEQ ID NO: 236248 - DNA, 19 bp, Homo sapiens
ctgtatatgttgtaataaa

SEQ ID NO: 236249 - DNA, 17 bp, Homo sapiens
ctgtatatttgaaactg

SEQ ID NO: 236250 - DNA, 23 bp, Homo sapiens
ctgtatccaagttatttgatctg

SEQ ID NO: 236251 - DNA, 17 bp, Homo sapiens
ctgtatcggagacagtg

SEQ ID NO: 236252 - DNA, 18 bp, Homo sapiens
ctgtatctaaaaaataac

SEQ ID NO: 236253 - DNA, 20 bp, Homo sapiens
ctgtatgatttaggcttcta

SEQ ID NO: 236254 - DNA, 12 bp, Homo sapiens
ctgtatgtcaga

SEQ ID NO: 236255 - DNA, 13 bp, Homo sapiens
ctgtatgtcttat

SEQ ID NO: 236256 - DNA, 17 bp, Homo sapiens
ctgtattacataaataa

SEQ ID NO: 236257 - DNA, 12 bp, Homo sapiens
ctgtattctgca

SEQ ID NO: 236258 - DNA, 11 bp, Homo sapiens
ctgtattgcta

SEQ ID NO: 236259 - DNA, 12 bp, Homo sapiens
ctgtatttccaa

SEQ ID NO: 236260 - DNA, 14 bp, Homo sapiens
ctgtatttgtatct

SEQ ID NO: 236261 - DNA, 15 bp, Homo sapiens
ctgtattttctttta

SEQ ID NO: 236262 - DNA, 20 bp, Homo sapiens
ctgtattttcttttatatct

SEQ ID NO: 236263 - DNA, 22 bp, Homo sapiens
ctgtattttcttttatatctgt

SEQ ID NO: 236264 - DNA, 23 bp, Homo sapiens
ctgtattttcttttatatctgta

SEQ ID NO: 236265 - DNA, 20 bp, Homo sapiens
ctgtatttttaaattctgct

SEQ ID NO: 236266 - DNA, 15 bp, Homo sapiens
ctgtatttttagaga

SEQ ID NO: 236267 - DNA, 17 bp, Homo sapiens
ctgtattttttttttcc

SEQ ID NO: 236268 - DNA, 18 bp, Homo sapiens
ctgtattttttttttcca

SEQ ID NO: 236269 - DNA, 20 bp, Homo sapiens
ctgtcaagtcatgatggaga

SEQ ID NO: 236270 - DNA, 19 bp, Homo sapiens
ctgtcaagttaacaaggaa

SEQ ID NO: 236271 - DNA, 13 bp, Homo sapiens
ctgtcaataaaca

SEQ ID NO: 236272 - DNA, 23 bp, Homo sapiens
ctgtcaatgaggttatgagaaaa

SEQ ID NO: 236273 - DNA, 13 bp, Homo sapiens
ctgtcaattacag

SEQ ID NO: 236274 - DNA, 19 bp, Homo sapiens
ctgtcaattacaggaagta

SEQ ID NO: 236275 - DNA, 20 bp, Homo sapiens
ctgtcaattacaggaagtac

SEQ ID NO: 236276 - DNA, 17 bp, Homo sapiens
ctgtcaccacatcttgt

SEQ ID NO: 236277 - DNA, 15 bp, Homo sapiens
ctgtcactactggtc

SEQ ID NO: 236278 - DNA, 20 bp, Homo sapiens
ctgtcactgtttctctgctg

SEQ ID NO: 236279 - DNA, 17 bp, Homo sapiens
ctgtcactttgctctgg

SEQ ID NO: 236280 - DNA, 19 bp, Homo sapiens
ctgtcactttgctctgggt

SEQ ID NO: 236281 - DNA, 20 bp, Homo sapiens
ctgtcagagaatatgaccta

SEQ ID NO: 236282 - DNA, 15 bp, Homo sapiens
ctgtcagaggctaag

SEQ ID NO: 236283 - DNA, 17 bp, Homo sapiens
ctgtcagcgcaggttta

SEQ ID NO: 236284 - DNA, 16 bp, Homo sapiens
ctgtcagctgagcttg

SEQ ID NO: 236285 - DNA, 14 bp, Homo sapiens
ctgtcagcttccca

SEQ ID NO: 236286 - DNA, 16 bp, Homo sapiens
ctgtcagcttcccaac

SEQ ID NO: 236287 - DNA, 19 bp, Homo sapiens
ctgtcaggcagtagcagct

SEQ ID NO: 236288 - DNA, 20 bp, Homo sapiens
ctgtcaggcagtagcagctg

SEQ ID NO: 236289 - DNA, 21 bp, Homo sapiens
ctgtcaggcagtagcagctgt

SEQ ID NO: 236290 - DNA, 22 bp, Homo sapiens
ctgtcagggccttggcccaggg

SEQ ID NO: 236291 - DNA, 19 bp, Homo sapiens
ctgtcagtgcagcccgtgt

SEQ ID NO: 236292 - DNA, 16 bp, Homo sapiens
ctgtcagtgtcctcag

SEQ ID NO: 236293 - DNA, 17 bp, Homo sapiens
ctgtcagtttgtgaagt

SEQ ID NO: 236294 - DNA, 21 bp, Homo sapiens
ctgtcagtttgtgaagtgatt

SEQ ID NO: 236295 - DNA, 17 bp, Homo sapiens
ctgtcatcactccctgg

SEQ ID NO: 236296 - DNA, 18 bp, Homo sapiens
ctgtcatcactccctgga

SEQ ID NO: 236297 - DNA, 21 bp, Homo sapiens
ctgtcatcactccctggatgt

SEQ ID NO: 236298 - DNA, 20 bp, Homo sapiens
ctgtcatgaacatgttcctg

SEQ ID NO: 236299 - DNA, 19 bp, Homo sapiens
ctgtccaaaggaggctggc

SEQ ID NO: 236300 - DNA, 20 bp, Homo sapiens
ctgtccaaaggaggctggca

SEQ ID NO: 236301 - DNA, 21 bp, Homo sapiens
ctgtccaagtgtttcttgtta

SEQ ID NO: 236302 - DNA, 19 bp, Homo sapiens
ctgtccaattccagagctg

SEQ ID NO: 236303 - DNA, 20 bp, Homo sapiens
ctgtccaattccagagctgt

SEQ ID NO: 236304 - DNA, 21 bp, Homo sapiens
ctgtccacctgtgctgctgca

SEQ ID NO: 236305 - DNA, 13 bp, Homo sapiens
ctgtccagaaaat

SEQ ID NO: 236306 - DNA, 18 bp, Homo sapiens
ctgtccagagagagaagt

SEQ ID NO: 236307 - DNA, 13 bp, Homo sapiens
ctgtccagcctgg

SEQ ID NO: 236308 - DNA, 14 bp, Homo sapiens
ctgtccaggccact

SEQ ID NO: 236309 - DNA, 19 bp, Homo sapiens
ctgtccaggccactgtggc

SEQ ID NO: 236310 - DNA, 12 bp, Homo sapiens
ctgtccagggct

SEQ ID NO: 236311 - DNA, 13 bp, Homo sapiens
ctgtccagggctt

SEQ ID NO: 236312 - DNA, 20 bp, Homo sapiens
ctgtccaggtgagtgtgagg

SEQ ID NO: 236313 - DNA, 14 bp, Homo sapiens
ctgtccatccccag

SEQ ID NO: 236314 - DNA, 23 bp, Homo sapiens
ctgtcccaatcttaccagatgct

SEQ ID NO: 236315 - DNA, 22 bp, Homo sapiens
ctgtcccacaaaatatttctaa

SEQ ID NO: 236316 - DNA, 21 bp, Homo sapiens
ctgtcccaccaactctgcact

SEQ ID NO: 236317 - DNA, 14 bp, Homo sapiens
ctgtcccactggga

SEQ ID NO: 236318 - DNA, 16 bp, Homo sapiens
ctgtcccactgggaca

SEQ ID NO: 236319 - DNA, 12 bp, Homo sapiens
ctgtcccagagg

SEQ ID NO: 236320 - DNA, 21 bp, Homo sapiens
ctgtcccaggggtctccctga

SEQ ID NO: 236321 - DNA, 16 bp, Homo sapiens
ctgtcccattctagat

SEQ ID NO: 236322 - DNA, 22 bp, Homo sapiens
ctgtcccattctccactcactg

SEQ ID NO: 236323 - DNA, 14 bp, Homo sapiens
ctgtccccagccct

SEQ ID NO: 236324 - DNA, 15 bp, Homo sapiens
ctgtcccccacgtgg

SEQ ID NO: 236325 - DNA, 13 bp, Homo sapiens
ctgtccccctacc

SEQ ID NO: 236326 - DNA, 16 bp, Homo sapiens
ctgtccccgccttccc

SEQ ID NO: 236327 - DNA, 17 bp, Homo sapiens
ctgtccccgccttccct

SEQ ID NO: 236328 - DNA, 19 bp, Homo sapiens
ctgtccccgccttccctca

SEQ ID NO: 236329 - DNA, 16 bp, Homo sapiens
ctgtcccctccatctg

SEQ ID NO: 236330 - DNA, 21 bp, Homo sapiens
ctgtcccctccatctggggat

SEQ ID NO: 236331 - DNA, 13 bp, Homo sapiens
ctgtcccctctcc

SEQ ID NO: 236332 - DNA, 13 bp, Homo sapiens
ctgtccccttcca

SEQ ID NO: 236333 - DNA, 15 bp, Homo sapiens
ctgtccccttccagg

SEQ ID NO: 236334 - DNA, 14 bp, Homo sapiens
ctgtcccgccttcc

SEQ ID NO: 236335 - DNA, 21 bp, Homo sapiens
ctgtcccgccttcctcctcca

SEQ ID NO: 236336 - DNA, 16 bp, Homo sapiens
ctgtccctaccactga

SEQ ID NO: 236337 - DNA, 19 bp, Homo sapiens
ctgtccctaccactgagcc

SEQ ID NO: 236338 - DNA, 24 bp, Homo sapiens
ctgtccctaccactgagcccttgc

SEQ ID NO: 236339 - DNA, 12 bp, Homo sapiens
ctgtccctcact

SEQ ID NO: 236340 - DNA, 13 bp, Homo sapiens
ctgtccctcctga

SEQ ID NO: 236341 - DNA, 16 bp, Homo sapiens
ctgtccctggccatct

SEQ ID NO: 236342 - DNA, 13 bp, Homo sapiens
ctgtccctgtccc

SEQ ID NO: 236343 - DNA, 14 bp, Homo sapiens
ctgtccctgtcccc

SEQ ID NO: 236344 - DNA, 14 bp, Homo sapiens
ctgtccctgtccct

SEQ ID NO: 236345 - DNA, 21 bp, Homo sapiens
ctgtcccttctcttaatttaa

SEQ ID NO: 236346 - DNA, 17 bp, Homo sapiens
ctgtccgccctcttccc

SEQ ID NO: 236347 - DNA, 19 bp, Homo sapiens
ctgtccgcctctgcccgca

SEQ ID NO: 236348 - DNA, 21 bp, Homo sapiens
ctgtccgcctctgcccgcaga

SEQ ID NO: 236349 - DNA, 22 bp, Homo sapiens
ctgtcctacccgcccgcgtcca

SEQ ID NO: 236350 - DNA, 22 bp, Homo sapiens
ctgtcctatggagcctctgcag

SEQ ID NO: 236351 - DNA, 15 bp, Homo sapiens
ctgtcctcaccgtct

SEQ ID NO: 236352 - DNA, 17 bp, Homo sapiens
ctgtcctcagcttctta

SEQ ID NO: 236353 - DNA, 22 bp, Homo sapiens
ctgtcctcattcttctctccca

SEQ ID NO: 236354 - DNA, 13 bp, Homo sapiens
ctgtcctccagag

SEQ ID NO: 236355 - DNA, 18 bp, Homo sapiens
ctgtcctcttaagacact

SEQ ID NO: 236356 - DNA, 19 bp, Homo sapiens
ctgtcctctttcagaaaac

SEQ ID NO: 236357 - DNA, 17 bp, Homo sapiens
ctgtcctgagccccctg

SEQ ID NO: 236358 - DNA, 17 bp, Homo sapiens
ctgtcctgatggtcagc

SEQ ID NO: 236359 - DNA, 13 bp, Homo sapiens
ctgtcctgcagta

SEQ ID NO: 236360 - DNA, 12 bp, Homo sapiens
ctgtcctgctca

SEQ ID NO: 236361 - DNA, 18 bp, Homo sapiens
ctgtcctgctcacgtctg

SEQ ID NO: 236362 - DNA, 22 bp, Homo sapiens
ctgtcctgctcacgtctgtgag

SEQ ID NO: 236363 - DNA, 14 bp, Homo sapiens
ctgtcctggctgtg

SEQ ID NO: 236364 - DNA, 18 bp, Homo sapiens
ctgtcctgggcgccctgg

SEQ ID NO: 236365 - DNA, 19 bp, Homo sapiens
ctgtcctgggcgccctgga

SEQ ID NO: 236366 - DNA, 22 bp, Homo sapiens
ctgtcctgtacattgtgggatg

SEQ ID NO: 236367 - DNA, 22 bp, Homo sapiens
ctgtccttcattccgttaggaa

SEQ ID NO: 236368 - DNA, 16 bp, Homo sapiens
ctgtccttcccacggc

SEQ ID NO: 236369 - DNA, 20 bp, Homo sapiens
ctgtccttcccacggccact

SEQ ID NO: 236370 - DNA, 20 bp, Homo sapiens
ctgtccttctctcacctcct

SEQ ID NO: 236371 - DNA, 13 bp, Homo sapiens
ctgtcctttccca

SEQ ID NO: 236372 - DNA, 14 bp, Homo sapiens
ctgtcctttctcca

SEQ ID NO: 236373 - DNA, 19 bp, Homo sapiens
ctgtcgcctgcggactcca

SEQ ID NO: 236374 - DNA, 13 bp, Homo sapiens
ctgtcgtccccct

SEQ ID NO: 236375 - DNA, 13 bp, Homo sapiens
ctgtctaacttta

SEQ ID NO: 236376 - DNA, 20 bp, Homo sapiens
ctgtctaagaataatgacgt

SEQ ID NO: 236377 - DNA, 14 bp, Homo sapiens
ctgtctactgtggt

SEQ ID NO: 236378 - DNA, 17 bp, Homo sapiens
ctgtctagaatcctgct

SEQ ID NO: 236379 - DNA, 18 bp, Homo sapiens
ctgtctagaatcctgctt

SEQ ID NO: 236380 - DNA, 22 bp, Homo sapiens
ctgtctaggtcagtacccacct

SEQ ID NO: 236381 - DNA, 16 bp, Homo sapiens
ctgtctcagtttcact

SEQ ID NO: 236382 - DNA, 17 bp, Homo sapiens
ctgtctcagtttcactt

SEQ ID NO: 236383 - DNA, 15 bp, Homo sapiens
ctgtctcatccccag

SEQ ID NO: 236384 - DNA, 16 bp, Homo sapiens
ctgtctcatccccagg

SEQ ID NO: 236385 - DNA, 19 bp, Homo sapiens
ctgtctcatccccaggggt

SEQ ID NO: 236386 - DNA, 20 bp, Homo sapiens
ctgtctcatccccaggggtc

SEQ ID NO: 236387 - DNA, 13 bp, Homo sapiens
ctgtctcatttat

SEQ ID NO: 236388 - DNA, 15 bp, Homo sapiens
ctgtctcatttattt

SEQ ID NO: 236389 - DNA, 18 bp, Homo sapiens
ctgtctccagacccccac

SEQ ID NO: 236390 - DNA, 19 bp, Homo sapiens
ctgtctccagacccccacc

SEQ ID NO: 236391 - DNA, 13 bp, Homo sapiens
ctgtctccttccc

SEQ ID NO: 236392 - DNA, 19 bp, Homo sapiens
ctgtctccttcccactgtc

SEQ ID NO: 236393 - DNA, 23 bp, Homo sapiens
ctgtctctccctaccctcttctc

SEQ ID NO: 236394 - DNA, 11 bp, Homo sapiens
ctgtctctctc

SEQ ID NO: 236395 - DNA, 20 bp, Homo sapiens
ctgtctctctctctttttct

SEQ ID NO: 236396 - DNA, 17 bp, Homo sapiens
ctgtctgagccctgccc

SEQ ID NO: 236397 - DNA, 24 bp, Homo sapiens
ctgtctgagccctgccctcactcc

SEQ ID NO: 236398 - DNA, 11 bp, Homo sapiens
ctgtctgattc

SEQ ID NO: 236399 - DNA, 15 bp, Homo sapiens
ctgtctgattctatg

SEQ ID NO: 236400 - DNA, 17 bp, Homo sapiens
ctgtctgattctatgcc

SEQ ID NO: 236401 - DNA, 16 bp, Homo sapiens
ctgtctgcgccgctgt

SEQ ID NO: 236402 - DNA, 17 bp, Homo sapiens
ctgtctgcgccgctgtg

SEQ ID NO: 236403 - DNA, 12 bp, Homo sapiens
ctgtctggaaga

SEQ ID NO: 236404 - DNA, 16 bp, Homo sapiens
ctgtctggcccaaagg

SEQ ID NO: 236405 - DNA, 22 bp, Homo sapiens
ctgtctggctcggacccacccc

SEQ ID NO: 236406 - DNA, 23 bp, Homo sapiens
ctgtctggctcggacccacccca

SEQ ID NO: 236407 - DNA, 12 bp, Homo sapiens
ctgtctggggcc

SEQ ID NO: 236408 - DNA, 20 bp, Homo sapiens
ctgtctgtaagattttattt

SEQ ID NO: 236409 - DNA, 14 bp, Homo sapiens
ctgtctgtacctaa

SEQ ID NO: 236410 - DNA, 20 bp, Homo sapiens
ctgtctgtcctacccgcccg

SEQ ID NO: 236411 - DNA, 15 bp, Homo sapiens
ctgtctgtctgtccc

SEQ ID NO: 236412 - DNA, 16 bp, Homo sapiens
ctgtctgtctgtccca

SEQ ID NO: 236413 - DNA, 17 bp, Homo sapiens
ctgtctgtctgtcccaa

SEQ ID NO: 236414 - DNA, 16 bp, Homo sapiens
ctgtcttcaaccctgc

SEQ ID NO: 236415 - DNA, 19 bp, Homo sapiens
ctgtcttcaaccctgccct

SEQ ID NO: 236416 - DNA, 15 bp, Homo sapiens
ctgtcttccaggccc

SEQ ID NO: 236417 - DNA, 15 bp, Homo sapiens
ctgtcttcctggtca

SEQ ID NO: 236418 - DNA, 21 bp, Homo sapiens
ctgtcttcctggtcataggct

SEQ ID NO: 236419 - DNA, 14 bp, Homo sapiens
ctgtcttctctcca

SEQ ID NO: 236420 - DNA, 21 bp, Homo sapiens
ctgtcttctctccacttctgg

SEQ ID NO: 236421 - DNA, 16 bp, Homo sapiens
ctgtcttctttctcct

SEQ ID NO: 236422 - DNA, 19 bp, Homo sapiens
ctgtcttctttctcctgtg

SEQ ID NO: 236423 - DNA, 23 bp, Homo sapiens
ctgtcttctttctcctgtggttt

SEQ ID NO: 236424 - DNA, 15 bp, Homo sapiens
ctgtctttatgattt

SEQ ID NO: 236425 - DNA, 13 bp, Homo sapiens
ctgtctttattct

SEQ ID NO: 236426 - DNA, 17 bp, Homo sapiens
ctgtctttattcttatt

SEQ ID NO: 236427 - DNA, 15 bp, Homo sapiens
ctgtcttttgattct

SEQ ID NO: 236428 - DNA, 13 bp, Homo sapiens
ctgtctttttcct

SEQ ID NO: 236429 - DNA, 23 bp, Homo sapiens
ctgtctttttccttcctgagaaa

SEQ ID NO: 236430 - DNA, 17 bp, Homo sapiens
ctgtgaaagtatgtgat

SEQ ID NO: 236431 - DNA, 18 bp, Homo sapiens
ctgtgaaagtatgtgata

SEQ ID NO: 236432 - DNA, 19 bp, Homo sapiens
ctgtgaaagtatgtgatat

SEQ ID NO: 236433 - DNA, 21 bp, Homo sapiens
ctgtgaaagtctcctgtatca

SEQ ID NO: 236434 - DNA, 22 bp, Homo sapiens
ctgtgaaagtctcctgtatcat

SEQ ID NO: 236435 - DNA, 16 bp, Homo sapiens
ctgtgaaatgctggca

SEQ ID NO: 236436 - DNA, 16 bp, Homo sapiens
ctgtgaacgatttaga

SEQ ID NO: 236437 - DNA, 15 bp, Homo sapiens
ctgtgaacttgggga

SEQ ID NO: 236438 - DNA, 22 bp, Homo sapiens
ctgtgaacttggggaacaaggg

SEQ ID NO: 236439 - DNA, 17 bp, Homo sapiens
ctgtgaagccctttgcc

SEQ ID NO: 236440 - DNA, 20 bp, Homo sapiens
ctgtgaagccctttgcctgt

SEQ ID NO: 236441 - DNA, 16 bp, Homo sapiens
ctgtgaagcctttatc

SEQ ID NO: 236442 - DNA, 18 bp, Homo sapiens
ctgtgaagcctttatcta

SEQ ID NO: 236443 - DNA, 18 bp, Homo sapiens
ctgtgaagtttacattgt

SEQ ID NO: 236444 - DNA, 23 bp, Homo sapiens
ctgtgaagtttacattgtaaata

SEQ ID NO: 236445 - DNA, 17 bp, Homo sapiens
ctgtgaataaagccaca

SEQ ID NO: 236446 - DNA, 19 bp, Homo sapiens
ctgtgaataaagccacata

SEQ ID NO: 236447 - DNA, 13 bp, Homo sapiens
ctgtgaatacaat

SEQ ID NO: 236448 - DNA, 15 bp, Homo sapiens
ctgtgaatacaatta

SEQ ID NO: 236449 - DNA, 16 bp, Homo sapiens
ctgtgaatacaattaa

SEQ ID NO: 236450 - DNA, 20 bp, Homo sapiens
ctgtgaatacaattaaaggt

SEQ ID NO: 236451 - DNA, 21 bp, Homo sapiens
ctgtgaatacaattaaaggtc

SEQ ID NO: 236452 - DNA, 22 bp, Homo sapiens
ctgtgaatgtaaaacagagcca

SEQ ID NO: 236453 - DNA, 18 bp, Homo sapiens
ctgtgacaataagtttga

SEQ ID NO: 236454 - DNA, 20 bp, Homo sapiens
ctgtgacaataagtttgaac

SEQ ID NO: 236455 - DNA, 14 bp, Homo sapiens
ctgtgacaggaagc

SEQ ID NO: 236456 - DNA, 16 bp, Homo sapiens
ctgtgacattccacag

SEQ ID NO: 236457 - DNA, 19 bp, Homo sapiens
ctgttggcccctctgctgt

SEQ ID NO: 236458 - DNA, 15 bp, Homo sapiens
ctgttggctgctccc

SEQ ID NO: 236459 - DNA, 14 bp, Homo sapiens
ctgttggctgctgc

SEQ ID NO: 236460 - DNA, 16 bp, Homo sapiens
ctgttggctgctgcca

SEQ ID NO: 236461 - DNA, 14 bp, Homo sapiens
ctgttgtcattgct

SEQ ID NO: 236462 - DNA, 15 bp, Homo sapiens
ctgttgtcctcccct

SEQ ID NO: 236463 - DNA, 15 bp, Homo sapiens
ctgttgtgcagtgtg

SEQ ID NO: 236464 - DNA, 14 bp, Homo sapiens
ctgttgtgggcgct

SEQ ID NO: 236465 - DNA, 20 bp, Homo sapiens
ctgttgtgggcgctgcttcc

SEQ ID NO: 236466 - DNA, 17 bp, Homo sapiens
ctgttgtgttcgttctt

SEQ ID NO: 236467 - DNA, 15 bp, Homo sapiens
ctgttgtttacctac

SEQ ID NO: 236468 - DNA, 14 bp, Homo sapiens
ctgttgtttgaaga

SEQ ID NO: 236469 - DNA, 19 bp, Homo sapiens
ctgtttaactccctagtta

SEQ ID NO: 236470 - DNA, 17 bp, Homo sapiens
ctgtttagcttcctcca

SEQ ID NO: 236471 - DNA, 23 bp, Homo sapiens
ctgtttagcttcctccagaggag

SEQ ID NO: 236472 - DNA, 14 bp, Homo sapiens
ctgtttatggcctc

SEQ ID NO: 236473 - DNA, 15 bp, Homo sapiens
ctgtttatggcctca

SEQ ID NO: 236474 - DNA, 16 bp, Homo sapiens
ctgtttatggcctcag

SEQ ID NO: 236475 - DNA, 16 bp, Homo sapiens
ctgtttatggtatttt

SEQ ID NO: 236476 - DNA, 16 bp, Homo sapiens
ctgtttatttctgttt

SEQ ID NO: 236477 - DNA, 19 bp, Homo sapiens
ctgtttcccttcccttcca

SEQ ID NO: 236478 - DNA, 13 bp, Homo sapiens
ctgtttctctgct

SEQ ID NO: 236479 - DNA, 14 bp, Homo sapiens
ctgtttgttaaaac

SEQ ID NO: 236480 - DNA, 13 bp, Homo sapiens
ctgttttactgct

SEQ ID NO: 236481 - DNA, 15 bp, Homo sapiens
ctgttttactgcttt

SEQ ID NO: 236482 - DNA, 19 bp, Homo sapiens
ctgttttattgagttctga

SEQ ID NO: 236483 - DNA, 22 bp, Homo sapiens
ctgttttattgagttctgaagg

SEQ ID NO: 236484 - DNA, 13 bp, Homo sapiens
ctgttttccctga

SEQ ID NO: 236485 - DNA, 11 bp, Homo sapiens
ctgttttctgg

SEQ ID NO: 236486 - DNA, 20 bp, Homo sapiens
ctgttttgtcctttgagaaa

SEQ ID NO: 236487 - DNA, 12 bp, Homo sapiens
ctgttttgtgcg

SEQ ID NO: 236488 - DNA, 14 bp, Homo sapiens
ctgttttgttctgt

SEQ ID NO: 236489 - DNA, 17 bp, Homo sapiens
ctgttttttcctgagct

SEQ ID NO: 236490 - DNA, 20 bp, Homo sapiens
ctgttttttttttttgtatt

SEQ ID NO: 236491 - DNA, 21 bp, Homo sapiens
ctgttttttttttttgtattt

SEQ ID NO: 236492 - DNA, 22 bp, Homo sapiens
ctgttttttttttttgtatttc

SEQ ID NO: 236493 - DNA, 23 bp, Homo sapiens
ctgttttttttttttgtatttct

SEQ ID NO: 236494 - DNA, 13 bp, Homo sapiens
cttaaaaaatgtc

SEQ ID NO: 236495 - DNA, 22 bp, Homo sapiens
cttaaaaagtctgcattacatt

SEQ ID NO: 236496 - DNA, 14 bp, Homo sapiens
cttaaaaagttata

SEQ ID NO: 236497 - DNA, 20 bp, Homo sapiens
cttaaaaatacttaataaat

SEQ ID NO: 236498 - DNA, 12 bp, Homo sapiens
cttaaaaatatg

SEQ ID NO: 236499 - DNA, 20 bp, Homo sapiens
cttaaaaatcattgattgtc

SEQ ID NO: 236500 - DNA, 15 bp, Homo sapiens
cttaaaaatgtaaat

SEQ ID NO: 236501 - DNA, 21 bp, Homo sapiens
cttaaaactaggcatttgtaa

SEQ ID NO: 236502 - DNA, 23 bp, Homo sapiens
cttaaaactaggcatttgtaaat

SEQ ID NO: 236503 - DNA, 12 bp, Homo sapiens
cttaaaagtatt

SEQ ID NO: 236504 - DNA, 20 bp, Homo sapiens
cttaaaataaacagttgtga

SEQ ID NO: 236505 - DNA, 11 bp, Homo sapiens
cttaaaataag

SEQ ID NO: 236506 - DNA, 22 bp, Homo sapiens
cttaaaataagtgaatctaata

SEQ ID NO: 236507 - DNA, 13 bp, Homo sapiens
cttaaaatagaaa

SEQ ID NO: 236508 - DNA, 12 bp, Homo sapiens
cttaaaatgcat

SEQ ID NO: 236509 - DNA, 19 bp, Homo sapiens
cttaaaatgcattgaaaga

SEQ ID NO: 236510 - DNA, 21 bp, Homo sapiens
cttaaaattcaagaaaataaa

SEQ ID NO: 236511 - DNA, 22 bp, Homo sapiens
cttaaacaaaaactttccatga

SEQ ID NO: 236512 - DNA, 22 bp, Homo sapiens
cttaaacagggcatctccagga

SEQ ID NO: 236513 - DNA, 15 bp, Homo sapiens
cttaaactgtgtgga

SEQ ID NO: 236514 - DNA, 15 bp, Homo sapiens
cttaaactttgtcac

SEQ ID NO: 236515 - DNA, 19 bp, Homo sapiens
cttaaactttgtcacttct

SEQ ID NO: 236516 - DNA, 20 bp, Homo sapiens
cttaaactttgtcacttctg

SEQ ID NO: 236517 - DNA, 13 bp, Homo sapiens
cttaaagaaacag

SEQ ID NO: 236518 - DNA, 22 bp, Homo sapiens
cttaaagaaacagctttcaagt

SEQ ID NO: 236519 - DNA, 23 bp, Homo sapiens
cttaaagaaacagctttcaagtg

SEQ ID NO: 236520 - DNA, 22 bp, Homo sapiens
cttaaagaaagtcgaattaata

SEQ ID NO: 236521 - DNA, 23 bp, Homo sapiens
cttaaagcaataagttcattaaa

SEQ ID NO: 236522 - DNA, 18 bp, Homo sapiens
cttaaagctgcctgtagt

SEQ ID NO: 236523 - DNA, 23 bp, Homo sapiens
cttaaagctgcctgtagttagga

SEQ ID NO: 236524 - DNA, 20 bp, Homo sapiens
cttaaaggcaccatctaata

SEQ ID NO: 236525 - DNA, 13 bp, Homo sapiens
cttaaaggcctgg

SEQ ID NO: 236526 - DNA, 21 bp, Homo sapiens
cttaaaggctgtggtagtact

SEQ ID NO: 236527 - DNA, 13 bp, Homo sapiens
cttaaataaaact

SEQ ID NO: 236528 - DNA, 18 bp, Homo sapiens
cttaaataaaactattta

SEQ ID NO: 236529 - DNA, 19 bp, Homo sapiens
cttaaataaaactatttaa

SEQ ID NO: 236530 - DNA, 23 bp, Homo sapiens
cttaaatcactgaggcattttta

SEQ ID NO: 236531 - DNA, 23 bp, Homo sapiens
cttaacaatttctgtccttcaga

SEQ ID NO: 236532 - DNA, 15 bp, Homo sapiens
cttaacatatttact

SEQ ID NO: 236533 - DNA, 17 bp, Homo sapiens
cttaacatatttactaa

SEQ ID NO: 236534 - DNA, 11 bp, Homo sapiens
cttaacatgct

SEQ ID NO: 236535 - DNA, 13 bp, Homo sapiens
cttaacatgctgt

SEQ ID NO: 236536 - DNA, 17 bp, Homo sapiens
cttaacatgctgtgtaa

SEQ ID NO: 236537 - DNA, 22 bp, Homo sapiens
cttaacatgctgtgtaagctgt

SEQ ID NO: 236538 - DNA, 20 bp, Homo sapiens
cttaaccaccgcatatgcat

SEQ ID NO: 236539 - DNA, 21 bp, Homo sapiens
cttaaccaccgcatatgcatg

SEQ ID NO: 236540 - DNA, 14 bp, Homo sapiens
cttaaccttctggg

SEQ ID NO: 236541 - DNA, 16 bp, Homo sapiens
cttaacggctccagga

SEQ ID NO: 236542 - DNA, 13 bp, Homo sapiens
cttaactaatttg

SEQ ID NO: 236543 - DNA, 11 bp, Homo sapiens
cttaactgtgt

SEQ ID NO: 236544 - DNA, 18 bp, Homo sapiens
cttaactgtgtgaagaaa

SEQ ID NO: 236545 - DNA, 11 bp, Homo sapiens
cttaagaacac

SEQ ID NO: 236546 - DNA, 22 bp, Homo sapiens
cttaagacaaatgggactgatg

SEQ ID NO: 236547 - DNA, 23 bp, Homo sapiens
cttaagagagagagccttaatgg

SEQ ID NO: 236548 - DNA, 16 bp, Homo sapiens
cttaagattaaattat

SEQ ID NO: 236549 - DNA, 19 bp, Homo sapiens
cttaagcactttgaaaata

SEQ ID NO: 236550 - DNA, 14 bp, Homo sapiens
cttaagcagaagca

SEQ ID NO: 236551 - DNA, 13 bp, Homo sapiens
cttaagcatttgc

SEQ ID NO: 236552 - DNA, 18 bp, Homo sapiens
cttaagccataggcccag

SEQ ID NO: 236553 - DNA, 20 bp, Homo sapiens
cttaagcccaggagtctgag

SEQ ID NO: 236554 - DNA, 20 bp, Homo sapiens
cttaaggacaaaaatgaact

SEQ ID NO: 236555 - DNA, 15 bp, Homo sapiens
cttaaggagaggaga

SEQ ID NO: 236556 - DNA, 18 bp, Homo sapiens
cttaagggaagctactga

SEQ ID NO: 236557 - DNA, 14 bp, Homo sapiens
cttaaggggggatg

SEQ ID NO: 236558 - DNA, 17 bp, Homo sapiens
cttaagggttgaaggca

SEQ ID NO: 236559 - DNA, 14 bp, Homo sapiens
cttaagtatcagaa

SEQ ID NO: 236560 - DNA, 15 bp, Homo sapiens
cttaagtatcagaaa

SEQ ID NO: 236561 - DNA, 15 bp, Homo sapiens
cttaagtcttactgt

SEQ ID NO: 236562 - DNA, 15 bp, Homo sapiens
cttaagttttacttg

SEQ ID NO: 236563 - DNA, 19 bp, Homo sapiens
cttaatatgatctgtggag

SEQ ID NO: 236564 - DNA, 21 bp, Homo sapiens
cttaatatgatctgtggagaa

SEQ ID NO: 236565 - DNA, 14 bp, Homo sapiens
cttaatcatatcaa

SEQ ID NO: 236566 - DNA, 20 bp, Homo sapiens
cttaatcctttaactctgcg

SEQ ID NO: 236567 - DNA, 21 bp, Homo sapiens
cttaatcctttaactctgcgg

SEQ ID NO: 236568 - DNA, 18 bp, Homo sapiens
cttaatctttattttatt

SEQ ID NO: 236569 - DNA, 14 bp, Homo sapiens
cttaatgtttattc

SEQ ID NO: 236570 - DNA, 16 bp, Homo sapiens
cttaattatgctaaca

SEQ ID NO: 236571 - DNA, 17 bp, Homo sapiens
cttaattcctttctcat

SEQ ID NO: 236572 - DNA, 19 bp, Homo sapiens
cttaattcctttctcatcc

SEQ ID NO: 236573 - DNA, 12 bp, Homo sapiens
cttaattctgat

SEQ ID NO: 236574 - DNA, 16 bp, Homo sapiens
cttaattctttgtttc

SEQ ID NO: 236575 - DNA, 17 bp, Homo sapiens
cttaattctttgtttcc

SEQ ID NO: 236576 - DNA, 18 bp, Homo sapiens
cttaattctttgtttcct

SEQ ID NO: 236577 - DNA, 20 bp, Homo sapiens
cttaattctttgtttcctct

SEQ ID NO: 236578 - DNA, 13 bp, Homo sapiens
cttaattttctaa

SEQ ID NO: 236579 - DNA, 15 bp, Homo sapiens
cttaattttctaaaa

SEQ ID NO: 236580 - DNA, 18 bp, Homo sapiens
cttacaaccacatttctg

SEQ ID NO: 236581 - DNA, 18 bp, Homo sapiens
cttacaaggcaggccttt

SEQ ID NO: 236582 - DNA, 16 bp, Homo sapiens
cttacaagtaatgaat

SEQ ID NO: 236583 - DNA, 18 bp, Homo sapiens
cttacaagtaatgaattt

SEQ ID NO: 236584 - DNA, 19 bp, Homo sapiens
cttacaagtttatgtggca

SEQ ID NO: 236585 - DNA, 16 bp, Homo sapiens
cttacaattccctgct

SEQ ID NO: 236586 - DNA, 20 bp, Homo sapiens
cttacaattccctgctgtcg

SEQ ID NO: 236587 - DNA, 13 bp, Homo sapiens
cttacacacaaaa

SEQ ID NO: 236588 - DNA, 16 bp, Homo sapiens
cttacacttggagccc

SEQ ID NO: 236589 - DNA, 17 bp, Homo sapiens
cttacagacagaatata

SEQ ID NO: 236590 - DNA, 22 bp, Homo sapiens
cttacatagttttaaactcatt

SEQ ID NO: 236591 - DNA, 23 bp, Homo sapiens
cttagcgttctggactctgcccc

SEQ ID NO: 236592 - DNA, 11 bp, Homo sapiens
cttagctccct

SEQ ID NO: 236593 - DNA, 13 bp, Homo sapiens
cttagctccctcc

SEQ ID NO: 236594 - DNA, 21 bp, Homo sapiens
cttagctccctcccgcacccc

SEQ ID NO: 236595 - DNA, 14 bp, Homo sapiens
cttagctgccagtg

SEQ ID NO: 236596 - DNA, 17 bp, Homo sapiens
cttagcttacaggaagc

SEQ ID NO: 236597 - DNA, 11 bp, Homo sapiens
cttagctttac

SEQ ID NO: 236598 - DNA, 16 bp, Homo sapiens
cttagctttacatttt

SEQ ID NO: 236599 - DNA, 15 bp, Homo sapiens
cttaggagagaccga

SEQ ID NO: 236600 - DNA, 16 bp, Homo sapiens
cttaggatttaccaaa

SEQ ID NO: 236601 - DNA, 22 bp, Homo sapiens
cttaggcaccatagaagaacag

SEQ ID NO: 236602 - DNA, 24 bp, Homo sapiens
cttaggcaccatagaagaacagca

SEQ ID NO: 236603 - DNA, 12 bp, Homo sapiens
cttagggaaaga

SEQ ID NO: 236604 - DNA, 18 bp, Homo sapiens
cttaggttggagatgaca

SEQ ID NO: 236605 - DNA, 17 bp, Homo sapiens
cttagtagggacttaat

SEQ ID NO: 236606 - DNA, 14 bp, Homo sapiens
cttagtattttacc

SEQ ID NO: 236607 - DNA, 17 bp, Homo sapiens
cttagtcctccctgctc

SEQ ID NO: 236608 - DNA, 20 bp, Homo sapiens
cttagtggtatgtctcttta

SEQ ID NO: 236609 - DNA, 22 bp, Homo sapiens
cttagtgtttagcattaaaaat

SEQ ID NO: 236610 - DNA, 14 bp, Homo sapiens
cttagttctcactg

SEQ ID NO: 236611 - DNA, 16 bp, Homo sapiens
cttagtttcagaagta

SEQ ID NO: 236612 - DNA, 17 bp, Homo sapiens
cttagtttcagaagtac

SEQ ID NO: 236613 - DNA, 22 bp, Homo sapiens
cttagtttgtgaattgattttg

SEQ ID NO: 236614 - DNA, 13 bp, Homo sapiens
cttagttttgttc

SEQ ID NO: 236615 - DNA, 17 bp, Homo sapiens
cttagtttttaaaaagg

SEQ ID NO: 236616 - DNA, 14 bp, Homo sapiens
cttataaaatcaat

SEQ ID NO: 236617 - DNA, 17 bp, Homo sapiens
cttataaacacattgaa

SEQ ID NO: 236618 - DNA, 17 bp, Homo sapiens
cttataaacagataatg

SEQ ID NO: 236619 - DNA, 21 bp, Homo sapiens
cttataaatcatattgatgaa

SEQ ID NO: 236620 - DNA, 22 bp, Homo sapiens
cttataaatcatattgatgaaa

SEQ ID NO: 236621 - DNA, 19 bp, Homo sapiens
cttataagaaaacatgtaa

SEQ ID NO: 236622 - DNA, 17 bp, Homo sapiens
cttataagcaacatgaa

SEQ ID NO: 236623 - DNA, 14 bp, Homo sapiens
cttataccaaaggg

SEQ ID NO: 236624 - DNA, 15 bp, Homo sapiens
cttatatatttgaaa

SEQ ID NO: 236625 - DNA, 14 bp, Homo sapiens
cttatatgcaggct

SEQ ID NO: 236626 - DNA, 19 bp, Homo sapiens
cttatatttccctaaaata

SEQ ID NO: 236627 - DNA, 23 bp, Homo sapiens
cttatatttccctaaaatacatt

SEQ ID NO: 236628 - DNA, 20 bp, Homo sapiens
cttatatttgacattcttca

SEQ ID NO: 236629 - DNA, 12 bp, Homo sapiens
cttatcaagtgt

SEQ ID NO: 236630 - DNA, 15 bp, Homo sapiens
cttatcatggtctca

SEQ ID NO: 236631 - DNA, 20 bp, Homo sapiens
cttatctagccaaagagctc

SEQ ID NO: 236632 - DNA, 22 bp, Homo sapiens
cttatctatatccataacctct

SEQ ID NO: 236633 - DNA, 17 bp, Homo sapiens
cttatctccctgcttca

SEQ ID NO: 236634 - DNA, 22 bp, Homo sapiens
cttatctccctgcttcatatct

SEQ ID NO: 236635 - DNA, 17 bp, Homo sapiens
cttatctgtgcgtgaaa

SEQ ID NO: 236636 - DNA, 17 bp, Homo sapiens
cttatgaaatgggcttt

SEQ ID NO: 236637 - DNA, 23 bp, Homo sapiens
cttatgacgcggctcaaaaggaa

SEQ ID NO: 236638 - DNA, 20 bp, Homo sapiens
cttatgagaacatggtgtgt

SEQ ID NO: 236639 - DNA, 22 bp, Homo sapiens
cttatgccacgggaagtttaga

SEQ ID NO: 236640 - DNA, 15 bp, Homo sapiens
cttatgccatttgtt

SEQ ID NO: 236641 - DNA, 20 bp, Homo sapiens
cttatgccgtctcatatttt

SEQ ID NO: 236642 - DNA, 21 bp, Homo sapiens
cttatgctagtttattggaag

SEQ ID NO: 236643 - DNA, 14 bp, Homo sapiens
cttatggtggaaga

SEQ ID NO: 236644 - DNA, 19 bp, Homo sapiens
cttatgtcctccaccacaa

SEQ ID NO: 236645 - DNA, 23 bp, Homo sapiens
cttattacagagggaaaggctga

SEQ ID NO: 236646 - DNA, 21 bp, Homo sapiens
cttattcatgctttctccttt

SEQ ID NO: 236647 - DNA, 18 bp, Homo sapiens
cttattgagcgtgattct

SEQ ID NO: 236648 - DNA, 21 bp, Homo sapiens
cttattgcctgggcagtgccc

SEQ ID NO: 236649 - DNA, 16 bp, Homo sapiens
cttattggccactggg

SEQ ID NO: 236650 - DNA, 13 bp, Homo sapiens
cttattgtacctc

SEQ ID NO: 236651 - DNA, 12 bp, Homo sapiens
cttattgttcca

SEQ ID NO: 236652 - DNA, 15 bp, Homo sapiens
cttattgttccaaga

SEQ ID NO: 236653 - DNA, 19 bp, Homo sapiens
cttattgttccaagacatt

SEQ ID NO: 236654 - DNA, 20 bp, Homo sapiens
cttattgttccaagacattg

SEQ ID NO: 236655 - DNA, 19 bp, Homo sapiens
cttatttagtattctgcct

SEQ ID NO: 236656 - DNA, 19 bp, Homo sapiens
cttatttatatatgaagta

SEQ ID NO: 236657 - DNA, 22 bp, Homo sapiens
cttatttatattcagagatgta

SEQ ID NO: 236658 - DNA, 23 bp, Homo sapiens
cttatttatattcagagatgtac

SEQ ID NO: 236659 - DNA, 18 bp, Homo sapiens
cttatttatattcatcaa

SEQ ID NO: 236660 - DNA, 14 bp, Homo sapiens
cttatttccccttt

SEQ ID NO: 236661 - DNA, 13 bp, Homo sapiens
cttatttctaaat

SEQ ID NO: 236662 - DNA, 12 bp, Homo sapiens
cttatttgaaag

SEQ ID NO: 236663 - DNA, 11 bp, Homo sapiens
cttatttgagt

SEQ ID NO: 236664 - DNA, 12 bp, Homo sapiens
cttatttgagtg

SEQ ID NO: 236665 - DNA, 18 bp, Homo sapiens
cttatttgtatttttcct

SEQ ID NO: 236666 - DNA, 14 bp, Homo sapiens
cttattttagacaa

SEQ ID NO: 236667 - DNA, 14 bp, Homo sapiens
cttattttctctgt

SEQ ID NO: 236668 - DNA, 19 bp, Homo sapiens
cttattttctgaattcata

SEQ ID NO: 236669 - DNA, 17 bp, Homo sapiens
cttattttttctttctt

SEQ ID NO: 236670 - DNA, 11 bp, Homo sapiens
cttcaaagctg

SEQ ID NO: 236671 - DNA, 21 bp, Homo sapiens
gaaggaacccggtcccaggcc

SEQ ID NO: 236672 - DNA, 23 bp, Homo sapiens
gaaggaatagccagagaggagca

SEQ ID NO: 236673 - DNA, 22 bp, Homo sapiens
gaaggaccaacccatgccctgc

SEQ ID NO: 236674 - DNA, 19 bp, Homo sapiens
gaaggactgacgagagatg

SEQ ID NO: 236675 - DNA, 13 bp, Homo sapiens
gaaggacttcctg

SEQ ID NO: 236676 - DNA, 18 bp, Homo sapiens
gaaggagagaaggggagg

SEQ ID NO: 236677 - DNA, 12 bp, Homo sapiens
gaaggagagccc

SEQ ID NO: 236678 - DNA, 17 bp, Homo sapiens
gaaggagagcccaggcc

SEQ ID NO: 236679 - DNA, 16 bp, Homo sapiens
gaaggagaggagtgcg

SEQ ID NO: 236680 - DNA, 13 bp, Homo sapiens
gaaggagagggag

SEQ ID NO: 236681 - DNA, 22 bp, Homo sapiens
gaaggagatgtaatgacagaga

SEQ ID NO: 236682 - DNA, 23 bp, Homo sapiens
gaaggagatgtaatgacagagag

SEQ ID NO: 236683 - DNA, 13 bp, Homo sapiens
gaaggagcctgcg

SEQ ID NO: 236684 - DNA, 21 bp, Homo sapiens
gaaggaggaccctgaatttga

SEQ ID NO: 236685 - DNA, 15 bp, Homo sapiens
gaaggagggcagagc

SEQ ID NO: 236686 - DNA, 14 bp, Homo sapiens
gaaggaggggaagc

SEQ ID NO: 236687 - DNA, 18 bp, Homo sapiens
gaaggaggggaagctgca

SEQ ID NO: 236688 - DNA, 15 bp, Homo sapiens
gaaggcaaatataag

SEQ ID NO: 236689 - DNA, 23 bp, Homo sapiens
gaaggcaaatataagctgggaaa

SEQ ID NO: 236690 - DNA, 13 bp, Homo sapiens
gaaggcaaatctc

SEQ ID NO: 236691 - DNA, 23 bp, Homo sapiens
gaaggcaacacctgtggataaaa

SEQ ID NO: 236692 - DNA, 16 bp, Homo sapiens
gaaggcaacctggaag

SEQ ID NO: 236693 - DNA, 16 bp, Homo sapiens
gaaggcacactgagca

SEQ ID NO: 236694 - DNA, 15 bp, Homo sapiens
gaaggcacccgccct

SEQ ID NO: 236695 - DNA, 13 bp, Homo sapiens
gaaggcagggcag

SEQ ID NO: 236696 - DNA, 17 bp, Homo sapiens
gaaggcagtctgaaccc

SEQ ID NO: 236697 - DNA, 14 bp, Homo sapiens
gaaggccacctgca

SEQ ID NO: 236698 - DNA, 20 bp, Homo sapiens
gaaggccagccctccctggc

SEQ ID NO: 236699 - DNA, 18 bp, Homo sapiens
gaaggcccgggaggagga

SEQ ID NO: 236700 - DNA, 19 bp, Homo sapiens
gaaggcctcttgtgctcac

SEQ ID NO: 236701 - DNA, 13 bp, Homo sapiens
gaaggcctgaggg

SEQ ID NO: 236702 - DNA, 14 bp, Homo sapiens
gaaggcctgaggga

SEQ ID NO: 236703 - DNA, 23 bp, Homo sapiens
gaaggcctgagggaagcccaccc

SEQ ID NO: 236704 - DNA, 19 bp, Homo sapiens
gaaggcctgccccccttcc

SEQ ID NO: 236705 - DNA, 16 bp, Homo sapiens
gaaggccttgctgtca

SEQ ID NO: 236706 - DNA, 15 bp, Homo sapiens
gaaggctggctgagt

SEQ ID NO: 236707 - DNA, 23 bp, Homo sapiens
gaaggctttcagggcctccagcc

SEQ ID NO: 236708 - DNA, 23 bp, Homo sapiens
gaaggctttgccatgggcctgct

SEQ ID NO: 236709 - DNA, 19 bp, Homo sapiens
gaaggcttttggtctccct

SEQ ID NO: 236710 - DNA, 16 bp, Homo sapiens
gaagggaaagcgggca

SEQ ID NO: 236711 - DNA, 23 bp, Homo sapiens
gaagggaaagcgggcagccccgt

SEQ ID NO: 236712 - DNA, 15 bp, Homo sapiens
gaagggaaccagccc

SEQ ID NO: 236713 - DNA, 16 bp, Homo sapiens
gaagggaaccagccct

SEQ ID NO: 236714 - DNA, 22 bp, Homo sapiens
gaagggaaccagccctccagag

SEQ ID NO: 236715 - DNA, 24 bp, Homo sapiens
gaagggaccgggagcctgcgtggc

SEQ ID NO: 236716 - DNA, 18 bp, Homo sapiens
gaagggactggtccaggc

SEQ ID NO: 236717 - DNA, 20 bp, Homo sapiens
gaagggccagtcctgcctgg

SEQ ID NO: 236718 - DNA, 18 bp, Homo sapiens
gaagggccagtctgggct

SEQ ID NO: 236719 - DNA, 13 bp, Homo sapiens
gaagggcccagga

SEQ ID NO: 236720 - DNA, 22 bp, Homo sapiens
gaaggggaggacctctgggctt

SEQ ID NO: 236721 - DNA, 15 bp, Homo sapiens
gaaggggaggagggc

SEQ ID NO: 236722 - DNA, 17 bp, Homo sapiens
gaaggggaggagggcgg

SEQ ID NO: 236723 - DNA, 19 bp, Homo sapiens
gaaggggccccggggctgg

SEQ ID NO: 236724 - DNA, 19 bp, Homo sapiens
gaaggggcgtgtccctcct

SEQ ID NO: 236725 - DNA, 13 bp, Homo sapiens
gaagggggatatg

SEQ ID NO: 236726 - DNA, 17 bp, Homo sapiens
gaagggtgacatcccag

SEQ ID NO: 236727 - DNA, 21 bp, Homo sapiens
gaaggtaatactataaatata

SEQ ID NO: 236728 - DNA, 17 bp, Homo sapiens
gaaggtctattggccaa

SEQ ID NO: 236729 - DNA, 23 bp, Homo sapiens
gaaggtgtccaaatttaatgtag

SEQ ID NO: 236730 - DNA, 12 bp, Homo sapiens
gaaggtgtgcta

SEQ ID NO: 236731 - DNA, 22 bp, Homo sapiens
gaagtaactccccttaaaatgt

SEQ ID NO: 236732 - DNA, 22 bp, Homo sapiens
gaagtaagtttatccaaatctt

SEQ ID NO: 236733 - DNA, 15 bp, Homo sapiens
gaagtatttgagaga

SEQ ID NO: 236734 - DNA, 19 bp, Homo sapiens
gaagtcaggagccagcagg

SEQ ID NO: 236735 - DNA, 16 bp, Homo sapiens
gaagtcagtcaacatt

SEQ ID NO: 236736 - DNA, 15 bp, Homo sapiens
gaagtccagctcctt

SEQ ID NO: 236737 - DNA, 20 bp, Homo sapiens
gaagtcctccctcctgcagg

SEQ ID NO: 236738 - DNA, 21 bp, Homo sapiens
gaagtccttcagtgagcccct

SEQ ID NO: 236739 - DNA, 23 bp, Homo sapiens
gaagtccttcagtgagcccctcc

SEQ ID NO: 236740 - DNA, 18 bp, Homo sapiens
gaagtcttccatcagcag

SEQ ID NO: 236741 - DNA, 22 bp, Homo sapiens
gaagtcttccatcagcagtgat

SEQ ID NO: 236742 - DNA, 18 bp, Homo sapiens
gaagtctttgtacagaca

SEQ ID NO: 236743 - DNA, 19 bp, Homo sapiens
gaagtctttgtacagacaa

SEQ ID NO: 236744 - DNA, 20 bp, Homo sapiens
gaagtctttgtacagacaac

SEQ ID NO: 236745 - DNA, 12 bp, Homo sapiens
gaagtgaaatta

SEQ ID NO: 236746 - DNA, 21 bp, Homo sapiens
gaagtgacaaggccccagaga

SEQ ID NO: 236747 - DNA, 13 bp, Homo sapiens
gaagtgacttgaa

SEQ ID NO: 236748 - DNA, 22 bp, Homo sapiens
gaagtgacttgaatgtacaaag

SEQ ID NO: 236749 - DNA, 20 bp, Homo sapiens
gaagtgataacactggagtg

SEQ ID NO: 236750 - DNA, 16 bp, Homo sapiens
gaagtgcatttctgaa

SEQ ID NO: 236751 - DNA, 13 bp, Homo sapiens
gaagtgcccctgc

SEQ ID NO: 236752 - DNA, 14 bp, Homo sapiens
gaagtgcccctgct

SEQ ID NO: 236753 - DNA, 17 bp, Homo sapiens
gaagtggaaaaagaaat

SEQ ID NO: 236754 - DNA, 19 bp, Homo sapiens
gaagtggaaaaagaaattc

SEQ ID NO: 236755 - DNA, 16 bp, Homo sapiens
gaagtgggagaagtgg

SEQ ID NO: 236756 - DNA, 19 bp, Homo sapiens
gaagtgggagaagtggccc

SEQ ID NO: 236757 - DNA, 16 bp, Homo sapiens
gaagtgggagtgggag

SEQ ID NO: 236758 - DNA, 20 bp, Homo sapiens
gaagtgggattcaggaatgg

SEQ ID NO: 236759 - DNA, 23 bp, Homo sapiens
gaagtgtaacagctgaggtctct

SEQ ID NO: 236760 - DNA, 13 bp, Homo sapiens
gaagtgtggctgg

SEQ ID NO: 236761 - DNA, 15 bp, Homo sapiens
gaagtgtggctggtg

SEQ ID NO: 236762 - DNA, 20 bp, Homo sapiens
gaagtgtggctggtgtcccc

SEQ ID NO: 236763 - DNA, 15 bp, Homo sapiens
gaagtgtggggcggg

SEQ ID NO: 236764 - DNA, 19 bp, Homo sapiens
gaagtgtggggcgggggtc

SEQ ID NO: 236765 - DNA, 13 bp, Homo sapiens
gaagtgtgttttg

SEQ ID NO: 236766 - DNA, 10 bp, Homo sapiens
gaagtgttca

SEQ ID NO: 236767 - DNA, 21 bp, Homo sapiens
gaagttaagcagcctttctgt

SEQ ID NO: 236768 - DNA, 12 bp, Homo sapiens
gaagttgttagt

SEQ ID NO: 236769 - DNA, 16 bp, Homo sapiens
gaagtttacattgtaa

SEQ ID NO: 236770 - DNA, 14 bp, Homo sapiens
gaagtttcacatga

SEQ ID NO: 236771 - DNA, 14 bp, Homo sapiens
gaagtttcatttat

SEQ ID NO: 236772 - DNA, 23 bp, Homo sapiens
gaagtttcctatgactaattcac

SEQ ID NO: 236773 - DNA, 21 bp, Homo sapiens
gaagtttgtgttctgtttgtt

SEQ ID NO: 236774 - DNA, 12 bp, Homo sapiens
gaagttttgcat

SEQ ID NO: 236775 - DNA, 18 bp, Homo sapiens
gaataaaaaacatttgta

SEQ ID NO: 236776 - DNA, 14 bp, Homo sapiens
gaataaaaaagaaa

SEQ ID NO: 236777 - DNA, 15 bp, Homo sapiens
gaataaaaaccctgt

SEQ ID NO: 236778 - DNA, 12 bp, Homo sapiens
gaataaacactt

SEQ ID NO: 236779 - DNA, 13 bp, Homo sapiens
gaataaaggctga

SEQ ID NO: 236780 - DNA, 14 bp, Homo sapiens
gaataaagttgaag

SEQ ID NO: 236781 - DNA, 16 bp, Homo sapiens
gaataaagttgaagct

SEQ ID NO: 236782 - DNA, 13 bp, Homo sapiens
gaataacactgca

SEQ ID NO: 236783 - DNA, 22 bp, Homo sapiens
gaataaccacttaaaaaatgtc

SEQ ID NO: 236784 - DNA, 17 bp, Homo sapiens
gaataatgtgggaagaa

SEQ ID NO: 236785 - DNA, 20 bp, Homo sapiens
gaataatgtgggaagaaaca

SEQ ID NO: 236786 - DNA, 20 bp, Homo sapiens
gaataatgttttttgaagtt

SEQ ID NO: 236787 - DNA, 14 bp, Homo sapiens
gaataatttcccaa

SEQ ID NO: 236788 - DNA, 14 bp, Homo sapiens
gaataatttcttac

SEQ ID NO: 236789 - DNA, 19 bp, Homo sapiens
gaatacaattcagttttag

SEQ ID NO: 236790 - DNA, 21 bp, Homo sapiens
gaatacagtaagctgctctat

SEQ ID NO: 236791 - DNA, 19 bp, Homo sapiens
gaatacatggtagcagggt

SEQ ID NO: 236792 - DNA, 20 bp, Homo sapiens
gaataccattaaaactgctt

SEQ ID NO: 236793 - DNA, 13 bp, Homo sapiens
gaatactgtattg

SEQ ID NO: 236794 - DNA, 24 bp, Homo sapiens
gaatactgtattgttacagctgaa

SEQ ID NO: 236795 - DNA, 18 bp, Homo sapiens
gaatactgttaaaggaaa

SEQ ID NO: 236796 - DNA, 23 bp, Homo sapiens
gaatacttcctgaaataaaactg

SEQ ID NO: 236797 - DNA, 17 bp, Homo sapiens
gaatagatcagtatttc

SEQ ID NO: 236798 - DNA, 15 bp, Homo sapiens
gaatagatgtgatca

SEQ ID NO: 236799 - DNA, 15 bp, Homo sapiens
gaatagcatgtcact

SEQ ID NO: 236800 - DNA, 13 bp, Homo sapiens
gaatagtctctgg

SEQ ID NO: 236801 - DNA, 12 bp, Homo sapiens
gaatagtgggat

SEQ ID NO: 236802 - DNA, 23 bp, Homo sapiens
gaatataagcttaaaataagtga

SEQ ID NO: 236803 - DNA, 19 bp, Homo sapiens
gaatataatggcctcttaa

SEQ ID NO: 236804 - DNA, 18 bp, Homo sapiens
gaatataccacaccgagg

SEQ ID NO: 236805 - DNA, 18 bp, Homo sapiens
gaatatccagtcaaagac

SEQ ID NO: 236806 - DNA, 18 bp, Homo sapiens
gaatatggaacatatgca

SEQ ID NO: 236807 - DNA, 22 bp, Homo sapiens
gaatatggaacatatgcacagg

SEQ ID NO: 236808 - DNA, 15 bp, Homo sapiens
gaatattaagaaaca

SEQ ID NO: 236809 - DNA, 15 bp, Homo sapiens
gaatattataaaaat

SEQ ID NO: 236810 - DNA, 15 bp, Homo sapiens
gaatattcaggactt

SEQ ID NO: 236811 - DNA, 14 bp, Homo sapiens
gaatattgttaaaa

SEQ ID NO: 236812 - DNA, 16 bp, Homo sapiens
gaatatttataacagc

SEQ ID NO: 236813 - DNA, 18 bp, Homo sapiens
gaatatttataacagcat

SEQ ID NO: 236814 - DNA, 19 bp, Homo sapiens
gaatatttatatttcacta

SEQ ID NO: 236815 - DNA, 20 bp, Homo sapiens
gaatatttatatttcactat

SEQ ID NO: 236816 - DNA, 21 bp, Homo sapiens
gaatatttattacctctgata

SEQ ID NO: 236817 - DNA, 20 bp, Homo sapiens
gaatattttttatttctaag

SEQ ID NO: 236818 - DNA, 21 bp, Homo sapiens
gaatattttttatttctaagt

SEQ ID NO: 236819 - DNA, 16 bp, Homo sapiens
gaatcaagtctgtgaa

SEQ ID NO: 236820 - DNA, 19 bp, Homo sapiens
gaatcacctaattaatttc

SEQ ID NO: 236821 - DNA, 23 bp, Homo sapiens
gaatcacctaattaatttcagta

SEQ ID NO: 236822 - DNA, 22 bp, Homo sapiens
gaatcatgttggatagtcagct

SEQ ID NO: 236823 - DNA, 16 bp, Homo sapiens
gaatcattatttatta

SEQ ID NO: 236824 - DNA, 16 bp, Homo sapiens
gaatccagaaggaagc

SEQ ID NO: 236825 - DNA, 21 bp, Homo sapiens
gaatcccacttatcaaatcat

SEQ ID NO: 236826 - DNA, 17 bp, Homo sapiens
gaatcccctccctgtca

SEQ ID NO: 236827 - DNA, 22 bp, Homo sapiens
gaatcccctcgcttcataggca

SEQ ID NO: 236828 - DNA, 17 bp, Homo sapiens
gaatccctgttcattgt

SEQ ID NO: 236829 - DNA, 12 bp, Homo sapiens
gaatcctgcctc

SEQ ID NO: 236830 - DNA, 13 bp, Homo sapiens
gaatcctgcctct

SEQ ID NO: 236831 - DNA, 14 bp, Homo sapiens
gaatcctgcctctc

SEQ ID NO: 236832 - DNA, 12 bp, Homo sapiens
gaatcctgcttt

SEQ ID NO: 236833 - DNA, 18 bp, Homo sapiens
gaatcctgctttacagga

SEQ ID NO: 236834 - DNA, 22 bp, Homo sapiens
gaatcctgtcctcagcttctta

SEQ ID NO: 236835 - DNA, 14 bp, Homo sapiens
gaatcgaggaacca

SEQ ID NO: 236836 - DNA, 22 bp, Homo sapiens
gaatcgatgggggatgcttcat

SEQ ID NO: 236837 - DNA, 15 bp, Homo sapiens
gaatcggtgctgtca

SEQ ID NO: 236838 - DNA, 16 bp, Homo sapiens
gaatctacagaacaaa

SEQ ID NO: 236839 - DNA, 16 bp, Homo sapiens
gaatctcaagattcta

SEQ ID NO: 236840 - DNA, 17 bp, Homo sapiens
gaatctgcagggagcaa

SEQ ID NO: 236841 - DNA, 21 bp, Homo sapiens
gaatctgcctgtggccttgcc

SEQ ID NO: 236842 - DNA, 17 bp, Homo sapiens
gaatctgccttccagcc

SEQ ID NO: 236843 - DNA, 18 bp, Homo sapiens
gaatctgccttccagccc

SEQ ID NO: 236844 - DNA, 21 bp, Homo sapiens
gaatctggcattctacacctg

SEQ ID NO: 236845 - DNA, 23 bp, Homo sapiens
gaatctggcattctacacctgga

SEQ ID NO: 236846 - DNA, 23 bp, Homo sapiens
gaatctgtctcccagttatgaat

SEQ ID NO: 236847 - DNA, 19 bp, Homo sapiens
gaatgaaaaatttaagcat

SEQ ID NO: 236848 - DNA, 20 bp, Homo sapiens
gaatgaaaaatttaagcatt

SEQ ID NO: 236849 - DNA, 20 bp, Homo sapiens
gaatgaaagtcttgtgacta

SEQ ID NO: 236850 - DNA, 18 bp, Homo sapiens
gaatgaaatataaactgt

SEQ ID NO: 236851 - DNA, 21 bp, Homo sapiens
gaatgaaatataaactgtgag

SEQ ID NO: 236852 - DNA, 21 bp, Homo sapiens
gaatgaagataccatcagcaa

SEQ ID NO: 236853 - DNA, 14 bp, Homo sapiens
gaatgaagcatgta

SEQ ID NO: 236854 - DNA, 11 bp, Homo sapiens
gaatgaatgtc

SEQ ID NO: 236855 - DNA, 22 bp, Homo sapiens
gaatgaatgtcagtgtgactga

SEQ ID NO: 236856 - DNA, 17 bp, Homo sapiens
gaatgactataaacatt

SEQ ID NO: 236857 - DNA, 16 bp, Homo sapiens
gaatgactgaaagaag

SEQ ID NO: 236858 - DNA, 21 bp, Homo sapiens
gaatgactgaaagaagaacag

SEQ ID NO: 236859 - DNA, 13 bp, Homo sapiens
gaatgagaaagaa

SEQ ID NO: 236860 - DNA, 14 bp, Homo sapiens
gaatgagaaagaaa

SEQ ID NO: 236861 - DNA, 14 bp, Homo sapiens
gaatgagctctcta

SEQ ID NO: 236862 - DNA, 14 bp, Homo sapiens
gaatgagctgggcc

SEQ ID NO: 236863 - DNA, 15 bp, Homo sapiens
gaatgagctgggccc

SEQ ID NO: 236864 - DNA, 13 bp, Homo sapiens
gaatgaggaggaa

SEQ ID NO: 236865 - DNA, 18 bp, Homo sapiens
gaatgagtaaataaactc

SEQ ID NO: 236866 - DNA, 22 bp, Homo sapiens
gaatgagtaaataaactcttca

SEQ ID NO: 236867 - DNA, 14 bp, Homo sapiens
gaatgattaattaa

SEQ ID NO: 236868 - DNA, 10 bp, Homo sapiens
gaatgcaaga

SEQ ID NO: 236869 - DNA, 18 bp, Homo sapiens
gaatgcaagagaaggaga

SEQ ID NO: 236870 - DNA, 16 bp, Homo sapiens
gaatgcagattcctgg

SEQ ID NO: 236871 - DNA, 21 bp, Homo sapiens
gaatgcagattcctgggcctg

SEQ ID NO: 236872 - DNA, 17 bp, Homo sapiens
gaatgcagggaagaggg

SEQ ID NO: 236873 - DNA, 18 bp, Homo sapiens
gaatgcagtataaaatgt

SEQ ID NO: 236874 - DNA, 14 bp, Homo sapiens
gaatgcattcaggg

SEQ ID NO: 236875 - DNA, 14 bp, Homo sapiens
gaatgcctgtgcca

SEQ ID NO: 236876 - DNA, 23 bp, Homo sapiens
gaatgcgctcttcaccaggaaga

SEQ ID NO: 236877 - DNA, 20 bp, Homo sapiens
gaatgcgctttattgcccat

SEQ ID NO: 236878 - DNA, 16 bp, Homo sapiens
gaatgctcaatgtgct

SEQ ID NO: 236879 - DNA, 19 bp, Homo sapiens
gaatgctcccccatcctcc

SEQ ID NO: 236880 - DNA, 16 bp, Homo sapiens
gaatgctctgtgccag

SEQ ID NO: 236881 - DNA, 13 bp, Homo sapiens
gaatgctgtgtta

SEQ ID NO: 236882 - DNA, 14 bp, Homo sapiens
gaatgcttggaata

SEQ ID NO: 236883 - DNA, 19 bp, Homo sapiens
gaatgcttggaatatctgc

SEQ ID NO: 236884 - DNA, 18 bp, Homo sapiens
gaatgctttttgaatgtt

SEQ ID NO: 236885 - DNA, 14 bp, Homo sapiens
gaatggatggggag

SEQ ID NO: 236886 - DNA, 20 bp, Homo sapiens
gaatggatggggagaatggt

SEQ ID NO: 236887 - DNA, 14 bp, Homo sapiens
gaatggattaaatg

SEQ ID NO: 236888 - DNA, 16 bp, Homo sapiens
gaatggattaaatggc

SEQ ID NO: 236889 - DNA, 18 bp, Homo sapiens
gaatggattaaatggcac

SEQ ID NO: 236890 - DNA, 23 bp, Homo sapiens
gaatgggccaagccagggttcca

SEQ ID NO: 236891 - DNA, 13 bp, Homo sapiens
gaatggggacctg

SEQ ID NO: 236892 - DNA, 17 bp, Homo sapiens
gaatggtgggctccaga

SEQ ID NO: 236893 - DNA, 18 bp, Homo sapiens
gaatggtgggctccagag

SEQ ID NO: 236894 - DNA, 16 bp, Homo sapiens
ctgtggggcaagcctg

SEQ ID NO: 236895 - DNA, 18 bp, Homo sapiens
ctgtggggcaagcctgag

SEQ ID NO: 236896 - DNA, 13 bp, Homo sapiens
ctgtggggccaca

SEQ ID NO: 236897 - DNA, 13 bp, Homo sapiens
ctgtggggcctga

SEQ ID NO: 236898 - DNA, 14 bp, Homo sapiens
ctgtgggtattgtt

SEQ ID NO: 236899 - DNA, 16 bp, Homo sapiens
ctgtgggtggggaagg

SEQ ID NO: 236900 - DNA, 20 bp, Homo sapiens
ctgtggtatctttaattgta

SEQ ID NO: 236901 - DNA, 17 bp, Homo sapiens
ctgtggtgacaggccca

SEQ ID NO: 236902 - DNA, 22 bp, Homo sapiens
ctgtggttacagtgcagacagg

SEQ ID NO: 236903 - DNA, 19 bp, Homo sapiens
ctgtggttcctaagcctgt

SEQ ID NO: 236904 - DNA, 14 bp, Homo sapiens
ctgtggtttgttat

SEQ ID NO: 236905 - DNA, 17 bp, Homo sapiens
ctgtggtttgttatcag

SEQ ID NO: 236906 - DNA, 20 bp, Homo sapiens
ctgtggttttcccctccctg

SEQ ID NO: 236907 - DNA, 22 bp, Homo sapiens
ctgtggttttcccctccctggg

SEQ ID NO: 236908 - DNA, 14 bp, Homo sapiens
ctgtgtaaccagca

SEQ ID NO: 236909 - DNA, 21 bp, Homo sapiens
ctgtgtaaccagcagtcacag

SEQ ID NO: 236910 - DNA, 13 bp, Homo sapiens
ctgtgtaactgcc

SEQ ID NO: 236911 - DNA, 16 bp, Homo sapiens
ctgtgtaactgcccaa

SEQ ID NO: 236912 - DNA, 14 bp, Homo sapiens
ctgtgtaagctgtg

SEQ ID NO: 236913 - DNA, 19 bp, Homo sapiens
ctgtgtaatcatttcttgg

SEQ ID NO: 236914 - DNA, 19 bp, Homo sapiens
ctgtgtagagcctgcatct

SEQ ID NO: 236915 - DNA, 13 bp, Homo sapiens
ctgtgtatgtaca

SEQ ID NO: 236916 - DNA, 15 bp, Homo sapiens
ctgtgtatgtacata

SEQ ID NO: 236917 - DNA, 18 bp, Homo sapiens
ctgtgtatgtacatatat

SEQ ID NO: 236918 - DNA, 13 bp, Homo sapiens
ctgtgtatttctg

SEQ ID NO: 236919 - DNA, 16 bp, Homo sapiens
ctgtgtatttctgtag

SEQ ID NO: 236920 - DNA, 17 bp, Homo sapiens
ctgtgtatttctgtaga

SEQ ID NO: 236921 - DNA, 16 bp, Homo sapiens
ctgtgtccagcagctg

SEQ ID NO: 236922 - DNA, 14 bp, Homo sapiens
ctgtgtcccagcac

SEQ ID NO: 236923 - DNA, 21 bp, Homo sapiens
ctgtgtccccgcgggcagtga

SEQ ID NO: 236924 - DNA, 22 bp, Homo sapiens
ctgtgtccccgcgggcagtgac

SEQ ID NO: 236925 - DNA, 15 bp, Homo sapiens
ctgtgtcccctgacc

SEQ ID NO: 236926 - DNA, 22 bp, Homo sapiens
ctgtgtcccctgacctgtccag

SEQ ID NO: 236927 - DNA, 16 bp, Homo sapiens
ctgtgtccctctctct

SEQ ID NO: 236928 - DNA, 20 bp, Homo sapiens
ctgtgtccctctctctggaa

SEQ ID NO: 236929 - DNA, 20 bp, Homo sapiens
ctgtgtcctggttagcagag

SEQ ID NO: 236930 - DNA, 23 bp, Homo sapiens
ctgtgtcggggggcgagggaggg

SEQ ID NO: 236931 - DNA, 14 bp, Homo sapiens
ctgtgtctcccttc

SEQ ID NO: 236932 - DNA, 15 bp, Homo sapiens
ctgtgtctctgtata

SEQ ID NO: 236933 - DNA, 23 bp, Homo sapiens
ctgtgtctctgtatatagctcta

SEQ ID NO: 236934 - DNA, 13 bp, Homo sapiens
ctgtgtctgctgt

SEQ ID NO: 236935 - DNA, 13 bp, Homo sapiens
ctgtgtctgtcac

SEQ ID NO: 236936 - DNA, 14 bp, Homo sapiens
ctgtgtctgtcacc

SEQ ID NO: 236937 - DNA, 17 bp, Homo sapiens
ctgtgtctgtcaccaca

SEQ ID NO: 236938 - DNA, 13 bp, Homo sapiens
ctgtgtctgtccc

SEQ ID NO: 236939 - DNA, 13 bp, Homo sapiens
ctgtgtctgtgtt

SEQ ID NO: 236940 - DNA, 22 bp, Homo sapiens
ctgtgtctttagggagacccaa

SEQ ID NO: 236941 - DNA, 13 bp, Homo sapiens
ctgtgtgaaaatg

SEQ ID NO: 236942 - DNA, 13 bp, Homo sapiens
ctgtgtgaagaaa

SEQ ID NO: 236943 - DNA, 16 bp, Homo sapiens
ctgtgtgaccttgggc

SEQ ID NO: 236944 - DNA, 19 bp, Homo sapiens
ctgtgtgagcgtgtccaca

SEQ ID NO: 236945 - DNA, 17 bp, Homo sapiens
ctgtgtgcagtgaaggt

SEQ ID NO: 236946 - DNA, 13 bp, Homo sapiens
ctgtgtgctgtaa

SEQ ID NO: 236947 - DNA, 17 bp, Homo sapiens
ctgtgtggaccatgggg

SEQ ID NO: 236948 - DNA, 16 bp, Homo sapiens
ctgtgtggactgtgat

SEQ ID NO: 236949 - DNA, 16 bp, Homo sapiens
ctgtgtggagagggaa

SEQ ID NO: 236950 - DNA, 19 bp, Homo sapiens
ctgtgtgggatacttagtg

SEQ ID NO: 236951 - DNA, 20 bp, Homo sapiens
ctgtgtgggatacttagtgg

SEQ ID NO: 236952 - DNA, 13 bp, Homo sapiens
ctgtgtggggagg

SEQ ID NO: 236953 - DNA, 13 bp, Homo sapiens
ctgtgtgtagcca

SEQ ID NO: 236954 - DNA, 20 bp, Homo sapiens
ctgtgtgtggggcccaagca

SEQ ID NO: 236955 - DNA, 19 bp, Homo sapiens
ctgtgtgttcttttgatac

SEQ ID NO: 236956 - DNA, 21 bp, Homo sapiens
ctgtgtgttcttttgatacat

SEQ ID NO: 236957 - DNA, 19 bp, Homo sapiens
ctgtgtgttgccaggcagg

SEQ ID NO: 236958 - DNA, 14 bp, Homo sapiens
ctgtgttagtgtct

SEQ ID NO: 236959 - DNA, 19 bp, Homo sapiens
ctgtgttagtgtctgtcca

SEQ ID NO: 236960 - DNA, 14 bp, Homo sapiens
ctgtgttcttgctg

SEQ ID NO: 236961 - DNA, 14 bp, Homo sapiens
ctgtgtttgttcct

SEQ ID NO: 236962 - DNA, 13 bp, Homo sapiens
ctgtgttttaata

SEQ ID NO: 236963 - DNA, 19 bp, Homo sapiens
ctgtgttttgtctgagcct

SEQ ID NO: 236964 - DNA, 20 bp, Homo sapiens
ctgtgttttgtctgagcctc

SEQ ID NO: 236965 - DNA, 15 bp, Homo sapiens
ctgttaaaatcagga

SEQ ID NO: 236966 - DNA, 17 bp, Homo sapiens
ctgttaaatatttttgt

SEQ ID NO: 236967 - DNA, 19 bp, Homo sapiens
ctgttaaatatttttgtac

SEQ ID NO: 236968 - DNA, 20 bp, Homo sapiens
ctgttaacactgtaatatct

SEQ ID NO: 236969 - DNA, 16 bp, Homo sapiens
ctgttaaccctccacc

SEQ ID NO: 236970 - DNA, 21 bp, Homo sapiens
ctgttaactagtgtttctgca

SEQ ID NO: 236971 - DNA, 19 bp, Homo sapiens
ctgttaaggtggaaaatgg

SEQ ID NO: 236972 - DNA, 14 bp, Homo sapiens
ctgttaagtctgag

SEQ ID NO: 236973 - DNA, 17 bp, Homo sapiens
ctgttaagtctgagaag

SEQ ID NO: 236974 - DNA, 23 bp, Homo sapiens
ctgttaataaagaaatccagatc

SEQ ID NO: 236975 - DNA, 16 bp, Homo sapiens
ctgttacacaatatgt

SEQ ID NO: 236976 - DNA, 18 bp, Homo sapiens
ctgttactgttaaccatt

SEQ ID NO: 236977 - DNA, 15 bp, Homo sapiens
ctgttacttaaatag

SEQ ID NO: 236978 - DNA, 15 bp, Homo sapiens
ctgttagatgctgaa

SEQ ID NO: 236979 - DNA, 17 bp, Homo sapiens
ctgttagtattaactat

SEQ ID NO: 236980 - DNA, 15 bp, Homo sapiens
ctgttagtcatttgc

SEQ ID NO: 236981 - DNA, 18 bp, Homo sapiens
ctgttagtcatttgctga

SEQ ID NO: 236982 - DNA, 13 bp, Homo sapiens
ctgttagtgacag

SEQ ID NO: 236983 - DNA, 21 bp, Homo sapiens
ctgttagtgacagagcccagc

SEQ ID NO: 236984 - DNA, 19 bp, Homo sapiens
ctgttatcaaaactttctt

SEQ ID NO: 236985 - DNA, 20 bp, Homo sapiens
ctgttatctgtctttatgat

SEQ ID NO: 236986 - DNA, 22 bp, Homo sapiens
ctgttatctgtctttatgattt

SEQ ID NO: 236987 - DNA, 13 bp, Homo sapiens
ctgttcaaagtac

SEQ ID NO: 236988 - DNA, 17 bp, Homo sapiens
ctgttcagatgtgcatt

SEQ ID NO: 236989 - DNA, 18 bp, Homo sapiens
ctgttcagatgtgcattt

SEQ ID NO: 236990 - DNA, 16 bp, Homo sapiens
ctgttcatgacagcta

SEQ ID NO: 236991 - DNA, 12 bp, Homo sapiens
ctgttcattgta

SEQ ID NO: 236992 - DNA, 14 bp, Homo sapiens
ctgttcatttccac

SEQ ID NO: 236993 - DNA, 23 bp, Homo sapiens
ctgttcatttccaccaagggtat

SEQ ID NO: 236994 - DNA, 10 bp, Homo sapiens
ctgttccaag

SEQ ID NO: 236995 - DNA, 19 bp, Homo sapiens
ctgttccaagtgtgtgtgc

SEQ ID NO: 236996 - DNA, 21 bp, Homo sapiens
ctgttccaagtgtgtgtgcaa

SEQ ID NO: 236997 - DNA, 13 bp, Homo sapiens
ctgttccagactc

SEQ ID NO: 236998 - DNA, 14 bp, Homo sapiens
ctgttccagactca

SEQ ID NO: 236999 - DNA, 22 bp, Homo sapiens
ctgttccagactcaggttccag

SEQ ID NO: 237000 - DNA, 14 bp, Homo sapiens
ctgttcccccaccc

SEQ ID NO: 237001 - DNA, 17 bp, Homo sapiens
ctgttcccctcactgga

SEQ ID NO: 237002 - DNA, 15 bp, Homo sapiens
ctgttccctccaagg

SEQ ID NO: 237003 - DNA, 17 bp, Homo sapiens
ctgttccctctgctcct

SEQ ID NO: 237004 - DNA, 17 bp, Homo sapiens
ctgttcctgccttctct

SEQ ID NO: 237005 - DNA, 12 bp, Homo sapiens
ctgttcctgtgt

SEQ ID NO: 237006 - DNA, 16 bp, Homo sapiens
ctgttcctgtgttctt

SEQ ID NO: 237007 - DNA, 20 bp, Homo sapiens
ctgttccttatgatattctc

SEQ ID NO: 237008 - DNA, 16 bp, Homo sapiens
ctgttccttcgagggt

SEQ ID NO: 237009 - DNA, 14 bp, Homo sapiens
ctgttctacttgat

SEQ ID NO: 237010 - DNA, 17 bp, Homo sapiens
ctgttctacttgatatt

SEQ ID NO: 237011 - DNA, 14 bp, Homo sapiens
ctgttctcagagct

SEQ ID NO: 237012 - DNA, 15 bp, Homo sapiens
ctgttctcagagctc

SEQ ID NO: 237013 - DNA, 20 bp, Homo sapiens
ctgttctcagagctccacag

SEQ ID NO: 237014 - DNA, 20 bp, Homo sapiens
ctgttctgatattaatttat

SEQ ID NO: 237015 - DNA, 14 bp, Homo sapiens
ctgttctgctccca

SEQ ID NO: 237016 - DNA, 16 bp, Homo sapiens
ctgttctggcctcaga

SEQ ID NO: 237017 - DNA, 13 bp, Homo sapiens
ctgttctgtagga

SEQ ID NO: 237018 - DNA, 19 bp, Homo sapiens
ctgttctgtaggagagact

SEQ ID NO: 237019 - DNA, 13 bp, Homo sapiens
ctgttctgtgtct

SEQ ID NO: 237020 - DNA, 17 bp, Homo sapiens
ctgttctgttttgcctg

SEQ ID NO: 237021 - DNA, 12 bp, Homo sapiens
ctgttcttcccc

SEQ ID NO: 237022 - DNA, 11 bp, Homo sapiens
ctgttgaggca

SEQ ID NO: 237023 - DNA, 16 bp, Homo sapiens
ctgttgagtatttgct

SEQ ID NO: 237024 - DNA, 18 bp, Homo sapiens
ctgttgcaaattccaccc

SEQ ID NO: 237025 - DNA, 15 bp, Homo sapiens
ctgttgccatagccc

SEQ ID NO: 237026 - DNA, 18 bp, Homo sapiens
ctgttgccctttctgtac

SEQ ID NO: 237027 - DNA, 13 bp, Homo sapiens
ctgttgcctcctc

SEQ ID NO: 237028 - DNA, 15 bp, Homo sapiens
ctgttgcctcctctc

SEQ ID NO: 237029 - DNA, 15 bp, Homo sapiens
ctgttgctgaagtca

SEQ ID NO: 237030 - DNA, 19 bp, Homo sapiens
cttcaaagctgaatatttt

SEQ ID NO: 237031 - DNA, 18 bp, Homo sapiens
cttcaaagcttgaagatc

SEQ ID NO: 237032 - DNA, 16 bp, Homo sapiens
cttcaaatcagagcag

SEQ ID NO: 237033 - DNA, 16 bp, Homo sapiens
cttcaaatccttccaa

SEQ ID NO: 237034 - DNA, 17 bp, Homo sapiens
cttcaaccctgccctgc

SEQ ID NO: 237035 - DNA, 16 bp, Homo sapiens
cttcaagggctgcttc

SEQ ID NO: 237036 - DNA, 17 bp, Homo sapiens
cttcaagggctgcttca

SEQ ID NO: 237037 - DNA, 22 bp, Homo sapiens
cttcaagtctgtgcctggagct

SEQ ID NO: 237038 - DNA, 23 bp, Homo sapiens
cttcaagtctgtgcctggagctc

SEQ ID NO: 237039 - DNA, 20 bp, Homo sapiens
cttcaataaatctttggaaa

SEQ ID NO: 237040 - DNA, 17 bp, Homo sapiens
cttcaatacttaaaaat

SEQ ID NO: 237041 - DNA, 13 bp, Homo sapiens
cttcaatctctgg

SEQ ID NO: 237042 - DNA, 16 bp, Homo sapiens
cttcaatgctagaaaa

SEQ ID NO: 237043 - DNA, 16 bp, Homo sapiens
cttcaatgggagtgaa

SEQ ID NO: 237044 - DNA, 19 bp, Homo sapiens
cttcaatttgtataaaatg

SEQ ID NO: 237045 - DNA, 13 bp, Homo sapiens
cttcacacccctc

SEQ ID NO: 237046 - DNA, 14 bp, Homo sapiens
cttcacacccctca

SEQ ID NO: 237047 - DNA, 19 bp, Homo sapiens
cttcacacctaccctcctt

SEQ ID NO: 237048 - DNA, 16 bp, Homo sapiens
cttcacagctctgtgt

SEQ ID NO: 237049 - DNA, 20 bp, Homo sapiens
cttcacaggcagtgcatgtg

SEQ ID NO: 237050 - DNA, 14 bp, Homo sapiens
cttcacagggacag

SEQ ID NO: 237051 - DNA, 17 bp, Homo sapiens
cttcacataccctcccc

SEQ ID NO: 237052 - DNA, 13 bp, Homo sapiens
cttcacatccacc

SEQ ID NO: 237053 - DNA, 13 bp, Homo sapiens
cttcaccaagctt

SEQ ID NO: 237054 - DNA, 21 bp, Homo sapiens
cttcaccaagcttagaagcca

SEQ ID NO: 237055 - DNA, 14 bp, Homo sapiens
cttcaccaggaaga

SEQ ID NO: 237056 - DNA, 15 bp, Homo sapiens
cttcaccaggaagaa

SEQ ID NO: 237057 - DNA, 22 bp, Homo sapiens
cttcaccaggaagaaggcccgg

SEQ ID NO: 237058 - DNA, 24 bp, Homo sapiens
cttcacccagctaatctgtagggc

SEQ ID NO: 237059 - DNA, 14 bp, Homo sapiens
cttcaccccggcag

SEQ ID NO: 237060 - DNA, 15 bp, Homo sapiens
cttcaccccggcagg

SEQ ID NO: 237061 - DNA, 21 bp, Homo sapiens
cttcaccccggcaggccctgc

SEQ ID NO: 237062 - DNA, 15 bp, Homo sapiens
cttcacccctgcact

SEQ ID NO: 237063 - DNA, 13 bp, Homo sapiens
cttcaccctgtca

SEQ ID NO: 237064 - DNA, 14 bp, Homo sapiens
cttcaccctgtcaa

SEQ ID NO: 237065 - DNA, 14 bp, Homo sapiens
cttcacgattctta

SEQ ID NO: 237066 - DNA, 23 bp, Homo sapiens
cttcacgattcttaccctttctt

SEQ ID NO: 237067 - DNA, 17 bp, Homo sapiens
cttcacgctggcttcca

SEQ ID NO: 237068 - DNA, 22 bp, Homo sapiens
cttcactctgacagtattaaca

SEQ ID NO: 237069 - DNA, 17 bp, Homo sapiens
cttcactgaatatcata

SEQ ID NO: 237070 - DNA, 19 bp, Homo sapiens
cttcactgcaattttgtgt

SEQ ID NO: 237071 - DNA, 16 bp, Homo sapiens
cttcacttctgaccac

SEQ ID NO: 237072 - DNA, 19 bp, Homo sapiens
cttcacttctgaccacact

SEQ ID NO: 237073 - DNA, 20 bp, Homo sapiens
cttcagaaaagacacttcaa

SEQ ID NO: 237074 - DNA, 19 bp, Homo sapiens
cttcagacacacggggcac

SEQ ID NO: 237075 - DNA, 14 bp, Homo sapiens
cttcagactctctc

SEQ ID NO: 237076 - DNA, 16 bp, Homo sapiens
cttcagactctctcct

SEQ ID NO: 237077 - DNA, 21 bp, Homo sapiens
cttcagactctctcctctctc

SEQ ID NO: 237078 - DNA, 15 bp, Homo sapiens
cttcagactttgctt

SEQ ID NO: 237079 - DNA, 18 bp, Homo sapiens
cttcagactttgcttccc

SEQ ID NO: 237080 - DNA, 13 bp, Homo sapiens
cttcagagaagtc

SEQ ID NO: 237081 - DNA, 14 bp, Homo sapiens
cttcagagagctgg

SEQ ID NO: 237082 - DNA, 22 bp, Homo sapiens
cttcagagagctggtagttagt

SEQ ID NO: 237083 - DNA, 12 bp, Homo sapiens
cttcagagggaa

SEQ ID NO: 237084 - DNA, 21 bp, Homo sapiens
cttcagaggtggctctggaat

SEQ ID NO: 237085 - DNA, 17 bp, Homo sapiens
cttcagattatttccag

SEQ ID NO: 237086 - DNA, 20 bp, Homo sapiens
cttcagcaaccctacagtat

SEQ ID NO: 237087 - DNA, 21 bp, Homo sapiens
cttcagcaaccctacagtata

SEQ ID NO: 237088 - DNA, 21 bp, Homo sapiens
cttcagcaggggtgggaggct

SEQ ID NO: 237089 - DNA, 21 bp, Homo sapiens
cttcagcagtacctataaagt

SEQ ID NO: 237090 - DNA, 17 bp, Homo sapiens
cttcagccgagcccaga

SEQ ID NO: 237091 - DNA, 23 bp, Homo sapiens
cttcagctgcctgaaacagccat

SEQ ID NO: 237092 - DNA, 11 bp, Homo sapiens
cttcagctggt

SEQ ID NO: 237093 - DNA, 19 bp, Homo sapiens
cttcagctgtacttcgtct

SEQ ID NO: 237094 - DNA, 21 bp, Homo sapiens
cttcagctttggatgtggtta

SEQ ID NO: 237095 - DNA, 21 bp, Homo sapiens
cttcaggaaagcagcagtttt

SEQ ID NO: 237096 - DNA, 15 bp, Homo sapiens
cttcaggcctccctc

SEQ ID NO: 237097 - DNA, 15 bp, Homo sapiens
cttcaggctcttctc

SEQ ID NO: 237098 - DNA, 19 bp, Homo sapiens
cttcaggctcttctccttt

SEQ ID NO: 237099 - DNA, 23 bp, Homo sapiens
cttcagggccagaaggagggcag

SEQ ID NO: 237100 - DNA, 16 bp, Homo sapiens
cttcagggctgggcag

SEQ ID NO: 237101 - DNA, 21 bp, Homo sapiens
cttcagggctgggcaggtcct

SEQ ID NO: 237102 - DNA, 21 bp, Homo sapiens
cttcaggggtcacctcctcca

SEQ ID NO: 237103 - DNA, 20 bp, Homo sapiens
cttcagggttctaacctttc

SEQ ID NO: 237104 - DNA, 18 bp, Homo sapiens
cttcagggttctcctctc

SEQ ID NO: 237105 - DNA, 21 bp, Homo sapiens
cttcagggttctcctctcccc

SEQ ID NO: 237106 - DNA, 17 bp, Homo sapiens
cttcagtatcaaggctg

SEQ ID NO: 237107 - DNA, 23 bp, Homo sapiens
cttcagtatcaaggctgcctgga

SEQ ID NO: 237108 - DNA, 16 bp, Homo sapiens
cttcagtcatggcatt

SEQ ID NO: 237109 - DNA, 14 bp, Homo sapiens
cttcagtccctgag

SEQ ID NO: 237110 - DNA, 13 bp, Homo sapiens
cttcagtcctggg

SEQ ID NO: 237111 - DNA, 15 bp, Homo sapiens
cttcagtcctgggag

SEQ ID NO: 237112 - DNA, 18 bp, Homo sapiens
cttcagtcctgggagacc

SEQ ID NO: 237113 - DNA, 19 bp, Homo sapiens
cttcagtgagcccctcccc

SEQ ID NO: 237114 - DNA, 16 bp, Homo sapiens
cttcataaattatttc

SEQ ID NO: 237115 - DNA, 18 bp, Homo sapiens
cttcataaattatttcta

SEQ ID NO: 237116 - DNA, 15 bp, Homo sapiens
cttcataacaatttt

SEQ ID NO: 237117 - DNA, 18 bp, Homo sapiens
cttcataagatattcttt

SEQ ID NO: 237118 - DNA, 21 bp, Homo sapiens
cttcataagatattctttaca

SEQ ID NO: 237119 - DNA, 22 bp, Homo sapiens
cttcataagatattctttacaa

SEQ ID NO: 237120 - DNA, 16 bp, Homo sapiens
cttcatagctccttgg

SEQ ID NO: 237121 - DNA, 20 bp, Homo sapiens
cttcataggcagagcccgcc

SEQ ID NO: 237122 - DNA, 14 bp, Homo sapiens
cttcatatctctcc

SEQ ID NO: 237123 - DNA, 18 bp, Homo sapiens
cttcatatctctcccttc

SEQ ID NO: 237124 - DNA, 13 bp, Homo sapiens
cttcatccataga

SEQ ID NO: 237125 - DNA, 14 bp, Homo sapiens
cttcatccatagac

SEQ ID NO: 237126 - DNA, 20 bp, Homo sapiens
cttcatccatagacacagta

SEQ ID NO: 237127 - DNA, 11 bp, Homo sapiens
cttcatcctct

SEQ ID NO: 237128 - DNA, 19 bp, Homo sapiens
cttcatccttagcaacagc

SEQ ID NO: 237129 - DNA, 20 bp, Homo sapiens
cttcatccttagcaacagcc

SEQ ID NO: 237130 - DNA, 18 bp, Homo sapiens
cttcatcgcagtggactg

SEQ ID NO: 237131 - DNA, 19 bp, Homo sapiens
cttcatcgcagtggactgt

SEQ ID NO: 237132 - DNA, 17 bp, Homo sapiens
cttcatgcaatgacatc

SEQ ID NO: 237133 - DNA, 16 bp, Homo sapiens
cttcatgcttttctca

SEQ ID NO: 237134 - DNA, 20 bp, Homo sapiens
cttcatgcttttctcatggt

SEQ ID NO: 237135 - DNA, 14 bp, Homo sapiens
cttcattaaatgtt

SEQ ID NO: 237136 - DNA, 19 bp, Homo sapiens
cttcattccgttaggaata

SEQ ID NO: 237137 - DNA, 18 bp, Homo sapiens
cttcattctaaaccaaaa

SEQ ID NO: 237138 - DNA, 23 bp, Homo sapiens
cttcattgggagttcctagcaag

SEQ ID NO: 237139 - DNA, 13 bp, Homo sapiens
ccttcaaagctga

SEQ ID NO: 237140 - DNA, 18 bp, Homo sapiens
ccttcacaggcagtgcat

SEQ ID NO: 237141 - DNA, 20 bp, Homo sapiens
ccttcacaggcagtgcatgt

SEQ ID NO: 237142 - DNA, 13 bp, Homo sapiens
ccttcaccaagct

SEQ ID NO: 237143 - DNA, 14 bp, Homo sapiens
ccttcaccccttca

SEQ ID NO: 237144 - DNA, 19 bp, Homo sapiens
ccttcacgctggcttccag

SEQ ID NO: 237145 - DNA, 22 bp, Homo sapiens
ccttcacgctggcttccagcgg

SEQ ID NO: 237146 - DNA, 15 bp, Homo sapiens
ccttcactgccatga

SEQ ID NO: 237147 - DNA, 12 bp, Homo sapiens
ccttcagagctc

SEQ ID NO: 237148 - DNA, 16 bp, Homo sapiens
ccttcagatcctaccc

SEQ ID NO: 237149 - DNA, 20 bp, Homo sapiens
ccttcagatcctacccctga

SEQ ID NO: 237150 - DNA, 15 bp, Homo sapiens
ccttcagcagctaga

SEQ ID NO: 237151 - DNA, 16 bp, Homo sapiens
ccttcagggagacagg

SEQ ID NO: 237152 - DNA, 19 bp, Homo sapiens
ccttcagggccagaaggag

SEQ ID NO: 237153 - DNA, 18 bp, Homo sapiens
ccttcagtatcaaggctg

SEQ ID NO: 237154 - DNA, 16 bp, Homo sapiens
ccttcagtgagcccct

SEQ ID NO: 237155 - DNA, 12 bp, Homo sapiens
ccttcagtttga

SEQ ID NO: 237156 - DNA, 15 bp, Homo sapiens
ccttcatctccaggg

SEQ ID NO: 237157 - DNA, 18 bp, Homo sapiens
ccttcatgcttttctcat

SEQ ID NO: 237158 - DNA, 19 bp, Homo sapiens
ccttcatttcaggagggat

SEQ ID NO: 237159 - DNA, 16 bp, Homo sapiens
ccttccaactgctgcc

SEQ ID NO: 237160 - DNA, 19 bp, Homo sapiens
ccttccaactgctgcccca

SEQ ID NO: 237161 - DNA, 16 bp, Homo sapiens
ccttccacctccctcc

SEQ ID NO: 237162 - DNA, 20 bp, Homo sapiens
ccttccacgctgtctccaga

SEQ ID NO: 237163 - DNA, 13 bp, Homo sapiens
ccttccactgcct

SEQ ID NO: 237164 - DNA, 18 bp, Homo sapiens
ccttccactgcctctgcc

SEQ ID NO: 237165 - DNA, 14 bp, Homo sapiens
ccttccagcccaga

SEQ ID NO: 237166 - DNA, 12 bp, Homo sapiens
ccttccagtggg

SEQ ID NO: 237167 - DNA, 18 bp, Homo sapiens
ccttccatgtcgcctctg

SEQ ID NO: 237168 - DNA, 21 bp, Homo sapiens
ccttccatgtcgcctctgcat

SEQ ID NO: 237169 - DNA, 21 bp, Homo sapiens
ccttcccaactcactgtgctc

SEQ ID NO: 237170 - DNA, 18 bp, Homo sapiens
ccttcccacggccactgc

SEQ ID NO: 237171 - DNA, 20 bp, Homo sapiens
ccttcccacggccactgcag

SEQ ID NO: 237172 - DNA, 13 bp, Homo sapiens
ccttcccagcaga

SEQ ID NO: 237173 - DNA, 13 bp, Homo sapiens
ccttcccagtggg

SEQ ID NO: 237174 - DNA, 20 bp, Homo sapiens
ccttcccagtgggctgtgtt

SEQ ID NO: 237175 - DNA, 15 bp, Homo sapiens
ccttcccatgcctgt

SEQ ID NO: 237176 - DNA, 13 bp, Homo sapiens
ccttccccaagaa

SEQ ID NO: 237177 - DNA, 22 bp, Homo sapiens
ccttccccactgcctgcccacc

SEQ ID NO: 237178 - DNA, 16 bp, Homo sapiens
ccttccccatttcctc

SEQ ID NO: 237179 - DNA, 17 bp, Homo sapiens
ccttccccatttcctct

SEQ ID NO: 237180 - DNA, 21 bp, Homo sapiens
ccttccccatttcctcttcct

SEQ ID NO: 237181 - DNA, 23 bp, Homo sapiens
ccttccccatttcctcttccttc

SEQ ID NO: 237182 - DNA, 13 bp, Homo sapiens
ccttcccccagcc

SEQ ID NO: 237183 - DNA, 18 bp, Homo sapiens
ccttcccccagcccaata

SEQ ID NO: 237184 - DNA, 19 bp, Homo sapiens
ccttcccccagcccaataa

SEQ ID NO: 237185 - DNA, 19 bp, Homo sapiens
ccttccccctgtagactag

SEQ ID NO: 237186 - DNA, 14 bp, Homo sapiens
ccttcccctccctg

SEQ ID NO: 237187 - DNA, 18 bp, Homo sapiens
ccttcccctccctggctc

SEQ ID NO: 237188 - DNA, 21 bp, Homo sapiens
ccttcccctgaggacctttct

SEQ ID NO: 237189 - DNA, 12 bp, Homo sapiens
ccttcccctgct

SEQ ID NO: 237190 - DNA, 19 bp, Homo sapiens
ccttcccgcagcaccagcc

SEQ ID NO: 237191 - DNA, 22 bp, Homo sapiens
ccttcccgcagcaccagcctga

SEQ ID NO: 237192 - DNA, 22 bp, Homo sapiens
gaaaagagaagaaagaagcact

SEQ ID NO: 237193 - DNA, 21 bp, Homo sapiens
gaaaagagtatcaaaggcaga

SEQ ID NO: 237194 - DNA, 15 bp, Homo sapiens
gaaaagagtatgtag

SEQ ID NO: 237195 - DNA, 21 bp, Homo sapiens
gaaaagattaaaattagtgag

SEQ ID NO: 237196 - DNA, 18 bp, Homo sapiens
gaaaagattccattttat

SEQ ID NO: 237197 - DNA, 18 bp, Homo sapiens
gaaaagcaattgccctgt

SEQ ID NO: 237198 - DNA, 19 bp, Homo sapiens
gaaaagcaattgccctgta

SEQ ID NO: 237199 - DNA, 13 bp, Homo sapiens
gaaaagcttccta

SEQ ID NO: 237200 - DNA, 14 bp, Homo sapiens
gaaaagcttcctag

SEQ ID NO: 237201 - DNA, 13 bp, Homo sapiens
gaaaaggaagact

SEQ ID NO: 237202 - DNA, 20 bp, Homo sapiens
gaaaaggaagactagaggct

SEQ ID NO: 237203 - DNA, 20 bp, Homo sapiens
gaaaaggactcttgagccct

SEQ ID NO: 237204 - DNA, 19 bp, Homo sapiens
gaaaagggaagttgtgcct

SEQ ID NO: 237205 - DNA, 16 bp, Homo sapiens
gaaaagggagaaaaag

SEQ ID NO: 237206 - DNA, 17 bp, Homo sapiens
gaaaagggagaaaaaga

SEQ ID NO: 237207 - DNA, 20 bp, Homo sapiens
gaaaaggttcttactgcttg

SEQ ID NO: 237208 - DNA, 14 bp, Homo sapiens
gaaaagttgtctta

SEQ ID NO: 237209 - DNA, 18 bp, Homo sapiens
gaaaataaaataaacgaa

SEQ ID NO: 237210 - DNA, 17 bp, Homo sapiens
gaaaataaaccaacaat

SEQ ID NO: 237211 - DNA, 22 bp, Homo sapiens
gaaaataatctggtgttcttgc

SEQ ID NO: 237212 - DNA, 23 bp, Homo sapiens
gaaaataatctggtgttcttgct

SEQ ID NO: 237213 - DNA, 15 bp, Homo sapiens
gaaaatacaataaac

SEQ ID NO: 237214 - DNA, 20 bp, Homo sapiens
gaaaatagggtccttgaaac

SEQ ID NO: 237215 - DNA, 19 bp, Homo sapiens
gaaaatagggtggacagaa

SEQ ID NO: 237216 - DNA, 20 bp, Homo sapiens
gaaaatagtaaatgctttgt

SEQ ID NO: 237217 - DNA, 14 bp, Homo sapiens
gaaaatgaagggat

SEQ ID NO: 237218 - DNA, 20 bp, Homo sapiens
gaaaatgatacgcaacataa

SEQ ID NO: 237219 - DNA, 20 bp, Homo sapiens
gaaaatgtaagtaaatgtct

SEQ ID NO: 237220 - DNA, 10 bp, Homo sapiens
gaaaatgtgt

SEQ ID NO: 237221 - DNA, 22 bp, Homo sapiens
gaaaatgtgtctgcaacatgga

SEQ ID NO: 237222 - DNA, 14 bp, Homo sapiens
gaaaatgtgtgttt

SEQ ID NO: 237223 - DNA, 14 bp, Homo sapiens
gaaaattttacttc

SEQ ID NO: 237224 - DNA, 17 bp, Homo sapiens
gaaacaaataatcacat

SEQ ID NO: 237225 - DNA, 14 bp, Homo sapiens
gaaacaacagaaac

SEQ ID NO: 237226 - DNA, 16 bp, Homo sapiens
gaaacaatatgcttta

SEQ ID NO: 237227 - DNA, 14 bp, Homo sapiens
gaaacaatttaaat

SEQ ID NO: 237228 - DNA, 16 bp, Homo sapiens
gaaataaaacctttca

SEQ ID NO: 237229 - DNA, 18 bp, Homo sapiens
gaaataaaacctttcaaa

SEQ ID NO: 237230 - DNA, 14 bp, Homo sapiens
gaaataaactgtgc

SEQ ID NO: 237231 - DNA, 14 bp, Homo sapiens
gaaataaatagcta

SEQ ID NO: 237232 - DNA, 22 bp, Homo sapiens
gaaataaattggtgataagtgg

SEQ ID NO: 237233 - DNA, 20 bp, Homo sapiens
gaaataacagtatttccaca

SEQ ID NO: 237234 - DNA, 22 bp, Homo sapiens
gaaataacagtatttccacaat

SEQ ID NO: 237235 - DNA, 15 bp, Homo sapiens
gaaataacattgcac

SEQ ID NO: 237236 - DNA, 22 bp, Homo sapiens
gaaataactccttcttgtagta

SEQ ID NO: 237237 - DNA, 15 bp, Homo sapiens
gaaataatatgcatt

SEQ ID NO: 237238 - DNA, 23 bp, Homo sapiens
gaaataattttttagttaaaatc

SEQ ID NO: 237239 - DNA, 14 bp, Homo sapiens
gaaatacactacaa

SEQ ID NO: 237240 - DNA, 20 bp, Homo sapiens
gaaatacttgacaacatttt

SEQ ID NO: 237241 - DNA, 15 bp, Homo sapiens
gaaatagtgttcttt

SEQ ID NO: 237242 - DNA, 18 bp, Homo sapiens
gaaatataaactgtgaga

SEQ ID NO: 237243 - DNA, 17 bp, Homo sapiens
gaaatatatatgtgtgt

SEQ ID NO: 237244 - DNA, 13 bp, Homo sapiens
gaaatatcattta

SEQ ID NO: 237245 - DNA, 22 bp, Homo sapiens
gaaatatgattttatttgacaa

SEQ ID NO: 237246 - DNA, 18 bp, Homo sapiens
gaaatatgcacaatagca

SEQ ID NO: 237247 - DNA, 14 bp, Homo sapiens
gaaatatgcatgta

SEQ ID NO: 237248 - DNA, 18 bp, Homo sapiens
gaaatatgcatgtacttt

SEQ ID NO: 237249 - DNA, 23 bp, Homo sapiens
gaaatattataaatccaaagtaa

SEQ ID NO: 237250 - DNA, 17 bp, Homo sapiens
gaaatattcacaaggtt

SEQ ID NO: 237251 - DNA, 19 bp, Homo sapiens
gaaatatttatttttttaa

SEQ ID NO: 237252 - DNA, 15 bp, Homo sapiens
gaaatatttgcttat

SEQ ID NO: 237253 - DNA, 20 bp, Homo sapiens
gaaatatttgcttatttata

SEQ ID NO: 237254 - DNA, 19 bp, Homo sapiens
gaaatattttgataataaa

SEQ ID NO: 237255 - DNA, 13 bp, Homo sapiens
gaaatatttttga

SEQ ID NO: 237256 - DNA, 19 bp, Homo sapiens
gaaatcaaagagagaaaat

SEQ ID NO: 237257 - DNA, 19 bp, Homo sapiens
gaaatcacaggggcggggc

SEQ ID NO: 237258 - DNA, 20 bp, Homo sapiens
gaaatcattgtgtgtcttca

SEQ ID NO: 237259 - DNA, 14 bp, Homo sapiens
gaaatccagcccca

SEQ ID NO: 237260 - DNA, 24 bp, Homo sapiens
gaaatccagccccatagaaaacaa

SEQ ID NO: 237261 - DNA, 14 bp, Homo sapiens
gaaatcccagttca

SEQ ID NO: 237262 - DNA, 17 bp, Homo sapiens
gaaatcccagttcatgt

SEQ ID NO: 237263 - DNA, 13 bp, Homo sapiens
gaaatcctgttac

SEQ ID NO: 237264 - DNA, 17 bp, Homo sapiens
gaaatcgccttatgaga

SEQ ID NO: 237265 - DNA, 22 bp, Homo sapiens
gaaatgcataccagtaattggc

SEQ ID NO: 237266 - DNA, 21 bp, Homo sapiens
gaaatgctattgttgtgggct

SEQ ID NO: 237267 - DNA, 22 bp, Homo sapiens
gaaatgctgatttaaacttctt

SEQ ID NO: 237268 - DNA, 13 bp, Homo sapiens
gaaatgctgcctg

SEQ ID NO: 237269 - DNA, 14 bp, Homo sapiens
gaaatgctgttggt

SEQ ID NO: 237270 - DNA, 17 bp, Homo sapiens
gaaatggcttgaagcca

SEQ ID NO: 237271 - DNA, 18 bp, Homo sapiens
gaaatggcttgaagccaa

SEQ ID NO: 237272 - DNA, 17 bp, Homo sapiens
gaaatgggctttaacaa

SEQ ID NO: 237273 - DNA, 23 bp, Homo sapiens
gaaatgtattttgaaaacactta

SEQ ID NO: 237274 - DNA, 16 bp, Homo sapiens
gaaatgtggatgctct

SEQ ID NO: 237275 - DNA, 16 bp, Homo sapiens
gaaattaaataatttt

SEQ ID NO: 237276 - DNA, 21 bp, Homo sapiens
gaaattatgtatgtttacata

SEQ ID NO: 237277 - DNA, 21 bp, Homo sapiens
gaaattatgtcaaatggatgt

SEQ ID NO: 237278 - DNA, 15 bp, Homo sapiens
gaaattatttaataa

SEQ ID NO: 237279 - DNA, 13 bp, Homo sapiens
gaaattcacactg

SEQ ID NO: 237280 - DNA, 16 bp, Homo sapiens
gaaattcattaaagaa

SEQ ID NO: 237281 - DNA, 17 bp, Homo sapiens
gaaattcattaaagaaa

SEQ ID NO: 237282 - DNA, 19 bp, Homo sapiens
gaaattcattaaagaaaaa

SEQ ID NO: 237283 - DNA, 15 bp, Homo sapiens
gaaattccctggacc

SEQ ID NO: 237284 - DNA, 15 bp, Homo sapiens
gaaattctgctgctt

SEQ ID NO: 237285 - DNA, 12 bp, Homo sapiens
gaaattctgtgg

SEQ ID NO: 237286 - DNA, 19 bp, Homo sapiens
gaaattcttcaatttgaaa

SEQ ID NO: 237287 - DNA, 17 bp, Homo sapiens
gaaattcttccctgggg

SEQ ID NO: 237288 - DNA, 18 bp, Homo sapiens
gaaattcttccctggggg

SEQ ID NO: 237289 - DNA, 17 bp, Homo sapiens
gaaattgcaaagaaaat

SEQ ID NO: 237290 - DNA, 19 bp, Homo sapiens
gaaattgcatttcctgaca

SEQ ID NO: 237291 - DNA, 18 bp, Homo sapiens
gaaattgggtgtgccctg

SEQ ID NO: 237292 - DNA, 23 bp, Homo sapiens
gaaattgggtgtgccctggctcc

SEQ ID NO: 237293 - DNA, 13 bp, Homo sapiens
gaaattgtgaact

SEQ ID NO: 237294 - DNA, 24 bp, Homo sapiens
gaaatttcaaagtatgtttcatta

SEQ ID NO: 237295 - DNA, 13 bp, Homo sapiens
gaaatttgttaat

SEQ ID NO: 237296 - DNA, 17 bp, Homo sapiens
gaaatttgttaatatat

SEQ ID NO: 237297 - DNA, 17 bp, Homo sapiens
gaaatttgttataatga

SEQ ID NO: 237298 - DNA, 18 bp, Homo sapiens
gaaatttgttatacttca

SEQ ID NO: 237299 - DNA, 21 bp, Homo sapiens
gaaatttgttatacttcaaaa

SEQ ID NO: 237300 - DNA, 12 bp, Homo sapiens
gaaattttcaac

SEQ ID NO: 237301 - DNA, 18 bp, Homo sapiens
gaaattttctagactttc

SEQ ID NO: 237302 - DNA, 20 bp, Homo sapiens
gaaattttctagactttctg

SEQ ID NO: 237303 - DNA, 20 bp, Homo sapiens
gaaatttttttccagaattg

SEQ ID NO: 237304 - DNA, 22 bp, Homo sapiens
gaacaaaacctcttctgtattt

SEQ ID NO: 237305 - DNA, 21 bp, Homo sapiens
gaacaaaagttcgaaagaaaa

SEQ ID NO: 237306 - DNA, 18 bp, Homo sapiens
gaacaaacaaaacttaaa

SEQ ID NO: 237307 - DNA, 21 bp, Homo sapiens
gaacaaagaccaatgtgaaga

SEQ ID NO: 237308 - DNA, 20 bp, Homo sapiens
gaacaaagggccaaatagag

SEQ ID NO: 237309 - DNA, 21 bp, Homo sapiens
gaacaaagggccaaatagagt

SEQ ID NO: 237310 - DNA, 23 bp, Homo sapiens
gaacaaatatgattctcctctcc

SEQ ID NO: 237311 - DNA, 20 bp, Homo sapiens
gaacaaatcacacctctggg

SEQ ID NO: 237312 - DNA, 22 bp, Homo sapiens
gaacaacaacaaagcatgctca

SEQ ID NO: 237313 - DNA, 13 bp, Homo sapiens
gaacaagaaagag

SEQ ID NO: 237314 - DNA, 14 bp, Homo sapiens
gaacaagaaagagt

SEQ ID NO: 237315 - DNA, 15 bp, Homo sapiens
gaacaagatttccct

SEQ ID NO: 237316 - DNA, 14 bp, Homo sapiens
gaacaaggcaaggc

SEQ ID NO: 237317 - DNA, 17 bp, Homo sapiens
gaacaaggcaaggctgt

SEQ ID NO: 237318 - DNA, 16 bp, Homo sapiens
gaacaagtcacagctg

SEQ ID NO: 237319 - DNA, 18 bp, Homo sapiens
gaacaagtcacagctgca

SEQ ID NO: 237320 - DNA, 13 bp, Homo sapiens
gaacaagtgaaca

SEQ ID NO: 237321 - DNA, 21 bp, Homo sapiens
gaacaagtgcctcctggactg

SEQ ID NO: 237322 - DNA, 21 bp, Homo sapiens
gaacaagtgtacagaagaatt

SEQ ID NO: 237323 - DNA, 18 bp, Homo sapiens
gaacaatcactattctta

SEQ ID NO: 237324 - DNA, 21 bp, Homo sapiens
gaacaattttttttctgtaaa

SEQ ID NO: 237325 - DNA, 23 bp, Homo sapiens
gaacacacacacacgcagacaca

SEQ ID NO: 237326 - DNA, 15 bp, Homo sapiens
gaacacactcagcag

SEQ ID NO: 237327 - DNA, 15 bp, Homo sapiens
gaacacagcatgtgc

SEQ ID NO: 237328 - DNA, 12 bp, Homo sapiens
gaacacaggcaa

SEQ ID NO: 237329 - DNA, 14 bp, Homo sapiens
gaacacaggcaaag

SEQ ID NO: 237330 - DNA, 16 bp, Homo sapiens
gaacacaggcaaagag

SEQ ID NO: 237331 - DNA, 22 bp, Homo sapiens
gaacacaggcaaagaggtgctg

SEQ ID NO: 237332 - DNA, 17 bp, Homo sapiens
gaagaaaaaaaataaca

SEQ ID NO: 237333 - DNA, 18 bp, Homo sapiens
gaagaaaaaaaataacac

SEQ ID NO: 237334 - DNA, 18 bp, Homo sapiens
gaagaaaacatatatttt

SEQ ID NO: 237335 - DNA, 21 bp, Homo sapiens
gaagaaacccttccacgtgta

SEQ ID NO: 237336 - DNA, 18 bp, Homo sapiens
gaagaaagaagcactctg

SEQ ID NO: 237337 - DNA, 14 bp, Homo sapiens
gaagaaagactcct

SEQ ID NO: 237338 - DNA, 17 bp, Homo sapiens
gaagaaagtctatgctt

SEQ ID NO: 237339 - DNA, 15 bp, Homo sapiens
gaagaaattatttaa

SEQ ID NO: 237340 - DNA, 21 bp, Homo sapiens
gaagaacacagcatgtgccaa

SEQ ID NO: 237341 - DNA, 10 bp, Homo sapiens
gaagaacatc

SEQ ID NO: 237342 - DNA, 22 bp, Homo sapiens
gaagaactctctagttccctca

SEQ ID NO: 237343 - DNA, 15 bp, Homo sapiens
gaagaaggacttcct

SEQ ID NO: 237344 - DNA, 16 bp, Homo sapiens
gaagaataaaaaagaa

SEQ ID NO: 237345 - DNA, 14 bp, Homo sapiens
gaagaatgtctcct

SEQ ID NO: 237346 - DNA, 19 bp, Homo sapiens
gaagaattttttttttaag

SEQ ID NO: 237347 - DNA, 24 bp, Homo sapiens
gaagacacgtgtttttgtatcttt

SEQ ID NO: 237348 - DNA, 16 bp, Homo sapiens
gaagaccagtcacagc

SEQ ID NO: 237349 - DNA, 16 bp, Homo sapiens
gaagactacttttaga

SEQ ID NO: 237350 - DNA, 22 bp, Homo sapiens
gaagacttctttgcaacaataa

SEQ ID NO: 237351 - DNA, 16 bp, Homo sapiens
gaagagaatcaaggcc

SEQ ID NO: 237352 - DNA, 17 bp, Homo sapiens
gaagagaatcaaggccg

SEQ ID NO: 237353 - DNA, 14 bp, Homo sapiens
gaagagagcctgcc

SEQ ID NO: 237354 - DNA, 15 bp, Homo sapiens
gaagagagcctgccc

SEQ ID NO: 237355 - DNA, 16 bp, Homo sapiens
gaagagaggagttcaa

SEQ ID NO: 237356 - DNA, 18 bp, Homo sapiens
gaagagaggagttcaatg

SEQ ID NO: 237357 - DNA, 21 bp, Homo sapiens
gaagagaggagttcaatgatc

SEQ ID NO: 237358 - DNA, 13 bp, Homo sapiens
gaagagaggcacc

SEQ ID NO: 237359 - DNA, 14 bp, Homo sapiens
gaagagatgctcta

SEQ ID NO: 237360 - DNA, 18 bp, Homo sapiens
gaagagatgggcttgttt

SEQ ID NO: 237361 - DNA, 12 bp, Homo sapiens
gaagagcagcct

SEQ ID NO: 237362 - DNA, 15 bp, Homo sapiens
gaagagccctggaca

SEQ ID NO: 237363 - DNA, 12 bp, Homo sapiens
gaagagctgggt

SEQ ID NO: 237364 - DNA, 13 bp, Homo sapiens
gaagagctgggta

SEQ ID NO: 237365 - DNA, 22 bp, Homo sapiens
gaagagctgggtaccaggccac

SEQ ID NO: 237366 - DNA, 16 bp, Homo sapiens
gaagaggcagattcaa

SEQ ID NO: 237367 - DNA, 14 bp, Homo sapiens
gaagaggccttggg

SEQ ID NO: 237368 - DNA, 12 bp, Homo sapiens
gaagagggagaa

SEQ ID NO: 237369 - DNA, 14 bp, Homo sapiens
gaagagggagaagg

SEQ ID NO: 237370 - DNA, 13 bp, Homo sapiens
gaagagggcctgt

SEQ ID NO: 237371 - DNA, 16 bp, Homo sapiens
gaagaggggaggggcc

SEQ ID NO: 237372 - DNA, 14 bp, Homo sapiens
gaagaggggccaga

SEQ ID NO: 237373 - DNA, 20 bp, Homo sapiens
gaagaggttctcagcaagtg

SEQ ID NO: 237374 - DNA, 23 bp, Homo sapiens
gaagaggttctcagcaagtgtac

SEQ ID NO: 237375 - DNA, 16 bp, Homo sapiens
gaagatacacaagagg

SEQ ID NO: 237376 - DNA, 16 bp, Homo sapiens
gaagataccatcagca

SEQ ID NO: 237377 - DNA, 13 bp, Homo sapiens
gaagataggctct

SEQ ID NO: 237378 - DNA, 21 bp, Homo sapiens
gaagatcagcaccctaagaga

SEQ ID NO: 237379 - DNA, 18 bp, Homo sapiens
gaagatcgttagtatcta

SEQ ID NO: 237380 - DNA, 15 bp, Homo sapiens
gaagatcttaaattt

SEQ ID NO: 237381 - DNA, 20 bp, Homo sapiens
gaagatgaaaccgtccctga

SEQ ID NO: 237382 - DNA, 23 bp, Homo sapiens
gaagatggttttattctttgaga

SEQ ID NO: 237383 - DNA, 19 bp, Homo sapiens
gaagatgtattcagagcca

SEQ ID NO: 237384 - DNA, 10 bp, Homo sapiens
gaagatgtcc

SEQ ID NO: 237385 - DNA, 15 bp, Homo sapiens
gaagatgtcccccag

SEQ ID NO: 237386 - DNA, 13 bp, Homo sapiens
gaagattctaaaa

SEQ ID NO: 237387 - DNA, 21 bp, Homo sapiens
gaagattctaaaacattcttt

SEQ ID NO: 237388 - DNA, 22 bp, Homo sapiens
gaagattctaaaacattcttta

SEQ ID NO: 237389 - DNA, 17 bp, Homo sapiens
gaagattctcctgtgct

SEQ ID NO: 237390 - DNA, 22 bp, Homo sapiens
gaagcaaacacacagactctgt

SEQ ID NO: 237391 - DNA, 17 bp, Homo sapiens
gaagcaaataccaaagc

SEQ ID NO: 237392 - DNA, 23 bp, Homo sapiens
gaagcaagacgtcctggaatgaa

SEQ ID NO: 237393 - DNA, 13 bp, Homo sapiens
gaagcaagttcac

SEQ ID NO: 237394 - DNA, 14 bp, Homo sapiens
gaagcacagcaggt

SEQ ID NO: 237395 - DNA, 12 bp, Homo sapiens
gaagcacaggcc

SEQ ID NO: 237396 - DNA, 22 bp, Homo sapiens
gaagcacctactatgtgctggg

SEQ ID NO: 237397 - DNA, 14 bp, Homo sapiens
gaagcactctgctg

SEQ ID NO: 237398 - DNA, 15 bp, Homo sapiens
gaagcactctgctgg

SEQ ID NO: 237399 - DNA, 19 bp, Homo sapiens
gaagcactctgctggcggg

SEQ ID NO: 237400 - DNA, 23 bp, Homo sapiens
gaagcactttgggattctttcca

SEQ ID NO: 237401 - DNA, 15 bp, Homo sapiens
gaagcaggctggagg

SEQ ID NO: 237402 - DNA, 17 bp, Homo sapiens
gaagcagggagagttgg

SEQ ID NO: 237403 - DNA, 18 bp, Homo sapiens
gaagcagtgcctcgaggc

SEQ ID NO: 237404 - DNA, 20 bp, Homo sapiens
gaagcagtgcctcgaggcac

SEQ ID NO: 237405 - DNA, 22 bp, Homo sapiens
gaagcagtgcctcgaggcaccg

SEQ ID NO: 237406 - DNA, 12 bp, Homo sapiens
gaagcagtgtcg

SEQ ID NO: 237407 - DNA, 17 bp, Homo sapiens
gaagcagtgtgtacttc

SEQ ID NO: 237408 - DNA, 13 bp, Homo sapiens
gaagcagttgtgt

SEQ ID NO: 237409 - DNA, 16 bp, Homo sapiens
gaagcagttgtgtcag

SEQ ID NO: 237410 - DNA, 13 bp, Homo sapiens
gaagcatgaaaaa

SEQ ID NO: 237411 - DNA, 16 bp, Homo sapiens
gaagcatgaaaaagca

SEQ ID NO: 237412 - DNA, 22 bp, Homo sapiens
gaagcatgctttgctgctatga

SEQ ID NO: 237413 - DNA, 14 bp, Homo sapiens
gaagcatgtttcat

SEQ ID NO: 237414 - DNA, 17 bp, Homo sapiens
gaagcatttggtggcct

SEQ ID NO: 237415 - DNA, 14 bp, Homo sapiens
gaagccaagacagt

SEQ ID NO: 237416 - DNA, 21 bp, Homo sapiens
gaagccaccatgtatgtggaa

SEQ ID NO: 237417 - DNA, 21 bp, Homo sapiens
gaagccacgtgctggagagta

SEQ ID NO: 237418 - DNA, 22 bp, Homo sapiens
gaagccatcacttctccccgca

SEQ ID NO: 237419 - DNA, 13 bp, Homo sapiens
gaagcccacccgc

SEQ ID NO: 237420 - DNA, 17 bp, Homo sapiens
gaagcccacccgcccca

SEQ ID NO: 237421 - DNA, 18 bp, Homo sapiens
gaagcccacccgccccag

SEQ ID NO: 237422 - DNA, 13 bp, Homo sapiens
gaagcccaggagg

SEQ ID NO: 237423 - DNA, 20 bp, Homo sapiens
gaagcccaggaggacctggg

SEQ ID NO: 237424 - DNA, 13 bp, Homo sapiens
gaagccctccttg

SEQ ID NO: 237425 - DNA, 19 bp, Homo sapiens
gaagccctccttgccaccc

SEQ ID NO: 237426 - DNA, 14 bp, Homo sapiens
gaagccgctgctgg

SEQ ID NO: 237427 - DNA, 16 bp, Homo sapiens
gaagccgtctgactcc

SEQ ID NO: 237428 - DNA, 19 bp, Homo sapiens
gaagccgtctgactccaga

SEQ ID NO: 237429 - DNA, 22 bp, Homo sapiens
gaagccgtctgactccagagtc

SEQ ID NO: 237430 - DNA, 14 bp, Homo sapiens
gaagcctaaataaa

SEQ ID NO: 237431 - DNA, 14 bp, Homo sapiens
gaagcctattgtaa

SEQ ID NO: 237432 - DNA, 14 bp, Homo sapiens
gaagcctcctgctg

SEQ ID NO: 237433 - DNA, 15 bp, Homo sapiens
gaagcctcctgctga

SEQ ID NO: 237434 - DNA, 13 bp, Homo sapiens
gaagcctgctgat

SEQ ID NO: 237435 - DNA, 13 bp, Homo sapiens
gaagccttgctga

SEQ ID NO: 237436 - DNA, 16 bp, Homo sapiens
gaagccttgctgaact

SEQ ID NO: 237437 - DNA, 18 bp, Homo sapiens
gaagccttttccataaag

SEQ ID NO: 237438 - DNA, 22 bp, Homo sapiens
gaagccttttccataaagtgta

SEQ ID NO: 237439 - DNA, 15 bp, Homo sapiens
gaagcgaacatcttc

SEQ ID NO: 237440 - DNA, 16 bp, Homo sapiens
gaagcgaacatcttca

SEQ ID NO: 237441 - DNA, 13 bp, Homo sapiens
gaagctcagccca

SEQ ID NO: 237442 - DNA, 15 bp, Homo sapiens
gaagctcagcccacc

SEQ ID NO: 237443 - DNA, 17 bp, Homo sapiens
gaagctcagcccacccc

SEQ ID NO: 237444 - DNA, 22 bp, Homo sapiens
gaagctcagcccacccccctca

SEQ ID NO: 237445 - DNA, 15 bp, Homo sapiens
gaagctgatctgatt

SEQ ID NO: 237446 - DNA, 20 bp, Homo sapiens
gaagctgattcccagagcag

SEQ ID NO: 237447 - DNA, 12 bp, Homo sapiens
gaagctgcagct

SEQ ID NO: 237448 - DNA, 15 bp, Homo sapiens
gaagctgcagcttgg

SEQ ID NO: 237449 - DNA, 18 bp, Homo sapiens
gaagctgcagcttgggag

SEQ ID NO: 237450 - DNA, 13 bp, Homo sapiens
gaagctggagtgc

SEQ ID NO: 237451 - DNA, 14 bp, Homo sapiens
gaagctggagtgct

SEQ ID NO: 237452 - DNA, 11 bp, Homo sapiens
gaagctgggga

SEQ ID NO: 237453 - DNA, 21 bp, Homo sapiens
gaagctggggacagctttcct

SEQ ID NO: 237454 - DNA, 16 bp, Homo sapiens
gaagctgtactcagag

SEQ ID NO: 237455 - DNA, 14 bp, Homo sapiens
gaattcctttacaa

SEQ ID NO: 237456 - DNA, 20 bp, Homo sapiens
gaattctaagattgtacata

SEQ ID NO: 237457 - DNA, 16 bp, Homo sapiens
gaattctgtgaagaat

SEQ ID NO: 237458 - DNA, 16 bp, Homo sapiens
gaattgaaaaggactc

SEQ ID NO: 237459 - DNA, 19 bp, Homo sapiens
gaattgaagtcatcataaa

SEQ ID NO: 237460 - DNA, 18 bp, Homo sapiens
gaattgacttcgactgtg

SEQ ID NO: 237461 - DNA, 13 bp, Homo sapiens
gaattgagaggtg

SEQ ID NO: 237462 - DNA, 20 bp, Homo sapiens
gaattgatcattttcccccc

SEQ ID NO: 237463 - DNA, 23 bp, Homo sapiens
gaattgattttgaggagtggttt

SEQ ID NO: 237464 - DNA, 23 bp, Homo sapiens
gaattgcattttttaaaacaaga

SEQ ID NO: 237465 - DNA, 22 bp, Homo sapiens
gaattgtaaggaatgattaatt

SEQ ID NO: 237466 - DNA, 13 bp, Homo sapiens
gaatttaaataaa

SEQ ID NO: 237467 - DNA, 14 bp, Homo sapiens
gaatttaaatataa

SEQ ID NO: 237468 - DNA, 20 bp, Homo sapiens
gaatttaaatataattctgt

SEQ ID NO: 237469 - DNA, 22 bp, Homo sapiens
gaatttaaatataattctgtaa

SEQ ID NO: 237470 - DNA, 13 bp, Homo sapiens
gacagctttcctg

SEQ ID NO: 237471 - DNA, 12 bp, Homo sapiens
gacaggaaaggg

SEQ ID NO: 237472 - DNA, 18 bp, Homo sapiens
gacaggaacacccagccc

SEQ ID NO: 237473 - DNA, 22 bp, Homo sapiens
gacaggaacacccagccccagc

SEQ ID NO: 237474 - DNA, 18 bp, Homo sapiens
gacaggaagcacagcagg

SEQ ID NO: 237475 - DNA, 20 bp, Homo sapiens
gacaggaagcccaaggcagt

SEQ ID NO: 237476 - DNA, 18 bp, Homo sapiens
gacaggagacctggcact

SEQ ID NO: 237477 - DNA, 18 bp, Homo sapiens
gacaggccatgtgagcca

SEQ ID NO: 237478 - DNA, 13 bp, Homo sapiens
gacaggccctccc

SEQ ID NO: 237479 - DNA, 15 bp, Homo sapiens
gacaggccctccctg

SEQ ID NO: 237480 - DNA, 17 bp, Homo sapiens
gacaggccctccctgtc

SEQ ID NO: 237481 - DNA, 18 bp, Homo sapiens
gacaggctcttagcagct

SEQ ID NO: 237482 - DNA, 15 bp, Homo sapiens
gacagggatgccaac

SEQ ID NO: 237483 - DNA, 14 bp, Homo sapiens
gacagggcatggcc

SEQ ID NO: 237484 - DNA, 15 bp, Homo sapiens
gacagggcatggcca

SEQ ID NO: 237485 - DNA, 20 bp, Homo sapiens
gacagggcatggccaggtgg

SEQ ID NO: 237486 - DNA, 18 bp, Homo sapiens
gacagggcccccggccac

SEQ ID NO: 237487 - DNA, 13 bp, Homo sapiens
gacagggtcctgc

SEQ ID NO: 237488 - DNA, 17 bp, Homo sapiens
gacagggttttttcatt

SEQ ID NO: 237489 - DNA, 14 bp, Homo sapiens
gacaggtctgggag

SEQ ID NO: 237490 - DNA, 16 bp, Homo sapiens
gacagtaagattttat

SEQ ID NO: 237491 - DNA, 14 bp, Homo sapiens
gacagtagcatact

SEQ ID NO: 237492 - DNA, 17 bp, Homo sapiens
gacagtatcactgtctt

SEQ ID NO: 237493 - DNA, 21 bp, Homo sapiens
gacagtatcactgtctttcct

SEQ ID NO: 237494 - DNA, 21 bp, Homo sapiens
gacagtatgagtcaatgtgca

SEQ ID NO: 237495 - DNA, 18 bp, Homo sapiens
gacagtattgccacctct

SEQ ID NO: 237496 - DNA, 17 bp, Homo sapiens
gacagtcaaggagtggc

SEQ ID NO: 237497 - DNA, 23 bp, Homo sapiens
gacagtcaggaagcctcctgctg

SEQ ID NO: 237498 - DNA, 22 bp, Homo sapiens
gacagtgcctgggaatgtatta

SEQ ID NO: 237499 - DNA, 13 bp, Homo sapiens
gacagtgccttct

SEQ ID NO: 237500 - DNA, 16 bp, Homo sapiens
gacagtggctctccaa

SEQ ID NO: 237501 - DNA, 18 bp, Homo sapiens
gacagtgggggtgcctgg

SEQ ID NO: 237502 - DNA, 15 bp, Homo sapiens
gacagttcacaccct

SEQ ID NO: 237503 - DNA, 17 bp, Homo sapiens
gacagttcacaccctgc

SEQ ID NO: 237504 - DNA, 23 bp, Homo sapiens
gacagttggcagagaaggcctct

SEQ ID NO: 237505 - DNA, 14 bp, Homo sapiens
gacatacacaaatg

SEQ ID NO: 237506 - DNA, 15 bp, Homo sapiens
gacatattcccatgg

SEQ ID NO: 237507 - DNA, 16 bp, Homo sapiens
gacatcaactgcatca

SEQ ID NO: 237508 - DNA, 18 bp, Homo sapiens
gacatcaagatacacttg

SEQ ID NO: 237509 - DNA, 13 bp, Homo sapiens
gacatcagtggca

SEQ ID NO: 237510 - DNA, 20 bp, Homo sapiens
gacatcagtggcatggctcc

SEQ ID NO: 237511 - DNA, 20 bp, Homo sapiens
gacatcctcaaaagaaagag

SEQ ID NO: 237512 - DNA, 13 bp, Homo sapiens
gacatcgatatga

SEQ ID NO: 237513 - DNA, 17 bp, Homo sapiens
gacatcgatatgaaaaa

SEQ ID NO: 237514 - DNA, 18 bp, Homo sapiens
gacatcggttcaggagga

SEQ ID NO: 237515 - DNA, 13 bp, Homo sapiens
gacatctctgcac

SEQ ID NO: 237516 - DNA, 14 bp, Homo sapiens
gacatgattccttc

SEQ ID NO: 237517 - DNA, 16 bp, Homo sapiens
gacatgattccttcct

SEQ ID NO: 237518 - DNA, 23 bp, Homo sapiens
gacatgccaactcgggagcattc

SEQ ID NO: 237519 - DNA, 22 bp, Homo sapiens
gacatgcgggctgggcagctgt

SEQ ID NO: 237520 - DNA, 17 bp, Homo sapiens
gacatgctcacctctag

SEQ ID NO: 237521 - DNA, 19 bp, Homo sapiens
gacatggcaacaaaggatg

SEQ ID NO: 237522 - DNA, 21 bp, Homo sapiens
gacatgtgcaattgtgaggga

SEQ ID NO: 237523 - DNA, 17 bp, Homo sapiens
gacatgtggggccaggt

SEQ ID NO: 237524 - DNA, 18 bp, Homo sapiens
gacatgttatatattttt

SEQ ID NO: 237525 - DNA, 15 bp, Homo sapiens
gacatgttcccttct

SEQ ID NO: 237526 - DNA, 16 bp, Homo sapiens
gacatgttcccttctc

SEQ ID NO: 237527 - DNA, 12 bp, Homo sapiens
gacattaacagt

SEQ ID NO: 237528 - DNA, 23 bp, Homo sapiens
gacattcaccaacaacagtcagc

SEQ ID NO: 237529 - DNA, 15 bp, Homo sapiens
gacattcccctccca

SEQ ID NO: 237530 - DNA, 15 bp, Homo sapiens
gacattgccccaaga

SEQ ID NO: 237531 - DNA, 17 bp, Homo sapiens
gacattttgtagctagt

SEQ ID NO: 237532 - DNA, 21 bp, Homo sapiens
gaccaaaagtgagatgggaag

SEQ ID NO: 237533 - DNA, 21 bp, Homo sapiens
gaccaaaatgacaatgatgat

SEQ ID NO: 237534 - DNA, 17 bp, Homo sapiens
gaccaacccatgccctg

SEQ ID NO: 237535 - DNA, 19 bp, Homo sapiens
gaccaacccatgccctgcc

SEQ ID NO: 237536 - DNA, 19 bp, Homo sapiens
gaccaactgggcccaagac

SEQ ID NO: 237537 - DNA, 15 bp, Homo sapiens
gaccaagaactgcat

SEQ ID NO: 237538 - DNA, 16 bp, Homo sapiens
gaccaagccggtgccc

SEQ ID NO: 237539 - DNA, 22 bp, Homo sapiens
gaccaagcttaaggagaggaga

SEQ ID NO: 237540 - DNA, 20 bp, Homo sapiens
gaccaaggcctcggcagaac

SEQ ID NO: 237541 - DNA, 15 bp, Homo sapiens
gaccaatctctgtga

SEQ ID NO: 237542 - DNA, 17 bp, Homo sapiens
gaccaattgccctgcca

SEQ ID NO: 237543 - DNA, 18 bp, Homo sapiens
gaccaattgccctgccag

SEQ ID NO: 237544 - DNA, 23 bp, Homo sapiens
gaccacaaggctgaaaagtgctt

SEQ ID NO: 237545 - DNA, 23 bp, Homo sapiens
gaccacaccactaaccatcccca

SEQ ID NO: 237546 - DNA, 16 bp, Homo sapiens
gaccacacctgcctct

SEQ ID NO: 237547 - DNA, 17 bp, Homo sapiens
gaccacacttcctgtcc

SEQ ID NO: 237548 - DNA, 18 bp, Homo sapiens
gaccacacttcctgtcca

SEQ ID NO: 237549 - DNA, 21 bp, Homo sapiens
gaccacagctgctggccaggg

SEQ ID NO: 237550 - DNA, 17 bp, Homo sapiens
gaccacagtgggtggca

SEQ ID NO: 237551 - DNA, 22 bp, Homo sapiens
gaccacagtgggtggcacctcc

SEQ ID NO: 237552 - DNA, 16 bp, Homo sapiens
gaccaccagccccagc

SEQ ID NO: 237553 - DNA, 20 bp, Homo sapiens
gaccaccagccccagcaaga

SEQ ID NO: 237554 - DNA, 21 bp, Homo sapiens
gaccaccagccgccccagccc

SEQ ID NO: 237555 - DNA, 24 bp, Homo sapiens
gaccaccttctgtccccagccctg

SEQ ID NO: 237556 - DNA, 20 bp, Homo sapiens
gaccacggacgtttccatca

SEQ ID NO: 237557 - DNA, 14 bp, Homo sapiens
gaccactgggcctg

SEQ ID NO: 237558 - DNA, 14 bp, Homo sapiens
gaccactgttatca

SEQ ID NO: 237559 - DNA, 19 bp, Homo sapiens
gaccagaaaatatgatata

SEQ ID NO: 237560 - DNA, 19 bp, Homo sapiens
gaccagaagtgaatgggaa

SEQ ID NO: 237561 - DNA, 16 bp, Homo sapiens
gaccagagctgtctga

SEQ ID NO: 237562 - DNA, 23 bp, Homo sapiens
gaccagaggtgggaggcccctgg

SEQ ID NO: 237563 - DNA, 17 bp, Homo sapiens
gaccagcactgtctcag

SEQ ID NO: 237564 - DNA, 21 bp, Homo sapiens
gaccagcctccatgctgcctc

SEQ ID NO: 237565 - DNA, 12 bp, Homo sapiens
gaccagcctttc

SEQ ID NO: 237566 - DNA, 14 bp, Homo sapiens
gaccagctgggggg

SEQ ID NO: 237567 - DNA, 23 bp, Homo sapiens
gaccagctggggggcagggggga

SEQ ID NO: 237568 - DNA, 17 bp, Homo sapiens
gaccaggactccctcct

SEQ ID NO: 237569 - DNA, 19 bp, Homo sapiens
gaccaggactccctcctca

SEQ ID NO: 237570 - DNA, 18 bp, Homo sapiens
gaccaggactctgccttc

SEQ ID NO: 237571 - DNA, 14 bp, Homo sapiens
gaccaggagccagg

SEQ ID NO: 237572 - DNA, 20 bp, Homo sapiens
gaccaggctcacaactgttt

SEQ ID NO: 237573 - DNA, 21 bp, Homo sapiens
gaccagtcacagccatttcaa

SEQ ID NO: 237574 - DNA, 22 bp, Homo sapiens
gaccagtggtgccttggaggga

SEQ ID NO: 237575 - DNA, 20 bp, Homo sapiens
gaccagttgggagcactgga

SEQ ID NO: 237576 - DNA, 12 bp, Homo sapiens
gaccagtttacc

SEQ ID NO: 237577 - DNA, 15 bp, Homo sapiens
gaccataatgttaca

SEQ ID NO: 237578 - DNA, 21 bp, Homo sapiens
gaccatccactctaccctccc

SEQ ID NO: 237579 - DNA, 14 bp, Homo sapiens
gaccatcctggccc

SEQ ID NO: 237580 - DNA, 15 bp, Homo sapiens
gaccatcctggcccc

SEQ ID NO: 237581 - DNA, 19 bp, Homo sapiens
gaccatcctggcccctcca

SEQ ID NO: 237582 - DNA, 14 bp, Homo sapiens
gaccatgtgattat

SEQ ID NO: 237583 - DNA, 16 bp, Homo sapiens
gaccattgacctcagc

SEQ ID NO: 237584 - DNA, 17 bp, Homo sapiens
gaccattgacctcagct

SEQ ID NO: 237585 - DNA, 20 bp, Homo sapiens
gaccattgacctcagctgca

SEQ ID NO: 237586 - DNA, 19 bp, Homo sapiens
gaccatttagtcctcacct

SEQ ID NO: 237587 - DNA, 12 bp, Homo sapiens
gacccaataaag

SEQ ID NO: 237588 - DNA, 14 bp, Homo sapiens
gacccaccagtgcc

SEQ ID NO: 237589 - DNA, 21 bp, Homo sapiens
gacccacccatcttcctgctg

SEQ ID NO: 237590 - DNA, 22 bp, Homo sapiens
gacccacccatcttcctgctgc

SEQ ID NO: 237591 - DNA, 12 bp, Homo sapiens
gacccaccccaa

SEQ ID NO: 237592 - DNA, 20 bp, Homo sapiens
gacccaccccaactctcccc

SEQ ID NO: 237593 - DNA, 16 bp, Homo sapiens
gacccactgatctcta

SEQ ID NO: 237594 - DNA, 22 bp, Homo sapiens
gacccagccccttgagaaacct

SEQ ID NO: 237595 - DNA, 23 bp, Homo sapiens
gacccagccccttgagaaacctt

SEQ ID NO: 237596 - DNA, 18 bp, Homo sapiens
gacccagctactctgtcc

SEQ ID NO: 237597 - DNA, 20 bp, Homo sapiens
gacccagctactctgtccag

SEQ ID NO: 237598 - DNA, 18 bp, Homo sapiens
gatggattctcagatatt

SEQ ID NO: 237599 - DNA, 22 bp, Homo sapiens
gatggattctcagatatttata

SEQ ID NO: 237600 - DNA, 15 bp, Homo sapiens
gatggatttgacaca

SEQ ID NO: 237601 - DNA, 19 bp, Homo sapiens
gatggcacctgtggccaga

SEQ ID NO: 237602 - DNA, 21 bp, Homo sapiens
gatggcacttagctatcagaa

SEQ ID NO: 237603 - DNA, 12 bp, Homo sapiens
gatggcagcctc

SEQ ID NO: 237604 - DNA, 13 bp, Homo sapiens
gatggcagcctca

SEQ ID NO: 237605 - DNA, 18 bp, Homo sapiens
gatggcagcctcagggct

SEQ ID NO: 237606 - DNA, 16 bp, Homo sapiens
gatggccaagagcatc

SEQ ID NO: 237607 - DNA, 14 bp, Homo sapiens
gatggccataggag

SEQ ID NO: 237608 - DNA, 14 bp, Homo sapiens
gatggccatgctca

SEQ ID NO: 237609 - DNA, 17 bp, Homo sapiens
gatggcgcgggaggcac

SEQ ID NO: 237610 - DNA, 13 bp, Homo sapiens
gatggctgtgaaa

SEQ ID NO: 237611 - DNA, 18 bp, Homo sapiens
gatggctgtgcctctgcc

SEQ ID NO: 237612 - DNA, 20 bp, Homo sapiens
gatggctgtgcctctgcctg

SEQ ID NO: 237613 - DNA, 21 bp, Homo sapiens
gatgggaacgcagatgatcca

SEQ ID NO: 237614 - DNA, 20 bp, Homo sapiens
gatgggagtgggcacctcag

SEQ ID NO: 237615 - DNA, 12 bp, Homo sapiens
gatgggcacagg

SEQ ID NO: 237616 - DNA, 15 bp, Homo sapiens
gatgggcacaggctg

SEQ ID NO: 237617 - DNA, 19 bp, Homo sapiens
gatgggcacaggctgcccc

SEQ ID NO: 237618 - DNA, 20 bp, Homo sapiens
gatgggcactggaaaacata

SEQ ID NO: 237619 - DNA, 20 bp, Homo sapiens
gatgggcatggggtgggcct

SEQ ID NO: 237620 - DNA, 18 bp, Homo sapiens
gatgggcattgggctgac

SEQ ID NO: 237621 - DNA, 18 bp, Homo sapiens
gatgggcttgttttcttg

SEQ ID NO: 237622 - DNA, 16 bp, Homo sapiens
gatggggagcagctgg

SEQ ID NO: 237623 - DNA, 16 bp, Homo sapiens
gatgggggaactgtga

SEQ ID NO: 237624 - DNA, 15 bp, Homo sapiens
gatgggggatgcttc

SEQ ID NO: 237625 - DNA, 20 bp, Homo sapiens
gatgggggtgcaggcagcct

SEQ ID NO: 237626 - DNA, 23 bp, Homo sapiens
gatggggtctcacagtgttgccc

SEQ ID NO: 237627 - DNA, 21 bp, Homo sapiens
gatgggttctaattttggatg

SEQ ID NO: 237628 - DNA, 23 bp, Homo sapiens
gatgggttctaattttggatgga

SEQ ID NO: 237629 - DNA, 11 bp, Homo sapiens
gatggtcccag

SEQ ID NO: 237630 - DNA, 15 bp, Homo sapiens
gatggtcccaggaag

SEQ ID NO: 237631 - DNA, 17 bp, Homo sapiens
gatggtcctcacaagcc

SEQ ID NO: 237632 - DNA, 24 bp, Homo sapiens
gatggtctccatatcagctctctg

SEQ ID NO: 237633 - DNA, 14 bp, Homo sapiens
gatggtgccccctg

SEQ ID NO: 237634 - DNA, 12 bp, Homo sapiens
gatggtgctgag

SEQ ID NO: 237635 - DNA, 14 bp, Homo sapiens
gatggtgctgagaa

SEQ ID NO: 237636 - DNA, 17 bp, Homo sapiens
gatggtgctgagaagct

SEQ ID NO: 237637 - DNA, 15 bp, Homo sapiens
gatgtaaaacagaat

SEQ ID NO: 237638 - DNA, 13 bp, Homo sapiens
gatgtaaaatctt

SEQ ID NO: 237639 - DNA, 16 bp, Homo sapiens
gatgtaaaatcttgtc

SEQ ID NO: 237640 - DNA, 14 bp, Homo sapiens
gatgtaagaagccc

SEQ ID NO: 237641 - DNA, 20 bp, Homo sapiens
gatgtaatatagggtttgtt

SEQ ID NO: 237642 - DNA, 19 bp, Homo sapiens
gatgtaatgacagagagtt

SEQ ID NO: 237643 - DNA, 16 bp, Homo sapiens
gatgtacagtctgtca

SEQ ID NO: 237644 - DNA, 13 bp, Homo sapiens
gatgtaggagctg

SEQ ID NO: 237645 - DNA, 14 bp, Homo sapiens
gatgtaggagctgg

SEQ ID NO: 237646 - DNA, 16 bp, Homo sapiens
gatgtaggctccacct

SEQ ID NO: 237647 - DNA, 15 bp, Homo sapiens
gatgtagtctgaggc

SEQ ID NO: 237648 - DNA, 13 bp, Homo sapiens
gatgtatgcccaa

SEQ ID NO: 237649 - DNA, 16 bp, Homo sapiens
gatgtatgcccaaaga

SEQ ID NO: 237650 - DNA, 20 bp, Homo sapiens
gatgtattaacctacctgtg

SEQ ID NO: 237651 - DNA, 20 bp, Homo sapiens
gatgtattagtagagcaacc

SEQ ID NO: 237652 - DNA, 18 bp, Homo sapiens
gatgtcaaccttgtgtga

SEQ ID NO: 237653 - DNA, 23 bp, Homo sapiens
gatgtcaaccttgtgtgagtgtg

SEQ ID NO: 237654 - DNA, 20 bp, Homo sapiens
gatgtcaatgctatggactg

SEQ ID NO: 237655 - DNA, 15 bp, Homo sapiens
gatgtcaccaagaag

SEQ ID NO: 237656 - DNA, 12 bp, Homo sapiens
gatgtcagcctt

SEQ ID NO: 237657 - DNA, 13 bp, Homo sapiens
gatgtcatcttga

SEQ ID NO: 237658 - DNA, 14 bp, Homo sapiens
gatgtcatcttgag

SEQ ID NO: 237659 - DNA, 16 bp, Homo sapiens
gatgtcatcttgagct

SEQ ID NO: 237660 - DNA, 17 bp, Homo sapiens
gatgtcccaacttgtaa

SEQ ID NO: 237661 - DNA, 21 bp, Homo sapiens
gatgtcccccaggggcccagg

SEQ ID NO: 237662 - DNA, 16 bp, Homo sapiens
gatgtcccctgtccca

SEQ ID NO: 237663 - DNA, 22 bp, Homo sapiens
gatgtcctctttactcccttcc

SEQ ID NO: 237664 - DNA, 18 bp, Homo sapiens
gatgtcgttcattttctg

SEQ ID NO: 237665 - DNA, 13 bp, Homo sapiens
gatgtctcttgta

SEQ ID NO: 237666 - DNA, 13 bp, Homo sapiens
gatgtctgagaga

SEQ ID NO: 237667 - DNA, 22 bp, Homo sapiens
gatgtcttccttggagggggga

SEQ ID NO: 237668 - DNA, 14 bp, Homo sapiens
gatgtcttctgcct

SEQ ID NO: 237669 - DNA, 23 bp, Homo sapiens
gatgtgaaaaagcctaagaaaaa

SEQ ID NO: 237670 - DNA, 20 bp, Homo sapiens
gatgtgaagataatttgcat

SEQ ID NO: 237671 - DNA, 19 bp, Homo sapiens
gatgtgacccaccagtgcc

SEQ ID NO: 237672 - DNA, 18 bp, Homo sapiens
gatgtgatggaacacaca

SEQ ID NO: 237673 - DNA, 22 bp, Homo sapiens
gatgtgcatttcacctgtgaca

SEQ ID NO: 237674 - DNA, 23 bp, Homo sapiens
gatgtgcatttttgtgaaatgaa

SEQ ID NO: 237675 - DNA, 16 bp, Homo sapiens
gatgtgccagaacttc

SEQ ID NO: 237676 - DNA, 21 bp, Homo sapiens
gatgtgcccagagtagcccag

SEQ ID NO: 237677 - DNA, 18 bp, Homo sapiens
gatgtgcgtgctgtctgt

SEQ ID NO: 237678 - DNA, 12 bp, Homo sapiens
gatgtggagcac

SEQ ID NO: 237679 - DNA, 24 bp, Homo sapiens
gatgtggagcacaaaagcctctca

SEQ ID NO: 237680 - DNA, 17 bp, Homo sapiens
gatgtggagctcctgct

SEQ ID NO: 237681 - DNA, 15 bp, Homo sapiens
gatgtggtgcctgag

SEQ ID NO: 237682 - DNA, 20 bp, Homo sapiens
gatgtggtgcctgaggtctg

SEQ ID NO: 237683 - DNA, 15 bp, Homo sapiens
gatgtgtatgtgttt

SEQ ID NO: 237684 - DNA, 13 bp, Homo sapiens
gatgtgtttttgt

SEQ ID NO: 237685 - DNA, 19 bp, Homo sapiens
gatgttcagcactgtccct

SEQ ID NO: 237686 - DNA, 20 bp, Homo sapiens
gatgttcagcactgtccctt

SEQ ID NO: 237687 - DNA, 18 bp, Homo sapiens
gatgttctggacctcccc

SEQ ID NO: 237688 - DNA, 18 bp, Homo sapiens
gatgttgaagaatacagt

SEQ ID NO: 237689 - DNA, 14 bp, Homo sapiens
gatgtttagtagct

SEQ ID NO: 237690 - DNA, 13 bp, Homo sapiens
gatgtttccagct

SEQ ID NO: 237691 - DNA, 12 bp, Homo sapiens
gatgtttcttct

SEQ ID NO: 237692 - DNA, 22 bp, Homo sapiens
gatgtttgttttcaaaatactt

SEQ ID NO: 237693 - DNA, 14 bp, Homo sapiens
gattaaacacctga

SEQ ID NO: 237694 - DNA, 13 bp, Homo sapiens
gattaaatggcac

SEQ ID NO: 237695 - DNA, 22 bp, Homo sapiens
gattaaatttaatatactgcat

SEQ ID NO: 237696 - DNA, 15 bp, Homo sapiens
gagggagtacaaaga

SEQ ID NO: 237697 - DNA, 18 bp, Homo sapiens
gagggagtacaaagacag

SEQ ID NO: 237698 - DNA, 13 bp, Homo sapiens
gagggagtgcaga

SEQ ID NO: 237699 - DNA, 21 bp, Homo sapiens
gagggagtgcagaacacctgg

SEQ ID NO: 237700 - DNA, 16 bp, Homo sapiens
gagggatctaggtctt

SEQ ID NO: 237701 - DNA, 19 bp, Homo sapiens
gagggattggccgcttggc

SEQ ID NO: 237702 - DNA, 22 bp, Homo sapiens
gagggcagaaaccttgtttgtt

SEQ ID NO: 237703 - DNA, 14 bp, Homo sapiens
gagggcagagccat

SEQ ID NO: 237704 - DNA, 17 bp, Homo sapiens
gagggcagagccatggg

SEQ ID NO: 237705 - DNA, 22 bp, Homo sapiens
gagggcagagccatgggcctgg

SEQ ID NO: 237706 - DNA, 17 bp, Homo sapiens
gagggcagtggggagca

SEQ ID NO: 237707 - DNA, 23 bp, Homo sapiens
gagggcatgtgatattttcacat

SEQ ID NO: 237708 - DNA, 13 bp, Homo sapiens
gagggcccagctg

SEQ ID NO: 237709 - DNA, 14 bp, Homo sapiens
gagggcccagctgt

SEQ ID NO: 237710 - DNA, 20 bp, Homo sapiens
gagggcccagctgtagccat

SEQ ID NO: 237711 - DNA, 18 bp, Homo sapiens
gagggcccctctgcccag

SEQ ID NO: 237712 - DNA, 13 bp, Homo sapiens
gagggcccctgcg

SEQ ID NO: 237713 - DNA, 19 bp, Homo sapiens
gagggcccctgcgtggggg

SEQ ID NO: 237714 - DNA, 13 bp, Homo sapiens
gagggcctcagag

SEQ ID NO: 237715 - DNA, 18 bp, Homo sapiens
gagggcctcagagacagc

SEQ ID NO: 237716 - DNA, 19 bp, Homo sapiens
gagggcctgtgggagcctg

SEQ ID NO: 237717 - DNA, 13 bp, Homo sapiens
gagggcgaggcgg

SEQ ID NO: 237718 - DNA, 14 bp, Homo sapiens
gagggcgaggcggg

SEQ ID NO: 237719 - DNA, 18 bp, Homo sapiens
gagggcgcccattcgtct

SEQ ID NO: 237720 - DNA, 15 bp, Homo sapiens
gagggcggccaggga

SEQ ID NO: 237721 - DNA, 17 bp, Homo sapiens
gagggctgagagggctg

SEQ ID NO: 237722 - DNA, 21 bp, Homo sapiens
gagggctgagagggctgtggc

SEQ ID NO: 237723 - DNA, 14 bp, Homo sapiens
gagggctgagcccc

SEQ ID NO: 237724 - DNA, 17 bp, Homo sapiens
gagggcttccctagatg

SEQ ID NO: 237725 - DNA, 16 bp, Homo sapiens
gaggggaagctgcagc

SEQ ID NO: 237726 - DNA, 14 bp, Homo sapiens
gaggggactgcatg

SEQ ID NO: 237727 - DNA, 21 bp, Homo sapiens
gaggggactgcatgcaagctc

SEQ ID NO: 237728 - DNA, 13 bp, Homo sapiens
gaggggagaggaa

SEQ ID NO: 237729 - DNA, 13 bp, Homo sapiens
gaggggaggtggc

SEQ ID NO: 237730 - DNA, 19 bp, Homo sapiens
gaggggcatggccagcagc

SEQ ID NO: 237731 - DNA, 16 bp, Homo sapiens
gaggggcctagggagc

SEQ ID NO: 237732 - DNA, 16 bp, Homo sapiens
gaggggcctctggctg

SEQ ID NO: 237733 - DNA, 14 bp, Homo sapiens
gaggggcctggcag

SEQ ID NO: 237734 - DNA, 20 bp, Homo sapiens
gaggggcctggcagccgtgc

SEQ ID NO: 237735 - DNA, 15 bp, Homo sapiens
gaggggcctggcctg

SEQ ID NO: 237736 - DNA, 16 bp, Homo sapiens
gaggggcctggcctgg

SEQ ID NO: 237737 - DNA, 20 bp, Homo sapiens
gaggggcggggccaggatgg

SEQ ID NO: 237738 - DNA, 16 bp, Homo sapiens
gaggggctgagtctgg

SEQ ID NO: 237739 - DNA, 15 bp, Homo sapiens
gaggggcttggagca

SEQ ID NO: 237740 - DNA, 16 bp, Homo sapiens
gaggggcttggagcag

SEQ ID NO: 237741 - DNA, 20 bp, Homo sapiens
gagggggccacctccccagg

SEQ ID NO: 237742 - DNA, 20 bp, Homo sapiens
gagggggcgctcaggaccca

SEQ ID NO: 237743 - DNA, 15 bp, Homo sapiens
gaggggtgcacccac

SEQ ID NO: 237744 - DNA, 13 bp, Homo sapiens
gaggggtgctgcc

SEQ ID NO: 237745 - DNA, 24 bp, Homo sapiens
gagggtcattttcctttctgtatt

SEQ ID NO: 237746 - DNA, 18 bp, Homo sapiens
gagggtccctaattctct

SEQ ID NO: 237747 - DNA, 19 bp, Homo sapiens
gagggtccctaattctctt

SEQ ID NO: 237748 - DNA, 15 bp, Homo sapiens
gagggtcctggctcc

SEQ ID NO: 237749 - DNA, 17 bp, Homo sapiens
gagggtcctggctcctg

SEQ ID NO: 237750 - DNA, 21 bp, Homo sapiens
gagggtcctggctcctgaggg

SEQ ID NO: 237751 - DNA, 13 bp, Homo sapiens
gagggtggagact

SEQ ID NO: 237752 - DNA, 20 bp, Homo sapiens
gagggtggagactaagccct

SEQ ID NO: 237753 - DNA, 14 bp, Homo sapiens
gagggtggaggaag

SEQ ID NO: 237754 - DNA, 14 bp, Homo sapiens
gagggttccaggct

SEQ ID NO: 237755 - DNA, 12 bp, Homo sapiens
gagggttcctgt

SEQ ID NO: 237756 - DNA, 17 bp, Homo sapiens
gagggttggggaggggc

SEQ ID NO: 237757 - DNA, 18 bp, Homo sapiens
gagggttgttctcctaga

SEQ ID NO: 237758 - DNA, 12 bp, Homo sapiens
gagggtttccac

SEQ ID NO: 237759 - DNA, 18 bp, Homo sapiens
gaggtaaaagagccaagt

SEQ ID NO: 237760 - DNA, 14 bp, Homo sapiens
gaggtagcgagctg

SEQ ID NO: 237761 - DNA, 19 bp, Homo sapiens
gaggtagcgagctgctctg

SEQ ID NO: 237762 - DNA, 18 bp, Homo sapiens
gaggtagctacacagcat

SEQ ID NO: 237763 - DNA, 17 bp, Homo sapiens
gaggtcaagcccaggag

SEQ ID NO: 237764 - DNA, 19 bp, Homo sapiens
gaggtcaagcccaggagga

SEQ ID NO: 237765 - DNA, 14 bp, Homo sapiens
gaggtcaggccctg

SEQ ID NO: 237766 - DNA, 15 bp, Homo sapiens
gaggtcaggccctgg

SEQ ID NO: 237767 - DNA, 22 bp, Homo sapiens
gaggtcatcccggggccatgga

SEQ ID NO: 237768 - DNA, 24 bp, Homo sapiens
gaggtcatcccggggccatggaag

SEQ ID NO: 237769 - DNA, 13 bp, Homo sapiens
gaggtcccaggaa

SEQ ID NO: 237770 - DNA, 14 bp, Homo sapiens
gaggtcccaggaag

SEQ ID NO: 237771 - DNA, 21 bp, Homo sapiens
gaggtctcaggttctttccat

SEQ ID NO: 237772 - DNA, 14 bp, Homo sapiens
gaggtctcttgagg

SEQ ID NO: 237773 - DNA, 15 bp, Homo sapiens
gaggtctcttgaggg

SEQ ID NO: 237774 - DNA, 17 bp, Homo sapiens
gaggtctcttgagggag

SEQ ID NO: 237775 - DNA, 19 bp, Homo sapiens
gaggtctgctcggccgtct

SEQ ID NO: 237776 - DNA, 19 bp, Homo sapiens
gaggtcttttgacatgtgg

SEQ ID NO: 237777 - DNA, 14 bp, Homo sapiens
gaggtgcctgagag

SEQ ID NO: 237778 - DNA, 16 bp, Homo sapiens
gaggtgctgggaggga

SEQ ID NO: 237779 - DNA, 21 bp, Homo sapiens
gaggtgggaggcccctggtgg

SEQ ID NO: 237780 - DNA, 23 bp, Homo sapiens
gaggtgggaggcccctggtggca

SEQ ID NO: 237781 - DNA, 16 bp, Homo sapiens
gaggtgggatatccct

SEQ ID NO: 237782 - DNA, 17 bp, Homo sapiens
gaggtgggcagatcatt

SEQ ID NO: 237783 - DNA, 15 bp, Homo sapiens
gaggtgggcagctgg

SEQ ID NO: 237784 - DNA, 20 bp, Homo sapiens
gaggtgggcatgccaccctc

SEQ ID NO: 237785 - DNA, 17 bp, Homo sapiens
gaggtgggccacaccca

SEQ ID NO: 237786 - DNA, 23 bp, Homo sapiens
gaggtgggccacacccaggaagg

SEQ ID NO: 237787 - DNA, 16 bp, Homo sapiens
cctgtgcagcagccca

SEQ ID NO: 237788 - DNA, 19 bp, Homo sapiens
cctgtgcagcagcccagct

SEQ ID NO: 237789 - DNA, 20 bp, Homo sapiens
cctgtgcagcagcccagctt

SEQ ID NO: 237790 - DNA, 20 bp, Homo sapiens
cctgtgccaacctgatgccc

SEQ ID NO: 237791 - DNA, 19 bp, Homo sapiens
cctgtgccacccaccaggg

SEQ ID NO: 237792 - DNA, 15 bp, Homo sapiens
cctgtgccaggctga

SEQ ID NO: 237793 - DNA, 14 bp, Homo sapiens
cctgtgcccaccca

SEQ ID NO: 237794 - DNA, 15 bp, Homo sapiens
cctgtgcccacccag

SEQ ID NO: 237795 - DNA, 18 bp, Homo sapiens
cctgtgcccacccagggc

SEQ ID NO: 237796 - DNA, 22 bp, Homo sapiens
cctgtgcccatcatctctgcct

SEQ ID NO: 237797 - DNA, 19 bp, Homo sapiens
cctgtgcccttgctgggtc

SEQ ID NO: 237798 - DNA, 15 bp, Homo sapiens
cctgtgcgttccctt

SEQ ID NO: 237799 - DNA, 17 bp, Homo sapiens
cctgtgctacctctaac

SEQ ID NO: 237800 - DNA, 15 bp, Homo sapiens
cctgtgctgaggact

SEQ ID NO: 237801 - DNA, 17 bp, Homo sapiens
cctgtgctgaggactcc

SEQ ID NO: 237802 - DNA, 21 bp, Homo sapiens
cctgtgctgaggactccctcc

SEQ ID NO: 237803 - DNA, 16 bp, Homo sapiens
cctgtgctgctgcacc

SEQ ID NO: 237804 - DNA, 16 bp, Homo sapiens
cctgtgctttctgcat

SEQ ID NO: 237805 - DNA, 16 bp, Homo sapiens
cctgtggaagggacta

SEQ ID NO: 237806 - DNA, 19 bp, Homo sapiens
cctgtggaagggactagga

SEQ ID NO: 237807 - DNA, 15 bp, Homo sapiens
cctgtggagcccgca

SEQ ID NO: 237808 - DNA, 17 bp, Homo sapiens
cctgtggagcccgcacc

SEQ ID NO: 237809 - DNA, 16 bp, Homo sapiens
cctgtggcagaaaaga

SEQ ID NO: 237810 - DNA, 23 bp, Homo sapiens
cctgtggcatctttgccttgggc

SEQ ID NO: 237811 - DNA, 16 bp, Homo sapiens
cctgtggccagagcac

SEQ ID NO: 237812 - DNA, 21 bp, Homo sapiens
cctgtggccagagcacctcag

SEQ ID NO: 237813 - DNA, 23 bp, Homo sapiens
cctgtggccagagcacctcagga

SEQ ID NO: 237814 - DNA, 14 bp, Homo sapiens
cctgtggccaggag

SEQ ID NO: 237815 - DNA, 19 bp, Homo sapiens
cctgtggccttgcccgcca

SEQ ID NO: 237816 - DNA, 23 bp, Homo sapiens
cctgtggctctacaactgagtcc

SEQ ID NO: 237817 - DNA, 15 bp, Homo sapiens
cctgtgggagaaggg

SEQ ID NO: 237818 - DNA, 15 bp, Homo sapiens
cctgtgggagcctgc

SEQ ID NO: 237819 - DNA, 16 bp, Homo sapiens
cctgtgggagtccact

SEQ ID NO: 237820 - DNA, 14 bp, Homo sapiens
cctgtggggcctga

SEQ ID NO: 237821 - DNA, 17 bp, Homo sapiens
cctgtggggcctgatgg

SEQ ID NO: 237822 - DNA, 22 bp, Homo sapiens
cctgtgggtccccactcacccc

SEQ ID NO: 237823 - DNA, 15 bp, Homo sapiens
cctgtggtaccctgg

SEQ ID NO: 237824 - DNA, 19 bp, Homo sapiens
cctgtggtaccctggcaga

SEQ ID NO: 237825 - DNA, 20 bp, Homo sapiens
cctgtggtaccctggcagag

SEQ ID NO: 237826 - DNA, 22 bp, Homo sapiens
cctgtggtgaagtgtggctggt

SEQ ID NO: 237827 - DNA, 16 bp, Homo sapiens
cctgtggtgatgtgcc

SEQ ID NO: 237828 - DNA, 15 bp, Homo sapiens
cctgtggttacagtg

SEQ ID NO: 237829 - DNA, 22 bp, Homo sapiens
cctgtggttacagtgcagacag

SEQ ID NO: 237830 - DNA, 12 bp, Homo sapiens
gaccttctggga

SEQ ID NO: 237831 - DNA, 14 bp, Homo sapiens
gaccttcttccaca

SEQ ID NO: 237832 - DNA, 20 bp, Homo sapiens
gaccttgatgtcttgagagc

SEQ ID NO: 237833 - DNA, 16 bp, Homo sapiens
gaccttgcaacttcat

SEQ ID NO: 237834 - DNA, 16 bp, Homo sapiens
gaccttggtggtggga

SEQ ID NO: 237835 - DNA, 20 bp, Homo sapiens
gaccttgttgttgttaaata

SEQ ID NO: 237836 - DNA, 11 bp, Homo sapiens
gacctttattt

SEQ ID NO: 237837 - DNA, 20 bp, Homo sapiens
gatagctacccacagagcaa

SEQ ID NO: 237838 - DNA, 13 bp, Homo sapiens
gatagctccttca

SEQ ID NO: 237839 - DNA, 17 bp, Homo sapiens
gataggagacttgtaca

SEQ ID NO: 237840 - DNA, 16 bp, Homo sapiens
gataggagcttccaga

SEQ ID NO: 237841 - DNA, 17 bp, Homo sapiens
gataggagcttccagat

SEQ ID NO: 237842 - DNA, 22 bp, Homo sapiens
gataggcccaaggtcccctcca

SEQ ID NO: 237843 - DNA, 14 bp, Homo sapiens
gataggctctgcac

SEQ ID NO: 237844 - DNA, 17 bp, Homo sapiens
gataggctctgcacaga

SEQ ID NO: 237845 - DNA, 15 bp, Homo sapiens
gatagtaacaatgaa

SEQ ID NO: 237846 - DNA, 14 bp, Homo sapiens
gatagtagatctgt

SEQ ID NO: 237847 - DNA, 19 bp, Homo sapiens
gatcctggagcccctgtgt

SEQ ID NO: 237848 - DNA, 14 bp, Homo sapiens
gatcgcttgagccc

SEQ ID NO: 237849 - DNA, 18 bp, Homo sapiens
gatcgcttgagcccagga

SEQ ID NO: 237850 - DNA, 17 bp, Homo sapiens
gatcggagcctcctctc

SEQ ID NO: 237851 - DNA, 20 bp, Homo sapiens
gatcggagcctcctctctca

SEQ ID NO: 237852 - DNA, 17 bp, Homo sapiens
gatcggggtggcagaaa

SEQ ID NO: 237853 - DNA, 23 bp, Homo sapiens
gatcgttctgccacttgcactgt

SEQ ID NO: 237854 - DNA, 19 bp, Homo sapiens
gatctaaaaggaggacagg

SEQ ID NO: 237855 - DNA, 20 bp, Homo sapiens
gatctaaaaggaggacaggg

SEQ ID NO: 237856 - DNA, 16 bp, Homo sapiens
gatctaaaccagtcct

SEQ ID NO: 237857 - DNA, 17 bp, Homo sapiens
gatctaagcctttccat

SEQ ID NO: 237858 - DNA, 17 bp, Homo sapiens
gatctacttcatagctc

SEQ ID NO: 237859 - DNA, 13 bp, Homo sapiens
gatctagccaggc

SEQ ID NO: 237860 - DNA, 14 bp, Homo sapiens
gatctagccaggcc

SEQ ID NO: 237861 - DNA, 16 bp, Homo sapiens
gatctagccaggcctc

SEQ ID NO: 237862 - DNA, 14 bp, Homo sapiens
gatctaggtttaac

SEQ ID NO: 237863 - DNA, 20 bp, Homo sapiens
gatctaggtttaactcagat

SEQ ID NO: 237864 - DNA, 22 bp, Homo sapiens
gatctaggtttaactcagatca

SEQ ID NO: 237865 - DNA, 15 bp, Homo sapiens
gatctatcacctgtc

SEQ ID NO: 237866 - DNA, 16 bp, Homo sapiens
gatctatcacctgtca

SEQ ID NO: 237867 - DNA, 18 bp, Homo sapiens
gatctattactctgacat

SEQ ID NO: 237868 - DNA, 17 bp, Homo sapiens
gatctcagctcactgca

SEQ ID NO: 237869 - DNA, 19 bp, Homo sapiens
gatctcagctcactgcaag

SEQ ID NO: 237870 - DNA, 14 bp, Homo sapiens
gcacacacagctcc

SEQ ID NO: 237871 - DNA, 16 bp, Homo sapiens
gcacacacagctcctc

SEQ ID NO: 237872 - DNA, 15 bp, Homo sapiens
gcacacacctgcctg

SEQ ID NO: 237873 - DNA, 15 bp, Homo sapiens
gcacacactcagtgc

SEQ ID NO: 237874 - DNA, 14 bp, Homo sapiens
gcacacataacaca

SEQ ID NO: 237875 - DNA, 17 bp, Homo sapiens
gcacacataacacacat

SEQ ID NO: 237876 - DNA, 17 bp, Homo sapiens
gcacaccactgccctgc

SEQ ID NO: 237877 - DNA, 18 bp, Homo sapiens
gcacaccactgccctgcc

SEQ ID NO: 237878 - DNA, 22 bp, Homo sapiens
gcacaccactgccctgcctgcc

SEQ ID NO: 237879 - DNA, 14 bp, Homo sapiens
gcacaccagttact

SEQ ID NO: 237880 - DNA, 23 bp, Homo sapiens
gcacaccctcactctgccagggc

SEQ ID NO: 237881 - DNA, 17 bp, Homo sapiens
gcacactgagtttgaac

SEQ ID NO: 237882 - DNA, 12 bp, Homo sapiens
gcacacttcccc

SEQ ID NO: 237883 - DNA, 19 bp, Homo sapiens
gcacacttccccttgggat

SEQ ID NO: 237884 - DNA, 20 bp, Homo sapiens
gcacagacatctcctcaccc

SEQ ID NO: 237885 - DNA, 15 bp, Homo sapiens
gcacagactgttccc

SEQ ID NO: 237886 - DNA, 23 bp, Homo sapiens
gcacagacttccaccatgtgcat

SEQ ID NO: 237887 - DNA, 14 bp, Homo sapiens
gcacagacttctgg

SEQ ID NO: 237888 - DNA, 18 bp, Homo sapiens
gcacagacttctggaagg

SEQ ID NO: 237889 - DNA, 19 bp, Homo sapiens
gcacagacttctggaaggc

SEQ ID NO: 237890 - DNA, 21 bp, Homo sapiens
gcacagacttctggaaggctg

SEQ ID NO: 237891 - DNA, 23 bp, Homo sapiens
gcacagagagggggccacctccc

SEQ ID NO: 237892 - DNA, 19 bp, Homo sapiens
gcacagagtcgatgctcaa

SEQ ID NO: 237893 - DNA, 17 bp, Homo sapiens
gcacagatacacataca

SEQ ID NO: 237894 - DNA, 24 bp, Homo sapiens
gcacagatggatttgcctgtgcca

SEQ ID NO: 237895 - DNA, 14 bp, Homo sapiens
gcacagcagcctgc

SEQ ID NO: 237896 - DNA, 21 bp, Homo sapiens
gcacagcaggtttatccagat

SEQ ID NO: 237897 - DNA, 22 bp, Homo sapiens
gcacagcccaaccaggaggggt

SEQ ID NO: 237898 - DNA, 11 bp, Homo sapiens
gcacagccctg

SEQ ID NO: 237899 - DNA, 21 bp, Homo sapiens
gcacagcggggccccagggct

SEQ ID NO: 237900 - DNA, 13 bp, Homo sapiens
gcacagctctcac

SEQ ID NO: 237901 - DNA, 15 bp, Homo sapiens
gcacaggcaacatta

SEQ ID NO: 237902 - DNA, 18 bp, Homo sapiens
gcacaggcaacattacaa

SEQ ID NO: 237903 - DNA, 12 bp, Homo sapiens
gcacaggcaggg

SEQ ID NO: 237904 - DNA, 19 bp, Homo sapiens
gcacaggccacttgctcag

SEQ ID NO: 237905 - DNA, 15 bp, Homo sapiens
gcacaggctcctgta

SEQ ID NO: 237906 - DNA, 13 bp, Homo sapiens
gcacaggctgccc

SEQ ID NO: 237907 - DNA, 16 bp, Homo sapiens
gcacagggcagtggga

SEQ ID NO: 237908 - DNA, 12 bp, Homo sapiens
gcacaggggccc

SEQ ID NO: 237909 - DNA, 15 bp, Homo sapiens
gcacaggggccccag

SEQ ID NO: 237910 - DNA, 18 bp, Homo sapiens
gcacagtgcatctcagcc

SEQ ID NO: 237911 - DNA, 20 bp, Homo sapiens
gcacagtgcatctcagccca

SEQ ID NO: 237912 - DNA, 17 bp, Homo sapiens
gcacagtgttaaatgaa

SEQ ID NO: 237913 - DNA, 23 bp, Homo sapiens
gcacagttgtctattctgagcct

SEQ ID NO: 237914 - DNA, 23 bp, Homo sapiens
gcacagtttgctatttgctttag

SEQ ID NO: 237915 - DNA, 21 bp, Homo sapiens
gcacatagctatcaagtgtgc

SEQ ID NO: 237916 - DNA, 18 bp, Homo sapiens
gcacatatattttttaca

SEQ ID NO: 237917 - DNA, 19 bp, Homo sapiens
gcacatatattttttacaa

SEQ ID NO: 237918 - DNA, 17 bp, Homo sapiens
gcacatatcaagaagtc

SEQ ID NO: 237919 - DNA, 19 bp, Homo sapiens
gcacatctaaattgatcat

SEQ ID NO: 237920 - DNA, 13 bp, Homo sapiens
gcacatctctgct

SEQ ID NO: 237921 - DNA, 21 bp, Homo sapiens
gcacatctgcattttcacccc

SEQ ID NO: 237922 - DNA, 22 bp, Homo sapiens
gcacatgacatttgtcctgcag

SEQ ID NO: 237923 - DNA, 23 bp, Homo sapiens
gcacatgcggcttccgagggcac

SEQ ID NO: 237924 - DNA, 16 bp, Homo sapiens
gcacatgctggccagc

SEQ ID NO: 237925 - DNA, 21 bp, Homo sapiens
gcacattaggaacagagtata

SEQ ID NO: 237926 - DNA, 15 bp, Homo sapiens
gcacattcctggccc

SEQ ID NO: 237927 - DNA, 18 bp, Homo sapiens
gcacattgttgttttttt

SEQ ID NO: 237928 - DNA, 16 bp, Homo sapiens
gcacatttcctctcta

SEQ ID NO: 237929 - DNA, 20 bp, Homo sapiens
gcacatttgtgcataaattt

SEQ ID NO: 237930 - DNA, 22 bp, Homo sapiens
gcacattttccacggaaacaga

SEQ ID NO: 237931 - DNA, 18 bp, Homo sapiens
gcacattttgacacaatg

SEQ ID NO: 237932 - DNA, 19 bp, Homo sapiens
gcaccaacctcactgccct

SEQ ID NO: 237933 - DNA, 17 bp, Homo sapiens
gcaccaagagccaatgg

SEQ ID NO: 237934 - DNA, 16 bp, Homo sapiens
gcaccaagcccacagg

SEQ ID NO: 237935 - DNA, 20 bp, Homo sapiens
gcaccaccagccagcgcagg

SEQ ID NO: 237936 - DNA, 20 bp, Homo sapiens
gcaccaccctagtcccttcc

SEQ ID NO: 237937 - DNA, 22 bp, Homo sapiens
gcaccagagtgaaagggctatg

SEQ ID NO: 237938 - DNA, 23 bp, Homo sapiens
gcaccagagtgaaagggctatgg

SEQ ID NO: 237939 - DNA, 17 bp, Homo sapiens
gcaccagcccttccctg

SEQ ID NO: 237940 - DNA, 17 bp, Homo sapiens
gcaccagccggggaaga

SEQ ID NO: 237941 - DNA, 14 bp, Homo sapiens
gcaccagcctgagc

SEQ ID NO: 237942 - DNA, 16 bp, Homo sapiens
gcaccagcctgagcca

SEQ ID NO: 237943 - DNA, 17 bp, Homo sapiens
gcaccagcctgagccac

SEQ ID NO: 237944 - DNA, 13 bp, Homo sapiens
gcaccagctctgt

SEQ ID NO: 237945 - DNA, 20 bp, Homo sapiens
gcaccagctctgtggcctgt

SEQ ID NO: 237946 - DNA, 14 bp, Homo sapiens
gcaccagctgctct

SEQ ID NO: 237947 - DNA, 17 bp, Homo sapiens
gcaccagctgctctgcc

SEQ ID NO: 237948 - DNA, 18 bp, Homo sapiens
gcaccagctgctctgccc

SEQ ID NO: 237949 - DNA, 13 bp, Homo sapiens
gcaccaggagaca

SEQ ID NO: 237950 - DNA, 23 bp, Homo sapiens
gcaccatagaagaacagcagatg

SEQ ID NO: 237951 - DNA, 20 bp, Homo sapiens
gcaccatcacaatacagata

SEQ ID NO: 237952 - DNA, 17 bp, Homo sapiens
gcaccatctctcctcct

SEQ ID NO: 237953 - DNA, 22 bp, Homo sapiens
gcaccattcaggaacctggacc

SEQ ID NO: 237954 - DNA, 19 bp, Homo sapiens
gcacccacccagcacccag

SEQ ID NO: 237955 - DNA, 22 bp, Homo sapiens
gcacccacccagcacccagcaa

SEQ ID NO: 237956 - DNA, 14 bp, Homo sapiens
gcacccacctccac

SEQ ID NO: 237957 - DNA, 15 bp, Homo sapiens
gcacccactcaccag

SEQ ID NO: 237958 - DNA, 19 bp, Homo sapiens
gcacccactcaccagggtc

SEQ ID NO: 237959 - DNA, 17 bp, Homo sapiens
gcaccccaaagctttcc

SEQ ID NO: 237960 - DNA, 13 bp, Homo sapiens
gcaccccaaggct

SEQ ID NO: 237961 - DNA, 15 bp, Homo sapiens
gcaccccaagtccag

SEQ ID NO: 237962 - DNA, 19 bp, Homo sapiens
gcaccccagcattccagct

SEQ ID NO: 237963 - DNA, 13 bp, Homo sapiens
gcacccccaccca

SEQ ID NO: 237964 - DNA, 14 bp, Homo sapiens
gcacccccacccac

SEQ ID NO: 237965 - DNA, 16 bp, Homo sapiens
gcacccccacccacct

SEQ ID NO: 237966 - DNA, 18 bp, Homo sapiens
gcacccccaccctttggg

SEQ ID NO: 237967 - DNA, 11 bp, Homo sapiens
gcacccccagc

SEQ ID NO: 237968 - DNA, 12 bp, Homo sapiens
gcacccccagcc

SEQ ID NO: 237969 - DNA, 13 bp, Homo sapiens
gcacccccagcct

SEQ ID NO: 237970 - DNA, 16 bp, Homo sapiens
gcacccccagcctccc

SEQ ID NO: 237971 - DNA, 18 bp, Homo sapiens
gcaccccgatgtggacct

SEQ ID NO: 237972 - DNA, 23 bp, Homo sapiens
gcacccggcagccccccagtgtc

SEQ ID NO: 237973 - DNA, 14 bp, Homo sapiens
gcaccctggggcct

SEQ ID NO: 237974 - DNA, 15 bp, Homo sapiens
gcaccctgggtgcca

SEQ ID NO: 237975 - DNA, 14 bp, Homo sapiens
gcaccgcagcatgt

SEQ ID NO: 237976 - DNA, 17 bp, Homo sapiens
gcaccgcagcatgtggg

SEQ ID NO: 237977 - DNA, 21 bp, Homo sapiens
gcaccgcccaacccccacctc

SEQ ID NO: 237978 - DNA, 13 bp, Homo sapiens
gcaccgcccaccc

SEQ ID NO: 237979 - DNA, 15 bp, Homo sapiens
gcaccggcgctgcag

SEQ ID NO: 237980 - DNA, 14 bp, Homo sapiens
gcatgtgtgcctgt

SEQ ID NO: 237981 - DNA, 16 bp, Homo sapiens
gcatgtgtgcctgtgg

SEQ ID NO: 237982 - DNA, 18 bp, Homo sapiens
gcatgtgtgcctgtggca

SEQ ID NO: 237983 - DNA, 16 bp, Homo sapiens
gcatgtgtgtgctcag

SEQ ID NO: 237984 - DNA, 14 bp, Homo sapiens
gcatgtgtgtgtct

SEQ ID NO: 237985 - DNA, 15 bp, Homo sapiens
gcatgtgtgtgtctc

SEQ ID NO: 237986 - DNA, 16 bp, Homo sapiens
gcatgtgtgtgtctct

SEQ ID NO: 237987 - DNA, 19 bp, Homo sapiens
gcatgtgtttggttctggg

SEQ ID NO: 237988 - DNA, 22 bp, Homo sapiens
gcatgtgtttggttctggggcc

SEQ ID NO: 237989 - DNA, 21 bp, Homo sapiens
gcatgttcttgttttgttata

SEQ ID NO: 237990 - DNA, 18 bp, Homo sapiens
gcatgttgagccaggcct

SEQ ID NO: 237991 - DNA, 17 bp, Homo sapiens
gcatgttgggataaata

SEQ ID NO: 237992 - DNA, 15 bp, Homo sapiens
gcatgtttcatgttt

SEQ ID NO: 237993 - DNA, 23 bp, Homo sapiens
gcatgtttcccgctccaagagaa

SEQ ID NO: 237994 - DNA, 18 bp, Homo sapiens
gcatgtttgtctgtgtgc

SEQ ID NO: 237995 - DNA, 16 bp, Homo sapiens
gcattaaaaataaaag

SEQ ID NO: 237996 - DNA, 14 bp, Homo sapiens
gcattaactaatct

SEQ ID NO: 237997 - DNA, 22 bp, Homo sapiens
gcattaactaatctattgggtt

SEQ ID NO: 237998 - DNA, 14 bp, Homo sapiens
gcattaacttttgt

SEQ ID NO: 237999 - DNA, 19 bp, Homo sapiens
gcattacagagaggagaaa

SEQ ID NO: 238000 - DNA, 14 bp, Homo sapiens
gcattactctgcac

SEQ ID NO: 238001 - DNA, 21 bp, Homo sapiens
gcattaggcttttaagaaaca

SEQ ID NO: 238002 - DNA, 16 bp, Homo sapiens
gcattattcctccagg

SEQ ID NO: 238003 - DNA, 22 bp, Homo sapiens
gcattatttgaaaacactgctg

SEQ ID NO: 238004 - DNA, 16 bp, Homo sapiens
gcattcacacacagcc

SEQ ID NO: 238005 - DNA, 19 bp, Homo sapiens
gcattcacacacagcctgg

SEQ ID NO: 238006 - DNA, 11 bp, Homo sapiens
gcattcatgtt

SEQ ID NO: 238007 - DNA, 17 bp, Homo sapiens
gcattccagctctgccc

SEQ ID NO: 238008 - DNA, 13 bp, Homo sapiens
gcattcccagagg

SEQ ID NO: 238009 - DNA, 16 bp, Homo sapiens
gcattcctttctttaa

SEQ ID NO: 238010 - DNA, 16 bp, Homo sapiens
gcattctgagctgggc

SEQ ID NO: 238011 - DNA, 19 bp, Homo sapiens
gcattctggggtggggctt

SEQ ID NO: 238012 - DNA, 14 bp, Homo sapiens
gcattgaaataata

SEQ ID NO: 238013 - DNA, 16 bp, Homo sapiens
gcattggaagacccca

SEQ ID NO: 238014 - DNA, 15 bp, Homo sapiens
gcattgggctgacac

SEQ ID NO: 238015 - DNA, 21 bp, Homo sapiens
gcattgttccacacatttaaa

SEQ ID NO: 238016 - DNA, 22 bp, Homo sapiens
gcattgttccacacatttaaaa

SEQ ID NO: 238017 - DNA, 16 bp, Homo sapiens
gcattgttgatgctca

SEQ ID NO: 238018 - DNA, 18 bp, Homo sapiens
gcattgtttgcttattgt

SEQ ID NO: 238019 - DNA, 23 bp, Homo sapiens
gcattgtttgcttattgttccaa

SEQ ID NO: 238020 - DNA, 12 bp, Homo sapiens
gcatttaaaatg

SEQ ID NO: 238021 - DNA, 16 bp, Homo sapiens
gcatttagcacaaaaa

SEQ ID NO: 238022 - DNA, 17 bp, Homo sapiens
gcatttatcattcttgt

SEQ ID NO: 238023 - DNA, 10 bp, Homo sapiens
gcatttatgc

SEQ ID NO: 238024 - DNA, 23 bp, Homo sapiens
gcatttcacctgtgacaaaggat

SEQ ID NO: 238025 - DNA, 14 bp, Homo sapiens
gcatttcagctgtg

SEQ ID NO: 238026 - DNA, 21 bp, Homo sapiens
gcatttccaacaccacagaca

SEQ ID NO: 238027 - DNA, 22 bp, Homo sapiens
gcatttccaacaccacagacac

SEQ ID NO: 238028 - DNA, 18 bp, Homo sapiens
gcatttctgaatagaaat

SEQ ID NO: 238029 - DNA, 19 bp, Homo sapiens
gcatttctgaatagaaatg

SEQ ID NO: 238030 - DNA, 23 bp, Homo sapiens
gcatttctttatttctgtctcat

SEQ ID NO: 238031 - DNA, 23 bp, Homo sapiens
gcatttgctctttcatctctgct

SEQ ID NO: 238032 - DNA, 15 bp, Homo sapiens
gcatttgctgaataa

SEQ ID NO: 238033 - DNA, 13 bp, Homo sapiens
gcatttgtaaata

SEQ ID NO: 238034 - DNA, 21 bp, Homo sapiens
gcatttgtaaatattaaacca

SEQ ID NO: 238035 - DNA, 13 bp, Homo sapiens
gcatttgtcaatg

SEQ ID NO: 238036 - DNA, 12 bp, Homo sapiens
gcatttgtgaaa

SEQ ID NO: 238037 - DNA, 15 bp, Homo sapiens
gcatttgtgagccaa

SEQ ID NO: 238038 - DNA, 13 bp, Homo sapiens
gcatttgtgatca

SEQ ID NO: 238039 - DNA, 17 bp, Homo sapiens
gcattttactgtacaga

SEQ ID NO: 238040 - DNA, 23 bp, Homo sapiens
gcattttaggtcccagaatggaa

SEQ ID NO: 238041 - DNA, 22 bp, Homo sapiens
gcattttcacattttgcctttc

SEQ ID NO: 238042 - DNA, 23 bp, Homo sapiens
gcattttcctcgcctaggcctgt

SEQ ID NO: 238043 - DNA, 15 bp, Homo sapiens
gcattttctcaggca

SEQ ID NO: 238044 - DNA, 22 bp, Homo sapiens
gcattttctgggttctgggtgg

SEQ ID NO: 238045 - DNA, 17 bp, Homo sapiens
gcatttttacctttcat

SEQ ID NO: 238046 - DNA, 21 bp, Homo sapiens
gcatttttgatttatgcatgg

SEQ ID NO: 238047 - DNA, 15 bp, Homo sapiens
gcattttttaaaaca

SEQ ID NO: 238048 - DNA, 23 bp, Homo sapiens
gccaaacagttgtaccactgcta

SEQ ID NO: 238049 - DNA, 20 bp, Homo sapiens
gccaaacatcagacctgtct

SEQ ID NO: 238050 - DNA, 12 bp, Homo sapiens
gccaaacttggg

SEQ ID NO: 238051 - DNA, 17 bp, Homo sapiens
gccaaagaatgccttga

SEQ ID NO: 238052 - DNA, 15 bp, Homo sapiens
gccaaagagctcttt

SEQ ID NO: 238053 - DNA, 18 bp, Homo sapiens
gccaaagtgcagcccttc

SEQ ID NO: 238054 - DNA, 22 bp, Homo sapiens
gccaaagtgtacaattttcatc

SEQ ID NO: 238055 - DNA, 22 bp, Homo sapiens
gccaaatagagtttttatattt

SEQ ID NO: 238056 - DNA, 20 bp, Homo sapiens
gccaaatagtgaaaagtaga

SEQ ID NO: 238057 - DNA, 15 bp, Homo sapiens
gccaaatatgcactt

SEQ ID NO: 238058 - DNA, 20 bp, Homo sapiens
gccaaatatgcactttccct

SEQ ID NO: 238059 - DNA, 17 bp, Homo sapiens
gccaaatatgtcctggg

SEQ ID NO: 238060 - DNA, 20 bp, Homo sapiens
gccaaatcctgggcatcccc

SEQ ID NO: 238061 - DNA, 18 bp, Homo sapiens
gccaaatgacttcatttc

SEQ ID NO: 238062 - DNA, 16 bp, Homo sapiens
gccaaatgtaattgaa

SEQ ID NO: 238063 - DNA, 18 bp, Homo sapiens
gccaaatgtaattgaata

SEQ ID NO: 238064 - DNA, 19 bp, Homo sapiens
gccaaattatttgtgtaat

SEQ ID NO: 238065 - DNA, 20 bp, Homo sapiens
gccaacaccacagaaatggg

SEQ ID NO: 238066 - DNA, 13 bp, Homo sapiens
gccaacagacact

SEQ ID NO: 238067 - DNA, 20 bp, Homo sapiens
gccaacatcgtgaaaccctg

SEQ ID NO: 238068 - DNA, 23 bp, Homo sapiens
gccaacatcgtgaaaccctgtct

SEQ ID NO: 238069 - DNA, 18 bp, Homo sapiens
gccaaccacctctggccc

SEQ ID NO: 238070 - DNA, 14 bp, Homo sapiens
gccaacccctgtgg

SEQ ID NO: 238071 - DNA, 19 bp, Homo sapiens
gccaaccgcatctgctcat

SEQ ID NO: 238072 - DNA, 15 bp, Homo sapiens
gccaactccatgacc

SEQ ID NO: 238073 - DNA, 19 bp, Homo sapiens
gccaactccatgaccaggc

SEQ ID NO: 238074 - DNA, 15 bp, Homo sapiens
gccaactcgggagca

SEQ ID NO: 238075 - DNA, 14 bp, Homo sapiens
gccaacttgtaaat

SEQ ID NO: 238076 - DNA, 18 bp, Homo sapiens
gccaacttgtaaatacac

SEQ ID NO: 238077 - DNA, 15 bp, Homo sapiens
gccaactttccagac

SEQ ID NO: 238078 - DNA, 12 bp, Homo sapiens
gccaagaaatcg

SEQ ID NO: 238079 - DNA, 17 bp, Homo sapiens
gccaagaactctgggca

SEQ ID NO: 238080 - DNA, 18 bp, Homo sapiens
gccaagaactgaaaacat

SEQ ID NO: 238081 - DNA, 16 bp, Homo sapiens
gccaagaagtgaggcc

SEQ ID NO: 238082 - DNA, 18 bp, Homo sapiens
gccaagaagtgaggcctg

SEQ ID NO: 238083 - DNA, 11 bp, Homo sapiens
gccaagacagt

SEQ ID NO: 238084 - DNA, 22 bp, Homo sapiens
gccaagcacctagcctcgctct

SEQ ID NO: 238085 - DNA, 20 bp, Homo sapiens
gccaagccagggttccagac

SEQ ID NO: 238086 - DNA, 21 bp, Homo sapiens
gccaagccagggttccagaca

SEQ ID NO: 238087 - DNA, 15 bp, Homo sapiens
gccaagcccaccctg

SEQ ID NO: 238088 - DNA, 13 bp, Homo sapiens
gccaagcctgcag

SEQ ID NO: 238089 - DNA, 14 bp, Homo sapiens
gccaagcctggagc

SEQ ID NO: 238090 - DNA, 19 bp, Homo sapiens
gccaagcctggagcccctg

SEQ ID NO: 238091 - DNA, 16 bp, Homo sapiens
gccaagctttcttcta

SEQ ID NO: 238092 - DNA, 15 bp, Homo sapiens
gccaaggcaggtaga

SEQ ID NO: 238093 - DNA, 18 bp, Homo sapiens
gccaaggccgcccacctg

SEQ ID NO: 238094 - DNA, 15 bp, Homo sapiens
gccaaggccttctcc

SEQ ID NO: 238095 - DNA, 18 bp, Homo sapiens
gccaaggccttctcctcc

SEQ ID NO: 238096 - DNA, 17 bp, Homo sapiens
gccaaggggccagctgc

SEQ ID NO: 238097 - DNA, 16 bp, Homo sapiens
gccaaggtcctgctca

SEQ ID NO: 238098 - DNA, 23 bp, Homo sapiens
gccaaggtgggtggatcacctgt

SEQ ID NO: 238099 - DNA, 16 bp, Homo sapiens
gccaagtaagaaagtg

SEQ ID NO: 238100 - DNA, 23 bp, Homo sapiens
gccaagtcccaccggttgcttct

SEQ ID NO: 238101 - DNA, 15 bp, Homo sapiens
gccaagtgcaggctg

SEQ ID NO: 238102 - DNA, 11 bp, Homo sapiens
gccaagttcaa

SEQ ID NO: 238103 - DNA, 23 bp, Homo sapiens
gccaatatgtattgtaaacatgt

SEQ ID NO: 238104 - DNA, 17 bp, Homo sapiens
gccaatgccacagccaa

SEQ ID NO: 238105 - DNA, 18 bp, Homo sapiens
gccaatggtgagggctga

SEQ ID NO: 238106 - DNA, 21 bp, Homo sapiens
gccaatggtgagggctgagag

SEQ ID NO: 238107 - DNA, 12 bp, Homo sapiens
gccaatttgtct

SEQ ID NO: 238108 - DNA, 15 bp, Homo sapiens
gccaatttgtctcct

SEQ ID NO: 238109 - DNA, 22 bp, Homo sapiens
gccaatttgtctcctactctgt

SEQ ID NO: 238110 - DNA, 16 bp, Homo sapiens
gccacaagaaatttga

SEQ ID NO: 238111 - DNA, 13 bp, Homo sapiens
gccacaatgtgat

SEQ ID NO: 238112 - DNA, 10 bp, Homo sapiens
gccacacagt

SEQ ID NO: 238113 - DNA, 19 bp, Homo sapiens
gccacacctggtctgtttt

SEQ ID NO: 238114 - DNA, 17 bp, Homo sapiens
gcaggggctgggcagag

SEQ ID NO: 238115 - DNA, 21 bp, Homo sapiens
gcaggggctgggcagagggga

SEQ ID NO: 238116 - DNA, 13 bp, Homo sapiens
gcaggggggagag

SEQ ID NO: 238117 - DNA, 14 bp, Homo sapiens
gcaggggggttggg

SEQ ID NO: 238118 - DNA, 21 bp, Homo sapiens
gcaggggggttgggttccaga

SEQ ID NO: 238119 - DNA, 22 bp, Homo sapiens
gcaggggggttgggttccagac

SEQ ID NO: 238120 - DNA, 22 bp, Homo sapiens
gcaggggtgggaggctcccaga

SEQ ID NO: 238121 - DNA, 13 bp, Homo sapiens
gcaggggttccca

SEQ ID NO: 238122 - DNA, 13 bp, Homo sapiens
gcagggtctttgt

SEQ ID NO: 238123 - DNA, 18 bp, Homo sapiens
gcagggtctttgtgtgct

SEQ ID NO: 238124 - DNA, 19 bp, Homo sapiens
gcagggtgggcagcctatg

SEQ ID NO: 238125 - DNA, 21 bp, Homo sapiens
gcagggtggggtaaggaggag

SEQ ID NO: 238126 - DNA, 23 bp, Homo sapiens
gcagggtggggtaaggaggagaa

SEQ ID NO: 238127 - DNA, 15 bp, Homo sapiens
gcagggtggtgctgg

SEQ ID NO: 238128 - DNA, 17 bp, Homo sapiens
gcagggtggtgctggga

SEQ ID NO: 238129 - DNA, 14 bp, Homo sapiens
gcagggttctagaa

SEQ ID NO: 238130 - DNA, 18 bp, Homo sapiens
gcaggtacttcctcctga

SEQ ID NO: 238131 - DNA, 12 bp, Homo sapiens
gcaggtcctggg

SEQ ID NO: 238132 - DNA, 15 bp, Homo sapiens
gcaggtcctggggag

SEQ ID NO: 238133 - DNA, 13 bp, Homo sapiens
gcaggtctgcagg

SEQ ID NO: 238134 - DNA, 13 bp, Homo sapiens
gcaggtgctgcct

SEQ ID NO: 238135 - DNA, 19 bp, Homo sapiens
gcaggtgctgccttgagac

SEQ ID NO: 238136 - DNA, 19 bp, Homo sapiens
gcaggtggccacagcagga

SEQ ID NO: 238137 - DNA, 16 bp, Homo sapiens
gcaggtggccagggct

SEQ ID NO: 238138 - DNA, 18 bp, Homo sapiens
gcaggtggccagggctcc

SEQ ID NO: 238139 - DNA, 13 bp, Homo sapiens
gcaggtgtggtgg

SEQ ID NO: 238140 - DNA, 16 bp, Homo sapiens
gcaggtgttgggacct

SEQ ID NO: 238141 - DNA, 21 bp, Homo sapiens
gcaggtgttgggacctgctgc

SEQ ID NO: 238142 - DNA, 22 bp, Homo sapiens
gcaggtgttgggacctgctgct

SEQ ID NO: 238143 - DNA, 15 bp, Homo sapiens
gcaggttctctcctg

SEQ ID NO: 238144 - DNA, 14 bp, Homo sapiens
gcaggttggacccc

SEQ ID NO: 238145 - DNA, 15 bp, Homo sapiens
gcaggttggacccca

SEQ ID NO: 238146 - DNA, 18 bp, Homo sapiens
gcaggttggaccccagag

SEQ ID NO: 238147 - DNA, 14 bp, Homo sapiens
gcagtaaaaactgt

SEQ ID NO: 238148 - DNA, 18 bp, Homo sapiens
gcagtaccatcccactga

SEQ ID NO: 238149 - DNA, 22 bp, Homo sapiens
gcagtacctgggaaaggaccca

SEQ ID NO: 238150 - DNA, 22 bp, Homo sapiens
gcagtagaaggtcggaggcttg

SEQ ID NO: 238151 - DNA, 18 bp, Homo sapiens
gcagtagaaggtgccgtg

SEQ ID NO: 238152 - DNA, 13 bp, Homo sapiens
gcagtagagagca

SEQ ID NO: 238153 - DNA, 22 bp, Homo sapiens
gcagtaggcattctttagtcta

SEQ ID NO: 238154 - DNA, 15 bp, Homo sapiens
gcagtatcacaggcc

SEQ ID NO: 238155 - DNA, 20 bp, Homo sapiens
gcagtatggcggaggccatg

SEQ ID NO: 238156 - DNA, 21 bp, Homo sapiens
gcagtatggcggaggccatgg

SEQ ID NO: 238157 - DNA, 23 bp, Homo sapiens
gcagtattccctttttaaatgag

SEQ ID NO: 238158 - DNA, 22 bp, Homo sapiens
gcagtcacactgctgggaagtg

SEQ ID NO: 238159 - DNA, 12 bp, Homo sapiens
gcagtcacaggt

SEQ ID NO: 238160 - DNA, 13 bp, Homo sapiens
gcagtcactgaat

SEQ ID NO: 238161 - DNA, 17 bp, Homo sapiens
gcagtcatctacttttt

SEQ ID NO: 238162 - DNA, 12 bp, Homo sapiens
gcagtccagagc

SEQ ID NO: 238163 - DNA, 16 bp, Homo sapiens
gcagtccagagctttt

SEQ ID NO: 238164 - DNA, 20 bp, Homo sapiens
gcagtccagagcttttcagc

SEQ ID NO: 238165 - DNA, 21 bp, Homo sapiens
gcagtcccagtattctcagag

SEQ ID NO: 238166 - DNA, 16 bp, Homo sapiens
gcagtccccagccctt

SEQ ID NO: 238167 - DNA, 18 bp, Homo sapiens
gcagtcctgcctcagcct

SEQ ID NO: 238168 - DNA, 20 bp, Homo sapiens
gcagtcctggtggggctgag

SEQ ID NO: 238169 - DNA, 22 bp, Homo sapiens
gcagtcctggtggggctgagcc

SEQ ID NO: 238170 - DNA, 23 bp, Homo sapiens
gcagtcctggtggggctgagcct

SEQ ID NO: 238171 - DNA, 12 bp, Homo sapiens
gcagtcgcagga

SEQ ID NO: 238172 - DNA, 23 bp, Homo sapiens
gcagtcgcaggatccgctgccac

SEQ ID NO: 238173 - DNA, 15 bp, Homo sapiens
gcagtctacttctgt

SEQ ID NO: 238174 - DNA, 22 bp, Homo sapiens
gcagtctctcttacccttctgt

SEQ ID NO: 238175 - DNA, 12 bp, Homo sapiens
gcagtcttgctc

SEQ ID NO: 238176 - DNA, 21 bp, Homo sapiens
gcagtgaattgtgaccaagtt

SEQ ID NO: 238177 - DNA, 16 bp, Homo sapiens
gcagtgacgtgagtgg

SEQ ID NO: 238178 - DNA, 14 bp, Homo sapiens
gcagtgactggcag

SEQ ID NO: 238179 - DNA, 22 bp, Homo sapiens
gcagtgaggggtatatctgggc

SEQ ID NO: 238180 - DNA, 19 bp, Homo sapiens
gcagtgcaccccctaaaga

SEQ ID NO: 238181 - DNA, 16 bp, Homo sapiens
gcagtgcacctctcat

SEQ ID NO: 238182 - DNA, 22 bp, Homo sapiens
gcagtgcatgtgaagcatgctt

SEQ ID NO: 238183 - DNA, 14 bp, Homo sapiens
gcagtgcccaccat

SEQ ID NO: 238184 - DNA, 18 bp, Homo sapiens
gcagtgcctcgaggcacc

SEQ ID NO: 238185 - DNA, 20 bp, Homo sapiens
gcagtgcctcgaggcaccgg

SEQ ID NO: 238186 - DNA, 21 bp, Homo sapiens
gcagtgcctcgaggcaccggc

SEQ ID NO: 238187 - DNA, 17 bp, Homo sapiens
gcagtgcctctggtctg

SEQ ID NO: 238188 - DNA, 15 bp, Homo sapiens
gcagtgccttgggga

SEQ ID NO: 238189 - DNA, 15 bp, Homo sapiens
gcagtgctgggccca

SEQ ID NO: 238190 - DNA, 18 bp, Homo sapiens
gcagtgctgggcccagcc

SEQ ID NO: 238191 - DNA, 19 bp, Homo sapiens
gcagtgctgggcccagccg

SEQ ID NO: 238192 - DNA, 21 bp, Homo sapiens
gcagtgctgggcccagccggg

SEQ ID NO: 238193 - DNA, 17 bp, Homo sapiens
gcagtggactgtgtccc

SEQ ID NO: 238194 - DNA, 18 bp, Homo sapiens
gcagtggactgtgtccct

SEQ ID NO: 238195 - DNA, 21 bp, Homo sapiens
gcagtggagaggggacttgga

SEQ ID NO: 238196 - DNA, 12 bp, Homo sapiens
gcagtggccagg

SEQ ID NO: 238197 - DNA, 19 bp, Homo sapiens
gcagtggctggtccagggc

SEQ ID NO: 238198 - DNA, 22 bp, Homo sapiens
gcagtggcttggagcagaggtg

SEQ ID NO: 238199 - DNA, 20 bp, Homo sapiens
gcagtggcttttgccccaga

SEQ ID NO: 238200 - DNA, 17 bp, Homo sapiens
gcagtgggtggggctgt

SEQ ID NO: 238201 - DNA, 21 bp, Homo sapiens
gcagtggtgcgatcatggctc

SEQ ID NO: 238202 - DNA, 18 bp, Homo sapiens
gcagtgtcatcagaagat

SEQ ID NO: 238203 - DNA, 21 bp, Homo sapiens
gcagtgtccagaagcggcctg

SEQ ID NO: 238204 - DNA, 19 bp, Homo sapiens
gcagtgtcctgtgctttct

SEQ ID NO: 238205 - DNA, 15 bp, Homo sapiens
gcagtgtcttccata

SEQ ID NO: 238206 - DNA, 16 bp, Homo sapiens
gcagtgtggtgggagg

SEQ ID NO: 238207 - DNA, 17 bp, Homo sapiens
gcagtgttcgcttggct

SEQ ID NO: 238208 - DNA, 14 bp, Homo sapiens
gcagttaacatctg

SEQ ID NO: 238209 - DNA, 14 bp, Homo sapiens
gcagttaccgagga

SEQ ID NO: 238210 - DNA, 14 bp, Homo sapiens
gcagttatagaaaa

SEQ ID NO: 238211 - DNA, 20 bp, Homo sapiens
gcagttcccccaacctcaga

SEQ ID NO: 238212 - DNA, 13 bp, Homo sapiens
gcagttcctgagt

SEQ ID NO: 238213 - DNA, 18 bp, Homo sapiens
gcagttctcactcctagg

SEQ ID NO: 238214 - DNA, 15 bp, Homo sapiens
gcagttctgcaaata

SEQ ID NO: 238215 - DNA, 18 bp, Homo sapiens
gcatatgcatgccaggct

SEQ ID NO: 238216 - DNA, 15 bp, Homo sapiens
gcatattctattgta

SEQ ID NO: 238217 - DNA, 14 bp, Homo sapiens
gcatcaaaatacaa

SEQ ID NO: 238218 - DNA, 15 bp, Homo sapiens
gcatcaaacatgaaa

SEQ ID NO: 238219 - DNA, 19 bp, Homo sapiens
gcatcaaacatgaaaacat

SEQ ID NO: 238220 - DNA, 20 bp, Homo sapiens
gcatcaaacatgaaaacatt

SEQ ID NO: 238221 - DNA, 14 bp, Homo sapiens
gcatcaaccaggaa

SEQ ID NO: 238222 - DNA, 18 bp, Homo sapiens
gcatcagcctctggccag

SEQ ID NO: 238223 - DNA, 17 bp, Homo sapiens
gcatcagctttccctgg

SEQ ID NO: 238224 - DNA, 20 bp, Homo sapiens
gcatcagctttccctggctc

SEQ ID NO: 238225 - DNA, 21 bp, Homo sapiens
gcatcagctttccctggctca

SEQ ID NO: 238226 - DNA, 14 bp, Homo sapiens
gcatcaggcactgg

SEQ ID NO: 238227 - DNA, 18 bp, Homo sapiens
gcatcattccaccatggc

SEQ ID NO: 238228 - DNA, 18 bp, Homo sapiens
gcatcattttcacctcca

SEQ ID NO: 238229 - DNA, 15 bp, Homo sapiens
gcatccagcctgtgt

SEQ ID NO: 238230 - DNA, 14 bp, Homo sapiens
gcatccaggcctga

SEQ ID NO: 238231 - DNA, 22 bp, Homo sapiens
gcatccaggcctgaggctgctg

SEQ ID NO: 238232 - DNA, 14 bp, Homo sapiens
gcatccagtatctt

SEQ ID NO: 238233 - DNA, 17 bp, Homo sapiens
gcatccatgtgtggact

SEQ ID NO: 238234 - DNA, 23 bp, Homo sapiens
gcatcccagtggcctcaaccctc

SEQ ID NO: 238235 - DNA, 12 bp, Homo sapiens
gcatccccagcc

SEQ ID NO: 238236 - DNA, 14 bp, Homo sapiens
gcatccccagcccc

SEQ ID NO: 238237 - DNA, 15 bp, Homo sapiens
gcatccccagccccc

SEQ ID NO: 238238 - DNA, 17 bp, Homo sapiens
gcatccctccaccccag

SEQ ID NO: 238239 - DNA, 21 bp, Homo sapiens
gcatccctccaccccagtccc

SEQ ID NO: 238240 - DNA, 17 bp, Homo sapiens
gcatccctgtgagcaaa

SEQ ID NO: 238241 - DNA, 16 bp, Homo sapiens
gcatcccttggcccct

SEQ ID NO: 238242 - DNA, 19 bp, Homo sapiens
gcatccgcctctgagccag

SEQ ID NO: 238243 - DNA, 15 bp, Homo sapiens
gcatcctcagcccca

SEQ ID NO: 238244 - DNA, 16 bp, Homo sapiens
gcatcctcagccccag

SEQ ID NO: 238245 - DNA, 17 bp, Homo sapiens
gcatcctcagccccagg

SEQ ID NO: 238246 - DNA, 21 bp, Homo sapiens
gcatcctcagttcctgcagca

SEQ ID NO: 238247 - DNA, 12 bp, Homo sapiens
gcatcctccagg

SEQ ID NO: 238248 - DNA, 22 bp, Homo sapiens
gcatccttaagtatcagaaagc

SEQ ID NO: 238249 - DNA, 22 bp, Homo sapiens
gcatcgtagaagagatgtggca

SEQ ID NO: 238250 - DNA, 21 bp, Homo sapiens
gcatcgtgacccttcagggcc

SEQ ID NO: 238251 - DNA, 22 bp, Homo sapiens
gcatcgttttctttgctgtgcc

SEQ ID NO: 238252 - DNA, 12 bp, Homo sapiens
gcatctacctgc

SEQ ID NO: 238253 - DNA, 13 bp, Homo sapiens
gcatctcagccca

SEQ ID NO: 238254 - DNA, 16 bp, Homo sapiens
gcatctccaggaaggc

SEQ ID NO: 238255 - DNA, 16 bp, Homo sapiens
gcatctcctgtgcatg

SEQ ID NO: 238256 - DNA, 13 bp, Homo sapiens
gcatctctagaga

SEQ ID NO: 238257 - DNA, 11 bp, Homo sapiens
gcatctctggg

SEQ ID NO: 238258 - DNA, 12 bp, Homo sapiens
gcatctctgggc

SEQ ID NO: 238259 - DNA, 14 bp, Homo sapiens
gcatctgacacaaa

SEQ ID NO: 238260 - DNA, 16 bp, Homo sapiens
gcatctgacacaaaaa

SEQ ID NO: 238261 - DNA, 18 bp, Homo sapiens
gcatctgagtccagctcc

SEQ ID NO: 238262 - DNA, 12 bp, Homo sapiens
gcatctgcccct

SEQ ID NO: 238263 - DNA, 14 bp, Homo sapiens
gcatctgcccctcc

SEQ ID NO: 238264 - DNA, 18 bp, Homo sapiens
gcatctgcccctccccca

SEQ ID NO: 238265 - DNA, 19 bp, Homo sapiens
gcatctgtcccactgggac

SEQ ID NO: 238266 - DNA, 13 bp, Homo sapiens
gcatctttgcctt

SEQ ID NO: 238267 - DNA, 11 bp, Homo sapiens
gcatgaaaggt

SEQ ID NO: 238268 - DNA, 21 bp, Homo sapiens
gcatgaaaggtaatctgaaac

SEQ ID NO: 238269 - DNA, 13 bp, Homo sapiens
gcatgaagataaa

SEQ ID NO: 238270 - DNA, 19 bp, Homo sapiens
gcatgaagattttctttct

SEQ ID NO: 238271 - DNA, 18 bp, Homo sapiens
gcatgacaagccccaggc

SEQ ID NO: 238272 - DNA, 19 bp, Homo sapiens
gcatgacaagccccaggca

SEQ ID NO: 238273 - DNA, 21 bp, Homo sapiens
gcatgacaagccccaggcagg

SEQ ID NO: 238274 - DNA, 13 bp, Homo sapiens
gcatgacaaggtg

SEQ ID NO: 238275 - DNA, 14 bp, Homo sapiens
gcatgacagctgtt

SEQ ID NO: 238276 - DNA, 13 bp, Homo sapiens
gcatgaccctgga

SEQ ID NO: 238277 - DNA, 16 bp, Homo sapiens
gcatgaccctggagcc

SEQ ID NO: 238278 - DNA, 23 bp, Homo sapiens
gcatgaccttttggcctttgtaa

SEQ ID NO: 238279 - DNA, 17 bp, Homo sapiens
gcatgacgtgaatgtgt

SEQ ID NO: 238280 - DNA, 18 bp, Homo sapiens
gcatgacgtttaaggcca

SEQ ID NO: 238281 - DNA, 15 bp, Homo sapiens
gcatgagaactaaat

SEQ ID NO: 238282 - DNA, 18 bp, Homo sapiens
gcatgagaactaaataga

SEQ ID NO: 238283 - DNA, 11 bp, Homo sapiens
gcatgagtggc

SEQ ID NO: 238284 - DNA, 12 bp, Homo sapiens
gcatgatattgt

SEQ ID NO: 238285 - DNA, 16 bp, Homo sapiens
gcatgatattgtatgt

SEQ ID NO: 238286 - DNA, 12 bp, Homo sapiens
gcatgcaactaa

SEQ ID NO: 238287 - DNA, 14 bp, Homo sapiens
gcatgcagaaaggg

SEQ ID NO: 238288 - DNA, 16 bp, Homo sapiens
gcatgcagcaacaccc

SEQ ID NO: 238289 - DNA, 13 bp, Homo sapiens
gcatgcagcagct

SEQ ID NO: 238290 - DNA, 15 bp, Homo sapiens
gcatgcagcagcttg

SEQ ID NO: 238291 - DNA, 14 bp, Homo sapiens
gcatgcattttgca

SEQ ID NO: 238292 - DNA, 11 bp, Homo sapiens
gcatgccaccc

SEQ ID NO: 238293 - DNA, 13 bp, Homo sapiens
gcatgccaccctc

SEQ ID NO: 238294 - DNA, 20 bp, Homo sapiens
gcatgccacgccccgtgtct

SEQ ID NO: 238295 - DNA, 18 bp, Homo sapiens
gcatgccgagtgccccag

SEQ ID NO: 238296 - DNA, 17 bp, Homo sapiens
gcatgcgaatgagctgg

SEQ ID NO: 238297 - DNA, 19 bp, Homo sapiens
gcatgcgaatgagctgggc

SEQ ID NO: 238298 - DNA, 12 bp, Homo sapiens
gcatgcgacagc

SEQ ID NO: 238299 - DNA, 11 bp, Homo sapiens
gcatgctcagt

SEQ ID NO: 238300 - DNA, 12 bp, Homo sapiens
gcatgctcccag

SEQ ID NO: 238301 - DNA, 15 bp, Homo sapiens
gcatgctcccagcat

SEQ ID NO: 238302 - DNA, 17 bp, Homo sapiens
gcatgctcccagcattt

SEQ ID NO: 238303 - DNA, 14 bp, Homo sapiens
gcatgctgcctgcc

SEQ ID NO: 238304 - DNA, 15 bp, Homo sapiens
gcatgctgcctgcct

SEQ ID NO: 238305 - DNA, 20 bp, Homo sapiens
gcatgctgcctgcctccggc

SEQ ID NO: 238306 - DNA, 14 bp, Homo sapiens
gcatgctgctttaa

SEQ ID NO: 238307 - DNA, 24 bp, Homo sapiens
gcatgctggcctcccaataaagct

SEQ ID NO: 238308 - DNA, 23 bp, Homo sapiens
gcatgctttgctgctatgaaaat

SEQ ID NO: 238309 - DNA, 13 bp, Homo sapiens
gcatggaatttgt

SEQ ID NO: 238310 - DNA, 14 bp, Homo sapiens
gcatggacagggcc

SEQ ID NO: 238311 - DNA, 22 bp, Homo sapiens
gcatggacagggccagggttgc

SEQ ID NO: 238312 - DNA, 16 bp, Homo sapiens
gcatggacctaacatt

SEQ ID NO: 238313 - DNA, 15 bp, Homo sapiens
gcatggacgcctggc

SEQ ID NO: 238314 - DNA, 16 bp, Homo sapiens
gcatggacgcctggct

SEQ ID NO: 238315 - DNA, 22 bp, Homo sapiens
gcatggacgcctggctccaggc

SEQ ID NO: 238316 - DNA, 14 bp, Homo sapiens
gcatggagaacagt

SEQ ID NO: 238317 - DNA, 18 bp, Homo sapiens
gcatggagtgtgtattgt

SEQ ID NO: 238318 - DNA, 19 bp, Homo sapiens
gcatggagtgtgtattgtt

SEQ ID NO: 238319 - DNA, 15 bp, Homo sapiens
gcatggagtgtttga

SEQ ID NO: 238320 - DNA, 17 bp, Homo sapiens
gcatggcagaagcgtct

SEQ ID NO: 238321 - DNA, 18 bp, Homo sapiens
gcatggcagcaggcctgt

SEQ ID NO: 238322 - DNA, 14 bp, Homo sapiens
gcatggccacagcc

SEQ ID NO: 238323 - DNA, 15 bp, Homo sapiens
gcatggccacagcca

SEQ ID NO: 238324 - DNA, 17 bp, Homo sapiens
gcatggccaggtggcca

SEQ ID NO: 238325 - DNA, 15 bp, Homo sapiens
gcatggcccagcctg

SEQ ID NO: 238326 - DNA, 13 bp, Homo sapiens
gcatggctccagt

SEQ ID NO: 238327 - DNA, 18 bp, Homo sapiens
gcatgggaaagccacctc

SEQ ID NO: 238328 - DNA, 16 bp, Homo sapiens
gcatgggaatgaatgt

SEQ ID NO: 238329 - DNA, 18 bp, Homo sapiens
gcatggggtgggcctctg

SEQ ID NO: 238330 - DNA, 21 bp, Homo sapiens
gcatgggtgaagggagagcca

SEQ ID NO: 238331 - DNA, 15 bp, Homo sapiens
gcatgggtggagggt

SEQ ID NO: 238332 - DNA, 17 bp, Homo sapiens
gcatggtaccagccctg

SEQ ID NO: 238333 - DNA, 20 bp, Homo sapiens
gcatggtaccagccctgggg

SEQ ID NO: 238334 - DNA, 22 bp, Homo sapiens
gcatggtaccagccctggggct

SEQ ID NO: 238335 - DNA, 23 bp, Homo sapiens
gcatggtaccagccctggggctg

SEQ ID NO: 238336 - DNA, 22 bp, Homo sapiens
gcatggtatttgagacattcca

SEQ ID NO: 238337 - DNA, 23 bp, Homo sapiens
gcatggtcctggaggatgaccag

SEQ ID NO: 238338 - DNA, 18 bp, Homo sapiens
gcatggttccttccctgg

SEQ ID NO: 238339 - DNA, 22 bp, Homo sapiens
gcatgtaaaatcttcagctggt

SEQ ID NO: 238340 - DNA, 11 bp, Homo sapiens
gcatgtacttt

SEQ ID NO: 238341 - DNA, 23 bp, Homo sapiens
gcatgtactttatattttctata

SEQ ID NO: 238342 - DNA, 21 bp, Homo sapiens
gcatgtattcactaaaataaa

SEQ ID NO: 238343 - DNA, 19 bp, Homo sapiens
gcatgtattggcctggagg

SEQ ID NO: 238344 - DNA, 15 bp, Homo sapiens
gcatgtatttaagaa

SEQ ID NO: 238345 - DNA, 23 bp, Homo sapiens
gcatgtccctaccgagtctcttc

SEQ ID NO: 238346 - DNA, 13 bp, Homo sapiens
gcatgtctctgct

SEQ ID NO: 238347 - DNA, 22 bp, Homo sapiens
gcatgtctgcatggcagaagcg

SEQ ID NO: 238348 - DNA, 11 bp, Homo sapiens
gcatgtgccaa

SEQ ID NO: 238349 - DNA, 15 bp, Homo sapiens
gcatgtgtcagagtg

SEQ ID NO: 238350 - DNA, 14 bp, Homo sapiens
gcatgtgtctgtat

SEQ ID NO: 238351 - DNA, 13 bp, Homo sapiens
gccaccacctgga

SEQ ID NO: 238352 - DNA, 16 bp, Homo sapiens
gccaccacgtctgcca

SEQ ID NO: 238353 - DNA, 16 bp, Homo sapiens
gccaccagctccactg

SEQ ID NO: 238354 - DNA, 21 bp, Homo sapiens
gccaccagctccactggcctg

SEQ ID NO: 238355 - DNA, 17 bp, Homo sapiens
gccaccatcctgcagcc

SEQ ID NO: 238356 - DNA, 14 bp, Homo sapiens
gccaccatggccag

SEQ ID NO: 238357 - DNA, 16 bp, Homo sapiens
gccacccaccagggct

SEQ ID NO: 238358 - DNA, 22 bp, Homo sapiens
gccacccaccagggctcagctc

SEQ ID NO: 238359 - DNA, 15 bp, Homo sapiens
gccacccacccttct

SEQ ID NO: 238360 - DNA, 14 bp, Homo sapiens
gccacccactcagg

SEQ ID NO: 238361 - DNA, 22 bp, Homo sapiens
gccacccactgtggggcaagcc

SEQ ID NO: 238362 - DNA, 22 bp, Homo sapiens
gccacccaggcaggccctgcct

SEQ ID NO: 238363 - DNA, 22 bp, Homo sapiens
gccaccccaaaccccagcccca

SEQ ID NO: 238364 - DNA, 21 bp, Homo sapiens
gccaccccgggctctctgctg

SEQ ID NO: 238365 - DNA, 16 bp, Homo sapiens
gccaccccgtgccacc

SEQ ID NO: 238366 - DNA, 15 bp, Homo sapiens
gccacccgcccgccc

SEQ ID NO: 238367 - DNA, 17 bp, Homo sapiens
gccacccgcccgccccc

SEQ ID NO: 238368 - DNA, 19 bp, Homo sapiens
gccacccggatctccaggc

SEQ ID NO: 238369 - DNA, 21 bp, Homo sapiens
gccacccggatctccaggccc

SEQ ID NO: 238370 - DNA, 22 bp, Homo sapiens
gccacccggatctccaggccca

SEQ ID NO: 238371 - DNA, 24 bp, Homo sapiens
gccacccggatctccaggcccagc

SEQ ID NO: 238372 - DNA, 22 bp, Homo sapiens
gccacccgtaggcagcctctct

SEQ ID NO: 238373 - DNA, 22 bp, Homo sapiens
gccacccgttctgctggcctgg

SEQ ID NO: 238374 - DNA, 22 bp, Homo sapiens
gccaccctaactgagctgccag

SEQ ID NO: 238375 - DNA, 16 bp, Homo sapiens
gccaccctctgcaggg

SEQ ID NO: 238376 - DNA, 13 bp, Homo sapiens
gccaccctggccc

SEQ ID NO: 238377 - DNA, 15 bp, Homo sapiens
gccaccgctgccagc

SEQ ID NO: 238378 - DNA, 15 bp, Homo sapiens
gccacctatctcgtg

SEQ ID NO: 238379 - DNA, 16 bp, Homo sapiens
gccacctatgcctgtg

SEQ ID NO: 238380 - DNA, 17 bp, Homo sapiens
gccacctccacccccaa

SEQ ID NO: 238381 - DNA, 19 bp, Homo sapiens
gccacctccacccccaaga

SEQ ID NO: 238382 - DNA, 21 bp, Homo sapiens
gccacctccacccccaagaaa

SEQ ID NO: 238383 - DNA, 17 bp, Homo sapiens
gccacctccccaggccg

SEQ ID NO: 238384 - DNA, 15 bp, Homo sapiens
gccacctctccctca

SEQ ID NO: 238385 - DNA, 13 bp, Homo sapiens
gccacctgccccc

SEQ ID NO: 238386 - DNA, 20 bp, Homo sapiens
gccacctgcccccttctccc

SEQ ID NO: 238387 - DNA, 13 bp, Homo sapiens
gccacctgggctg

SEQ ID NO: 238388 - DNA, 18 bp, Homo sapiens
gccacctgggctgggaga

SEQ ID NO: 238389 - DNA, 13 bp, Homo sapiens
gccacctgtctgt

SEQ ID NO: 238390 - DNA, 14 bp, Homo sapiens
gccacctgtctgtc

SEQ ID NO: 238391 - DNA, 20 bp, Homo sapiens
gccacgaggtggtagctctg

SEQ ID NO: 238392 - DNA, 18 bp, Homo sapiens
gccacgcagccaggacac

SEQ ID NO: 238393 - DNA, 17 bp, Homo sapiens
gccacgccccagcccga

SEQ ID NO: 238394 - DNA, 19 bp, Homo sapiens
gccacgctcctctgttcag

SEQ ID NO: 238395 - DNA, 14 bp, Homo sapiens
gccacgctttgctg

SEQ ID NO: 238396 - DNA, 21 bp, Homo sapiens
gccacggaccgcatcctccag

SEQ ID NO: 238397 - DNA, 13 bp, Homo sapiens
gccacggcagcct

SEQ ID NO: 238398 - DNA, 14 bp, Homo sapiens
gccacggcagccta

SEQ ID NO: 238399 - DNA, 13 bp, Homo sapiens
gccacggccaccc

SEQ ID NO: 238400 - DNA, 13 bp, Homo sapiens
gccacggcctggg

SEQ ID NO: 238401 - DNA, 15 bp, Homo sapiens
gccacggcctgggag

SEQ ID NO: 238402 - DNA, 17 bp, Homo sapiens
gccacgtatagtcctag

SEQ ID NO: 238403 - DNA, 16 bp, Homo sapiens
gccacgtgctggagag

SEQ ID NO: 238404 - DNA, 14 bp, Homo sapiens
gccactaggctggg

SEQ ID NO: 238405 - DNA, 16 bp, Homo sapiens
gccactaggctgggtg

SEQ ID NO: 238406 - DNA, 22 bp, Homo sapiens
gccactaggctgggtgcccaca

SEQ ID NO: 238407 - DNA, 14 bp, Homo sapiens
gccactccctgagc

SEQ ID NO: 238408 - DNA, 22 bp, Homo sapiens
gccactcgcagtcgcaggatcc

SEQ ID NO: 238409 - DNA, 22 bp, Homo sapiens
gccactctcagagactcccagg

SEQ ID NO: 238410 - DNA, 22 bp, Homo sapiens
gccactctctgggactctcctc

SEQ ID NO: 238411 - DNA, 19 bp, Homo sapiens
gccactgactgcagggaca

SEQ ID NO: 238412 - DNA, 12 bp, Homo sapiens
gccactgcagtc

SEQ ID NO: 238413 - DNA, 15 bp, Homo sapiens
gccactgcagtcacc

SEQ ID NO: 238414 - DNA, 22 bp, Homo sapiens
gccactgcagtcacccctgtct

SEQ ID NO: 238415 - DNA, 13 bp, Homo sapiens
gccactgccaggc

SEQ ID NO: 238416 - DNA, 19 bp, Homo sapiens
gccactgccaggcacctgg

SEQ ID NO: 238417 - DNA, 20 bp, Homo sapiens
gccactgccaggcacctggc

SEQ ID NO: 238418 - DNA, 22 bp, Homo sapiens
gccactgccaggcacctggcct

SEQ ID NO: 238419 - DNA, 24 bp, Homo sapiens
gccactgccaggcacctggcctgc

SEQ ID NO: 238420 - DNA, 18 bp, Homo sapiens
gccactgcccgagctggt

SEQ ID NO: 238421 - DNA, 14 bp, Homo sapiens
gccactgccctctc

SEQ ID NO: 238422 - DNA, 16 bp, Homo sapiens
gccactgccctctcca

SEQ ID NO: 238423 - DNA, 17 bp, Homo sapiens
gccactgccctctccac

SEQ ID NO: 238424 - DNA, 16 bp, Homo sapiens
gccactggcatctctg

SEQ ID NO: 238425 - DNA, 19 bp, Homo sapiens
gccactggctgtgcctccc

SEQ ID NO: 238426 - DNA, 20 bp, Homo sapiens
gccactggctgtgcctcccc

SEQ ID NO: 238427 - DNA, 21 bp, Homo sapiens
gccactgggccccattctccc

SEQ ID NO: 238428 - DNA, 17 bp, Homo sapiens
gccactgggtctcactc

SEQ ID NO: 238429 - DNA, 18 bp, Homo sapiens
gccactgggtctcactcc

SEQ ID NO: 238430 - DNA, 12 bp, Homo sapiens
gccactgtggcc

SEQ ID NO: 238431 - DNA, 15 bp, Homo sapiens
gccactgtggccaga

SEQ ID NO: 238432 - DNA, 18 bp, Homo sapiens
gccactgtggccagagct

SEQ ID NO: 238433 - DNA, 20 bp, Homo sapiens
gccactgtggccagagctgg

SEQ ID NO: 238434 - DNA, 21 bp, Homo sapiens
gccacttcttaaaggcctgga

SEQ ID NO: 238435 - DNA, 22 bp, Homo sapiens
gccacttcttaaaggcctggaa

SEQ ID NO: 238436 - DNA, 16 bp, Homo sapiens
gccacttgacattcct

SEQ ID NO: 238437 - DNA, 23 bp, Homo sapiens
gccacttgacattccttgtcacc

SEQ ID NO: 238438 - DNA, 12 bp, Homo sapiens
gccacttgctca

SEQ ID NO: 238439 - DNA, 17 bp, Homo sapiens
gccactttgcagacctg

SEQ ID NO: 238440 - DNA, 22 bp, Homo sapiens
gccagaaacagtgggagccctg

SEQ ID NO: 238441 - DNA, 15 bp, Homo sapiens
gccagaaccccgagc

SEQ ID NO: 238442 - DNA, 14 bp, Homo sapiens
gccagaaggagggc

SEQ ID NO: 238443 - DNA, 15 bp, Homo sapiens
gccagaaggagggca

SEQ ID NO: 238444 - DNA, 17 bp, Homo sapiens
gccagaaggagggcaga

SEQ ID NO: 238445 - DNA, 18 bp, Homo sapiens
gccagaaggagggcagag

SEQ ID NO: 238446 - DNA, 21 bp, Homo sapiens
gccagaaggagggcagagcca

SEQ ID NO: 238447 - DNA, 22 bp, Homo sapiens
gccagaaggagggcagagccat

SEQ ID NO: 238448 - DNA, 18 bp, Homo sapiens
gccagaagggggccatga

SEQ ID NO: 238449 - DNA, 13 bp, Homo sapiens
gccagacctcaac

SEQ ID NO: 238450 - DNA, 22 bp, Homo sapiens
gccagacggcacccacccagca

SEQ ID NO: 238451 - DNA, 18 bp, Homo sapiens
gccagagaggagcacctg

SEQ ID NO: 238452 - DNA, 18 bp, Homo sapiens
gccagagagggcccagct

SEQ ID NO: 238453 - DNA, 20 bp, Homo sapiens
gccagagagggcccagctgt

SEQ ID NO: 238454 - DNA, 24 bp, Homo sapiens
gccagagagggcccagctgtagcc

SEQ ID NO: 238455 - DNA, 16 bp, Homo sapiens
gccagagcacctcagg

SEQ ID NO: 238456 - DNA, 19 bp, Homo sapiens
gccagagcacctcaggacc

SEQ ID NO: 238457 - DNA, 23 bp, Homo sapiens
gccagagcccttcactgccatga

SEQ ID NO: 238458 - DNA, 13 bp, Homo sapiens
gccagagcctggt

SEQ ID NO: 238459 - DNA, 12 bp, Homo sapiens
gccagagctggg

SEQ ID NO: 238460 - DNA, 16 bp, Homo sapiens
gccagagctgggtggg

SEQ ID NO: 238461 - DNA, 22 bp, Homo sapiens
gccagagctgggtggggacagt

SEQ ID NO: 238462 - DNA, 14 bp, Homo sapiens
gccagagtggcctg

SEQ ID NO: 238463 - DNA, 17 bp, Homo sapiens
gccagagtggcctggcc

SEQ ID NO: 238464 - DNA, 24 bp, Homo sapiens
gccagagtggcctggccaggagct

SEQ ID NO: 238465 - DNA, 18 bp, Homo sapiens
gccagatgttgttcctgg

SEQ ID NO: 238466 - DNA, 22 bp, Homo sapiens
gccagcaatgatgtccagaaga

SEQ ID NO: 238467 - DNA, 20 bp, Homo sapiens
gccagcacagaaacagagga

SEQ ID NO: 238468 - DNA, 22 bp, Homo sapiens
gccagcacagaaacagaggaga

SEQ ID NO: 238469 - DNA, 13 bp, Homo sapiens
gccagcacagagc

SEQ ID NO: 238470 - DNA, 21 bp, Homo sapiens
gccagcagggcgggccaggag

SEQ ID NO: 238471 - DNA, 22 bp, Homo sapiens
gccagcagggcgggccaggaga

SEQ ID NO: 238472 - DNA, 22 bp, Homo sapiens
gccagcaggttctctcctgtga

SEQ ID NO: 238473 - DNA, 13 bp, Homo sapiens
gccagccacacca

SEQ ID NO: 238474 - DNA, 23 bp, Homo sapiens
gccagccaccctaactgagctgc

SEQ ID NO: 238475 - DNA, 16 bp, Homo sapiens
gccagcccaaagctgg

SEQ ID NO: 238476 - DNA, 10 bp, Homo sapiens
gccagcccag

SEQ ID NO: 238477 - DNA, 11 bp, Homo sapiens
gccagcccagc

SEQ ID NO: 238478 - DNA, 12 bp, Homo sapiens
gccagcccagct

SEQ ID NO: 238479 - DNA, 13 bp, Homo sapiens
gccagcccagctc

SEQ ID NO: 238480 - DNA, 16 bp, Homo sapiens
gcgcctgcgctcctct

SEQ ID NO: 238481 - DNA, 19 bp, Homo sapiens
gcgccttctacctgcagga

SEQ ID NO: 238482 - DNA, 13 bp, Homo sapiens
gcgcgcaccgccc

SEQ ID NO: 238483 - DNA, 14 bp, Homo sapiens
gcgcgggagagagt

SEQ ID NO: 238484 - DNA, 14 bp, Homo sapiens
gcgcgggaggcacc

SEQ ID NO: 238485 - DNA, 21 bp, Homo sapiens
gcgcggttcaggtcagggcta

SEQ ID NO: 238486 - DNA, 15 bp, Homo sapiens
gcgcgtgcccccagc

SEQ ID NO: 238487 - DNA, 13 bp, Homo sapiens
gcgcgtgccttcc

SEQ ID NO: 238488 - DNA, 11 bp, Homo sapiens
gcgctcaggac

SEQ ID NO: 238489 - DNA, 16 bp, Homo sapiens
gcgctccggcagaggc

SEQ ID NO: 238490 - DNA, 20 bp, Homo sapiens
gcgctccggcagaggcaggg

SEQ ID NO: 238491 - DNA, 23 bp, Homo sapiens
gcgctccggcagaggcagggccc

SEQ ID NO: 238492 - DNA, 14 bp, Homo sapiens
gcgctcctctgcag

SEQ ID NO: 238493 - DNA, 21 bp, Homo sapiens
gcgctcctctgcagcctgagc

SEQ ID NO: 238494 - DNA, 22 bp, Homo sapiens
gcgctcctctgcagcctgagct

SEQ ID NO: 238495 - DNA, 23 bp, Homo sapiens
gcgctcctctgcagcctgagctc

SEQ ID NO: 238496 - DNA, 13 bp, Homo sapiens
gcgctctgcccct

SEQ ID NO: 238497 - DNA, 15 bp, Homo sapiens
gcgctctgcccctcc

SEQ ID NO: 238498 - DNA, 18 bp, Homo sapiens
gcgctctgcccctccgtc

SEQ ID NO: 238499 - DNA, 18 bp, Homo sapiens
gcgctcttcaccaggaag

SEQ ID NO: 238500 - DNA, 19 bp, Homo sapiens
gcgctcttcaccaggaaga

SEQ ID NO: 238501 - DNA, 16 bp, Homo sapiens
gcgctcttggtccctg

SEQ ID NO: 238502 - DNA, 11 bp, Homo sapiens
gcgctgcaggt

SEQ ID NO: 238503 - DNA, 23 bp, Homo sapiens
gcgctgctcttatgccatttgtt

SEQ ID NO: 238504 - DNA, 23 bp, Homo sapiens
gcgctggaatccagaaggaagct

SEQ ID NO: 238505 - DNA, 16 bp, Homo sapiens
gcgctttctcctgtgc

SEQ ID NO: 238506 - DNA, 15 bp, Homo sapiens
gcggaacctggctgc

SEQ ID NO: 238507 - DNA, 20 bp, Homo sapiens
gcggaccggagcggctgagg

SEQ ID NO: 238508 - DNA, 22 bp, Homo sapiens
gcggaggccatgggggcccctc

SEQ ID NO: 238509 - DNA, 14 bp, Homo sapiens
gcggagggatgcag

SEQ ID NO: 238510 - DNA, 15 bp, Homo sapiens
gcggcaccgcccacc

SEQ ID NO: 238511 - DNA, 18 bp, Homo sapiens
gcggcaccgcccacccac

SEQ ID NO: 238512 - DNA, 18 bp, Homo sapiens
gcggcagctcttctgggc

SEQ ID NO: 238513 - DNA, 19 bp, Homo sapiens
gcggcagctcttctgggca

SEQ ID NO: 238514 - DNA, 17 bp, Homo sapiens
gcggcccctctgttctg

SEQ ID NO: 238515 - DNA, 14 bp, Homo sapiens
gcggcccggcccac

SEQ ID NO: 238516 - DNA, 22 bp, Homo sapiens
gcggcccggcccacgcagagcc

SEQ ID NO: 238517 - DNA, 15 bp, Homo sapiens
gcggccgatgggagt

SEQ ID NO: 238518 - DNA, 22 bp, Homo sapiens
gcggccgatgggagtctccctc

SEQ ID NO: 238519 - DNA, 19 bp, Homo sapiens
gcggccggcctggggccgg

SEQ ID NO: 238520 - DNA, 22 bp, Homo sapiens
gcggcgatgcactcgcactgca

SEQ ID NO: 238521 - DNA, 13 bp, Homo sapiens
gcggcgcagaggg

SEQ ID NO: 238522 - DNA, 18 bp, Homo sapiens
gcggctaggccggccagc

SEQ ID NO: 238523 - DNA, 22 bp, Homo sapiens
gcggctaggccggccagctccc

SEQ ID NO: 238524 - DNA, 19 bp, Homo sapiens
gcggctcaaaaggaaacca

SEQ ID NO: 238525 - DNA, 22 bp, Homo sapiens
gcggctcaaaaggaaaccaagt

SEQ ID NO: 238526 - DNA, 12 bp, Homo sapiens
gcggctgagagc

SEQ ID NO: 238527 - DNA, 21 bp, Homo sapiens
gcggctgagagccccagctga

SEQ ID NO: 238528 - DNA, 23 bp, Homo sapiens
gcggctgagagccccagctgaca

SEQ ID NO: 238529 - DNA, 20 bp, Homo sapiens
gcggctgaggacggggcaga

SEQ ID NO: 238530 - DNA, 19 bp, Homo sapiens
gcggctggaaagaggagaa

SEQ ID NO: 238531 - DNA, 14 bp, Homo sapiens
gcggctgggagcct

SEQ ID NO: 238532 - DNA, 18 bp, Homo sapiens
gcggctgggagcctcgcc

SEQ ID NO: 238533 - DNA, 14 bp, Homo sapiens
gcgggacctgtggc

SEQ ID NO: 238534 - DNA, 13 bp, Homo sapiens
gcgggaggcacca

SEQ ID NO: 238535 - DNA, 17 bp, Homo sapiens
gcgggaggcaccagctc

SEQ ID NO: 238536 - DNA, 16 bp, Homo sapiens
gcgggcagcccctgct

SEQ ID NO: 238537 - DNA, 10 bp, Homo sapiens
gcgggcaggg

SEQ ID NO: 238538 - DNA, 22 bp, Homo sapiens
gcgggcagggccgctcgatgcc

SEQ ID NO: 238539 - DNA, 20 bp, Homo sapiens
gcgggccaaggactgccgac

SEQ ID NO: 238540 - DNA, 11 bp, Homo sapiens
gcgggccagga

SEQ ID NO: 238541 - DNA, 14 bp, Homo sapiens
gcgggcccagctga

SEQ ID NO: 238542 - DNA, 12 bp, Homo sapiens
gcgggcggccag

SEQ ID NO: 238543 - DNA, 13 bp, Homo sapiens
gcggggcagcagg

SEQ ID NO: 238544 - DNA, 14 bp, Homo sapiens
gcggggcagcagga

SEQ ID NO: 238545 - DNA, 14 bp, Homo sapiens
gcgggggagcctgg

SEQ ID NO: 238546 - DNA, 16 bp, Homo sapiens
gcgggggagcctggag

SEQ ID NO: 238547 - DNA, 17 bp, Homo sapiens
gcgggggctaactggcc

SEQ ID NO: 238548 - DNA, 18 bp, Homo sapiens
gcgggggtctatacattc

SEQ ID NO: 238549 - DNA, 19 bp, Homo sapiens
gcgggtaaaaagagaaggc

SEQ ID NO: 238550 - DNA, 22 bp, Homo sapiens
gcgggtaaaaagagaaggcaag

SEQ ID NO: 238551 - DNA, 23 bp, Homo sapiens
gcgggtaaaaagagaaggcaagc

SEQ ID NO: 238552 - DNA, 14 bp, Homo sapiens
gcgggtctgaagga

SEQ ID NO: 238553 - DNA, 17 bp, Homo sapiens
gcggtaggtgctggcct

SEQ ID NO: 238554 - DNA, 16 bp, Homo sapiens
gcggtcgcggctggga

SEQ ID NO: 238555 - DNA, 13 bp, Homo sapiens
gcggtgaggcagg

SEQ ID NO: 238556 - DNA, 14 bp, Homo sapiens
gcggtgctctggcg

SEQ ID NO: 238557 - DNA, 22 bp, Homo sapiens
gcggtgctctggcggcttcctg

SEQ ID NO: 238558 - DNA, 18 bp, Homo sapiens
gcggtggaaggagcctgc

SEQ ID NO: 238559 - DNA, 18 bp, Homo sapiens
gcggtggctcacgcctgt

SEQ ID NO: 238560 - DNA, 14 bp, Homo sapiens
gcggtgggcagcca

SEQ ID NO: 238561 - DNA, 15 bp, Homo sapiens
gcgtaatgggcctgc

SEQ ID NO: 238562 - DNA, 17 bp, Homo sapiens
gcgtaatgggcctgccc

SEQ ID NO: 238563 - DNA, 14 bp, Homo sapiens
gcgtagagagccgg

SEQ ID NO: 238564 - DNA, 15 bp, Homo sapiens
gcgtagagagccggg

SEQ ID NO: 238565 - DNA, 21 bp, Homo sapiens
gcgtcatggctcaaggattca

SEQ ID NO: 238566 - DNA, 15 bp, Homo sapiens
gcgtccaaccccggg

SEQ ID NO: 238567 - DNA, 19 bp, Homo sapiens
gcgtcccagtctctggcag

SEQ ID NO: 238568 - DNA, 16 bp, Homo sapiens
gcgtccgcgcgccagc

SEQ ID NO: 238569 - DNA, 19 bp, Homo sapiens
gcgtccgcgcgccagcaca

SEQ ID NO: 238570 - DNA, 17 bp, Homo sapiens
gcgtcctgacgccctgc

SEQ ID NO: 238571 - DNA, 13 bp, Homo sapiens
gcgtcctgaggaa

SEQ ID NO: 238572 - DNA, 15 bp, Homo sapiens
gcgtcctgcagagga

SEQ ID NO: 238573 - DNA, 19 bp, Homo sapiens
gcgtcctgcagaggaccac

SEQ ID NO: 238574 - DNA, 19 bp, Homo sapiens
gcgtctgagcggccgcctg

SEQ ID NO: 238575 - DNA, 23 bp, Homo sapiens
gcgtctgagcggccgcctgtcct

SEQ ID NO: 238576 - DNA, 15 bp, Homo sapiens
gcgtctgccccaccc

SEQ ID NO: 238577 - DNA, 12 bp, Homo sapiens
gcgtgaaacaca

SEQ ID NO: 238578 - DNA, 23 bp, Homo sapiens
gcgtgaaacacaccaggctgtgg

SEQ ID NO: 238579 - DNA, 14 bp, Homo sapiens
gcgtgaaggacctg

SEQ ID NO: 238580 - DNA, 15 bp, Homo sapiens
gcgtgattgaccctt

SEQ ID NO: 238581 - DNA, 16 bp, Homo sapiens
gcgtgcccccctcctc

SEQ ID NO: 238582 - DNA, 15 bp, Homo sapiens
gcgtgctccttttct

SEQ ID NO: 238583 - DNA, 21 bp, Homo sapiens
gcgtggcgcagtggccctgag

SEQ ID NO: 238584 - DNA, 19 bp, Homo sapiens
gcgtggctgtggcacagac

SEQ ID NO: 238585 - DNA, 19 bp, Homo sapiens
gcgtgtagcgtcctgagga

SEQ ID NO: 238586 - DNA, 18 bp, Homo sapiens
gcgtgtcaactttcattt

SEQ ID NO: 238587 - DNA, 15 bp, Homo sapiens
gcgtgtccacagagt

SEQ ID NO: 238588 - DNA, 18 bp, Homo sapiens
gcgtgtccctcctcttcc

SEQ ID NO: 238589 - DNA, 21 bp, Homo sapiens
gcgtgtccctcctcttcctgt

SEQ ID NO: 238590 - DNA, 22 bp, Homo sapiens
gcgtgtctgtttccttctcttt

SEQ ID NO: 238591 - DNA, 21 bp, Homo sapiens
gcgttaacacagtaaaatatt

SEQ ID NO: 238592 - DNA, 17 bp, Homo sapiens
gcgttacaccctttctt

SEQ ID NO: 238593 - DNA, 18 bp, Homo sapiens
gcgttagaatgaggagga

SEQ ID NO: 238594 - DNA, 14 bp, Homo sapiens
gcgttcctggcctt

SEQ ID NO: 238595 - DNA, 12 bp, Homo sapiens
gcgttctcctgc

SEQ ID NO: 238596 - DNA, 16 bp, Homo sapiens
gcgttctcctgcttgt

SEQ ID NO: 238597 - DNA, 19 bp, Homo sapiens
gcgttggaattaaaacaat

SEQ ID NO: 238598 - DNA, 17 bp, Homo sapiens
gcgttggagccactcct

SEQ ID NO: 238599 - DNA, 22 bp, Homo sapiens
gcgttggatttaaaaatgccaa

SEQ ID NO: 238600 - DNA, 15 bp, Homo sapiens
gcgttggtgccactt

SEQ ID NO: 238601 - DNA, 23 bp, Homo sapiens
gcgttggtgccacttcttaaagg

SEQ ID NO: 238602 - DNA, 13 bp, Homo sapiens
gcgtttgctgtgc

SEQ ID NO: 238603 - DNA, 23 bp, Homo sapiens
gctaaaaagaactcaaaaggaga

SEQ ID NO: 238604 - DNA, 15 bp, Homo sapiens
gctaaaaggaatagg

SEQ ID NO: 238605 - DNA, 18 bp, Homo sapiens
gctaaagaagacacacag

SEQ ID NO: 238606 - DNA, 20 bp, Homo sapiens
gctaaagaggtggggtgaag

SEQ ID NO: 238607 - DNA, 20 bp, Homo sapiens
gctaaaggggagaaactgaa

SEQ ID NO: 238608 - DNA, 13 bp, Homo sapiens
gctaacaagtagc

SEQ ID NO: 238609 - DNA, 17 bp, Homo sapiens
gctaacatggaagtact

SEQ ID NO: 238610 - DNA, 14 bp, Homo sapiens
gctaacattttaaa

SEQ ID NO: 238611 - DNA, 17 bp, Homo sapiens
gctaactggccccaggc

SEQ ID NO: 238612 - DNA, 15 bp, Homo sapiens
gctaactgtatgtgt

SEQ ID NO: 238613 - DNA, 17 bp, Homo sapiens
gctaagctcaaatgtat

SEQ ID NO: 238614 - DNA, 14 bp, Homo sapiens
gctgccctggtgct

SEQ ID NO: 238615 - DNA, 18 bp, Homo sapiens
gctgccctggtgctgcca

SEQ ID NO: 238616 - DNA, 19 bp, Homo sapiens
gctgccctggtgctgccac

SEQ ID NO: 238617 - DNA, 19 bp, Homo sapiens
gctgccgcgtgcgaccaga

SEQ ID NO: 238618 - DNA, 13 bp, Homo sapiens
gctgccggctgca

SEQ ID NO: 238619 - DNA, 14 bp, Homo sapiens
gctgccggctgcac

SEQ ID NO: 238620 - DNA, 19 bp, Homo sapiens
gctgccgtgcacggggcca

SEQ ID NO: 238621 - DNA, 21 bp, Homo sapiens
gctgccgtgcacggggccagc

SEQ ID NO: 238622 - DNA, 19 bp, Homo sapiens
gctgcctccccaaccctgc

SEQ ID NO: 238623 - DNA, 23 bp, Homo sapiens
gctgcctccccaaccctgcccct

SEQ ID NO: 238624 - DNA, 23 bp, Homo sapiens
gctgcctccctggggaccaggag

SEQ ID NO: 238625 - DNA, 19 bp, Homo sapiens
gctgcctctgaaaatattt

SEQ ID NO: 238626 - DNA, 11 bp, Homo sapiens
gctgcctctgg

SEQ ID NO: 238627 - DNA, 15 bp, Homo sapiens
gctgcctgaaaacca

SEQ ID NO: 238628 - DNA, 19 bp, Homo sapiens
gctgcctgacactgagccc

SEQ ID NO: 238629 - DNA, 11 bp, Homo sapiens
gctgcctgcct

SEQ ID NO: 238630 - DNA, 15 bp, Homo sapiens
gctgcctgcctccgg

SEQ ID NO: 238631 - DNA, 16 bp, Homo sapiens
gctgcctgcctccggc

SEQ ID NO: 238632 - DNA, 22 bp, Homo sapiens
gctgcctgcctccggccctgcc

SEQ ID NO: 238633 - DNA, 14 bp, Homo sapiens
gctgcctgcctgtc

SEQ ID NO: 238634 - DNA, 16 bp, Homo sapiens
gctgcctgctctgcag

SEQ ID NO: 238635 - DNA, 16 bp, Homo sapiens
gctgcctggagaaagg

SEQ ID NO: 238636 - DNA, 21 bp, Homo sapiens
gctgcctggcccccagctgtg

SEQ ID NO: 238637 - DNA, 11 bp, Homo sapiens
gctgcctggcg

SEQ ID NO: 238638 - DNA, 15 bp, Homo sapiens
gctgccttagaacct

SEQ ID NO: 238639 - DNA, 15 bp, Homo sapiens
gctgccttcagggag

SEQ ID NO: 238640 - DNA, 22 bp, Homo sapiens
gctgccttctgacggccctgca

SEQ ID NO: 238641 - DNA, 14 bp, Homo sapiens
gctgcggcaccctt

SEQ ID NO: 238642 - DNA, 22 bp, Homo sapiens
gctgcgtctgacatcctgacct

SEQ ID NO: 238643 - DNA, 15 bp, Homo sapiens
gctgctaatcttcag

SEQ ID NO: 238644 - DNA, 15 bp, Homo sapiens
gctgctaccgccctg

SEQ ID NO: 238645 - DNA, 19 bp, Homo sapiens
gctgctaccgccctgggct

SEQ ID NO: 238646 - DNA, 21 bp, Homo sapiens
gctgctaccgccctgggctgg

SEQ ID NO: 238647 - DNA, 23 bp, Homo sapiens
gctgctaccgccctgggctggac

SEQ ID NO: 238648 - DNA, 23 bp, Homo sapiens
gctgctactacccgagcccagct

SEQ ID NO: 238649 - DNA, 13 bp, Homo sapiens
gctgctcctcatg

SEQ ID NO: 238650 - DNA, 20 bp, Homo sapiens
gctgctcctcgcagttcggt

SEQ ID NO: 238651 - DNA, 19 bp, Homo sapiens
gctgctcctcggccagagc

SEQ ID NO: 238652 - DNA, 20 bp, Homo sapiens
gctgctcctcggccagagct

SEQ ID NO: 238653 - DNA, 21 bp, Homo sapiens
gctgctcctcggccagagctc

SEQ ID NO: 238654 - DNA, 18 bp, Homo sapiens
gctgctcctctttcccct

SEQ ID NO: 238655 - DNA, 20 bp, Homo sapiens
gctgctcctctttcccctcc

SEQ ID NO: 238656 - DNA, 22 bp, Homo sapiens
gctgctcgggaaggcctgaggg

SEQ ID NO: 238657 - DNA, 23 bp, Homo sapiens
gctgctctccttcactctgacag

SEQ ID NO: 238658 - DNA, 17 bp, Homo sapiens
gctgctctgcccagagc

SEQ ID NO: 238659 - DNA, 12 bp, Homo sapiens
gctgctctgcta

SEQ ID NO: 238660 - DNA, 22 bp, Homo sapiens
gctgctgaaaaccatctggcct

SEQ ID NO: 238661 - DNA, 19 bp, Homo sapiens
gctgctgatgtaggagctg

SEQ ID NO: 238662 - DNA, 13 bp, Homo sapiens
gctgctgcaccaa

SEQ ID NO: 238663 - DNA, 23 bp, Homo sapiens
gctgctgccaccaaatctgtcta

SEQ ID NO: 238664 - DNA, 12 bp, Homo sapiens
gctgctgcctgc

SEQ ID NO: 238665 - DNA, 13 bp, Homo sapiens
gctgctgctgctg

SEQ ID NO: 238666 - DNA, 14 bp, Homo sapiens
gctgctggagaata

SEQ ID NO: 238667 - DNA, 11 bp, Homo sapiens
gctgctggctt

SEQ ID NO: 238668 - DNA, 15 bp, Homo sapiens
gctgctggggcatgt

SEQ ID NO: 238669 - DNA, 17 bp, Homo sapiens
gctgctggggcatgtgt

SEQ ID NO: 238670 - DNA, 20 bp, Homo sapiens
gctgctggtcacccccaccc

SEQ ID NO: 238671 - DNA, 13 bp, Homo sapiens
gctgctgtgaatt

SEQ ID NO: 238672 - DNA, 13 bp, Homo sapiens
gctgctgtgcctg

SEQ ID NO: 238673 - DNA, 14 bp, Homo sapiens
gctgcttccagttg

SEQ ID NO: 238674 - DNA, 14 bp, Homo sapiens
gctgcttccctctg

SEQ ID NO: 238675 - DNA, 20 bp, Homo sapiens
gctgcttccctctgcctgtc

SEQ ID NO: 238676 - DNA, 12 bp, Homo sapiens
gctgcttcctaa

SEQ ID NO: 238677 - DNA, 13 bp, Homo sapiens
gctgcttcctaac

SEQ ID NO: 238678 - DNA, 16 bp, Homo sapiens
gctgcttcctaactta

SEQ ID NO: 238679 - DNA, 14 bp, Homo sapiens
gctgcttctccacc

SEQ ID NO: 238680 - DNA, 13 bp, Homo sapiens
gctgcttctgggc

SEQ ID NO: 238681 - DNA, 16 bp, Homo sapiens
gctgcttctgggcctg

SEQ ID NO: 238682 - DNA, 15 bp, Homo sapiens
gctgcttctggggga

SEQ ID NO: 238683 - DNA, 12 bp, Homo sapiens
gctgcttctgtg

SEQ ID NO: 238684 - DNA, 13 bp, Homo sapiens
gctgctttccaac

SEQ ID NO: 238685 - DNA, 16 bp, Homo sapiens
gctgctttggctgact

SEQ ID NO: 238686 - DNA, 19 bp, Homo sapiens
gctgctttggctgactggg

SEQ ID NO: 238687 - DNA, 22 bp, Homo sapiens
gctgctttgttaccttaaaact

SEQ ID NO: 238688 - DNA, 23 bp, Homo sapiens
gctgctttgttaccttaaaacta

SEQ ID NO: 238689 - DNA, 22 bp, Homo sapiens
gctgcttttccctaagccaagg

SEQ ID NO: 238690 - DNA, 23 bp, Homo sapiens
gctggaaaatctgtaaaaaagaa

SEQ ID NO: 238691 - DNA, 21 bp, Homo sapiens
gctggaaagaggagaaggaga

SEQ ID NO: 238692 - DNA, 21 bp, Homo sapiens
gctggaaaggatgcttctgct

SEQ ID NO: 238693 - DNA, 18 bp, Homo sapiens
gctggaagacttagatct

SEQ ID NO: 238694 - DNA, 20 bp, Homo sapiens
gctggaaggcagggcagagg

SEQ ID NO: 238695 - DNA, 13 bp, Homo sapiens
gctggaagggtca

SEQ ID NO: 238696 - DNA, 17 bp, Homo sapiens
gctggaatccagaagga

SEQ ID NO: 238697 - DNA, 22 bp, Homo sapiens
gctggaatccagaaggaagctc

SEQ ID NO: 238698 - DNA, 17 bp, Homo sapiens
gctggacatgctttggc

SEQ ID NO: 238699 - DNA, 20 bp, Homo sapiens
gctggagaataaatttggga

SEQ ID NO: 238700 - DNA, 12 bp, Homo sapiens
gctggagaggtt

SEQ ID NO: 238701 - DNA, 18 bp, Homo sapiens
gctggagccaatggtgag

SEQ ID NO: 238702 - DNA, 13 bp, Homo sapiens
gctggagcctgag

SEQ ID NO: 238703 - DNA, 16 bp, Homo sapiens
gctggagtcctgttct

SEQ ID NO: 238704 - DNA, 14 bp, Homo sapiens
gctggagtgcagtg

SEQ ID NO: 238705 - DNA, 15 bp, Homo sapiens
gctggagtgcagtgg

SEQ ID NO: 238706 - DNA, 20 bp, Homo sapiens
gctggagtgcagtggtgcga

SEQ ID NO: 238707 - DNA, 15 bp, Homo sapiens
gctggagtgctgctt

SEQ ID NO: 238708 - DNA, 13 bp, Homo sapiens
gctggagtgctgg

SEQ ID NO: 238709 - DNA, 15 bp, Homo sapiens
gctggagtgctggct

SEQ ID NO: 238710 - DNA, 18 bp, Homo sapiens
gctggattaatgttttgt

SEQ ID NO: 238711 - DNA, 16 bp, Homo sapiens
gctggattacaggcat

SEQ ID NO: 238712 - DNA, 17 bp, Homo sapiens
gctggcaccgccttctc

SEQ ID NO: 238713 - DNA, 15 bp, Homo sapiens
gctggcagcgcctcc

SEQ ID NO: 238714 - DNA, 16 bp, Homo sapiens
gctggcagcgcctccc

SEQ ID NO: 238715 - DNA, 18 bp, Homo sapiens
gctggcagcgcctcccgc

SEQ ID NO: 238716 - DNA, 18 bp, Homo sapiens
gctggcagcgctcctgga

SEQ ID NO: 238717 - DNA, 16 bp, Homo sapiens
gctggcagctctccag

SEQ ID NO: 238718 - DNA, 23 bp, Homo sapiens
gctggcagctctccagtcaggag

SEQ ID NO: 238719 - DNA, 16 bp, Homo sapiens
gctggcatttgcacct

SEQ ID NO: 238720 - DNA, 19 bp, Homo sapiens
gctggccagcaaggcaggt

SEQ ID NO: 238721 - DNA, 13 bp, Homo sapiens
gctggccagcctg

SEQ ID NO: 238722 - DNA, 21 bp, Homo sapiens
gctggccagcctggggcctgg

SEQ ID NO: 238723 - DNA, 12 bp, Homo sapiens
gctggccctgcc

SEQ ID NO: 238724 - DNA, 18 bp, Homo sapiens
gctggccctgccctcccc

SEQ ID NO: 238725 - DNA, 18 bp, Homo sapiens
gctggcctcccaataaag

SEQ ID NO: 238726 - DNA, 14 bp, Homo sapiens
gctggcctcttcct

SEQ ID NO: 238727 - DNA, 12 bp, Homo sapiens
gctggcctggat

SEQ ID NO: 238728 - DNA, 14 bp, Homo sapiens
gctggcctggatct

SEQ ID NO: 238729 - DNA, 19 bp, Homo sapiens
gctggccttcctgccctac

SEQ ID NO: 238730 - DNA, 14 bp, Homo sapiens
gctggcggaacctg

SEQ ID NO: 238731 - DNA, 17 bp, Homo sapiens
gctggggggctgtcctg

SEQ ID NO: 238732 - DNA, 13 bp, Homo sapiens
gctgggtccaggg

SEQ ID NO: 238733 - DNA, 12 bp, Homo sapiens
gctgggtcgccc

SEQ ID NO: 238734 - DNA, 14 bp, Homo sapiens
gctgggtcgcccct

SEQ ID NO: 238735 - DNA, 18 bp, Homo sapiens
gctgggtcgcccctcctc

SEQ ID NO: 238736 - DNA, 13 bp, Homo sapiens
gctgggtgggaat

SEQ ID NO: 238737 - DNA, 15 bp, Homo sapiens
gctgggtggggacag

SEQ ID NO: 238738 - DNA, 13 bp, Homo sapiens
gctgggtgtttca

SEQ ID NO: 238739 - DNA, 21 bp, Homo sapiens
gctgggtttgggcagtggaga

SEQ ID NO: 238740 - DNA, 21 bp, Homo sapiens
gctgggttttcaggggctttg

SEQ ID NO: 238741 - DNA, 18 bp, Homo sapiens
gctggtaagggccaagtc

SEQ ID NO: 238742 - DNA, 23 bp, Homo sapiens
gctggtaagggccaagtcccacc

SEQ ID NO: 238743 - DNA, 18 bp, Homo sapiens
gctggtagagatggagga

SEQ ID NO: 238744 - DNA, 21 bp, Homo sapiens
gctggtagagatggaggagga

SEQ ID NO: 238745 - DNA, 23 bp, Homo sapiens
gctggtcactaaccaacaaggtt

SEQ ID NO: 238746 - DNA, 15 bp, Homo sapiens
gctggtcactgccat

SEQ ID NO: 238747 - DNA, 19 bp, Homo sapiens
gctggtccagggctagtga

SEQ ID NO: 238748 - DNA, 14 bp, Homo sapiens
gctggtgacagcct

SEQ ID NO: 238749 - DNA, 23 bp, Homo sapiens
gctggtgacagccttgggccttt

SEQ ID NO: 238750 - DNA, 20 bp, Homo sapiens
gctggtgcattacagagagg

SEQ ID NO: 238751 - DNA, 23 bp, Homo sapiens
gctggtgccagccttcctctgca

SEQ ID NO: 238752 - DNA, 14 bp, Homo sapiens
gctggtgccccaca

SEQ ID NO: 238753 - DNA, 15 bp, Homo sapiens
gctggtgccccacag

SEQ ID NO: 238754 - DNA, 18 bp, Homo sapiens
gctggtgccccacagcta

SEQ ID NO: 238755 - DNA, 13 bp, Homo sapiens
gctggtgcccgga

SEQ ID NO: 238756 - DNA, 16 bp, Homo sapiens
gctggtggatggtgac

SEQ ID NO: 238757 - DNA, 19 bp, Homo sapiens
gctggtgggcaccaagagc

SEQ ID NO: 238758 - DNA, 20 bp, Homo sapiens
gctggtggtcatgaattcat

SEQ ID NO: 238759 - DNA, 19 bp, Homo sapiens
gctggtgtcactctgcctc

SEQ ID NO: 238760 - DNA, 12 bp, Homo sapiens
gctggtgtcccc

SEQ ID NO: 238761 - DNA, 13 bp, Homo sapiens
gctggtgtcccct

SEQ ID NO: 238762 - DNA, 15 bp, Homo sapiens
gctggtgtccccttc

SEQ ID NO: 238763 - DNA, 22 bp, Homo sapiens
gctggtgtccccttcccctgct

SEQ ID NO: 238764 - DNA, 15 bp, Homo sapiens
gctggtttcctcatt

SEQ ID NO: 238765 - DNA, 12 bp, Homo sapiens
gctggttttcct

SEQ ID NO: 238766 - DNA, 12 bp, Homo sapiens
gctgtaaaaaca

SEQ ID NO: 238767 - DNA, 19 bp, Homo sapiens
gctgtaaataaaaatagct

SEQ ID NO: 238768 - DNA, 23 bp, Homo sapiens
gctgtaactcagacattccaagg

SEQ ID NO: 238769 - DNA, 14 bp, Homo sapiens
gctgtaactgctga

SEQ ID NO: 238770 - DNA, 16 bp, Homo sapiens
gctgtaactgctgagc

SEQ ID NO: 238771 - DNA, 17 bp, Homo sapiens
gctgtaagacggccttg

SEQ ID NO: 238772 - DNA, 22 bp, Homo sapiens
gctgtaatctatgaattctaag

SEQ ID NO: 238773 - DNA, 14 bp, Homo sapiens
gctgtaatttaatt

SEQ ID NO: 238774 - DNA, 14 bp, Homo sapiens
gctgtacagatatc

SEQ ID NO: 238775 - DNA, 15 bp, Homo sapiens
gctgtacccttccac

SEQ ID NO: 238776 - DNA, 18 bp, Homo sapiens
gctgtacccttccacctc

SEQ ID NO: 238777 - DNA, 20 bp, Homo sapiens
gctgtactgagttctcatcc

SEQ ID NO: 238778 - DNA, 14 bp, Homo sapiens
gctgtagccatggc

SEQ ID NO: 238779 - DNA, 17 bp, Homo sapiens
gctgtagccatggctca

SEQ ID NO: 238780 - DNA, 20 bp, Homo sapiens
gctgtagtagccctttctgt

SEQ ID NO: 238781 - DNA, 21 bp, Homo sapiens
gctgtagtagccctttctgtg

SEQ ID NO: 238782 - DNA, 14 bp, Homo sapiens
gctgtatacaaaca

SEQ ID NO: 238783 - DNA, 17 bp, Homo sapiens
gctgtatacaaacaggt

SEQ ID NO: 238784 - DNA, 20 bp, Homo sapiens
gctgtatacaaacaggtgct

SEQ ID NO: 238785 - DNA, 19 bp, Homo sapiens
gctgtattttcttttatat

SEQ ID NO: 238786 - DNA, 16 bp, Homo sapiens
gctgtcaattacagga

SEQ ID NO: 238787 - DNA, 22 bp, Homo sapiens
gctgtcacccagcaaggcacag

SEQ ID NO: 238788 - DNA, 17 bp, Homo sapiens
gctgtcagccattcctg

SEQ ID NO: 238789 - DNA, 17 bp, Homo sapiens
gctgtcagcgcctcaag

SEQ ID NO: 238790 - DNA, 15 bp, Homo sapiens
gctgtcattgtccat

SEQ ID NO: 238791 - DNA, 16 bp, Homo sapiens
gctgtccagagaaaag

SEQ ID NO: 238792 - DNA, 21 bp, Homo sapiens
gctgtcccaggggtctccctg

SEQ ID NO: 238793 - DNA, 15 bp, Homo sapiens
gctgtcccctccatc

SEQ ID NO: 238794 - DNA, 21 bp, Homo sapiens
gctgtcccctccatctgggga

SEQ ID NO: 238795 - DNA, 22 bp, Homo sapiens
gctgtcccctccatctggggat

SEQ ID NO: 238796 - DNA, 18 bp, Homo sapiens
gctgtcccctctccctgg

SEQ ID NO: 238797 - DNA, 16 bp, Homo sapiens
gctgtcccctctgtca

SEQ ID NO: 238798 - DNA, 13 bp, Homo sapiens
gctgtccctcact

SEQ ID NO: 238799 - DNA, 16 bp, Homo sapiens
gctgtccctcctgagg

SEQ ID NO: 238800 - DNA, 21 bp, Homo sapiens
gctgtccctcctgaggtctgg

SEQ ID NO: 238801 - DNA, 19 bp, Homo sapiens
gctgtcccttacgtgagtc

SEQ ID NO: 238802 - DNA, 21 bp, Homo sapiens
gctgtcccttacgtgagtcct

SEQ ID NO: 238803 - DNA, 16 bp, Homo sapiens
gctgtcccttttcctt

SEQ ID NO: 238804 - DNA, 19 bp, Homo sapiens
gctgtccttagactccttc

SEQ ID NO: 238805 - DNA, 14 bp, Homo sapiens
gctgtctggggcct

SEQ ID NO: 238806 - DNA, 12 bp, Homo sapiens
gctgtctgtcct

SEQ ID NO: 238807 - DNA, 15 bp, Homo sapiens
gctgtgaaacagtgt

SEQ ID NO: 238808 - DNA, 10 bp, Homo sapiens
gctgtgaaat

SEQ ID NO: 238809 - DNA, 12 bp, Homo sapiens
gctgtgaaattg

SEQ ID NO: 238810 - DNA, 14 bp, Homo sapiens
gctgtgaatttttt

SEQ ID NO: 238811 - DNA, 22 bp, Homo sapiens
gctgtgaccatttataatgtta

SEQ ID NO: 238812 - DNA, 17 bp, Homo sapiens
gctgtgactgagggcct

SEQ ID NO: 238813 - DNA, 18 bp, Homo sapiens
gctgtgagcagcctccac

SEQ ID NO: 238814 - DNA, 22 bp, Homo sapiens
gcacctgaggcccagcagagcc

SEQ ID NO: 238815 - DNA, 23 bp, Homo sapiens
gcacctgaggcccagcagagccg

SEQ ID NO: 238816 - DNA, 15 bp, Homo sapiens
gcacctgccctctgt

SEQ ID NO: 238817 - DNA, 20 bp, Homo sapiens
gcacctgcgcctggctctgt

SEQ ID NO: 238818 - DNA, 21 bp, Homo sapiens
gcacctgcgcctggctctgtc

SEQ ID NO: 238819 - DNA, 11 bp, Homo sapiens
gcacctgctgg

SEQ ID NO: 238820 - DNA, 23 bp, Homo sapiens
gcacctgctggaaaccacacttc

SEQ ID NO: 238821 - DNA, 15 bp, Homo sapiens
gcacctggcacacca

SEQ ID NO: 238822 - DNA, 13 bp, Homo sapiens
gcacctggcctgc

SEQ ID NO: 238823 - DNA, 14 bp, Homo sapiens
gcacctgtggccag

SEQ ID NO: 238824 - DNA, 19 bp, Homo sapiens
gcacctgtggccagagcac

SEQ ID NO: 238825 - DNA, 19 bp, Homo sapiens
gcacctgtggcctctcagt

SEQ ID NO: 238826 - DNA, 21 bp, Homo sapiens
gcacctgtggcctctcagtca

SEQ ID NO: 238827 - DNA, 15 bp, Homo sapiens
gcaccttcctcactt

SEQ ID NO: 238828 - DNA, 16 bp, Homo sapiens
gcaccttcctcacttc

SEQ ID NO: 238829 - DNA, 14 bp, Homo sapiens
gcaccttgctgcag

SEQ ID NO: 238830 - DNA, 18 bp, Homo sapiens
gcaccttgggcacgggag

SEQ ID NO: 238831 - DNA, 22 bp, Homo sapiens
gcaccttttataccagagacct

SEQ ID NO: 238832 - DNA, 20 bp, Homo sapiens
gcacgagtgggaaggacttg

SEQ ID NO: 238833 - DNA, 21 bp, Homo sapiens
gcacgatctcagctcactgca

SEQ ID NO: 238834 - DNA, 14 bp, Homo sapiens
gcacgcacacacac

SEQ ID NO: 238835 - DNA, 15 bp, Homo sapiens
gcacgcacctgtagt

SEQ ID NO: 238836 - DNA, 16 bp, Homo sapiens
gcacgcacctgtagtc

SEQ ID NO: 238837 - DNA, 22 bp, Homo sapiens
gcacgcacctgtagtcccagct

SEQ ID NO: 238838 - DNA, 18 bp, Homo sapiens
gcacgcccatgtgtgagt

SEQ ID NO: 238839 - DNA, 16 bp, Homo sapiens
gcacgctgtgggcagg

SEQ ID NO: 238840 - DNA, 23 bp, Homo sapiens
gcacggctccgagggcggccagg

SEQ ID NO: 238841 - DNA, 15 bp, Homo sapiens
gcacgggcaaagaaa

SEQ ID NO: 238842 - DNA, 20 bp, Homo sapiens
gcacggtttctgttctgccc

SEQ ID NO: 238843 - DNA, 22 bp, Homo sapiens
gcacgtcctccaccggtgcctc

SEQ ID NO: 238844 - DNA, 23 bp, Homo sapiens
gcacgtcgccatccgtcaccaga

SEQ ID NO: 238845 - DNA, 15 bp, Homo sapiens
gcacgtggagagctg

SEQ ID NO: 238846 - DNA, 23 bp, Homo sapiens
gcacgtgggtcttcagggggcca

SEQ ID NO: 238847 - DNA, 16 bp, Homo sapiens
gcactactcctctgca

SEQ ID NO: 238848 - DNA, 14 bp, Homo sapiens
gcactattggactt

SEQ ID NO: 238849 - DNA, 15 bp, Homo sapiens
gcactattggacttt

SEQ ID NO: 238850 - DNA, 21 bp, Homo sapiens
gcactcagtgtggactgggaa

SEQ ID NO: 238851 - DNA, 18 bp, Homo sapiens
gcactccatggccacccc

SEQ ID NO: 238852 - DNA, 14 bp, Homo sapiens
gcactcccagggcc

SEQ ID NO: 238853 - DNA, 15 bp, Homo sapiens
gcactctctgccagc

SEQ ID NO: 238854 - DNA, 23 bp, Homo sapiens
gcactctctgccagctccacagg

SEQ ID NO: 238855 - DNA, 23 bp, Homo sapiens
gcactctgagtttaccatttgta

SEQ ID NO: 238856 - DNA, 21 bp, Homo sapiens
gcactgaaggctttcagggcc

SEQ ID NO: 238857 - DNA, 23 bp, Homo sapiens
gcactgacctgctccgccaggaa

SEQ ID NO: 238858 - DNA, 12 bp, Homo sapiens
gcactgagggcc

SEQ ID NO: 238859 - DNA, 14 bp, Homo sapiens
gcactgagggccac

SEQ ID NO: 238860 - DNA, 15 bp, Homo sapiens
gcactgatttcacaa

SEQ ID NO: 238861 - DNA, 19 bp, Homo sapiens
gcactgatttcacaacaga

SEQ ID NO: 238862 - DNA, 21 bp, Homo sapiens
gcactgccattagactgaatt

SEQ ID NO: 238863 - DNA, 18 bp, Homo sapiens
gcactgctgcccagcctc

SEQ ID NO: 238864 - DNA, 14 bp, Homo sapiens
gcactggaaaacat

SEQ ID NO: 238865 - DNA, 19 bp, Homo sapiens
gcactggcattgtccctgt

SEQ ID NO: 238866 - DNA, 13 bp, Homo sapiens
gcactggccagag

SEQ ID NO: 238867 - DNA, 14 bp, Homo sapiens
gcactggccagaga

SEQ ID NO: 238868 - DNA, 20 bp, Homo sapiens
gcactggccagagagggccc

SEQ ID NO: 238869 - DNA, 14 bp, Homo sapiens
gcactggctgctct

SEQ ID NO: 238870 - DNA, 16 bp, Homo sapiens
gcactggctgctctgt

SEQ ID NO: 238871 - DNA, 14 bp, Homo sapiens
gcactgggaagctg

SEQ ID NO: 238872 - DNA, 19 bp, Homo sapiens
gcactgggaagctggagtg

SEQ ID NO: 238873 - DNA, 16 bp, Homo sapiens
gcactgggccggcagc

SEQ ID NO: 238874 - DNA, 20 bp, Homo sapiens
gcactgggccggcagcctgg

SEQ ID NO: 238875 - DNA, 21 bp, Homo sapiens
gcactgggccggcagcctggt

SEQ ID NO: 238876 - DNA, 20 bp, Homo sapiens
gcactgggggaacagatgct

SEQ ID NO: 238877 - DNA, 16 bp, Homo sapiens
gcactggggtaccaca

SEQ ID NO: 238878 - DNA, 24 bp, Homo sapiens
gcactggtggcccgacagcctggc

SEQ ID NO: 238879 - DNA, 16 bp, Homo sapiens
gcactgtcactttgct

SEQ ID NO: 238880 - DNA, 20 bp, Homo sapiens
gcactgtctcagtttcactt

SEQ ID NO: 238881 - DNA, 11 bp, Homo sapiens
gcactgtgctt

SEQ ID NO: 238882 - DNA, 22 bp, Homo sapiens
gcactgtgcttgctcctaagca

SEQ ID NO: 238883 - DNA, 22 bp, Homo sapiens
gcactgtgtttatatgtcttgc

SEQ ID NO: 238884 - DNA, 18 bp, Homo sapiens
gcacttattttttaatgt

SEQ ID NO: 238885 - DNA, 14 bp, Homo sapiens
gcacttcatatcta

SEQ ID NO: 238886 - DNA, 22 bp, Homo sapiens
gcacttcatatctagatttcta

SEQ ID NO: 238887 - DNA, 11 bp, Homo sapiens
gcacttccaaa

SEQ ID NO: 238888 - DNA, 22 bp, Homo sapiens
gcacttgcacgcccatgtgtga

SEQ ID NO: 238889 - DNA, 15 bp, Homo sapiens
gcacttgcgtcctgc

SEQ ID NO: 238890 - DNA, 18 bp, Homo sapiens
gcacttggactcttgctc

SEQ ID NO: 238891 - DNA, 16 bp, Homo sapiens
gcacttggtgctgctt

SEQ ID NO: 238892 - DNA, 17 bp, Homo sapiens
gcacttggtgctgcttt

SEQ ID NO: 238893 - DNA, 18 bp, Homo sapiens
gcactttagtgattgctt

SEQ ID NO: 238894 - DNA, 15 bp, Homo sapiens
gcactttgaaaatat

SEQ ID NO: 238895 - DNA, 23 bp, Homo sapiens
gcactttgaaaatatttctatgt

SEQ ID NO: 238896 - DNA, 16 bp, Homo sapiens
gcactttgggaggctg

SEQ ID NO: 238897 - DNA, 17 bp, Homo sapiens
gcactttgggaggctga

SEQ ID NO: 238898 - DNA, 14 bp, Homo sapiens
gcacttttctgtgt

SEQ ID NO: 238899 - DNA, 14 bp, Homo sapiens
gcagaaaagaggag

SEQ ID NO: 238900 - DNA, 16 bp, Homo sapiens
gcagaaaagaggagac

SEQ ID NO: 238901 - DNA, 22 bp, Homo sapiens
gcagaaacccccaggaggagag

SEQ ID NO: 238902 - DNA, 15 bp, Homo sapiens
gcagaaagggtaggt

SEQ ID NO: 238903 - DNA, 16 bp, Homo sapiens
gcagaaatgtgctgca

SEQ ID NO: 238904 - DNA, 13 bp, Homo sapiens
gcagaacacctgg

SEQ ID NO: 238905 - DNA, 20 bp, Homo sapiens
gcagaacagttaagcagccg

SEQ ID NO: 238906 - DNA, 16 bp, Homo sapiens
gcagaaccctggtgag

SEQ ID NO: 238907 - DNA, 16 bp, Homo sapiens
gcagaacctggtggct

SEQ ID NO: 238908 - DNA, 19 bp, Homo sapiens
gcagaacctggtggctgga

SEQ ID NO: 238909 - DNA, 18 bp, Homo sapiens
gcagaactctctgtcttc

SEQ ID NO: 238910 - DNA, 14 bp, Homo sapiens
gcagaactgagctc

SEQ ID NO: 238911 - DNA, 16 bp, Homo sapiens
gcagaactgagctcct

SEQ ID NO: 238912 - DNA, 18 bp, Homo sapiens
gcagaactgagctcctct

SEQ ID NO: 238913 - DNA, 13 bp, Homo sapiens
gcagaagatagag

SEQ ID NO: 238914 - DNA, 23 bp, Homo sapiens
gcagaagggggtctcttcttcca

SEQ ID NO: 238915 - DNA, 21 bp, Homo sapiens
gcagaagtgctctttgtggca

SEQ ID NO: 238916 - DNA, 22 bp, Homo sapiens
gcagaagtgctctttgtggcag

SEQ ID NO: 238917 - DNA, 14 bp, Homo sapiens
gcagaatagtattt

SEQ ID NO: 238918 - DNA, 22 bp, Homo sapiens
gcagaatggtgggctccagagt

SEQ ID NO: 238919 - DNA, 10 bp, Homo sapiens
gcagacacac

SEQ ID NO: 238920 - DNA, 12 bp, Homo sapiens
gcagacacacaa

SEQ ID NO: 238921 - DNA, 22 bp, Homo sapiens
gcagacacacacacacacacaa

SEQ ID NO: 238922 - DNA, 18 bp, Homo sapiens
gcagactcagtttgtcag

SEQ ID NO: 238923 - DNA, 22 bp, Homo sapiens
gcagactcctcagatctgaaca

SEQ ID NO: 238924 - DNA, 12 bp, Homo sapiens
gcagactggagg

SEQ ID NO: 238925 - DNA, 13 bp, Homo sapiens
gcagactggaggg

SEQ ID NO: 238926 - DNA, 14 bp, Homo sapiens
gcagagaaaacaca

SEQ ID NO: 238927 - DNA, 12 bp, Homo sapiens
gcagagaagaga

SEQ ID NO: 238928 - DNA, 15 bp, Homo sapiens
gcagagaagagacca

SEQ ID NO: 238929 - DNA, 14 bp, Homo sapiens
gcagagaagccttg

SEQ ID NO: 238930 - DNA, 16 bp, Homo sapiens
gctactctgtccaggc

SEQ ID NO: 238931 - DNA, 18 bp, Homo sapiens
gctactctgtccaggcca

SEQ ID NO: 238932 - DNA, 20 bp, Homo sapiens
gctactctgtccaggccact

SEQ ID NO: 238933 - DNA, 17 bp, Homo sapiens
gctactgatttcctttg

SEQ ID NO: 238934 - DNA, 15 bp, Homo sapiens
gctactggcagctcc

SEQ ID NO: 238935 - DNA, 17 bp, Homo sapiens
gctactggcagctcctc

SEQ ID NO: 238936 - DNA, 20 bp, Homo sapiens
gctactgtcagtgtcctcag

SEQ ID NO: 238937 - DNA, 21 bp, Homo sapiens
gctacttaattcctttctcat

SEQ ID NO: 238938 - DNA, 16 bp, Homo sapiens
gctacttgggagcctg

SEQ ID NO: 238939 - DNA, 13 bp, Homo sapiens
gctacttgggagg

SEQ ID NO: 238940 - DNA, 15 bp, Homo sapiens
gctacttttacttgt

SEQ ID NO: 238941 - DNA, 13 bp, Homo sapiens
gctagaatacttt

SEQ ID NO: 238942 - DNA, 15 bp, Homo sapiens
gctagaatacttttt

SEQ ID NO: 238943 - DNA, 20 bp, Homo sapiens
gctagaatatcctatactgg

SEQ ID NO: 238944 - DNA, 22 bp, Homo sapiens
gctagaatggaaaactgcctgt

SEQ ID NO: 238945 - DNA, 23 bp, Homo sapiens
gctagaatggaaaactgcctgtt

SEQ ID NO: 238946 - DNA, 17 bp, Homo sapiens
gctagacaaaggcccag

SEQ ID NO: 238947 - DNA, 19 bp, Homo sapiens
gctagacaaggttgctgtt

SEQ ID NO: 238948 - DNA, 22 bp, Homo sapiens
gctagagaggggcctctggctg

SEQ ID NO: 238949 - DNA, 23 bp, Homo sapiens
gctagagaggggcctctggctgc

SEQ ID NO: 238950 - DNA, 20 bp, Homo sapiens
gctagagcaacccctgtacc

SEQ ID NO: 238951 - DNA, 15 bp, Homo sapiens
gctagagcattctgg

SEQ ID NO: 238952 - DNA, 20 bp, Homo sapiens
gctagagcattctggggtgg

SEQ ID NO: 238953 - DNA, 16 bp, Homo sapiens
gctagagtcctcactc

SEQ ID NO: 238954 - DNA, 18 bp, Homo sapiens
gctagagtcctcactccc

SEQ ID NO: 238955 - DNA, 19 bp, Homo sapiens
gctagcaaatggcagaacc

SEQ ID NO: 238956 - DNA, 22 bp, Homo sapiens
gctagcccagtccctggagctg

SEQ ID NO: 238957 - DNA, 11 bp, Homo sapiens
gctagccccag

SEQ ID NO: 238958 - DNA, 22 bp, Homo sapiens
gctagctatttctatgtatgtg

SEQ ID NO: 238959 - DNA, 16 bp, Homo sapiens
gctaggaaaggcagaa

SEQ ID NO: 238960 - DNA, 20 bp, Homo sapiens
gctaggaaaggcagaaacac

SEQ ID NO: 238961 - DNA, 11 bp, Homo sapiens
gctaggactga

SEQ ID NO: 238962 - DNA, 17 bp, Homo sapiens
gctaggactgaggagtg

SEQ ID NO: 238963 - DNA, 16 bp, Homo sapiens
gctaggccggccagct

SEQ ID NO: 238964 - DNA, 18 bp, Homo sapiens
gctaggcgctggggagac

SEQ ID NO: 238965 - DNA, 13 bp, Homo sapiens
gctagtacctgta

SEQ ID NO: 238966 - DNA, 21 bp, Homo sapiens
gctagtatcttcaaactttca

SEQ ID NO: 238967 - DNA, 20 bp, Homo sapiens
gctagtccggacccacctca

SEQ ID NO: 238968 - DNA, 21 bp, Homo sapiens
gctagtgacttgtgtcccatg

SEQ ID NO: 238969 - DNA, 17 bp, Homo sapiens
gctagtgtgagtggcag

SEQ ID NO: 238970 - DNA, 21 bp, Homo sapiens
gctagtgtgagtggcagccat

SEQ ID NO: 238971 - DNA, 18 bp, Homo sapiens
gctataaatagtgaaaat

SEQ ID NO: 238972 - DNA, 18 bp, Homo sapiens
gctataacaactctattt

SEQ ID NO: 238973 - DNA, 22 bp, Homo sapiens
gctataacatttgctgaatatg

SEQ ID NO: 238974 - DNA, 17 bp, Homo sapiens
gctatatccatgtactg

SEQ ID NO: 238975 - DNA, 18 bp, Homo sapiens
gctatatccatgtactgt

SEQ ID NO: 238976 - DNA, 19 bp, Homo sapiens
gctatatccatgtactgta

SEQ ID NO: 238977 - DNA, 14 bp, Homo sapiens
gctatattttcatg

SEQ ID NO: 238978 - DNA, 23 bp, Homo sapiens
gctatattttcatgacttttcca

SEQ ID NO: 238979 - DNA, 15 bp, Homo sapiens
gctatcccttctcag

SEQ ID NO: 238980 - DNA, 23 bp, Homo sapiens
gctatgcacaccaaattgctgag

SEQ ID NO: 238981 - DNA, 15 bp, Homo sapiens
gctatggcaaggggg

SEQ ID NO: 238982 - DNA, 19 bp, Homo sapiens
gctatgggagccccagggt

SEQ ID NO: 238983 - DNA, 21 bp, Homo sapiens
gctatgggagccccagggtct

SEQ ID NO: 238984 - DNA, 23 bp, Homo sapiens
gctatgttttggagagagcaatc

SEQ ID NO: 238985 - DNA, 12 bp, Homo sapiens
gctattaagaaa

SEQ ID NO: 238986 - DNA, 14 bp, Homo sapiens
gctattaagaaact

SEQ ID NO: 238987 - DNA, 13 bp, Homo sapiens
gctattacaaata

SEQ ID NO: 238988 - DNA, 14 bp, Homo sapiens
gctattcacacaca

SEQ ID NO: 238989 - DNA, 14 bp, Homo sapiens
gctattccctggag

SEQ ID NO: 238990 - DNA, 12 bp, Homo sapiens
gctattgttgtg

SEQ ID NO: 238991 - DNA, 15 bp, Homo sapiens
gctattgttgtgggc

SEQ ID NO: 238992 - DNA, 16 bp, Homo sapiens
gctattgttgtgggct

SEQ ID NO: 238993 - DNA, 21 bp, Homo sapiens
gctatttcaggcacatcattg

SEQ ID NO: 238994 - DNA, 15 bp, Homo sapiens
gctatttctctcccc

SEQ ID NO: 238995 - DNA, 17 bp, Homo sapiens
gctcaaagatgtactga

SEQ ID NO: 238996 - DNA, 20 bp, Homo sapiens
gctcaaagatgtactgagag

SEQ ID NO: 238997 - DNA, 14 bp, Homo sapiens
gctcaaatctattc

SEQ ID NO: 238998 - DNA, 16 bp, Homo sapiens
gctcaacccccctccc

SEQ ID NO: 238999 - DNA, 20 bp, Homo sapiens
gctcaacccccctcccagac

SEQ ID NO: 239000 - DNA, 21 bp, Homo sapiens
gctcaacctctcagatccctc

SEQ ID NO: 239001 - DNA, 19 bp, Homo sapiens
gctcaatattcctgaatga

SEQ ID NO: 239002 - DNA, 22 bp, Homo sapiens
gctcaatattcctgaatgaaat

SEQ ID NO: 239003 - DNA, 17 bp, Homo sapiens
gctcaatgaaaccttcc

SEQ ID NO: 239004 - DNA, 21 bp, Homo sapiens
gctcaatgaaaccttcctctt

SEQ ID NO: 239005 - DNA, 12 bp, Homo sapiens
gctcaatgtgct

SEQ ID NO: 239006 - DNA, 12 bp, Homo sapiens
gctcacagactg

SEQ ID NO: 239007 - DNA, 16 bp, Homo sapiens
gctcacattccctctc

SEQ ID NO: 239008 - DNA, 20 bp, Homo sapiens
gctcacattccctctcatcc

SEQ ID NO: 239009 - DNA, 19 bp, Homo sapiens
gctcacccattgtctcatt

SEQ ID NO: 239010 - DNA, 14 bp, Homo sapiens
gctcacctgcagcc

SEQ ID NO: 239011 - DNA, 19 bp, Homo sapiens
gctcacctgcagcccctcc

SEQ ID NO: 239012 - DNA, 18 bp, Homo sapiens
gctcacgctcccccgcag

SEQ ID NO: 239013 - DNA, 15 bp, Homo sapiens
gctcacggggcctcc

SEQ ID NO: 239014 - DNA, 16 bp, Homo sapiens
gctcacgtctgtgagt

SEQ ID NO: 239015 - DNA, 22 bp, Homo sapiens
gctcacgtctgtgagtctgtcc

SEQ ID NO: 239016 - DNA, 17 bp, Homo sapiens
gctcacgtgtgtgactc

SEQ ID NO: 239017 - DNA, 14 bp, Homo sapiens
gctcactctttccc

SEQ ID NO: 239018 - DNA, 18 bp, Homo sapiens
gctcactctttcccccaa

SEQ ID NO: 239019 - DNA, 13 bp, Homo sapiens
gctcactgcagcc

SEQ ID NO: 239020 - DNA, 14 bp, Homo sapiens
gctcagaacacatt

SEQ ID NO: 239021 - DNA, 23 bp, Homo sapiens
gctcagaacaccccgctctggca

SEQ ID NO: 239022 - DNA, 21 bp, Homo sapiens
gctcagaatagatctgatggt

SEQ ID NO: 239023 - DNA, 18 bp, Homo sapiens
gctcagacgagacaccct

SEQ ID NO: 239024 - DNA, 16 bp, Homo sapiens
gctcagagcagcctct

SEQ ID NO: 239025 - DNA, 15 bp, Homo sapiens
gctcagagctaggcc

SEQ ID NO: 239026 - DNA, 19 bp, Homo sapiens
gctcagcaaggggctctgc

SEQ ID NO: 239027 - DNA, 20 bp, Homo sapiens
gctcagcaatagggtgcagt

SEQ ID NO: 239028 - DNA, 22 bp, Homo sapiens
gctcagcacagcctcacccctg

SEQ ID NO: 239029 - DNA, 16 bp, Homo sapiens
gctcagcagttcactt

SEQ ID NO: 239030 - DNA, 14 bp, Homo sapiens
gctcagcccacccc

SEQ ID NO: 239031 - DNA, 22 bp, Homo sapiens
gctcagccccggccactccctg

SEQ ID NO: 239032 - DNA, 19 bp, Homo sapiens
gctcagccctccctgcccc

SEQ ID NO: 239033 - DNA, 15 bp, Homo sapiens
gctcagcgctggcag

SEQ ID NO: 239034 - DNA, 21 bp, Homo sapiens
gctcaggacccaggccctcca

SEQ ID NO: 239035 - DNA, 13 bp, Homo sapiens
gctcaggagagag

SEQ ID NO: 239036 - DNA, 19 bp, Homo sapiens
gctgccccgttccctgtca

SEQ ID NO: 239037 - DNA, 22 bp, Homo sapiens
gctgccccgttccctgtcagag

SEQ ID NO: 239038 - DNA, 13 bp, Homo sapiens
gctgcccctgtct

SEQ ID NO: 239039 - DNA, 19 bp, Homo sapiens
gctgcccctgtctggaaga

SEQ ID NO: 239040 - DNA, 14 bp, Homo sapiens
gctgccctccatcc

SEQ ID NO: 239041 - DNA, 15 bp, Homo sapiens
gctttctcctgtgcc

SEQ ID NO: 239042 - DNA, 16 bp, Homo sapiens
gctttctcctgtgccc

SEQ ID NO: 239043 - DNA, 18 bp, Homo sapiens
gctttctctgcttcagct

SEQ ID NO: 239044 - DNA, 20 bp, Homo sapiens
gctttctctgcttcagcttg

SEQ ID NO: 239045 - DNA, 10 bp, Homo sapiens
gctttctctt

SEQ ID NO: 239046 - DNA, 23 bp, Homo sapiens
gctttctggaaattcttccctgg

SEQ ID NO: 239047 - DNA, 23 bp, Homo sapiens
gctttcttctacaaccagagccc

SEQ ID NO: 239048 - DNA, 18 bp, Homo sapiens
gctttcttgccacacagt

SEQ ID NO: 239049 - DNA, 12 bp, Homo sapiens
gctttcttgctg

SEQ ID NO: 239050 - DNA, 14 bp, Homo sapiens
gctttcttgctggt

SEQ ID NO: 239051 - DNA, 18 bp, Homo sapiens
gctttctttttaaagctt

SEQ ID NO: 239052 - DNA, 22 bp, Homo sapiens
gctttctttttaaagcttttga

SEQ ID NO: 239053 - DNA, 15 bp, Homo sapiens
gctttgactgagcag

SEQ ID NO: 239054 - DNA, 22 bp, Homo sapiens
gctttgactgagcagactggtg

SEQ ID NO: 239055 - DNA, 15 bp, Homo sapiens
gctttgcaggctctg

SEQ ID NO: 239056 - DNA, 22 bp, Homo sapiens
gctttgcaggctctgggctcag

SEQ ID NO: 239057 - DNA, 18 bp, Homo sapiens
gctttgccttccacgctg

SEQ ID NO: 239058 - DNA, 19 bp, Homo sapiens
gctttgctgctaccgccct

SEQ ID NO: 239059 - DNA, 14 bp, Homo sapiens
gctttgctgctatg

SEQ ID NO: 239060 - DNA, 18 bp, Homo sapiens
gctttggaaatttggaag

SEQ ID NO: 239061 - DNA, 22 bp, Homo sapiens
gctttggacacacacagcttct

SEQ ID NO: 239062 - DNA, 18 bp, Homo sapiens
gctttggacgcacacagc

SEQ ID NO: 239063 - DNA, 19 bp, Homo sapiens
gctttggacgcacacagct

SEQ ID NO: 239064 - DNA, 19 bp, Homo sapiens
gctttgggaacactggcct

SEQ ID NO: 239065 - DNA, 16 bp, Homo sapiens
gctttgggctgccctg

SEQ ID NO: 239066 - DNA, 18 bp, Homo sapiens
gctttgggctgccctggt

SEQ ID NO: 239067 - DNA, 19 bp, Homo sapiens
gctttggggacagttggca

SEQ ID NO: 239068 - DNA, 20 bp, Homo sapiens
gctttggggacagttggcag

SEQ ID NO: 239069 - DNA, 23 bp, Homo sapiens
gctttggggacagttggcagaga

SEQ ID NO: 239070 - DNA, 19 bp, Homo sapiens
gctttggggagcgcctcgc

SEQ ID NO: 239071 - DNA, 16 bp, Homo sapiens
gctttggtggcccctc

SEQ ID NO: 239072 - DNA, 20 bp, Homo sapiens
gctttggtggcccctcccca

SEQ ID NO: 239073 - DNA, 22 bp, Homo sapiens
ggacagctaggctgagatgcac

SEQ ID NO: 239074 - DNA, 19 bp, Homo sapiens
ggacagctgcaggtgccca

SEQ ID NO: 239075 - DNA, 16 bp, Homo sapiens
ggacagctttcctggg

SEQ ID NO: 239076 - DNA, 13 bp, Homo sapiens
ggacagggccagg

SEQ ID NO: 239077 - DNA, 18 bp, Homo sapiens
ggacagggccagggttgc

SEQ ID NO: 239078 - DNA, 20 bp, Homo sapiens
ggacaggtctgggagaggca

SEQ ID NO: 239079 - DNA, 20 bp, Homo sapiens
ggacagtattctcagtgctc

SEQ ID NO: 239080 - DNA, 17 bp, Homo sapiens
ggacagtgataggccca

SEQ ID NO: 239081 - DNA, 20 bp, Homo sapiens
ggacagtgctgaccccagga

SEQ ID NO: 239082 - DNA, 17 bp, Homo sapiens
ggacagttcacaccctg

SEQ ID NO: 239083 - DNA, 20 bp, Homo sapiens
ggacagttcacaccctgcaa

SEQ ID NO: 239084 - DNA, 14 bp, Homo sapiens
ggacagttggcaga

SEQ ID NO: 239085 - DNA, 19 bp, Homo sapiens
ggacataactgacttagtt

SEQ ID NO: 239086 - DNA, 20 bp, Homo sapiens
ggacatgatttagggaagca

SEQ ID NO: 239087 - DNA, 22 bp, Homo sapiens
ggacatggtgtgccacaggctg

SEQ ID NO: 239088 - DNA, 20 bp, Homo sapiens
ggaccaacccatgccctgcc

SEQ ID NO: 239089 - DNA, 19 bp, Homo sapiens
ggaccaagcttaaggagag

SEQ ID NO: 239090 - DNA, 22 bp, Homo sapiens
ggaccaagcttaaggagaggag

SEQ ID NO: 239091 - DNA, 23 bp, Homo sapiens
ggaccaagcttaaggagaggaga

SEQ ID NO: 239092 - DNA, 17 bp, Homo sapiens
ggaccacagtgggtggc

SEQ ID NO: 239093 - DNA, 21 bp, Homo sapiens
ggaccacagtgggtggcacct

SEQ ID NO: 239094 - DNA, 22 bp, Homo sapiens
ggaccagctggggggcaggggg

SEQ ID NO: 239095 - DNA, 17 bp, Homo sapiens
ggaccaggactccctcc

SEQ ID NO: 239096 - DNA, 15 bp, Homo sapiens
ggaccaggagccagg

SEQ ID NO: 239097 - DNA, 12 bp, Homo sapiens
ggaccaggagct

SEQ ID NO: 239098 - DNA, 20 bp, Homo sapiens
ggaccaggtgtctagaggca

SEQ ID NO: 239099 - DNA, 18 bp, Homo sapiens
ggaccattgacctcagct

SEQ ID NO: 239100 - DNA, 22 bp, Homo sapiens
ggaccattgacctcagctgcac

SEQ ID NO: 239101 - DNA, 11 bp, Homo sapiens
ggacccacccc

SEQ ID NO: 239102 - DNA, 23 bp, Homo sapiens
ggacccagccgccatcagcccaa

SEQ ID NO: 239103 - DNA, 14 bp, Homo sapiens
ggacccagctactc

SEQ ID NO: 239104 - DNA, 23 bp, Homo sapiens
ggacccagctactctgtccaggc

SEQ ID NO: 239105 - DNA, 14 bp, Homo sapiens
ggacccaggccctc

SEQ ID NO: 239106 - DNA, 20 bp, Homo sapiens
ggacccatagatcttctgaa

SEQ ID NO: 239107 - DNA, 16 bp, Homo sapiens
ggaccccatctgctga

SEQ ID NO: 239108 - DNA, 22 bp, Homo sapiens
ggacccctgctcccagcctgct

SEQ ID NO: 239109 - DNA, 17 bp, Homo sapiens
ggacccgggaccacagc

SEQ ID NO: 239110 - DNA, 20 bp, Homo sapiens
ggacccgggaccacagctgc

SEQ ID NO: 239111 - DNA, 23 bp, Homo sapiens
ggacccgggaccacagctgctgg

SEQ ID NO: 239112 - DNA, 20 bp, Homo sapiens
ggaccctcggggcaggaagt

SEQ ID NO: 239113 - DNA, 20 bp, Homo sapiens
ggacccttctactttttcct

SEQ ID NO: 239114 - DNA, 14 bp, Homo sapiens
ggaccgcatcctcc

SEQ ID NO: 239115 - DNA, 15 bp, Homo sapiens
ggaccgccaaagaat

SEQ ID NO: 239116 - DNA, 16 bp, Homo sapiens
ggaccgcgtagagagc

SEQ ID NO: 239117 - DNA, 17 bp, Homo sapiens
ggaccgcgtagagagcc

SEQ ID NO: 239118 - DNA, 17 bp, Homo sapiens
ggaccggagcggctgag

SEQ ID NO: 239119 - DNA, 19 bp, Homo sapiens
ggaccggagcggctgagga

SEQ ID NO: 239120 - DNA, 20 bp, Homo sapiens
ggaccggagcggctgaggac

SEQ ID NO: 239121 - DNA, 18 bp, Homo sapiens
ggaccgggtgggcctggc

SEQ ID NO: 239122 - DNA, 19 bp, Homo sapiens
ggaccgggtgggcctggcc

SEQ ID NO: 239123 - DNA, 23 bp, Homo sapiens
ggaccgtgccattgtactccagc

SEQ ID NO: 239124 - DNA, 18 bp, Homo sapiens
ggacctcagtttctgttg

SEQ ID NO: 239125 - DNA, 19 bp, Homo sapiens
ggacctccacctgggagat

SEQ ID NO: 239126 - DNA, 13 bp, Homo sapiens
ggacctcctgagc

SEQ ID NO: 239127 - DNA, 16 bp, Homo sapiens
ggacctcgtgctttaa

SEQ ID NO: 239128 - DNA, 12 bp, Homo sapiens
ggacctctgggc

SEQ ID NO: 239129 - DNA, 23 bp, Homo sapiens
ggacctgaagggtgacatcccag

SEQ ID NO: 239130 - DNA, 21 bp, Homo sapiens
ggacctgagcctggtcctggc

SEQ ID NO: 239131 - DNA, 15 bp, Homo sapiens
ggacctggagacagg

SEQ ID NO: 239132 - DNA, 18 bp, Homo sapiens
ggacctgtgttcttgctg

SEQ ID NO: 239133 - DNA, 16 bp, Homo sapiens
ggacctgttttcttca

SEQ ID NO: 239134 - DNA, 15 bp, Homo sapiens
ggaccttatctgtgc

SEQ ID NO: 239135 - DNA, 13 bp, Homo sapiens
ggacgcagggaga

SEQ ID NO: 239136 - DNA, 19 bp, Homo sapiens
ggacgcagggagaccctgg

SEQ ID NO: 239137 - DNA, 15 bp, Homo sapiens
ggacggagttcagag

SEQ ID NO: 239138 - DNA, 22 bp, Homo sapiens
ggacggcctgatgctccctccc

SEQ ID NO: 239139 - DNA, 18 bp, Homo sapiens
ggacgggggctgcttctc

SEQ ID NO: 239140 - DNA, 18 bp, Homo sapiens
ggacgtcctgccacctgg

SEQ ID NO: 239141 - DNA, 20 bp, Homo sapiens
ggacgtgttatgactccaga

SEQ ID NO: 239142 - DNA, 19 bp, Homo sapiens
ggacgttaggcccgggccc

SEQ ID NO: 239143 - DNA, 18 bp, Homo sapiens
ggacgttgctttttcact

SEQ ID NO: 239144 - DNA, 15 bp, Homo sapiens
ggactaagggaagaa

SEQ ID NO: 239145 - DNA, 20 bp, Homo sapiens
ggactatagcagggctgggc

SEQ ID NO: 239146 - DNA, 13 bp, Homo sapiens
ggactatataaag

SEQ ID NO: 239147 - DNA, 16 bp, Homo sapiens
ggactcagccctgagg

SEQ ID NO: 239148 - DNA, 13 bp, Homo sapiens
ggactcaggcctg

SEQ ID NO: 239149 - DNA, 16 bp, Homo sapiens
ggactcaggcctgcca

SEQ ID NO: 239150 - DNA, 17 bp, Homo sapiens
ggactcaggcctgccaa

SEQ ID NO: 239151 - DNA, 17 bp, Homo sapiens
ggactccatggcccttc

SEQ ID NO: 239152 - DNA, 15 bp, Homo sapiens
ggactcccgggccac

SEQ ID NO: 239153 - DNA, 19 bp, Homo sapiens
ggactccctccatgtggcc

SEQ ID NO: 239154 - DNA, 20 bp, Homo sapiens
ggactccctcctcacctctg

SEQ ID NO: 239155 - DNA, 22 bp, Homo sapiens
ggactcgggctaagtccagctc

SEQ ID NO: 239156 - DNA, 20 bp, Homo sapiens
ggactctcagggattctggg

SEQ ID NO: 239157 - DNA, 13 bp, Homo sapiens
ggactctcctcct

SEQ ID NO: 239158 - DNA, 14 bp, Homo sapiens
ggactctcctcctc

SEQ ID NO: 239159 - DNA, 16 bp, Homo sapiens
ggactctcctcctccc

SEQ ID NO: 239160 - DNA, 19 bp, Homo sapiens
ggactctcctcctcccctc

SEQ ID NO: 239161 - DNA, 23 bp, Homo sapiens
ggactctcctcctcccctcctct

SEQ ID NO: 239162 - DNA, 16 bp, Homo sapiens
ggactctgccccaatc

SEQ ID NO: 239163 - DNA, 18 bp, Homo sapiens
ggactctgccccttctgt

SEQ ID NO: 239164 - DNA, 13 bp, Homo sapiens
ggactctgccttc

SEQ ID NO: 239165 - DNA, 17 bp, Homo sapiens
ggactctgccttccagg

SEQ ID NO: 239166 - DNA, 18 bp, Homo sapiens
ggactctgccttccaggc

SEQ ID NO: 239167 - DNA, 11 bp, Homo sapiens
ggactctgtgt

SEQ ID NO: 239168 - DNA, 13 bp, Homo sapiens
ggactctgtgtga

SEQ ID NO: 239169 - DNA, 16 bp, Homo sapiens
ggactgaagcctgcag

SEQ ID NO: 239170 - DNA, 17 bp, Homo sapiens
ggactgaagcctgcagg

SEQ ID NO: 239171 - DNA, 14 bp, Homo sapiens
ggactgacctgccc

SEQ ID NO: 239172 - DNA, 13 bp, Homo sapiens
ggactgaggagtg

SEQ ID NO: 239173 - DNA, 17 bp, Homo sapiens
ggactgcccccagaaag

SEQ ID NO: 239174 - DNA, 23 bp, Homo sapiens
ggactgcccccagaaagcctcct

SEQ ID NO: 239175 - DNA, 18 bp, Homo sapiens
ggactggcccacccctct

SEQ ID NO: 239176 - DNA, 13 bp, Homo sapiens
ggactggcccttg

SEQ ID NO: 239177 - DNA, 23 bp, Homo sapiens
ggactggctagagtcctcactcc

SEQ ID NO: 239178 - DNA, 17 bp, Homo sapiens
ggactgggagtcagagc

SEQ ID NO: 239179 - DNA, 19 bp, Homo sapiens
ggactgggggactgggagt

SEQ ID NO: 239180 - DNA, 22 bp, Homo sapiens
ggactgggggactgggagtcag

SEQ ID NO: 239181 - DNA, 20 bp, Homo sapiens
ggactgggttgcgtcctgac

SEQ ID NO: 239182 - DNA, 18 bp, Homo sapiens
ggactggtccaggcatgg

SEQ ID NO: 239183 - DNA, 12 bp, Homo sapiens
ggactgtatttc

SEQ ID NO: 239184 - DNA, 13 bp, Homo sapiens
ggactgtcagctg

SEQ ID NO: 239185 - DNA, 19 bp, Homo sapiens
ggactgtcctaggtgaccc

SEQ ID NO: 239186 - DNA, 20 bp, Homo sapiens
ggactgtcctaggtgacccc

SEQ ID NO: 239187 - DNA, 19 bp, Homo sapiens
ggactgtcttcaaccctgc

SEQ ID NO: 239188 - DNA, 16 bp, Homo sapiens
ggactgtcttgagaaa

SEQ ID NO: 239189 - DNA, 15 bp, Homo sapiens
ggactgtggcctcag

SEQ ID NO: 239190 - DNA, 21 bp, Homo sapiens
ggactgttcacggcagaccag

SEQ ID NO: 239191 - DNA, 23 bp, Homo sapiens
ggacttaatcggttgaccctact

SEQ ID NO: 239192 - DNA, 19 bp, Homo sapiens
ggacttattacaatttgtt

SEQ ID NO: 239193 - DNA, 23 bp, Homo sapiens
ggacttcaaaatcagtgatggga

SEQ ID NO: 239194 - DNA, 14 bp, Homo sapiens
ggacttcctggggc

SEQ ID NO: 239195 - DNA, 18 bp, Homo sapiens
ggacttccttgctctccc

SEQ ID NO: 239196 - DNA, 14 bp, Homo sapiens
ggacttgaatggtt

SEQ ID NO: 239197 - DNA, 21 bp, Homo sapiens
ggagcccctcctctgagcagc

SEQ ID NO: 239198 - DNA, 19 bp, Homo sapiens
ggagcccctgtgtgggagg

SEQ ID NO: 239199 - DNA, 20 bp, Homo sapiens
ggagcccgatattctccctg

SEQ ID NO: 239200 - DNA, 15 bp, Homo sapiens
ggagcccgtgcagta

SEQ ID NO: 239201 - DNA, 12 bp, Homo sapiens
ggagccctgacc

SEQ ID NO: 239202 - DNA, 15 bp, Homo sapiens
ggagccgggccgcag

SEQ ID NO: 239203 - DNA, 20 bp, Homo sapiens
ggagcctcctgaccctgtga

SEQ ID NO: 239204 - DNA, 16 bp, Homo sapiens
ggagcctcgcccctcc

SEQ ID NO: 239205 - DNA, 13 bp, Homo sapiens
ggagcctgaggca

SEQ ID NO: 239206 - DNA, 15 bp, Homo sapiens
ggagcctgaggcagg

SEQ ID NO: 239207 - DNA, 11 bp, Homo sapiens
ggagcctgcag

SEQ ID NO: 239208 - DNA, 22 bp, Homo sapiens
ggagcctgcagggtggtgctgg

SEQ ID NO: 239209 - DNA, 20 bp, Homo sapiens
ggagcctgcggctgctggca

SEQ ID NO: 239210 - DNA, 18 bp, Homo sapiens
ggagcctgcgtggcctgg

SEQ ID NO: 239211 - DNA, 14 bp, Homo sapiens
ggagcctggagccc

SEQ ID NO: 239212 - DNA, 15 bp, Homo sapiens
ggagcctggagcccc

SEQ ID NO: 239213 - DNA, 17 bp, Homo sapiens
ggagcctggagcccctg

SEQ ID NO: 239214 - DNA, 18 bp, Homo sapiens
ggagcctggagcccctgt

SEQ ID NO: 239215 - DNA, 13 bp, Homo sapiens
ggagcctgtgtta

SEQ ID NO: 239216 - DNA, 15 bp, Homo sapiens
ggagcggctgaggac

SEQ ID NO: 239217 - DNA, 22 bp, Homo sapiens
ggagcggctgaggacggggcag

SEQ ID NO: 239218 - DNA, 23 bp, Homo sapiens
ggagcggctgaggacggggcaga

SEQ ID NO: 239219 - DNA, 20 bp, Homo sapiens
ggagcgggggctaactggcc

SEQ ID NO: 239220 - DNA, 21 bp, Homo sapiens
ggagcgggggctaactggccc

SEQ ID NO: 239221 - DNA, 23 bp, Homo sapiens
ggagcgggggctaactggcccca

SEQ ID NO: 239222 - DNA, 23 bp, Homo sapiens
ggagctagagaggggcctctggc

SEQ ID NO: 239223 - DNA, 22 bp, Homo sapiens
ggagctagcccagtccctggag

SEQ ID NO: 239224 - DNA, 15 bp, Homo sapiens
ggagctatcaggaac

SEQ ID NO: 239225 - DNA, 14 bp, Homo sapiens
ggagctcctgggaa

SEQ ID NO: 239226 - DNA, 17 bp, Homo sapiens
ggagctgagatgagccc

SEQ ID NO: 239227 - DNA, 11 bp, Homo sapiens
ggagctgaggc

SEQ ID NO: 239228 - DNA, 21 bp, Homo sapiens
ggagctgaggccattccctgt

SEQ ID NO: 239229 - DNA, 22 bp, Homo sapiens
ggagctgaggccattccctgta

SEQ ID NO: 239230 - DNA, 17 bp, Homo sapiens
ggagctgatttccaggc

SEQ ID NO: 239231 - DNA, 19 bp, Homo sapiens
ggagctgatttccaggccc

SEQ ID NO: 239232 - DNA, 13 bp, Homo sapiens
ggagctgctggct

SEQ ID NO: 239233 - DNA, 13 bp, Homo sapiens
ggagctgcttcca

SEQ ID NO: 239234 - DNA, 17 bp, Homo sapiens
ggagctggctggcaggt

SEQ ID NO: 239235 - DNA, 13 bp, Homo sapiens
ggagctgggaagg

SEQ ID NO: 239236 - DNA, 18 bp, Homo sapiens
ggagctgggaaggtcccg

SEQ ID NO: 239237 - DNA, 17 bp, Homo sapiens
ggagctggtgacagcct

SEQ ID NO: 239238 - DNA, 14 bp, Homo sapiens
ggagctgtcaggca

SEQ ID NO: 239239 - DNA, 18 bp, Homo sapiens
ggagcttacctcccacct

SEQ ID NO: 239240 - DNA, 21 bp, Homo sapiens
ggaggaaaaccaagccgtggc

SEQ ID NO: 239241 - DNA, 22 bp, Homo sapiens
ggaggaaagtagcagtcatcat

SEQ ID NO: 239242 - DNA, 18 bp, Homo sapiens
ggaggaacgtggttcaga

SEQ ID NO: 239243 - DNA, 20 bp, Homo sapiens
ggaggaacgtggttcagaga

SEQ ID NO: 239244 - DNA, 22 bp, Homo sapiens
ggaggaactggtccaggccagg

SEQ ID NO: 239245 - DNA, 22 bp, Homo sapiens
ggaggaacttgctgctgtgcct

SEQ ID NO: 239246 - DNA, 19 bp, Homo sapiens
ggaggaatcgaggaaccag

SEQ ID NO: 239247 - DNA, 18 bp, Homo sapiens
ggaggaatgctcccccat

SEQ ID NO: 239248 - DNA, 12 bp, Homo sapiens
ggaggaccttat

SEQ ID NO: 239249 - DNA, 15 bp, Homo sapiens
ggaggagacagtcag

SEQ ID NO: 239250 - DNA, 11 bp, Homo sapiens
ggaggagcacc

SEQ ID NO: 239251 - DNA, 13 bp, Homo sapiens
ggaggagcacccc

SEQ ID NO: 239252 - DNA, 14 bp, Homo sapiens
ggaggagccttgga

SEQ ID NO: 239253 - DNA, 15 bp, Homo sapiens
ggaggagccttggag

SEQ ID NO: 239254 - DNA, 18 bp, Homo sapiens
ggaggaggcagaaccagc

SEQ ID NO: 239255 - DNA, 14 bp, Homo sapiens
ggaggatcacttga

SEQ ID NO: 239256 - DNA, 19 bp, Homo sapiens
ggaggattctttccccaga

SEQ ID NO: 239257 - DNA, 20 bp, Homo sapiens
ggaggcaagagactgggagc

SEQ ID NO: 239258 - DNA, 12 bp, Homo sapiens
ggaggcaagcaa

SEQ ID NO: 239259 - DNA, 14 bp, Homo sapiens
ggaggcagaaccag

SEQ ID NO: 239260 - DNA, 17 bp, Homo sapiens
ggaggcagccagggctt

SEQ ID NO: 239261 - DNA, 13 bp, Homo sapiens
ggaggcagccccc

SEQ ID NO: 239262 - DNA, 17 bp, Homo sapiens
ggaggcagtggcttgga

SEQ ID NO: 239263 - DNA, 17 bp, Homo sapiens
ggaggccaagcctgcag

SEQ ID NO: 239264 - DNA, 20 bp, Homo sapiens
ggaggccaagtgcaggctgg

SEQ ID NO: 239265 - DNA, 22 bp, Homo sapiens
ggaggccaccccaaaccccagc

SEQ ID NO: 239266 - DNA, 12 bp, Homo sapiens
ggaggccaggcc

SEQ ID NO: 239267 - DNA, 14 bp, Homo sapiens
ggaggccaggccct

SEQ ID NO: 239268 - DNA, 15 bp, Homo sapiens
ggaggccaggccctc

SEQ ID NO: 239269 - DNA, 16 bp, Homo sapiens
ggaggcccctggccca

SEQ ID NO: 239270 - DNA, 19 bp, Homo sapiens
ggaggcccctggcccagcg

SEQ ID NO: 239271 - DNA, 22 bp, Homo sapiens
ggaggcccctggcccagcggcc

SEQ ID NO: 239272 - DNA, 13 bp, Homo sapiens
ggaggcccctggt

SEQ ID NO: 239273 - DNA, 16 bp, Homo sapiens
ggaggcccctggtggc

SEQ ID NO: 239274 - DNA, 21 bp, Homo sapiens
ggaggccgaggcaggggctgg

SEQ ID NO: 239275 - DNA, 21 bp, Homo sapiens
ggaggcctcaccctgcttggg

SEQ ID NO: 239276 - DNA, 13 bp, Homo sapiens
ggaggcctctggg

SEQ ID NO: 239277 - DNA, 14 bp, Homo sapiens
ggaggcctgaaatg

SEQ ID NO: 239278 - DNA, 14 bp, Homo sapiens
ggaggcctgatgct

SEQ ID NO: 239279 - DNA, 16 bp, Homo sapiens
ggaggcctggtctgga

SEQ ID NO: 239280 - DNA, 13 bp, Homo sapiens
ggaggcgcccacc

SEQ ID NO: 239281 - DNA, 18 bp, Homo sapiens
ggaggcgcccacctgccc

SEQ ID NO: 239282 - DNA, 20 bp, Homo sapiens
ggaggcgcccacctgcccag

SEQ ID NO: 239283 - DNA, 12 bp, Homo sapiens
ggaggcgcgagc

SEQ ID NO: 239284 - DNA, 17 bp, Homo sapiens
ggaggctcccagaccca

SEQ ID NO: 239285 - DNA, 20 bp, Homo sapiens
ggaggctcccagacccaggg

SEQ ID NO: 239286 - DNA, 18 bp, Homo sapiens
ggaggcttgtcagagctg

SEQ ID NO: 239287 - DNA, 19 bp, Homo sapiens
ggaggcttgtcagagctgg

SEQ ID NO: 239288 - DNA, 21 bp, Homo sapiens
ggaggctttaagctccagctt

SEQ ID NO: 239289 - DNA, 17 bp, Homo sapiens
ggagggaccaggtgtct

SEQ ID NO: 239290 - DNA, 13 bp, Homo sapiens
ggagggagctgct

SEQ ID NO: 239291 - DNA, 18 bp, Homo sapiens
ggagggatagagacgcag

SEQ ID NO: 239292 - DNA, 19 bp, Homo sapiens
ggagggattgaacacaggc

SEQ ID NO: 239293 - DNA, 13 bp, Homo sapiens
ggagggcagagcc

SEQ ID NO: 239294 - DNA, 17 bp, Homo sapiens
ggagggcagagccatgg

SEQ ID NO: 239295 - DNA, 18 bp, Homo sapiens
ggagggcagagccatggg

SEQ ID NO: 239296 - DNA, 13 bp, Homo sapiens
ggagggcctctgg

SEQ ID NO: 239297 - DNA, 20 bp, Homo sapiens
ggagggcgaggcgggggatc

SEQ ID NO: 239298 - DNA, 20 bp, Homo sapiens
ggagggcgcatgtgtgtatc

SEQ ID NO: 239299 - DNA, 18 bp, Homo sapiens
ggagggcttggggctgca

SEQ ID NO: 239300 - DNA, 17 bp, Homo sapiens
ggaggggaagctgcagc

SEQ ID NO: 239301 - DNA, 13 bp, Homo sapiens
ggaggggacgctg

SEQ ID NO: 239302 - DNA, 15 bp, Homo sapiens
ggaggggcctaggga

SEQ ID NO: 239303 - DNA, 18 bp, Homo sapiens
ggaggggcctagggagcc

SEQ ID NO: 239304 - DNA, 15 bp, Homo sapiens
ggaggggcctctgaa

SEQ ID NO: 239305 - DNA, 13 bp, Homo sapiens
ggaggggcctggc

SEQ ID NO: 239306 - DNA, 14 bp, Homo sapiens
ggaggggcctggca

SEQ ID NO: 239307 - DNA, 18 bp, Homo sapiens
ggaggggcctggcagccg

SEQ ID NO: 239308 - DNA, 15 bp, Homo sapiens
ggaggggctgagtct

SEQ ID NO: 239309 - DNA, 13 bp, Homo sapiens
ggagggggccctt

SEQ ID NO: 239310 - DNA, 18 bp, Homo sapiens
ggagggggcgctcaggac

SEQ ID NO: 239311 - DNA, 21 bp, Homo sapiens
ggagggggcgctcaggaccca

SEQ ID NO: 239312 - DNA, 18 bp, Homo sapiens
ggaggggtaaatatatgt

SEQ ID NO: 239313 - DNA, 16 bp, Homo sapiens
ggaggggtcagctctg

SEQ ID NO: 239314 - DNA, 17 bp, Homo sapiens
ggaggggtggtcctgac

SEQ ID NO: 239315 - DNA, 15 bp, Homo sapiens
ggagggtcagtgcca

SEQ ID NO: 239316 - DNA, 15 bp, Homo sapiens
ggagggtggcaggtg

SEQ ID NO: 239317 - DNA, 20 bp, Homo sapiens
ggagggttctaagtgggaga

SEQ ID NO: 239318 - DNA, 22 bp, Homo sapiens
ggaggtcgaccccaaagcccct

SEQ ID NO: 239319 - DNA, 12 bp, Homo sapiens
ggaggtggcagc

SEQ ID NO: 239320 - DNA, 16 bp, Homo sapiens
ggaggtgggcatgcca

SEQ ID NO: 239321 - DNA, 18 bp, Homo sapiens
ggaggtgggcatgccacc

SEQ ID NO: 239322 - DNA, 17 bp, Homo sapiens
ggaggtgtggagtggag

SEQ ID NO: 239323 - DNA, 22 bp, Homo sapiens
ggaggtgtggagtggaggggtc

SEQ ID NO: 239324 - DNA, 20 bp, Homo sapiens
ggaggttgagaatgcagtga

SEQ ID NO: 239325 - DNA, 18 bp, Homo sapiens
ggaggttgagtgagccgg

SEQ ID NO: 239326 - DNA, 15 bp, Homo sapiens
ggagtacaaagacag

SEQ ID NO: 239327 - DNA, 18 bp, Homo sapiens
ggagtacaaagacaggga

SEQ ID NO: 239328 - DNA, 22 bp, Homo sapiens
ggagtagagatggggaaagaat

SEQ ID NO: 239329 - DNA, 15 bp, Homo sapiens
ggagtatctgggaac

SEQ ID NO: 239330 - DNA, 21 bp, Homo sapiens
ggagtcaagtgtgcctgctat

SEQ ID NO: 239331 - DNA, 15 bp, Homo sapiens
ggagtcagagccctg

SEQ ID NO: 239332 - DNA, 21 bp, Homo sapiens
ggagtcagagccctggctggg

SEQ ID NO: 239333 - DNA, 22 bp, Homo sapiens
ggagtcagagccctggctgggt

SEQ ID NO: 239334 - DNA, 17 bp, Homo sapiens
ggagtcagatgagcaag

SEQ ID NO: 239335 - DNA, 17 bp, Homo sapiens
ggagtcagggagccctg

SEQ ID NO: 239336 - DNA, 16 bp, Homo sapiens
ggagtccactttcctc

SEQ ID NO: 239337 - DNA, 19 bp, Homo sapiens
ggagtccactttcctctct

SEQ ID NO: 239338 - DNA, 18 bp, Homo sapiens
ggagtccagacctgggcc

SEQ ID NO: 239339 - DNA, 22 bp, Homo sapiens
ggagtccagacctgggccctgg

SEQ ID NO: 239340 - DNA, 22 bp, Homo sapiens
ggagtccccgtgtgccccaaga

SEQ ID NO: 239341 - DNA, 13 bp, Homo sapiens
ggagtcccctccc

SEQ ID NO: 239342 - DNA, 13 bp, Homo sapiens
ggagtctctgcca

SEQ ID NO: 239343 - DNA, 18 bp, Homo sapiens
ggagtctgaaggagagga

SEQ ID NO: 239344 - DNA, 20 bp, Homo sapiens
ggagtctgaaggagaggagt

SEQ ID NO: 239345 - DNA, 23 bp, Homo sapiens
ggagtctgcttgtcttagatgtt

SEQ ID NO: 239346 - DNA, 17 bp, Homo sapiens
ggagtgaagtaattgac

SEQ ID NO: 239347 - DNA, 16 bp, Homo sapiens
ggagtgagaaattttt

SEQ ID NO: 239348 - DNA, 14 bp, Homo sapiens
ggagtgagcttggt

SEQ ID NO: 239349 - DNA, 19 bp, Homo sapiens
ggagtgaggcttccaggct

SEQ ID NO: 239350 - DNA, 22 bp, Homo sapiens
ggagtgaggcttccaggctctt

SEQ ID NO: 239351 - DNA, 18 bp, Homo sapiens
ggagtgcagaacacctgg

SEQ ID NO: 239352 - DNA, 14 bp, Homo sapiens
ggagtgctgcttgt

SEQ ID NO: 239353 - DNA, 19 bp, Homo sapiens
ggagtgctgcttgtgcctc

SEQ ID NO: 239354 - DNA, 12 bp, Homo sapiens
ggagtggaggca

SEQ ID NO: 239355 - DNA, 17 bp, Homo sapiens
ggagtggaggcattgtt

SEQ ID NO: 239356 - DNA, 17 bp, Homo sapiens
ggagtgggagaggaagc

SEQ ID NO: 239357 - DNA, 16 bp, Homo sapiens
ggagtggggcagtaga

SEQ ID NO: 239358 - DNA, 17 bp, Homo sapiens
ggagtgtctgcagtcct

SEQ ID NO: 239359 - DNA, 13 bp, Homo sapiens
ggagtgtgtgggg

SEQ ID NO: 239360 - DNA, 13 bp, Homo sapiens
ggagtgttctgtg

SEQ ID NO: 239361 - DNA, 15 bp, Homo sapiens
ggagtgtttcatggg

SEQ ID NO: 239362 - DNA, 12 bp, Homo sapiens
ggagtgtttgac

SEQ ID NO: 239363 - DNA, 21 bp, Homo sapiens
ggagtgtttgacgaagaaaca

SEQ ID NO: 239364 - DNA, 15 bp, Homo sapiens
ggagttcaatgatct

SEQ ID NO: 239365 - DNA, 20 bp, Homo sapiens
ggagttcaatgatctaggtt

SEQ ID NO: 239366 - DNA, 13 bp, Homo sapiens
ggagttcagaggg

SEQ ID NO: 239367 - DNA, 19 bp, Homo sapiens
ggagttgagtacagtgagg

SEQ ID NO: 239368 - DNA, 19 bp, Homo sapiens
ggagttgagtcacaagagg

SEQ ID NO: 239369 - DNA, 24 bp, Homo sapiens
ggagttgctcctacccctgtcctg

SEQ ID NO: 239370 - DNA, 22 bp, Homo sapiens
ggagttgtcaagtctctgctgg

SEQ ID NO: 239371 - DNA, 12 bp, Homo sapiens
ggataacaccac

SEQ ID NO: 239372 - DNA, 13 bp, Homo sapiens
ggatagcattttt

SEQ ID NO: 239373 - DNA, 15 bp, Homo sapiens
ggatagcctttgtag

SEQ ID NO: 239374 - DNA, 15 bp, Homo sapiens
ggatataggagagga

SEQ ID NO: 239375 - DNA, 18 bp, Homo sapiens
ggatcaaagctaggaaag

SEQ ID NO: 239376 - DNA, 18 bp, Homo sapiens
ggatcacaaggtcaggag

SEQ ID NO: 239377 - DNA, 22 bp, Homo sapiens
ggatcacttgagcccaggaagt

SEQ ID NO: 239378 - DNA, 17 bp, Homo sapiens
ggatcagagtctggcct

SEQ ID NO: 239379 - DNA, 18 bp, Homo sapiens
ggatcagagtctggcctg

SEQ ID NO: 239380 - DNA, 11 bp, Homo sapiens
ggatcagcctc

SEQ ID NO: 239381 - DNA, 18 bp, Homo sapiens
ggatcatagtcgggcata

SEQ ID NO: 239382 - DNA, 13 bp, Homo sapiens
ggatccagaaggg

SEQ ID NO: 239383 - DNA, 12 bp, Homo sapiens
ggatccagagag

SEQ ID NO: 239384 - DNA, 22 bp, Homo sapiens
ggatcccctctgtctacaaata

SEQ ID NO: 239385 - DNA, 20 bp, Homo sapiens
ggatcccctgctactccact

SEQ ID NO: 239386 - DNA, 19 bp, Homo sapiens
ggatccgcggggaccctgc

SEQ ID NO: 239387 - DNA, 12 bp, Homo sapiens
ggatcctgcact

SEQ ID NO: 239388 - DNA, 19 bp, Homo sapiens
ggatcggaggcttgtcaga

SEQ ID NO: 239389 - DNA, 23 bp, Homo sapiens
ggatcggaggcttgtcagagctg

SEQ ID NO: 239390 - DNA, 15 bp, Homo sapiens
ggatcggcctcctct

SEQ ID NO: 239391 - DNA, 19 bp, Homo sapiens
ggatctaaaaggaggacag

SEQ ID NO: 239392 - DNA, 20 bp, Homo sapiens
ggatctatcacctgtcatca

SEQ ID NO: 239393 - DNA, 14 bp, Homo sapiens
ggatctccaggccc

SEQ ID NO: 239394 - DNA, 15 bp, Homo sapiens
ggatctccaggccca

SEQ ID NO: 239395 - DNA, 16 bp, Homo sapiens
ggatctccaggcccag

SEQ ID NO: 239396 - DNA, 14 bp, Homo sapiens
ggatctccccactc

SEQ ID NO: 239397 - DNA, 21 bp, Homo sapiens
ggatctctcaggagcacaggc

SEQ ID NO: 239398 - DNA, 16 bp, Homo sapiens
ggatctggggaaggac

SEQ ID NO: 239399 - DNA, 15 bp, Homo sapiens
ggatctgtgcccaga

SEQ ID NO: 239400 - DNA, 15 bp, Homo sapiens
ggatcttcaatggct

SEQ ID NO: 239401 - DNA, 15 bp, Homo sapiens
ggatcttctccctcc

SEQ ID NO: 239402 - DNA, 11 bp, Homo sapiens
ggatgaaagct

SEQ ID NO: 239403 - DNA, 21 bp, Homo sapiens
ggatgaaagttcccccatcag

SEQ ID NO: 239404 - DNA, 20 bp, Homo sapiens
ggatgaattgtaaaagcaac

SEQ ID NO: 239405 - DNA, 20 bp, Homo sapiens
ggatgaggccgctagaggcc

SEQ ID NO: 239406 - DNA, 18 bp, Homo sapiens
ggatgaggtgctgggagg

SEQ ID NO: 239407 - DNA, 15 bp, Homo sapiens
ggatgattcttttcc

SEQ ID NO: 239408 - DNA, 17 bp, Homo sapiens
ggatgattggattattc

SEQ ID NO: 239409 - DNA, 20 bp, Homo sapiens
ggatgcacggtttctgttct

SEQ ID NO: 239410 - DNA, 14 bp, Homo sapiens
ggatgcactggcct

SEQ ID NO: 239411 - DNA, 14 bp, Homo sapiens
ggatgctgaggagg

SEQ ID NO: 239412 - DNA, 12 bp, Homo sapiens
ggatgctgtgcc

SEQ ID NO: 239413 - DNA, 14 bp, Homo sapiens
ggatggaagtgtct

SEQ ID NO: 239414 - DNA, 21 bp, Homo sapiens
ggatggagaatgccagcccaa

SEQ ID NO: 239415 - DNA, 22 bp, Homo sapiens
ggatggatctgctccatgcaga

SEQ ID NO: 239416 - DNA, 19 bp, Homo sapiens
ggatggcagcctcagggct

SEQ ID NO: 239417 - DNA, 16 bp, Homo sapiens
ggatgggagtgggcac

SEQ ID NO: 239418 - DNA, 14 bp, Homo sapiens
ggatgggcacaggc

SEQ ID NO: 239419 - DNA, 20 bp, Homo sapiens
ggatggggttgggctctgcg

SEQ ID NO: 239420 - DNA, 19 bp, Homo sapiens
ggatggtcatcgtgacagc

SEQ ID NO: 239421 - DNA, 22 bp, Homo sapiens
ggatggtcatcgtgacagcagc

SEQ ID NO: 239422 - DNA, 14 bp, Homo sapiens
ggatgtaatatagg

SEQ ID NO: 239423 - DNA, 18 bp, Homo sapiens
ggatgtggagctcctgct

SEQ ID NO: 239424 - DNA, 14 bp, Homo sapiens
ggatgtggttaccg

SEQ ID NO: 239425 - DNA, 15 bp, Homo sapiens
ggatgtgtaaatgga

SEQ ID NO: 239426 - DNA, 20 bp, Homo sapiens
ggatgttcagcactgtccct

SEQ ID NO: 239427 - DNA, 23 bp, Homo sapiens
ggatgttcagcactgtcccttgc

SEQ ID NO: 239428 - DNA, 18 bp, Homo sapiens
ggatgtttcttctttgac

SEQ ID NO: 239429 - DNA, 18 bp, Homo sapiens
ggattaagatacactcct

SEQ ID NO: 239430 - DNA, 18 bp, Homo sapiens
ggattagctagactagga

SEQ ID NO: 239431 - DNA, 15 bp, Homo sapiens
ggattatatgtatta

SEQ ID NO: 239432 - DNA, 19 bp, Homo sapiens
ggattattcatttaaaatg

SEQ ID NO: 239433 - DNA, 13 bp, Homo sapiens
ggattcaaatgca

SEQ ID NO: 239434 - DNA, 13 bp, Homo sapiens
ggattcacttcta

SEQ ID NO: 239435 - DNA, 18 bp, Homo sapiens
ggattccggccctggctg

SEQ ID NO: 239436 - DNA, 17 bp, Homo sapiens
ggattctgtcttccagg

SEQ ID NO: 239437 - DNA, 16 bp, Homo sapiens
ggattctttccccaga

SEQ ID NO: 239438 - DNA, 16 bp, Homo sapiens
ggattgaacacaggca

SEQ ID NO: 239439 - DNA, 17 bp, Homo sapiens
ggattgaacacaggcaa

SEQ ID NO: 239440 - DNA, 15 bp, Homo sapiens
ggattgcacgtggcc

SEQ ID NO: 239441 - DNA, 18 bp, Homo sapiens
ggattgtacgtgggagag

SEQ ID NO: 239442 - DNA, 20 bp, Homo sapiens
ggattgtatcaagtggcatg

SEQ ID NO: 239443 - DNA, 15 bp, Homo sapiens
ggattgtccacaaat

SEQ ID NO: 239444 - DNA, 17 bp, Homo sapiens
ggatttcaagggactgg

SEQ ID NO: 239445 - DNA, 14 bp, Homo sapiens
ggatttcttcctat

SEQ ID NO: 239446 - DNA, 21 bp, Homo sapiens
ggatttgaaccaggccttctg

SEQ ID NO: 239447 - DNA, 16 bp, Homo sapiens
ggatttgacacactca

SEQ ID NO: 239448 - DNA, 17 bp, Homo sapiens
ggattttaaaaattgga

SEQ ID NO: 239449 - DNA, 22 bp, Homo sapiens
ggattttaacaaaagcaagact

SEQ ID NO: 239450 - DNA, 11 bp, Homo sapiens
ggatttttcat

SEQ ID NO: 239451 - DNA, 15 bp, Homo sapiens
ggcaaaaccttgcta

SEQ ID NO: 239452 - DNA, 23 bp, Homo sapiens
ggcaaaagtctgaggcacctgca

SEQ ID NO: 239453 - DNA, 10 bp, Homo sapiens
ggcaaacaat

SEQ ID NO: 239454 - DNA, 13 bp, Homo sapiens
ggcaaacaggcag

SEQ ID NO: 239455 - DNA, 14 bp, Homo sapiens
ggcaaacatgtgca

SEQ ID NO: 239456 - DNA, 12 bp, Homo sapiens
ggcaaagaaaac

SEQ ID NO: 239457 - DNA, 21 bp, Homo sapiens
ggcaaagaggtgctgctttgc

SEQ ID NO: 239458 - DNA, 22 bp, Homo sapiens
ggcaaagcacgaaatgttattt

SEQ ID NO: 239459 - DNA, 19 bp, Homo sapiens
ggcaaagccacaaggctgg

SEQ ID NO: 239460 - DNA, 11 bp, Homo sapiens
ggcaaatctcc

SEQ ID NO: 239461 - DNA, 20 bp, Homo sapiens
ggcaacaaaggatggctctg

SEQ ID NO: 239462 - DNA, 21 bp, Homo sapiens
ggcaacagaaaacaattgttc

SEQ ID NO: 239463 - DNA, 16 bp, Homo sapiens
ggcaacagagtgagac

SEQ ID NO: 239464 - DNA, 19 bp, Homo sapiens
ggcaacattacaaacaaag

SEQ ID NO: 239465 - DNA, 20 bp, Homo sapiens
ggcaaccccctcggagcctg

SEQ ID NO: 239466 - DNA, 16 bp, Homo sapiens
ggcaacctgtaactgc

SEQ ID NO: 239467 - DNA, 16 bp, Homo sapiens
ggcaacgaagaaaaaa

SEQ ID NO: 239468 - DNA, 17 bp, Homo sapiens
ggcaacgaagaaaaaaa

SEQ ID NO: 239469 - DNA, 19 bp, Homo sapiens
ggcaacgtgcgtgtctctg

SEQ ID NO: 239470 - DNA, 14 bp, Homo sapiens
ggcaactgaacaaa

SEQ ID NO: 239471 - DNA, 19 bp, Homo sapiens
ggcaactgaacaaaaaaat

SEQ ID NO: 239472 - DNA, 21 bp, Homo sapiens
ggcaacttcagtcctgggaga

SEQ ID NO: 239473 - DNA, 22 bp, Homo sapiens
ggcaagaaattcattaaagaaa

SEQ ID NO: 239474 - DNA, 18 bp, Homo sapiens
ggcaagaaggaattgact

SEQ ID NO: 239475 - DNA, 14 bp, Homo sapiens
ggcaagagactggg

SEQ ID NO: 239476 - DNA, 24 bp, Homo sapiens
ggcaagagctctttgtctcaccag

SEQ ID NO: 239477 - DNA, 17 bp, Homo sapiens
ggcaagatagctccttc

SEQ ID NO: 239478 - DNA, 14 bp, Homo sapiens
ggcaagcccctcag

SEQ ID NO: 239479 - DNA, 17 bp, Homo sapiens
ggcaagcccctcagccc

SEQ ID NO: 239480 - DNA, 21 bp, Homo sapiens
ggcaagcccctcagcccttgc

SEQ ID NO: 239481 - DNA, 15 bp, Homo sapiens
ggcaagcctgagtgg

SEQ ID NO: 239482 - DNA, 23 bp, Homo sapiens
ggctactgcagctttacatgcaa

SEQ ID NO: 239483 - DNA, 13 bp, Homo sapiens
ggctactggcagc

SEQ ID NO: 239484 - DNA, 23 bp, Homo sapiens
ggctactggcagctcctctcctt

SEQ ID NO: 239485 - DNA, 18 bp, Homo sapiens
ggctagaagaaagtaaaa

SEQ ID NO: 239486 - DNA, 22 bp, Homo sapiens
ggctagaagaaagtaaaaagaa

SEQ ID NO: 239487 - DNA, 15 bp, Homo sapiens
ggctagaatggaaaa

SEQ ID NO: 239488 - DNA, 13 bp, Homo sapiens
ggctagagtcctc

SEQ ID NO: 239489 - DNA, 18 bp, Homo sapiens
ggctagagtcctcactcc

SEQ ID NO: 239490 - DNA, 20 bp, Homo sapiens
ggctagagtcctcactccca

SEQ ID NO: 239491 - DNA, 13 bp, Homo sapiens
ggctagccccagg

SEQ ID NO: 239492 - DNA, 17 bp, Homo sapiens
ggctagccccagggtga

SEQ ID NO: 239493 - DNA, 19 bp, Homo sapiens
ggctaggccggccagctcc

SEQ ID NO: 239494 - DNA, 13 bp, Homo sapiens
ggctagtactgta

SEQ ID NO: 239495 - DNA, 20 bp, Homo sapiens
ggctagtgacttgtgtccca

SEQ ID NO: 239496 - DNA, 15 bp, Homo sapiens
ggctagtgtgagtgg

SEQ ID NO: 239497 - DNA, 17 bp, Homo sapiens
ggctatcccttctcaga

SEQ ID NO: 239498 - DNA, 17 bp, Homo sapiens
ggctatggagggtcctc

SEQ ID NO: 239499 - DNA, 15 bp, Homo sapiens
ggctattccctggag

SEQ ID NO: 239500 - DNA, 16 bp, Homo sapiens
ggctattccctggaga

SEQ ID NO: 239501 - DNA, 17 bp, Homo sapiens
ggctatttgtgtgtatg

SEQ ID NO: 239502 - DNA, 12 bp, Homo sapiens
ggctcacagcca

SEQ ID NO: 239503 - DNA, 13 bp, Homo sapiens
ggctcacagccac

SEQ ID NO: 239504 - DNA, 21 bp, Homo sapiens
ggctcacagccaccacctgga

SEQ ID NO: 239505 - DNA, 12 bp, Homo sapiens
ggctcacgcctg

SEQ ID NO: 239506 - DNA, 19 bp, Homo sapiens
ggctcacggggcctccaac

SEQ ID NO: 239507 - DNA, 13 bp, Homo sapiens
ggctcacgtgtgt

SEQ ID NO: 239508 - DNA, 14 bp, Homo sapiens
ggctcaggcaagcc

SEQ ID NO: 239509 - DNA, 15 bp, Homo sapiens
ggctcaggcaagccc

SEQ ID NO: 239510 - DNA, 18 bp, Homo sapiens
ggctcagggcccacctcc

SEQ ID NO: 239511 - DNA, 23 bp, Homo sapiens
ggctcagggcccacctcctccag

SEQ ID NO: 239512 - DNA, 14 bp, Homo sapiens
ggctcagggctgga

SEQ ID NO: 239513 - DNA, 17 bp, Homo sapiens
ggctcatattcctgcag

SEQ ID NO: 239514 - DNA, 16 bp, Homo sapiens
ggctccacgccctggg

SEQ ID NO: 239515 - DNA, 22 bp, Homo sapiens
ggctccacgggggcctagtggc

SEQ ID NO: 239516 - DNA, 16 bp, Homo sapiens
ggctccagacattgta

SEQ ID NO: 239517 - DNA, 17 bp, Homo sapiens
ggctccaggctccaggc

SEQ ID NO: 239518 - DNA, 21 bp, Homo sapiens
ggctccaggctccaggctgac

SEQ ID NO: 239519 - DNA, 18 bp, Homo sapiens
ggctccagtctgctgccc

SEQ ID NO: 239520 - DNA, 24 bp, Homo sapiens
ggctccagtctgctgccctccatc

SEQ ID NO: 239521 - DNA, 11 bp, Homo sapiens
ggctccatgct

SEQ ID NO: 239522 - DNA, 17 bp, Homo sapiens
ggctcccaatcagcttt

SEQ ID NO: 239523 - DNA, 18 bp, Homo sapiens
ggctcccaatcagctttt

SEQ ID NO: 239524 - DNA, 17 bp, Homo sapiens
ggctcccacaggccctt

SEQ ID NO: 239525 - DNA, 19 bp, Homo sapiens
ggctcccacaggcccttcc

SEQ ID NO: 239526 - DNA, 20 bp, Homo sapiens
ggctcccacaggcccttcct

SEQ ID NO: 239527 - DNA, 13 bp, Homo sapiens
ggctcccagaccc

SEQ ID NO: 239528 - DNA, 22 bp, Homo sapiens
ggctccccacgagtcacctgca

SEQ ID NO: 239529 - DNA, 23 bp, Homo sapiens
ggctccccacgagtcacctgcaa

SEQ ID NO: 239530 - DNA, 14 bp, Homo sapiens
ggctccccctgcca

SEQ ID NO: 239531 - DNA, 16 bp, Homo sapiens
ggctccccctgccagc

SEQ ID NO: 239532 - DNA, 18 bp, Homo sapiens
ggctccccgcctccactc

SEQ ID NO: 239533 - DNA, 11 bp, Homo sapiens
ggctcccctct

SEQ ID NO: 239534 - DNA, 14 bp, Homo sapiens
ggctcccctggtct

SEQ ID NO: 239535 - DNA, 20 bp, Homo sapiens
ggctccgagggcggccaggg

SEQ ID NO: 239536 - DNA, 21 bp, Homo sapiens
ggctccgagggcggccaggga

SEQ ID NO: 239537 - DNA, 18 bp, Homo sapiens
ggctccgtcagtatcagg

SEQ ID NO: 239538 - DNA, 18 bp, Homo sapiens
ggctcctcctctctggac

SEQ ID NO: 239539 - DNA, 12 bp, Homo sapiens
ggctcctccttg

SEQ ID NO: 239540 - DNA, 12 bp, Homo sapiens
ggctcctggagc

SEQ ID NO: 239541 - DNA, 12 bp, Homo sapiens
ggctcctggctg

SEQ ID NO: 239542 - DNA, 15 bp, Homo sapiens
ggctcctggctgcca

SEQ ID NO: 239543 - DNA, 19 bp, Homo sapiens
ggctcgagtgcccctgcag

SEQ ID NO: 239544 - DNA, 21 bp, Homo sapiens
ggctcgagtgcccctgcaggg

SEQ ID NO: 239545 - DNA, 18 bp, Homo sapiens
ggctcgccccacccaggg

SEQ ID NO: 239546 - DNA, 13 bp, Homo sapiens
ggctcgtggcctt

SEQ ID NO: 239547 - DNA, 14 bp, Homo sapiens
ggctcgtgggctct

SEQ ID NO: 239548 - DNA, 16 bp, Homo sapiens
ggctcgtgggctctgg

SEQ ID NO: 239549 - DNA, 15 bp, Homo sapiens
ggctcgttctcttct

SEQ ID NO: 239550 - DNA, 18 bp, Homo sapiens
ggctctccaaaggggctg

SEQ ID NO: 239551 - DNA, 23 bp, Homo sapiens
ggctctccaaaggggctgctggg

SEQ ID NO: 239552 - DNA, 13 bp, Homo sapiens
ggctctcccctct

SEQ ID NO: 239553 - DNA, 23 bp, Homo sapiens
ggctctcccctctcgccccatcc

SEQ ID NO: 239554 - DNA, 21 bp, Homo sapiens
ggctctcgtccctctgctccg

SEQ ID NO: 239555 - DNA, 13 bp, Homo sapiens
ggctctgagaagg

SEQ ID NO: 239556 - DNA, 16 bp, Homo sapiens
ggctctgctgacttct

SEQ ID NO: 239557 - DNA, 14 bp, Homo sapiens
ggctctggccaccc

SEQ ID NO: 239558 - DNA, 21 bp, Homo sapiens
ggctctggccaccctggcccg

SEQ ID NO: 239559 - DNA, 10 bp, Homo sapiens
ggctctggct

SEQ ID NO: 239560 - DNA, 12 bp, Homo sapiens
ggctctggctcc

SEQ ID NO: 239561 - DNA, 12 bp, Homo sapiens
ggctctgggctc

SEQ ID NO: 239562 - DNA, 15 bp, Homo sapiens
ggctctgggctcagg

SEQ ID NO: 239563 - DNA, 18 bp, Homo sapiens
ggctctgggctcagggct

SEQ ID NO: 239564 - DNA, 20 bp, Homo sapiens
ggctctgggctcagggctgg

SEQ ID NO: 239565 - DNA, 20 bp, Homo sapiens
ggctctgtattctgcaacag

SEQ ID NO: 239566 - DNA, 15 bp, Homo sapiens
ggctctgtcttcctg

SEQ ID NO: 239567 - DNA, 16 bp, Homo sapiens
ggctctgtcttcctgg

SEQ ID NO: 239568 - DNA, 17 bp, Homo sapiens
ggctctgtcttcctggt

SEQ ID NO: 239569 - DNA, 20 bp, Homo sapiens
ggctctgtgaaaacatattt

SEQ ID NO: 239570 - DNA, 14 bp, Homo sapiens
ggctcttcctggac

SEQ ID NO: 239571 - DNA, 15 bp, Homo sapiens
ggctcttcctggacc

SEQ ID NO: 239572 - DNA, 12 bp, Homo sapiens
ggctcttctcct

SEQ ID NO: 239573 - DNA, 15 bp, Homo sapiens
ggctcttctcctttc

SEQ ID NO: 239574 - DNA, 13 bp, Homo sapiens
ggctgaaattatg

SEQ ID NO: 239575 - DNA, 16 bp, Homo sapiens
ggctgacacctaccat

SEQ ID NO: 239576 - DNA, 13 bp, Homo sapiens
ggctgacagagca

SEQ ID NO: 239577 - DNA, 21 bp, Homo sapiens
ggctgacagagcaggtctgca

SEQ ID NO: 239578 - DNA, 21 bp, Homo sapiens
ggctgaccttgaactcctggg

SEQ ID NO: 239579 - DNA, 22 bp, Homo sapiens
ggctgactagaagggccagtcc

SEQ ID NO: 239580 - DNA, 13 bp, Homo sapiens
ggctgactgggaa

SEQ ID NO: 239581 - DNA, 15 bp, Homo sapiens
ggctgactggggctg

SEQ ID NO: 239582 - DNA, 19 bp, Homo sapiens
ggctgactgggggcctctg

SEQ ID NO: 239583 - DNA, 20 bp, Homo sapiens
ggctgactgggggcctctgc

SEQ ID NO: 239584 - DNA, 17 bp, Homo sapiens
ggctgagagccccagct

SEQ ID NO: 239585 - DNA, 18 bp, Homo sapiens
ggctgagagccccagctg

SEQ ID NO: 239586 - DNA, 19 bp, Homo sapiens
ggctgagagccccagctga

SEQ ID NO: 239587 - DNA, 20 bp, Homo sapiens
ggctgagagggctgtggctg

SEQ ID NO: 239588 - DNA, 18 bp, Homo sapiens
ggctgagcccctacccca

SEQ ID NO: 239589 - DNA, 22 bp, Homo sapiens
ggctgagcccctaccccacacc

SEQ ID NO: 239590 - DNA, 19 bp, Homo sapiens
ggctgagcccctcctctcc

SEQ ID NO: 239591 - DNA, 20 bp, Homo sapiens
ggctgagcctactgtctcct

SEQ ID NO: 239592 - DNA, 21 bp, Homo sapiens
ggctgaggacggggcagagct

SEQ ID NO: 239593 - DNA, 16 bp, Homo sapiens
ggctgagtgcagaggc

SEQ ID NO: 239594 - DNA, 17 bp, Homo sapiens
ggctgagtgcagaggct

SEQ ID NO: 239595 - DNA, 19 bp, Homo sapiens
ggctgagtggaatgcaggg

SEQ ID NO: 239596 - DNA, 22 bp, Homo sapiens
ggctgcaaaaccggcaacctgt

SEQ ID NO: 239597 - DNA, 22 bp, Homo sapiens
ggctgcacagcccaaccaggag

SEQ ID NO: 239598 - DNA, 15 bp, Homo sapiens
ggctgcagcaggcag

SEQ ID NO: 239599 - DNA, 17 bp, Homo sapiens
ggctgcatcctcagccc

SEQ ID NO: 239600 - DNA, 22 bp, Homo sapiens
ggctgcatcctcagccccaggg

SEQ ID NO: 239601 - DNA, 22 bp, Homo sapiens
ggctgcatgcgggcttcctcct

SEQ ID NO: 239602 - DNA, 20 bp, Homo sapiens
ggctgcccacacaccccaat

SEQ ID NO: 239603 - DNA, 19 bp, Homo sapiens
ggctgccccaacctgctga

SEQ ID NO: 239604 - DNA, 18 bp, Homo sapiens
ggctgccccacaggccac

SEQ ID NO: 239605 - DNA, 16 bp, Homo sapiens
ggctgccctggtgctg

SEQ ID NO: 239606 - DNA, 12 bp, Homo sapiens
gggaaaggccgg

SEQ ID NO: 239607 - DNA, 18 bp, Homo sapiens
gggaaaggtgctcaaaga

SEQ ID NO: 239608 - DNA, 19 bp, Homo sapiens
gggaaaggtgctcaaagat

SEQ ID NO: 239609 - DNA, 20 bp, Homo sapiens
gggaaaggtgctcaaagatg

SEQ ID NO: 239610 - DNA, 18 bp, Homo sapiens
gggaaatgctgatttaaa

SEQ ID NO: 239611 - DNA, 21 bp, Homo sapiens
gggaacaaatcacacctctgg

SEQ ID NO: 239612 - DNA, 22 bp, Homo sapiens
gggaacaaatcacacctctggg

SEQ ID NO: 239613 - DNA, 23 bp, Homo sapiens
gggaacaaatcacacctctgggc

SEQ ID NO: 239614 - DNA, 13 bp, Homo sapiens
gggaacaagtgta

SEQ ID NO: 239615 - DNA, 14 bp, Homo sapiens
gggaacaagtgtac

SEQ ID NO: 239616 - DNA, 20 bp, Homo sapiens
gggaaccagccctccagagc

SEQ ID NO: 239617 - DNA, 19 bp, Homo sapiens
gggaacctagtactctctg

SEQ ID NO: 239618 - DNA, 20 bp, Homo sapiens
gggaacctagtactctctgc

SEQ ID NO: 239619 - DNA, 21 bp, Homo sapiens
gggaacctagtactctctgct

SEQ ID NO: 239620 - DNA, 16 bp, Homo sapiens
gggaactaaagggtgt

SEQ ID NO: 239621 - DNA, 18 bp, Homo sapiens
gggaactccactctcctt

SEQ ID NO: 239622 - DNA, 13 bp, Homo sapiens
gggaagagacttg

SEQ ID NO: 239623 - DNA, 18 bp, Homo sapiens
gggaagagaggagttcaa

SEQ ID NO: 239624 - DNA, 14 bp, Homo sapiens
gggaagaggccttg

SEQ ID NO: 239625 - DNA, 15 bp, Homo sapiens
gggaagagggcagta

SEQ ID NO: 239626 - DNA, 22 bp, Homo sapiens
gggaagcccacccgccccagag

SEQ ID NO: 239627 - DNA, 13 bp, Homo sapiens
gggaagctgcagc

SEQ ID NO: 239628 - DNA, 18 bp, Homo sapiens
gggaagcttgagcctccc

SEQ ID NO: 239629 - DNA, 13 bp, Homo sapiens
gggaaggtgaccg

SEQ ID NO: 239630 - DNA, 21 bp, Homo sapiens
gggaagtgacaaggccccaga

SEQ ID NO: 239631 - DNA, 23 bp, Homo sapiens
gggaatactcttggtcacctcaa

SEQ ID NO: 239632 - DNA, 22 bp, Homo sapiens
gggaatgttccctgcaccctgg

SEQ ID NO: 239633 - DNA, 14 bp, Homo sapiens
gggaattctcttgg

SEQ ID NO: 239634 - DNA, 22 bp, Homo sapiens
gggaattgaggtctgctcggcc

SEQ ID NO: 239635 - DNA, 16 bp, Homo sapiens
gggacaatggcaatag

SEQ ID NO: 239636 - DNA, 16 bp, Homo sapiens
gggacacggcctctgg

SEQ ID NO: 239637 - DNA, 22 bp, Homo sapiens
gggacacggcctctggggagac

SEQ ID NO: 239638 - DNA, 14 bp, Homo sapiens
gggacacgggcagc

SEQ ID NO: 239639 - DNA, 23 bp, Homo sapiens
gggacagagttcagggaggggct

SEQ ID NO: 239640 - DNA, 18 bp, Homo sapiens
gggacagatctgatttat

SEQ ID NO: 239641 - DNA, 17 bp, Homo sapiens
gggacagccagagctgg

SEQ ID NO: 239642 - DNA, 18 bp, Homo sapiens
gggacagccagagctggg

SEQ ID NO: 239643 - DNA, 20 bp, Homo sapiens
gggacagccagagctgggtg

SEQ ID NO: 239644 - DNA, 20 bp, Homo sapiens
gggacagctttcctgggtga

SEQ ID NO: 239645 - DNA, 21 bp, Homo sapiens
gggacaggaacacccagcccc

SEQ ID NO: 239646 - DNA, 21 bp, Homo sapiens
gggacagtattctcagtgctc

SEQ ID NO: 239647 - DNA, 16 bp, Homo sapiens
gggacagttggcagag

SEQ ID NO: 239648 - DNA, 19 bp, Homo sapiens
gggacagttggcagagaag

SEQ ID NO: 239649 - DNA, 21 bp, Homo sapiens
gggaccacagctgctggccag

SEQ ID NO: 239650 - DNA, 15 bp, Homo sapiens
gggaccagctggggg

SEQ ID NO: 239651 - DNA, 22 bp, Homo sapiens
gggacccagctactctgtccag

SEQ ID NO: 239652 - DNA, 22 bp, Homo sapiens
gggacccctgctcccagcctgc

SEQ ID NO: 239653 - DNA, 21 bp, Homo sapiens
gggaccctcggggcaggaagt

SEQ ID NO: 239654 - DNA, 23 bp, Homo sapiens
gggaccgccagatggggcctctg

SEQ ID NO: 239655 - DNA, 22 bp, Homo sapiens
gggacctggggtggggaggcag

SEQ ID NO: 239656 - DNA, 15 bp, Homo sapiens
gggacgtggtcaggg

SEQ ID NO: 239657 - DNA, 18 bp, Homo sapiens
gggactctcctcctcccc

SEQ ID NO: 239658 - DNA, 21 bp, Homo sapiens
gggactctcctcctcccctcc

SEQ ID NO: 239659 - DNA, 21 bp, Homo sapiens
gggactctgcttggctgtccc

SEQ ID NO: 239660 - DNA, 18 bp, Homo sapiens
gggactgaagccaaagtt

SEQ ID NO: 239661 - DNA, 13 bp, Homo sapiens
gggactgagccag

SEQ ID NO: 239662 - DNA, 16 bp, Homo sapiens
gggactgatgtcatct

SEQ ID NO: 239663 - DNA, 21 bp, Homo sapiens
gggactggagtcagatgagca

SEQ ID NO: 239664 - DNA, 23 bp, Homo sapiens
gggactggcccacccctcttccc

SEQ ID NO: 239665 - DNA, 14 bp, Homo sapiens
gggactgggagggc

SEQ ID NO: 239666 - DNA, 17 bp, Homo sapiens
gggactgggagggccca

SEQ ID NO: 239667 - DNA, 15 bp, Homo sapiens
gggactgggagtcag

SEQ ID NO: 239668 - DNA, 18 bp, Homo sapiens
gggactgggagtcagagc

SEQ ID NO: 239669 - DNA, 18 bp, Homo sapiens
gggactggtccaggcatg

SEQ ID NO: 239670 - DNA, 19 bp, Homo sapiens
gggactggtccaggcatgg

SEQ ID NO: 239671 - DNA, 22 bp, Homo sapiens
gggactgtacctgtaggaaaca

SEQ ID NO: 239672 - DNA, 21 bp, Homo sapiens
gggactgtcttcaaccctgcc

SEQ ID NO: 239673 - DNA, 22 bp, Homo sapiens
gggactgtcttcaaccctgccc

SEQ ID NO: 239674 - DNA, 14 bp, Homo sapiens
gggagaaaagccag

SEQ ID NO: 239675 - DNA, 14 bp, Homo sapiens
gggagaagggagaa

SEQ ID NO: 239676 - DNA, 13 bp, Homo sapiens
gggagaagtggcc

SEQ ID NO: 239677 - DNA, 17 bp, Homo sapiens
gggagacacctcagagc

SEQ ID NO: 239678 - DNA, 20 bp, Homo sapiens
gggcacctcatggactccag

SEQ ID NO: 239679 - DNA, 13 bp, Homo sapiens
gggcacctctgct

SEQ ID NO: 239680 - DNA, 20 bp, Homo sapiens
gggcacgggagagcgccacc

SEQ ID NO: 239681 - DNA, 18 bp, Homo sapiens
gggcactctctgccagct

SEQ ID NO: 239682 - DNA, 19 bp, Homo sapiens
gggcactctctgccagctc

SEQ ID NO: 239683 - DNA, 21 bp, Homo sapiens
gggcagaaggaggaagggact

SEQ ID NO: 239684 - DNA, 22 bp, Homo sapiens
gggcagaaggaggaagggactg

SEQ ID NO: 239685 - DNA, 15 bp, Homo sapiens
gggcagagccatggg

SEQ ID NO: 239686 - DNA, 16 bp, Homo sapiens
gggcagagctcagagg

SEQ ID NO: 239687 - DNA, 17 bp, Homo sapiens
gggcagagctcagagga

SEQ ID NO: 239688 - DNA, 23 bp, Homo sapiens
gggcagagctcagaggagtctgg

SEQ ID NO: 239689 - DNA, 14 bp, Homo sapiens
gggcagagggaatg

SEQ ID NO: 239690 - DNA, 22 bp, Homo sapiens
gggcagagggaatgttccctgc

SEQ ID NO: 239691 - DNA, 14 bp, Homo sapiens
gggcagaggggaga

SEQ ID NO: 239692 - DNA, 19 bp, Homo sapiens
gggcagaggggagaggaag

SEQ ID NO: 239693 - DNA, 14 bp, Homo sapiens
gggcagaggggcag

SEQ ID NO: 239694 - DNA, 19 bp, Homo sapiens
gggcagaggtcccctgagg

SEQ ID NO: 239695 - DNA, 16 bp, Homo sapiens
gggcagcacagagagg

SEQ ID NO: 239696 - DNA, 19 bp, Homo sapiens
gggcagcactgggaagctg

SEQ ID NO: 239697 - DNA, 23 bp, Homo sapiens
gggcagccccgttttggggacgt

SEQ ID NO: 239698 - DNA, 16 bp, Homo sapiens
gggcagcccctgctgg

SEQ ID NO: 239699 - DNA, 20 bp, Homo sapiens
gggcagcctggctcccagga

SEQ ID NO: 239700 - DNA, 22 bp, Homo sapiens
gggcagcctggctcccaggaca

SEQ ID NO: 239701 - DNA, 23 bp, Homo sapiens
gggcagcctggctcccaggacac

SEQ ID NO: 239702 - DNA, 14 bp, Homo sapiens
gggcagctgggccc

SEQ ID NO: 239703 - DNA, 16 bp, Homo sapiens
gggcaggaaggagagc

SEQ ID NO: 239704 - DNA, 18 bp, Homo sapiens
gggcaggaaggagagcct

SEQ ID NO: 239705 - DNA, 19 bp, Homo sapiens
gggcaggaatcaaggagcc

SEQ ID NO: 239706 - DNA, 21 bp, Homo sapiens
gggcaggaatcaaggagcctc

SEQ ID NO: 239707 - DNA, 15 bp, Homo sapiens
gggcaggcagagctc

SEQ ID NO: 239708 - DNA, 11 bp, Homo sapiens
gggcaggcctg

SEQ ID NO: 239709 - DNA, 12 bp, Homo sapiens
gggcaggcggtc

SEQ ID NO: 239710 - DNA, 13 bp, Homo sapiens
gggcagggcaggg

SEQ ID NO: 239711 - DNA, 14 bp, Homo sapiens
gggcagggcatgac

SEQ ID NO: 239712 - DNA, 17 bp, Homo sapiens
gggcagggccgcagggc

SEQ ID NO: 239713 - DNA, 22 bp, Homo sapiens
gggcagggccgcccgggcccag

SEQ ID NO: 239714 - DNA, 15 bp, Homo sapiens
gggcagggctcccac

SEQ ID NO: 239715 - DNA, 15 bp, Homo sapiens
gggcaggtcctgggg

SEQ ID NO: 239716 - DNA, 20 bp, Homo sapiens
gggcaggtggccacagcagg

SEQ ID NO: 239717 - DNA, 13 bp, Homo sapiens
gggcaggtgggag

SEQ ID NO: 239718 - DNA, 22 bp, Homo sapiens
gggcagtacctgggaaaggacc

SEQ ID NO: 239719 - DNA, 20 bp, Homo sapiens
gggcagtagaaggtcggagg

SEQ ID NO: 239720 - DNA, 15 bp, Homo sapiens
gggcagtgactggca

SEQ ID NO: 239721 - DNA, 23 bp, Homo sapiens
gggcagtgctagtgagctgggca

SEQ ID NO: 239722 - DNA, 12 bp, Homo sapiens
gggcagtggaga

SEQ ID NO: 239723 - DNA, 17 bp, Homo sapiens
gggcagtggagagggga

SEQ ID NO: 239724 - DNA, 18 bp, Homo sapiens
gggcagtgtggtgggagg

SEQ ID NO: 239725 - DNA, 23 bp, Homo sapiens
gggcagttctcactcctaggaga

SEQ ID NO: 239726 - DNA, 22 bp, Homo sapiens
gggcatcagctttccctggctc

SEQ ID NO: 239727 - DNA, 13 bp, Homo sapiens
gggcatcaggcac

SEQ ID NO: 239728 - DNA, 16 bp, Homo sapiens
gggcatcaggcactgg

SEQ ID NO: 239729 - DNA, 17 bp, Homo sapiens
gggcatccacccagtgc

SEQ ID NO: 239730 - DNA, 21 bp, Homo sapiens
gggcatccacccagtgctgcc

SEQ ID NO: 239731 - DNA, 23 bp, Homo sapiens
gggcatccacccagtgctgccat

SEQ ID NO: 239732 - DNA, 16 bp, Homo sapiens
gggcatccccagcccc

SEQ ID NO: 239733 - DNA, 18 bp, Homo sapiens
gggcatccttgaggacct

SEQ ID NO: 239734 - DNA, 14 bp, Homo sapiens
gggcatcgcaggag

SEQ ID NO: 239735 - DNA, 19 bp, Homo sapiens
gggcatctgcccctccccc

SEQ ID NO: 239736 - DNA, 17 bp, Homo sapiens
gggcatggacagggcca

SEQ ID NO: 239737 - DNA, 21 bp, Homo sapiens
gggcatgggggaggctctgaa

SEQ ID NO: 239738 - DNA, 15 bp, Homo sapiens
gggcatggggtgggc

SEQ ID NO: 239739 - DNA, 17 bp, Homo sapiens
gggcatggggtgggcct

SEQ ID NO: 239740 - DNA, 19 bp, Homo sapiens
gggcatggtatttgagaca

SEQ ID NO: 239741 - DNA, 19 bp, Homo sapiens
gggcatggttccttccctg

SEQ ID NO: 239742 - DNA, 18 bp, Homo sapiens
gggcatgtattggcctgg

SEQ ID NO: 239743 - DNA, 15 bp, Homo sapiens
gggcatgtgtgcctg

SEQ ID NO: 239744 - DNA, 16 bp, Homo sapiens
gggcatgtgtgcctgt

SEQ ID NO: 239745 - DNA, 22 bp, Homo sapiens
gggcatgtgtgcctgtggcaga

SEQ ID NO: 239746 - DNA, 19 bp, Homo sapiens
gggcatgttgggataaata

SEQ ID NO: 239747 - DNA, 15 bp, Homo sapiens
gggcattaaaaatag

SEQ ID NO: 239748 - DNA, 23 bp, Homo sapiens
gggcattgggctgacacctacca

SEQ ID NO: 239749 - DNA, 18 bp, Homo sapiens
gggccacacccaggaagg

SEQ ID NO: 239750 - DNA, 19 bp, Homo sapiens
gggccacagggcgagactc

SEQ ID NO: 239751 - DNA, 18 bp, Homo sapiens
gggccaccagctccactg

SEQ ID NO: 239752 - DNA, 15 bp, Homo sapiens
gggccacccaccagg

SEQ ID NO: 239753 - DNA, 17 bp, Homo sapiens
gggccacccaccagggc

SEQ ID NO: 239754 - DNA, 22 bp, Homo sapiens
gggccacccaccagggctcagc

SEQ ID NO: 239755 - DNA, 22 bp, Homo sapiens
gggccacccttcacgctggctt

SEQ ID NO: 239756 - DNA, 17 bp, Homo sapiens
gggccacctccccaggc

SEQ ID NO: 239757 - DNA, 17 bp, Homo sapiens
gggccacgccccagccc

SEQ ID NO: 239758 - DNA, 19 bp, Homo sapiens
gggccagaaggagggcaga

SEQ ID NO: 239759 - DNA, 20 bp, Homo sapiens
gggccagaaggagggcagag

SEQ ID NO: 239760 - DNA, 22 bp, Homo sapiens
gggccagaaggagggcagagcc

SEQ ID NO: 239761 - DNA, 15 bp, Homo sapiens
gggccagactggctg

SEQ ID NO: 239762 - DNA, 18 bp, Homo sapiens
gggccagactggctgcac

SEQ ID NO: 239763 - DNA, 21 bp, Homo sapiens
gggccagactggctgcacagc

SEQ ID NO: 239764 - DNA, 12 bp, Homo sapiens
gggccagaggca

SEQ ID NO: 239765 - DNA, 14 bp, Homo sapiens
gggccagcccagga

SEQ ID NO: 239766 - DNA, 15 bp, Homo sapiens
gggccagcccaggat

SEQ ID NO: 239767 - DNA, 12 bp, Homo sapiens
gggccagctgcc

SEQ ID NO: 239768 - DNA, 14 bp, Homo sapiens
gggccagctgcccc

SEQ ID NO: 239769 - DNA, 22 bp, Homo sapiens
gggccagctgcccctcatttat

SEQ ID NO: 239770 - DNA, 15 bp, Homo sapiens
gggccagtctgggct

SEQ ID NO: 239771 - DNA, 15 bp, Homo sapiens
gggccatgaactttg

SEQ ID NO: 239772 - DNA, 18 bp, Homo sapiens
gggccatgagctccagac

SEQ ID NO: 239773 - DNA, 18 bp, Homo sapiens
gggcccaagcatgcccca

SEQ ID NO: 239774 - DNA, 22 bp, Homo sapiens
gggcccagaactgcccccactg

SEQ ID NO: 239775 - DNA, 12 bp, Homo sapiens
gggcccagaggg

SEQ ID NO: 239776 - DNA, 13 bp, Homo sapiens
gggcccagctgag

SEQ ID NO: 239777 - DNA, 16 bp, Homo sapiens
gggcccagctgggctc

SEQ ID NO: 239778 - DNA, 20 bp, Homo sapiens
gggcccagctgtagccatgg

SEQ ID NO: 239779 - DNA, 22 bp, Homo sapiens
gggcccagctgtagccatggct

SEQ ID NO: 239780 - DNA, 23 bp, Homo sapiens
gggcccaggagagcccccaccag

SEQ ID NO: 239781 - DNA, 13 bp, Homo sapiens
gggcccaggcctg

SEQ ID NO: 239782 - DNA, 13 bp, Homo sapiens
gggcccaggctcc

SEQ ID NO: 239783 - DNA, 17 bp, Homo sapiens
gggcccaggggctgtgg

SEQ ID NO: 239784 - DNA, 21 bp, Homo sapiens
gggcccatggccccagctggc

SEQ ID NO: 239785 - DNA, 17 bp, Homo sapiens
gggccccaaagcccagc

SEQ ID NO: 239786 - DNA, 22 bp, Homo sapiens
gggccccacctacttgtgactg

SEQ ID NO: 239787 - DNA, 12 bp, Homo sapiens
gggccccagacc

SEQ ID NO: 239788 - DNA, 18 bp, Homo sapiens
taagtttagaaattacaa

SEQ ID NO: 239789 - DNA, 18 bp, Homo sapiens
taagtttatccaaatctt

SEQ ID NO: 239790 - DNA, 18 bp, Homo sapiens
taagtttatgtctaaaga

SEQ ID NO: 239791 - DNA, 13 bp, Homo sapiens
taataaaaaacaa

SEQ ID NO: 239792 - DNA, 19 bp, Homo sapiens
taataaaaaatggaaagaa

SEQ ID NO: 239793 - DNA, 13 bp, Homo sapiens
taataaaaaggtt

SEQ ID NO: 239794 - DNA, 20 bp, Homo sapiens
taataaaactgcacagtgct

SEQ ID NO: 239795 - DNA, 21 bp, Homo sapiens
taataaaactgcacagtgctg

SEQ ID NO: 239796 - DNA, 21 bp, Homo sapiens
taataaaatatcattcagcaa

SEQ ID NO: 239797 - DNA, 12 bp, Homo sapiens
taataaaattga

SEQ ID NO: 239798 - DNA, 17 bp, Homo sapiens
taataaacttagaataa

SEQ ID NO: 239799 - DNA, 18 bp, Homo sapiens
taataaacttagaataaa

SEQ ID NO: 239800 - DNA, 13 bp, Homo sapiens
taataaagacagg

SEQ ID NO: 239801 - DNA, 15 bp, Homo sapiens
taataaagctactga

SEQ ID NO: 239802 - DNA, 16 bp, Homo sapiens
taataaagctactgat

SEQ ID NO: 239803 - DNA, 14 bp, Homo sapiens
taataaagtatata

SEQ ID NO: 239804 - DNA, 18 bp, Homo sapiens
taataaagtattccacct

SEQ ID NO: 239805 - DNA, 21 bp, Homo sapiens
taataaagtctgtctgcactg

SEQ ID NO: 239806 - DNA, 19 bp, Homo sapiens
taataaatatactatgaaa

SEQ ID NO: 239807 - DNA, 15 bp, Homo sapiens
taataaattaacatt

SEQ ID NO: 239808 - DNA, 21 bp, Homo sapiens
taataaattgcatgctgcttt

SEQ ID NO: 239809 - DNA, 14 bp, Homo sapiens
taataaatttaagt

SEQ ID NO: 239810 - DNA, 15 bp, Homo sapiens
taataactgtgaagt

SEQ ID NO: 239811 - DNA, 20 bp, Homo sapiens
taataatgtcctttccctgg

SEQ ID NO: 239812 - DNA, 20 bp, Homo sapiens
taatacactaattcctttct

SEQ ID NO: 239813 - DNA, 19 bp, Homo sapiens
taatacagcagtgtcatca

SEQ ID NO: 239814 - DNA, 13 bp, Homo sapiens
taatacataagtt

SEQ ID NO: 239815 - DNA, 21 bp, Homo sapiens
taatacattccatcacagcca

SEQ ID NO: 239816 - DNA, 19 bp, Homo sapiens
taatacccccgtcggaatg

SEQ ID NO: 239817 - DNA, 23 bp, Homo sapiens
taatacccccgtcggaatggtaa

SEQ ID NO: 239818 - DNA, 13 bp, Homo sapiens
taatacctttaaa

SEQ ID NO: 239819 - DNA, 16 bp, Homo sapiens
taatactaagacccta

SEQ ID NO: 239820 - DNA, 18 bp, Homo sapiens
taatactataaatatatt

SEQ ID NO: 239821 - DNA, 15 bp, Homo sapiens
taatactcacctcct

SEQ ID NO: 239822 - DNA, 20 bp, Homo sapiens
taatactgaatttctttgat

SEQ ID NO: 239823 - DNA, 16 bp, Homo sapiens
taatactggttatcct

SEQ ID NO: 239824 - DNA, 15 bp, Homo sapiens
taatacttaaaaata

SEQ ID NO: 239825 - DNA, 20 bp, Homo sapiens
taatacttttttattttgtt

SEQ ID NO: 239826 - DNA, 15 bp, Homo sapiens
taatagaaaactgaa

SEQ ID NO: 239827 - DNA, 18 bp, Homo sapiens
taatagataactgctctt

SEQ ID NO: 239828 - DNA, 22 bp, Homo sapiens
taatagcgggttactttcacat

SEQ ID NO: 239829 - DNA, 17 bp, Homo sapiens
taatagtactattaaca

SEQ ID NO: 239830 - DNA, 14 bp, Homo sapiens
taatagtatatcta

SEQ ID NO: 239831 - DNA, 17 bp, Homo sapiens
taatagtggcaaatgaa

SEQ ID NO: 239832 - DNA, 17 bp, Homo sapiens
taatagttcaggatttg

SEQ ID NO: 239833 - DNA, 16 bp, Homo sapiens
taatataaatgaatga

SEQ ID NO: 239834 - DNA, 16 bp, Homo sapiens
taatataactgcctta

SEQ ID NO: 239835 - DNA, 21 bp, Homo sapiens
taatataactgccttaaaact

SEQ ID NO: 239836 - DNA, 23 bp, Homo sapiens
taatataactgccttaaaacttt

SEQ ID NO: 239837 - DNA, 14 bp, Homo sapiens
taatataataatgt

SEQ ID NO: 239838 - DNA, 18 bp, Homo sapiens
taatatactaaccatttc

SEQ ID NO: 239839 - DNA, 14 bp, Homo sapiens
taatatactgcata

SEQ ID NO: 239840 - DNA, 15 bp, Homo sapiens
taatatactgcatat

SEQ ID NO: 239841 - DNA, 14 bp, Homo sapiens
taatatattgctgc

SEQ ID NO: 239842 - DNA, 17 bp, Homo sapiens
taatatcattttattca

SEQ ID NO: 239843 - DNA, 18 bp, Homo sapiens
taatatcattttattcac

SEQ ID NO: 239844 - DNA, 16 bp, Homo sapiens
taatatcctgaataac

SEQ ID NO: 239845 - DNA, 16 bp, Homo sapiens
taatatcttgaagaat

SEQ ID NO: 239846 - DNA, 17 bp, Homo sapiens
taatatcttgaagaata

SEQ ID NO: 239847 - DNA, 12 bp, Homo sapiens
taatatcttgct

SEQ ID NO: 239848 - DNA, 15 bp, Homo sapiens
taatatctttcagtt

SEQ ID NO: 239849 - DNA, 19 bp, Homo sapiens
taatatctttcagttatta

SEQ ID NO: 239850 - DNA, 18 bp, Homo sapiens
tacagagaaattctgtgg

SEQ ID NO: 239851 - DNA, 20 bp, Homo sapiens
tacagagaaattctgtggtg

SEQ ID NO: 239852 - DNA, 16 bp, Homo sapiens
tacagagcagctcccc

SEQ ID NO: 239853 - DNA, 20 bp, Homo sapiens
tacagaggtctctgccggct

SEQ ID NO: 239854 - DNA, 16 bp, Homo sapiens
tacagagtggcccctc

SEQ ID NO: 239855 - DNA, 12 bp, Homo sapiens
tacagataacat

SEQ ID NO: 239856 - DNA, 13 bp, Homo sapiens
tacagataattta

SEQ ID NO: 239857 - DNA, 22 bp, Homo sapiens
tacagatccgcatgtgtctgta

SEQ ID NO: 239858 - DNA, 23 bp, Homo sapiens
tacagatccgcatgtgtctgtat

SEQ ID NO: 239859 - DNA, 19 bp, Homo sapiens
tacagatttagtttaccaa

SEQ ID NO: 239860 - DNA, 17 bp, Homo sapiens
tacagcaggatgtgcct

SEQ ID NO: 239861 - DNA, 18 bp, Homo sapiens
tacagcagggtcttgctg

SEQ ID NO: 239862 - DNA, 15 bp, Homo sapiens
tacagcctgcacaca

SEQ ID NO: 239863 - DNA, 19 bp, Homo sapiens
tacagcctgcacacacctg

SEQ ID NO: 239864 - DNA, 21 bp, Homo sapiens
tacagcctgcacacacctgcc

SEQ ID NO: 239865 - DNA, 18 bp, Homo sapiens
tacagctaatcagcattc

SEQ ID NO: 239866 - DNA, 14 bp, Homo sapiens
tacagctgtttaag

SEQ ID NO: 239867 - DNA, 16 bp, Homo sapiens
tacagctgtttaagat

SEQ ID NO: 239868 - DNA, 14 bp, Homo sapiens
tacagcttcaccct

SEQ ID NO: 239869 - DNA, 15 bp, Homo sapiens
tacagcttttctctt

SEQ ID NO: 239870 - DNA, 21 bp, Homo sapiens
tacaggaagctttttgtatta

SEQ ID NO: 239871 - DNA, 15 bp, Homo sapiens
tacaggaaggcttgc

SEQ ID NO: 239872 - DNA, 15 bp, Homo sapiens
tacaggaagtactgg

SEQ ID NO: 239873 - DNA, 13 bp, Homo sapiens
tacaggaagtccc

SEQ ID NO: 239874 - DNA, 21 bp, Homo sapiens
tacaggatggttactgaggac

SEQ ID NO: 239875 - DNA, 20 bp, Homo sapiens
tacaggcaaaacacgcaagg

SEQ ID NO: 239876 - DNA, 22 bp, Homo sapiens
tacaggcaaaacacgcaagggc

SEQ ID NO: 239877 - DNA, 15 bp, Homo sapiens
tacaggcgctccagg

SEQ ID NO: 239878 - DNA, 18 bp, Homo sapiens
tacaggcgctccaggcca

SEQ ID NO: 239879 - DNA, 19 bp, Homo sapiens
tacagggaactgggaagat

SEQ ID NO: 239880 - DNA, 23 bp, Homo sapiens
tacagggaactgggaagatgctg

SEQ ID NO: 239881 - DNA, 23 bp, Homo sapiens
tacaggggggtcggaagcctgtc

SEQ ID NO: 239882 - DNA, 19 bp, Homo sapiens
tacagggtagataacctgt

SEQ ID NO: 239883 - DNA, 13 bp, Homo sapiens
tacaggtgtacta

SEQ ID NO: 239884 - DNA, 13 bp, Homo sapiens
tacagtaaataaa

SEQ ID NO: 239885 - DNA, 16 bp, Homo sapiens
tacagtaaataaattg

SEQ ID NO: 239886 - DNA, 21 bp, Homo sapiens
tacagtaaataaattgtttga

SEQ ID NO: 239887 - DNA, 21 bp, Homo sapiens
tacagtaagctgctctattgt

SEQ ID NO: 239888 - DNA, 12 bp, Homo sapiens
tacagtatataa

SEQ ID NO: 239889 - DNA, 19 bp, Homo sapiens
tacagtatttaccttcctt

SEQ ID NO: 239890 - DNA, 19 bp, Homo sapiens
tacagtccttcaaaatcct

SEQ ID NO: 239891 - DNA, 14 bp, Homo sapiens
tacagtctcaattt

SEQ ID NO: 239892 - DNA, 21 bp, Homo sapiens
tacagtctcaattttgtattt

SEQ ID NO: 239893 - DNA, 15 bp, Homo sapiens
tacagtgcagacagg

SEQ ID NO: 239894 - DNA, 13 bp, Homo sapiens
tacagtgcctgta

SEQ ID NO: 239895 - DNA, 16 bp, Homo sapiens
tacagtgcctgtatct

SEQ ID NO: 239896 - DNA, 17 bp, Homo sapiens
tacagtgcctgtatctt

SEQ ID NO: 239897 - DNA, 14 bp, Homo sapiens
tacagtgctttatg

SEQ ID NO: 239898 - DNA, 15 bp, Homo sapiens
tacagtgctttatgg

SEQ ID NO: 239899 - DNA, 22 bp, Homo sapiens
tacagtggattgctcatctcag

SEQ ID NO: 239900 - DNA, 24 bp, Homo sapiens
tacagtgtatctcgaagtcttcca

SEQ ID NO: 239901 - DNA, 18 bp, Homo sapiens
tacagtgtctgtgccatg

SEQ ID NO: 239902 - DNA, 16 bp, Homo sapiens
tacagttaactctccc

SEQ ID NO: 239903 - DNA, 16 bp, Homo sapiens
tacagttacttccttc

SEQ ID NO: 239904 - DNA, 11 bp, Homo sapiens
tacagttcttc

SEQ ID NO: 239905 - DNA, 17 bp, Homo sapiens
tacataaactgacttta

SEQ ID NO: 239906 - DNA, 16 bp, Homo sapiens
tacataacaggcattg

SEQ ID NO: 239907 - DNA, 21 bp, Homo sapiens
tacataacaggcattgcacta

SEQ ID NO: 239908 - DNA, 15 bp, Homo sapiens
tacataagtaattca

SEQ ID NO: 239909 - DNA, 19 bp, Homo sapiens
tacataagtaattcaagaa

SEQ ID NO: 239910 - DNA, 21 bp, Homo sapiens
tacataatgcttaatttctaa

SEQ ID NO: 239911 - DNA, 15 bp, Homo sapiens
tacataattaaattt

SEQ ID NO: 239912 - DNA, 15 bp, Homo sapiens
tacatacagtgatat

SEQ ID NO: 239913 - DNA, 15 bp, Homo sapiens
tacatacattgtata

SEQ ID NO: 239914 - DNA, 14 bp, Homo sapiens
tacatagtctttgt

SEQ ID NO: 239915 - DNA, 20 bp, Homo sapiens
tacatagtctttgtttacat

SEQ ID NO: 239916 - DNA, 17 bp, Homo sapiens
tacatagtgaattttaa

SEQ ID NO: 239917 - DNA, 18 bp, Homo sapiens
tacatagtgaattttaaa

SEQ ID NO: 239918 - DNA, 22 bp, Homo sapiens
tacatagtgaattttaaaatgt

SEQ ID NO: 239919 - DNA, 16 bp, Homo sapiens
tacatagtggtcattt

SEQ ID NO: 239920 - DNA, 22 bp, Homo sapiens
tacatatgagtgtggaagccgg

SEQ ID NO: 239921 - DNA, 14 bp, Homo sapiens
tacatatgctttaa

SEQ ID NO: 239922 - DNA, 14 bp, Homo sapiens
tacatatggaaatc

SEQ ID NO: 239923 - DNA, 22 bp, Homo sapiens
tacatatggaaatcctgttact

SEQ ID NO: 239924 - DNA, 18 bp, Homo sapiens
tacatattactgttgcat

SEQ ID NO: 239925 - DNA, 19 bp, Homo sapiens
tacatattaggaaaatatg

SEQ ID NO: 239926 - DNA, 14 bp, Homo sapiens
tacatattggaaag

SEQ ID NO: 239927 - DNA, 20 bp, Homo sapiens
tacatcatttctttttggga

SEQ ID NO: 239928 - DNA, 15 bp, Homo sapiens
tacatcgccctccac

SEQ ID NO: 239929 - DNA, 21 bp, Homo sapiens
tacatctaagtcagtttcaca

SEQ ID NO: 239930 - DNA, 13 bp, Homo sapiens
tacatctgtcatg

SEQ ID NO: 239931 - DNA, 18 bp, Homo sapiens
tacatgaattgcatttta

SEQ ID NO: 239932 - DNA, 16 bp, Homo sapiens
tacatgagttcaaata

SEQ ID NO: 239933 - DNA, 14 bp, Homo sapiens
tacatgcagcccat

SEQ ID NO: 239934 - DNA, 12 bp, Homo sapiens
tacatgcatgtt

SEQ ID NO: 239935 - DNA, 14 bp, Homo sapiens
tacatgcatgtttt

SEQ ID NO: 239936 - DNA, 22 bp, Homo sapiens
tacatgcatgttttatgtgcac

SEQ ID NO: 239937 - DNA, 17 bp, Homo sapiens
tacatgggtagcttctg

SEQ ID NO: 239938 - DNA, 13 bp, Homo sapiens
tacatggtatctc

SEQ ID NO: 239939 - DNA, 17 bp, Homo sapiens
tacatgtagaaaaatac

SEQ ID NO: 239940 - DNA, 22 bp, Homo sapiens
tacatgtctcatattttcagtg

SEQ ID NO: 239941 - DNA, 21 bp, Homo sapiens
tacatgtggaaaactcacaga

SEQ ID NO: 239942 - DNA, 18 bp, Homo sapiens
tacatgttattgttttca

SEQ ID NO: 239943 - DNA, 15 bp, Homo sapiens
tacatgtttccatca

SEQ ID NO: 239944 - DNA, 21 bp, Homo sapiens
tacatgtttccatcatttctg

SEQ ID NO: 239945 - DNA, 17 bp, Homo sapiens
tacattccctctcctgc

SEQ ID NO: 239946 - DNA, 16 bp, Homo sapiens
tacattcctcagctgc

SEQ ID NO: 239947 - DNA, 21 bp, Homo sapiens
tacattcctgagattctggga

SEQ ID NO: 239948 - DNA, 22 bp, Homo sapiens
tacattctgaaggccttgttaa

SEQ ID NO: 239949 - DNA, 17 bp, Homo sapiens
tacattgtaaatagtat

SEQ ID NO: 239950 - DNA, 16 bp, Homo sapiens
tacattgtaatctgct

SEQ ID NO: 239951 - DNA, 14 bp, Homo sapiens
tacatttatacatc

SEQ ID NO: 239952 - DNA, 16 bp, Homo sapiens
tacatttatacatcac

SEQ ID NO: 239953 - DNA, 15 bp, Homo sapiens
tacatttatcttctg

SEQ ID NO: 239954 - DNA, 17 bp, Homo sapiens
tacatttatcttctgtt

SEQ ID NO: 239955 - DNA, 19 bp, Homo sapiens
tacatttatcttctgtttt

SEQ ID NO: 239956 - DNA, 22 bp, Homo sapiens
tacatttatcttctgtttttct

SEQ ID NO: 239957 - DNA, 20 bp, Homo sapiens
tacatttatgtgtgaagcaa

SEQ ID NO: 239958 - DNA, 21 bp, Homo sapiens
tacatttcacctactttgtaa

SEQ ID NO: 239959 - DNA, 16 bp, Homo sapiens
tacatttgtatgttgt

SEQ ID NO: 239960 - DNA, 16 bp, Homo sapiens
tacattttagacagta

SEQ ID NO: 239961 - DNA, 16 bp, Homo sapiens
tacattttatttatta

SEQ ID NO: 239962 - DNA, 16 bp, Homo sapiens
tacattttcagtacca

SEQ ID NO: 239963 - DNA, 14 bp, Homo sapiens
gggtgaccaggtcc

SEQ ID NO: 239964 - DNA, 15 bp, Homo sapiens
gggtgaggaccactc

SEQ ID NO: 239965 - DNA, 18 bp, Homo sapiens
gggtgaggaccactcctg

SEQ ID NO: 239966 - DNA, 22 bp, Homo sapiens
gggtgaggcgtgggatccagag

SEQ ID NO: 239967 - DNA, 18 bp, Homo sapiens
gggtgaggtaggcgggaa

SEQ ID NO: 239968 - DNA, 14 bp, Homo sapiens
gggtgcacccactc

SEQ ID NO: 239969 - DNA, 23 bp, Homo sapiens
gggtgccaaccacctctggccct

SEQ ID NO: 239970 - DNA, 13 bp, Homo sapiens
gggtgcccacagc

SEQ ID NO: 239971 - DNA, 20 bp, Homo sapiens
gggtgccctccactgccctc

SEQ ID NO: 239972 - DNA, 14 bp, Homo sapiens
gggtgcctgagccc

SEQ ID NO: 239973 - DNA, 20 bp, Homo sapiens
gggtgcgctcacctgcagcc

SEQ ID NO: 239974 - DNA, 20 bp, Homo sapiens
gggtgctctggctggagagg

SEQ ID NO: 239975 - DNA, 23 bp, Homo sapiens
gggtgctgcttccctctgcctgt

SEQ ID NO: 239976 - DNA, 22 bp, Homo sapiens
gggtggaggaaggtgctgagct

SEQ ID NO: 239977 - DNA, 13 bp, Homo sapiens
gggtggagtcagg

SEQ ID NO: 239978 - DNA, 16 bp, Homo sapiens
gggtggcacctcctga

SEQ ID NO: 239979 - DNA, 20 bp, Homo sapiens
gggtggcacctcctgagaag

SEQ ID NO: 239980 - DNA, 22 bp, Homo sapiens
gggtggcctaagagttgagctc

SEQ ID NO: 239981 - DNA, 21 bp, Homo sapiens
gggtggctggggctggcacgg

SEQ ID NO: 239982 - DNA, 16 bp, Homo sapiens
gggtgggacacagaga

SEQ ID NO: 239983 - DNA, 16 bp, Homo sapiens
gggtgggaggctccca

SEQ ID NO: 239984 - DNA, 13 bp, Homo sapiens
gggtgggcctctg

SEQ ID NO: 239985 - DNA, 12 bp, Homo sapiens
gggtgggcctgg

SEQ ID NO: 239986 - DNA, 13 bp, Homo sapiens
gggtgggcctggc

SEQ ID NO: 239987 - DNA, 14 bp, Homo sapiens
gggtgggcctggcc

SEQ ID NO: 239988 - DNA, 20 bp, Homo sapiens
gggtgggcctggcctgagct

SEQ ID NO: 239989 - DNA, 16 bp, Homo sapiens
gggtggggtagggctg

SEQ ID NO: 239990 - DNA, 12 bp, Homo sapiens
gggtggggtgga

SEQ ID NO: 239991 - DNA, 13 bp, Homo sapiens
gggtggtcctgac

SEQ ID NO: 239992 - DNA, 12 bp, Homo sapiens
gggtggtgctgg

SEQ ID NO: 239993 - DNA, 23 bp, Homo sapiens
gggtgtatttattttcctcccca

SEQ ID NO: 239994 - DNA, 13 bp, Homo sapiens
gggtgtgccctgg

SEQ ID NO: 239995 - DNA, 17 bp, Homo sapiens
gggtgtgccctggctcc

SEQ ID NO: 239996 - DNA, 12 bp, Homo sapiens
gggtgtggcttg

SEQ ID NO: 239997 - DNA, 20 bp, Homo sapiens
gggtgttccaaagagaaggc

SEQ ID NO: 239998 - DNA, 20 bp, Homo sapiens
gggttaaagaaaggcagaga

SEQ ID NO: 239999 - DNA, 16 bp, Homo sapiens
gggttccaggctgtgt

SEQ ID NO: 240000 - DNA, 16 bp, Homo sapiens
gggttctcctctcccc

SEQ ID NO: 240001 - DNA, 15 bp, Homo sapiens
gggttctgtaaaatg

SEQ ID NO: 240002 - DNA, 13 bp, Homo sapiens
gggttgaaggcag

SEQ ID NO: 240003 - DNA, 18 bp, Homo sapiens
gggttgaaggcagtctga

SEQ ID NO: 240004 - DNA, 15 bp, Homo sapiens
gggttggaggcctca

SEQ ID NO: 240005 - DNA, 12 bp, Homo sapiens
gggttgggccca

SEQ ID NO: 240006 - DNA, 13 bp, Homo sapiens
gggttgtgagccc

SEQ ID NO: 240007 - DNA, 20 bp, Homo sapiens
gggtttcactgtgttagcca

SEQ ID NO: 240008 - DNA, 15 bp, Homo sapiens
gggtttccacacagc

SEQ ID NO: 240009 - DNA, 17 bp, Homo sapiens
gggtttccacacaggcc

SEQ ID NO: 240010 - DNA, 18 bp, Homo sapiens
gggtttccacacaggccc

SEQ ID NO: 240011 - DNA, 21 bp, Homo sapiens
gggtttgagtcaaaagcctgg

SEQ ID NO: 240012 - DNA, 19 bp, Homo sapiens
gggtttgcttttgttttgt

SEQ ID NO: 240013 - DNA, 16 bp, Homo sapiens
gggtttgggcccctca

SEQ ID NO: 240014 - DNA, 18 bp, Homo sapiens
gggttttccaatgtgact

SEQ ID NO: 240015 - DNA, 21 bp, Homo sapiens
ggtaaactgatgctttcagat

SEQ ID NO: 240016 - DNA, 14 bp, Homo sapiens
ggtaaatatatgtt

SEQ ID NO: 240017 - DNA, 15 bp, Homo sapiens
ggtaaatatatgttt

SEQ ID NO: 240018 - DNA, 18 bp, Homo sapiens
ggtaaatatatgttttga

SEQ ID NO: 240019 - DNA, 21 bp, Homo sapiens
ggtaaatatatgttttgagaa

SEQ ID NO: 240020 - DNA, 22 bp, Homo sapiens
ggtaaatatatgttttgagaaa

SEQ ID NO: 240021 - DNA, 23 bp, Homo sapiens
ggtaaatatatgttttgagaaaa

SEQ ID NO: 240022 - DNA, 15 bp, Homo sapiens
ggtaaattaagacat

SEQ ID NO: 240023 - DNA, 17 bp, Homo sapiens
ggtaacaagaggagcag

SEQ ID NO: 240024 - DNA, 12 bp, Homo sapiens
ggtaactgccag

SEQ ID NO: 240025 - DNA, 15 bp, Homo sapiens
ggcaagctggcagga

SEQ ID NO: 240026 - DNA, 16 bp, Homo sapiens
ggcaagctggcaggag

SEQ ID NO: 240027 - DNA, 15 bp, Homo sapiens
ggcaaggggtgcctg

SEQ ID NO: 240028 - DNA, 23 bp, Homo sapiens
ggcaaggtctccttactctgagc

SEQ ID NO: 240029 - DNA, 18 bp, Homo sapiens
ggcaaggtgggggagcct

SEQ ID NO: 240030 - DNA, 19 bp, Homo sapiens
ggcaaggtgggggagcctg

SEQ ID NO: 240031 - DNA, 22 bp, Homo sapiens
ggcaaggtgggggagcctggag

SEQ ID NO: 240032 - DNA, 18 bp, Homo sapiens
ggcaatagtgtgttctga

SEQ ID NO: 240033 - DNA, 23 bp, Homo sapiens
ggcaatgactgtgagcgagcctg

SEQ ID NO: 240034 - DNA, 15 bp, Homo sapiens
ggcacaagacccctg

SEQ ID NO: 240035 - DNA, 17 bp, Homo sapiens
ggcacaagacccctgct

SEQ ID NO: 240036 - DNA, 18 bp, Homo sapiens
ggcacaagacccctgctc

SEQ ID NO: 240037 - DNA, 18 bp, Homo sapiens
ggcacaccactgccctgc

SEQ ID NO: 240038 - DNA, 21 bp, Homo sapiens
ggcacaccactgccctgcctg

SEQ ID NO: 240039 - DNA, 17 bp, Homo sapiens
ggcacagaaagggcagc

SEQ ID NO: 240040 - DNA, 22 bp, Homo sapiens
ggcacagaaagggcagcttcag

SEQ ID NO: 240041 - DNA, 16 bp, Homo sapiens
ggcacagacgactgtc

SEQ ID NO: 240042 - DNA, 19 bp, Homo sapiens
ggcacagacttctggaagg

SEQ ID NO: 240043 - DNA, 12 bp, Homo sapiens
ggcacagccaga

SEQ ID NO: 240044 - DNA, 17 bp, Homo sapiens
ggcacagccggggcctg

SEQ ID NO: 240045 - DNA, 23 bp, Homo sapiens
ggcacagccggggcctgcctagc

SEQ ID NO: 240046 - DNA, 21 bp, Homo sapiens
ggcacagctgctgtgccagga

SEQ ID NO: 240047 - DNA, 15 bp, Homo sapiens
ggcacaggctgcccc

SEQ ID NO: 240048 - DNA, 16 bp, Homo sapiens
ggcacagggcagtggg

SEQ ID NO: 240049 - DNA, 17 bp, Homo sapiens
ggcacagggtctgctct

SEQ ID NO: 240050 - DNA, 23 bp, Homo sapiens
ggcacatctaaattgatcattca

SEQ ID NO: 240051 - DNA, 18 bp, Homo sapiens
ggcacatgtgttcagagt

SEQ ID NO: 240052 - DNA, 20 bp, Homo sapiens
ggcacatttccccagacctg

SEQ ID NO: 240053 - DNA, 21 bp, Homo sapiens
ggcacatttccccagacctga

SEQ ID NO: 240054 - DNA, 15 bp, Homo sapiens
ggcaccaaagatgca

SEQ ID NO: 240055 - DNA, 17 bp, Homo sapiens
ggcaccaaagatgcagc

SEQ ID NO: 240056 - DNA, 14 bp, Homo sapiens
ggcaccagccccct

SEQ ID NO: 240057 - DNA, 22 bp, Homo sapiens
ggcaccagctctgtggcctgtg

SEQ ID NO: 240058 - DNA, 20 bp, Homo sapiens
ggcacccacaagtgccactg

SEQ ID NO: 240059 - DNA, 22 bp, Homo sapiens
ggcacccactccggattccggc

SEQ ID NO: 240060 - DNA, 13 bp, Homo sapiens
ggcacccccatgc

SEQ ID NO: 240061 - DNA, 14 bp, Homo sapiens
ggcacccccatgct

SEQ ID NO: 240062 - DNA, 15 bp, Homo sapiens
ggcacccccatgctg

SEQ ID NO: 240063 - DNA, 16 bp, Homo sapiens
ggcaccgcccacccac

SEQ ID NO: 240064 - DNA, 17 bp, Homo sapiens
ggcaccgcccacccaca

SEQ ID NO: 240065 - DNA, 17 bp, Homo sapiens
ggcaccggcgctgcagg

SEQ ID NO: 240066 - DNA, 14 bp, Homo sapiens
ggcacctcagaaag

SEQ ID NO: 240067 - DNA, 14 bp, Homo sapiens
ggcacctcctgaga

SEQ ID NO: 240068 - DNA, 13 bp, Homo sapiens
ggcacctggcctg

SEQ ID NO: 240069 - DNA, 20 bp, Homo sapiens
ggcacctgtggccagagcac

SEQ ID NO: 240070 - DNA, 18 bp, Homo sapiens
ggcacgccaacagccccc

SEQ ID NO: 240071 - DNA, 13 bp, Homo sapiens
ggcacggaggctc

SEQ ID NO: 240072 - DNA, 13 bp, Homo sapiens
ggcacgggagagc

SEQ ID NO: 240073 - DNA, 19 bp, Homo sapiens
ggcacgggagagcgccacc

SEQ ID NO: 240074 - DNA, 22 bp, Homo sapiens
ggcacgggagagcgccacccgc

SEQ ID NO: 240075 - DNA, 23 bp, Homo sapiens
ggcacgggagagcgccacccgcc

SEQ ID NO: 240076 - DNA, 13 bp, Homo sapiens
ggcacgtcctcca

SEQ ID NO: 240077 - DNA, 14 bp, Homo sapiens
ggcactctctgcca

SEQ ID NO: 240078 - DNA, 20 bp, Homo sapiens
ggcactctctgccagctcca

SEQ ID NO: 240079 - DNA, 22 bp, Homo sapiens
ggcactctctgccagctccaca

SEQ ID NO: 240080 - DNA, 13 bp, Homo sapiens
ggcactgccttct

SEQ ID NO: 240081 - DNA, 17 bp, Homo sapiens
ggcactgcgccacctgc

SEQ ID NO: 240082 - DNA, 14 bp, Homo sapiens
ggcactggaaaaca

SEQ ID NO: 240083 - DNA, 14 bp, Homo sapiens
ggcactggctgctc

SEQ ID NO: 240084 - DNA, 13 bp, Homo sapiens
ggcactgtggcct

SEQ ID NO: 240085 - DNA, 22 bp, Homo sapiens
ggcacttcgtggatgacctcct

SEQ ID NO: 240086 - DNA, 22 bp, Homo sapiens
ggcagaaaactggcagtgcacc

SEQ ID NO: 240087 - DNA, 23 bp, Homo sapiens
ggcagaaaagaggagaccctgga

SEQ ID NO: 240088 - DNA, 22 bp, Homo sapiens
ggcagaaaccttgtttgtttta

SEQ ID NO: 240089 - DNA, 23 bp, Homo sapiens
ggcagaaatcccagttcatgttg

SEQ ID NO: 240090 - DNA, 21 bp, Homo sapiens
ggcagaactgagctcctctgg

SEQ ID NO: 240091 - DNA, 14 bp, Homo sapiens
ggcagaaggaggaa

SEQ ID NO: 240092 - DNA, 22 bp, Homo sapiens
ggcagaaggaggaagggactgg

SEQ ID NO: 240093 - DNA, 11 bp, Homo sapiens
ggcagaaggga

SEQ ID NO: 240094 - DNA, 15 bp, Homo sapiens
ggcagaagtgctctt

SEQ ID NO: 240095 - DNA, 15 bp, Homo sapiens
ggcagagaaggcctc

SEQ ID NO: 240096 - DNA, 16 bp, Homo sapiens
ggcagagaaggcctct

SEQ ID NO: 240097 - DNA, 17 bp, Homo sapiens
ggcagagaaggcctctt

SEQ ID NO: 240098 - DNA, 18 bp, Homo sapiens
ggcagagacaataaaaca

SEQ ID NO: 240099 - DNA, 19 bp, Homo sapiens
ggcagagattgggggggct

SEQ ID NO: 240100 - DNA, 21 bp, Homo sapiens
ggcagagattgggggggcttg

SEQ ID NO: 240101 - DNA, 13 bp, Homo sapiens
ggcagagccatgg

SEQ ID NO: 240102 - DNA, 18 bp, Homo sapiens
ggcagagccatgggcctg

SEQ ID NO: 240103 - DNA, 23 bp, Homo sapiens
ggcagagccatgggcctgggcct

SEQ ID NO: 240104 - DNA, 17 bp, Homo sapiens
ggcagagctcagaggag

SEQ ID NO: 240105 - DNA, 14 bp, Homo sapiens
ggcagagctcagca

SEQ ID NO: 240106 - DNA, 19 bp, Homo sapiens
ggcagagctcagcacagcc

SEQ ID NO: 240107 - DNA, 21 bp, Homo sapiens
ggcagagctgagtcggctggg

SEQ ID NO: 240108 - DNA, 15 bp, Homo sapiens
ggcagaggacagatc

SEQ ID NO: 240109 - DNA, 14 bp, Homo sapiens
ggcagaggcagggc

SEQ ID NO: 240110 - DNA, 16 bp, Homo sapiens
ggcagaggcagggccc

SEQ ID NO: 240111 - DNA, 17 bp, Homo sapiens
ggcagaggggagaggaa

SEQ ID NO: 240112 - DNA, 16 bp, Homo sapiens
ggcagagtgccccacc

SEQ ID NO: 240113 - DNA, 20 bp, Homo sapiens
ggcagataatcagcctctta

SEQ ID NO: 240114 - DNA, 15 bp, Homo sapiens
ggcagatctgtgccc

SEQ ID NO: 240115 - DNA, 18 bp, Homo sapiens
ggcagatctgtgccccat

SEQ ID NO: 240116 - DNA, 13 bp, Homo sapiens
ggcagatggagcc

SEQ ID NO: 240117 - DNA, 16 bp, Homo sapiens
ggcagattttacaaaa

SEQ ID NO: 240118 - DNA, 16 bp, Homo sapiens
ggcagcaaaggaagac

SEQ ID NO: 240119 - DNA, 16 bp, Homo sapiens
ggcagcaacaggacca

SEQ ID NO: 240120 - DNA, 17 bp, Homo sapiens
ggcagcaacaggaccag

SEQ ID NO: 240121 - DNA, 19 bp, Homo sapiens
ggcagcaacaggaccagga

SEQ ID NO: 240122 - DNA, 20 bp, Homo sapiens
ggcagcaacaggaccaggag

SEQ ID NO: 240123 - DNA, 21 bp, Homo sapiens
ggcagcaacaggaccaggagc

SEQ ID NO: 240124 - DNA, 22 bp, Homo sapiens
ggcagcaacaggaccaggagcc

SEQ ID NO: 240125 - DNA, 23 bp, Homo sapiens
ggcagcaacaggaccaggagcca

SEQ ID NO: 240126 - DNA, 11 bp, Homo sapiens
ggcagcagccg

SEQ ID NO: 240127 - DNA, 13 bp, Homo sapiens
ggcagccaggctg

SEQ ID NO: 240128 - DNA, 16 bp, Homo sapiens
ggcagccatgcctcat

SEQ ID NO: 240129 - DNA, 19 bp, Homo sapiens
ggcagccatgcctcatgcc

SEQ ID NO: 240130 - DNA, 16 bp, Homo sapiens
ggcagcccagagagac

SEQ ID NO: 240131 - DNA, 21 bp, Homo sapiens
ggcagccccacttcaccccca

SEQ ID NO: 240132 - DNA, 11 bp, Homo sapiens
ggcagccccat

SEQ ID NO: 240133 - DNA, 13 bp, Homo sapiens
ggcagccccatcc

SEQ ID NO: 240134 - DNA, 21 bp, Homo sapiens
ggcagccccatccttcccgca

SEQ ID NO: 240135 - DNA, 22 bp, Homo sapiens
ggcagccccatccttcccgcag

SEQ ID NO: 240136 - DNA, 23 bp, Homo sapiens
ggcagccccatccttcccgcagc

SEQ ID NO: 240137 - DNA, 13 bp, Homo sapiens
ggcagccccccag

SEQ ID NO: 240138 - DNA, 23 bp, Homo sapiens
ggcagccccccagtgtccccagg

SEQ ID NO: 240139 - DNA, 15 bp, Homo sapiens
ggcagcccctcccca

SEQ ID NO: 240140 - DNA, 14 bp, Homo sapiens
ggcagcccctgctg

SEQ ID NO: 240141 - DNA, 19 bp, Homo sapiens
ggcagcccctgctggacca

SEQ ID NO: 240142 - DNA, 21 bp, Homo sapiens
ggcagccgctaggagagactg

SEQ ID NO: 240143 - DNA, 23 bp, Homo sapiens
ggcagccgctaggagagactgaa

SEQ ID NO: 240144 - DNA, 21 bp, Homo sapiens
ggcagccgtgccttcagctct

SEQ ID NO: 240145 - DNA, 22 bp, Homo sapiens
ggcagccgtgccttcagctcta

SEQ ID NO: 240146 - DNA, 16 bp, Homo sapiens
ggcagcctcagggctt

SEQ ID NO: 240147 - DNA, 15 bp, Homo sapiens
ggcagcctccagagc

SEQ ID NO: 240148 - DNA, 18 bp, Homo sapiens
ggcagcctccagagccag

SEQ ID NO: 240149 - DNA, 19 bp, Homo sapiens
ggcagcctccagagccagc

SEQ ID NO: 240150 - DNA, 22 bp, Homo sapiens
ggcagcctccagagccagcctg

SEQ ID NO: 240151 - DNA, 23 bp, Homo sapiens
ggcagcctccagagccagcctgg

SEQ ID NO: 240152 - DNA, 14 bp, Homo sapiens
ggcagcctggctcc

SEQ ID NO: 240153 - DNA, 18 bp, Homo sapiens
ggcagcctggctcccagg

SEQ ID NO: 240154 - DNA, 11 bp, Homo sapiens
ggcagcctggt

SEQ ID NO: 240155 - DNA, 12 bp, Homo sapiens
ggcagcctgtgg

SEQ ID NO: 240156 - DNA, 21 bp, Homo sapiens
ggcagcctgtgggagaaggga

SEQ ID NO: 240157 - DNA, 15 bp, Homo sapiens
ggcagcgctcctgga

SEQ ID NO: 240158 - DNA, 21 bp, Homo sapiens
gctcctgaggggcatctgccc

SEQ ID NO: 240159 - DNA, 23 bp, Homo sapiens
gctcctgctggggggcagggccc

SEQ ID NO: 240160 - DNA, 13 bp, Homo sapiens
gctcctggagcca

SEQ ID NO: 240161 - DNA, 14 bp, Homo sapiens
gctcctggagccag

SEQ ID NO: 240162 - DNA, 20 bp, Homo sapiens
gctcctggagccagccaccc

SEQ ID NO: 240163 - DNA, 11 bp, Homo sapiens
gctcctggctg

SEQ ID NO: 240164 - DNA, 13 bp, Homo sapiens
gctcctggctgcc

SEQ ID NO: 240165 - DNA, 18 bp, Homo sapiens
gctcctggctgccaggcg

SEQ ID NO: 240166 - DNA, 19 bp, Homo sapiens
gctcctggctgccaggcgt

SEQ ID NO: 240167 - DNA, 18 bp, Homo sapiens
gctccttcagcagctaga

SEQ ID NO: 240168 - DNA, 14 bp, Homo sapiens
gctccttcatgctt

SEQ ID NO: 240169 - DNA, 21 bp, Homo sapiens
tacacctggaccatttgattg

SEQ ID NO: 240170 - DNA, 11 bp, Homo sapiens
tacactcctgc

SEQ ID NO: 240171 - DNA, 13 bp, Homo sapiens
tacactctcctgg

SEQ ID NO: 240172 - DNA, 15 bp, Homo sapiens
tacactgacttgaga

SEQ ID NO: 240173 - DNA, 13 bp, Homo sapiens
tacactgttattt

SEQ ID NO: 240174 - DNA, 21 bp, Homo sapiens
tacacttacaagtaatgaatt

SEQ ID NO: 240175 - DNA, 12 bp, Homo sapiens
tacacttctgat

SEQ ID NO: 240176 - DNA, 13 bp, Homo sapiens
tacacttgggtga

SEQ ID NO: 240177 - DNA, 13 bp, Homo sapiens
tacactttatgca

SEQ ID NO: 240178 - DNA, 23 bp, Homo sapiens
tacagaaagcaaatcagacacaa

SEQ ID NO: 240179 - DNA, 16 bp, Homo sapiens
tacagaatcattgctt

SEQ ID NO: 240180 - DNA, 17 bp, Homo sapiens
tacagaatcattgctta

SEQ ID NO: 240181 - DNA, 15 bp, Homo sapiens
tacagacaaagcgtg

SEQ ID NO: 240182 - DNA, 13 bp, Homo sapiens
tacagacactaag

SEQ ID NO: 240183 - DNA, 16 bp, Homo sapiens
taccactgctaataaa

SEQ ID NO: 240184 - DNA, 21 bp, Homo sapiens
taccacttatttctaaatcct

SEQ ID NO: 240185 - DNA, 14 bp, Homo sapiens
taccagactgcagg

SEQ ID NO: 240186 - DNA, 23 bp, Homo sapiens
taccagactgcaggttggacccc

SEQ ID NO: 240187 - DNA, 21 bp, Homo sapiens
taccagcaagaataaaaaaga

SEQ ID NO: 240188 - DNA, 20 bp, Homo sapiens
taccagccctggggctgggc

SEQ ID NO: 240189 - DNA, 20 bp, Homo sapiens
taccagcgcccgctgggctg

SEQ ID NO: 240190 - DNA, 12 bp, Homo sapiens
taccaggccacc

SEQ ID NO: 240191 - DNA, 15 bp, Homo sapiens
taccaggccacccac

SEQ ID NO: 240192 - DNA, 13 bp, Homo sapiens
tacttaactattc

SEQ ID NO: 240193 - DNA, 15 bp, Homo sapiens
gcccatgcccacctg

SEQ ID NO: 240194 - DNA, 13 bp, Homo sapiens
gcccatgccctcc

SEQ ID NO: 240195 - DNA, 23 bp, Homo sapiens
gcccatgccctccgtcctggcag

SEQ ID NO: 240196 - DNA, 16 bp, Homo sapiens
gcccatggccccagct

SEQ ID NO: 240197 - DNA, 17 bp, Homo sapiens
gcccatggccccagctg

SEQ ID NO: 240198 - DNA, 19 bp, Homo sapiens
gcccattagcaacgcctgc

SEQ ID NO: 240199 - DNA, 20 bp, Homo sapiens
gcccattcgtctgtcccaga

SEQ ID NO: 240200 - DNA, 22 bp, Homo sapiens
gcccattcgtctgtcccagagc

SEQ ID NO: 240201 - DNA, 23 bp, Homo sapiens
gcccattcgtctgtcccagagct

SEQ ID NO: 240202 - DNA, 13 bp, Homo sapiens
gcccattgtaact

SEQ ID NO: 240203 - DNA, 19 bp, Homo sapiens
gccccaaaaccacagccct

SEQ ID NO: 240204 - DNA, 20 bp, Homo sapiens
gccccaaaaccacagccctg

SEQ ID NO: 240205 - DNA, 17 bp, Homo sapiens
gccccaaagcccagccc

SEQ ID NO: 240206 - DNA, 19 bp, Homo sapiens
gccccaaagcccagcccgg

SEQ ID NO: 240207 - DNA, 15 bp, Homo sapiens
gccccaacctgctga

SEQ ID NO: 240208 - DNA, 21 bp, Homo sapiens
gccccaagaggctagccccag

SEQ ID NO: 240209 - DNA, 20 bp, Homo sapiens
gccccaagataggggcacac

SEQ ID NO: 240210 - DNA, 13 bp, Homo sapiens
gccccaagcagcc

SEQ ID NO: 240211 - DNA, 16 bp, Homo sapiens
gccccaagcagccagc

SEQ ID NO: 240212 - DNA, 23 bp, Homo sapiens
gccccaagcagccagccagtctt

SEQ ID NO: 240213 - DNA, 16 bp, Homo sapiens
gccccacacaggcctg

SEQ ID NO: 240214 - DNA, 22 bp, Homo sapiens
gccccacacaggcctggcccag

SEQ ID NO: 240215 - DNA, 14 bp, Homo sapiens
gccccacacggact

SEQ ID NO: 240216 - DNA, 19 bp, Homo sapiens
gccccacagctacctgaga

SEQ ID NO: 240217 - DNA, 20 bp, Homo sapiens
gccccacagctacctgagac

SEQ ID NO: 240218 - DNA, 13 bp, Homo sapiens
gccccacccaccc

SEQ ID NO: 240219 - DNA, 14 bp, Homo sapiens
gccccacccacccc

SEQ ID NO: 240220 - DNA, 17 bp, Homo sapiens
gccccacccacccctcc

SEQ ID NO: 240221 - DNA, 21 bp, Homo sapiens
gccccacccacccctcctggg

SEQ ID NO: 240222 - DNA, 18 bp, Homo sapiens
gccccacccaccctctgg

SEQ ID NO: 240223 - DNA, 19 bp, Homo sapiens
tatctttaaatgatgtaca

SEQ ID NO: 240224 - DNA, 15 bp, Homo sapiens
tatctttaattgtat

SEQ ID NO: 240225 - DNA, 19 bp, Homo sapiens
tatctttatacttaaacag

SEQ ID NO: 240226 - DNA, 22 bp, Homo sapiens
tatctttatacttaaacagctt

SEQ ID NO: 240227 - DNA, 12 bp, Homo sapiens
tatctttgcact

SEQ ID NO: 240228 - DNA, 18 bp, Homo sapiens
tatcttttatttcattca

SEQ ID NO: 240229 - DNA, 15 bp, Homo sapiens
tatcttttttcaaaa

SEQ ID NO: 240230 - DNA, 16 bp, Homo sapiens
tatgaaaaaaaaatta

SEQ ID NO: 240231 - DNA, 22 bp, Homo sapiens
tatgaaaaaaaaattatttgcc

SEQ ID NO: 240232 - DNA, 22 bp, Homo sapiens
tatgaaagatggctgtgcctct

SEQ ID NO: 240233 - DNA, 12 bp, Homo sapiens
tatgaaatgata

SEQ ID NO: 240234 - DNA, 20 bp, Homo sapiens
tatgaaatgataaagatgtc

SEQ ID NO: 240235 - DNA, 22 bp, Homo sapiens
tatgaaatgataaagatgtcaa

SEQ ID NO: 240236 - DNA, 22 bp, Homo sapiens
tatgaacagggcccaggcctgg

SEQ ID NO: 240237 - DNA, 15 bp, Homo sapiens
tatgaacttaacatg

SEQ ID NO: 240238 - DNA, 23 bp, Homo sapiens
tatgaacttaacatgctgtgtaa

SEQ ID NO: 240239 - DNA, 16 bp, Homo sapiens
tatgaacttgaggaca

SEQ ID NO: 240240 - DNA, 18 bp, Homo sapiens
tatgaacttgaggacaca

SEQ ID NO: 240241 - DNA, 20 bp, Homo sapiens
tatgaacttgaggacacatg

SEQ ID NO: 240242 - DNA, 21 bp, Homo sapiens
tatgaacttgaggacacatgt

SEQ ID NO: 240243 - DNA, 13 bp, Homo sapiens
tatgaagacactg

SEQ ID NO: 240244 - DNA, 21 bp, Homo sapiens
tatgaagctacctcaaacttc

SEQ ID NO: 240245 - DNA, 15 bp, Homo sapiens
tatgaagtactttta

SEQ ID NO: 240246 - DNA, 16 bp, Homo sapiens
tatgaagtacttttaa

SEQ ID NO: 240247 - DNA, 17 bp, Homo sapiens
tatgaagttaacagtct

SEQ ID NO: 240248 - DNA, 18 bp, Homo sapiens
tatgaataaagacaccta

SEQ ID NO: 240249 - DNA, 17 bp, Homo sapiens
tatgaataattatgttt

SEQ ID NO: 240250 - DNA, 16 bp, Homo sapiens
tatgaatacagggcat

SEQ ID NO: 240251 - DNA, 20 bp, Homo sapiens
tatgaatttaaatataattc

SEQ ID NO: 240252 - DNA, 23 bp, Homo sapiens
tatgaatttaaatataattctgt

SEQ ID NO: 240253 - DNA, 23 bp, Homo sapiens
tatgacaatttcaaaatgcatgt

SEQ ID NO: 240254 - DNA, 22 bp, Homo sapiens
tatgacactgttaatagtacta

SEQ ID NO: 240255 - DNA, 13 bp, Homo sapiens
tatgacatttcta

SEQ ID NO: 240256 - DNA, 22 bp, Homo sapiens
tatgacctaaatccattttcta

SEQ ID NO: 240257 - DNA, 18 bp, Homo sapiens
tatgacctcaacaaagaa

SEQ ID NO: 240258 - DNA, 16 bp, Homo sapiens
tatgacggaagaacat

SEQ ID NO: 240259 - DNA, 13 bp, Homo sapiens
tatgactaaagag

SEQ ID NO: 240260 - DNA, 18 bp, Homo sapiens
tatgactaaagagagaat

SEQ ID NO: 240261 - DNA, 21 bp, Homo sapiens
tatgactaaagagagaatgta

SEQ ID NO: 240262 - DNA, 16 bp, Homo sapiens
tatgactccagaattt

SEQ ID NO: 240263 - DNA, 17 bp, Homo sapiens
tatgactccagaatttc

SEQ ID NO: 240264 - DNA, 15 bp, Homo sapiens
tatgagaaaaaaaca

SEQ ID NO: 240265 - DNA, 16 bp, Homo sapiens
tatgagaaaaaaacag

SEQ ID NO: 240266 - DNA, 18 bp, Homo sapiens
tatgagaaatataaaaat

SEQ ID NO: 240267 - DNA, 20 bp, Homo sapiens
tatgagaaatataaaaataa

SEQ ID NO: 240268 - DNA, 22 bp, Homo sapiens
tatgagaacaagtcacagctgc

SEQ ID NO: 240269 - DNA, 20 bp, Homo sapiens
tatgagaacatggtgtgtgt

SEQ ID NO: 240270 - DNA, 21 bp, Homo sapiens
tatgagaactggttcttgcct

SEQ ID NO: 240271 - DNA, 15 bp, Homo sapiens
tatgagaggcaatga

SEQ ID NO: 240272 - DNA, 23 bp, Homo sapiens
tatgagattggaaaaaattagac

SEQ ID NO: 240273 - DNA, 17 bp, Homo sapiens
tatgaggacaaggtata

SEQ ID NO: 240274 - DNA, 21 bp, Homo sapiens
tatgaggggactgcatgcaag

SEQ ID NO: 240275 - DNA, 22 bp, Homo sapiens
tatgaggggactgcatgcaagc

SEQ ID NO: 240276 - DNA, 15 bp, Homo sapiens
tatgagttactgaag

SEQ ID NO: 240277 - DNA, 21 bp, Homo sapiens
tatgagtttttgatagcttta

SEQ ID NO: 240278 - DNA, 23 bp, Homo sapiens
tatgagtttttgatagctttatt

SEQ ID NO: 240279 - DNA, 15 bp, Homo sapiens
tatgataaaaggaag

SEQ ID NO: 240280 - DNA, 19 bp, Homo sapiens
tatgataaaaggaagtaga

SEQ ID NO: 240281 - DNA, 21 bp, Homo sapiens
tatgataggcagcactgaaat

SEQ ID NO: 240282 - DNA, 13 bp, Homo sapiens
tatgatatataaa

SEQ ID NO: 240283 - DNA, 15 bp, Homo sapiens
tatgatatgcatgta

SEQ ID NO: 240284 - DNA, 14 bp, Homo sapiens
tatgatattctcat

SEQ ID NO: 240285 - DNA, 13 bp, Homo sapiens
tatgatatttctt

SEQ ID NO: 240286 - DNA, 17 bp, Homo sapiens
tatgatctgtggagaat

SEQ ID NO: 240287 - DNA, 19 bp, Homo sapiens
tatgatctgtggagaatgt

SEQ ID NO: 240288 - DNA, 14 bp, Homo sapiens
tatgatgtattagt

SEQ ID NO: 240289 - DNA, 15 bp, Homo sapiens
tatgattgaaaagaa

SEQ ID NO: 240290 - DNA, 17 bp, Homo sapiens
tatgattgtaacatatt

SEQ ID NO: 240291 - DNA, 18 bp, Homo sapiens
tatgatttcatgattaga

SEQ ID NO: 240292 - DNA, 20 bp, Homo sapiens
tatgattttatttaaactat

SEQ ID NO: 240293 - DNA, 21 bp, Homo sapiens
tatgattttatttaaactatt

SEQ ID NO: 240294 - DNA, 21 bp, Homo sapiens
tatgcaaacagttcttggacc

SEQ ID NO: 240295 - DNA, 23 bp, Homo sapiens
tatgcacaccaaattgctgagat

SEQ ID NO: 240296 - DNA, 20 bp, Homo sapiens
tatgcacagattaaacttca

SEQ ID NO: 240297 - DNA, 20 bp, Homo sapiens
tatgcactttccctagaaag

SEQ ID NO: 240298 - DNA, 16 bp, Homo sapiens
tatgcagcatacaaaa

SEQ ID NO: 240299 - DNA, 18 bp, Homo sapiens
tatgcagcatacaaaaat

SEQ ID NO: 240300 - DNA, 21 bp, Homo sapiens
tatgggtatcaaacagctcag

SEQ ID NO: 240301 - DNA, 14 bp, Homo sapiens
tatggtatttgagt

SEQ ID NO: 240302 - DNA, 22 bp, Homo sapiens
tatggtattttcgtgcatttgt

SEQ ID NO: 240303 - DNA, 13 bp, Homo sapiens
tatggtgaaatta

SEQ ID NO: 240304 - DNA, 14 bp, Homo sapiens
tatgtaaagtatgt

SEQ ID NO: 240305 - DNA, 17 bp, Homo sapiens
tatgtaaagtatgtaaa

SEQ ID NO: 240306 - DNA, 18 bp, Homo sapiens
tatgtaaagtatgtaaac

SEQ ID NO: 240307 - DNA, 20 bp, Homo sapiens
tatgtaaattattgtaaact

SEQ ID NO: 240308 - DNA, 16 bp, Homo sapiens
tatgtaagagcacctt

SEQ ID NO: 240309 - DNA, 17 bp, Homo sapiens
tatgtaatgcaaaattt

SEQ ID NO: 240310 - DNA, 18 bp, Homo sapiens
tatgtatatctttgcact

SEQ ID NO: 240311 - DNA, 17 bp, Homo sapiens
tatgtatctaaatgaaa

SEQ ID NO: 240312 - DNA, 22 bp, Homo sapiens
tatgtatctaaatgaaaagaga

SEQ ID NO: 240313 - DNA, 19 bp, Homo sapiens
tatgtatgctgatttacta

SEQ ID NO: 240314 - DNA, 16 bp, Homo sapiens
tatgtatgtgtagtgt

SEQ ID NO: 240315 - DNA, 13 bp, Homo sapiens
tatgtatgtttac

SEQ ID NO: 240316 - DNA, 17 bp, Homo sapiens
tatgtattaccagcccc

SEQ ID NO: 240317 - DNA, 17 bp, Homo sapiens
tatgtattggcatttat

SEQ ID NO: 240318 - DNA, 12 bp, Homo sapiens
tatgtatttata

SEQ ID NO: 240319 - DNA, 13 bp, Homo sapiens
tatgtcaaatgga

SEQ ID NO: 240320 - DNA, 16 bp, Homo sapiens
tatgtcagcagctctg

SEQ ID NO: 240321 - DNA, 13 bp, Homo sapiens
tatgtcatttcta

SEQ ID NO: 240322 - DNA, 21 bp, Homo sapiens
tatgtcatttctactttgact

SEQ ID NO: 240323 - DNA, 13 bp, Homo sapiens
tatgtcccatgac

SEQ ID NO: 240324 - DNA, 16 bp, Homo sapiens
tatgtctaaagagctt

SEQ ID NO: 240325 - DNA, 22 bp, Homo sapiens
tatgtctcacagggacccacat

SEQ ID NO: 240326 - DNA, 10 bp, Homo sapiens
tatgtctgtt

SEQ ID NO: 240327 - DNA, 14 bp, Homo sapiens
tatgtcttataaga

SEQ ID NO: 240328 - DNA, 12 bp, Homo sapiens
tatgtctttaaa

SEQ ID NO: 240329 - DNA, 16 bp, Homo sapiens
tatgtctttaaaatga

SEQ ID NO: 240330 - DNA, 17 bp, Homo sapiens
tatgtgaaagtgtaaaa

SEQ ID NO: 240331 - DNA, 22 bp, Homo sapiens
tatgtgaatgatctctctgaat

SEQ ID NO: 240332 - DNA, 19 bp, Homo sapiens
tatgtgacaattttgtaca

SEQ ID NO: 240333 - DNA, 18 bp, Homo sapiens
tatgtgagcatgaaacta

SEQ ID NO: 240334 - DNA, 20 bp, Homo sapiens
tatgtgatatctgaacacat

SEQ ID NO: 240335 - DNA, 20 bp, Homo sapiens
tatgtgcaaggtgataggaa

SEQ ID NO: 240336 - DNA, 22 bp, Homo sapiens
tatgtgcactgtcactttgctc

SEQ ID NO: 240337 - DNA, 17 bp, Homo sapiens
tatgtgccataaacaga

SEQ ID NO: 240338 - DNA, 15 bp, Homo sapiens
tatgtgcctttttgt

SEQ ID NO: 240339 - DNA, 20 bp, Homo sapiens
tatgtggagttcatcttgaa

SEQ ID NO: 240340 - DNA, 18 bp, Homo sapiens
tatgtggatacagtcatt

SEQ ID NO: 240341 - DNA, 11 bp, Homo sapiens
tatgtggcagc

SEQ ID NO: 240342 - DNA, 14 bp, Homo sapiens
tatgtggcagctgg

SEQ ID NO: 240343 - DNA, 21 bp, Homo sapiens
tatgtgtgaggagctgctggc

SEQ ID NO: 240344 - DNA, 21 bp, Homo sapiens
tatgtgtgtttaaataaagta

SEQ ID NO: 240345 - DNA, 14 bp, Homo sapiens
tatgttaagctctt

SEQ ID NO: 240346 - DNA, 15 bp, Homo sapiens
tatgttacttaaaca

SEQ ID NO: 240347 - DNA, 23 bp, Homo sapiens
tatgttctcccctacattagtaa

SEQ ID NO: 240348 - DNA, 18 bp, Homo sapiens
tatgttgacctaagattt

SEQ ID NO: 240349 - DNA, 13 bp, Homo sapiens
tatgttgctgaaa

SEQ ID NO: 240350 - DNA, 15 bp, Homo sapiens
tatgttgctgaaaca

SEQ ID NO: 240351 - DNA, 15 bp, Homo sapiens
tatgtttacctcact

SEQ ID NO: 240352 - DNA, 18 bp, Homo sapiens
tatgtttggctgaaatta

SEQ ID NO: 240353 - DNA, 13 bp, Homo sapiens
tatgtttgtacac

SEQ ID NO: 240354 - DNA, 16 bp, Homo sapiens
tatgttttagcatgtg

SEQ ID NO: 240355 - DNA, 18 bp, Homo sapiens
tatgttttagcatgtgtt

SEQ ID NO: 240356 - DNA, 19 bp, Homo sapiens
tatgttttggagagagcaa

SEQ ID NO: 240357 - DNA, 22 bp, Homo sapiens
tattaaaaatataaacaatgtt

SEQ ID NO: 240358 - DNA, 22 bp, Homo sapiens
tattaaaaatatggaacttcta

SEQ ID NO: 240359 - DNA, 17 bp, Homo sapiens
tattaaaagaaagggtt

SEQ ID NO: 240360 - DNA, 17 bp, Homo sapiens
tattaaaatgattgtaa

SEQ ID NO: 240361 - DNA, 18 bp, Homo sapiens
tattaaacttgtcagaat

SEQ ID NO: 240362 - DNA, 12 bp, Homo sapiens
tattaaagacag

SEQ ID NO: 240363 - DNA, 13 bp, Homo sapiens
tattaaagggggg

SEQ ID NO: 240364 - DNA, 20 bp, Homo sapiens
tattaaatcagttttgtgta

SEQ ID NO: 240365 - DNA, 16 bp, Homo sapiens
tattaacctacctgtg

SEQ ID NO: 240366 - DNA, 15 bp, Homo sapiens
tattaactacattta

SEQ ID NO: 240367 - DNA, 18 bp, Homo sapiens
tattaactacatttatga

SEQ ID NO: 240368 - DNA, 20 bp, Homo sapiens
tattaactctgcatagacaa

SEQ ID NO: 240369 - DNA, 23 bp, Homo sapiens
tattaactctgcatagacaaagg

SEQ ID NO: 240370 - DNA, 14 bp, Homo sapiens
tattaagcagtaaa

SEQ ID NO: 240371 - DNA, 20 bp, Homo sapiens
tattaagcagtaaaaactgt

SEQ ID NO: 240372 - DNA, 22 bp, Homo sapiens
tattaagtctgggatgtagaac

SEQ ID NO: 240373 - DNA, 13 bp, Homo sapiens
tattaatattatt

SEQ ID NO: 240374 - DNA, 17 bp, Homo sapiens
tattaatgaactgtgac

SEQ ID NO: 240375 - DNA, 14 bp, Homo sapiens
tattaatgctaagg

SEQ ID NO: 240376 - DNA, 12 bp, Homo sapiens
tattaatggcat

SEQ ID NO: 240377 - DNA, 17 bp, Homo sapiens
tattaatggcatgtaat

SEQ ID NO: 240378 - DNA, 20 bp, Homo sapiens
tattaattataccagtgtta

SEQ ID NO: 240379 - DNA, 19 bp, Homo sapiens
tattaatttatatttgtct

SEQ ID NO: 240380 - DNA, 18 bp, Homo sapiens
tattacaaattttcactg

SEQ ID NO: 240381 - DNA, 22 bp, Homo sapiens
tattacaaattttcactgctgc

SEQ ID NO: 240382 - DNA, 17 bp, Homo sapiens
tattacactgtatttgt

SEQ ID NO: 240383 - DNA, 13 bp, Homo sapiens
tattacataaata

SEQ ID NO: 240384 - DNA, 16 bp, Homo sapiens
tattacatctaatgct

SEQ ID NO: 240385 - DNA, 23 bp, Homo sapiens
tattacatctttattaacctcag

SEQ ID NO: 240386 - DNA, 13 bp, Homo sapiens
tattaccagcaag

SEQ ID NO: 240387 - DNA, 16 bp, Homo sapiens
tattaccatcttaatc

SEQ ID NO: 240388 - DNA, 19 bp, Homo sapiens
tcaagctaataaaatatca

SEQ ID NO: 240389 - DNA, 22 bp, Homo sapiens
tcaagctaataaaatatcattc

SEQ ID NO: 240390 - DNA, 18 bp, Homo sapiens
tcaagctccatcttattt

SEQ ID NO: 240391 - DNA, 18 bp, Homo sapiens
tcaagctgtcccctctgt

SEQ ID NO: 240392 - DNA, 17 bp, Homo sapiens
tcaagcttgtgtacttg

SEQ ID NO: 240393 - DNA, 13 bp, Homo sapiens
tcaagcttttcct

SEQ ID NO: 240394 - DNA, 17 bp, Homo sapiens
tcaagcttttcctttct

SEQ ID NO: 240395 - DNA, 18 bp, Homo sapiens
tcaagcttttcctttctt

SEQ ID NO: 240396 - DNA, 22 bp, Homo sapiens
tcaagcttttcctttctttttt

SEQ ID NO: 240397 - DNA, 23 bp, Homo sapiens
tcaaggaagtgataacactggag

SEQ ID NO: 240398 - DNA, 15 bp, Homo sapiens
tcaaggagtgaagta

SEQ ID NO: 240399 - DNA, 16 bp, Homo sapiens
tcaaggagtgaagtaa

SEQ ID NO: 240400 - DNA, 17 bp, Homo sapiens
tcaaggagtgaagtaat

SEQ ID NO: 240401 - DNA, 19 bp, Homo sapiens
tcaaggagtgaagtaattg

SEQ ID NO: 240402 - DNA, 15 bp, Homo sapiens
tcaaggcaaaaatat

SEQ ID NO: 240403 - DNA, 22 bp, Homo sapiens
tcaaggcaaaaatatcaggagc

SEQ ID NO: 240404 - DNA, 10 bp, Homo sapiens
tcaaggccaa

SEQ ID NO: 240405 - DNA, 21 bp, Homo sapiens
tcaaggccgtgtccccttgtt

SEQ ID NO: 240406 - DNA, 13 bp, Homo sapiens
tcaaggctgcagt

SEQ ID NO: 240407 - DNA, 22 bp, Homo sapiens
tcaaggctgcctggagaaagga

SEQ ID NO: 240408 - DNA, 22 bp, Homo sapiens
tcaagggactgggggtgccaac

SEQ ID NO: 240409 - DNA, 19 bp, Homo sapiens
tcaagggggctgctctgca

SEQ ID NO: 240410 - DNA, 21 bp, Homo sapiens
tcaaggtcgtttttttcattc

SEQ ID NO: 240411 - DNA, 22 bp, Homo sapiens
tcaagtaagaagacatgaacca

SEQ ID NO: 240412 - DNA, 19 bp, Homo sapiens
tcaagtaatccacctgcct

SEQ ID NO: 240413 - DNA, 13 bp, Homo sapiens
tcaagtatataaa

SEQ ID NO: 240414 - DNA, 15 bp, Homo sapiens
tcaagtatccttgtt

SEQ ID NO: 240415 - DNA, 21 bp, Homo sapiens
tcaagtcccgaggcagcaaca

SEQ ID NO: 240416 - DNA, 16 bp, Homo sapiens
tcaagtctctgctggc

SEQ ID NO: 240417 - DNA, 17 bp, Homo sapiens
tcaagtctctgctggcc

SEQ ID NO: 240418 - DNA, 11 bp, Homo sapiens
tcaagtctgtg

SEQ ID NO: 240419 - DNA, 20 bp, Homo sapiens
tcaagtctgtgcctggagct

SEQ ID NO: 240420 - DNA, 13 bp, Homo sapiens
tcaagtgagtggc

SEQ ID NO: 240421 - DNA, 18 bp, Homo sapiens
tcaagtgattctcctgcc

SEQ ID NO: 240422 - DNA, 16 bp, Homo sapiens
tcaagtggaaaccttg

SEQ ID NO: 240423 - DNA, 21 bp, Homo sapiens
tcaagtgtctcagtccacctg

SEQ ID NO: 240424 - DNA, 22 bp, Homo sapiens
tcaagtgtgcctgctatccagc

SEQ ID NO: 240425 - DNA, 18 bp, Homo sapiens
tcaagttccgtctcctct

SEQ ID NO: 240426 - DNA, 17 bp, Homo sapiens
tcaagttgtgcttgttt

SEQ ID NO: 240427 - DNA, 22 bp, Homo sapiens
tcaagttgtgcttgtttacagc

SEQ ID NO: 240428 - DNA, 15 bp, Homo sapiens
tcaataaaatgtgat

SEQ ID NO: 240429 - DNA, 16 bp, Homo sapiens
tcaataaaatgtgatt

SEQ ID NO: 240430 - DNA, 23 bp, Homo sapiens
tcaataaaatgtgatttttctga

SEQ ID NO: 240431 - DNA, 14 bp, Homo sapiens
tcaataaacagctt

SEQ ID NO: 240432 - DNA, 19 bp, Homo sapiens
tcaataaagaaaaaaatag

SEQ ID NO: 240433 - DNA, 17 bp, Homo sapiens
tcaataaagcactattg

SEQ ID NO: 240434 - DNA, 20 bp, Homo sapiens
tcaataaagcactattgttt

SEQ ID NO: 240435 - DNA, 14 bp, Homo sapiens
tcaataaaggtcat

SEQ ID NO: 240436 - DNA, 21 bp, Homo sapiens
tcaataccccaagtccacctg

SEQ ID NO: 240437 - DNA, 22 bp, Homo sapiens
tcaatacttgaatatggaacat

SEQ ID NO: 240438 - DNA, 15 bp, Homo sapiens
tcaatacttttgtgt

SEQ ID NO: 240439 - DNA, 15 bp, Homo sapiens
tcaatagtattaact

SEQ ID NO: 240440 - DNA, 16 bp, Homo sapiens
tcaatagtattaacta

SEQ ID NO: 240441 - DNA, 15 bp, Homo sapiens
tcaatatataataaa

SEQ ID NO: 240442 - DNA, 15 bp, Homo sapiens
tcaatattcaataaa

SEQ ID NO: 240443 - DNA, 17 bp, Homo sapiens
tcaatattcaataaagc

SEQ ID NO: 240444 - DNA, 14 bp, Homo sapiens
tcaatattcctgaa

SEQ ID NO: 240445 - DNA, 21 bp, Homo sapiens
tcaatattcctgaatgaaata

SEQ ID NO: 240446 - DNA, 14 bp, Homo sapiens
tcaatatttaagag

SEQ ID NO: 240447 - DNA, 15 bp, Homo sapiens
tcaatcactgctccc

SEQ ID NO: 240448 - DNA, 15 bp, Homo sapiens
tcaatcatctgtgtg

SEQ ID NO: 240449 - DNA, 15 bp, Homo sapiens
tcaatcatttctcac

SEQ ID NO: 240450 - DNA, 21 bp, Homo sapiens
tcaatcattttgggaaattct

SEQ ID NO: 240451 - DNA, 18 bp, Homo sapiens
tcaatccacagtattgtt

SEQ ID NO: 240452 - DNA, 13 bp, Homo sapiens
tcaatcctgtcaa

SEQ ID NO: 240453 - DNA, 18 bp, Homo sapiens
tcaatctcccgctgctgc

SEQ ID NO: 240454 - DNA, 11 bp, Homo sapiens
tcaatctctgt

SEQ ID NO: 240455 - DNA, 16 bp, Homo sapiens
tcaatctctgttctgc

SEQ ID NO: 240456 - DNA, 22 bp, Homo sapiens
tcaatctggcttctgcattact

SEQ ID NO: 240457 - DNA, 16 bp, Homo sapiens
tcaatgaaaccttcct

SEQ ID NO: 240458 - DNA, 17 bp, Homo sapiens
tcaatgaaatatttgct

SEQ ID NO: 240459 - DNA, 18 bp, Homo sapiens
tcaatgaaatatttgctt

SEQ ID NO: 240460 - DNA, 19 bp, Homo sapiens
tcaatgaaatatttgctta

SEQ ID NO: 240461 - DNA, 15 bp, Homo sapiens
tcaatgaatattgaa

SEQ ID NO: 240462 - DNA, 11 bp, Homo sapiens
tcaatgatcta

SEQ ID NO: 240463 - DNA, 19 bp, Homo sapiens
tcaatgatctaggtttaac

SEQ ID NO: 240464 - DNA, 21 bp, Homo sapiens
tcaatgatctaggtttaactc

SEQ ID NO: 240465 - DNA, 14 bp, Homo sapiens
tcaatgccctgcca

SEQ ID NO: 240466 - DNA, 16 bp, Homo sapiens
tcaatgccctgccatt

SEQ ID NO: 240467 - DNA, 15 bp, Homo sapiens
tcaatgctacaaaat

SEQ ID NO: 240468 - DNA, 20 bp, Homo sapiens
tcaatgctatggactgcaca

SEQ ID NO: 240469 - DNA, 12 bp, Homo sapiens
tcaatggctttt

SEQ ID NO: 240470 - DNA, 20 bp, Homo sapiens
tcaatgggagtgaacatttc

SEQ ID NO: 240471 - DNA, 21 bp, Homo sapiens
tcaatgggagtgaacatttct

SEQ ID NO: 240472 - DNA, 18 bp, Homo sapiens
tcaatgtgattctaatgt

SEQ ID NO: 240473 - DNA, 22 bp, Homo sapiens
tcaatgtgattctaatgtcttc

SEQ ID NO: 240474 - DNA, 19 bp, Homo sapiens
tcaatgtgctgttgattct

SEQ ID NO: 240475 - DNA, 20 bp, Homo sapiens
tcaatgtgctgttgattctt

SEQ ID NO: 240476 - DNA, 12 bp, Homo sapiens
tcaatgttcatt

SEQ ID NO: 240477 - DNA, 13 bp, Homo sapiens
tcaatgttcattg

SEQ ID NO: 240478 - DNA, 16 bp, Homo sapiens
tcaattaaatgtaggt

SEQ ID NO: 240479 - DNA, 13 bp, Homo sapiens
tcaattaattctt

SEQ ID NO: 240480 - DNA, 19 bp, Homo sapiens
tcaattacaggaagtactg

SEQ ID NO: 240481 - DNA, 20 bp, Homo sapiens
tcaattacaggaagtactgg

SEQ ID NO: 240482 - DNA, 21 bp, Homo sapiens
tcaattacaggaagtactgga

SEQ ID NO: 240483 - DNA, 22 bp, Homo sapiens
tcaattattacatttatacatc

SEQ ID NO: 240484 - DNA, 21 bp, Homo sapiens
tcaattccatttaaaaaacaa

SEQ ID NO: 240485 - DNA, 20 bp, Homo sapiens
tcaattctgatacagcctta

SEQ ID NO: 240486 - DNA, 18 bp, Homo sapiens
tcaattgcagatgccaaa

SEQ ID NO: 240487 - DNA, 17 bp, Homo sapiens
tcaatttactttttaaa

SEQ ID NO: 240488 - DNA, 23 bp, Homo sapiens
tcaatttactttttaaacagtgt

SEQ ID NO: 240489 - DNA, 16 bp, Homo sapiens
tcaatttctcacaata

SEQ ID NO: 240490 - DNA, 14 bp, Homo sapiens
tcacaaaagctgtg

SEQ ID NO: 240491 - DNA, 21 bp, Homo sapiens
tcacaaaagctgtgtctctgt

SEQ ID NO: 240492 - DNA, 16 bp, Homo sapiens
tcacaactcagcattg

SEQ ID NO: 240493 - DNA, 20 bp, Homo sapiens
tcacaagctgcctccctgtc

SEQ ID NO: 240494 - DNA, 18 bp, Homo sapiens
tcacaagtcctgccaagt

SEQ ID NO: 240495 - DNA, 18 bp, Homo sapiens
tcacaataaatgtattca

SEQ ID NO: 240496 - DNA, 17 bp, Homo sapiens
tcacaatataaagttct

SEQ ID NO: 240497 - DNA, 20 bp, Homo sapiens
tcacaatgttggcctgtcag

SEQ ID NO: 240498 - DNA, 12 bp, Homo sapiens
tcacacacagcc

SEQ ID NO: 240499 - DNA, 20 bp, Homo sapiens
tcacacacagcctggcctcc

SEQ ID NO: 240500 - DNA, 14 bp, Homo sapiens
tcacacacatggaa

SEQ ID NO: 240501 - DNA, 15 bp, Homo sapiens
tcacacagctggggc

SEQ ID NO: 240502 - DNA, 22 bp, Homo sapiens
tcacacatccagacatcatgaa

SEQ ID NO: 240503 - DNA, 15 bp, Homo sapiens
tcacaccactgtact

SEQ ID NO: 240504 - DNA, 22 bp, Homo sapiens
tcatctgaggagtccaaaatat

SEQ ID NO: 240505 - DNA, 12 bp, Homo sapiens
tcatctgggcca

SEQ ID NO: 240506 - DNA, 12 bp, Homo sapiens
tcatctgtcagc

SEQ ID NO: 240507 - DNA, 17 bp, Homo sapiens
tcatctgtgtgaaaatg

SEQ ID NO: 240508 - DNA, 17 bp, Homo sapiens
tcatctgtttttctttt

SEQ ID NO: 240509 - DNA, 21 bp, Homo sapiens
tcatcttcactgcaattttgt

SEQ ID NO: 240510 - DNA, 18 bp, Homo sapiens
tcatcttgaagggcccag

SEQ ID NO: 240511 - DNA, 17 bp, Homo sapiens
tcatctttcctttgctc

SEQ ID NO: 240512 - DNA, 23 bp, Homo sapiens
tcatctttcctttgctctggata

SEQ ID NO: 240513 - DNA, 17 bp, Homo sapiens
tcatcttttagagtaaa

SEQ ID NO: 240514 - DNA, 11 bp, Homo sapiens
tcatgaaaagt

SEQ ID NO: 240515 - DNA, 13 bp, Homo sapiens
tcatgaaaagtgc

SEQ ID NO: 240516 - DNA, 22 bp, Homo sapiens
tcatgaaaatcctaccaacctc

SEQ ID NO: 240517 - DNA, 14 bp, Homo sapiens
tcatgaaatatgca

SEQ ID NO: 240518 - DNA, 15 bp, Homo sapiens
tcatgaaatatgcat

SEQ ID NO: 240519 - DNA, 18 bp, Homo sapiens
tcatgaacaaaatgaagt

SEQ ID NO: 240520 - DNA, 21 bp, Homo sapiens
tcatgaacaaaatgaagttaa

SEQ ID NO: 240521 - DNA, 15 bp, Homo sapiens
tcatgaagccttgct

SEQ ID NO: 240522 - DNA, 21 bp, Homo sapiens
tcatgaattcatactctgttg

SEQ ID NO: 240523 - DNA, 22 bp, Homo sapiens
tcatgaattcatactctgttgc

SEQ ID NO: 240524 - DNA, 16 bp, Homo sapiens
tcatgacaagcatttt

SEQ ID NO: 240525 - DNA, 14 bp, Homo sapiens
tcatgacatgttat

SEQ ID NO: 240526 - DNA, 17 bp, Homo sapiens
tcatgacatgttatata

SEQ ID NO: 240527 - DNA, 21 bp, Homo sapiens
tcatgacatgttatatatttt

SEQ ID NO: 240528 - DNA, 18 bp, Homo sapiens
tcatgacatttctcaaag

SEQ ID NO: 240529 - DNA, 13 bp, Homo sapiens
tcatgaccactgg

SEQ ID NO: 240530 - DNA, 23 bp, Homo sapiens
tcatgatccacccacctcagcct

SEQ ID NO: 240531 - DNA, 16 bp, Homo sapiens
tcatgatggagacttc

SEQ ID NO: 240532 - DNA, 15 bp, Homo sapiens
tcatgatgtctgcaa

SEQ ID NO: 240533 - DNA, 19 bp, Homo sapiens
tcatgattagacaatgtgg

SEQ ID NO: 240534 - DNA, 13 bp, Homo sapiens
tcatgattagcaa

SEQ ID NO: 240535 - DNA, 16 bp, Homo sapiens
tcatgattagcaagtt

SEQ ID NO: 240536 - DNA, 23 bp, Homo sapiens
tcatgatttcatttcaactgttt

SEQ ID NO: 240537 - DNA, 18 bp, Homo sapiens
tcatgcactcacaaagat

SEQ ID NO: 240538 - DNA, 17 bp, Homo sapiens
tcatgcactgcaaatac

SEQ ID NO: 240539 - DNA, 15 bp, Homo sapiens
tcatgcattgtaatc

SEQ ID NO: 240540 - DNA, 12 bp, Homo sapiens
tcatgcattgtt

SEQ ID NO: 240541 - DNA, 15 bp, Homo sapiens
tcatgccagcagcac

SEQ ID NO: 240542 - DNA, 17 bp, Homo sapiens
tcatgccagcagcacgt

SEQ ID NO: 240543 - DNA, 22 bp, Homo sapiens
tcatgcctggcccccctccagg

SEQ ID NO: 240544 - DNA, 15 bp, Homo sapiens
tcatgcggcccagcc

SEQ ID NO: 240545 - DNA, 19 bp, Homo sapiens
tcatgcggcccagccatgg

SEQ ID NO: 240546 - DNA, 15 bp, Homo sapiens
tcatgcttactattt

SEQ ID NO: 240547 - DNA, 20 bp, Homo sapiens
tcatggattcattacagctt

SEQ ID NO: 240548 - DNA, 19 bp, Homo sapiens
tcatggcgtaatgggcctg

SEQ ID NO: 240549 - DNA, 13 bp, Homo sapiens
tcatggctcaagg

SEQ ID NO: 240550 - DNA, 19 bp, Homo sapiens
tcatggctgttatctgtct

SEQ ID NO: 240551 - DNA, 12 bp, Homo sapiens
tcatggctttgt

SEQ ID NO: 240552 - DNA, 19 bp, Homo sapiens
tcatgggaacgcagcctcc

SEQ ID NO: 240553 - DNA, 13 bp, Homo sapiens
tcatgggaagaac

SEQ ID NO: 240554 - DNA, 18 bp, Homo sapiens
tcatgggagtcagggagc

SEQ ID NO: 240555 - DNA, 19 bp, Homo sapiens
tcatgggagtcagggagcc

SEQ ID NO: 240556 - DNA, 22 bp, Homo sapiens
tcatgggagtcagggagccctg

SEQ ID NO: 240557 - DNA, 13 bp, Homo sapiens
tcatggtctcagt

SEQ ID NO: 240558 - DNA, 16 bp, Homo sapiens
tcatggtgatgcaagt

SEQ ID NO: 240559 - DNA, 14 bp, Homo sapiens
tcatgtaaataaat

SEQ ID NO: 240560 - DNA, 22 bp, Homo sapiens
tcatgtaagaatccaaagtgga

SEQ ID NO: 240561 - DNA, 18 bp, Homo sapiens
tcatgtaccatcaataaa

SEQ ID NO: 240562 - DNA, 22 bp, Homo sapiens
tcatgtcaaagtgaaagacatt

SEQ ID NO: 240563 - DNA, 16 bp, Homo sapiens
tcatgtcaacttctgg

SEQ ID NO: 240564 - DNA, 21 bp, Homo sapiens
tcatgtcaacttctggctcct

SEQ ID NO: 240565 - DNA, 14 bp, Homo sapiens
tcatgtcatttctc

SEQ ID NO: 240566 - DNA, 13 bp, Homo sapiens
tcatgtgctttgt

SEQ ID NO: 240567 - DNA, 17 bp, Homo sapiens
tcatgtgggtgagccag

SEQ ID NO: 240568 - DNA, 10 bp, Homo sapiens
tcatgtgtat

SEQ ID NO: 240569 - DNA, 15 bp, Homo sapiens
tcatgtgtataaaaa

SEQ ID NO: 240570 - DNA, 21 bp, Homo sapiens
tcatgttaatcctagctgtgt

SEQ ID NO: 240571 - DNA, 22 bp, Homo sapiens
tcatgttcctaaaaatctgtgg

SEQ ID NO: 240572 - DNA, 16 bp, Homo sapiens
tcatgttctcatgttt

SEQ ID NO: 240573 - DNA, 21 bp, Homo sapiens
tcatgttctgagctataacat

SEQ ID NO: 240574 - DNA, 13 bp, Homo sapiens
tcatgtttgtaaa

SEQ ID NO: 240575 - DNA, 15 bp, Homo sapiens
tcatgtttgtgcatg

SEQ ID NO: 240576 - DNA, 16 bp, Homo sapiens
tcatgttttgatgaga

SEQ ID NO: 240577 - DNA, 13 bp, Homo sapiens
tcatgttttgcta

SEQ ID NO: 240578 - DNA, 15 bp, Homo sapiens
tcatgttttgctaat

SEQ ID NO: 240579 - DNA, 17 bp, Homo sapiens
tcatgttttgtgactat

SEQ ID NO: 240580 - DNA, 15 bp, Homo sapiens
tcattaaaagtttta

SEQ ID NO: 240581 - DNA, 21 bp, Homo sapiens
tcattaaaatagattatccca

SEQ ID NO: 240582 - DNA, 14 bp, Homo sapiens
tcattaaacaaaca

SEQ ID NO: 240583 - DNA, 21 bp, Homo sapiens
tcattaaacatgaatttaatg

SEQ ID NO: 240584 - DNA, 14 bp, Homo sapiens
tcattaaacgtcat

SEQ ID NO: 240585 - DNA, 12 bp, Homo sapiens
tcattaaatact

SEQ ID NO: 240586 - DNA, 22 bp, Homo sapiens
tcattaaatggtgatttcttgc

SEQ ID NO: 240587 - DNA, 23 bp, Homo sapiens
tcattaaatggtgatttcttgct

SEQ ID NO: 240588 - DNA, 13 bp, Homo sapiens
tcattaaatgttt

SEQ ID NO: 240589 - DNA, 22 bp, Homo sapiens
tcattaaccttatcataaattc

SEQ ID NO: 240590 - DNA, 13 bp, Homo sapiens
tcattacttgatt

SEQ ID NO: 240591 - DNA, 23 bp, Homo sapiens
tcattataaacgtgatgatcagc

SEQ ID NO: 240592 - DNA, 14 bp, Homo sapiens
tcattatagcatgt

SEQ ID NO: 240593 - DNA, 18 bp, Homo sapiens
tcattatgtagaaatatt

SEQ ID NO: 240594 - DNA, 19 bp, Homo sapiens
tcattattggaattaacct

SEQ ID NO: 240595 - DNA, 14 bp, Homo sapiens
tcattatttattaa

SEQ ID NO: 240596 - DNA, 17 bp, Homo sapiens
tcattatttttccactt

SEQ ID NO: 240597 - DNA, 11 bp, Homo sapiens
tcattcaaaac

SEQ ID NO: 240598 - DNA, 15 bp, Homo sapiens
tcattcaaaactttc

SEQ ID NO: 240599 - DNA, 18 bp, Homo sapiens
tcattcaagcctgtgaat

SEQ ID NO: 240600 - DNA, 15 bp, Homo sapiens
tcattcaatatctga

SEQ ID NO: 240601 - DNA, 17 bp, Homo sapiens
tcattcaatatctgaca

SEQ ID NO: 240602 - DNA, 10 bp, Homo sapiens
tcattcagca

SEQ ID NO: 240603 - DNA, 16 bp, Homo sapiens
tcattcaggtgttctc

SEQ ID NO: 240604 - DNA, 19 bp, Homo sapiens
tcattcaggtgttctcttc

SEQ ID NO: 240605 - DNA, 13 bp, Homo sapiens
tcattcattttgt

SEQ ID NO: 240606 - DNA, 16 bp, Homo sapiens
tcattccatgtgccca

SEQ ID NO: 240607 - DNA, 17 bp, Homo sapiens
tcattccatgtgcccag

SEQ ID NO: 240608 - DNA, 18 bp, Homo sapiens
tcattccatgtgcccagt

SEQ ID NO: 240609 - DNA, 18 bp, Homo sapiens
tcattcctaacacagcat

SEQ ID NO: 240610 - DNA, 23 bp, Homo sapiens
tcattcctcccaccccaagcaaa

SEQ ID NO: 240611 - DNA, 14 bp, Homo sapiens
tcattcctgaaaga

SEQ ID NO: 240612 - DNA, 20 bp, Homo sapiens
tcattcctgaaagaaacagt

SEQ ID NO: 240613 - DNA, 22 bp, Homo sapiens
tcattcctgaaagaaacagtta

SEQ ID NO: 240614 - DNA, 16 bp, Homo sapiens
tcattctgtgatcatt

SEQ ID NO: 240615 - DNA, 21 bp, Homo sapiens
tcattcttacaattgcactgc

SEQ ID NO: 240616 - DNA, 17 bp, Homo sapiens
tcacgagatcttccttc

SEQ ID NO: 240617 - DNA, 19 bp, Homo sapiens
tcacgagatcttccttccg

SEQ ID NO: 240618 - DNA, 13 bp, Homo sapiens
tcacgagccttgc

SEQ ID NO: 240619 - DNA, 20 bp, Homo sapiens
tcacgattcttaccctttct

SEQ ID NO: 240620 - DNA, 12 bp, Homo sapiens
tcacgctctcca

SEQ ID NO: 240621 - DNA, 15 bp, Homo sapiens
tcacgctctggacat

SEQ ID NO: 240622 - DNA, 15 bp, Homo sapiens
tcacgctggcttcca

SEQ ID NO: 240623 - DNA, 17 bp, Homo sapiens
tcacgctggcttccagc

SEQ ID NO: 240624 - DNA, 12 bp, Homo sapiens
tcacgctttcat

SEQ ID NO: 240625 - DNA, 12 bp, Homo sapiens
tcacggacagga

SEQ ID NO: 240626 - DNA, 14 bp, Homo sapiens
tcacggacaggaag

SEQ ID NO: 240627 - DNA, 17 bp, Homo sapiens
tcacggacaggaagcac

SEQ ID NO: 240628 - DNA, 18 bp, Homo sapiens
tcacggactctttgctgt

SEQ ID NO: 240629 - DNA, 17 bp, Homo sapiens
tcacggggcctccaacc

SEQ ID NO: 240630 - DNA, 23 bp, Homo sapiens
tcacggggttggctgttccagac

SEQ ID NO: 240631 - DNA, 15 bp, Homo sapiens
tcactaaatttctca

SEQ ID NO: 240632 - DNA, 17 bp, Homo sapiens
tcactaataaagtctgt

SEQ ID NO: 240633 - DNA, 20 bp, Homo sapiens
tcactaccctcctgtaaaat

SEQ ID NO: 240634 - DNA, 22 bp, Homo sapiens
tcactaccctcctgtaaaatac

SEQ ID NO: 240635 - DNA, 16 bp, Homo sapiens
tcactactggtctgta

SEQ ID NO: 240636 - DNA, 15 bp, Homo sapiens
tcactagctttgcct

SEQ ID NO: 240637 - DNA, 14 bp, Homo sapiens
tcactatccatgca

SEQ ID NO: 240638 - DNA, 13 bp, Homo sapiens
tcactatgtttct

SEQ ID NO: 240639 - DNA, 15 bp, Homo sapiens
tcactatgtttctca

SEQ ID NO: 240640 - DNA, 20 bp, Homo sapiens
tcactatttttatttatatt

SEQ ID NO: 240641 - DNA, 21 bp, Homo sapiens
tcactcaaccataacacttga

SEQ ID NO: 240642 - DNA, 23 bp, Homo sapiens
tcactcagaattattcatagctg

SEQ ID NO: 240643 - DNA, 21 bp, Homo sapiens
tcactcatactgtcatataat

SEQ ID NO: 240644 - DNA, 22 bp, Homo sapiens
tcactcatactgtcatataatg

SEQ ID NO: 240645 - DNA, 12 bp, Homo sapiens
tcactccactcc

SEQ ID NO: 240646 - DNA, 17 bp, Homo sapiens
tcactccactcccctca

SEQ ID NO: 240647 - DNA, 20 bp, Homo sapiens
tcactccactcccctcatcc

SEQ ID NO: 240648 - DNA, 21 bp, Homo sapiens
tcactccaggaaggggctgga

SEQ ID NO: 240649 - DNA, 16 bp, Homo sapiens
tcactccattctcagc

SEQ ID NO: 240650 - DNA, 16 bp, Homo sapiens
tcactcccctcctttc

SEQ ID NO: 240651 - DNA, 12 bp, Homo sapiens
tcactccctgga

SEQ ID NO: 240652 - DNA, 22 bp, Homo sapiens
tcactcctaggagagccaacct

SEQ ID NO: 240653 - DNA, 10 bp, Homo sapiens
tcactcctgt

SEQ ID NO: 240654 - DNA, 19 bp, Homo sapiens
tcactctacttagcatgtc

SEQ ID NO: 240655 - DNA, 15 bp, Homo sapiens
tcactctctgaagat

SEQ ID NO: 240656 - DNA, 16 bp, Homo sapiens
tcactctgacagtatt

SEQ ID NO: 240657 - DNA, 18 bp, Homo sapiens
tcactctgaccttcacag

SEQ ID NO: 240658 - DNA, 12 bp, Homo sapiens
tcactctgcctc

SEQ ID NO: 240659 - DNA, 13 bp, Homo sapiens
tcactctgcctct

SEQ ID NO: 240660 - DNA, 14 bp, Homo sapiens
tcactctgcctcta

SEQ ID NO: 240661 - DNA, 17 bp, Homo sapiens
tcactcttatgaaatgg

SEQ ID NO: 240662 - DNA, 13 bp, Homo sapiens
tcactcttcctca

SEQ ID NO: 240663 - DNA, 20 bp, Homo sapiens
tcactcttcctcatcctgct

SEQ ID NO: 240664 - DNA, 23 bp, Homo sapiens
tcactgaaacttcaagcaccagg

SEQ ID NO: 240665 - DNA, 16 bp, Homo sapiens
tcactgaagtgaatac

SEQ ID NO: 240666 - DNA, 21 bp, Homo sapiens
tcactgaagtgaatacatggt

SEQ ID NO: 240667 - DNA, 23 bp, Homo sapiens
tcactgaataatggaattatgta

SEQ ID NO: 240668 - DNA, 20 bp, Homo sapiens
tcactgaatatcatatgtat

SEQ ID NO: 240669 - DNA, 13 bp, Homo sapiens
tcactgagctgtg

SEQ ID NO: 240670 - DNA, 20 bp, Homo sapiens
tcactgcacagtgcatctca

SEQ ID NO: 240671 - DNA, 14 bp, Homo sapiens
tcactgcagcctcg

SEQ ID NO: 240672 - DNA, 11 bp, Homo sapiens
tcactgccatg

SEQ ID NO: 240673 - DNA, 12 bp, Homo sapiens
tcactgccatga

SEQ ID NO: 240674 - DNA, 13 bp, Homo sapiens
tcactgccatgat

SEQ ID NO: 240675 - DNA, 16 bp, Homo sapiens
tcactgccatgatagc

SEQ ID NO: 240676 - DNA, 20 bp, Homo sapiens
tcactgccatgatagctggg

SEQ ID NO: 240677 - DNA, 11 bp, Homo sapiens
tcactgctgct

SEQ ID NO: 240678 - DNA, 12 bp, Homo sapiens
tcactgctggct

SEQ ID NO: 240679 - DNA, 13 bp, Homo sapiens
tcactgctggctg

SEQ ID NO: 240680 - DNA, 16 bp, Homo sapiens
tcactgctggctgcct

SEQ ID NO: 240681 - DNA, 17 bp, Homo sapiens
tcactgctggctgcctt

SEQ ID NO: 240682 - DNA, 17 bp, Homo sapiens
tcactgctgtccctcct

SEQ ID NO: 240683 - DNA, 18 bp, Homo sapiens
tcactgctgtccctcctg

SEQ ID NO: 240684 - DNA, 14 bp, Homo sapiens
tcactggatgaaga

SEQ ID NO: 240685 - DNA, 22 bp, Homo sapiens
tcactggggatcccgtgctgga

SEQ ID NO: 240686 - DNA, 14 bp, Homo sapiens
tcactggtgcattt

SEQ ID NO: 240687 - DNA, 22 bp, Homo sapiens
tcactggtgcatttaaaatgga

SEQ ID NO: 240688 - DNA, 14 bp, Homo sapiens
tcactgtctgttgt

SEQ ID NO: 240689 - DNA, 17 bp, Homo sapiens
tcactgttccctctgct

SEQ ID NO: 240690 - DNA, 19 bp, Homo sapiens
tcactgttccctctgctcc

SEQ ID NO: 240691 - DNA, 20 bp, Homo sapiens
tcactgttccctctgctcct

SEQ ID NO: 240692 - DNA, 22 bp, Homo sapiens
tcactgttccctctgctcctgg

SEQ ID NO: 240693 - DNA, 17 bp, Homo sapiens
tcacttaaactttgtca

SEQ ID NO: 240694 - DNA, 16 bp, Homo sapiens
tcacttaacctgcttt

SEQ ID NO: 240695 - DNA, 15 bp, Homo sapiens
tcacttaagcccagg

SEQ ID NO: 240696 - DNA, 22 bp, Homo sapiens
tcacttaaggggggatgtcttg

SEQ ID NO: 240697 - DNA, 20 bp, Homo sapiens
tcacttataccaaagggaaa

SEQ ID NO: 240698 - DNA, 11 bp, Homo sapiens
tcacttcccct

SEQ ID NO: 240699 - DNA, 22 bp, Homo sapiens
tcacttcctagagcatctgtcc

SEQ ID NO: 240700 - DNA, 17 bp, Homo sapiens
tcacttctgaccacact

SEQ ID NO: 240701 - DNA, 15 bp, Homo sapiens
tcacttgactcttga

SEQ ID NO: 240702 - DNA, 17 bp, Homo sapiens
tcacttgcactggggga

SEQ ID NO: 240703 - DNA, 22 bp, Homo sapiens
tcacttgtcctcagtttttcct

SEQ ID NO: 240704 - DNA, 18 bp, Homo sapiens
tcacttgtcttgctctta

SEQ ID NO: 240705 - DNA, 15 bp, Homo sapiens
tcacttgtgtttgta

SEQ ID NO: 240706 - DNA, 21 bp, Homo sapiens
tcactttagaggcttgatcat

SEQ ID NO: 240707 - DNA, 17 bp, Homo sapiens
tcactttcacatagatg

SEQ ID NO: 240708 - DNA, 14 bp, Homo sapiens
tcactttgctctgg

SEQ ID NO: 240709 - DNA, 14 bp, Homo sapiens
tcacttttcacttg

SEQ ID NO: 240710 - DNA, 15 bp, Homo sapiens
tcacttttttcctgt

SEQ ID NO: 240711 - DNA, 18 bp, Homo sapiens
tcacttttttcctgtcaa

SEQ ID NO: 240712 - DNA, 21 bp, Homo sapiens
tcacttttttcctgtcaatat

SEQ ID NO: 240713 - DNA, 12 bp, Homo sapiens
tcagaaaacaga

SEQ ID NO: 240714 - DNA, 17 bp, Homo sapiens
tcagaaaacagaaaaaa

SEQ ID NO: 240715 - DNA, 14 bp, Homo sapiens
tcagaaaagacact

SEQ ID NO: 240716 - DNA, 14 bp, Homo sapiens
tcagaaaagggaag

SEQ ID NO: 240717 - DNA, 17 bp, Homo sapiens
tcagaaaatattatgtg

SEQ ID NO: 240718 - DNA, 18 bp, Homo sapiens
tcagaaaccaaacagttt

SEQ ID NO: 240719 - DNA, 17 bp, Homo sapiens
tcagaaacttgtgaagt

SEQ ID NO: 240720 - DNA, 20 bp, Homo sapiens
tcagaaagggcagcccctcc

SEQ ID NO: 240721 - DNA, 21 bp, Homo sapiens
tcagaaagggcagcccctccc

SEQ ID NO: 240722 - DNA, 21 bp, Homo sapiens
tcagaaatgctgcctgcctgt

SEQ ID NO: 240723 - DNA, 19 bp, Homo sapiens
tcagaaatttttatcagtt

SEQ ID NO: 240724 - DNA, 12 bp, Homo sapiens
tcagaacacatt

SEQ ID NO: 240725 - DNA, 19 bp, Homo sapiens
tcagaacaccaagacttga

SEQ ID NO: 240726 - DNA, 15 bp, Homo sapiens
tcagaacaccccgct

SEQ ID NO: 240727 - DNA, 16 bp, Homo sapiens
tcagaacagtctgaaa

SEQ ID NO: 240728 - DNA, 16 bp, Homo sapiens
tcagaactctcagact

SEQ ID NO: 240729 - DNA, 20 bp, Homo sapiens
tcagaactgctaccatgaag

SEQ ID NO: 240730 - DNA, 18 bp, Homo sapiens
tcagaactgttggctgct

SEQ ID NO: 240731 - DNA, 13 bp, Homo sapiens
tcagaagaaattt

SEQ ID NO: 240732 - DNA, 16 bp, Homo sapiens
tcagaagcctattgta

SEQ ID NO: 240733 - DNA, 22 bp, Homo sapiens
tcagaagcctattgtaaataca

SEQ ID NO: 240734 - DNA, 17 bp, Homo sapiens
tcagaagtttggcaata

SEQ ID NO: 240735 - DNA, 15 bp, Homo sapiens
tcagaatcaaacctt

SEQ ID NO: 240736 - DNA, 21 bp, Homo sapiens
tcagaatcaaacctttttata

SEQ ID NO: 240737 - DNA, 14 bp, Homo sapiens
tcagaatgctctac

SEQ ID NO: 240738 - DNA, 22 bp, Homo sapiens
tcagaattgtttttagaaattt

SEQ ID NO: 240739 - DNA, 18 bp, Homo sapiens
tcagacacaattagagaa

SEQ ID NO: 240740 - DNA, 22 bp, Homo sapiens
tcagacagggtctgaaggactg

SEQ ID NO: 240741 - DNA, 15 bp, Homo sapiens
tcagaccataatgtt

SEQ ID NO: 240742 - DNA, 13 bp, Homo sapiens
tcagacccctgcc

SEQ ID NO: 240743 - DNA, 23 bp, Homo sapiens
tcagacccttgaagatgtagctt

SEQ ID NO: 240744 - DNA, 13 bp, Homo sapiens
tcagaccctttag

SEQ ID NO: 240745 - DNA, 17 bp, Homo sapiens
tcagacctctgatccct

SEQ ID NO: 240746 - DNA, 18 bp, Homo sapiens
tcagacctgtcttccaag

SEQ ID NO: 240747 - DNA, 14 bp, Homo sapiens
tccaccctcccctc

SEQ ID NO: 240748 - DNA, 16 bp, Homo sapiens
tccacccttggcctgt

SEQ ID NO: 240749 - DNA, 19 bp, Homo sapiens
tccacccttggcctgtctc

SEQ ID NO: 240750 - DNA, 20 bp, Homo sapiens
tccacccttggcctgtctca

SEQ ID NO: 240751 - DNA, 17 bp, Homo sapiens
tccaccggtgcctcctc

SEQ ID NO: 240752 - DNA, 16 bp, Homo sapiens
tccacctcacaactcc

SEQ ID NO: 240753 - DNA, 15 bp, Homo sapiens
tccacctccacccac

SEQ ID NO: 240754 - DNA, 21 bp, Homo sapiens
tccacctcccccaaaccctgc

SEQ ID NO: 240755 - DNA, 13 bp, Homo sapiens
tccacctccctcc

SEQ ID NO: 240756 - DNA, 13 bp, Homo sapiens
tccacctcctaga

SEQ ID NO: 240757 - DNA, 18 bp, Homo sapiens
tccacctcctctcttgga

SEQ ID NO: 240758 - DNA, 22 bp, Homo sapiens
tccacctgcctatccatcctgc

SEQ ID NO: 240759 - DNA, 23 bp, Homo sapiens
tccacctgcctatccatcctgcg

SEQ ID NO: 240760 - DNA, 14 bp, Homo sapiens
tccacctgggagat

SEQ ID NO: 240761 - DNA, 20 bp, Homo sapiens
tccacctgggagatgctggg

SEQ ID NO: 240762 - DNA, 20 bp, Homo sapiens
tccacctgtctcagcctccc

SEQ ID NO: 240763 - DNA, 12 bp, Homo sapiens
tccaccttaact

SEQ ID NO: 240764 - DNA, 22 bp, Homo sapiens
tccaccttaccctactggctgt

SEQ ID NO: 240765 - DNA, 13 bp, Homo sapiens
tccaccttccagg

SEQ ID NO: 240766 - DNA, 14 bp, Homo sapiens
tccaccttccaggc

SEQ ID NO: 240767 - DNA, 15 bp, Homo sapiens
tccacgccctgggga

SEQ ID NO: 240768 - DNA, 12 bp, Homo sapiens
tccacgctgtct

SEQ ID NO: 240769 - DNA, 16 bp, Homo sapiens
tccacgctgtctccag

SEQ ID NO: 240770 - DNA, 22 bp, Homo sapiens
tccacgctgtctccagaccccc

SEQ ID NO: 240771 - DNA, 23 bp, Homo sapiens
tccacgctgtctccagaccccca

SEQ ID NO: 240772 - DNA, 15 bp, Homo sapiens
tccacggtgcgtggc

SEQ ID NO: 240773 - DNA, 22 bp, Homo sapiens
tccacggtgcgtggctgtggca

SEQ ID NO: 240774 - DNA, 18 bp, Homo sapiens
tccacgtccccctggggc

SEQ ID NO: 240775 - DNA, 14 bp, Homo sapiens
tccacgtgtatgca

SEQ ID NO: 240776 - DNA, 17 bp, Homo sapiens
tccacgttcacccctcc

SEQ ID NO: 240777 - DNA, 19 bp, Homo sapiens
tccactaatattcagtcct

SEQ ID NO: 240778 - DNA, 15 bp, Homo sapiens
tccactacgctcctg

SEQ ID NO: 240779 - DNA, 16 bp, Homo sapiens
tccactacgctcctgt

SEQ ID NO: 240780 - DNA, 19 bp, Homo sapiens
tccactaggtgcccagtct

SEQ ID NO: 240781 - DNA, 12 bp, Homo sapiens
tccactcactcc

SEQ ID NO: 240782 - DNA, 15 bp, Homo sapiens
tccactcagggctgg

SEQ ID NO: 240783 - DNA, 16 bp, Homo sapiens
tccactcagggctggc

SEQ ID NO: 240784 - DNA, 18 bp, Homo sapiens
tccactcccactgccagg

SEQ ID NO: 240785 - DNA, 18 bp, Homo sapiens
tccactcccccacctgac

SEQ ID NO: 240786 - DNA, 14 bp, Homo sapiens
tccactcccctcat

SEQ ID NO: 240787 - DNA, 16 bp, Homo sapiens
tccactcccctcatcc

SEQ ID NO: 240788 - DNA, 15 bp, Homo sapiens
tccactccctgctcc

SEQ ID NO: 240789 - DNA, 18 bp, Homo sapiens
tccactccctgctccacg

SEQ ID NO: 240790 - DNA, 9 bp, Homo sapiens
tccactcct

SEQ ID NO: 240791 - DNA, 17 bp, Homo sapiens
tccactctagttctaga

SEQ ID NO: 240792 - DNA, 18 bp, Homo sapiens
tccactctagttctagat

SEQ ID NO: 240793 - DNA, 23 bp, Homo sapiens
tccactctccttcgtgtctctcc

SEQ ID NO: 240794 - DNA, 15 bp, Homo sapiens
tccactgccctctgt

SEQ ID NO: 240795 - DNA, 22 bp, Homo sapiens
tccactgccttcgatacaccgg

SEQ ID NO: 240796 - DNA, 23 bp, Homo sapiens
tccactggagaattgaaaaggac

SEQ ID NO: 240797 - DNA, 12 bp, Homo sapiens
tccactggcctg

SEQ ID NO: 240798 - DNA, 23 bp, Homo sapiens
tccacttcagggttctaaccttt

SEQ ID NO: 240799 - DNA, 13 bp, Homo sapiens
tccactttcctct

SEQ ID NO: 240800 - DNA, 21 bp, Homo sapiens
tccagaaagaaaatgaatttg

SEQ ID NO: 240801 - DNA, 18 bp, Homo sapiens
tccagaaagcaggagcag

SEQ ID NO: 240802 - DNA, 22 bp, Homo sapiens
tccagaaagcaggagcagctgt

SEQ ID NO: 240803 - DNA, 14 bp, Homo sapiens
tccagaaaggatat

SEQ ID NO: 240804 - DNA, 17 bp, Homo sapiens
tccagaaaggatattta

SEQ ID NO: 240805 - DNA, 18 bp, Homo sapiens
tccagaaaggatatttaa

SEQ ID NO: 240806 - DNA, 14 bp, Homo sapiens
tccagaaattcttc

SEQ ID NO: 240807 - DNA, 16 bp, Homo sapiens
tccagaacaaaagata

SEQ ID NO: 240808 - DNA, 13 bp, Homo sapiens
tccagaagaaatt

SEQ ID NO: 240809 - DNA, 18 bp, Homo sapiens
tccagaagaaattattta

SEQ ID NO: 240810 - DNA, 20 bp, Homo sapiens
tccagaagaaattatttaat

SEQ ID NO: 240811 - DNA, 22 bp, Homo sapiens
tccagaagaaattatttaatat

SEQ ID NO: 240812 - DNA, 17 bp, Homo sapiens
tccagaagaatattcag

SEQ ID NO: 240813 - DNA, 17 bp, Homo sapiens
tccagaagatgccctcc

SEQ ID NO: 240814 - DNA, 12 bp, Homo sapiens
tccagaaggaag

SEQ ID NO: 240815 - DNA, 21 bp, Homo sapiens
tccagaaggggtttggtctgg

SEQ ID NO: 240816 - DNA, 20 bp, Homo sapiens
tccagaagttttaacttcca

SEQ ID NO: 240817 - DNA, 12 bp, Homo sapiens
tccagaatatct

SEQ ID NO: 240818 - DNA, 15 bp, Homo sapiens
tccagaatctgctgt

SEQ ID NO: 240819 - DNA, 16 bp, Homo sapiens
tccagaatctgctgtt

SEQ ID NO: 240820 - DNA, 18 bp, Homo sapiens
tccagaatggtctttcta

SEQ ID NO: 240821 - DNA, 13 bp, Homo sapiens
tccagaatgtaag

SEQ ID NO: 240822 - DNA, 23 bp, Homo sapiens
tccagaattaaggtttgttttcc

SEQ ID NO: 240823 - DNA, 16 bp, Homo sapiens
tccagacccccacccc

SEQ ID NO: 240824 - DNA, 20 bp, Homo sapiens
tccagacccccaccccttcc

SEQ ID NO: 240825 - DNA, 22 bp, Homo sapiens
tccagacccctaccctttccca

SEQ ID NO: 240826 - DNA, 15 bp, Homo sapiens
tccagacccctggct

SEQ ID NO: 240827 - DNA, 17 bp, Homo sapiens
tccagacccctggcttt

SEQ ID NO: 240828 - DNA, 23 bp, Homo sapiens
tccagacccctggcttttcactg

SEQ ID NO: 240829 - DNA, 14 bp, Homo sapiens
tccagaccctgcct

SEQ ID NO: 240830 - DNA, 15 bp, Homo sapiens
tccagaccctgcctg

SEQ ID NO: 240831 - DNA, 22 bp, Homo sapiens
tccagaccctgcctgagcccag

SEQ ID NO: 240832 - DNA, 17 bp, Homo sapiens
tccagacctgggccctg

SEQ ID NO: 240833 - DNA, 15 bp, Homo sapiens
tccagagaccacacc

SEQ ID NO: 240834 - DNA, 10 bp, Homo sapiens
tccagagaga

SEQ ID NO: 240835 - DNA, 13 bp, Homo sapiens
tccagagagaagc

SEQ ID NO: 240836 - DNA, 17 bp, Homo sapiens
tccagagagtggctcct

SEQ ID NO: 240837 - DNA, 14 bp, Homo sapiens
tccagagccagcct

SEQ ID NO: 240838 - DNA, 20 bp, Homo sapiens
tccagagccagcctgggact

SEQ ID NO: 240839 - DNA, 15 bp, Homo sapiens
tccagagctcatttc

SEQ ID NO: 240840 - DNA, 21 bp, Homo sapiens
tccagaggtgagggaggcctg

SEQ ID NO: 240841 - DNA, 16 bp, Homo sapiens
tccagagtctgagccc

SEQ ID NO: 240842 - DNA, 21 bp, Homo sapiens
tccagataattggtggatcaa

SEQ ID NO: 240843 - DNA, 22 bp, Homo sapiens
tccagatatgaacagggcccag

SEQ ID NO: 240844 - DNA, 15 bp, Homo sapiens
tccagattgggggcc

SEQ ID NO: 240845 - DNA, 17 bp, Homo sapiens
tccagattgggggccct

SEQ ID NO: 240846 - DNA, 19 bp, Homo sapiens
tccagattgggggccctgg

SEQ ID NO: 240847 - DNA, 21 bp, Homo sapiens
tccagcaattctcctgcctca

SEQ ID NO: 240848 - DNA, 13 bp, Homo sapiens
tccagcacagact

SEQ ID NO: 240849 - DNA, 15 bp, Homo sapiens
tccagcagctgcggg

SEQ ID NO: 240850 - DNA, 16 bp, Homo sapiens
tccagcagtgctgggc

SEQ ID NO: 240851 - DNA, 17 bp, Homo sapiens
tccagcagtgctgggcc

SEQ ID NO: 240852 - DNA, 18 bp, Homo sapiens
tccagcagtgctgggccc

SEQ ID NO: 240853 - DNA, 19 bp, Homo sapiens
tccagcagtgctgggccca

SEQ ID NO: 240854 - DNA, 21 bp, Homo sapiens
tccagcagtgctgggcccagc

SEQ ID NO: 240855 - DNA, 14 bp, Homo sapiens
tccagcatccagcc

SEQ ID NO: 240856 - DNA, 16 bp, Homo sapiens
tccagcatccagcctg

SEQ ID NO: 240857 - DNA, 11 bp, Homo sapiens
tccagcatgtg

SEQ ID NO: 240858 - DNA, 15 bp, Homo sapiens
tccagcatgtgtgtg

SEQ ID NO: 240859 - DNA, 22 bp, Homo sapiens
tccagcatgtgtgtgtctctat

SEQ ID NO: 240860 - DNA, 19 bp, Homo sapiens
tccagccacccagccagga

SEQ ID NO: 240861 - DNA, 23 bp, Homo sapiens
tccagccagcaatgatgtccaga

SEQ ID NO: 240862 - DNA, 22 bp, Homo sapiens
tccagcccgagtggtctcctct

SEQ ID NO: 240863 - DNA, 21 bp, Homo sapiens
tccatcttggtagttctgtgc

SEQ ID NO: 240864 - DNA, 22 bp, Homo sapiens
tccatcttggtagttctgtgcc

SEQ ID NO: 240865 - DNA, 23 bp, Homo sapiens
tccatcttggtagttctgtgcct

SEQ ID NO: 240866 - DNA, 18 bp, Homo sapiens
tccatctttctacagaga

SEQ ID NO: 240867 - DNA, 15 bp, Homo sapiens
tccatgaaggcagag

SEQ ID NO: 240868 - DNA, 12 bp, Homo sapiens
tccatgaatgta

SEQ ID NO: 240869 - DNA, 16 bp, Homo sapiens
tccatgaccaggccac

SEQ ID NO: 240870 - DNA, 19 bp, Homo sapiens
tccatgactggctgtctgc

SEQ ID NO: 240871 - DNA, 19 bp, Homo sapiens
tccatgagtttgccctggt

SEQ ID NO: 240872 - DNA, 14 bp, Homo sapiens
tccatgatggaata

SEQ ID NO: 240873 - DNA, 21 bp, Homo sapiens
tccatgattccaagggcccag

SEQ ID NO: 240874 - DNA, 19 bp, Homo sapiens
tccatgcagactcctcaga

SEQ ID NO: 240875 - DNA, 23 bp, Homo sapiens
tccatgcagataacagctggttg

SEQ ID NO: 240876 - DNA, 20 bp, Homo sapiens
tccatgcagatctagccagg

SEQ ID NO: 240877 - DNA, 23 bp, Homo sapiens
tccatgcagatctagccaggcct

SEQ ID NO: 240878 - DNA, 18 bp, Homo sapiens
tccatgcctacagataat

SEQ ID NO: 240879 - DNA, 21 bp, Homo sapiens
tccatgcctatttactggaaa

SEQ ID NO: 240880 - DNA, 16 bp, Homo sapiens
tccatgcctgagggtg

SEQ ID NO: 240881 - DNA, 21 bp, Homo sapiens
tccatgcggccggcctggggc

SEQ ID NO: 240882 - DNA, 13 bp, Homo sapiens
tccatgctcctca

SEQ ID NO: 240883 - DNA, 21 bp, Homo sapiens
tccatgctcctcactgcccgc

SEQ ID NO: 240884 - DNA, 14 bp, Homo sapiens
tccatgctgcctcc

SEQ ID NO: 240885 - DNA, 17 bp, Homo sapiens
tccatggcaccagcccc

SEQ ID NO: 240886 - DNA, 17 bp, Homo sapiens
tccatggcttcctgaga

SEQ ID NO: 240887 - DNA, 19 bp, Homo sapiens
tccatgggcacctctgctg

SEQ ID NO: 240888 - DNA, 23 bp, Homo sapiens
tccatgtagaagagggagaagga

SEQ ID NO: 240889 - DNA, 18 bp, Homo sapiens
tccatgtcgcctctgcat

SEQ ID NO: 240890 - DNA, 11 bp, Homo sapiens
tccatgtggcc

SEQ ID NO: 240891 - DNA, 13 bp, Homo sapiens
tccatgtggcctt

SEQ ID NO: 240892 - DNA, 18 bp, Homo sapiens
tccatgtgtgtgcaagtg

SEQ ID NO: 240893 - DNA, 14 bp, Homo sapiens
tccatgtgttttgc

SEQ ID NO: 240894 - DNA, 16 bp, Homo sapiens
tccatgtgttttgctt

SEQ ID NO: 240895 - DNA, 14 bp, Homo sapiens
tccattaggatttg

SEQ ID NO: 240896 - DNA, 15 bp, Homo sapiens
tccattatctgctgt

SEQ ID NO: 240897 - DNA, 14 bp, Homo sapiens
tccattattcaaga

SEQ ID NO: 240898 - DNA, 11 bp, Homo sapiens
tccattattta

SEQ ID NO: 240899 - DNA, 15 bp, Homo sapiens
tccattcagtctgca

SEQ ID NO: 240900 - DNA, 19 bp, Homo sapiens
tccattcagtctgcagcta

SEQ ID NO: 240901 - DNA, 23 bp, Homo sapiens
tccattctgctttcttgccacac

SEQ ID NO: 240902 - DNA, 12 bp, Homo sapiens
tccattctttct

SEQ ID NO: 240903 - DNA, 19 bp, Homo sapiens
tccattcttttaaatgggt

SEQ ID NO: 240904 - DNA, 19 bp, Homo sapiens
tccattgcaaaaggttaag

SEQ ID NO: 240905 - DNA, 13 bp, Homo sapiens
tccattgtattgt

SEQ ID NO: 240906 - DNA, 20 bp, Homo sapiens
tccatttagttctttgttat

SEQ ID NO: 240907 - DNA, 14 bp, Homo sapiens
tccatttcatgtga

SEQ ID NO: 240908 - DNA, 17 bp, Homo sapiens
tccatttcatgtgatct

SEQ ID NO: 240909 - DNA, 17 bp, Homo sapiens
tccattttaacaaacaa

SEQ ID NO: 240910 - DNA, 16 bp, Homo sapiens
tccattttctaaactg

SEQ ID NO: 240911 - DNA, 17 bp, Homo sapiens
tccattttctaaactgt

SEQ ID NO: 240912 - DNA, 23 bp, Homo sapiens
tccattttctaaactgttttcat

SEQ ID NO: 240913 - DNA, 15 bp, Homo sapiens
tccattttggaaaat

SEQ ID NO: 240914 - DNA, 22 bp, Homo sapiens
tccatttttactaaagcagtgt

SEQ ID NO: 240915 - DNA, 18 bp, Homo sapiens
tccatttttcccaggaca

SEQ ID NO: 240916 - DNA, 13 bp, Homo sapiens
tccatttttgttg

SEQ ID NO: 240917 - DNA, 18 bp, Homo sapiens
tcccaaaaaccccagtgt

SEQ ID NO: 240918 - DNA, 19 bp, Homo sapiens
tcccaaaaaccccagtgtt

SEQ ID NO: 240919 - DNA, 16 bp, Homo sapiens
tcccaaagagctgcct

SEQ ID NO: 240920 - DNA, 21 bp, Homo sapiens
tcccaaagcagtgcatgctgt

SEQ ID NO: 240921 - DNA, 22 bp, Homo sapiens
tcccaaagcggccgatgggagt

SEQ ID NO: 240922 - DNA, 21 bp, Homo sapiens
tcccaaagtgctgggattaca

SEQ ID NO: 240923 - DNA, 16 bp, Homo sapiens
tcccaaataaactcct

SEQ ID NO: 240924 - DNA, 13 bp, Homo sapiens
tcccaaataaatt

SEQ ID NO: 240925 - DNA, 20 bp, Homo sapiens
tcccaaatatgcccctcccc

SEQ ID NO: 240926 - DNA, 22 bp, Homo sapiens
tcccaaatatgcccctccccag

SEQ ID NO: 240927 - DNA, 22 bp, Homo sapiens
tcccaacaatactttgtgtctt

SEQ ID NO: 240928 - DNA, 19 bp, Homo sapiens
tcccaacacaaggtgggca

SEQ ID NO: 240929 - DNA, 18 bp, Homo sapiens
tcccaacacttcagactg

SEQ ID NO: 240930 - DNA, 16 bp, Homo sapiens
tcccaacctcaatgcc

SEQ ID NO: 240931 - DNA, 21 bp, Homo sapiens
tcccaacctcaatgccctgcc

SEQ ID NO: 240932 - DNA, 17 bp, Homo sapiens
tcccaactcactgtgct

SEQ ID NO: 240933 - DNA, 18 bp, Homo sapiens
tcccaactcactgtgctc

SEQ ID NO: 240934 - DNA, 21 bp, Homo sapiens
tcccaactcactgtgctccta

SEQ ID NO: 240935 - DNA, 15 bp, Homo sapiens
tcccaactctggcct

SEQ ID NO: 240936 - DNA, 14 bp, Homo sapiens
tcccaacttgtaaa

SEQ ID NO: 240937 - DNA, 22 bp, Homo sapiens
tcccaactttggaaaacataaa

SEQ ID NO: 240938 - DNA, 18 bp, Homo sapiens
tcccaagaacagcaggcc

SEQ ID NO: 240939 - DNA, 21 bp, Homo sapiens
tcccaagaacagcaggcccac

SEQ ID NO: 240940 - DNA, 17 bp, Homo sapiens
tcccaagctcagagcag

SEQ ID NO: 240941 - DNA, 14 bp, Homo sapiens
tcccaaggagctga

SEQ ID NO: 240942 - DNA, 13 bp, Homo sapiens
tcccaagggaggc

SEQ ID NO: 240943 - DNA, 17 bp, Homo sapiens
tcccaaggtcctctcag

SEQ ID NO: 240944 - DNA, 18 bp, Homo sapiens
tcccaagtcaaacagtgt

SEQ ID NO: 240945 - DNA, 13 bp, Homo sapiens
tcccaagtccaca

SEQ ID NO: 240946 - DNA, 13 bp, Homo sapiens
tcccaataaaagt

SEQ ID NO: 240947 - DNA, 12 bp, Homo sapiens
tcccaataaagc

SEQ ID NO: 240948 - DNA, 16 bp, Homo sapiens
tcccaataaagtcctc

SEQ ID NO: 240949 - DNA, 16 bp, Homo sapiens
tcccaatcagcttttg

SEQ ID NO: 240950 - DNA, 23 bp, Homo sapiens
tcccaatcagcttttgttctaga

SEQ ID NO: 240951 - DNA, 15 bp, Homo sapiens
tcccaattaggaagt

SEQ ID NO: 240952 - DNA, 21 bp, Homo sapiens
tcccaatttaagagtcctgag

SEQ ID NO: 240953 - DNA, 12 bp, Homo sapiens
tcccacaaaata

SEQ ID NO: 240954 - DNA, 13 bp, Homo sapiens
tcccacaaaatat

SEQ ID NO: 240955 - DNA, 17 bp, Homo sapiens
tcccacaaaatatttct

SEQ ID NO: 240956 - DNA, 13 bp, Homo sapiens
tcccacacttgct

SEQ ID NO: 240957 - DNA, 14 bp, Homo sapiens
tcccacacttgctg

SEQ ID NO: 240958 - DNA, 16 bp, Homo sapiens
tcccaccaactctgca

SEQ ID NO: 240959 - DNA, 17 bp, Homo sapiens
tcccaccacagcaggtg

SEQ ID NO: 240960 - DNA, 22 bp, Homo sapiens
tcccaccagaacgcaccccact

SEQ ID NO: 240961 - DNA, 13 bp, Homo sapiens
tcccaccagccca

SEQ ID NO: 240962 - DNA, 20 bp, Homo sapiens
tcccacccccatctctccct

SEQ ID NO: 240963 - DNA, 17 bp, Homo sapiens
tcccacccccttctctg

SEQ ID NO: 240964 - DNA, 20 bp, Homo sapiens
tcccacccccttctctgctc

SEQ ID NO: 240965 - DNA, 21 bp, Homo sapiens
tcccacccccttctctgctcc

SEQ ID NO: 240966 - DNA, 18 bp, Homo sapiens
tcccaccccggcctccac

SEQ ID NO: 240967 - DNA, 19 bp, Homo sapiens
tcccacccggccacagctg

SEQ ID NO: 240968 - DNA, 21 bp, Homo sapiens
tcccacccggccacagctgct

SEQ ID NO: 240969 - DNA, 23 bp, Homo sapiens
tcccacccggccacagctgctgg

SEQ ID NO: 240970 - DNA, 18 bp, Homo sapiens
tcccaccggttgcttctg

SEQ ID NO: 240971 - DNA, 21 bp, Homo sapiens
tcccaccggttgcttctggga

SEQ ID NO: 240972 - DNA, 16 bp, Homo sapiens
tcccacctctgaggac

SEQ ID NO: 240973 - DNA, 20 bp, Homo sapiens
tcccacctctgaggactctg

SEQ ID NO: 240974 - DNA, 15 bp, Homo sapiens
tcccacctctttgga

SEQ ID NO: 240975 - DNA, 20 bp, Homo sapiens
tcccacgcactccatgagca

SEQ ID NO: 240976 - DNA, 21 bp, Homo sapiens
tcccacgctgggacacagacc

SEQ ID NO: 240977 - DNA, 15 bp, Homo sapiens
tcccacggccactgc

SEQ ID NO: 240978 - DNA, 15 bp, Homo sapiens
tcccacgtctggcca

SEQ ID NO: 240979 - DNA, 20 bp, Homo sapiens
tcccacgttgacaccaagaa

SEQ ID NO: 240980 - DNA, 14 bp, Homo sapiens
tcccactcctagga

SEQ ID NO: 240981 - DNA, 15 bp, Homo sapiens
tcccactgagtctca

SEQ ID NO: 240982 - DNA, 19 bp, Homo sapiens
tcccactgatatcacgggc

SEQ ID NO: 240983 - DNA, 17 bp, Homo sapiens
tcccactgcacttggtg

SEQ ID NO: 240984 - DNA, 18 bp, Homo sapiens
tcccactgccaggatttt

SEQ ID NO: 240985 - DNA, 13 bp, Homo sapiens
tcccactgtcctt

SEQ ID NO: 240986 - DNA, 15 bp, Homo sapiens
tcccactgtcctttc

SEQ ID NO: 240987 - DNA, 17 bp, Homo sapiens
tcccactgtcctttctc

SEQ ID NO: 240988 - DNA, 18 bp, Homo sapiens
tcccactgtcctttctcc

SEQ ID NO: 240989 - DNA, 19 bp, Homo sapiens
tcccactgtcctttctcca

SEQ ID NO: 240990 - DNA, 13 bp, Homo sapiens
tcccactttcatt

SEQ ID NO: 240991 - DNA, 13 bp, Homo sapiens
tcccactttgggg

SEQ ID NO: 240992 - DNA, 11 bp, Homo sapiens
tccagccgtgt

SEQ ID NO: 240993 - DNA, 14 bp, Homo sapiens
tccagcctcccctc

SEQ ID NO: 240994 - DNA, 16 bp, Homo sapiens
tccagcctcccctccc

SEQ ID NO: 240995 - DNA, 19 bp, Homo sapiens
tccagcctcccctcccctg

SEQ ID NO: 240996 - DNA, 20 bp, Homo sapiens
tccagcctcccctcccctgg

SEQ ID NO: 240997 - DNA, 15 bp, Homo sapiens
tccagcctctcccgg

SEQ ID NO: 240998 - DNA, 19 bp, Homo sapiens
tccagcctctcccggctgc

SEQ ID NO: 240999 - DNA, 21 bp, Homo sapiens
tccagcctctcccggctgcct

SEQ ID NO: 241000 - DNA, 23 bp, Homo sapiens
tccagcctctcccggctgcctgc

SEQ ID NO: 241001 - DNA, 12 bp, Homo sapiens
tccagcctgggc

SEQ ID NO: 241002 - DNA, 12 bp, Homo sapiens
tccagcctgggt

SEQ ID NO: 241003 - DNA, 15 bp, Homo sapiens
tccagcgggccctct

SEQ ID NO: 241004 - DNA, 22 bp, Homo sapiens
tccagcggttgccttttttatc

SEQ ID NO: 241005 - DNA, 19 bp, Homo sapiens
tccagctaagcctgatgat

SEQ ID NO: 241006 - DNA, 22 bp, Homo sapiens
tccagctctaataaaacagctg

SEQ ID NO: 241007 - DNA, 13 bp, Homo sapiens
tccagctctgccc

SEQ ID NO: 241008 - DNA, 17 bp, Homo sapiens
tccagctgccaagtgct

SEQ ID NO: 241009 - DNA, 22 bp, Homo sapiens
tccagctgccaagtgctctttg

SEQ ID NO: 241010 - DNA, 23 bp, Homo sapiens
tccagcttcggagggcccctgcg

SEQ ID NO: 241011 - DNA, 23 bp, Homo sapiens
tccagcttctggtactctcctag

SEQ ID NO: 241012 - DNA, 14 bp, Homo sapiens
tccagcttgaggga

SEQ ID NO: 241013 - DNA, 14 bp, Homo sapiens
tccagctttaaggg

SEQ ID NO: 241014 - DNA, 15 bp, Homo sapiens
tccaggaaaactgtt

SEQ ID NO: 241015 - DNA, 14 bp, Homo sapiens
tccaggaagcacag

SEQ ID NO: 241016 - DNA, 16 bp, Homo sapiens
tccaggaagcacaggc

SEQ ID NO: 241017 - DNA, 14 bp, Homo sapiens
tccaggaaggcagc

SEQ ID NO: 241018 - DNA, 17 bp, Homo sapiens
tccaggaaggcagctgc

SEQ ID NO: 241019 - DNA, 16 bp, Homo sapiens
tccaggaataggcatt

SEQ ID NO: 241020 - DNA, 18 bp, Homo sapiens
tccaggataaggagactg

SEQ ID NO: 241021 - DNA, 16 bp, Homo sapiens
tccaggatcctcctgg

SEQ ID NO: 241022 - DNA, 16 bp, Homo sapiens
tccaggatcctgcagg

SEQ ID NO: 241023 - DNA, 17 bp, Homo sapiens
tccaggattgtccacaa

SEQ ID NO: 241024 - DNA, 20 bp, Homo sapiens
tccaggattgtccacaaatg

SEQ ID NO: 241025 - DNA, 22 bp, Homo sapiens
tccaggattgtccacaaatgtc

SEQ ID NO: 241026 - DNA, 16 bp, Homo sapiens
tccaggcatgaccctg

SEQ ID NO: 241027 - DNA, 17 bp, Homo sapiens
tccaggcatgaccctgg

SEQ ID NO: 241028 - DNA, 22 bp, Homo sapiens
tccaggcatgaccctggagccc

SEQ ID NO: 241029 - DNA, 16 bp, Homo sapiens
tccaggcatgctggcc

SEQ ID NO: 241030 - DNA, 14 bp, Homo sapiens
tccaggccactgtg

SEQ ID NO: 241031 - DNA, 20 bp, Homo sapiens
tccaggccactgtggccaga

SEQ ID NO: 241032 - DNA, 19 bp, Homo sapiens
tccaggccagctccttttc

SEQ ID NO: 241033 - DNA, 13 bp, Homo sapiens
tccaggcccagcc

SEQ ID NO: 241034 - DNA, 15 bp, Homo sapiens
tccaggcccagcctg

SEQ ID NO: 241035 - DNA, 18 bp, Homo sapiens
tccaggcccctgaggact

SEQ ID NO: 241036 - DNA, 22 bp, Homo sapiens
tccaggcccctgaggactggag

SEQ ID NO: 241037 - DNA, 19 bp, Homo sapiens
tccaggccctcagatggca

SEQ ID NO: 241038 - DNA, 14 bp, Homo sapiens
tccaggcctgaggc

SEQ ID NO: 241039 - DNA, 21 bp, Homo sapiens
tccaggcctgaggctgctgac

SEQ ID NO: 241040 - DNA, 19 bp, Homo sapiens
tccaggcgatgtgcaagtg

SEQ ID NO: 241041 - DNA, 22 bp, Homo sapiens
tccaggcgtagggccagggctc

SEQ ID NO: 241042 - DNA, 13 bp, Homo sapiens
tccaggctagtcc

SEQ ID NO: 241043 - DNA, 16 bp, Homo sapiens
tccaggctccaggctg

SEQ ID NO: 241044 - DNA, 20 bp, Homo sapiens
tccaggctcttcctggacct

SEQ ID NO: 241045 - DNA, 22 bp, Homo sapiens
tccaggctcttcctggacctga

SEQ ID NO: 241046 - DNA, 12 bp, Homo sapiens
tccaggctgact

SEQ ID NO: 241047 - DNA, 18 bp, Homo sapiens
tccaggctgactgggggc

SEQ ID NO: 241048 - DNA, 15 bp, Homo sapiens
tccaggctggggcct

SEQ ID NO: 241049 - DNA, 17 bp, Homo sapiens
tcccagacttgtttcct

SEQ ID NO: 241050 - DNA, 14 bp, Homo sapiens
tcccagagaacaat

SEQ ID NO: 241051 - DNA, 11 bp, Homo sapiens
tcccagagcag

SEQ ID NO: 241052 - DNA, 11 bp, Homo sapiens
tcccagagccc

SEQ ID NO: 241053 - DNA, 20 bp, Homo sapiens
tcccagagcttattggccac

SEQ ID NO: 241054 - DNA, 21 bp, Homo sapiens
tcccagagcttattggccact

SEQ ID NO: 241055 - DNA, 17 bp, Homo sapiens
tcccagaggctcctgga

SEQ ID NO: 241056 - DNA, 20 bp, Homo sapiens
tcccagaggctcctggagcc

SEQ ID NO: 241057 - DNA, 22 bp, Homo sapiens
tcccagaggttatctgcctggc

SEQ ID NO: 241058 - DNA, 20 bp, Homo sapiens
tcccagcaaagttttcagat

SEQ ID NO: 241059 - DNA, 20 bp, Homo sapiens
tcccagcacatttcctctct

SEQ ID NO: 241060 - DNA, 14 bp, Homo sapiens
tcccagcacctgcc

SEQ ID NO: 241061 - DNA, 21 bp, Homo sapiens
tcccagcacctggcacaccag

SEQ ID NO: 241062 - DNA, 16 bp, Homo sapiens
tcccagcactttggga

SEQ ID NO: 241063 - DNA, 19 bp, Homo sapiens
tcccagcactttgggaggc

SEQ ID NO: 241064 - DNA, 22 bp, Homo sapiens
tcccagcactttgggaggccta

SEQ ID NO: 241065 - DNA, 15 bp, Homo sapiens
tcccagcatttgtcc

SEQ ID NO: 241066 - DNA, 15 bp, Homo sapiens
tcccagccaccacca

SEQ ID NO: 241067 - DNA, 21 bp, Homo sapiens
tcccagccaccaccactgtcc

SEQ ID NO: 241068 - DNA, 22 bp, Homo sapiens
tcccagccaccaccactgtccc

SEQ ID NO: 241069 - DNA, 17 bp, Homo sapiens
tcccagccctttccagg

SEQ ID NO: 241070 - DNA, 10 bp, Homo sapiens
tcccagcctg

SEQ ID NO: 241071 - DNA, 19 bp, Homo sapiens
tcccagcctgctgagagcc

SEQ ID NO: 241072 - DNA, 14 bp, Homo sapiens
tcccagcctgtggt

SEQ ID NO: 241073 - DNA, 24 bp, Homo sapiens
tcccagcgtttagtttctagaggc

SEQ ID NO: 241074 - DNA, 17 bp, Homo sapiens
tcccagctacttgggag

SEQ ID NO: 241075 - DNA, 21 bp, Homo sapiens
tcccagctctagacaaccctg

SEQ ID NO: 241076 - DNA, 13 bp, Homo sapiens
tcccagctggcag

SEQ ID NO: 241077 - DNA, 16 bp, Homo sapiens
tcccagctggcagcgc

SEQ ID NO: 241078 - DNA, 20 bp, Homo sapiens
tcccagctggcagcgcctcc

SEQ ID NO: 241079 - DNA, 21 bp, Homo sapiens
tcccagctggcagcgcctccc

SEQ ID NO: 241080 - DNA, 22 bp, Homo sapiens
tcccagctggcagcgcctcccg

SEQ ID NO: 241081 - DNA, 14 bp, Homo sapiens
tcccaggaagcagg

SEQ ID NO: 241082 - DNA, 23 bp, Homo sapiens
tcccaggaagcagggagagttgg

SEQ ID NO: 241083 - DNA, 21 bp, Homo sapiens
tcccaggaccctgggtcacct

SEQ ID NO: 241084 - DNA, 20 bp, Homo sapiens
tcccaggacctggagacagg

SEQ ID NO: 241085 - DNA, 22 bp, Homo sapiens
tcccaggacgcagggagaccct

SEQ ID NO: 241086 - DNA, 23 bp, Homo sapiens
tcccaggacgcagggagaccctg

SEQ ID NO: 241087 - DNA, 12 bp, Homo sapiens
tcccaggagggg

SEQ ID NO: 241088 - DNA, 15 bp, Homo sapiens
tcccaggaggggcct

SEQ ID NO: 241089 - DNA, 21 bp, Homo sapiens
tcccaggaggggcctctgaaa

SEQ ID NO: 241090 - DNA, 12 bp, Homo sapiens
tcccaggccagc

SEQ ID NO: 241091 - DNA, 16 bp, Homo sapiens
tcccaggccagcgagg

SEQ ID NO: 241092 - DNA, 21 bp, Homo sapiens
tcccaggccgcatggcccctc

SEQ ID NO: 241093 - DNA, 21 bp, Homo sapiens
tcccaggcgccccttccccct

SEQ ID NO: 241094 - DNA, 20 bp, Homo sapiens
tcccagggaaggacttggag

SEQ ID NO: 241095 - DNA, 20 bp, Homo sapiens
tcccaggggtctccctgagc

SEQ ID NO: 241096 - DNA, 15 bp, Homo sapiens
tcccaggttccagca

SEQ ID NO: 241097 - DNA, 17 bp, Homo sapiens
tcccaggttggaggccc

SEQ ID NO: 241098 - DNA, 19 bp, Homo sapiens
tcccagtattctcagagca

SEQ ID NO: 241099 - DNA, 22 bp, Homo sapiens
tcccagtggcctcaaccctccc

SEQ ID NO: 241100 - DNA, 15 bp, Homo sapiens
tcccagtgggaggcg

SEQ ID NO: 241101 - DNA, 20 bp, Homo sapiens
tcccatagtgctgggattca

SEQ ID NO: 241102 - DNA, 17 bp, Homo sapiens
tcccatcaccccttccc

SEQ ID NO: 241103 - DNA, 17 bp, Homo sapiens
tcccatcactgctgtcc

SEQ ID NO: 241104 - DNA, 19 bp, Homo sapiens
tcccatctccttcccccag

SEQ ID NO: 241105 - DNA, 22 bp, Homo sapiens
tcccatctccttcccccagccc

SEQ ID NO: 241106 - DNA, 18 bp, Homo sapiens
tcccatgaccttgacgtg

SEQ ID NO: 241107 - DNA, 19 bp, Homo sapiens
tcccatgactgcacccagc

SEQ ID NO: 241108 - DNA, 15 bp, Homo sapiens
tcccatgatccctgt

SEQ ID NO: 241109 - DNA, 16 bp, Homo sapiens
tcccatgatccctgtg

SEQ ID NO: 241110 - DNA, 23 bp, Homo sapiens
tcccatgcacacaaacacctcct

SEQ ID NO: 241111 - DNA, 19 bp, Homo sapiens
tcccatgcctgtctctgtt

SEQ ID NO: 241112 - DNA, 17 bp, Homo sapiens
tcccatggcccagcagc

SEQ ID NO: 241113 - DNA, 14 bp, Homo sapiens
tcccatggccttcc

SEQ ID NO: 241114 - DNA, 15 bp, Homo sapiens
tcccatggccttccc

SEQ ID NO: 241115 - DNA, 23 bp, Homo sapiens
tcccatgggggctccagacattg

SEQ ID NO: 241116 - DNA, 17 bp, Homo sapiens
tcccatggtagactgtg

SEQ ID NO: 241117 - DNA, 16 bp, Homo sapiens
tcccatggtccctagc

SEQ ID NO: 241118 - DNA, 16 bp, Homo sapiens
tcccatgttgcatgcc

SEQ ID NO: 241119 - DNA, 16 bp, Homo sapiens
tcccattgtggctcct

SEQ ID NO: 241120 - DNA, 17 bp, Homo sapiens
tcccatttcgtgtaata

SEQ ID NO: 241121 - DNA, 21 bp, Homo sapiens
tcccatttctaaaggcctctt

SEQ ID NO: 241122 - DNA, 17 bp, Homo sapiens
tcccatttgtgtttcag

SEQ ID NO: 241123 - DNA, 22 bp, Homo sapiens
tcccattttgcaaaatttccag

SEQ ID NO: 241124 - DNA, 14 bp, Homo sapiens
tccccaaaggcatc

SEQ ID NO: 241125 - DNA, 18 bp, Homo sapiens
tccccaacgtcccctccg

SEQ ID NO: 241126 - DNA, 23 bp, Homo sapiens
tccccaacgtcccctccgccgtg

SEQ ID NO: 241127 - DNA, 14 bp, Homo sapiens
tccccaactccatg

SEQ ID NO: 241128 - DNA, 23 bp, Homo sapiens
tccccaagtggtttccacatgct

SEQ ID NO: 241129 - DNA, 20 bp, Homo sapiens
tccccaatccaacccatgca

SEQ ID NO: 241130 - DNA, 14 bp, Homo sapiens
tccccaatgctctc

SEQ ID NO: 241131 - DNA, 10 bp, Homo sapiens
tccccacact

SEQ ID NO: 241132 - DNA, 15 bp, Homo sapiens
tccccaccaccccag

SEQ ID NO: 241133 - DNA, 21 bp, Homo sapiens
tccccaccagtctcacccact

SEQ ID NO: 241134 - DNA, 21 bp, Homo sapiens
tccccaccagtgaatgaaagt

SEQ ID NO: 241135 - DNA, 15 bp, Homo sapiens
tccccacccctgcct

SEQ ID NO: 241136 - DNA, 19 bp, Homo sapiens
tccccacccctgcctttgt

SEQ ID NO: 241137 - DNA, 18 bp, Homo sapiens
tccccaccctcccctctc

SEQ ID NO: 241138 - DNA, 18 bp, Homo sapiens
tccccacgagtcacctgc

SEQ ID NO: 241139 - DNA, 22 bp, Homo sapiens
tccccacggggcctcgggacct

SEQ ID NO: 241140 - DNA, 13 bp, Homo sapiens
tccccactcccgt

SEQ ID NO: 241141 - DNA, 17 bp, Homo sapiens
tccccactcccgtgatg

SEQ ID NO: 241142 - DNA, 15 bp, Homo sapiens
tccccactccctgtc

SEQ ID NO: 241143 - DNA, 19 bp, Homo sapiens
tccccactcctcctccagc

SEQ ID NO: 241144 - DNA, 22 bp, Homo sapiens
tccccactcctcctccagccca

SEQ ID NO: 241145 - DNA, 14 bp, Homo sapiens
tccccactctgctc

SEQ ID NO: 241146 - DNA, 19 bp, Homo sapiens
tccccactgacagcctccc

SEQ ID NO: 241147 - DNA, 17 bp, Homo sapiens
tccccagaaaggagact

SEQ ID NO: 241148 - DNA, 21 bp, Homo sapiens
tccccagagcactgggttgca

SEQ ID NO: 241149 - DNA, 14 bp, Homo sapiens
tccccagaggctcc

SEQ ID NO: 241150 - DNA, 16 bp, Homo sapiens
tccccagaggctccca

SEQ ID NO: 241151 - DNA, 21 bp, Homo sapiens
tccccagccagcccttccctg

SEQ ID NO: 241152 - DNA, 13 bp, Homo sapiens
tccccagcccact

SEQ ID NO: 241153 - DNA, 20 bp, Homo sapiens
tatttttgtttcttccaaag

SEQ ID NO: 241154 - DNA, 14 bp, Homo sapiens
tattttttaatgtg

SEQ ID NO: 241155 - DNA, 19 bp, Homo sapiens
tattttttaatgtgagaca

SEQ ID NO: 241156 - DNA, 23 bp, Homo sapiens
tattttttaatttgatgaaagct

SEQ ID NO: 241157 - DNA, 15 bp, Homo sapiens
tattttttccctcct

SEQ ID NO: 241158 - DNA, 15 bp, Homo sapiens
tatttttttaagcgt

SEQ ID NO: 241159 - DNA, 15 bp, Homo sapiens
tatttttttctacct

SEQ ID NO: 241160 - DNA, 23 bp, Homo sapiens
tatttttttctaccttgaggtct

SEQ ID NO: 241161 - DNA, 18 bp, Homo sapiens
tatttttttgatggctaa

SEQ ID NO: 241162 - DNA, 20 bp, Homo sapiens
tattttttttttccattagt

SEQ ID NO: 241163 - DNA, 20 bp, Homo sapiens
tcaaaaaaaaaaaaatgcac

SEQ ID NO: 241164 - DNA, 15 bp, Homo sapiens
tcaaaaagtgtttat

SEQ ID NO: 241165 - DNA, 19 bp, Homo sapiens
tcaaaaagtgtttattttt

SEQ ID NO: 241166 - DNA, 14 bp, Homo sapiens
tcaaaaatacaaaa

SEQ ID NO: 241167 - DNA, 21 bp, Homo sapiens
tcaaaaatacaaaataaaaac

SEQ ID NO: 241168 - DNA, 16 bp, Homo sapiens
tcaaaaatataactta

SEQ ID NO: 241169 - DNA, 20 bp, Homo sapiens
tcccggcctcttccacccat

SEQ ID NO: 241170 - DNA, 16 bp, Homo sapiens
tcccggctgcctgccg

SEQ ID NO: 241171 - DNA, 16 bp, Homo sapiens
tcccgggccacgcccc

SEQ ID NO: 241172 - DNA, 14 bp, Homo sapiens
tcccggggccatgg

SEQ ID NO: 241173 - DNA, 17 bp, Homo sapiens
tcccggtgtatgcagtg

SEQ ID NO: 241174 - DNA, 15 bp, Homo sapiens
tcccggttcaccttg

SEQ ID NO: 241175 - DNA, 19 bp, Homo sapiens
tcccggttcagacccctgc

SEQ ID NO: 241176 - DNA, 16 bp, Homo sapiens
tcccggtttcagaagc

SEQ ID NO: 241177 - DNA, 14 bp, Homo sapiens
tcccgtccgtccgc

SEQ ID NO: 241178 - DNA, 19 bp, Homo sapiens
tcccgtgaaagaattattt

SEQ ID NO: 241179 - DNA, 14 bp, Homo sapiens
tcccgtgctggaag

SEQ ID NO: 241180 - DNA, 14 bp, Homo sapiens
tccctaaagccctc

SEQ ID NO: 241181 - DNA, 16 bp, Homo sapiens
tccctaagaattccca

SEQ ID NO: 241182 - DNA, 20 bp, Homo sapiens
tccctaagccaagggcctct

SEQ ID NO: 241183 - DNA, 23 bp, Homo sapiens
tccctaattctcttcgctgtgat

SEQ ID NO: 241184 - DNA, 20 bp, Homo sapiens
tccctacccacagggcctga

SEQ ID NO: 241185 - DNA, 24 bp, Homo sapiens
tccctacccacagggcctgacttt

SEQ ID NO: 241186 - DNA, 19 bp, Homo sapiens
tccctaccccctaagagcc

SEQ ID NO: 241187 - DNA, 19 bp, Homo sapiens
tccctaccctcttctcagc

SEQ ID NO: 241188 - DNA, 22 bp, Homo sapiens
tccctaccgagtctcttctcca

SEQ ID NO: 241189 - DNA, 17 bp, Homo sapiens
tccctactagagacctc

SEQ ID NO: 241190 - DNA, 16 bp, Homo sapiens
tccctacttaggaaat

SEQ ID NO: 241191 - DNA, 22 bp, Homo sapiens
tccctagaaaacaatgcaaaac

SEQ ID NO: 241192 - DNA, 20 bp, Homo sapiens
tccctagaaagccatattcc

SEQ ID NO: 241193 - DNA, 22 bp, Homo sapiens
tccctagaaagccatattccag

SEQ ID NO: 241194 - DNA, 18 bp, Homo sapiens
tccctagactgcatcccg

SEQ ID NO: 241195 - DNA, 15 bp, Homo sapiens
tccctatcagttcta

SEQ ID NO: 241196 - DNA, 17 bp, Homo sapiens
tccctcactcttcctca

SEQ ID NO: 241197 - DNA, 13 bp, Homo sapiens
tccctccaaggtc

SEQ ID NO: 241198 - DNA, 19 bp, Homo sapiens
tccctccacacctccaccc

SEQ ID NO: 241199 - DNA, 16 bp, Homo sapiens
tccctccaccccagtc

SEQ ID NO: 241200 - DNA, 19 bp, Homo sapiens
tccctccaccccagtcccc

SEQ ID NO: 241201 - DNA, 16 bp, Homo sapiens
tccctccacctgcttg

SEQ ID NO: 241202 - DNA, 20 bp, Homo sapiens
tccctccacgttcacccctc

SEQ ID NO: 241203 - DNA, 13 bp, Homo sapiens
tccctccactcct

SEQ ID NO: 241204 - DNA, 15 bp, Homo sapiens
tccctccatggcagg

SEQ ID NO: 241205 - DNA, 22 bp, Homo sapiens
tccctccccacagtcctcacag

SEQ ID NO: 241206 - DNA, 13 bp, Homo sapiens
tccctccccaccc

SEQ ID NO: 241207 - DNA, 22 bp, Homo sapiens
tccctccccaccccaaccactc

SEQ ID NO: 241208 - DNA, 14 bp, Homo sapiens
tccctccccagtgt

SEQ ID NO: 241209 - DNA, 18 bp, Homo sapiens
tccctccccagtgttttt

SEQ ID NO: 241210 - DNA, 16 bp, Homo sapiens
tccctcccctgccctc

SEQ ID NO: 241211 - DNA, 20 bp, Homo sapiens
tccctcccggcatgggaaag

SEQ ID NO: 241212 - DNA, 13 bp, Homo sapiens
tccctccctccac

SEQ ID NO: 241213 - DNA, 17 bp, Homo sapiens
tccctccctccacacct

SEQ ID NO: 241214 - DNA, 14 bp, Homo sapiens
tccctccctgcagg

SEQ ID NO: 241215 - DNA, 13 bp, Homo sapiens
tccctccgggcag

SEQ ID NO: 241216 - DNA, 16 bp, Homo sapiens
tccctccgggcagggg

SEQ ID NO: 241217 - DNA, 13 bp, Homo sapiens
tccctcctcacct

SEQ ID NO: 241218 - DNA, 16 bp, Homo sapiens
tccctcctcacctctg

SEQ ID NO: 241219 - DNA, 13 bp, Homo sapiens
tccctcctcccat

SEQ ID NO: 241220 - DNA, 16 bp, Homo sapiens
tccctcctcttcctgt

SEQ ID NO: 241221 - DNA, 18 bp, Homo sapiens
tccctcctgacaaatatt

SEQ ID NO: 241222 - DNA, 13 bp, Homo sapiens
tccctcctggagc

SEQ ID NO: 241223 - DNA, 16 bp, Homo sapiens
tccctcctggagcatc

SEQ ID NO: 241224 - DNA, 13 bp, Homo sapiens
tccctcctggctc

SEQ ID NO: 241225 - DNA, 17 bp, Homo sapiens
tccctcctggctcacag

SEQ ID NO: 241226 - DNA, 21 bp, Homo sapiens
tccctcgcatccgcctctgag

SEQ ID NO: 241227 - DNA, 19 bp, Homo sapiens
tccctcgctgcacaaatac

SEQ ID NO: 241228 - DNA, 22 bp, Homo sapiens
tccctcgctgcacaaatactcc

SEQ ID NO: 241229 - DNA, 14 bp, Homo sapiens
tccctcgctgtatg

SEQ ID NO: 241230 - DNA, 15 bp, Homo sapiens
tccctcggacccacc

SEQ ID NO: 241231 - DNA, 19 bp, Homo sapiens
tccctcggtcacctgtgct

SEQ ID NO: 241232 - DNA, 17 bp, Homo sapiens
tccctctcactccccag

SEQ ID NO: 241233 - DNA, 17 bp, Homo sapiens
tccctctcctgcccaga

SEQ ID NO: 241234 - DNA, 16 bp, Homo sapiens
tccctctcgctcccct

SEQ ID NO: 241235 - DNA, 17 bp, Homo sapiens
tccctctcgctcccctc

SEQ ID NO: 241236 - DNA, 12 bp, Homo sapiens
tccctctctctg

SEQ ID NO: 241237 - DNA, 16 bp, Homo sapiens
tccctctctctggaaa

SEQ ID NO: 241238 - DNA, 16 bp, Homo sapiens
tccctctctcttctgc

SEQ ID NO: 241239 - DNA, 20 bp, Homo sapiens
tccctctctcttctgctcca

SEQ ID NO: 241240 - DNA, 15 bp, Homo sapiens
tccctctcttccggg

SEQ ID NO: 241241 - DNA, 18 bp, Homo sapiens
tccctctcttccgggagc

SEQ ID NO: 241242 - DNA, 13 bp, Homo sapiens
tccctctgcccca

SEQ ID NO: 241243 - DNA, 20 bp, Homo sapiens
tccctctgccccaagcagcc

SEQ ID NO: 241244 - DNA, 21 bp, Homo sapiens
tccctctgccccaagcagcca

SEQ ID NO: 241245 - DNA, 11 bp, Homo sapiens
tccctctgcct

SEQ ID NO: 241246 - DNA, 18 bp, Homo sapiens
tccctctgcctgtccctc

SEQ ID NO: 241247 - DNA, 20 bp, Homo sapiens
tccctctgcctgtccctctc

SEQ ID NO: 241248 - DNA, 13 bp, Homo sapiens
tccctctgctccg

SEQ ID NO: 241249 - DNA, 23 bp, Homo sapiens
tccctctgctccgtgtgtctcat

SEQ ID NO: 241250 - DNA, 14 bp, Homo sapiens
tccctctgctctca

SEQ ID NO: 241251 - DNA, 13 bp, Homo sapiens
tccctctgttgga

SEQ ID NO: 241252 - DNA, 22 bp, Homo sapiens
tccctcttccttggttccctct

SEQ ID NO: 241253 - DNA, 13 bp, Homo sapiens
tccctctttcctg

SEQ ID NO: 241254 - DNA, 17 bp, Homo sapiens
tccctgaaaatgttttt

SEQ ID NO: 241255 - DNA, 17 bp, Homo sapiens
tccctgaagtcttgcat

SEQ ID NO: 241256 - DNA, 15 bp, Homo sapiens
tccctgaatcctctc

SEQ ID NO: 241257 - DNA, 14 bp, Homo sapiens
tccctgacccgtct

SEQ ID NO: 241258 - DNA, 16 bp, Homo sapiens
tccctgacctccctct

SEQ ID NO: 241259 - DNA, 20 bp, Homo sapiens
tccctgaccttagcgttctg

SEQ ID NO: 241260 - DNA, 21 bp, Homo sapiens
tccctgaccttagcgttctgg

SEQ ID NO: 241261 - DNA, 22 bp, Homo sapiens
tccctgagcagtctacttctgt

SEQ ID NO: 241262 - DNA, 14 bp, Homo sapiens
tccctgagcctgcc

SEQ ID NO: 241263 - DNA, 16 bp, Homo sapiens
tccctgagcctgcccc

SEQ ID NO: 241264 - DNA, 19 bp, Homo sapiens
tccctgagcctgccccagc

SEQ ID NO: 241265 - DNA, 16 bp, Homo sapiens
tccctgcacaagccag

SEQ ID NO: 241266 - DNA, 13 bp, Homo sapiens
tccctgcaccctg

SEQ ID NO: 241267 - DNA, 11 bp, Homo sapiens
tccctgcaggg

SEQ ID NO: 241268 - DNA, 24 bp, Homo sapiens
tccctgccaactccatgaccaggc

SEQ ID NO: 241269 - DNA, 21 bp, Homo sapiens
tccctgccacactcagtcccc

SEQ ID NO: 241270 - DNA, 23 bp, Homo sapiens
tccctgccacactcagtccccca

SEQ ID NO: 241271 - DNA, 15 bp, Homo sapiens
tccctgccccgcccc

SEQ ID NO: 241272 - DNA, 17 bp, Homo sapiens
tccctgccccgcccccc

SEQ ID NO: 241273 - DNA, 20 bp, Homo sapiens
tccctgccccgccccccaga

SEQ ID NO: 241274 - DNA, 20 bp, Homo sapiens
tccctgcctaggagctgggg

SEQ ID NO: 241275 - DNA, 13 bp, Homo sapiens
tccctgcctcaca

SEQ ID NO: 241276 - DNA, 16 bp, Homo sapiens
tccctgcctcacatct

SEQ ID NO: 241277 - DNA, 19 bp, Homo sapiens
tccctgcctcacatctccc

SEQ ID NO: 241278 - DNA, 15 bp, Homo sapiens
tccctgcctgctcct

SEQ ID NO: 241279 - DNA, 22 bp, Homo sapiens
tccctgcttcatatctctccct

SEQ ID NO: 241280 - DNA, 22 bp, Homo sapiens
tccctgcttgcccgctcccaca

SEQ ID NO: 241281 - DNA, 14 bp, Homo sapiens
tccctggaattcac

SEQ ID NO: 241282 - DNA, 11 bp, Homo sapiens
tccctggacca

SEQ ID NO: 241283 - DNA, 19 bp, Homo sapiens
tccctggaccagatgctga

SEQ ID NO: 241284 - DNA, 13 bp, Homo sapiens
tccctggagtcag

SEQ ID NO: 241285 - DNA, 21 bp, Homo sapiens
tccctggatgtgtggggcatg

SEQ ID NO: 241286 - DNA, 14 bp, Homo sapiens
tccctggccatctc

SEQ ID NO: 241287 - DNA, 14 bp, Homo sapiens
tccctggcctgttc

SEQ ID NO: 241288 - DNA, 18 bp, Homo sapiens
tccctggcctgttctgtt

SEQ ID NO: 241289 - DNA, 16 bp, Homo sapiens
tccctggctgcctctg

SEQ ID NO: 241290 - DNA, 14 bp, Homo sapiens
tccctgggcctgtc

SEQ ID NO: 241291 - DNA, 16 bp, Homo sapiens
tccctgggcctgtctc

SEQ ID NO: 241292 - DNA, 14 bp, Homo sapiens
tccctgtcccctga

SEQ ID NO: 241293 - DNA, 14 bp, Homo sapiens
tccctgtccctgcc

SEQ ID NO: 241294 - DNA, 14 bp, Homo sapiens
tccctgtctccagg

SEQ ID NO: 241295 - DNA, 19 bp, Homo sapiens
tccctgtcttccccacctt

SEQ ID NO: 241296 - DNA, 19 bp, Homo sapiens
tccctgtgacccgttccat

SEQ ID NO: 241297 - DNA, 20 bp, Homo sapiens
tccctgtgagagagttgctc

SEQ ID NO: 241298 - DNA, 14 bp, Homo sapiens
tccctgtggtaccc

SEQ ID NO: 241299 - DNA, 21 bp, Homo sapiens
tccctgtggtaccctggcaga

SEQ ID NO: 241300 - DNA, 22 bp, Homo sapiens
tccctgtggtaccctggcagag

SEQ ID NO: 241301 - DNA, 14 bp, Homo sapiens
tccctgttctttaa

SEQ ID NO: 241302 - DNA, 18 bp, Homo sapiens
tcccttacgtgagtcctg

SEQ ID NO: 241303 - DNA, 22 bp, Homo sapiens
tcccttacgtgagtcctggcat

SEQ ID NO: 241304 - DNA, 19 bp, Homo sapiens
tcccttactattcccactt

SEQ ID NO: 241305 - DNA, 20 bp, Homo sapiens
tcccttagccccgagtttaa

SEQ ID NO: 241306 - DNA, 11 bp, Homo sapiens
tcccttcaacc

SEQ ID NO: 241307 - DNA, 21 bp, Homo sapiens
tcccttcactcaagcttggct

SEQ ID NO: 241308 - DNA, 22 bp, Homo sapiens
tcccttccacctcacaactcct

SEQ ID NO: 241309 - DNA, 19 bp, Homo sapiens
tcccttccactgcctctgc

SEQ ID NO: 241310 - DNA, 16 bp, Homo sapiens
tcccttcccagtgggc

SEQ ID NO: 241311 - DNA, 17 bp, Homo sapiens
tcccttcccagtgggct

SEQ ID NO: 241312 - DNA, 22 bp, Homo sapiens
tcccttcccagtgggctgtgtt

SEQ ID NO: 241313 - DNA, 15 bp, Homo sapiens
tcccttcccctgcct

SEQ ID NO: 241314 - DNA, 14 bp, Homo sapiens
tcccttcccctgtg

SEQ ID NO: 241315 - DNA, 15 bp, Homo sapiens
tcccttctcacagca

SEQ ID NO: 241316 - DNA, 16 bp, Homo sapiens
tcccttctcacagcac

SEQ ID NO: 241317 - DNA, 13 bp, Homo sapiens
tcccttctcagaa

SEQ ID NO: 241318 - DNA, 13 bp, Homo sapiens
tcccttctccttc

SEQ ID NO: 241319 - DNA, 20 bp, Homo sapiens
tcccttctctgtagggaact

SEQ ID NO: 241320 - DNA, 19 bp, Homo sapiens
tcccttctggacactgaga

SEQ ID NO: 241321 - DNA, 16 bp, Homo sapiens
tcccttgacctttcca

SEQ ID NO: 241322 - DNA, 17 bp, Homo sapiens
tcccttgacctttccag

SEQ ID NO: 241323 - DNA, 19 bp, Homo sapiens
tcccttgctcagtgcctcc

SEQ ID NO: 241324 - DNA, 20 bp, Homo sapiens
tcccttgctcagtgcctcct

SEQ ID NO: 241325 - DNA, 20 bp, Homo sapiens
tcccttggaaacctgccctg

SEQ ID NO: 241326 - DNA, 23 bp, Homo sapiens
tcccttggaaacctgccctgcct

SEQ ID NO: 241327 - DNA, 12 bp, Homo sapiens
tcccttggccac

SEQ ID NO: 241328 - DNA, 19 bp, Homo sapiens
tcccttggccacggcctgg

SEQ ID NO: 241329 - DNA, 21 bp, Homo sapiens
tcccttggccacggcctggga

SEQ ID NO: 241330 - DNA, 13 bp, Homo sapiens
tcccttggcccct

SEQ ID NO: 241331 - DNA, 17 bp, Homo sapiens
tcccttggcccctctct

SEQ ID NO: 241332 - DNA, 13 bp, Homo sapiens
tcccttggcctca

SEQ ID NO: 241333 - DNA, 13 bp, Homo sapiens
tcccttgtgtctg

SEQ ID NO: 241334 - DNA, 18 bp, Homo sapiens
tcccttgtgtctgttgct

SEQ ID NO: 241335 - DNA, 14 bp, Homo sapiens
tccctttccctacc

SEQ ID NO: 241336 - DNA, 23 bp, Homo sapiens
tccctttccttccatccctaccc

SEQ ID NO: 241337 - DNA, 19 bp, Homo sapiens
tccctttctgcttgtgtta

SEQ ID NO: 241338 - DNA, 13 bp, Homo sapiens
tccctttcttggc

SEQ ID NO: 241339 - DNA, 21 bp, Homo sapiens
tccctttcttggccagttatc

SEQ ID NO: 241340 - DNA, 14 bp, Homo sapiens
tccctttgctccac

SEQ ID NO: 241341 - DNA, 19 bp, Homo sapiens
tccctttgctccaccccac

SEQ ID NO: 241342 - DNA, 17 bp, Homo sapiens
tccctttgttgctgtct

SEQ ID NO: 241343 - DNA, 22 bp, Homo sapiens
tccctttttgagtaattttctg

SEQ ID NO: 241344 - DNA, 16 bp, Homo sapiens
tcccttttttcttccc

SEQ ID NO: 241345 - DNA, 19 bp, Homo sapiens
tccgaagaccttctgaaga

SEQ ID NO: 241346 - DNA, 20 bp, Homo sapiens
tccgaccactaattgccaag

SEQ ID NO: 241347 - DNA, 14 bp, Homo sapiens
tccgagggcggcca

SEQ ID NO: 241348 - DNA, 18 bp, Homo sapiens
tccgagggcggccaggga

SEQ ID NO: 241349 - DNA, 21 bp, Homo sapiens
tccgagggcggccagggacag

SEQ ID NO: 241350 - DNA, 14 bp, Homo sapiens
tccgcaccagctgc

SEQ ID NO: 241351 - DNA, 15 bp, Homo sapiens
tccgcaccagctgct

SEQ ID NO: 241352 - DNA, 21 bp, Homo sapiens
tccgcaccagctgctctgccc

SEQ ID NO: 241353 - DNA, 16 bp, Homo sapiens
tccgccagacctcaac

SEQ ID NO: 241354 - DNA, 15 bp, Homo sapiens
tccgccattccaagt

SEQ ID NO: 241355 - DNA, 13 bp, Homo sapiens
tccgcccagcctc

SEQ ID NO: 241356 - DNA, 16 bp, Homo sapiens
tccgcccagcctctcc

SEQ ID NO: 241357 - DNA, 17 bp, Homo sapiens
tccgcccgcccaccccg

SEQ ID NO: 241358 - DNA, 20 bp, Homo sapiens
tccgcccgcccaccccgctg

SEQ ID NO: 241359 - DNA, 21 bp, Homo sapiens
tccgcccgcccaccccgctgc

SEQ ID NO: 241360 - DNA, 11 bp, Homo sapiens
tccgccctggg

SEQ ID NO: 241361 - DNA, 17 bp, Homo sapiens
tccgcctctgctggcac

SEQ ID NO: 241362 - DNA, 16 bp, Homo sapiens
tccgctctctcatgtg

SEQ ID NO: 241363 - DNA, 20 bp, Homo sapiens
tccgctctgaggcaaccccc

SEQ ID NO: 241364 - DNA, 14 bp, Homo sapiens
tccgctgccaccac

SEQ ID NO: 241365 - DNA, 22 bp, Homo sapiens
tccgctgccaccacgtctgcca

SEQ ID NO: 241366 - DNA, 19 bp, Homo sapiens
tccgctgcgggcccagctg

SEQ ID NO: 241367 - DNA, 20 bp, Homo sapiens
tccgctgcgggcccagctga

SEQ ID NO: 241368 - DNA, 14 bp, Homo sapiens
tccgctgctgcttt

SEQ ID NO: 241369 - DNA, 15 bp, Homo sapiens
tccgctgtcacccag

SEQ ID NO: 241370 - DNA, 22 bp, Homo sapiens
tccggaatcctgtcctcagctt

SEQ ID NO: 241371 - DNA, 14 bp, Homo sapiens
tccggcagaggcag

SEQ ID NO: 241372 - DNA, 19 bp, Homo sapiens
tccggcatgagggctgaga

SEQ ID NO: 241373 - DNA, 13 bp, Homo sapiens
tccggccctggct

SEQ ID NO: 241374 - DNA, 15 bp, Homo sapiens
tccggcctgcagccc

SEQ ID NO: 241375 - DNA, 19 bp, Homo sapiens
tccgggagagcggctgccc

SEQ ID NO: 241376 - DNA, 12 bp, Homo sapiens
tccgggagctgg

SEQ ID NO: 241377 - DNA, 14 bp, Homo sapiens
tccgggagctggtg

SEQ ID NO: 241378 - DNA, 21 bp, Homo sapiens
tccgggagctggtgacagcct

SEQ ID NO: 241379 - DNA, 11 bp, Homo sapiens
tccgggcaggg

SEQ ID NO: 241380 - DNA, 15 bp, Homo sapiens
tccggggaggagcct

SEQ ID NO: 241381 - DNA, 20 bp, Homo sapiens
tccggggaggagccttggag

SEQ ID NO: 241382 - DNA, 16 bp, Homo sapiens
tccggggtctgtgctg

SEQ ID NO: 241383 - DNA, 21 bp, Homo sapiens
tccggggtctgtgctgtgcct

SEQ ID NO: 241384 - DNA, 15 bp, Homo sapiens
tccggtgtgagccca

SEQ ID NO: 241385 - DNA, 18 bp, Homo sapiens
tccggtgtgagcccacct

SEQ ID NO: 241386 - DNA, 22 bp, Homo sapiens
tccgtcacccttggtagagttt

SEQ ID NO: 241387 - DNA, 13 bp, Homo sapiens
tccgtccacccag

SEQ ID NO: 241388 - DNA, 15 bp, Homo sapiens
tccgtccacccaggc

SEQ ID NO: 241389 - DNA, 22 bp, Homo sapiens
tccgtccactacgctcctgtct

SEQ ID NO: 241390 - DNA, 22 bp, Homo sapiens
tccgtccccagggtgcaggcgc

SEQ ID NO: 241391 - DNA, 12 bp, Homo sapiens
tccgtccgcccg

SEQ ID NO: 241392 - DNA, 14 bp, Homo sapiens
tccgtcctggcagg

SEQ ID NO: 241393 - DNA, 15 bp, Homo sapiens
tccgtgagacacaag

SEQ ID NO: 241394 - DNA, 20 bp, Homo sapiens
tccgtgagtgaaccatcatt

SEQ ID NO: 241395 - DNA, 18 bp, Homo sapiens
tccgtgatccatccatct

SEQ ID NO: 241396 - DNA, 19 bp, Homo sapiens
tccgtggccccgccctcag

SEQ ID NO: 241397 - DNA, 20 bp, Homo sapiens
tccgtggccccgccctcagg

SEQ ID NO: 241398 - DNA, 22 bp, Homo sapiens
tccgtgggtcatcccagcacct

SEQ ID NO: 241399 - DNA, 13 bp, Homo sapiens
tccgtgtggagca

SEQ ID NO: 241400 - DNA, 19 bp, Homo sapiens
tccgttaacctttttgtaa

SEQ ID NO: 241401 - DNA, 12 bp, Homo sapiens
tccgttaggaat

SEQ ID NO: 241402 - DNA, 19 bp, Homo sapiens
tccgttcccacctctgagg

SEQ ID NO: 241403 - DNA, 16 bp, Homo sapiens
tcctaaaaatctgtgg

SEQ ID NO: 241404 - DNA, 18 bp, Homo sapiens
tcctaaaaatctgtggca

SEQ ID NO: 241405 - DNA, 21 bp, Homo sapiens
tcctaaaagttttaacctcag

SEQ ID NO: 241406 - DNA, 17 bp, Homo sapiens
tcctaaagtgaagaagc

SEQ ID NO: 241407 - DNA, 20 bp, Homo sapiens
tcctctctccctgcctcaca

SEQ ID NO: 241408 - DNA, 15 bp, Homo sapiens
tcctctctctccctc

SEQ ID NO: 241409 - DNA, 12 bp, Homo sapiens
tcctctctgctg

SEQ ID NO: 241410 - DNA, 15 bp, Homo sapiens
tcctctgaatattaa

SEQ ID NO: 241411 - DNA, 13 bp, Homo sapiens
tcctctgagcagc

SEQ ID NO: 241412 - DNA, 18 bp, Homo sapiens
tcctctgagcagcctctg

SEQ ID NO: 241413 - DNA, 19 bp, Homo sapiens
tcctctgagcagcctctgc

SEQ ID NO: 241414 - DNA, 16 bp, Homo sapiens
tcctctgagctgttat

SEQ ID NO: 241415 - DNA, 14 bp, Homo sapiens
tcctctgcagcctg

SEQ ID NO: 241416 - DNA, 16 bp, Homo sapiens
tcctctgcagctgacc

SEQ ID NO: 241417 - DNA, 12 bp, Homo sapiens
tcctctgccccc

SEQ ID NO: 241418 - DNA, 14 bp, Homo sapiens
tcctctgccccctc

SEQ ID NO: 241419 - DNA, 18 bp, Homo sapiens
tcctctgccccctccccc

SEQ ID NO: 241420 - DNA, 19 bp, Homo sapiens
tcctctgccccctcccccg

SEQ ID NO: 241421 - DNA, 23 bp, Homo sapiens
tcctctgccccctcccccgcaga

SEQ ID NO: 241422 - DNA, 11 bp, Homo sapiens
tcctctgcctt

SEQ ID NO: 241423 - DNA, 15 bp, Homo sapiens
tcctctgccttggac

SEQ ID NO: 241424 - DNA, 22 bp, Homo sapiens
tcctctgccttggacaccatcc

SEQ ID NO: 241425 - DNA, 11 bp, Homo sapiens
tcctctggagc

SEQ ID NO: 241426 - DNA, 23 bp, Homo sapiens
tcctctggggaagggaaccagcc

SEQ ID NO: 241427 - DNA, 15 bp, Homo sapiens
tcctctgtcagtcat

SEQ ID NO: 241428 - DNA, 19 bp, Homo sapiens
tcctctgtcagtttgtgaa

SEQ ID NO: 241429 - DNA, 22 bp, Homo sapiens
tcctctgtccaggcactgctgc

SEQ ID NO: 241430 - DNA, 18 bp, Homo sapiens
tctgatgctaggttgttt

SEQ ID NO: 241431 - DNA, 16 bp, Homo sapiens
tctgatggtgagctgg

SEQ ID NO: 241432 - DNA, 18 bp, Homo sapiens
tctgatggtgagctggga

SEQ ID NO: 241433 - DNA, 14 bp, Homo sapiens
tctgatgtctctaa

SEQ ID NO: 241434 - DNA, 21 bp, Homo sapiens
tctgatgttttgatgccattt

SEQ ID NO: 241435 - DNA, 21 bp, Homo sapiens
tctgattaaatttaatatact

SEQ ID NO: 241436 - DNA, 17 bp, Homo sapiens
tctgattaatccatttt

SEQ ID NO: 241437 - DNA, 13 bp, Homo sapiens
tctgattatcagg

SEQ ID NO: 241438 - DNA, 13 bp, Homo sapiens
tctgattctatgc

SEQ ID NO: 241439 - DNA, 19 bp, Homo sapiens
tctgattggacattttctt

SEQ ID NO: 241440 - DNA, 21 bp, Homo sapiens
tctgattggacattttcttca

SEQ ID NO: 241441 - DNA, 17 bp, Homo sapiens
tctgatttgcaaatgca

SEQ ID NO: 241442 - DNA, 20 bp, Homo sapiens
tctgatttgtccctatgcat

SEQ ID NO: 241443 - DNA, 23 bp, Homo sapiens
tctgcaaaggagggcctcagaga

SEQ ID NO: 241444 - DNA, 19 bp, Homo sapiens
tctgcaacatggattccaa

SEQ ID NO: 241445 - DNA, 16 bp, Homo sapiens
tctgcaactagccaag

SEQ ID NO: 241446 - DNA, 17 bp, Homo sapiens
tctgcaactagccaagg

SEQ ID NO: 241447 - DNA, 20 bp, Homo sapiens
tctgcaactcatgaacaaaa

SEQ ID NO: 241448 - DNA, 19 bp, Homo sapiens
tctgcaagcccactggcca

SEQ ID NO: 241449 - DNA, 21 bp, Homo sapiens
tctgcaatgtttttgtgtaga

SEQ ID NO: 241450 - DNA, 10 bp, Homo sapiens
tctgcacaga

SEQ ID NO: 241451 - DNA, 21 bp, Homo sapiens
tctgcacctatgtagctctgc

SEQ ID NO: 241452 - DNA, 19 bp, Homo sapiens
tctgcactactcctctgca

SEQ ID NO: 241453 - DNA, 21 bp, Homo sapiens
tctgcactactcctctgcagt

SEQ ID NO: 241454 - DNA, 20 bp, Homo sapiens
tctgcactccatggccaccc

SEQ ID NO: 241455 - DNA, 21 bp, Homo sapiens
tctgcactccatggccacccc

SEQ ID NO: 241456 - DNA, 15 bp, Homo sapiens
tctgcagaaacagaa

SEQ ID NO: 241457 - DNA, 17 bp, Homo sapiens
tctgcagactcgttctc

SEQ ID NO: 241458 - DNA, 12 bp, Homo sapiens
tctgcagagact

SEQ ID NO: 241459 - DNA, 12 bp, Homo sapiens
tctgcagagcag

SEQ ID NO: 241460 - DNA, 12 bp, Homo sapiens
tctgcagaggca

SEQ ID NO: 241461 - DNA, 18 bp, Homo sapiens
tctgcagaggcagcagga

SEQ ID NO: 241462 - DNA, 20 bp, Homo sapiens
tctgcagaggcagcaggagc

SEQ ID NO: 241463 - DNA, 16 bp, Homo sapiens
tctgcagcatgacctg

SEQ ID NO: 241464 - DNA, 14 bp, Homo sapiens
tctgcagcccacag

SEQ ID NO: 241465 - DNA, 18 bp, Homo sapiens
tctgcagcccacagagga

SEQ ID NO: 241466 - DNA, 21 bp, Homo sapiens
tctgcagcccacagaggacag

SEQ ID NO: 241467 - DNA, 11 bp, Homo sapiens
tctgcagccct

SEQ ID NO: 241468 - DNA, 17 bp, Homo sapiens
tctgcagcccttgggca

SEQ ID NO: 241469 - DNA, 15 bp, Homo sapiens
tctgcagcctgagct

SEQ ID NO: 241470 - DNA, 23 bp, Homo sapiens
tctgcagcctgagctccaccctc

SEQ ID NO: 241471 - DNA, 13 bp, Homo sapiens
tctgcagctgacc

SEQ ID NO: 241472 - DNA, 14 bp, Homo sapiens
tctgcaggacacag

SEQ ID NO: 241473 - DNA, 14 bp, Homo sapiens
tctgcaggccacca

SEQ ID NO: 241474 - DNA, 21 bp, Homo sapiens
tctgcaggccaccagctgctg

SEQ ID NO: 241475 - DNA, 14 bp, Homo sapiens
tctgcagggcagcc

SEQ ID NO: 241476 - DNA, 22 bp, Homo sapiens
tctgcagggcagcctgtgggag

SEQ ID NO: 241477 - DNA, 12 bp, Homo sapiens
tctgcagtcctg

SEQ ID NO: 241478 - DNA, 13 bp, Homo sapiens
tctgcagtcctgg

SEQ ID NO: 241479 - DNA, 15 bp, Homo sapiens
tctgcatagacaaag

SEQ ID NO: 241480 - DNA, 16 bp, Homo sapiens
tctgcatcatctgtag

SEQ ID NO: 241481 - DNA, 19 bp, Homo sapiens
tctgcatcatctgtagata

SEQ ID NO: 241482 - DNA, 16 bp, Homo sapiens
tctgcatggcagaagc

SEQ ID NO: 241483 - DNA, 23 bp, Homo sapiens
tctgcatgtaaaatcttcagctg

SEQ ID NO: 241484 - DNA, 17 bp, Homo sapiens
tctgcattcaggatcaa

SEQ ID NO: 241485 - DNA, 13 bp, Homo sapiens
tctgcatttagca

SEQ ID NO: 241486 - DNA, 15 bp, Homo sapiens
tctgcatttagcaca

SEQ ID NO: 241487 - DNA, 23 bp, Homo sapiens
tctgcatttataaatgtgtggtg

SEQ ID NO: 241488 - DNA, 18 bp, Homo sapiens
tctgcattttctcaggca

SEQ ID NO: 241489 - DNA, 16 bp, Homo sapiens
tctgcattttctgggt

SEQ ID NO: 241490 - DNA, 15 bp, Homo sapiens
tctgccacccactca

SEQ ID NO: 241491 - DNA, 18 bp, Homo sapiens
tctgccacccactcagga

SEQ ID NO: 241492 - DNA, 21 bp, Homo sapiens
tctgccacccactcaggattg

SEQ ID NO: 241493 - DNA, 17 bp, Homo sapiens
tctgccacttgcactgt

SEQ ID NO: 241494 - DNA, 16 bp, Homo sapiens
tctgccaggcccatct

SEQ ID NO: 241495 - DNA, 16 bp, Homo sapiens
tctgccatcagcccct

SEQ ID NO: 241496 - DNA, 23 bp, Homo sapiens
tctgccatcagcccctgctgctc

SEQ ID NO: 241497 - DNA, 12 bp, Homo sapiens
tctgccatgtgg

SEQ ID NO: 241498 - DNA, 15 bp, Homo sapiens
tctgccatgtggcag

SEQ ID NO: 241499 - DNA, 16 bp, Homo sapiens
tctgcccaccgacccc

SEQ ID NO: 241500 - DNA, 18 bp, Homo sapiens
tctgcccagagctgggtg

SEQ ID NO: 241501 - DNA, 19 bp, Homo sapiens
tctgccccaagcagccagc

SEQ ID NO: 241502 - DNA, 21 bp, Homo sapiens
tctgccccaagcagccagcca

SEQ ID NO: 241503 - DNA, 22 bp, Homo sapiens
tctgccccaagcagccagccag

SEQ ID NO: 241504 - DNA, 22 bp, Homo sapiens
tctgccccaagcccccaacccc

SEQ ID NO: 241505 - DNA, 21 bp, Homo sapiens
tctgccccaatcgggtccaga

SEQ ID NO: 241506 - DNA, 12 bp, Homo sapiens
tctgccccaccc

SEQ ID NO: 241507 - DNA, 15 bp, Homo sapiens
tctgccccctccccc

SEQ ID NO: 241508 - DNA, 24 bp, Homo sapiens
tctgccccctcccccgcagacaga

SEQ ID NO: 241509 - DNA, 13 bp, Homo sapiens
tctgcccctcccc

SEQ ID NO: 241510 - DNA, 14 bp, Homo sapiens
tctgcccctccccc

SEQ ID NO: 241511 - DNA, 15 bp, Homo sapiens
tctgcccctccccca

SEQ ID NO: 241512 - DNA, 22 bp, Homo sapiens
tctgcccctcccccaaccccca

SEQ ID NO: 241513 - DNA, 12 bp, Homo sapiens
tctgcccctccg

SEQ ID NO: 241514 - DNA, 20 bp, Homo sapiens
tctgcccctccgtccccagg

SEQ ID NO: 241515 - DNA, 21 bp, Homo sapiens
tctgcccctccgtccccaggg

SEQ ID NO: 241516 - DNA, 19 bp, Homo sapiens
tctgccccttctgtttcca

SEQ ID NO: 241517 - DNA, 20 bp, Homo sapiens
tctgccccttgaccccacac

SEQ ID NO: 241518 - DNA, 22 bp, Homo sapiens
tctgccccttgggcatccaccc

SEQ ID NO: 241519 - DNA, 14 bp, Homo sapiens
tctgcccgcagagc

SEQ ID NO: 241520 - DNA, 21 bp, Homo sapiens
tctgcccgcagagcccacgcc

SEQ ID NO: 241521 - DNA, 16 bp, Homo sapiens
tctggaggcctctggg

SEQ ID NO: 241522 - DNA, 17 bp, Homo sapiens
tctggaggcctctgggc

SEQ ID NO: 241523 - DNA, 13 bp, Homo sapiens
tctggagtctgaa

SEQ ID NO: 241524 - DNA, 15 bp, Homo sapiens
tctggagtgtgtggg

SEQ ID NO: 241525 - DNA, 20 bp, Homo sapiens
tctggatggccgggctgctg

SEQ ID NO: 241526 - DNA, 23 bp, Homo sapiens
tctggatggccgggctgctgctg

SEQ ID NO: 241527 - DNA, 20 bp, Homo sapiens
tctggcattctacacctgga

SEQ ID NO: 241528 - DNA, 19 bp, Homo sapiens
tctggccacaatcctcccc

SEQ ID NO: 241529 - DNA, 18 bp, Homo sapiens
tctggccaccctggcccg

SEQ ID NO: 241530 - DNA, 19 bp, Homo sapiens
tctggccaggatggagggg

SEQ ID NO: 241531 - DNA, 17 bp, Homo sapiens
tctggccaggcactgcc

SEQ ID NO: 241532 - DNA, 18 bp, Homo sapiens
tctggccaggcactgcct

SEQ ID NO: 241533 - DNA, 23 bp, Homo sapiens
tctggccaggcactgccttctcc

SEQ ID NO: 241534 - DNA, 21 bp, Homo sapiens
tctggccctgttgtgggggtg

SEQ ID NO: 241535 - DNA, 20 bp, Homo sapiens
tctggcctcagaccaactct

SEQ ID NO: 241536 - DNA, 14 bp, Homo sapiens
tctggcctgccagg

SEQ ID NO: 241537 - DNA, 16 bp, Homo sapiens
tctggcctggcctggc

SEQ ID NO: 241538 - DNA, 17 bp, Homo sapiens
tctggcctggcctggcc

SEQ ID NO: 241539 - DNA, 20 bp, Homo sapiens
tctggcctggcctggccctg

SEQ ID NO: 241540 - DNA, 22 bp, Homo sapiens
tctggcctggcctggccctgcc

SEQ ID NO: 241541 - DNA, 23 bp, Homo sapiens
tctggcctggcctggccctgccc

SEQ ID NO: 241542 - DNA, 19 bp, Homo sapiens
tctggccttggttcctcca

SEQ ID NO: 241543 - DNA, 20 bp, Homo sapiens
tctggccttggttcctccag

SEQ ID NO: 241544 - DNA, 22 bp, Homo sapiens
tctggccttggttcctccagca

SEQ ID NO: 241545 - DNA, 14 bp, Homo sapiens
tctggcgagccctt

SEQ ID NO: 241546 - DNA, 18 bp, Homo sapiens
tctggcgagcccttagcc

SEQ ID NO: 241547 - DNA, 19 bp, Homo sapiens
tctggcgagcccttagcct

SEQ ID NO: 241548 - DNA, 20 bp, Homo sapiens
tctggcgagcccttagcctt

SEQ ID NO: 241549 - DNA, 15 bp, Homo sapiens
tctggctaaggcatc

SEQ ID NO: 241550 - DNA, 23 bp, Homo sapiens
tctggctaggggccgagtccagg

SEQ ID NO: 241551 - DNA, 19 bp, Homo sapiens
tctggctcagggcccacct

SEQ ID NO: 241552 - DNA, 23 bp, Homo sapiens
tctggctcagggcccacctcctc

SEQ ID NO: 241553 - DNA, 15 bp, Homo sapiens
tctggctccctggga

SEQ ID NO: 241554 - DNA, 12 bp, Homo sapiens
tctggctcctgt

SEQ ID NO: 241555 - DNA, 14 bp, Homo sapiens
tctggctcctgttt

SEQ ID NO: 241556 - DNA, 22 bp, Homo sapiens
tctggctgccccaacctgctga

SEQ ID NO: 241557 - DNA, 19 bp, Homo sapiens
tctggctgcctggcccagg

SEQ ID NO: 241558 - DNA, 22 bp, Homo sapiens
tctggctggagaggaaaagcca

SEQ ID NO: 241559 - DNA, 20 bp, Homo sapiens
tctggctgtacgtctggtgt

SEQ ID NO: 241560 - DNA, 18 bp, Homo sapiens
tctggctgtggcccctcc

SEQ ID NO: 241561 - DNA, 16 bp, Homo sapiens
tctggcttctgcatta

SEQ ID NO: 241562 - DNA, 15 bp, Homo sapiens
tctgggaaagcagag

SEQ ID NO: 241563 - DNA, 15 bp, Homo sapiens
tctgggaaaggtgct

SEQ ID NO: 241564 - DNA, 17 bp, Homo sapiens
tctgggaaaggtgctca

SEQ ID NO: 241565 - DNA, 19 bp, Homo sapiens
tctgggaaaggtgctcaaa

SEQ ID NO: 241566 - DNA, 20 bp, Homo sapiens
tctgggaaaggtgctcaaag

SEQ ID NO: 241567 - DNA, 18 bp, Homo sapiens
tctgggaactgtgccttt

SEQ ID NO: 241568 - DNA, 13 bp, Homo sapiens
tctgggaagggag

SEQ ID NO: 241569 - DNA, 13 bp, Homo sapiens
tctgggacttcct

SEQ ID NO: 241570 - DNA, 13 bp, Homo sapiens
tctgggagaggat

SEQ ID NO: 241571 - DNA, 15 bp, Homo sapiens
tctgggagaggattt

SEQ ID NO: 241572 - DNA, 16 bp, Homo sapiens
tctgggagaggatttt

SEQ ID NO: 241573 - DNA, 13 bp, Homo sapiens
tctgggaggcagg

SEQ ID NO: 241574 - DNA, 16 bp, Homo sapiens
tctgggaggggtgctg

SEQ ID NO: 241575 - DNA, 21 bp, Homo sapiens
tctgggagtgttctgtttccc

SEQ ID NO: 241576 - DNA, 13 bp, Homo sapiens
tctgggatattta

SEQ ID NO: 241577 - DNA, 15 bp, Homo sapiens
tctgggatatttaac

SEQ ID NO: 241578 - DNA, 22 bp, Homo sapiens
tctgggatgtagaacttcaaga

SEQ ID NO: 241579 - DNA, 14 bp, Homo sapiens
tctgggcagagcct

SEQ ID NO: 241580 - DNA, 19 bp, Homo sapiens
tctgggcagagcctgtccc

SEQ ID NO: 241581 - DNA, 19 bp, Homo sapiens
tctgggcaggacctcagag

SEQ ID NO: 241582 - DNA, 19 bp, Homo sapiens
tctgggccagaagtcctcc

SEQ ID NO: 241583 - DNA, 22 bp, Homo sapiens
tctgggccctgcaggaggcctg

SEQ ID NO: 241584 - DNA, 23 bp, Homo sapiens
tctgggccctgcaggaggcctgg

SEQ ID NO: 241585 - DNA, 15 bp, Homo sapiens
tctgggcctctgact

SEQ ID NO: 241586 - DNA, 16 bp, Homo sapiens
tctgggcctgatggag

SEQ ID NO: 241587 - DNA, 12 bp, Homo sapiens
tctgggcctggg

SEQ ID NO: 241588 - DNA, 18 bp, Homo sapiens
tctgggctcagggctgga

SEQ ID NO: 241589 - DNA, 14 bp, Homo sapiens
tctgggctggcaga

SEQ ID NO: 241590 - DNA, 21 bp, Homo sapiens
tctgggcttggggcttcctaa

SEQ ID NO: 241591 - DNA, 12 bp, Homo sapiens
tctggggaagga

SEQ ID NO: 241592 - DNA, 16 bp, Homo sapiens
tctggggatggagaat

SEQ ID NO: 241593 - DNA, 22 bp, Homo sapiens
tctggggatggagaatgccagc

SEQ ID NO: 241594 - DNA, 18 bp, Homo sapiens
tctggggatttctgggat

SEQ ID NO: 241595 - DNA, 13 bp, Homo sapiens
tctggggcccctt

SEQ ID NO: 241596 - DNA, 14 bp, Homo sapiens
tctggggctctagg

SEQ ID NO: 241597 - DNA, 15 bp, Homo sapiens
tctggggctctggga

SEQ ID NO: 241598 - DNA, 13 bp, Homo sapiens
tctgggggtcagg

SEQ ID NO: 241599 - DNA, 20 bp, Homo sapiens
tctggggtggggcttggaag

SEQ ID NO: 241600 - DNA, 16 bp, Homo sapiens
tctgggtatctttcca

SEQ ID NO: 241601 - DNA, 15 bp, Homo sapiens
tctgggtgatttcta

SEQ ID NO: 241602 - DNA, 16 bp, Homo sapiens
tctgggtggtaactgc

SEQ ID NO: 241603 - DNA, 21 bp, Homo sapiens
tctgggtggtaactgccagcc

SEQ ID NO: 241604 - DNA, 16 bp, Homo sapiens
tctgggtggttgccct

SEQ ID NO: 241605 - DNA, 23 bp, Homo sapiens
tctgggttctcttcattcccact

SEQ ID NO: 241606 - DNA, 13 bp, Homo sapiens
tctgggttctggg

SEQ ID NO: 241607 - DNA, 15 bp, Homo sapiens
tctgggttctgggtg

SEQ ID NO: 241608 - DNA, 18 bp, Homo sapiens
tctgggtttacaacaaac

SEQ ID NO: 241609 - DNA, 16 bp, Homo sapiens
tctggtagatagaaat

SEQ ID NO: 241610 - DNA, 20 bp, Homo sapiens
tctggtaggaatagcatgtc

SEQ ID NO: 241611 - DNA, 23 bp, Homo sapiens
tctggtatgaacttgaggacaca

SEQ ID NO: 241612 - DNA, 23 bp, Homo sapiens
tctggtcaaagaaagaaagttta

SEQ ID NO: 241613 - DNA, 16 bp, Homo sapiens
tctggtccacacacca

SEQ ID NO: 241614 - DNA, 14 bp, Homo sapiens
tctggtctgggtgc

SEQ ID NO: 241615 - DNA, 13 bp, Homo sapiens
tctggtgcatgtt

SEQ ID NO: 241616 - DNA, 14 bp, Homo sapiens
tctggtgcatgttc

SEQ ID NO: 241617 - DNA, 15 bp, Homo sapiens
tctggtgcgtgtggc

SEQ ID NO: 241618 - DNA, 12 bp, Homo sapiens
tctggtggcccc

SEQ ID NO: 241619 - DNA, 15 bp, Homo sapiens
tctggttagctcagc

SEQ ID NO: 241620 - DNA, 16 bp, Homo sapiens
tctggttagctcagcc

SEQ ID NO: 241621 - DNA, 22 bp, Homo sapiens
tctggttagctcagccccagcc

SEQ ID NO: 241622 - DNA, 14 bp, Homo sapiens
tctggttccactca

SEQ ID NO: 241623 - DNA, 17 bp, Homo sapiens
tctggttccactcagct

SEQ ID NO: 241624 - DNA, 20 bp, Homo sapiens
tctggttgtatttctatatt

SEQ ID NO: 241625 - DNA, 14 bp, Homo sapiens
tctgtaaaaaagaa

SEQ ID NO: 241626 - DNA, 20 bp, Homo sapiens
tctgtaaaaaagaaaaacaa

SEQ ID NO: 241627 - DNA, 15 bp, Homo sapiens
tctgtaaactcaaaa

SEQ ID NO: 241628 - DNA, 13 bp, Homo sapiens
tctgtaaataacc

SEQ ID NO: 241629 - DNA, 15 bp, Homo sapiens
tctgtaaatatccca

SEQ ID NO: 241630 - DNA, 19 bp, Homo sapiens
tctgtaaatttaactgcat

SEQ ID NO: 241631 - DNA, 22 bp, Homo sapiens
tctgtaaatttaactgcatata

SEQ ID NO: 241632 - DNA, 20 bp, Homo sapiens
tctgtaaccacctctctgtc

SEQ ID NO: 241633 - DNA, 21 bp, Homo sapiens
tctgtaaccacctctctgtct

SEQ ID NO: 241634 - DNA, 21 bp, Homo sapiens
tctgtaagctctttgaaacaa

SEQ ID NO: 241635 - DNA, 21 bp, Homo sapiens
tctgtaatcacactctcttct

SEQ ID NO: 241636 - DNA, 19 bp, Homo sapiens
tctgtagaatgctgtagaa

SEQ ID NO: 241637 - DNA, 18 bp, Homo sapiens
tctgtagagccttctgat

SEQ ID NO: 241638 - DNA, 20 bp, Homo sapiens
tctgtagaggagcctggagt

SEQ ID NO: 241639 - DNA, 21 bp, Homo sapiens
tctgtagctattctttgacca

SEQ ID NO: 241640 - DNA, 14 bp, Homo sapiens
tctgtagctccctc

SEQ ID NO: 241641 - DNA, 20 bp, Homo sapiens
tctgtagctccctcctccca

SEQ ID NO: 241642 - DNA, 21 bp, Homo sapiens
tctgtagctccctcctcccat

SEQ ID NO: 241643 - DNA, 22 bp, Homo sapiens
tctgtagctccctcctcccatc

SEQ ID NO: 241644 - DNA, 19 bp, Homo sapiens
tctgtagggaactctgggg

SEQ ID NO: 241645 - DNA, 18 bp, Homo sapiens
tcttaaaaattatcttta

SEQ ID NO: 241646 - DNA, 23 bp, Homo sapiens
tcttaaaagttgtgattccagat

SEQ ID NO: 241647 - DNA, 20 bp, Homo sapiens
tcttaaaattcaagaaaata

SEQ ID NO: 241648 - DNA, 19 bp, Homo sapiens
tcttaaagctgcctgtagt

SEQ ID NO: 241649 - DNA, 23 bp, Homo sapiens
tcttaaagctgcctgtagttagg

SEQ ID NO: 241650 - DNA, 14 bp, Homo sapiens
tcttaaaggcctgg

SEQ ID NO: 241651 - DNA, 20 bp, Homo sapiens
tcttaaatgaagtgcccact

SEQ ID NO: 241652 - DNA, 23 bp, Homo sapiens
tcttaaatggaattattttgaat

SEQ ID NO: 241653 - DNA, 14 bp, Homo sapiens
tcttaaattttgtg

SEQ ID NO: 241654 - DNA, 18 bp, Homo sapiens
tcttaaattttgtgatat

SEQ ID NO: 241655 - DNA, 15 bp, Homo sapiens
tcttaacaatttctg

SEQ ID NO: 241656 - DNA, 16 bp, Homo sapiens
tcttaagcactttgaa

SEQ ID NO: 241657 - DNA, 15 bp, Homo sapiens
tcttaatataactgc

SEQ ID NO: 241658 - DNA, 18 bp, Homo sapiens
tcttaatataactgcctt

SEQ ID NO: 241659 - DNA, 16 bp, Homo sapiens
tcttaatctttatttt

SEQ ID NO: 241660 - DNA, 18 bp, Homo sapiens
tcttaattctgatgctag

SEQ ID NO: 241661 - DNA, 23 bp, Homo sapiens
tcttaatttaatcttttttatgt

SEQ ID NO: 241662 - DNA, 13 bp, Homo sapiens
tcttacaaaacat

SEQ ID NO: 241663 - DNA, 21 bp, Homo sapiens
tcttacaaggcaggcctttcc

SEQ ID NO: 241664 - DNA, 22 bp, Homo sapiens
tcttacaaggcaggcctttcct

SEQ ID NO: 241665 - DNA, 13 bp, Homo sapiens
tcttaccagatgc

SEQ ID NO: 241666 - DNA, 14 bp, Homo sapiens
tcttaccagatgct

SEQ ID NO: 241667 - DNA, 15 bp, Homo sapiens
tcttacctcatttgc

SEQ ID NO: 241668 - DNA, 15 bp, Homo sapiens
tcttacgctctctgt

SEQ ID NO: 241669 - DNA, 24 bp, Homo sapiens
tcttactaaacattttgttattgg

SEQ ID NO: 241670 - DNA, 17 bp, Homo sapiens
tcttactattaagcagt

SEQ ID NO: 241671 - DNA, 23 bp, Homo sapiens
tcttactattaagcagtaaaaac

SEQ ID NO: 241672 - DNA, 16 bp, Homo sapiens
tcttactgttttgtgc

SEQ ID NO: 241673 - DNA, 16 bp, Homo sapiens
tcttacttgagccttt

SEQ ID NO: 241674 - DNA, 13 bp, Homo sapiens
tcttactttgtgc

SEQ ID NO: 241675 - DNA, 19 bp, Homo sapiens
tcttactttgtgcaaaagc

SEQ ID NO: 241676 - DNA, 19 bp, Homo sapiens
tcttagaacagatggctgt

SEQ ID NO: 241677 - DNA, 22 bp, Homo sapiens
tcttagaacagatggctgtgaa

SEQ ID NO: 241678 - DNA, 22 bp, Homo sapiens
tcttagagaataagaataataa

SEQ ID NO: 241679 - DNA, 19 bp, Homo sapiens
tcttagattgggccatggc

SEQ ID NO: 241680 - DNA, 13 bp, Homo sapiens
tcttagctcttgg

SEQ ID NO: 241681 - DNA, 13 bp, Homo sapiens
tcttagcttacag

SEQ ID NO: 241682 - DNA, 16 bp, Homo sapiens
tcttagcttacaggaa

SEQ ID NO: 241683 - DNA, 17 bp, Homo sapiens
tcttagcttacaggaag

SEQ ID NO: 241684 - DNA, 19 bp, Homo sapiens
tcttaggaagagaaaccag

SEQ ID NO: 241685 - DNA, 18 bp, Homo sapiens
tcttagtcctccctgctc

SEQ ID NO: 241686 - DNA, 20 bp, Homo sapiens
tcttagtcctccctgctcag

SEQ ID NO: 241687 - DNA, 14 bp, Homo sapiens
tcttagtgcctgag

SEQ ID NO: 241688 - DNA, 14 bp, Homo sapiens
tcttagtgtgatga

SEQ ID NO: 241689 - DNA, 14 bp, Homo sapiens
tcttagtgtgtgca

SEQ ID NO: 241690 - DNA, 22 bp, Homo sapiens
tcttagtttttaaaaaggcctt

SEQ ID NO: 241691 - DNA, 21 bp, Homo sapiens
tcttagtttttacttgtttaa

SEQ ID NO: 241692 - DNA, 13 bp, Homo sapiens
tcttataaaatca

SEQ ID NO: 241693 - DNA, 15 bp, Homo sapiens
tcttataagaaaaca

SEQ ID NO: 241694 - DNA, 20 bp, Homo sapiens
tcttataagaaaacatgtaa

SEQ ID NO: 241695 - DNA, 15 bp, Homo sapiens
tcttatacatttgat

SEQ ID NO: 241696 - DNA, 19 bp, Homo sapiens
tcttatagaatatttatta

SEQ ID NO: 241697 - DNA, 20 bp, Homo sapiens
tcttatatatatttctttgt

SEQ ID NO: 241698 - DNA, 20 bp, Homo sapiens
tcttatgaaatgggctttaa

SEQ ID NO: 241699 - DNA, 15 bp, Homo sapiens
tcttatggtggaaga

SEQ ID NO: 241700 - DNA, 17 bp, Homo sapiens
tcttatggtggaagagg

SEQ ID NO: 241701 - DNA, 22 bp, Homo sapiens
tcttattcatgctttctccttt

SEQ ID NO: 241702 - DNA, 23 bp, Homo sapiens
tcttattcatgctttctcctttt

SEQ ID NO: 241703 - DNA, 21 bp, Homo sapiens
tcttattcccaaactacagaa

SEQ ID NO: 241704 - DNA, 22 bp, Homo sapiens
tcttattcccaaactacagaat

SEQ ID NO: 241705 - DNA, 16 bp, Homo sapiens
tcttattgttcctctt

SEQ ID NO: 241706 - DNA, 14 bp, Homo sapiens
tcttatttatatat

SEQ ID NO: 241707 - DNA, 21 bp, Homo sapiens
tcttatttcccctttccaatt

SEQ ID NO: 241708 - DNA, 19 bp, Homo sapiens
tcttcaaactttcactttg

SEQ ID NO: 241709 - DNA, 23 bp, Homo sapiens
tcttcaacatcaatgttcattgt

SEQ ID NO: 241710 - DNA, 24 bp, Homo sapiens
tcttcaacatcaatgttcattgta

SEQ ID NO: 241711 - DNA, 16 bp, Homo sapiens
tcttcaaccctgccct

SEQ ID NO: 241712 - DNA, 17 bp, Homo sapiens
tcttcaaccctgccctg

SEQ ID NO: 241713 - DNA, 18 bp, Homo sapiens
tcttcaaccctgccctgc

SEQ ID NO: 241714 - DNA, 20 bp, Homo sapiens
tcttcaaccctgccctgcac

SEQ ID NO: 241715 - DNA, 15 bp, Homo sapiens
tcttcaagctgtccc

SEQ ID NO: 241716 - DNA, 11 bp, Homo sapiens
tcttcaaggcc

SEQ ID NO: 241717 - DNA, 18 bp, Homo sapiens
tcttcaagggctgcttca

SEQ ID NO: 241718 - DNA, 13 bp, Homo sapiens
tcttcaatctctg

SEQ ID NO: 241719 - DNA, 14 bp, Homo sapiens
tcttcaatctctgt

SEQ ID NO: 241720 - DNA, 15 bp, Homo sapiens
tcttcaatctctgtt

SEQ ID NO: 241721 - DNA, 16 bp, Homo sapiens
tcttcaatggcacctt

SEQ ID NO: 241722 - DNA, 19 bp, Homo sapiens
tcttcaatttgaaatcacc

SEQ ID NO: 241723 - DNA, 18 bp, Homo sapiens
tcttcacagctctgtgtt

SEQ ID NO: 241724 - DNA, 16 bp, Homo sapiens
tcttcacatttagaat

SEQ ID NO: 241725 - DNA, 17 bp, Homo sapiens
tcttcaccccggcaggc

SEQ ID NO: 241726 - DNA, 15 bp, Homo sapiens
tcttcaccttggttt

SEQ ID NO: 241727 - DNA, 20 bp, Homo sapiens
tcttcactgcaattttgtgt

SEQ ID NO: 241728 - DNA, 20 bp, Homo sapiens
tcttcagaaagtgtgcttta

SEQ ID NO: 241729 - DNA, 15 bp, Homo sapiens
tcttcagatcctgct

SEQ ID NO: 241730 - DNA, 17 bp, Homo sapiens
tcttcagatcctgctgc

SEQ ID NO: 241731 - DNA, 20 bp, Homo sapiens
tcttcagcagcgtgcaatag

SEQ ID NO: 241732 - DNA, 14 bp, Homo sapiens
tcttcaggagaatg

SEQ ID NO: 241733 - DNA, 14 bp, Homo sapiens
tcttcaggcctccc

SEQ ID NO: 241734 - DNA, 17 bp, Homo sapiens
tcttcaggcttcctgca

SEQ ID NO: 241735 - DNA, 19 bp, Homo sapiens
tcttcaggggtcacctcct

SEQ ID NO: 241736 - DNA, 22 bp, Homo sapiens
tcttcaggtgaaaaaggcaagc

SEQ ID NO: 241737 - DNA, 14 bp, Homo sapiens
tcttcatacaaagg

SEQ ID NO: 241738 - DNA, 15 bp, Homo sapiens
tcttcatactttttt

SEQ ID NO: 241739 - DNA, 20 bp, Homo sapiens
tcttcatccatagacacagt

SEQ ID NO: 241740 - DNA, 17 bp, Homo sapiens
tcttcatgcaatgacat

SEQ ID NO: 241741 - DNA, 14 bp, Homo sapiens
tcttcatggtctct

SEQ ID NO: 241742 - DNA, 18 bp, Homo sapiens
tcttcatggtctcttcca

SEQ ID NO: 241743 - DNA, 16 bp, Homo sapiens
tcttcattcccactgc

SEQ ID NO: 241744 - DNA, 19 bp, Homo sapiens
tcttcattcccactgcact

SEQ ID NO: 241745 - DNA, 16 bp, Homo sapiens
tcttcatttattttga

SEQ ID NO: 241746 - DNA, 14 bp, Homo sapiens
tcttcatttcattg

SEQ ID NO: 241747 - DNA, 24 bp, Homo sapiens
tcttcatttcattgtatgatgtgt

SEQ ID NO: 241748 - DNA, 20 bp, Homo sapiens
tcttccacaaaaaatacttt

SEQ ID NO: 241749 - DNA, 19 bp, Homo sapiens
tcttccagagcctaagaaa

SEQ ID NO: 241750 - DNA, 22 bp, Homo sapiens
tcttccagcccagacatcctgt

SEQ ID NO: 241751 - DNA, 12 bp, Homo sapiens
tcttccaggaag

SEQ ID NO: 241752 - DNA, 12 bp, Homo sapiens
tcttccataatg

SEQ ID NO: 241753 - DNA, 16 bp, Homo sapiens
tcttccataatgtata

SEQ ID NO: 241754 - DNA, 18 bp, Homo sapiens
tcttccatcagctctctg

SEQ ID NO: 241755 - DNA, 19 bp, Homo sapiens
tcttcccaaggccagtctg

SEQ ID NO: 241756 - DNA, 15 bp, Homo sapiens
tcttcccatttgtaa

SEQ ID NO: 241757 - DNA, 18 bp, Homo sapiens
tcttcccatttgtaatgt

SEQ ID NO: 241758 - DNA, 19 bp, Homo sapiens
tcttcccatttgtaatgta

SEQ ID NO: 241759 - DNA, 19 bp, Homo sapiens
tcttcccccgctaattcat

SEQ ID NO: 241760 - DNA, 21 bp, Homo sapiens
tcttccccctctcccagttgt

SEQ ID NO: 241761 - DNA, 14 bp, Homo sapiens
tcttcccccttccc

SEQ ID NO: 241762 - DNA, 16 bp, Homo sapiens
tcttcccgcctcagcc

SEQ ID NO: 241763 - DNA, 13 bp, Homo sapiens
tcttccctacctc

SEQ ID NO: 241764 - DNA, 21 bp, Homo sapiens
tcttccctacctcaggcagga

SEQ ID NO: 241765 - DNA, 20 bp, Homo sapiens
tcttccctagggctgggtgt

SEQ ID NO: 241766 - DNA, 10 bp, Homo sapiens
tcttccctcc

SEQ ID NO: 241767 - DNA, 21 bp, Homo sapiens
tcttccctgcttcacgattct

SEQ ID NO: 241768 - DNA, 21 bp, Homo sapiens
tcttccctgggggtcccagga

SEQ ID NO: 241769 - DNA, 14 bp, Homo sapiens
tcttcccttagcct

SEQ ID NO: 241770 - DNA, 23 bp, Homo sapiens
tcttccctttcctcccttctgat

SEQ ID NO: 241771 - DNA, 15 bp, Homo sapiens
tcttccggagatgta

SEQ ID NO: 241772 - DNA, 16 bp, Homo sapiens
tcttccggagatgtag

SEQ ID NO: 241773 - DNA, 18 bp, Homo sapiens
tcttccggagatgtagca

SEQ ID NO: 241774 - DNA, 15 bp, Homo sapiens
tcttcctcatcctgc

SEQ ID NO: 241775 - DNA, 14 bp, Homo sapiens
tcttcctcttacct

SEQ ID NO: 241776 - DNA, 14 bp, Homo sapiens
tcttcctgagtggt

SEQ ID NO: 241777 - DNA, 14 bp, Homo sapiens
tcttcctgctgctg

SEQ ID NO: 241778 - DNA, 15 bp, Homo sapiens
tcttcctgctgctgt

SEQ ID NO: 241779 - DNA, 15 bp, Homo sapiens
tgaaatttttaaatc

SEQ ID NO: 241780 - DNA, 18 bp, Homo sapiens
tgaacaaaaaataaaaat

SEQ ID NO: 241781 - DNA, 14 bp, Homo sapiens
tgaacaaaatgaag

SEQ ID NO: 241782 - DNA, 15 bp, Homo sapiens
tgaacaagatttccc

SEQ ID NO: 241783 - DNA, 13 bp, Homo sapiens
tgaacaattacct

SEQ ID NO: 241784 - DNA, 15 bp, Homo sapiens
tgaacaattgtgttt

SEQ ID NO: 241785 - DNA, 12 bp, Homo sapiens
tgaacacaggca

SEQ ID NO: 241786 - DNA, 16 bp, Homo sapiens
tgaacacgaagcttag

SEQ ID NO: 241787 - DNA, 15 bp, Homo sapiens
tgaacacttattgct

SEQ ID NO: 241788 - DNA, 17 bp, Homo sapiens
tgaacacttattgcttt

SEQ ID NO: 241789 - DNA, 21 bp, Homo sapiens
tgaacagattgctacacacac

SEQ ID NO: 241790 - DNA, 17 bp, Homo sapiens
tgaacagccaaaagcta

SEQ ID NO: 241791 - DNA, 16 bp, Homo sapiens
tgaacagcttcactta

SEQ ID NO: 241792 - DNA, 14 bp, Homo sapiens
tgaacagggcccag

SEQ ID NO: 241793 - DNA, 19 bp, Homo sapiens
tgaacagggcccaggcctg

SEQ ID NO: 241794 - DNA, 22 bp, Homo sapiens
tgaacagtttatgcagtgctgc

SEQ ID NO: 241795 - DNA, 22 bp, Homo sapiens
tgaacagtttggatgtcctcaa

SEQ ID NO: 241796 - DNA, 18 bp, Homo sapiens
tgaacatcttttaactgc

SEQ ID NO: 241797 - DNA, 14 bp, Homo sapiens
tgaacatggactct

SEQ ID NO: 241798 - DNA, 14 bp, Homo sapiens
tgaacattcttgct

SEQ ID NO: 241799 - DNA, 23 bp, Homo sapiens
tgaacatttctaactaaggacag

SEQ ID NO: 241800 - DNA, 19 bp, Homo sapiens
tgaacatttgggtaaatca

SEQ ID NO: 241801 - DNA, 21 bp, Homo sapiens
tgaaccaaaacattccgttta

SEQ ID NO: 241802 - DNA, 15 bp, Homo sapiens
tgaaccagctcatct

SEQ ID NO: 241803 - DNA, 16 bp, Homo sapiens
tgaaccaggccttctg

SEQ ID NO: 241804 - DNA, 20 bp, Homo sapiens
tgaacccaggacgcttctga

SEQ ID NO: 241805 - DNA, 21 bp, Homo sapiens
tgaacccaggacgcttctgaa

SEQ ID NO: 241806 - DNA, 21 bp, Homo sapiens
tgaaccccatgggcttggact

SEQ ID NO: 241807 - DNA, 22 bp, Homo sapiens
tgaacccgggacgcaggggttg

SEQ ID NO: 241808 - DNA, 17 bp, Homo sapiens
tgaacccttgtgcttgg

SEQ ID NO: 241809 - DNA, 14 bp, Homo sapiens
tgaacctaccttca

SEQ ID NO: 241810 - DNA, 20 bp, Homo sapiens
tgaacgtacccaaggtcaca

SEQ ID NO: 241811 - DNA, 22 bp, Homo sapiens
tgaacgttctcaaaccctgttt

SEQ ID NO: 241812 - DNA, 23 bp, Homo sapiens
tgaacgttttaataatttttgct

SEQ ID NO: 241813 - DNA, 16 bp, Homo sapiens
tgaactaagttttgtg

SEQ ID NO: 241814 - DNA, 21 bp, Homo sapiens
tgaactacgcttgctcatttt

SEQ ID NO: 241815 - DNA, 17 bp, Homo sapiens
tgaactcaactttgaca

SEQ ID NO: 241816 - DNA, 21 bp, Homo sapiens
tgaactcaccgctcaccctcc

SEQ ID NO: 241817 - DNA, 17 bp, Homo sapiens
tgaactcacgagccttg

SEQ ID NO: 241818 - DNA, 12 bp, Homo sapiens
tgaactctcaaa

SEQ ID NO: 241819 - DNA, 17 bp, Homo sapiens
tgaactctgcaactgaa

SEQ ID NO: 241820 - DNA, 17 bp, Homo sapiens
tgaactctgttccccca

SEQ ID NO: 241821 - DNA, 21 bp, Homo sapiens
tgaactcttaatcaaatagca

SEQ ID NO: 241822 - DNA, 20 bp, Homo sapiens
tgaactctttctggcctgcc

SEQ ID NO: 241823 - DNA, 15 bp, Homo sapiens
tgaactgctgctggt

SEQ ID NO: 241824 - DNA, 15 bp, Homo sapiens
tgaactgtgacagga

SEQ ID NO: 241825 - DNA, 16 bp, Homo sapiens
tgaactgtgacaggaa

SEQ ID NO: 241826 - DNA, 17 bp, Homo sapiens
tgaactgtgacaggaag

SEQ ID NO: 241827 - DNA, 17 bp, Homo sapiens
tgaacttaacatgctgt

SEQ ID NO: 241828 - DNA, 21 bp, Homo sapiens
tgaacttaacatgctgtgtaa

SEQ ID NO: 241829 - DNA, 18 bp, Homo sapiens
tgaacttgaggacacatg

SEQ ID NO: 241830 - DNA, 19 bp, Homo sapiens
tgaacttgaggacacatgt

SEQ ID NO: 241831 - DNA, 21 bp, Homo sapiens
tgaacttgaggacacatgtcc

SEQ ID NO: 241832 - DNA, 11 bp, Homo sapiens
tgaactttctc

SEQ ID NO: 241833 - DNA, 22 bp, Homo sapiens
tgaactttctcttcatactttt

SEQ ID NO: 241834 - DNA, 20 bp, Homo sapiens
tgaactttgaggaggaagca

SEQ ID NO: 241835 - DNA, 15 bp, Homo sapiens
tgaagaaaatgaagc

SEQ ID NO: 241836 - DNA, 13 bp, Homo sapiens
tgaatgcattggc

SEQ ID NO: 241837 - DNA, 14 bp, Homo sapiens
tgaatgctgtacct

SEQ ID NO: 241838 - DNA, 18 bp, Homo sapiens
tgaatgctttttgaatgt

SEQ ID NO: 241839 - DNA, 19 bp, Homo sapiens
tgaatgctttttgaatgtt

SEQ ID NO: 241840 - DNA, 23 bp, Homo sapiens
tgaatgctttttgaatgttattt

SEQ ID NO: 241841 - DNA, 18 bp, Homo sapiens
tgaatggattaaatggca

SEQ ID NO: 241842 - DNA, 18 bp, Homo sapiens
tgaatggccctagaactg

SEQ ID NO: 241843 - DNA, 13 bp, Homo sapiens
tgaatgggaaagg

SEQ ID NO: 241844 - DNA, 14 bp, Homo sapiens
tgaatgggaaaggg

SEQ ID NO: 241845 - DNA, 17 bp, Homo sapiens
tgaatggtgcagaaaaa

SEQ ID NO: 241846 - DNA, 13 bp, Homo sapiens
tgaatgtacaaag

SEQ ID NO: 241847 - DNA, 14 bp, Homo sapiens
tgaatgtacaaaga

SEQ ID NO: 241848 - DNA, 15 bp, Homo sapiens
tgaatgtacaaagat

SEQ ID NO: 241849 - DNA, 16 bp, Homo sapiens
tgaatgtatcaggaaa

SEQ ID NO: 241850 - DNA, 22 bp, Homo sapiens
tgaatgtatctagtggtctgat

SEQ ID NO: 241851 - DNA, 23 bp, Homo sapiens
tgaatgtatgtgcactgtcactt

SEQ ID NO: 241852 - DNA, 11 bp, Homo sapiens
tgaatgtcaca

SEQ ID NO: 241853 - DNA, 17 bp, Homo sapiens
tgaatgtcacaaattga

SEQ ID NO: 241854 - DNA, 14 bp, Homo sapiens
tgaatgtcattatt

SEQ ID NO: 241855 - DNA, 19 bp, Homo sapiens
tgaatgtcattatttgata

SEQ ID NO: 241856 - DNA, 19 bp, Homo sapiens
tgaatgtccccattctata

SEQ ID NO: 241857 - DNA, 20 bp, Homo sapiens
tgaatgtccccattctataa

SEQ ID NO: 241858 - DNA, 14 bp, Homo sapiens
tgaatgtcttcctt

SEQ ID NO: 241859 - DNA, 19 bp, Homo sapiens
tgaatgtcttccttttctt

SEQ ID NO: 241860 - DNA, 23 bp, Homo sapiens
tgaatgtgatcatctttgctgaa

SEQ ID NO: 241861 - DNA, 12 bp, Homo sapiens
tgaatgttctga

SEQ ID NO: 241862 - DNA, 16 bp, Homo sapiens
tgaatgttctgacatt

SEQ ID NO: 241863 - DNA, 17 bp, Homo sapiens
tgaatgttctgacatta

SEQ ID NO: 241864 - DNA, 21 bp, Homo sapiens
tgaatgttgtcctgtgtcatc

SEQ ID NO: 241865 - DNA, 19 bp, Homo sapiens
tgaatgtttacactctttg

SEQ ID NO: 241866 - DNA, 16 bp, Homo sapiens
tgaattaaattaggaa

SEQ ID NO: 241867 - DNA, 15 bp, Homo sapiens
tgaattaaatttaat

SEQ ID NO: 241868 - DNA, 18 bp, Homo sapiens
tgaattacagtgaaattt

SEQ ID NO: 241869 - DNA, 14 bp, Homo sapiens
tgaattagccaaaa

SEQ ID NO: 241870 - DNA, 13 bp, Homo sapiens
tgaattattttgt

SEQ ID NO: 241871 - DNA, 17 bp, Homo sapiens
tgaattcagattttaaa

SEQ ID NO: 241872 - DNA, 18 bp, Homo sapiens
tgaattcatactctgttg

SEQ ID NO: 241873 - DNA, 13 bp, Homo sapiens
tgaattctctcta

SEQ ID NO: 241874 - DNA, 21 bp, Homo sapiens
tgaattctctctaaaaataaa

SEQ ID NO: 241875 - DNA, 14 bp, Homo sapiens
tgaattctgtgaag

SEQ ID NO: 241876 - DNA, 13 bp, Homo sapiens
tgaattgataata

SEQ ID NO: 241877 - DNA, 16 bp, Homo sapiens
tgaattgataataaac

SEQ ID NO: 241878 - DNA, 17 bp, Homo sapiens
tgaattgtgaccaagtt

SEQ ID NO: 241879 - DNA, 21 bp, Homo sapiens
tgaattgttgaaactaaagca

SEQ ID NO: 241880 - DNA, 15 bp, Homo sapiens
tgaattgtttgatat

SEQ ID NO: 241881 - DNA, 12 bp, Homo sapiens
tgaatttaaata

SEQ ID NO: 241882 - DNA, 13 bp, Homo sapiens
tgaatttaagcat

SEQ ID NO: 241883 - DNA, 14 bp, Homo sapiens
tgaatttaagcatg

SEQ ID NO: 241884 - DNA, 16 bp, Homo sapiens
tgaatttcctatctgt

SEQ ID NO: 241885 - DNA, 20 bp, Homo sapiens
tgaatttctagacagtattg

SEQ ID NO: 241886 - DNA, 23 bp, Homo sapiens
tgaatttcttcactgttgaaaat

SEQ ID NO: 241887 - DNA, 17 bp, Homo sapiens
tgaatttctttgattta

SEQ ID NO: 241888 - DNA, 17 bp, Homo sapiens
tgaatttgaatgaaaaa

SEQ ID NO: 241889 - DNA, 18 bp, Homo sapiens
tgaatttgaatgaaaaat

SEQ ID NO: 241890 - DNA, 19 bp, Homo sapiens
tgaatttgaatgaaaaatt

SEQ ID NO: 241891 - DNA, 17 bp, Homo sapiens
tgaatttgggcctcttg

SEQ ID NO: 241892 - DNA, 15 bp, Homo sapiens
tgaattttaaaagca

SEQ ID NO: 241893 - DNA, 13 bp, Homo sapiens
tgaattttaaaat

SEQ ID NO: 241894 - DNA, 21 bp, Homo sapiens
tgaattttaaattaaagcaaa

SEQ ID NO: 241895 - DNA, 23 bp, Homo sapiens
tgaattttcaaaggcttccaatg

SEQ ID NO: 241896 - DNA, 19 bp, Homo sapiens
tgaattttttttaacattc

SEQ ID NO: 241897 - DNA, 17 bp, Homo sapiens
tgacaaaacctaacttg

SEQ ID NO: 241898 - DNA, 15 bp, Homo sapiens
tgacaaaatatataa

SEQ ID NO: 241899 - DNA, 14 bp, Homo sapiens
tgacaaaattttgc

SEQ ID NO: 241900 - DNA, 13 bp, Homo sapiens
tgacaaagaaaat

SEQ ID NO: 241901 - DNA, 14 bp, Homo sapiens
tgacaaagaaaatg

SEQ ID NO: 241902 - DNA, 18 bp, Homo sapiens
tgacaaagaaaatgagaa

SEQ ID NO: 241903 - DNA, 14 bp, Homo sapiens
tgacaaaggatgaa

SEQ ID NO: 241904 - DNA, 16 bp, Homo sapiens
tgacaaagttacaaat

SEQ ID NO: 241905 - DNA, 16 bp, Homo sapiens
tgacaacactacacgc

SEQ ID NO: 241906 - DNA, 20 bp, Homo sapiens
tgacaaccaccgctccccag

SEQ ID NO: 241907 - DNA, 23 bp, Homo sapiens
tgacaaccaccgctccccagccc

SEQ ID NO: 241908 - DNA, 19 bp, Homo sapiens
tgacaaccatgagaccact

SEQ ID NO: 241909 - DNA, 17 bp, Homo sapiens
tgacaacctttgtgtaa

SEQ ID NO: 241910 - DNA, 14 bp, Homo sapiens
tgacaactgaagag

SEQ ID NO: 241911 - DNA, 18 bp, Homo sapiens
tgacaactgaagagacac

SEQ ID NO: 241912 - DNA, 21 bp, Homo sapiens
tgacaactgtctaactttaga

SEQ ID NO: 241913 - DNA, 14 bp, Homo sapiens
tgacaacttctaat

SEQ ID NO: 241914 - DNA, 19 bp, Homo sapiens
tgacaactttgccagcttt

SEQ ID NO: 241915 - DNA, 17 bp, Homo sapiens
tgacaagccccaggcag

SEQ ID NO: 241916 - DNA, 20 bp, Homo sapiens
tgacaagctaggacacctgt

SEQ ID NO: 241917 - DNA, 13 bp, Homo sapiens
tgacaaggcccca

SEQ ID NO: 241918 - DNA, 16 bp, Homo sapiens
tgacaaggccccagag

SEQ ID NO: 241919 - DNA, 14 bp, Homo sapiens
tgacaagtcatttt

SEQ ID NO: 241920 - DNA, 17 bp, Homo sapiens
tgacctgctccgccagg

SEQ ID NO: 241921 - DNA, 15 bp, Homo sapiens
tgacctgtgaccagc

SEQ ID NO: 241922 - DNA, 19 bp, Homo sapiens
tgacctgtggggatttctc

SEQ ID NO: 241923 - DNA, 23 bp, Homo sapiens
tgacctgtggggatttctcccag

SEQ ID NO: 241924 - DNA, 14 bp, Homo sapiens
tgaccttcacaggg

SEQ ID NO: 241925 - DNA, 11 bp, Homo sapiens
tgaccttcctc

SEQ ID NO: 241926 - DNA, 14 bp, Homo sapiens
tgaccttcctctgg

SEQ ID NO: 241927 - DNA, 19 bp, Homo sapiens
tgaccttcctctggggctc

SEQ ID NO: 241928 - DNA, 18 bp, Homo sapiens
tgacctttatttattaaa

SEQ ID NO: 241929 - DNA, 23 bp, Homo sapiens
tgacctttatttattaaacttca

SEQ ID NO: 241930 - DNA, 14 bp, Homo sapiens
tgacctttccagcc

SEQ ID NO: 241931 - DNA, 19 bp, Homo sapiens
tgaccttttggcctttgta

SEQ ID NO: 241932 - DNA, 20 bp, Homo sapiens
tgaccttttggcctttgtaa

SEQ ID NO: 241933 - DNA, 20 bp, Homo sapiens
tgacgacaagtgctgaacag

SEQ ID NO: 241934 - DNA, 22 bp, Homo sapiens
tgacgccctgcgttggagccac

SEQ ID NO: 241935 - DNA, 23 bp, Homo sapiens
tgacgccctgcgttggagccact

SEQ ID NO: 241936 - DNA, 22 bp, Homo sapiens
tgacggaaggacctatgtttgc

SEQ ID NO: 241937 - DNA, 19 bp, Homo sapiens
tgacggatgattggattat

SEQ ID NO: 241938 - DNA, 13 bp, Homo sapiens
tgacggccctgca

SEQ ID NO: 241939 - DNA, 15 bp, Homo sapiens
tgacggccctgcaat

SEQ ID NO: 241940 - DNA, 19 bp, Homo sapiens
tgacggcgcccccagtgtg

SEQ ID NO: 241941 - DNA, 14 bp, Homo sapiens
tgacggctgtgtat

SEQ ID NO: 241942 - DNA, 22 bp, Homo sapiens
tgacggctgtgtatttctgtag

SEQ ID NO: 241943 - DNA, 20 bp, Homo sapiens
tgacggtcctttaggcagcc

SEQ ID NO: 241944 - DNA, 15 bp, Homo sapiens
tgacgtattgtgaaa

SEQ ID NO: 241945 - DNA, 18 bp, Homo sapiens
tgacgtattgtgaaattt

SEQ ID NO: 241946 - DNA, 22 bp, Homo sapiens
tgacgtgaccaattgccctgcc

SEQ ID NO: 241947 - DNA, 18 bp, Homo sapiens
tgagaccctcttctctgg

SEQ ID NO: 241948 - DNA, 20 bp, Homo sapiens
tgagaccctcttctctgggc

SEQ ID NO: 241949 - DNA, 18 bp, Homo sapiens
tgagacggatggaaggag

SEQ ID NO: 241950 - DNA, 21 bp, Homo sapiens
tgagacggatggaaggagaga

SEQ ID NO: 241951 - DNA, 14 bp, Homo sapiens
tgagactatttaaa

SEQ ID NO: 241952 - DNA, 13 bp, Homo sapiens
tgagactcctgat

SEQ ID NO: 241953 - DNA, 14 bp, Homo sapiens
tgagacttgctctc

SEQ ID NO: 241954 - DNA, 17 bp, Homo sapiens
tgagagaatctgcctgt

SEQ ID NO: 241955 - DNA, 18 bp, Homo sapiens
tgagagagagaacctttc

SEQ ID NO: 241956 - DNA, 20 bp, Homo sapiens
tgagagagttgctcctcagg

SEQ ID NO: 241957 - DNA, 16 bp, Homo sapiens
tgagagccccagctga

SEQ ID NO: 241958 - DNA, 14 bp, Homo sapiens
tgagagcgctggcc

SEQ ID NO: 241959 - DNA, 15 bp, Homo sapiens
tgagagcgctggcct

SEQ ID NO: 241960 - DNA, 12 bp, Homo sapiens
tgagagctgctg

SEQ ID NO: 241961 - DNA, 13 bp, Homo sapiens
tgagagctgctga

SEQ ID NO: 241962 - DNA, 18 bp, Homo sapiens
tgagaggaggggtaaata

SEQ ID NO: 241963 - DNA, 19 bp, Homo sapiens
tgagaggaggggtaaatat

SEQ ID NO: 241964 - DNA, 22 bp, Homo sapiens
tgagaggaggggtaaatatatg

SEQ ID NO: 241965 - DNA, 22 bp, Homo sapiens
tgagaggcatccagtatcttga

SEQ ID NO: 241966 - DNA, 15 bp, Homo sapiens
tgagaggcatgacag

SEQ ID NO: 241967 - DNA, 19 bp, Homo sapiens
tgagaggcatgacagctgt

SEQ ID NO: 241968 - DNA, 20 bp, Homo sapiens
tgagaggcatgacagctgtt

SEQ ID NO: 241969 - DNA, 20 bp, Homo sapiens
tgagagggatgcagtgcctt

SEQ ID NO: 241970 - DNA, 16 bp, Homo sapiens
tgagagggctgtggct

SEQ ID NO: 241971 - DNA, 14 bp, Homo sapiens
tgagaggggtgaga

SEQ ID NO: 241972 - DNA, 20 bp, Homo sapiens
tgagagtactcacttttcac

SEQ ID NO: 241973 - DNA, 14 bp, Homo sapiens
tgagataaatatca

SEQ ID NO: 241974 - DNA, 17 bp, Homo sapiens
tgagataaatatcatta

SEQ ID NO: 241975 - DNA, 16 bp, Homo sapiens
tgagataacttccttc

SEQ ID NO: 241976 - DNA, 17 bp, Homo sapiens
tgagatacccagagaga

SEQ ID NO: 241977 - DNA, 19 bp, Homo sapiens
tgagatacccagagagaaa

SEQ ID NO: 241978 - DNA, 14 bp, Homo sapiens
tgagatagaagatg

SEQ ID NO: 241979 - DNA, 19 bp, Homo sapiens
tgagatagaagatgtttgc

SEQ ID NO: 241980 - DNA, 22 bp, Homo sapiens
tgagatatatctttatacttaa

SEQ ID NO: 241981 - DNA, 16 bp, Homo sapiens
tgagatcacagcctcc

SEQ ID NO: 241982 - DNA, 20 bp, Homo sapiens
tgagatcacagcctccaggg

SEQ ID NO: 241983 - DNA, 21 bp, Homo sapiens
tgagatcagcattcaaaatag

SEQ ID NO: 241984 - DNA, 22 bp, Homo sapiens
tgagatctaagcctttccataa

SEQ ID NO: 241985 - DNA, 23 bp, Homo sapiens
tgagatctaagcctttccataag

SEQ ID NO: 241986 - DNA, 13 bp, Homo sapiens
tgagatgagcccc

SEQ ID NO: 241987 - DNA, 22 bp, Homo sapiens
tgagatgcgttgttacaggaag

SEQ ID NO: 241988 - DNA, 17 bp, Homo sapiens
tgagatgggaagggctt

SEQ ID NO: 241989 - DNA, 19 bp, Homo sapiens
tgagatggtgccccctggg

SEQ ID NO: 241990 - DNA, 20 bp, Homo sapiens
tgagatggtgccccctgggg

SEQ ID NO: 241991 - DNA, 12 bp, Homo sapiens
tgagatgtatga

SEQ ID NO: 241992 - DNA, 20 bp, Homo sapiens
tgagattcctctgtattgtg

SEQ ID NO: 241993 - DNA, 19 bp, Homo sapiens
tgagattctaaatgttcat

SEQ ID NO: 241994 - DNA, 18 bp, Homo sapiens
tgagattggaaaaaatta

SEQ ID NO: 241995 - DNA, 19 bp, Homo sapiens
tgagattggtcattaaata

SEQ ID NO: 241996 - DNA, 18 bp, Homo sapiens
tgagatttgccagcacag

SEQ ID NO: 241997 - DNA, 22 bp, Homo sapiens
tgagatttgccagcacaggggc

SEQ ID NO: 241998 - DNA, 16 bp, Homo sapiens
tgagcaaacctgcccc

SEQ ID NO: 241999 - DNA, 19 bp, Homo sapiens
tgagcaaacctgccccatc

SEQ ID NO: 242000 - DNA, 21 bp, Homo sapiens
tgagcaaacctgccccatccc

SEQ ID NO: 242001 - DNA, 18 bp, Homo sapiens
tgagcaaactaacttgac

SEQ ID NO: 242002 - DNA, 18 bp, Homo sapiens
tgagcaaatgtggctcct

SEQ ID NO: 242003 - DNA, 20 bp, Homo sapiens
tgagcaactgtgcagcaccc

SEQ ID NO: 242004 - DNA, 20 bp, Homo sapiens
tgagcaaggacaacctgccc

SEQ ID NO: 242005 - DNA, 15 bp, Homo sapiens
tgagcaaggacattg

SEQ ID NO: 242006 - DNA, 19 bp, Homo sapiens
tgagcaaggacattgcccc

SEQ ID NO: 242007 - DNA, 16 bp, Homo sapiens
tgagcaaggcaagaag

SEQ ID NO: 242008 - DNA, 19 bp, Homo sapiens
tgagcaaggcaagaagtgg

SEQ ID NO: 242009 - DNA, 20 bp, Homo sapiens
tgagcaaggcaagaagtggg

SEQ ID NO: 242010 - DNA, 21 bp, Homo sapiens
tgagcaccaggtgttaaaaac

SEQ ID NO: 242011 - DNA, 18 bp, Homo sapiens
tgagcacgggcaaagaaa

SEQ ID NO: 242012 - DNA, 21 bp, Homo sapiens
tgagcacgggcaaagaaaaca

SEQ ID NO: 242013 - DNA, 11 bp, Homo sapiens
tgagcagaccg

SEQ ID NO: 242014 - DNA, 16 bp, Homo sapiens
tgagcagactggtgag

SEQ ID NO: 242015 - DNA, 22 bp, Homo sapiens
tgagcagcaggcgtgcctcgtg

SEQ ID NO: 242016 - DNA, 13 bp, Homo sapiens
tgagcagcctcca

SEQ ID NO: 242017 - DNA, 19 bp, Homo sapiens
tgagcagcctctgccaggc

SEQ ID NO: 242018 - DNA, 20 bp, Homo sapiens
tgagcagcctctgccaggcc

SEQ ID NO: 242019 - DNA, 22 bp, Homo sapiens
tgagcagcctctgccaggcctg

SEQ ID NO: 242020 - DNA, 18 bp, Homo sapiens
tgagcaggaaggcctggg

SEQ ID NO: 242021 - DNA, 15 bp, Homo sapiens
tgagcagggccctca

SEQ ID NO: 242022 - DNA, 16 bp, Homo sapiens
tgagcagtagaagcct

SEQ ID NO: 242023 - DNA, 17 bp, Homo sapiens
tgagcagtctacttctg

SEQ ID NO: 242024 - DNA, 12 bp, Homo sapiens
tgagcagtggct

SEQ ID NO: 242025 - DNA, 12 bp, Homo sapiens
tgagcagtgggg

SEQ ID NO: 242026 - DNA, 13 bp, Homo sapiens
tgagcagtgggga

SEQ ID NO: 242027 - DNA, 15 bp, Homo sapiens
tgagcagtggggagc

SEQ ID NO: 242028 - DNA, 21 bp, Homo sapiens
tgagcagttgttatattcatt

SEQ ID NO: 242029 - DNA, 18 bp, Homo sapiens
tgagcagttttccaggag

SEQ ID NO: 242030 - DNA, 14 bp, Homo sapiens
tgagccaaagagaa

SEQ ID NO: 242031 - DNA, 23 bp, Homo sapiens
tgagccaccgctgccagcacaga

SEQ ID NO: 242032 - DNA, 12 bp, Homo sapiens
tgagccaggagc

SEQ ID NO: 242033 - DNA, 20 bp, Homo sapiens
tgagccaggagcctcctgac

SEQ ID NO: 242034 - DNA, 13 bp, Homo sapiens
tgagccagtccca

SEQ ID NO: 242035 - DNA, 16 bp, Homo sapiens
tgagccagtcccaggg

SEQ ID NO: 242036 - DNA, 19 bp, Homo sapiens
tgagccagtcccaggggca

SEQ ID NO: 242037 - DNA, 13 bp, Homo sapiens
tgagcccactcct

SEQ ID NO: 242038 - DNA, 12 bp, Homo sapiens
tgagcccaggaa

SEQ ID NO: 242039 - DNA, 14 bp, Homo sapiens
tgagcccaggagct

SEQ ID NO: 242040 - DNA, 11 bp, Homo sapiens
tgagccccacc

SEQ ID NO: 242041 - DNA, 19 bp, Homo sapiens
tgagccccacctctccaag

SEQ ID NO: 242042 - DNA, 19 bp, Homo sapiens
tgagcccccacctgcctga

SEQ ID NO: 242043 - DNA, 19 bp, Homo sapiens
tgagccccctctcctgaag

SEQ ID NO: 242044 - DNA, 18 bp, Homo sapiens
tgagccccctgcacccac

SEQ ID NO: 242045 - DNA, 20 bp, Homo sapiens
tgagccccctgcacccaccc

SEQ ID NO: 242046 - DNA, 16 bp, Homo sapiens
tgagccccctgtgccc

SEQ ID NO: 242047 - DNA, 19 bp, Homo sapiens
tgagccccctgtgcccacc

SEQ ID NO: 242048 - DNA, 23 bp, Homo sapiens
tgagccccctgtgcccacccagg

SEQ ID NO: 242049 - DNA, 14 bp, Homo sapiens
tgagcccctcccca

SEQ ID NO: 242050 - DNA, 16 bp, Homo sapiens
tgagcccctccccagc

SEQ ID NO: 242051 - DNA, 14 bp, Homo sapiens
tgagcccctcctct

SEQ ID NO: 242052 - DNA, 17 bp, Homo sapiens
tgagcccctcctctcct

SEQ ID NO: 242053 - DNA, 14 bp, Homo sapiens
tgagcccctgggac

SEQ ID NO: 242054 - DNA, 23 bp, Homo sapiens
tgagccctccttcttgccctgag

SEQ ID NO: 242055 - DNA, 13 bp, Homo sapiens
tgagccctgccct

SEQ ID NO: 242056 - DNA, 15 bp, Homo sapiens
tgagccctgccctca

SEQ ID NO: 242057 - DNA, 16 bp, Homo sapiens
tgagcctactgtctcc

SEQ ID NO: 242058 - DNA, 22 bp, Homo sapiens
tgagcctactgtctccttccca

SEQ ID NO: 242059 - DNA, 13 bp, Homo sapiens
tgccttcagctct

SEQ ID NO: 242060 - DNA, 20 bp, Homo sapiens
tgccttccacgctgtctcca

SEQ ID NO: 242061 - DNA, 21 bp, Homo sapiens
tgccttccacgctgtctccag

SEQ ID NO: 242062 - DNA, 22 bp, Homo sapiens
tgccttccacgctgtctccaga

SEQ ID NO: 242063 - DNA, 23 bp, Homo sapiens
tgccttccacgctgtctccagac

SEQ ID NO: 242064 - DNA, 13 bp, Homo sapiens
tgccttccaggcg

SEQ ID NO: 242065 - DNA, 22 bp, Homo sapiens
tgccttccaggcgtagggccag

SEQ ID NO: 242066 - DNA, 14 bp, Homo sapiens
tgccttccataatt

SEQ ID NO: 242067 - DNA, 13 bp, Homo sapiens
tgccttcctcatc

SEQ ID NO: 242068 - DNA, 16 bp, Homo sapiens
tgccttcctcatcccc

SEQ ID NO: 242069 - DNA, 17 bp, Homo sapiens
tgccttcctcatcccct

SEQ ID NO: 242070 - DNA, 14 bp, Homo sapiens
tgccttctcctctc

SEQ ID NO: 242071 - DNA, 18 bp, Homo sapiens
tgccttctcctctctggg

SEQ ID NO: 242072 - DNA, 17 bp, Homo sapiens
tgccttctgacggccct

SEQ ID NO: 242073 - DNA, 16 bp, Homo sapiens
tgccttcttcacccag

SEQ ID NO: 242074 - DNA, 19 bp, Homo sapiens
tgccttgcatttgtacctt

SEQ ID NO: 242075 - DNA, 15 bp, Homo sapiens
tgccttgggctgctc

SEQ ID NO: 242076 - DNA, 18 bp, Homo sapiens
tgccttggggaatttcct

SEQ ID NO: 242077 - DNA, 22 bp, Homo sapiens
tgccttgtagatggagcaagtg

SEQ ID NO: 242078 - DNA, 19 bp, Homo sapiens
tgcctttaaatctgtgatg

SEQ ID NO: 242079 - DNA, 14 bp, Homo sapiens
tgcctttaggcagg

SEQ ID NO: 242080 - DNA, 18 bp, Homo sapiens
tgcctttcacagcttctt

SEQ ID NO: 242081 - DNA, 11 bp, Homo sapiens
tgcctttcccc

SEQ ID NO: 242082 - DNA, 22 bp, Homo sapiens
tgcctttctgcagtttttcagg

SEQ ID NO: 242083 - DNA, 18 bp, Homo sapiens
tgcctttgagtttcctca

SEQ ID NO: 242084 - DNA, 13 bp, Homo sapiens
tgcctttgtaagt

SEQ ID NO: 242085 - DNA, 15 bp, Homo sapiens
tgcctttgttttgat

SEQ ID NO: 242086 - DNA, 21 bp, Homo sapiens
tgccttttaaaaatactatgt

SEQ ID NO: 242087 - DNA, 18 bp, Homo sapiens
tgccttttaaattctttt

SEQ ID NO: 242088 - DNA, 14 bp, Homo sapiens
tgccttttgtgtga

SEQ ID NO: 242089 - DNA, 17 bp, Homo sapiens
tgccttttgtgtgatgc

SEQ ID NO: 242090 - DNA, 15 bp, Homo sapiens
tgcgaatgagctggg

SEQ ID NO: 242091 - DNA, 16 bp, Homo sapiens
tgcgaccagaggtggg

SEQ ID NO: 242092 - DNA, 16 bp, Homo sapiens
tgcgacggagagaaaa

SEQ ID NO: 242093 - DNA, 13 bp, Homo sapiens
tgcgagcaacagt

SEQ ID NO: 242094 - DNA, 17 bp, Homo sapiens
tgcgagcaacagtgccc

SEQ ID NO: 242095 - DNA, 17 bp, Homo sapiens
tgcgagtgtgtgcatgt

SEQ ID NO: 242096 - DNA, 15 bp, Homo sapiens
tgcgatcatggctca

SEQ ID NO: 242097 - DNA, 13 bp, Homo sapiens
tgcgattttatct

SEQ ID NO: 242098 - DNA, 19 bp, Homo sapiens
tgcgcccctccccacccct

SEQ ID NO: 242099 - DNA, 14 bp, Homo sapiens
tgcgccctccctcc

SEQ ID NO: 242100 - DNA, 15 bp, Homo sapiens
tgcgccctccctccc

SEQ ID NO: 242101 - DNA, 17 bp, Homo sapiens
tgcgccctccctccctc

SEQ ID NO: 242102 - DNA, 16 bp, Homo sapiens
tgcgcccttaccttcc

SEQ ID NO: 242103 - DNA, 18 bp, Homo sapiens
tgcgcccttgtgccctgc

SEQ ID NO: 242104 - DNA, 23 bp, Homo sapiens
tgcgcccttgtgccctgcctcca

SEQ ID NO: 242105 - DNA, 14 bp, Homo sapiens
tgcgcctgcccgcc

SEQ ID NO: 242106 - DNA, 23 bp, Homo sapiens
tgcgcggatgtagcatgttctat

SEQ ID NO: 242107 - DNA, 12 bp, Homo sapiens
tgcgctagagca

SEQ ID NO: 242108 - DNA, 21 bp, Homo sapiens
tgcgctagagcattctggggt

SEQ ID NO: 242109 - DNA, 22 bp, Homo sapiens
tgcgctagagcattctggggtg

SEQ ID NO: 242110 - DNA, 15 bp, Homo sapiens
tgcgctcacctgcag

SEQ ID NO: 242111 - DNA, 16 bp, Homo sapiens
tgcgctcacctgcagc

SEQ ID NO: 242112 - DNA, 12 bp, Homo sapiens
tgcgctcctctg

SEQ ID NO: 242113 - DNA, 14 bp, Homo sapiens
tgcgctcctctgca

SEQ ID NO: 242114 - DNA, 15 bp, Homo sapiens
tgcgctcctctgcag

SEQ ID NO: 242115 - DNA, 16 bp, Homo sapiens
tgcgctcctctgcagc

SEQ ID NO: 242116 - DNA, 16 bp, Homo sapiens
tgcgctcttcaccagg

SEQ ID NO: 242117 - DNA, 17 bp, Homo sapiens
tgcgctcttcaccagga

SEQ ID NO: 242118 - DNA, 17 bp, Homo sapiens
tgcgctgacaaccaccg

SEQ ID NO: 242119 - DNA, 15 bp, Homo sapiens
tgcgctgtgctccag

SEQ ID NO: 242120 - DNA, 22 bp, Homo sapiens
tgcgctttattgcccatgggat

SEQ ID NO: 242121 - DNA, 23 bp, Homo sapiens
tgcgctttattgcccatgggata

SEQ ID NO: 242122 - DNA, 22 bp, Homo sapiens
tgcggaccggagcggctgagga

SEQ ID NO: 242123 - DNA, 23 bp, Homo sapiens
tgcggaccggagcggctgaggac

SEQ ID NO: 242124 - DNA, 17 bp, Homo sapiens
tgcggactccatggccc

SEQ ID NO: 242125 - DNA, 17 bp, Homo sapiens
tgcggcaccgcccaccc

SEQ ID NO: 242126 - DNA, 13 bp, Homo sapiens
tgcggcccagcca

SEQ ID NO: 242127 - DNA, 22 bp, Homo sapiens
tgcggcccagccatgggccctc

SEQ ID NO: 242128 - DNA, 19 bp, Homo sapiens
tgcggcccgtgcgcagccg

SEQ ID NO: 242129 - DNA, 18 bp, Homo sapiens
tgcggcttccgagggcac

SEQ ID NO: 242130 - DNA, 21 bp, Homo sapiens
tgcgggcattttgaatgtgat

SEQ ID NO: 242131 - DNA, 15 bp, Homo sapiens
tgcgggctgggcagc

SEQ ID NO: 242132 - DNA, 16 bp, Homo sapiens
tgcgggctgggcagct

SEQ ID NO: 242133 - DNA, 17 bp, Homo sapiens
tgcgggctgggcagctg

SEQ ID NO: 242134 - DNA, 17 bp, Homo sapiens
tgcggtaggtgctggcc

SEQ ID NO: 242135 - DNA, 20 bp, Homo sapiens
tgcggttagaatcccatgga

SEQ ID NO: 242136 - DNA, 20 bp, Homo sapiens
tgcggtttccaaggtgcaca

SEQ ID NO: 242137 - DNA, 19 bp, Homo sapiens
tgcgtcagaccagtactgg

SEQ ID NO: 242138 - DNA, 21 bp, Homo sapiens
tgcgtccactttcccttcccc

SEQ ID NO: 242139 - DNA, 13 bp, Homo sapiens
tgcgtcctgcaga

SEQ ID NO: 242140 - DNA, 17 bp, Homo sapiens
tgcgtgctgtctgtcct

SEQ ID NO: 242141 - DNA, 17 bp, Homo sapiens
tgcgtggcacatctaaa

SEQ ID NO: 242142 - DNA, 17 bp, Homo sapiens
tgcgtggcctggggctg

SEQ ID NO: 242143 - DNA, 14 bp, Homo sapiens
tgcgtggctgtggc

SEQ ID NO: 242144 - DNA, 15 bp, Homo sapiens
tgcgtgtctctgcca

SEQ ID NO: 242145 - DNA, 17 bp, Homo sapiens
tgcgtgtctctgccatg

SEQ ID NO: 242146 - DNA, 13 bp, Homo sapiens
tgcgtgtctgttt

SEQ ID NO: 242147 - DNA, 12 bp, Homo sapiens
tgcgtgtggccc

SEQ ID NO: 242148 - DNA, 19 bp, Homo sapiens
tgcgtgtgtccatgtgtgt

SEQ ID NO: 242149 - DNA, 13 bp, Homo sapiens
tgcgttcccttca

SEQ ID NO: 242150 - DNA, 14 bp, Homo sapiens
tgcgttcccttcag

SEQ ID NO: 242151 - DNA, 13 bp, Homo sapiens
tgcgttggagcca

SEQ ID NO: 242152 - DNA, 14 bp, Homo sapiens
tgcgttggagccac

SEQ ID NO: 242153 - DNA, 20 bp, Homo sapiens
tgcgttttagagtatgcaag

SEQ ID NO: 242154 - DNA, 16 bp, Homo sapiens
tgctaaatgacttatt

SEQ ID NO: 242155 - DNA, 15 bp, Homo sapiens
tgctaaatttacgta

SEQ ID NO: 242156 - DNA, 19 bp, Homo sapiens
tgctaaatttacgtatatt

SEQ ID NO: 242157 - DNA, 21 bp, Homo sapiens
tgctaaattttcagtagggct

SEQ ID NO: 242158 - DNA, 19 bp, Homo sapiens
tgctaacaaactgaaaaat

SEQ ID NO: 242159 - DNA, 22 bp, Homo sapiens
tgctaagaagcgagcactgacc

SEQ ID NO: 242160 - DNA, 12 bp, Homo sapiens
tgctaataaaac

SEQ ID NO: 242161 - DNA, 13 bp, Homo sapiens
tgctaataaactg

SEQ ID NO: 242162 - DNA, 14 bp, Homo sapiens
tgctaataaactgt

SEQ ID NO: 242163 - DNA, 14 bp, Homo sapiens
tgctaataaatgac

SEQ ID NO: 242164 - DNA, 20 bp, Homo sapiens
tgctaataaatgaccagttt

SEQ ID NO: 242165 - DNA, 23 bp, Homo sapiens
tgctaataaatgaccagtttacc

SEQ ID NO: 242166 - DNA, 22 bp, Homo sapiens
tgctaatcatgtgggtgagcca

SEQ ID NO: 242167 - DNA, 15 bp, Homo sapiens
tgctaatgtaatcat

SEQ ID NO: 242168 - DNA, 23 bp, Homo sapiens
tgctaatttctgtccagaaaata

SEQ ID NO: 242169 - DNA, 17 bp, Homo sapiens
tgctaattttctcaaaa

SEQ ID NO: 242170 - DNA, 15 bp, Homo sapiens
tgctacaaaatgtgt

SEQ ID NO: 242171 - DNA, 12 bp, Homo sapiens
tgctacacacac

SEQ ID NO: 242172 - DNA, 13 bp, Homo sapiens
tgctacacacaca

SEQ ID NO: 242173 - DNA, 22 bp, Homo sapiens
tgctacacttacaagtaatgaa

SEQ ID NO: 242174 - DNA, 23 bp, Homo sapiens
tgctacacttacaagtaatgaat

SEQ ID NO: 242175 - DNA, 18 bp, Homo sapiens
tgctacagtagctgtggg

SEQ ID NO: 242176 - DNA, 16 bp, Homo sapiens
tgctaccgccctgggc

SEQ ID NO: 242177 - DNA, 22 bp, Homo sapiens
tgctaccgccctgggctggact

SEQ ID NO: 242178 - DNA, 12 bp, Homo sapiens
tgctacctctga

SEQ ID NO: 242179 - DNA, 19 bp, Homo sapiens
tgctacctgatcccactcc

SEQ ID NO: 242180 - DNA, 23 bp, Homo sapiens
tgctacctgatcccactcctagg

SEQ ID NO: 242181 - DNA, 12 bp, Homo sapiens
tgctactcagta

SEQ ID NO: 242182 - DNA, 13 bp, Homo sapiens
tgctactgtcagt

SEQ ID NO: 242183 - DNA, 16 bp, Homo sapiens
tgctagaatacttttt

SEQ ID NO: 242184 - DNA, 14 bp, Homo sapiens
tgctagagcaaccc

SEQ ID NO: 242185 - DNA, 17 bp, Homo sapiens
tgctagagcaacccctg

SEQ ID NO: 242186 - DNA, 22 bp, Homo sapiens
tgctagagcaacccctgtaccc

SEQ ID NO: 242187 - DNA, 18 bp, Homo sapiens
tgctagcaacaacttact

SEQ ID NO: 242188 - DNA, 13 bp, Homo sapiens
tgctagccctggg

SEQ ID NO: 242189 - DNA, 16 bp, Homo sapiens
tgctagctgtagaaat

SEQ ID NO: 242190 - DNA, 16 bp, Homo sapiens
tgctagggtgcctgct

SEQ ID NO: 242191 - DNA, 21 bp, Homo sapiens
tgctaggtagaggcatttgtc

SEQ ID NO: 242192 - DNA, 22 bp, Homo sapiens
tgctaggtagaggcatttgtct

SEQ ID NO: 242193 - DNA, 23 bp, Homo sapiens
tgctaggtagaggcatttgtctt

SEQ ID NO: 242194 - DNA, 14 bp, Homo sapiens
tgctgggcccagcc

SEQ ID NO: 242195 - DNA, 23 bp, Homo sapiens
tgctgggcccagccggggtgggg

SEQ ID NO: 242196 - DNA, 15 bp, Homo sapiens
tgctggggagtccct

SEQ ID NO: 242197 - DNA, 12 bp, Homo sapiens
tgctggggcatg

SEQ ID NO: 242198 - DNA, 23 bp, Homo sapiens
tgctggggggcagggcccatctg

SEQ ID NO: 242199 - DNA, 14 bp, Homo sapiens
tgctgggtgcctcc

SEQ ID NO: 242200 - DNA, 13 bp, Homo sapiens
tgctgggtttcca

SEQ ID NO: 242201 - DNA, 23 bp, Homo sapiens
tgctgggtttccacacagcctgt

SEQ ID NO: 242202 - DNA, 23 bp, Homo sapiens
tgctggttgtcatttttgcagta

SEQ ID NO: 242203 - DNA, 17 bp, Homo sapiens
tgctggttgttgccagg

SEQ ID NO: 242204 - DNA, 22 bp, Homo sapiens
tgctgtaactcagacattccaa

SEQ ID NO: 242205 - DNA, 17 bp, Homo sapiens
tgctgtaactgctgagc

SEQ ID NO: 242206 - DNA, 18 bp, Homo sapiens
tgctgtaactttctgaaa

SEQ ID NO: 242207 - DNA, 16 bp, Homo sapiens
tgctgtaagcacctgg

SEQ ID NO: 242208 - DNA, 15 bp, Homo sapiens
tgctgtacccttcca

SEQ ID NO: 242209 - DNA, 20 bp, Homo sapiens
tgctgtagaatccggtttta

SEQ ID NO: 242210 - DNA, 15 bp, Homo sapiens
tgctgtagagacttc

SEQ ID NO: 242211 - DNA, 16 bp, Homo sapiens
tgctgtagagacttcc

SEQ ID NO: 242212 - DNA, 18 bp, Homo sapiens
tgctgtatacaaacaggt

SEQ ID NO: 242213 - DNA, 22 bp, Homo sapiens
tgctgtcagaccttcttccaca

SEQ ID NO: 242214 - DNA, 21 bp, Homo sapiens
tgctgtcattgtccatgccta

SEQ ID NO: 242215 - DNA, 15 bp, Homo sapiens
tgctgtccctcctga

SEQ ID NO: 242216 - DNA, 15 bp, Homo sapiens
tgctgtcccttttcc

SEQ ID NO: 242217 - DNA, 14 bp, Homo sapiens
tgctgtctggcttt

SEQ ID NO: 242218 - DNA, 15 bp, Homo sapiens
tgctgtctgtcctat

SEQ ID NO: 242219 - DNA, 17 bp, Homo sapiens
tgctgtgaggctgtcct

SEQ ID NO: 242220 - DNA, 18 bp, Homo sapiens
tgctgtgcaaacagtgta

SEQ ID NO: 242221 - DNA, 15 bp, Homo sapiens
tgctgtgcctgctag

SEQ ID NO: 242222 - DNA, 13 bp, Homo sapiens
tgctgtgctctgg

SEQ ID NO: 242223 - DNA, 23 bp, Homo sapiens
tgctgtgctctggggatttctgg

SEQ ID NO: 242224 - DNA, 23 bp, Homo sapiens
tgctgtgggtcagtgtgccaccc

SEQ ID NO: 242225 - DNA, 17 bp, Homo sapiens
tgctgtggtctctttgt

SEQ ID NO: 242226 - DNA, 11 bp, Homo sapiens
tgctgtgttaa

SEQ ID NO: 242227 - DNA, 20 bp, Homo sapiens
tgctgttactgttaaccatt

SEQ ID NO: 242228 - DNA, 18 bp, Homo sapiens
tgctgttcctgctccatg

SEQ ID NO: 242229 - DNA, 12 bp, Homo sapiens
tgctgttgacgt

SEQ ID NO: 242230 - DNA, 16 bp, Homo sapiens
tgctgttgattctttc

SEQ ID NO: 242231 - DNA, 17 bp, Homo sapiens
tgctgttgattctttca

SEQ ID NO: 242232 - DNA, 13 bp, Homo sapiens
tgctgttggcctc

SEQ ID NO: 242233 - DNA, 14 bp, Homo sapiens
tgctgttgtaaaca

SEQ ID NO: 242234 - DNA, 17 bp, Homo sapiens
tgctgttgtctgccgtg

SEQ ID NO: 242235 - DNA, 18 bp, Homo sapiens
tgctgttgtgcagtgtgc

SEQ ID NO: 242236 - DNA, 17 bp, Homo sapiens
tgctgttgttcagaagt

SEQ ID NO: 242237 - DNA, 20 bp, Homo sapiens
tgctgtttagcttcctccag

SEQ ID NO: 242238 - DNA, 15 bp, Homo sapiens
tgctgtttatatata

SEQ ID NO: 242239 - DNA, 12 bp, Homo sapiens
tgctgttttatg

SEQ ID NO: 242240 - DNA, 15 bp, Homo sapiens
tgctgttttatgtca

SEQ ID NO: 242241 - DNA, 16 bp, Homo sapiens
tgctgttttatgtcat

SEQ ID NO: 242242 - DNA, 22 bp, Homo sapiens
tgctgttttatgtcatactctg

SEQ ID NO: 242243 - DNA, 18 bp, Homo sapiens
tgctgttttgttctgtgg

SEQ ID NO: 242244 - DNA, 14 bp, Homo sapiens
tgcttaaaagacat

SEQ ID NO: 242245 - DNA, 16 bp, Homo sapiens
tgcttaatctagagct

SEQ ID NO: 242246 - DNA, 17 bp, Homo sapiens
tgcttaatctagagcta

SEQ ID NO: 242247 - DNA, 19 bp, Homo sapiens
tgcttaatctagagctatg

SEQ ID NO: 242248 - DNA, 17 bp, Homo sapiens
tgcttacacatctcaga

SEQ ID NO: 242249 - DNA, 18 bp, Homo sapiens
tgcttacatttttacaat

SEQ ID NO: 242250 - DNA, 15 bp, Homo sapiens
tgcttaccaaaacat

SEQ ID NO: 242251 - DNA, 21 bp, Homo sapiens
tgcttactgtcggtgtcccct

SEQ ID NO: 242252 - DNA, 21 bp, Homo sapiens
tgcttagaacccttctgcttt

SEQ ID NO: 242253 - DNA, 22 bp, Homo sapiens
tgcttagaacccttctgctttc

SEQ ID NO: 242254 - DNA, 21 bp, Homo sapiens
tgcttagtcacttatttcata

SEQ ID NO: 242255 - DNA, 15 bp, Homo sapiens
tgcttagtgtccctt

SEQ ID NO: 242256 - DNA, 13 bp, Homo sapiens
tgcttatacactt

SEQ ID NO: 242257 - DNA, 21 bp, Homo sapiens
tgcttattgttccaagacatt

SEQ ID NO: 242258 - DNA, 23 bp, Homo sapiens
tgcttattgttccaagacattgt

SEQ ID NO: 242259 - DNA, 19 bp, Homo sapiens
tgcttattgttttattgta

SEQ ID NO: 242260 - DNA, 16 bp, Homo sapiens
tgcttcaagtgttgct

SEQ ID NO: 242261 - DNA, 19 bp, Homo sapiens
tgcttcaagtgttgctctt

SEQ ID NO: 242262 - DNA, 22 bp, Homo sapiens
tgcttcaagtgttgctcttgga

SEQ ID NO: 242263 - DNA, 14 bp, Homo sapiens
tgcttcacacccct

SEQ ID NO: 242264 - DNA, 18 bp, Homo sapiens
tgcttcacacccctcagc

SEQ ID NO: 242265 - DNA, 20 bp, Homo sapiens
tgcttcacacccctcagcgc

SEQ ID NO: 242266 - DNA, 20 bp, Homo sapiens
tgcttcacggactctttgct

SEQ ID NO: 242267 - DNA, 18 bp, Homo sapiens
tgcttcagtggagaatta

SEQ ID NO: 242268 - DNA, 13 bp, Homo sapiens
tgcttcatatctc

SEQ ID NO: 242269 - DNA, 20 bp, Homo sapiens
tgcttcatgaaaatcctacc

SEQ ID NO: 242270 - DNA, 14 bp, Homo sapiens
tgcttccaagccct

SEQ ID NO: 242271 - DNA, 19 bp, Homo sapiens
tgcttccaagcccttccct

SEQ ID NO: 242272 - DNA, 21 bp, Homo sapiens
tgcttccctctgcctgtccct

SEQ ID NO: 242273 - DNA, 22 bp, Homo sapiens
tgcttccctttcactgaagtga

SEQ ID NO: 242274 - DNA, 13 bp, Homo sapiens
tgcttcctctgaa

SEQ ID NO: 242275 - DNA, 18 bp, Homo sapiens
tgcttctcaactaaagaa

SEQ ID NO: 242276 - DNA, 19 bp, Homo sapiens
tgcttctcatagccccggt

SEQ ID NO: 242277 - DNA, 14 bp, Homo sapiens
tgcttctccacctc

SEQ ID NO: 242278 - DNA, 15 bp, Homo sapiens
tgcttctccacctcc

SEQ ID NO: 242279 - DNA, 16 bp, Homo sapiens
tgcttctccacctccc

SEQ ID NO: 242280 - DNA, 17 bp, Homo sapiens
tgcttctccatgagaca

SEQ ID NO: 242281 - DNA, 21 bp, Homo sapiens
tgcttctcggaggccaggccc

SEQ ID NO: 242282 - DNA, 23 bp, Homo sapiens
tgcttctgctcacattccctctc

SEQ ID NO: 242283 - DNA, 15 bp, Homo sapiens
tgcttctgctgccct

SEQ ID NO: 242284 - DNA, 17 bp, Homo sapiens
tgcttctgctgccctga

SEQ ID NO: 242285 - DNA, 22 bp, Homo sapiens
tgcttctggctttgttcttgtc

SEQ ID NO: 242286 - DNA, 20 bp, Homo sapiens
tgcttctgtagtactcctta

SEQ ID NO: 242287 - DNA, 12 bp, Homo sapiens
tgcttctgtgca

SEQ ID NO: 242288 - DNA, 20 bp, Homo sapiens
tgcttcttatggtataataa

SEQ ID NO: 242289 - DNA, 23 bp, Homo sapiens
tgcttcttccccagggttctgta

SEQ ID NO: 242290 - DNA, 16 bp, Homo sapiens
tgcttcttgtaatatt

SEQ ID NO: 242291 - DNA, 20 bp, Homo sapiens
tgcttcttgtaatatttctt

SEQ ID NO: 242292 - DNA, 21 bp, Homo sapiens
tgcttgataggaattcatctt

SEQ ID NO: 242293 - DNA, 15 bp, Homo sapiens
tgcttgatggtttat

SEQ ID NO: 242294 - DNA, 18 bp, Homo sapiens
tgcttgcccgctcccaca

SEQ ID NO: 242295 - DNA, 17 bp, Homo sapiens
tgcttgccgactggctg

SEQ ID NO: 242296 - DNA, 19 bp, Homo sapiens
tgcttgcctagggcctggt

SEQ ID NO: 242297 - DNA, 19 bp, Homo sapiens
tgcttgcgtgctgggacag

SEQ ID NO: 242298 - DNA, 20 bp, Homo sapiens
tgcttggatccatacaaaac

SEQ ID NO: 242299 - DNA, 12 bp, Homo sapiens
tgcttggctgcc

SEQ ID NO: 242300 - DNA, 13 bp, Homo sapiens
tgcttggctgccc

SEQ ID NO: 242301 - DNA, 16 bp, Homo sapiens
tgcttggctgccccac

SEQ ID NO: 242302 - DNA, 17 bp, Homo sapiens
tgcttgggccactgccc

SEQ ID NO: 242303 - DNA, 23 bp, Homo sapiens
tgcttgggcttctgcggtgaggc

SEQ ID NO: 242304 - DNA, 12 bp, Homo sapiens
tgcttggggcta

SEQ ID NO: 242305 - DNA, 19 bp, Homo sapiens
tgcttggtggggctcgtgg

SEQ ID NO: 242306 - DNA, 20 bp, Homo sapiens
tgcttggtggggctcgtggc

SEQ ID NO: 242307 - DNA, 16 bp, Homo sapiens
tgcttgtaaaaatatg

SEQ ID NO: 242308 - DNA, 18 bp, Homo sapiens
tgcttgtactaagccagg

SEQ ID NO: 242309 - DNA, 18 bp, Homo sapiens
tgcttgtgaaaggaaaga

SEQ ID NO: 242310 - DNA, 21 bp, Homo sapiens
tgcttgtgatttttgaacaat

SEQ ID NO: 242311 - DNA, 18 bp, Homo sapiens
tgcttgtgcctcccttcc

SEQ ID NO: 242312 - DNA, 22 bp, Homo sapiens
tgcttgtgcctcccttcccagt

SEQ ID NO: 242313 - DNA, 19 bp, Homo sapiens
tgcttgttccctctccctg

SEQ ID NO: 242314 - DNA, 20 bp, Homo sapiens
tgctttacctttattaatga

SEQ ID NO: 242315 - DNA, 13 bp, Homo sapiens
tgctttagcttga

SEQ ID NO: 242316 - DNA, 22 bp, Homo sapiens
tgctttagcttgaaaaggtgac

SEQ ID NO: 242317 - DNA, 17 bp, Homo sapiens
tgctttatgctgaaaca

SEQ ID NO: 242318 - DNA, 22 bp, Homo sapiens
tgctttcaacttaaatcactga

SEQ ID NO: 242319 - DNA, 16 bp, Homo sapiens
tgctttccaacacaca

SEQ ID NO: 242320 - DNA, 12 bp, Homo sapiens
tgctttccttcg

SEQ ID NO: 242321 - DNA, 19 bp, Homo sapiens
tgctttcgtgtaaattatg

SEQ ID NO: 242322 - DNA, 18 bp, Homo sapiens
tgctttctactcattttt

SEQ ID NO: 242323 - DNA, 16 bp, Homo sapiens
tgctttctctttcagt

SEQ ID NO: 242324 - DNA, 15 bp, Homo sapiens
tggacaagaagctgc

SEQ ID NO: 242325 - DNA, 17 bp, Homo sapiens
tggacacaaaaaaatgg

SEQ ID NO: 242326 - DNA, 14 bp, Homo sapiens
tggacacacacagc

SEQ ID NO: 242327 - DNA, 15 bp, Homo sapiens
tggacacactgtaaa

SEQ ID NO: 242328 - DNA, 12 bp, Homo sapiens
tggacacctgcc

SEQ ID NO: 242329 - DNA, 13 bp, Homo sapiens
tggacactgtgga

SEQ ID NO: 242330 - DNA, 13 bp, Homo sapiens
tggacacttaatt

SEQ ID NO: 242331 - DNA, 15 bp, Homo sapiens
tggacagacacagag

SEQ ID NO: 242332 - DNA, 15 bp, Homo sapiens
tggacagagggagaa

SEQ ID NO: 242333 - DNA, 15 bp, Homo sapiens
tggacagcaaaacca

SEQ ID NO: 242334 - DNA, 17 bp, Homo sapiens
tggacagcaaaaccatt

SEQ ID NO: 242335 - DNA, 22 bp, Homo sapiens
tggacagcaaaaccattgcttc

SEQ ID NO: 242336 - DNA, 13 bp, Homo sapiens
tggacagggccag

SEQ ID NO: 242337 - DNA, 15 bp, Homo sapiens
tggacagggccaggg

SEQ ID NO: 242338 - DNA, 18 bp, Homo sapiens
tggacagttcacaccctg

SEQ ID NO: 242339 - DNA, 19 bp, Homo sapiens
tggacagttcacaccctgc

SEQ ID NO: 242340 - DNA, 22 bp, Homo sapiens
tggacagttcacaccctgcaag

SEQ ID NO: 242341 - DNA, 20 bp, Homo sapiens
tggacataactgacttagtt

SEQ ID NO: 242342 - DNA, 15 bp, Homo sapiens
tggacatcgatatga

SEQ ID NO: 242343 - DNA, 18 bp, Homo sapiens
tggacatcgatatgaaaa

SEQ ID NO: 242344 - DNA, 19 bp, Homo sapiens
tggacatgcacagctaaca

SEQ ID NO: 242345 - DNA, 16 bp, Homo sapiens
tggacatggtctcctc

SEQ ID NO: 242346 - DNA, 13 bp, Homo sapiens
tggaccaaagctg

SEQ ID NO: 242347 - DNA, 14 bp, Homo sapiens
tggaccaaagctga

SEQ ID NO: 242348 - DNA, 13 bp, Homo sapiens
tggaccagatgct

SEQ ID NO: 242349 - DNA, 13 bp, Homo sapiens
tggaccagcctcc

SEQ ID NO: 242350 - DNA, 21 bp, Homo sapiens
tggaccatttgattgttttat

SEQ ID NO: 242351 - DNA, 23 bp, Homo sapiens
tggacccagcaggggcagaagga

SEQ ID NO: 242352 - DNA, 20 bp, Homo sapiens
tggaccgggtgggcctggcc

SEQ ID NO: 242353 - DNA, 21 bp, Homo sapiens
tggaccgggtgggcctggcct

SEQ ID NO: 242354 - DNA, 22 bp, Homo sapiens
tggaccgggtgggcctggcctg

SEQ ID NO: 242355 - DNA, 23 bp, Homo sapiens
tggaccgggtgggcctggcctga

SEQ ID NO: 242356 - DNA, 17 bp, Homo sapiens
tggacctaacattcgat

SEQ ID NO: 242357 - DNA, 22 bp, Homo sapiens
tggacctatgtcctaaggacac

SEQ ID NO: 242358 - DNA, 14 bp, Homo sapiens
tggacctattgcca

SEQ ID NO: 242359 - DNA, 17 bp, Homo sapiens
tggacctcgtgctttaa

SEQ ID NO: 242360 - DNA, 20 bp, Homo sapiens
tggacctctactttccaggc

SEQ ID NO: 242361 - DNA, 16 bp, Homo sapiens
tggacctgcctcctgc

SEQ ID NO: 242362 - DNA, 16 bp, Homo sapiens
tggaccttgagaccac

SEQ ID NO: 242363 - DNA, 16 bp, Homo sapiens
tggaggaatgctcccc

SEQ ID NO: 242364 - DNA, 22 bp, Homo sapiens
tggaggaatgctcccccatcct

SEQ ID NO: 242365 - DNA, 17 bp, Homo sapiens
tggaggacgtggactgg

SEQ ID NO: 242366 - DNA, 12 bp, Homo sapiens
tggaggaggagg

SEQ ID NO: 242367 - DNA, 19 bp, Homo sapiens
tggaggattctttccccag

SEQ ID NO: 242368 - DNA, 21 bp, Homo sapiens
tggaggattctttccccagag

SEQ ID NO: 242369 - DNA, 17 bp, Homo sapiens
tggaggcagccagggct

SEQ ID NO: 242370 - DNA, 19 bp, Homo sapiens
tggaggcattcccagaggt

SEQ ID NO: 242371 - DNA, 21 bp, Homo sapiens
tggaggccaccaagctgctct

SEQ ID NO: 242372 - DNA, 19 bp, Homo sapiens
tggaggcctcaccctgctt

SEQ ID NO: 242373 - DNA, 14 bp, Homo sapiens
tggaggcctgatgc

SEQ ID NO: 242374 - DNA, 15 bp, Homo sapiens
tggaggcctgatgct

SEQ ID NO: 242375 - DNA, 18 bp, Homo sapiens
tggaggcctggtctggag

SEQ ID NO: 242376 - DNA, 18 bp, Homo sapiens
tggagggattgaacacag

SEQ ID NO: 242377 - DNA, 19 bp, Homo sapiens
tggagggattgaacacagg

SEQ ID NO: 242378 - DNA, 22 bp, Homo sapiens
tggagggcaaggggtttccaca

SEQ ID NO: 242379 - DNA, 15 bp, Homo sapiens
tggaggggaaacgca

SEQ ID NO: 242380 - DNA, 20 bp, Homo sapiens
tggaggggtggtcctgactc

SEQ ID NO: 242381 - DNA, 20 bp, Homo sapiens
tggaggtgagatcacagcct

SEQ ID NO: 242382 - DNA, 11 bp, Homo sapiens
tggaggtggct

SEQ ID NO: 242383 - DNA, 18 bp, Homo sapiens
tggaggtgggcatgccac

SEQ ID NO: 242384 - DNA, 15 bp, Homo sapiens
tggaggttctcagag

SEQ ID NO: 242385 - DNA, 18 bp, Homo sapiens
tggagtactatatttaca

SEQ ID NO: 242386 - DNA, 18 bp, Homo sapiens
tggagtagacccctggct

SEQ ID NO: 242387 - DNA, 13 bp, Homo sapiens
tggagtcagatga

SEQ ID NO: 242388 - DNA, 18 bp, Homo sapiens
tggagtcagatgagcaag

SEQ ID NO: 242389 - DNA, 16 bp, Homo sapiens
tggagtccagacctgg

SEQ ID NO: 242390 - DNA, 22 bp, Homo sapiens
tggagtccagacctgggccctg

SEQ ID NO: 242391 - DNA, 17 bp, Homo sapiens
tggagtcctgttctcag

SEQ ID NO: 242392 - DNA, 23 bp, Homo sapiens
tggagtcggatctagccatggct

SEQ ID NO: 242393 - DNA, 16 bp, Homo sapiens
tggagtctgaaggaga

SEQ ID NO: 242394 - DNA, 20 bp, Homo sapiens
tggagtctgaaggagaggag

SEQ ID NO: 242395 - DNA, 17 bp, Homo sapiens
tggagtgagcagtagaa

SEQ ID NO: 242396 - DNA, 17 bp, Homo sapiens
tggagtgaggcttccag

SEQ ID NO: 242397 - DNA, 17 bp, Homo sapiens
tggagtgctgcttgtgc

SEQ ID NO: 242398 - DNA, 13 bp, Homo sapiens
tggagtgctggct

SEQ ID NO: 242399 - DNA, 16 bp, Homo sapiens
tggagtgctggctcca

SEQ ID NO: 242400 - DNA, 23 bp, Homo sapiens
tggagtgctggctccacgccctg

SEQ ID NO: 242401 - DNA, 19 bp, Homo sapiens
tggagtggaggcattgttt

SEQ ID NO: 242402 - DNA, 13 bp, Homo sapiens
tggagtggagggg

SEQ ID NO: 242403 - DNA, 20 bp, Homo sapiens
tggagtggaggggtcagcag

SEQ ID NO: 242404 - DNA, 22 bp, Homo sapiens
tggagtgtttgacgaagaaaca

SEQ ID NO: 242405 - DNA, 17 bp, Homo sapiens
tggagttacattaatgt

SEQ ID NO: 242406 - DNA, 17 bp, Homo sapiens
tggagttttaactgtaa

SEQ ID NO: 242407 - DNA, 15 bp, Homo sapiens
tggataaaaaagaaa

SEQ ID NO: 242408 - DNA, 16 bp, Homo sapiens
tggataaaaaagaaaa

SEQ ID NO: 242409 - DNA, 17 bp, Homo sapiens
tggataaaaaagaaaac

SEQ ID NO: 242410 - DNA, 14 bp, Homo sapiens
tggataaatcattt

SEQ ID NO: 242411 - DNA, 18 bp, Homo sapiens
tggataaatcatttcagt

SEQ ID NO: 242412 - DNA, 20 bp, Homo sapiens
tggataaatcatttcagtat

SEQ ID NO: 242413 - DNA, 20 bp, Homo sapiens
tggataataactagatctcc

SEQ ID NO: 242414 - DNA, 14 bp, Homo sapiens
tggataattttgca

SEQ ID NO: 242415 - DNA, 21 bp, Homo sapiens
tggataattttgcataaaatt

SEQ ID NO: 242416 - DNA, 22 bp, Homo sapiens
tggatactgcccggggcagctg

SEQ ID NO: 242417 - DNA, 18 bp, Homo sapiens
tggatatctgttagatgc

SEQ ID NO: 242418 - DNA, 14 bp, Homo sapiens
tggatatgtgtaaa

SEQ ID NO: 242419 - DNA, 18 bp, Homo sapiens
tggatatgtgtaaatgtt

SEQ ID NO: 242420 - DNA, 18 bp, Homo sapiens
tggatattttcaaattgt

SEQ ID NO: 242421 - DNA, 23 bp, Homo sapiens
tggatattttcaaattgtatcta

SEQ ID NO: 242422 - DNA, 18 bp, Homo sapiens
tggatccatacaaaacta

SEQ ID NO: 242423 - DNA, 17 bp, Homo sapiens
tggatccccagtgaaaa

SEQ ID NO: 242424 - DNA, 23 bp, Homo sapiens
tggatcccctctgtctacaaata

SEQ ID NO: 242425 - DNA, 21 bp, Homo sapiens
tggatctatcacctgtcatca

SEQ ID NO: 242426 - DNA, 16 bp, Homo sapiens
tggatctgctccatgc

SEQ ID NO: 242427 - DNA, 18 bp, Homo sapiens
tggatcttcaatggcttt

SEQ ID NO: 242428 - DNA, 16 bp, Homo sapiens
tggatcttttcattct

SEQ ID NO: 242429 - DNA, 19 bp, Homo sapiens
tggatgaagattctcctgt

SEQ ID NO: 242430 - DNA, 16 bp, Homo sapiens
tggatgattcttttcc

SEQ ID NO: 242431 - DNA, 19 bp, Homo sapiens
tggatgcatgccctaagag

SEQ ID NO: 242432 - DNA, 20 bp, Homo sapiens
tggatgggagtgggcacctc

SEQ ID NO: 242433 - DNA, 23 bp, Homo sapiens
tggatgggagtgggcacctcaga

SEQ ID NO: 242434 - DNA, 14 bp, Homo sapiens
tggatggtgacttt

SEQ ID NO: 242435 - DNA, 20 bp, Homo sapiens
tggatggtgacttttgaaga

SEQ ID NO: 242436 - DNA, 23 bp, Homo sapiens
tggatgtcctcaaagaagtggtt

SEQ ID NO: 242437 - DNA, 13 bp, Homo sapiens
tggattaaatggc

SEQ ID NO: 242438 - DNA, 15 bp, Homo sapiens
tggattaaatggcac

SEQ ID NO: 242439 - DNA, 22 bp, Homo sapiens
tggattaaatggcacctgtata

SEQ ID NO: 242440 - DNA, 19 bp, Homo sapiens
tggattaatgttttgtaca

SEQ ID NO: 242441 - DNA, 17 bp, Homo sapiens
tggattagcctggagca

SEQ ID NO: 242442 - DNA, 14 bp, Homo sapiens
tggattattcattt

SEQ ID NO: 242443 - DNA, 16 bp, Homo sapiens
tggattattcatttaa

SEQ ID NO: 242444 - DNA, 18 bp, Homo sapiens
tggattattcatttaaaa

SEQ ID NO: 242445 - DNA, 18 bp, Homo sapiens
tggattctatatttcata

SEQ ID NO: 242446 - DNA, 21 bp, Homo sapiens
tggatttatgttgtatagatt

SEQ ID NO: 242447 - DNA, 23 bp, Homo sapiens
tggatttgacacactcaccattt

SEQ ID NO: 242448 - DNA, 21 bp, Homo sapiens
tggatttgcatttttgtattt

SEQ ID NO: 242449 - DNA, 17 bp, Homo sapiens
tggatttgcctgtgcca

SEQ ID NO: 242450 - DNA, 19 bp, Homo sapiens
tggatttgggagctctgct

SEQ ID NO: 242451 - DNA, 19 bp, Homo sapiens
tggattttaaaaattggaa

SEQ ID NO: 242452 - DNA, 20 bp, Homo sapiens
tggattttctattgttactc

SEQ ID NO: 242453 - DNA, 14 bp, Homo sapiens
tggattttctttct

SEQ ID NO: 242454 - DNA, 15 bp, Homo sapiens
tggatttttaaatta

SEQ ID NO: 242455 - DNA, 22 bp, Homo sapiens
tggatttttacaaataaagatg

SEQ ID NO: 242456 - DNA, 14 bp, Homo sapiens
tggcaaaagacatc

SEQ ID NO: 242457 - DNA, 20 bp, Homo sapiens
tggcaaggtgggttccaggg

SEQ ID NO: 242458 - DNA, 13 bp, Homo sapiens
tggcaataaatgg

SEQ ID NO: 242459 - DNA, 21 bp, Homo sapiens
tggcaataaatgtcccaaata

SEQ ID NO: 242460 - DNA, 16 bp, Homo sapiens
tggcaatagtgtgttc

SEQ ID NO: 242461 - DNA, 14 bp, Homo sapiens
tggcaattctttga

SEQ ID NO: 242462 - DNA, 23 bp, Homo sapiens
tggcaattctttgacctcaacct

SEQ ID NO: 242463 - DNA, 22 bp, Homo sapiens
tggcacacaatcctataaatgt

SEQ ID NO: 242464 - DNA, 13 bp, Homo sapiens
tggcacagaaagg

SEQ ID NO: 242465 - DNA, 22 bp, Homo sapiens
tggcacagacttctggaaggct

SEQ ID NO: 242466 - DNA, 23 bp, Homo sapiens
tggcacagacttctggaaggctg

SEQ ID NO: 242467 - DNA, 15 bp, Homo sapiens
tggcacagggcagtg

SEQ ID NO: 242468 - DNA, 20 bp, Homo sapiens
tggcacatagtgggccttca

SEQ ID NO: 242469 - DNA, 21 bp, Homo sapiens
tggcacatttccccagacctg

SEQ ID NO: 242470 - DNA, 11 bp, Homo sapiens
tggcaccaaag

SEQ ID NO: 242471 - DNA, 13 bp, Homo sapiens
tggcaccagcccc

SEQ ID NO: 242472 - DNA, 18 bp, Homo sapiens
tggcaccagccccctgga

SEQ ID NO: 242473 - DNA, 14 bp, Homo sapiens
tggcacccccatgc

SEQ ID NO: 242474 - DNA, 16 bp, Homo sapiens
tggcacccctttctag

SEQ ID NO: 242475 - DNA, 13 bp, Homo sapiens
tggcacctcctga

SEQ ID NO: 242476 - DNA, 13 bp, Homo sapiens
tggcacctgtata

SEQ ID NO: 242477 - DNA, 15 bp, Homo sapiens
tggcacctgtggcca

SEQ ID NO: 242478 - DNA, 16 bp, Homo sapiens
tggcacctgtggccag

SEQ ID NO: 242479 - DNA, 16 bp, Homo sapiens
tggcacgatctcagct

SEQ ID NO: 242480 - DNA, 18 bp, Homo sapiens
tggcacgatctcagctca

SEQ ID NO: 242481 - DNA, 19 bp, Homo sapiens
tggcacgcacctgtagtcc

SEQ ID NO: 242482 - DNA, 22 bp, Homo sapiens
tggcacgcacctgtagtcccag

SEQ ID NO: 242483 - DNA, 14 bp, Homo sapiens
tggcacgtcctcca

SEQ ID NO: 242484 - DNA, 19 bp, Homo sapiens
tggcactgatgggcactgg

SEQ ID NO: 242485 - DNA, 13 bp, Homo sapiens
tggcactggatgc

SEQ ID NO: 242486 - DNA, 18 bp, Homo sapiens
tggcactggatgcagaaa

SEQ ID NO: 242487 - DNA, 21 bp, Homo sapiens
tggcacttagctatcagaaga

SEQ ID NO: 242488 - DNA, 14 bp, Homo sapiens
tggcactttagtga

SEQ ID NO: 242489 - DNA, 15 bp, Homo sapiens
tggcactttttcaca

SEQ ID NO: 242490 - DNA, 18 bp, Homo sapiens
tttttgagtaattttctg

SEQ ID NO: 242491 - DNA, 12 bp, Homo sapiens
tttttgctgatt

SEQ ID NO: 242492 - DNA, 15 bp, Homo sapiens
tttttggaaactgtt

SEQ ID NO: 242493 - DNA, 15 bp, Homo sapiens
tttttggcattatct

SEQ ID NO: 242494 - DNA, 15 bp, Homo sapiens
tttttggttgtttgc

SEQ ID NO: 242495 - DNA, 21 bp, Homo sapiens
tttttgtatttcttttatata

SEQ ID NO: 242496 - DNA, 21 bp, Homo sapiens
tttttgtcccccaacttgaga

SEQ ID NO: 242497 - DNA, 11 bp, Homo sapiens
aaaaaaaagaa

SEQ ID NO: 242498 - DNA, 10 bp, Homo sapiens
aaaaaaagaa

SEQ ID NO: 242499 - DNA, 14 bp, Homo sapiens
aaaaaaatatgaga

SEQ ID NO: 242500 - DNA, 12 bp, Homo sapiens
aaaaaaatcaaa

SEQ ID NO: 242501 - DNA, 12 bp, Homo sapiens
aaaaaaattggc

SEQ ID NO: 242502 - DNA, 10 bp, Homo sapiens
aaaaaacaag

SEQ ID NO: 242503 - DNA, 11 bp, Homo sapiens
aaaaaactttt

SEQ ID NO: 242504 - DNA, 15 bp, Homo sapiens
aaaaaagaagtttgg

SEQ ID NO: 242505 - DNA, 12 bp, Homo sapiens
aaaaaaggaaaa

SEQ ID NO: 242506 - DNA, 19 bp, Homo sapiens
aaaaaagggacagcatgcc

SEQ ID NO: 242507 - DNA, 20 bp, Homo sapiens
aaaaaagtttacaagtgtat

SEQ ID NO: 242508 - DNA, 12 bp, Homo sapiens
aaaaaataacac

SEQ ID NO: 242509 - DNA, 11 bp, Homo sapiens
aaaaaatatat

SEQ ID NO: 242510 - DNA, 22 bp, Homo sapiens
aaaaaatctctccccaatgctc

SEQ ID NO: 242511 - DNA, 15 bp, Homo sapiens
aaaaaatgcgtatat

SEQ ID NO: 242512 - DNA, 13 bp, Homo sapiens
aaaaaattggcat

SEQ ID NO: 242513 - DNA, 18 bp, Homo sapiens
aaaaacaatatttattgt

SEQ ID NO: 242514 - DNA, 16 bp, Homo sapiens
aaaaacacggcagctg

SEQ ID NO: 242515 - DNA, 12 bp, Homo sapiens
aaaaacactagt

SEQ ID NO: 242516 - DNA, 17 bp, Homo sapiens
aaaaacagaacatttct

SEQ ID NO: 242517 - DNA, 12 bp, Homo sapiens
aaaaacagagga

SEQ ID NO: 242518 - DNA, 13 bp, Homo sapiens
aaaaacatgtcat

SEQ ID NO: 242519 - DNA, 16 bp, Homo sapiens
aaaaacattttaaaat

SEQ ID NO: 242520 - DNA, 20 bp, Homo sapiens
aaaaacattttaaaatcaac

SEQ ID NO: 242521 - DNA, 22 bp, Homo sapiens
aaaaaccacagatactgaaaca

SEQ ID NO: 242522 - DNA, 14 bp, Homo sapiens
aaaaaccagaatta

SEQ ID NO: 242523 - DNA, 20 bp, Homo sapiens
aaaaactaaatctctaatat

SEQ ID NO: 242524 - DNA, 18 bp, Homo sapiens
aaaaactcctgtcttgct

SEQ ID NO: 242525 - DNA, 13 bp, Homo sapiens
aaaaactttccat

SEQ ID NO: 242526 - DNA, 12 bp, Homo sapiens
aaaaagaaaaca

SEQ ID NO: 242527 - DNA, 20 bp, Homo sapiens
aaaaagagaaaaaccaatga

SEQ ID NO: 242528 - DNA, 21 bp, Homo sapiens
aaaaagcagctaccaggtgtt

SEQ ID NO: 242529 - DNA, 20 bp, Homo sapiens
aaaaagcctgcaatttcata

SEQ ID NO: 242530 - DNA, 15 bp, Homo sapiens
aaaaaggaaaactca

SEQ ID NO: 242531 - DNA, 22 bp, Homo sapiens
aaaaaggagctcttcttgtgaa

SEQ ID NO: 242532 - DNA, 12 bp, Homo sapiens
aaaaaggccttt

SEQ ID NO: 242533 - DNA, 21 bp, Homo sapiens
aaaaaggcctttgggatttgc

SEQ ID NO: 242534 - DNA, 22 bp, Homo sapiens
aaaaagggcagggcatctcctg

SEQ ID NO: 242535 - DNA, 11 bp, Homo sapiens
aaaaaggttta

SEQ ID NO: 242536 - DNA, 11 bp, Homo sapiens
aaaaagtcaat

SEQ ID NO: 242537 - DNA, 16 bp, Homo sapiens
aaaaagtgacacagca

SEQ ID NO: 242538 - DNA, 17 bp, Homo sapiens
aaaaagtgacacagcag

SEQ ID NO: 242539 - DNA, 23 bp, Homo sapiens
aaaaagtgacacagcagcttcac

SEQ ID NO: 242540 - DNA, 23 bp, Homo sapiens
aaaaagtgggttttttagttgaa

SEQ ID NO: 242541 - DNA, 13 bp, Homo sapiens
aaaaagtgtttat

SEQ ID NO: 242542 - DNA, 23 bp, Homo sapiens
aaaaagtgtttatttttcatatt

SEQ ID NO: 242543 - DNA, 13 bp, Homo sapiens
aaaaagttgaagg

SEQ ID NO: 242544 - DNA, 17 bp, Homo sapiens
aaaaagtttacaagtgt

SEQ ID NO: 242545 - DNA, 19 bp, Homo sapiens
aaaaagtttggttctgtgt

SEQ ID NO: 242546 - DNA, 12 bp, Homo sapiens
aaaaataaaatg

SEQ ID NO: 242547 - DNA, 22 bp, Homo sapiens
aaaaataaccccaaaatgaaga

SEQ ID NO: 242548 - DNA, 12 bp, Homo sapiens
aaaaataataaa

SEQ ID NO: 242549 - DNA, 17 bp, Homo sapiens
aaaaataataaattgca

SEQ ID NO: 242550 - DNA, 14 bp, Homo sapiens
aaaaatacatgcat

SEQ ID NO: 242551 - DNA, 19 bp, Homo sapiens
aaaaatagtaagcctccct

SEQ ID NO: 242552 - DNA, 18 bp, Homo sapiens
aaaaatagtcttccacaa

SEQ ID NO: 242553 - DNA, 13 bp, Homo sapiens
aaaaatataaaca

SEQ ID NO: 242554 - DNA, 14 bp, Homo sapiens
aaaaatataaacaa

SEQ ID NO: 242555 - DNA, 12 bp, Homo sapiens
aaaaatatatta

SEQ ID NO: 242556 - DNA, 21 bp, Homo sapiens
aaaaatatattaaaaatataa

SEQ ID NO: 242557 - DNA, 13 bp, Homo sapiens
aaaaatatattta

SEQ ID NO: 242558 - DNA, 15 bp, Homo sapiens
aaaaatatatttaat

SEQ ID NO: 242559 - DNA, 19 bp, Homo sapiens
aaaaatatatttaatgata

SEQ ID NO: 242560 - DNA, 17 bp, Homo sapiens
aaaaatcactcatataa

SEQ ID NO: 242561 - DNA, 17 bp, Homo sapiens
aaaaatcagtgtttaaa

SEQ ID NO: 242562 - DNA, 12 bp, Homo sapiens
aaaaatctagtt

SEQ ID NO: 242563 - DNA, 15 bp, Homo sapiens
aaaaatctagttttt

SEQ ID NO: 242564 - DNA, 20 bp, Homo sapiens
aaaaatgaatgtctaaaatt

SEQ ID NO: 242565 - DNA, 12 bp, Homo sapiens
aaaaatgcatga

SEQ ID NO: 242566 - DNA, 18 bp, Homo sapiens
aaaaatgcccttaaatca

SEQ ID NO: 242567 - DNA, 20 bp, Homo sapiens
aaaaattaaaccaagcagct

SEQ ID NO: 242568 - DNA, 15 bp, Homo sapiens
aaaaattatctttaa

SEQ ID NO: 242569 - DNA, 14 bp, Homo sapiens
aaaaattgtgatca

SEQ ID NO: 242570 - DNA, 15 bp, Homo sapiens
aaaaatttaagcatt

SEQ ID NO: 242571 - DNA, 20 bp, Homo sapiens
aaaaatttaagcattgtttg

SEQ ID NO: 242572 - DNA, 21 bp, Homo sapiens
aaaaatttaagcattgtttgc

SEQ ID NO: 242573 - DNA, 15 bp, Homo sapiens
aaaaatttgtttaaa

SEQ ID NO: 242574 - DNA, 15 bp, Homo sapiens
aaaacaaaaaacaat

SEQ ID NO: 242575 - DNA, 23 bp, Homo sapiens
aaaacaaaaattcacaagctgcc

SEQ ID NO: 242576 - DNA, 10 bp, Homo sapiens
aaaacaaaat

SEQ ID NO: 242577 - DNA, 16 bp, Homo sapiens
aaaacaaagctgattt

SEQ ID NO: 242578 - DNA, 12 bp, Homo sapiens
aaaacaacaaaa

SEQ ID NO: 242579 - DNA, 13 bp, Homo sapiens
aaaacaacaaaaa

SEQ ID NO: 242580 - DNA, 22 bp, Homo sapiens
aaaacaacagcaacaacaacag

SEQ ID NO: 242581 - DNA, 17 bp, Homo sapiens
aaaacaagaaagtttcc

SEQ ID NO: 242582 - DNA, 18 bp, Homo sapiens
aaaacaagaaagtttccc

SEQ ID NO: 242583 - DNA, 17 bp, Homo sapiens
aaaacaagcaggatggc

SEQ ID NO: 242584 - DNA, 21 bp, Homo sapiens
aaagcagtgcatgctgtccct

SEQ ID NO: 242585 - DNA, 22 bp, Homo sapiens
aaagcagtgcatgctgtccctt

SEQ ID NO: 242586 - DNA, 12 bp, Homo sapiens
aaagcagtgttt

SEQ ID NO: 242587 - DNA, 14 bp, Homo sapiens
aaagcagtgttttc

SEQ ID NO: 242588 - DNA, 18 bp, Homo sapiens
aaagcagtgttttcacct

SEQ ID NO: 242589 - DNA, 22 bp, Homo sapiens
aaagcagttgggagtacatatg

SEQ ID NO: 242590 - DNA, 14 bp, Homo sapiens
aaagcatatataaa

SEQ ID NO: 242591 - DNA, 16 bp, Homo sapiens
aaagcatatataaaac

SEQ ID NO: 242592 - DNA, 18 bp, Homo sapiens
aaagcatatataaaacaa

SEQ ID NO: 242593 - DNA, 14 bp, Homo sapiens
aaagcatcaaataa

SEQ ID NO: 242594 - DNA, 19 bp, Homo sapiens
aaagcatcaaataatacat

SEQ ID NO: 242595 - DNA, 13 bp, Homo sapiens
aaagcatccatgt

SEQ ID NO: 242596 - DNA, 18 bp, Homo sapiens
aaagcatgctcagtattg

SEQ ID NO: 242597 - DNA, 19 bp, Homo sapiens
aaagcatgctcagtattga

SEQ ID NO: 242598 - DNA, 14 bp, Homo sapiens
aaagcatttatcat

SEQ ID NO: 242599 - DNA, 20 bp, Homo sapiens
aaagcatttgagctgtggtt

SEQ ID NO: 242600 - DNA, 23 bp, Homo sapiens
aaagccaagcaaaccaatggtga

SEQ ID NO: 242601 - DNA, 17 bp, Homo sapiens
aaagccacaaggctggc

SEQ ID NO: 242602 - DNA, 12 bp, Homo sapiens
aaagccacccca

SEQ ID NO: 242603 - DNA, 17 bp, Homo sapiens
aaagccactagactctt

SEQ ID NO: 242604 - DNA, 18 bp, Homo sapiens
aaagccatatcaccagtc

SEQ ID NO: 242605 - DNA, 20 bp, Homo sapiens
aaagccatattccagcagtg

SEQ ID NO: 242606 - DNA, 21 bp, Homo sapiens
aaagccatattccagcagtga

SEQ ID NO: 242607 - DNA, 19 bp, Homo sapiens
aaagcccacctgggctggg

SEQ ID NO: 242608 - DNA, 18 bp, Homo sapiens
aaagcccagcccggctga

SEQ ID NO: 242609 - DNA, 18 bp, Homo sapiens
aaagcccctcacctcagg

SEQ ID NO: 242610 - DNA, 20 bp, Homo sapiens
aaagcccctcacctcaggac

SEQ ID NO: 242611 - DNA, 13 bp, Homo sapiens
aaagccctcttca

SEQ ID NO: 242612 - DNA, 13 bp, Homo sapiens
aaagcctaagaaa

SEQ ID NO: 242613 - DNA, 20 bp, Homo sapiens
aaagcctaagaaaaaggaaa

SEQ ID NO: 242614 - DNA, 20 bp, Homo sapiens
aaagcctgggcagaaatgtg

SEQ ID NO: 242615 - DNA, 17 bp, Homo sapiens
aaagcgatatacagatg

SEQ ID NO: 242616 - DNA, 19 bp, Homo sapiens
aaagtgcagcccttcctcc

SEQ ID NO: 242617 - DNA, 16 bp, Homo sapiens
aaagtgctacttgaga

SEQ ID NO: 242618 - DNA, 10 bp, Homo sapiens
aaagtgctgg

SEQ ID NO: 242619 - DNA, 15 bp, Homo sapiens
aaagtggattttcct

SEQ ID NO: 242620 - DNA, 18 bp, Homo sapiens
aaagtggattttcctgaa

SEQ ID NO: 242621 - DNA, 18 bp, Homo sapiens
aaagtggcagagccagga

SEQ ID NO: 242622 - DNA, 19 bp, Homo sapiens
aaagtggctaattcaattt

SEQ ID NO: 242623 - DNA, 22 bp, Homo sapiens
aaagtggctaattcaatttatg

SEQ ID NO: 242624 - DNA, 17 bp, Homo sapiens
aaagtgggtttcaattt

SEQ ID NO: 242625 - DNA, 17 bp, Homo sapiens
aaagtgggttttttagt

SEQ ID NO: 242626 - DNA, 17 bp, Homo sapiens
aaagtggtacaggaagg

SEQ ID NO: 242627 - DNA, 19 bp, Homo sapiens
aaagtggtggcaaaagaca

SEQ ID NO: 242628 - DNA, 20 bp, Homo sapiens
aaagtggtggcaaaagacat

SEQ ID NO: 242629 - DNA, 16 bp, Homo sapiens
aaagtgtaaaatagaa

SEQ ID NO: 242630 - DNA, 14 bp, Homo sapiens
aaagtgtacaattt

SEQ ID NO: 242631 - DNA, 20 bp, Homo sapiens
aaagtgtacaattttcatcc

SEQ ID NO: 242632 - DNA, 16 bp, Homo sapiens
aaagtgtagcaccctg

SEQ ID NO: 242633 - DNA, 13 bp, Homo sapiens
aaagtgtgcttta

SEQ ID NO: 242634 - DNA, 22 bp, Homo sapiens
aaagtgtgctttatgctgaaac

SEQ ID NO: 242635 - DNA, 23 bp, Homo sapiens
aaagtgtgctttatgctgaaaca

SEQ ID NO: 242636 - DNA, 14 bp, Homo sapiens
aaagtgtgttgttg

SEQ ID NO: 242637 - DNA, 12 bp, Homo sapiens
aaagtgttggtc

SEQ ID NO: 242638 - DNA, 20 bp, Homo sapiens
aaagtgtttatttttcatat

SEQ ID NO: 242639 - DNA, 21 bp, Homo sapiens
aaagtgtttatttttcatatt

SEQ ID NO: 242640 - DNA, 22 bp, Homo sapiens
aaagttaaacattgaagtaatg

SEQ ID NO: 242641 - DNA, 13 bp, Homo sapiens
aaagttaacatta

SEQ ID NO: 242642 - DNA, 20 bp, Homo sapiens
aaagttaacctacctgtaac

SEQ ID NO: 242643 - DNA, 14 bp, Homo sapiens
aaagttaactctta

SEQ ID NO: 242644 - DNA, 22 bp, Homo sapiens
aaagttacttgaatttcaaaca

SEQ ID NO: 242645 - DNA, 13 bp, Homo sapiens
aaagttattatgt

SEQ ID NO: 242646 - DNA, 13 bp, Homo sapiens
aaagttccagttt

SEQ ID NO: 242647 - DNA, 14 bp, Homo sapiens
aaagttctcagaac

SEQ ID NO: 242648 - DNA, 22 bp, Homo sapiens
aaagttgataggagacttgtac

SEQ ID NO: 242649 - DNA, 14 bp, Homo sapiens
aaagttgtcttaaa

SEQ ID NO: 242650 - DNA, 15 bp, Homo sapiens
aaatattcaataaga

SEQ ID NO: 242651 - DNA, 11 bp, Homo sapiens
aaatattcttg

SEQ ID NO: 242652 - DNA, 17 bp, Homo sapiens
aaatattgcttggacta

SEQ ID NO: 242653 - DNA, 22 bp, Homo sapiens
aaatattgcttggactacctat

SEQ ID NO: 242654 - DNA, 20 bp, Homo sapiens
aaatatttaatgatgtgtca

SEQ ID NO: 242655 - DNA, 15 bp, Homo sapiens
aaatatttatattgt

SEQ ID NO: 242656 - DNA, 19 bp, Homo sapiens
aaatatttatttgttttgg

SEQ ID NO: 242657 - DNA, 12 bp, Homo sapiens
aaatatttcctt

SEQ ID NO: 242658 - DNA, 13 bp, Homo sapiens
aaatatttctaag

SEQ ID NO: 242659 - DNA, 19 bp, Homo sapiens
aaatattttgataataaat

SEQ ID NO: 242660 - DNA, 21 bp, Homo sapiens
aaatattttgataataaattg

SEQ ID NO: 242661 - DNA, 15 bp, Homo sapiens
aaatatttttccctc

SEQ ID NO: 242662 - DNA, 17 bp, Homo sapiens
aaatcaaatttttctgg

SEQ ID NO: 242663 - DNA, 19 bp, Homo sapiens
aaatcaacttgtgtactga

SEQ ID NO: 242664 - DNA, 19 bp, Homo sapiens
aaatcaattttttaaacca

SEQ ID NO: 242665 - DNA, 16 bp, Homo sapiens
aaatcaccttttctaa

SEQ ID NO: 242666 - DNA, 18 bp, Homo sapiens
aaatcaccttttctaaaa

SEQ ID NO: 242667 - DNA, 13 bp, Homo sapiens
aaatcagagcagt

SEQ ID NO: 242668 - DNA, 18 bp, Homo sapiens
aaatcagttttgtgtaca

SEQ ID NO: 242669 - DNA, 19 bp, Homo sapiens
aaatcatactgtaaggaaa

SEQ ID NO: 242670 - DNA, 19 bp, Homo sapiens
aaatcattaatactcttct

SEQ ID NO: 242671 - DNA, 14 bp, Homo sapiens
aaatcattcaaaac

SEQ ID NO: 242672 - DNA, 14 bp, Homo sapiens
aaatcattgtagaa

SEQ ID NO: 242673 - DNA, 20 bp, Homo sapiens
aaatcattgtagaaacacag

SEQ ID NO: 242674 - DNA, 23 bp, Homo sapiens
aaatccatatcttaaagaaacag

SEQ ID NO: 242675 - DNA, 15 bp, Homo sapiens
aaatccatttaatca

SEQ ID NO: 242676 - DNA, 21 bp, Homo sapiens
aaatccattttctaaactgtt

SEQ ID NO: 242677 - DNA, 21 bp, Homo sapiens
aaatcccatctctaaaaaaat

SEQ ID NO: 242678 - DNA, 14 bp, Homo sapiens
aaatcctaccaaag

SEQ ID NO: 242679 - DNA, 15 bp, Homo sapiens
aaatcctaccaaagt

SEQ ID NO: 242680 - DNA, 17 bp, Homo sapiens
aaatcctaccaacctct

SEQ ID NO: 242681 - DNA, 19 bp, Homo sapiens
aaatcctaccaacctctga

SEQ ID NO: 242682 - DNA, 18 bp, Homo sapiens
aaatcctggcaagtgacc

SEQ ID NO: 242683 - DNA, 23 bp, Homo sapiens
aaatcctgggcatccccagcccc

SEQ ID NO: 242684 - DNA, 18 bp, Homo sapiens
aaatcctgttacttaaat

SEQ ID NO: 242685 - DNA, 16 bp, Homo sapiens
aaatcctttactgtta

SEQ ID NO: 242686 - DNA, 22 bp, Homo sapiens
aaatcgccttatgagaacatgg

SEQ ID NO: 242687 - DNA, 23 bp, Homo sapiens
aaatcggatctggggctctggga

SEQ ID NO: 242688 - DNA, 21 bp, Homo sapiens
aaatctaaaacaaaatctgaa

SEQ ID NO: 242689 - DNA, 20 bp, Homo sapiens
aaatctaaatagatactttt

SEQ ID NO: 242690 - DNA, 21 bp, Homo sapiens
aaatctaaatagatacttttg

SEQ ID NO: 242691 - DNA, 22 bp, Homo sapiens
aaatctaaattaacttctattt

SEQ ID NO: 242692 - DNA, 18 bp, Homo sapiens
aaatctaatattaaaaat

SEQ ID NO: 242693 - DNA, 19 bp, Homo sapiens
aaatctaatattaaaaata

SEQ ID NO: 242694 - DNA, 16 bp, Homo sapiens
aaatctagatcaatta

SEQ ID NO: 242695 - DNA, 21 bp, Homo sapiens
aaatctagatcaattaattct

SEQ ID NO: 242696 - DNA, 20 bp, Homo sapiens
aaatctagttttttttgtaa

SEQ ID NO: 242697 - DNA, 21 bp, Homo sapiens
aaatctagttttttttgtaaa

SEQ ID NO: 242698 - DNA, 13 bp, Homo sapiens
aaatctattcaga

SEQ ID NO: 242699 - DNA, 17 bp, Homo sapiens
aaatctcaccccatccc

SEQ ID NO: 242700 - DNA, 14 bp, Homo sapiens
aaatctcatcccta

SEQ ID NO: 242701 - DNA, 17 bp, Homo sapiens
aaatctcctttgtccat

SEQ ID NO: 242702 - DNA, 12 bp, Homo sapiens
aaatctctaata

SEQ ID NO: 242703 - DNA, 13 bp, Homo sapiens
aaatctctaatat

SEQ ID NO: 242704 - DNA, 16 bp, Homo sapiens
aaatctctagcctctt

SEQ ID NO: 242705 - DNA, 17 bp, Homo sapiens
aaatctctagcctcttt

SEQ ID NO: 242706 - DNA, 19 bp, Homo sapiens
aaatctgggtatctttcca

SEQ ID NO: 242707 - DNA, 19 bp, Homo sapiens
aaatctgtaagctctttga

SEQ ID NO: 242708 - DNA, 22 bp, Homo sapiens
aaatctgtccaaaggaggctgg

SEQ ID NO: 242709 - DNA, 15 bp, Homo sapiens
aaatctgtctgattc

SEQ ID NO: 242710 - DNA, 22 bp, Homo sapiens
aaatctgtctgattctatgcct

SEQ ID NO: 242711 - DNA, 15 bp, Homo sapiens
aaatctgtgaattaa

SEQ ID NO: 242712 - DNA, 20 bp, Homo sapiens
aaatctgtgaattaaaaaag

SEQ ID NO: 242713 - DNA, 23 bp, Homo sapiens
aaatctgtgatgatcctcatatg

SEQ ID NO: 242714 - DNA, 13 bp, Homo sapiens
aaatcttacaaca

SEQ ID NO: 242715 - DNA, 15 bp, Homo sapiens
aaatcttcagctggt

SEQ ID NO: 242716 - DNA, 19 bp, Homo sapiens
aaatcttcagctggtggat

SEQ ID NO: 242717 - DNA, 21 bp, Homo sapiens
aaatcttcagctggtggatgg

SEQ ID NO: 242718 - DNA, 17 bp, Homo sapiens
aaatcttgtcatgtgta

SEQ ID NO: 242719 - DNA, 19 bp, Homo sapiens
aaatcttgtcatgtgtata

SEQ ID NO: 242720 - DNA, 14 bp, Homo sapiens
aaatctttaagaat

SEQ ID NO: 242721 - DNA, 22 bp, Homo sapiens
aaatcttttaaaaattcaaatg

SEQ ID NO: 242722 - DNA, 14 bp, Homo sapiens
aaatgaagaaaaag

SEQ ID NO: 242723 - DNA, 23 bp, Homo sapiens
aaatgaagattattttttatgag

SEQ ID NO: 242724 - DNA, 16 bp, Homo sapiens
aaatgaagttaactta

SEQ ID NO: 242725 - DNA, 18 bp, Homo sapiens
aaatgaataatttcccaa

SEQ ID NO: 242726 - DNA, 12 bp, Homo sapiens
aaatgaatgcat

SEQ ID NO: 242727 - DNA, 13 bp, Homo sapiens
aaatgaatgcatt

SEQ ID NO: 242728 - DNA, 16 bp, Homo sapiens
aaatgacttattgatt

SEQ ID NO: 242729 - DNA, 20 bp, Homo sapiens
aaatgagatgtatgcccaaa

SEQ ID NO: 242730 - DNA, 23 bp, Homo sapiens
aaatgagctcgcatttgtcaatg

SEQ ID NO: 242731 - DNA, 20 bp, Homo sapiens
aaatgagctttcaggaagtt

SEQ ID NO: 242732 - DNA, 17 bp, Homo sapiens
aaatgaggaaaagaaaa

SEQ ID NO: 242733 - DNA, 16 bp, Homo sapiens
aaatgaggacatgttt

SEQ ID NO: 242734 - DNA, 20 bp, Homo sapiens
aaatgagggacttccctaga

SEQ ID NO: 242735 - DNA, 15 bp, Homo sapiens
aaatgataaagatgt

SEQ ID NO: 242736 - DNA, 19 bp, Homo sapiens
aaatgataaagatgtcaaa

SEQ ID NO: 242737 - DNA, 16 bp, Homo sapiens
aaatgatgtgaaagga

SEQ ID NO: 242738 - DNA, 15 bp, Homo sapiens
aaatgattccaaata

SEQ ID NO: 242739 - DNA, 19 bp, Homo sapiens
aaatgattttattaccttg

SEQ ID NO: 242740 - DNA, 13 bp, Homo sapiens
aaatgattttcat

SEQ ID NO: 242741 - DNA, 13 bp, Homo sapiens
aaatgcagacaca

SEQ ID NO: 242742 - DNA, 14 bp, Homo sapiens
aaatgcagacacac

SEQ ID NO: 242743 - DNA, 22 bp, Homo sapiens
aaatgcagggaggggaggcaga

SEQ ID NO: 242744 - DNA, 18 bp, Homo sapiens
aaatgcagttttaagaat

SEQ ID NO: 242745 - DNA, 9 bp, Homo sapiens
aagggccag

SEQ ID NO: 242746 - DNA, 16 bp, Homo sapiens
aagggccagtcctgcc

SEQ ID NO: 242747 - DNA, 11 bp, Homo sapiens
aagggcccagg

SEQ ID NO: 242748 - DNA, 18 bp, Homo sapiens
aagggcgctgagggcagg

SEQ ID NO: 242749 - DNA, 15 bp, Homo sapiens
aagggctaaggcctc

SEQ ID NO: 242750 - DNA, 15 bp, Homo sapiens
aagggctccagcatc

SEQ ID NO: 242751 - DNA, 21 bp, Homo sapiens
aagggctccagcatccagcct

SEQ ID NO: 242752 - DNA, 14 bp, Homo sapiens
aagggcttttcttt

SEQ ID NO: 242753 - DNA, 21 bp, Homo sapiens
aaggggaaaatgtgaagctga

SEQ ID NO: 242754 - DNA, 23 bp, Homo sapiens
aaggggcacaccactgccctgcc

SEQ ID NO: 242755 - DNA, 19 bp, Homo sapiens
aaggggcagtctggagggg

SEQ ID NO: 242756 - DNA, 16 bp, Homo sapiens
aaggggccagctgccc

SEQ ID NO: 242757 - DNA, 20 bp, Homo sapiens
aaggggccccggggctggca

SEQ ID NO: 242758 - DNA, 16 bp, Homo sapiens
aaggggcgagcaccca

SEQ ID NO: 242759 - DNA, 18 bp, Homo sapiens
aaggggggcagggagtga

SEQ ID NO: 242760 - DNA, 17 bp, Homo sapiens
aaggggtgcctgggaac

SEQ ID NO: 242761 - DNA, 19 bp, Homo sapiens
aagggtccggcttggctag

SEQ ID NO: 242762 - DNA, 19 bp, Homo sapiens
aagggtccttccctctccc

SEQ ID NO: 242763 - DNA, 14 bp, Homo sapiens
aagggtgacatccc

SEQ ID NO: 242764 - DNA, 20 bp, Homo sapiens
aagggtgctgcttccctctg

SEQ ID NO: 242765 - DNA, 23 bp, Homo sapiens
aagggtgctgcttccctctgcct

SEQ ID NO: 242766 - DNA, 23 bp, Homo sapiens
aagggtgggcatcaaagatgaga

SEQ ID NO: 242767 - DNA, 21 bp, Homo sapiens
aagggtgtgggtcagggaggg

SEQ ID NO: 242768 - DNA, 22 bp, Homo sapiens
aagggtgtgggtcagggagggg

SEQ ID NO: 242769 - DNA, 17 bp, Homo sapiens
aagggtttgtggctggg

SEQ ID NO: 242770 - DNA, 23 bp, Homo sapiens
aaggtaatactataaatatattg

SEQ ID NO: 242771 - DNA, 14 bp, Homo sapiens
aaggtaatctgaaa

SEQ ID NO: 242772 - DNA, 21 bp, Homo sapiens
aaggtacggtgagactctgag

SEQ ID NO: 242773 - DNA, 20 bp, Homo sapiens
aaggtagccctggccagagg

SEQ ID NO: 242774 - DNA, 12 bp, Homo sapiens
aaggtagttttt

SEQ ID NO: 242775 - DNA, 21 bp, Homo sapiens
aaggtatacacccagttctga

SEQ ID NO: 242776 - DNA, 14 bp, Homo sapiens
aaggtatcacacac

SEQ ID NO: 242777 - DNA, 15 bp, Homo sapiens
aaggtatcacacact

SEQ ID NO: 242778 - DNA, 23 bp, Homo sapiens
aaggtatggtggggatattttta

SEQ ID NO: 242779 - DNA, 18 bp, Homo sapiens
aaggtcagtgttataaaa

SEQ ID NO: 242780 - DNA, 20 bp, Homo sapiens
aaggtcattgtggctatctg

SEQ ID NO: 242781 - DNA, 18 bp, Homo sapiens
aaggtccgagctctgtcc

SEQ ID NO: 242782 - DNA, 14 bp, Homo sapiens
aaggtcctctcagt

SEQ ID NO: 242783 - DNA, 23 bp, Homo sapiens
aaggtcctctcagttctctccct

SEQ ID NO: 242784 - DNA, 15 bp, Homo sapiens
aaggtcctgctgtgg

SEQ ID NO: 242785 - DNA, 19 bp, Homo sapiens
aaggtctccttactctgag

SEQ ID NO: 242786 - DNA, 23 bp, Homo sapiens
aaggtctccttactctgagccca

SEQ ID NO: 242787 - DNA, 13 bp, Homo sapiens
aaggtcttcttgt

SEQ ID NO: 242788 - DNA, 19 bp, Homo sapiens
aaggtcttcttgtgtcctg

SEQ ID NO: 242789 - DNA, 12 bp, Homo sapiens
aaggtgcacatt

SEQ ID NO: 242790 - DNA, 23 bp, Homo sapiens
aaggtgcagttcccccaacctca

SEQ ID NO: 242791 - DNA, 12 bp, Homo sapiens
aaggtgctcaaa

SEQ ID NO: 242792 - DNA, 21 bp, Homo sapiens
aaggtgctgttgtcattgctt

SEQ ID NO: 242793 - DNA, 23 bp, Homo sapiens
aaggtgctgttgtcattgcttta

SEQ ID NO: 242794 - DNA, 17 bp, Homo sapiens
aaggtgggggagcctgg

SEQ ID NO: 242795 - DNA, 19 bp, Homo sapiens
aaggtgggggttggctggg

SEQ ID NO: 242796 - DNA, 21 bp, Homo sapiens
aaggtggtcttggagaggagg

SEQ ID NO: 242797 - DNA, 23 bp, Homo sapiens
aaggtggtcttggagaggaggtg

SEQ ID NO: 242798 - DNA, 17 bp, Homo sapiens
aaggtgtaactctaatt

SEQ ID NO: 242799 - DNA, 13 bp, Homo sapiens
aaggtgtgctaca

SEQ ID NO: 242800 - DNA, 14 bp, Homo sapiens
aaggtgtgctacag

SEQ ID NO: 242801 - DNA, 22 bp, Homo sapiens
aaggtgttcattcacttgcatt

SEQ ID NO: 242802 - DNA, 18 bp, Homo sapiens
aaggttaacagtaaaaat

SEQ ID NO: 242803 - DNA, 22 bp, Homo sapiens
aaggttccaatcagatctttat

SEQ ID NO: 242804 - DNA, 21 bp, Homo sapiens
aaggttctcaggtgttgccaa

SEQ ID NO: 242805 - DNA, 12 bp, Homo sapiens
aagcacatttta

SEQ ID NO: 242806 - DNA, 14 bp, Homo sapiens
aagcaccccatgcc

SEQ ID NO: 242807 - DNA, 16 bp, Homo sapiens
aagcaccgcagcatgt

SEQ ID NO: 242808 - DNA, 13 bp, Homo sapiens
aagcactctgctg

SEQ ID NO: 242809 - DNA, 14 bp, Homo sapiens
aagcactctgctgg

SEQ ID NO: 242810 - DNA, 13 bp, Homo sapiens
aagcactgacact

SEQ ID NO: 242811 - DNA, 20 bp, Homo sapiens
aagcacttggactcttgctc

SEQ ID NO: 242812 - DNA, 23 bp, Homo sapiens
aagcactttgaaaatatttctat

SEQ ID NO: 242813 - DNA, 23 bp, Homo sapiens
aagcacttttcctgtctcagcct

SEQ ID NO: 242814 - DNA, 20 bp, Homo sapiens
aagcagacagcaagggcttg

SEQ ID NO: 242815 - DNA, 17 bp, Homo sapiens
aagcagacgcagcagct

SEQ ID NO: 242816 - DNA, 15 bp, Homo sapiens
aagcagagacctttg

SEQ ID NO: 242817 - DNA, 22 bp, Homo sapiens
aagcagagccagtcttcctcct

SEQ ID NO: 242818 - DNA, 15 bp, Homo sapiens
aagcagagttctttg

SEQ ID NO: 242819 - DNA, 17 bp, Homo sapiens
aagcagagttctttgca

SEQ ID NO: 242820 - DNA, 16 bp, Homo sapiens
aagcagcacttataaa

SEQ ID NO: 242821 - DNA, 11 bp, Homo sapiens
aagcagccagc

SEQ ID NO: 242822 - DNA, 14 bp, Homo sapiens
aagcagcctttctg

SEQ ID NO: 242823 - DNA, 21 bp, Homo sapiens
aagcagcctttctgtggagag

SEQ ID NO: 242824 - DNA, 16 bp, Homo sapiens
aagcagctaaattttc

SEQ ID NO: 242825 - DNA, 16 bp, Homo sapiens
aagcaggcaagcatgt

SEQ ID NO: 242826 - DNA, 15 bp, Homo sapiens
aagcaggctggaggt

SEQ ID NO: 242827 - DNA, 18 bp, Homo sapiens
aagcagggaaagctccac

SEQ ID NO: 242828 - DNA, 22 bp, Homo sapiens
aagcagggacaccccccgcccc

SEQ ID NO: 242829 - DNA, 23 bp, Homo sapiens
aagcagggagagttggggaaggc

SEQ ID NO: 242830 - DNA, 20 bp, Homo sapiens
aagcaggtttcttgcttctg

SEQ ID NO: 242831 - DNA, 22 bp, Homo sapiens
aagcagtaaaaactgttctcta

SEQ ID NO: 242832 - DNA, 20 bp, Homo sapiens
aagcagtagaaataatatgc

SEQ ID NO: 242833 - DNA, 13 bp, Homo sapiens
aagcagtcataag

SEQ ID NO: 242834 - DNA, 14 bp, Homo sapiens
aagcagtcttgctc

SEQ ID NO: 242835 - DNA, 14 bp, Homo sapiens
aagcagtgcatgct

SEQ ID NO: 242836 - DNA, 15 bp, Homo sapiens
aagcagtgcatgctg

SEQ ID NO: 242837 - DNA, 20 bp, Homo sapiens
aagcagtgccttccataatt

SEQ ID NO: 242838 - DNA, 16 bp, Homo sapiens
aagcagtgcttgtaaa

SEQ ID NO: 242839 - DNA, 18 bp, Homo sapiens
aagcagtgtcgccgtccc

SEQ ID NO: 242840 - DNA, 11 bp, Homo sapiens
aagcagtgttt

SEQ ID NO: 242841 - DNA, 14 bp, Homo sapiens
aagcagtgttttca

SEQ ID NO: 242842 - DNA, 17 bp, Homo sapiens
aagcatatataaaacaa

SEQ ID NO: 242843 - DNA, 21 bp, Homo sapiens
aagcatatataaaacaaaaca

SEQ ID NO: 242844 - DNA, 17 bp, Homo sapiens
aagcatcaaataataca

SEQ ID NO: 242845 - DNA, 15 bp, Homo sapiens
aagcatcacacagtg

SEQ ID NO: 242846 - DNA, 22 bp, Homo sapiens
aagcatcagagatggtaatcta

SEQ ID NO: 242847 - DNA, 13 bp, Homo sapiens
aagcatcagcaag

SEQ ID NO: 242848 - DNA, 16 bp, Homo sapiens
aagcatcagcaagaca

SEQ ID NO: 242849 - DNA, 17 bp, Homo sapiens
aagcatccatgtgtgga

SEQ ID NO: 242850 - DNA, 19 bp, Homo sapiens
aagcatccatgtgtggact

SEQ ID NO: 242851 - DNA, 13 bp, Homo sapiens
aagcatgaaaaag

SEQ ID NO: 242852 - DNA, 15 bp, Homo sapiens
aagcatgccccaccc

SEQ ID NO: 242853 - DNA, 12 bp, Homo sapiens
aagcatgctcag

SEQ ID NO: 242854 - DNA, 16 bp, Homo sapiens
aagcatgtctctgctt

SEQ ID NO: 242855 - DNA, 16 bp, Homo sapiens
aagcatgtttcatgtt

SEQ ID NO: 242856 - DNA, 23 bp, Homo sapiens
aagcattctgtgcataaaagtta

SEQ ID NO: 242857 - DNA, 14 bp, Homo sapiens
aagcattgaaatta

SEQ ID NO: 242858 - DNA, 17 bp, Homo sapiens
aagcattgaaattatag

SEQ ID NO: 242859 - DNA, 23 bp, Homo sapiens
aagcattgtttgcttattgttcc

SEQ ID NO: 242860 - DNA, 20 bp, Homo sapiens
aagcattttactgtctgtaa

SEQ ID NO: 242861 - DNA, 21 bp, Homo sapiens
aagcattttactgtctgtaag

SEQ ID NO: 242862 - DNA, 21 bp, Homo sapiens
aagcattttcagcatcaaaca

SEQ ID NO: 242863 - DNA, 21 bp, Homo sapiens
aagcattttctttctgttttt

SEQ ID NO: 242864 - DNA, 17 bp, Homo sapiens
aagccaaaaaccttagc

SEQ ID NO: 242865 - DNA, 18 bp, Homo sapiens
aagccaaacattcttatt

SEQ ID NO: 242866 - DNA, 16 bp, Homo sapiens
aagccaacaccctgtc

SEQ ID NO: 242867 - DNA, 9 bp, Homo sapiens
aagccaagc

SEQ ID NO: 242868 - DNA, 20 bp, Homo sapiens
aagccaagcaaaccaatggt

SEQ ID NO: 242869 - DNA, 22 bp, Homo sapiens
aagccaagtcagctttgccttc

SEQ ID NO: 242870 - DNA, 14 bp, Homo sapiens
aagccaataaataa

SEQ ID NO: 242871 - DNA, 16 bp, Homo sapiens
aagccaataaataata

SEQ ID NO: 242872 - DNA, 15 bp, Homo sapiens
aagccacaagaaatt

SEQ ID NO: 242873 - DNA, 16 bp, Homo sapiens
aagccacaagaaattt

SEQ ID NO: 242874 - DNA, 18 bp, Homo sapiens
aagccacaagaaatttga

SEQ ID NO: 242875 - DNA, 13 bp, Homo sapiens
aagccacagaaat

SEQ ID NO: 242876 - DNA, 17 bp, Homo sapiens
aagccacgtgctggaga

SEQ ID NO: 242877 - DNA, 15 bp, Homo sapiens
aagccactagactct

SEQ ID NO: 242878 - DNA, 11 bp, Homo sapiens
aagccagacag

SEQ ID NO: 242879 - DNA, 14 bp, Homo sapiens
aagccaggagaccc

SEQ ID NO: 242880 - DNA, 19 bp, Homo sapiens
aagccaggagaccctgtct

SEQ ID NO: 242881 - DNA, 22 bp, Homo sapiens
aagccagggatggggccacagc

SEQ ID NO: 242882 - DNA, 17 bp, Homo sapiens
aagccagtgactccagg

SEQ ID NO: 242883 - DNA, 23 bp, Homo sapiens
aagccagtggggtcccccctgag

SEQ ID NO: 242884 - DNA, 14 bp, Homo sapiens
aagccataggccca

SEQ ID NO: 242885 - DNA, 16 bp, Homo sapiens
aagccataggcccagg

SEQ ID NO: 242886 - DNA, 17 bp, Homo sapiens
aagccataggcccagga

SEQ ID NO: 242887 - DNA, 18 bp, Homo sapiens
aagccataggcccaggat

SEQ ID NO: 242888 - DNA, 21 bp, Homo sapiens
aagccatatgacaatttcaaa

SEQ ID NO: 242889 - DNA, 13 bp, Homo sapiens
aagccatcacttc

SEQ ID NO: 242890 - DNA, 20 bp, Homo sapiens
aagccatcacttctccccgc

SEQ ID NO: 242891 - DNA, 21 bp, Homo sapiens
aagccatcacttctccccgca

SEQ ID NO: 242892 - DNA, 20 bp, Homo sapiens
aagccattctaaggaaatta

SEQ ID NO: 242893 - DNA, 17 bp, Homo sapiens
aagccattgaccaccca

SEQ ID NO: 242894 - DNA, 22 bp, Homo sapiens
aagcccacccgccccagagact

SEQ ID NO: 242895 - DNA, 15 bp, Homo sapiens
aaatgtattcaaata

SEQ ID NO: 242896 - DNA, 13 bp, Homo sapiens
aaatgtgattttt

SEQ ID NO: 242897 - DNA, 16 bp, Homo sapiens
aaatgtgccatttttt

SEQ ID NO: 242898 - DNA, 18 bp, Homo sapiens
aaatgtggcatttgtgat

SEQ ID NO: 242899 - DNA, 17 bp, Homo sapiens
aaatgtgtgcttggaaa

SEQ ID NO: 242900 - DNA, 15 bp, Homo sapiens
aaatgtgtggtgcta

SEQ ID NO: 242901 - DNA, 21 bp, Homo sapiens
aaatgttaacagagtttgata

SEQ ID NO: 242902 - DNA, 15 bp, Homo sapiens
aaatgttagcaagat

SEQ ID NO: 242903 - DNA, 21 bp, Homo sapiens
aaatgttagcaagatgatttt

SEQ ID NO: 242904 - DNA, 11 bp, Homo sapiens
aaatgttatga

SEQ ID NO: 242905 - DNA, 18 bp, Homo sapiens
aaatgttattcaataact

SEQ ID NO: 242906 - DNA, 12 bp, Homo sapiens
aaatgttcattc

SEQ ID NO: 242907 - DNA, 17 bp, Homo sapiens
aaatgtttaatatctga

SEQ ID NO: 242908 - DNA, 20 bp, Homo sapiens
aaatgtttatattgttttta

SEQ ID NO: 242909 - DNA, 20 bp, Homo sapiens
aaatgttttacaatggctgg

SEQ ID NO: 242910 - DNA, 21 bp, Homo sapiens
aaatgttttacaatggctggg

SEQ ID NO: 242911 - DNA, 18 bp, Homo sapiens
aaatgttttcatttacag

SEQ ID NO: 242912 - DNA, 18 bp, Homo sapiens
aaatgtttttattaacaa

SEQ ID NO: 242913 - DNA, 21 bp, Homo sapiens
aaatgtttttctgccagggag

SEQ ID NO: 242914 - DNA, 16 bp, Homo sapiens
aaattaaaaatttttt

SEQ ID NO: 242915 - DNA, 15 bp, Homo sapiens
aaattaaacaattta

SEQ ID NO: 242916 - DNA, 15 bp, Homo sapiens
aaattaaataaaata

SEQ ID NO: 242917 - DNA, 18 bp, Homo sapiens
aaattaaataattttaca

SEQ ID NO: 242918 - DNA, 16 bp, Homo sapiens
aaattaaatatatgta

SEQ ID NO: 242919 - DNA, 19 bp, Homo sapiens
aaattaaatatatgtatgt

SEQ ID NO: 242920 - DNA, 17 bp, Homo sapiens
aaattaacttgagtttt

SEQ ID NO: 242921 - DNA, 13 bp, Homo sapiens
aaattaagacttt

SEQ ID NO: 242922 - DNA, 11 bp, Homo sapiens
aaattacaagt

SEQ ID NO: 242923 - DNA, 23 bp, Homo sapiens
aaattacacccatgcacagaaca

SEQ ID NO: 242924 - DNA, 15 bp, Homo sapiens
aaattactacaaaat

SEQ ID NO: 242925 - DNA, 13 bp, Homo sapiens
aaattagaaaaaa

SEQ ID NO: 242926 - DNA, 18 bp, Homo sapiens
aaattagtgagatttgta

SEQ ID NO: 242927 - DNA, 19 bp, Homo sapiens
aaattagtgagatttgtat

SEQ ID NO: 242928 - DNA, 18 bp, Homo sapiens
aaattataaggactgcat

SEQ ID NO: 242929 - DNA, 23 bp, Homo sapiens
aaattataaggactgcatggtaa

SEQ ID NO: 242930 - DNA, 13 bp, Homo sapiens
aaattatagaagt

SEQ ID NO: 242931 - DNA, 18 bp, Homo sapiens
aaattataggagacttgt

SEQ ID NO: 242932 - DNA, 14 bp, Homo sapiens
aaattatatgatat

SEQ ID NO: 242933 - DNA, 21 bp, Homo sapiens
aaattatatgatatgcatgta

SEQ ID NO: 242934 - DNA, 17 bp, Homo sapiens
aaattatcaagctaata

SEQ ID NO: 242935 - DNA, 11 bp, Homo sapiens
aaattatcagt

SEQ ID NO: 242936 - DNA, 13 bp, Homo sapiens
aaattatctattt

SEQ ID NO: 242937 - DNA, 14 bp, Homo sapiens
aaattatctatttg

SEQ ID NO: 242938 - DNA, 17 bp, Homo sapiens
aaattatgtatgtttac

SEQ ID NO: 242939 - DNA, 19 bp, Homo sapiens
aaattatgtatgtttacat

SEQ ID NO: 242940 - DNA, 13 bp, Homo sapiens
aaattattaaaaa

SEQ ID NO: 242941 - DNA, 19 bp, Homo sapiens
aaattattaaaaattatag

SEQ ID NO: 242942 - DNA, 13 bp, Homo sapiens
aaattattacttt

SEQ ID NO: 242943 - DNA, 24 bp, Homo sapiens
aaattattactttaaattatatga

SEQ ID NO: 242944 - DNA, 16 bp, Homo sapiens
aaattattcagttaag

SEQ ID NO: 242945 - DNA, 23 bp, Homo sapiens
aaattattcagttaagaaaaaaa

SEQ ID NO: 242946 - DNA, 14 bp, Homo sapiens
aaattattctagtc

SEQ ID NO: 242947 - DNA, 16 bp, Homo sapiens
aaattattgtaaactt

SEQ ID NO: 242948 - DNA, 21 bp, Homo sapiens
aaattattgtaaactttttca

SEQ ID NO: 242949 - DNA, 17 bp, Homo sapiens
aaattatttctaaaaca

SEQ ID NO: 242950 - DNA, 22 bp, Homo sapiens
aaattatttgtgtaatagaaaa

SEQ ID NO: 242951 - DNA, 15 bp, Homo sapiens
aaattattttaaaca

SEQ ID NO: 242952 - DNA, 16 bp, Homo sapiens
aaattattttaaatta

SEQ ID NO: 242953 - DNA, 20 bp, Homo sapiens
aaattattttaaattataag

SEQ ID NO: 242954 - DNA, 20 bp, Homo sapiens
aaattcaaggagatataaaa

SEQ ID NO: 242955 - DNA, 16 bp, Homo sapiens
aaattcacaagctgcc

SEQ ID NO: 242956 - DNA, 13 bp, Homo sapiens
aaattcattaaag

SEQ ID NO: 242957 - DNA, 14 bp, Homo sapiens
aaattcattaaaga

SEQ ID NO: 242958 - DNA, 15 bp, Homo sapiens
aaattcattaaagaa

SEQ ID NO: 242959 - DNA, 13 bp, Homo sapiens
aaattcatttttt

SEQ ID NO: 242960 - DNA, 17 bp, Homo sapiens
aaattccagaaaggata

SEQ ID NO: 242961 - DNA, 21 bp, Homo sapiens
aaattccagaaaggatattta

SEQ ID NO: 242962 - DNA, 19 bp, Homo sapiens
aaattccccatatttgtgt

SEQ ID NO: 242963 - DNA, 20 bp, Homo sapiens
aaattccctggaccagatgc

SEQ ID NO: 242964 - DNA, 14 bp, Homo sapiens
aaattcctgcaaaa

SEQ ID NO: 242965 - DNA, 22 bp, Homo sapiens
aaattctataggaacatatgaa

SEQ ID NO: 242966 - DNA, 23 bp, Homo sapiens
aaattctataggaacatatgaaa

SEQ ID NO: 242967 - DNA, 21 bp, Homo sapiens
aaattctattctgatcttatt

SEQ ID NO: 242968 - DNA, 12 bp, Homo sapiens
aaattctgctgc

SEQ ID NO: 242969 - DNA, 11 bp, Homo sapiens
aaattcttttc

SEQ ID NO: 242970 - DNA, 12 bp, Homo sapiens
aaattgaaattg

SEQ ID NO: 242971 - DNA, 23 bp, Homo sapiens
aaattgaataatgttttttgaag

SEQ ID NO: 242972 - DNA, 18 bp, Homo sapiens
aaattgacaacattttat

SEQ ID NO: 242973 - DNA, 18 bp, Homo sapiens
aaattgaccctagccaga

SEQ ID NO: 242974 - DNA, 20 bp, Homo sapiens
aaattgaggacttaatttac

SEQ ID NO: 242975 - DNA, 19 bp, Homo sapiens
aaattgatcattcataatt

SEQ ID NO: 242976 - DNA, 20 bp, Homo sapiens
aaattgcacacactcagtgc

SEQ ID NO: 242977 - DNA, 18 bp, Homo sapiens
aaattgcatgctgcttta

SEQ ID NO: 242978 - DNA, 21 bp, Homo sapiens
aaattgcatgctgctttaatt

SEQ ID NO: 242979 - DNA, 17 bp, Homo sapiens
aaattgcctcccttcct

SEQ ID NO: 242980 - DNA, 18 bp, Homo sapiens
aaattgcctcccttcctc

SEQ ID NO: 242981 - DNA, 19 bp, Homo sapiens
aaattgccttcagccctaa

SEQ ID NO: 242982 - DNA, 18 bp, Homo sapiens
aaattgctgagatgttta

SEQ ID NO: 242983 - DNA, 19 bp, Homo sapiens
aaattgcttttgttgtgac

SEQ ID NO: 242984 - DNA, 23 bp, Homo sapiens
aaattggacagttttgatacaaa

SEQ ID NO: 242985 - DNA, 12 bp, Homo sapiens
aaattggctcct

SEQ ID NO: 242986 - DNA, 23 bp, Homo sapiens
aaattgggcttgtgatttccatt

SEQ ID NO: 242987 - DNA, 16 bp, Homo sapiens
aaattggtgataagtg

SEQ ID NO: 242988 - DNA, 18 bp, Homo sapiens
aaattgtatacattttgt

SEQ ID NO: 242989 - DNA, 22 bp, Homo sapiens
aaattgtatctagtgcagctga

SEQ ID NO: 242990 - DNA, 15 bp, Homo sapiens
aagagctaggaaaga

SEQ ID NO: 242991 - DNA, 17 bp, Homo sapiens
aagagctcaggagaagg

SEQ ID NO: 242992 - DNA, 12 bp, Homo sapiens
aagagctccttg

SEQ ID NO: 242993 - DNA, 13 bp, Homo sapiens
aagagctctccag

SEQ ID NO: 242994 - DNA, 23 bp, Homo sapiens
aagagctctttgtctcaccagct

SEQ ID NO: 242995 - DNA, 18 bp, Homo sapiens
aagaggaaattaaataat

SEQ ID NO: 242996 - DNA, 20 bp, Homo sapiens
aagaggaaattaaataattt

SEQ ID NO: 242997 - DNA, 14 bp, Homo sapiens
aagaggagaaggag

SEQ ID NO: 242998 - DNA, 23 bp, Homo sapiens
aagaggccctgtctgtacctaac

SEQ ID NO: 242999 - DNA, 18 bp, Homo sapiens
aagagggagaaggagagg

SEQ ID NO: 243000 - DNA, 14 bp, Homo sapiens
aagagggcctgtgg

SEQ ID NO: 243001 - DNA, 11 bp, Homo sapiens
aagaggtgctg

SEQ ID NO: 243002 - DNA, 14 bp, Homo sapiens
aagaggtggattca

SEQ ID NO: 243003 - DNA, 14 bp, Homo sapiens
aagagtaaaacatt

SEQ ID NO: 243004 - DNA, 19 bp, Homo sapiens
aagagtatcaaaggcagaa

SEQ ID NO: 243005 - DNA, 14 bp, Homo sapiens
aagagtatgagaaa

SEQ ID NO: 243006 - DNA, 21 bp, Homo sapiens
aagagtatgagaaatacagtg

SEQ ID NO: 243007 - DNA, 20 bp, Homo sapiens
aagagtcttaattttctaaa

SEQ ID NO: 243008 - DNA, 20 bp, Homo sapiens
aagagtgactagtacaaatt

SEQ ID NO: 243009 - DNA, 22 bp, Homo sapiens
aagagtgggctttccagggtct

SEQ ID NO: 243010 - DNA, 20 bp, Homo sapiens
aagagtgggggagagcaggc

SEQ ID NO: 243011 - DNA, 15 bp, Homo sapiens
aagagtgtgctcggg

SEQ ID NO: 243012 - DNA, 15 bp, Homo sapiens
aagagttaagaatgt

SEQ ID NO: 243013 - DNA, 15 bp, Homo sapiens
aagagttatatgact

SEQ ID NO: 243014 - DNA, 17 bp, Homo sapiens
aagagttctatccccaa

SEQ ID NO: 243015 - DNA, 15 bp, Homo sapiens
aagataaaaggatag

SEQ ID NO: 243016 - DNA, 16 bp, Homo sapiens
aagataacgcaggaga

SEQ ID NO: 243017 - DNA, 17 bp, Homo sapiens
aagataacgcaggagag

SEQ ID NO: 243018 - DNA, 20 bp, Homo sapiens
aagataacgcaggagagaga

SEQ ID NO: 243019 - DNA, 15 bp, Homo sapiens
aagataacttgagca

SEQ ID NO: 243020 - DNA, 23 bp, Homo sapiens
aagataagacttgtttctttctg

SEQ ID NO: 243021 - DNA, 22 bp, Homo sapiens
aagataatggataatcttcggc

SEQ ID NO: 243022 - DNA, 12 bp, Homo sapiens
aagataatgttc

SEQ ID NO: 243023 - DNA, 22 bp, Homo sapiens
aagataattaaatgaaatactt

SEQ ID NO: 243024 - DNA, 20 bp, Homo sapiens
aagatacaagtttcagacag

SEQ ID NO: 243025 - DNA, 14 bp, Homo sapiens
aagatacactcctg

SEQ ID NO: 243026 - DNA, 17 bp, Homo sapiens
aagatacactcctgctg

SEQ ID NO: 243027 - DNA, 18 bp, Homo sapiens
aagatacactcctgctgt

SEQ ID NO: 243028 - DNA, 17 bp, Homo sapiens
aagatactcaagcaggt

SEQ ID NO: 243029 - DNA, 10 bp, Homo sapiens
aagatactgc

SEQ ID NO: 243030 - DNA, 12 bp, Homo sapiens
aagatagctcct

SEQ ID NO: 243031 - DNA, 14 bp, Homo sapiens
aagataggctctgc

SEQ ID NO: 243032 - DNA, 17 bp, Homo sapiens
aagataggctctgcaca

SEQ ID NO: 243033 - DNA, 13 bp, Homo sapiens
aagatattattca

SEQ ID NO: 243034 - DNA, 13 bp, Homo sapiens
aagatattattta

SEQ ID NO: 243035 - DNA, 15 bp, Homo sapiens
aagatattctttaca

SEQ ID NO: 243036 - DNA, 13 bp, Homo sapiens
aagatatttatat

SEQ ID NO: 243037 - DNA, 18 bp, Homo sapiens
aagatatttatatatatt

SEQ ID NO: 243038 - DNA, 17 bp, Homo sapiens
aagatcaaaataaaaag

SEQ ID NO: 243039 - DNA, 16 bp, Homo sapiens
aagatcacaaatagtg

SEQ ID NO: 243040 - DNA, 15 bp, Homo sapiens
aagatcactttgctc

SEQ ID NO: 243041 - DNA, 19 bp, Homo sapiens
aagatctcagataaagtga

SEQ ID NO: 243042 - DNA, 14 bp, Homo sapiens
aagatcttaaattt

SEQ ID NO: 243043 - DNA, 17 bp, Homo sapiens
aagatcttaaattttgt

SEQ ID NO: 243044 - DNA, 23 bp, Homo sapiens
aagatgaaaaatggtcccttctt

SEQ ID NO: 243045 - DNA, 15 bp, Homo sapiens
aagatgaaattgcca

SEQ ID NO: 243046 - DNA, 20 bp, Homo sapiens
aagatgagattggcatggct

SEQ ID NO: 243047 - DNA, 16 bp, Homo sapiens
aagatgaggaaataat

SEQ ID NO: 243048 - DNA, 14 bp, Homo sapiens
aagatgatcatttg

SEQ ID NO: 243049 - DNA, 12 bp, Homo sapiens
aagatgattttg

SEQ ID NO: 243050 - DNA, 21 bp, Homo sapiens
aagatgatttttaagtacaaa

SEQ ID NO: 243051 - DNA, 22 bp, Homo sapiens
aagatgatttttaagtacaaaa

SEQ ID NO: 243052 - DNA, 23 bp, Homo sapiens
aagatgccaaggaggtcccagga

SEQ ID NO: 243053 - DNA, 24 bp, Homo sapiens
aagatgcccactgaggaatgatga

SEQ ID NO: 243054 - DNA, 21 bp, Homo sapiens
aagatgctgaaacaggagaga

SEQ ID NO: 243055 - DNA, 16 bp, Homo sapiens
aagatggactctgaaa

SEQ ID NO: 243056 - DNA, 19 bp, Homo sapiens
aagatggctattataatgg

SEQ ID NO: 243057 - DNA, 20 bp, Homo sapiens
aagatggctgtgcctctgcc

SEQ ID NO: 243058 - DNA, 23 bp, Homo sapiens
aagatggcttccgtgagacacaa

SEQ ID NO: 243059 - DNA, 16 bp, Homo sapiens
aagatgtactgagagg

SEQ ID NO: 243060 - DNA, 19 bp, Homo sapiens
aagatgtactgagaggagg

SEQ ID NO: 243061 - DNA, 21 bp, Homo sapiens
aagatgtactgagaggagggg

SEQ ID NO: 243062 - DNA, 21 bp, Homo sapiens
aagatgtattaacctacctgt

SEQ ID NO: 243063 - DNA, 18 bp, Homo sapiens
aagatgtcaaatatctca

SEQ ID NO: 243064 - DNA, 18 bp, Homo sapiens
aagatgtgacatgtttta

SEQ ID NO: 243065 - DNA, 15 bp, Homo sapiens
aagatgttgtgtctt

SEQ ID NO: 243066 - DNA, 18 bp, Homo sapiens
aagatgttgtgtcttgtg

SEQ ID NO: 243067 - DNA, 11 bp, Homo sapiens
aagatgtttgc

SEQ ID NO: 243068 - DNA, 17 bp, Homo sapiens
aagattaaaattagtga

SEQ ID NO: 243069 - DNA, 21 bp, Homo sapiens
aagattaaattatatctgagg

SEQ ID NO: 243070 - DNA, 17 bp, Homo sapiens
aagattacaagataaaa

SEQ ID NO: 243071 - DNA, 18 bp, Homo sapiens
aagattatattataataa

SEQ ID NO: 243072 - DNA, 19 bp, Homo sapiens
aagattatattataataat

SEQ ID NO: 243073 - DNA, 22 bp, Homo sapiens
aagattatcctgttactgaatt

SEQ ID NO: 243074 - DNA, 13 bp, Homo sapiens
aagattcaattta

SEQ ID NO: 243075 - DNA, 20 bp, Homo sapiens
aagattccattttatacaag

SEQ ID NO: 243076 - DNA, 16 bp, Homo sapiens
aagattccattttgga

SEQ ID NO: 243077 - DNA, 20 bp, Homo sapiens
aagattcccggctggacttt

SEQ ID NO: 243078 - DNA, 11 bp, Homo sapiens
aagattctaaa

SEQ ID NO: 243079 - DNA, 12 bp, Homo sapiens
aagattctaaaa

SEQ ID NO: 243080 - DNA, 23 bp, Homo sapiens
aagattctactcttgtcattttt

SEQ ID NO: 243081 - DNA, 17 bp, Homo sapiens
aagattctcctgtgcta

SEQ ID NO: 243082 - DNA, 13 bp, Homo sapiens
aagattctttaaa

SEQ ID NO: 243083 - DNA, 22 bp, Homo sapiens
aagattggacatggtctcctct

SEQ ID NO: 243084 - DNA, 13 bp, Homo sapiens
aagattgtacata

SEQ ID NO: 243085 - DNA, 17 bp, Homo sapiens
aaggttctcataggaaa

SEQ ID NO: 243086 - DNA, 17 bp, Homo sapiens
aaggttcttactgcttg

SEQ ID NO: 243087 - DNA, 17 bp, Homo sapiens
aaggttggaactgctgc

SEQ ID NO: 243088 - DNA, 18 bp, Homo sapiens
aaggttggaactgctgcc

SEQ ID NO: 243089 - DNA, 19 bp, Homo sapiens
aaggttggaactgctgcca

SEQ ID NO: 243090 - DNA, 16 bp, Homo sapiens
aaggtttcactgttca

SEQ ID NO: 243091 - DNA, 17 bp, Homo sapiens
aaggtttcactgttcat

SEQ ID NO: 243092 - DNA, 12 bp, Homo sapiens
aagtaaagctaa

SEQ ID NO: 243093 - DNA, 21 bp, Homo sapiens
aagtaaagctaaaatgatttt

SEQ ID NO: 243094 - DNA, 17 bp, Homo sapiens
aagtaacaatgcatgct

SEQ ID NO: 243095 - DNA, 15 bp, Homo sapiens
aagtaacatataaat

SEQ ID NO: 243096 - DNA, 16 bp, Homo sapiens
aagtaacatataaatt

SEQ ID NO: 243097 - DNA, 22 bp, Homo sapiens
aagtaaccaggccccagcctcc

SEQ ID NO: 243098 - DNA, 20 bp, Homo sapiens
aagtaagaaagtgaagcaaa

SEQ ID NO: 243099 - DNA, 15 bp, Homo sapiens
aagtaagaagacatg

SEQ ID NO: 243100 - DNA, 22 bp, Homo sapiens
aagtaagagctaagttctaagt

SEQ ID NO: 243101 - DNA, 21 bp, Homo sapiens
aagtaatccacctgcctcggc

SEQ ID NO: 243102 - DNA, 18 bp, Homo sapiens
aagtaatcccgccaccta

SEQ ID NO: 243103 - DNA, 17 bp, Homo sapiens
aagtaatgaattttatg

SEQ ID NO: 243104 - DNA, 15 bp, Homo sapiens
aagtaattaattgct

SEQ ID NO: 243105 - DNA, 15 bp, Homo sapiens
aagtaattatcggga

SEQ ID NO: 243106 - DNA, 20 bp, Homo sapiens
aagtaattttgcacagacat

SEQ ID NO: 243107 - DNA, 21 bp, Homo sapiens
aagtacatagtgaattttaaa

SEQ ID NO: 243108 - DNA, 23 bp, Homo sapiens
aagtacatagtgaattttaaaat

SEQ ID NO: 243109 - DNA, 16 bp, Homo sapiens
aagtaccaaagtttta

SEQ ID NO: 243110 - DNA, 19 bp, Homo sapiens
aagtaccaactgagccaaa

SEQ ID NO: 243111 - DNA, 16 bp, Homo sapiens
aagtaccaatgctgtt

SEQ ID NO: 243112 - DNA, 16 bp, Homo sapiens
aagtacgttattgttg

SEQ ID NO: 243113 - DNA, 22 bp, Homo sapiens
aagtactaaaactagataactt

SEQ ID NO: 243114 - DNA, 23 bp, Homo sapiens
aagtactaaaactagataactta

SEQ ID NO: 243115 - DNA, 16 bp, Homo sapiens
aagtactactgtagaa

SEQ ID NO: 243116 - DNA, 14 bp, Homo sapiens
aagtactataattt

SEQ ID NO: 243117 - DNA, 13 bp, Homo sapiens
aagtagagaagta

SEQ ID NO: 243118 - DNA, 19 bp, Homo sapiens
aagtaggggttgtgggtga

SEQ ID NO: 243119 - DNA, 16 bp, Homo sapiens
aagtaggtatacaaaa

SEQ ID NO: 243120 - DNA, 21 bp, Homo sapiens
aagtaggtatacaaaagacta

SEQ ID NO: 243121 - DNA, 20 bp, Homo sapiens
aagtataaatttgtgtaata

SEQ ID NO: 243122 - DNA, 21 bp, Homo sapiens
aagtataaatttgtgtaatat

SEQ ID NO: 243123 - DNA, 12 bp, Homo sapiens
aagtatacagtt

SEQ ID NO: 243124 - DNA, 21 bp, Homo sapiens
aagtatacagttcaataaact

SEQ ID NO: 243125 - DNA, 18 bp, Homo sapiens
aagtatataaattggctt

SEQ ID NO: 243126 - DNA, 18 bp, Homo sapiens
aagtatatttatttctag

SEQ ID NO: 243127 - DNA, 15 bp, Homo sapiens
aagtatcatgcattc

SEQ ID NO: 243128 - DNA, 20 bp, Homo sapiens
aagtatccaattatgtgaca

SEQ ID NO: 243129 - DNA, 13 bp, Homo sapiens
aagtatctgtacc

SEQ ID NO: 243130 - DNA, 13 bp, Homo sapiens
aagtatgtgagtg

SEQ ID NO: 243131 - DNA, 18 bp, Homo sapiens
aagtatgtgtaaaatgtg

SEQ ID NO: 243132 - DNA, 14 bp, Homo sapiens
aagtatgtttttaa

SEQ ID NO: 243133 - DNA, 13 bp, Homo sapiens
aagtattcataca

SEQ ID NO: 243134 - DNA, 15 bp, Homo sapiens
aagtattccacctta

SEQ ID NO: 243135 - DNA, 13 bp, Homo sapiens
aataaaggctgag

SEQ ID NO: 243136 - DNA, 20 bp, Homo sapiens
aataaaggtcccttagcccc

SEQ ID NO: 243137 - DNA, 14 bp, Homo sapiens
aataaagtatataa

SEQ ID NO: 243138 - DNA, 15 bp, Homo sapiens
aataaagtatataat

SEQ ID NO: 243139 - DNA, 23 bp, Homo sapiens
aataaataaaattcatttctaca

SEQ ID NO: 243140 - DNA, 11 bp, Homo sapiens
aataaataatc

SEQ ID NO: 243141 - DNA, 13 bp, Homo sapiens
aataaatatacta

SEQ ID NO: 243142 - DNA, 16 bp, Homo sapiens
aataaatcataaaact

SEQ ID NO: 243143 - DNA, 20 bp, Homo sapiens
aataaatctaaatgattatc

SEQ ID NO: 243144 - DNA, 11 bp, Homo sapiens
aataaatcttt

SEQ ID NO: 243145 - DNA, 13 bp, Homo sapiens
aataaatgaccag

SEQ ID NO: 243146 - DNA, 14 bp, Homo sapiens
aataaatgaccagt

SEQ ID NO: 243147 - DNA, 14 bp, Homo sapiens
aataaatgtacctg

SEQ ID NO: 243148 - DNA, 20 bp, Homo sapiens
aataaatgtatcttattcac

SEQ ID NO: 243149 - DNA, 21 bp, Homo sapiens
aataaatgtatcttattcaca

SEQ ID NO: 243150 - DNA, 22 bp, Homo sapiens
aataaatgtcccaaataaattt

SEQ ID NO: 243151 - DNA, 21 bp, Homo sapiens
aataaattgcatgctgcttta

SEQ ID NO: 243152 - DNA, 22 bp, Homo sapiens
aataaattgcctcccttcctcc

SEQ ID NO: 243153 - DNA, 16 bp, Homo sapiens
aataaattgctccttg

SEQ ID NO: 243154 - DNA, 21 bp, Homo sapiens
aataaatttataacaattgat

SEQ ID NO: 243155 - DNA, 12 bp, Homo sapiens
aataacacacat

SEQ ID NO: 243156 - DNA, 12 bp, Homo sapiens
aataacatattc

SEQ ID NO: 243157 - DNA, 14 bp, Homo sapiens
aataacatattctt

SEQ ID NO: 243158 - DNA, 13 bp, Homo sapiens
aataacatctctt

SEQ ID NO: 243159 - DNA, 19 bp, Homo sapiens
aataacatctgaaaagaaa

SEQ ID NO: 243160 - DNA, 22 bp, Homo sapiens
aataaccacttaaaaaatgtcc

SEQ ID NO: 243161 - DNA, 19 bp, Homo sapiens
aataactactgcaaaaagt

SEQ ID NO: 243162 - DNA, 13 bp, Homo sapiens
aataactactgtg

SEQ ID NO: 243163 - DNA, 17 bp, Homo sapiens
aataactactgtgttcc

SEQ ID NO: 243164 - DNA, 18 bp, Homo sapiens
aataactagatctcctgt

SEQ ID NO: 243165 - DNA, 20 bp, Homo sapiens
aataactggatattctttat

SEQ ID NO: 243166 - DNA, 16 bp, Homo sapiens
aataacttcagagaag

SEQ ID NO: 243167 - DNA, 17 bp, Homo sapiens
aataacttcagagaagt

SEQ ID NO: 243168 - DNA, 22 bp, Homo sapiens
aataagcagaggtggaaaatga

SEQ ID NO: 243169 - DNA, 21 bp, Homo sapiens
aataagtaacatataaattaa

SEQ ID NO: 243170 - DNA, 13 bp, Homo sapiens
aataagtaatatc

SEQ ID NO: 243171 - DNA, 17 bp, Homo sapiens
aataagtcctaaagtga

SEQ ID NO: 243172 - DNA, 21 bp, Homo sapiens
aataagtcctaaagtgaagaa

SEQ ID NO: 243173 - DNA, 22 bp, Homo sapiens
aataagtcctaaagtgaagaag

SEQ ID NO: 243174 - DNA, 19 bp, Homo sapiens
aataagtgaatctaataaa

SEQ ID NO: 243175 - DNA, 19 bp, Homo sapiens
acagcggcccggcccacgc

SEQ ID NO: 243176 - DNA, 14 bp, Homo sapiens
acagcggggaaggt

SEQ ID NO: 243177 - DNA, 16 bp, Homo sapiens
acagcggggccccagg

SEQ ID NO: 243178 - DNA, 17 bp, Homo sapiens
acagcgggtaaaaagag

SEQ ID NO: 243179 - DNA, 20 bp, Homo sapiens
acagcgtgtcaactttcatt

SEQ ID NO: 243180 - DNA, 13 bp, Homo sapiens
acagctaacatgg

SEQ ID NO: 243181 - DNA, 14 bp, Homo sapiens
acagctaacatgga

SEQ ID NO: 243182 - DNA, 14 bp, Homo sapiens
acagctaggctgag

SEQ ID NO: 243183 - DNA, 15 bp, Homo sapiens
acagctcacctctga

SEQ ID NO: 243184 - DNA, 16 bp, Homo sapiens
acagctcttggcattt

SEQ ID NO: 243185 - DNA, 15 bp, Homo sapiens
acagctgagagactt

SEQ ID NO: 243186 - DNA, 16 bp, Homo sapiens
acagctgagagacttt

SEQ ID NO: 243187 - DNA, 22 bp, Homo sapiens
acagctgagagacttttaatca

SEQ ID NO: 243188 - DNA, 15 bp, Homo sapiens
acagctgcagagaca

SEQ ID NO: 243189 - DNA, 14 bp, Homo sapiens
acagctgcagctgg

SEQ ID NO: 243190 - DNA, 15 bp, Homo sapiens
acagctgcagctggg

SEQ ID NO: 243191 - DNA, 18 bp, Homo sapiens
acagctgcagctgggccc

SEQ ID NO: 243192 - DNA, 15 bp, Homo sapiens
acagctgtgaggaca

SEQ ID NO: 243193 - DNA, 12 bp, Homo sapiens
acagctgttcct

SEQ ID NO: 243194 - DNA, 15 bp, Homo sapiens
acagctgttcctgtg

SEQ ID NO: 243195 - DNA, 23 bp, Homo sapiens
acagctgttcctgtgttcttcgt

SEQ ID NO: 243196 - DNA, 15 bp, Homo sapiens
acagctgtttaagat

SEQ ID NO: 243197 - DNA, 19 bp, Homo sapiens
acagctgtttaagatgggc

SEQ ID NO: 243198 - DNA, 20 bp, Homo sapiens
acagcttcatgcctttgtaa

SEQ ID NO: 243199 - DNA, 16 bp, Homo sapiens
acagcttgttttggac

SEQ ID NO: 243200 - DNA, 15 bp, Homo sapiens
aatggctgggagggg

SEQ ID NO: 243201 - DNA, 16 bp, Homo sapiens
aatggctgggtttggg

SEQ ID NO: 243202 - DNA, 18 bp, Homo sapiens
aatggctttggtctcttg

SEQ ID NO: 243203 - DNA, 22 bp, Homo sapiens
aatgggaactgcctctttcctg

SEQ ID NO: 243204 - DNA, 18 bp, Homo sapiens
aatgggactgatgtcatc

SEQ ID NO: 243205 - DNA, 21 bp, Homo sapiens
aatgggactgatgtcatcttg

SEQ ID NO: 243206 - DNA, 22 bp, Homo sapiens
aatgggactgatgtcatcttga

SEQ ID NO: 243207 - DNA, 13 bp, Homo sapiens
aatgggactggag

SEQ ID NO: 243208 - DNA, 23 bp, Homo sapiens
aatgggactggagtcagatgagc

SEQ ID NO: 243209 - DNA, 18 bp, Homo sapiens
aatgggagatggtcagtg

SEQ ID NO: 243210 - DNA, 20 bp, Homo sapiens
aatgggagtgaacatttcta

SEQ ID NO: 243211 - DNA, 15 bp, Homo sapiens
aatgggctttaacaa

SEQ ID NO: 243212 - DNA, 20 bp, Homo sapiens
aatgggggcggctggaaaga

SEQ ID NO: 243213 - DNA, 21 bp, Homo sapiens
aatggggtttgggcccctcag

SEQ ID NO: 243214 - DNA, 16 bp, Homo sapiens
aatgggtatctatatt

SEQ ID NO: 243215 - DNA, 17 bp, Homo sapiens
aatggtgagaattaaaa

SEQ ID NO: 243216 - DNA, 23 bp, Homo sapiens
aatggtgatcctctattttgtga

SEQ ID NO: 243217 - DNA, 18 bp, Homo sapiens
aatggtgggctccagagt

SEQ ID NO: 243218 - DNA, 22 bp, Homo sapiens
aatggtggggaactataaagaa

SEQ ID NO: 243219 - DNA, 16 bp, Homo sapiens
aatggtgtgtttccct

SEQ ID NO: 243220 - DNA, 14 bp, Homo sapiens
aatggttccatgcc

SEQ ID NO: 243221 - DNA, 19 bp, Homo sapiens
aatggttccatgcctgagg

SEQ ID NO: 243222 - DNA, 21 bp, Homo sapiens
aatggttccatgcctgagggt

SEQ ID NO: 243223 - DNA, 18 bp, Homo sapiens
aatggttgggacaatggc

SEQ ID NO: 243224 - DNA, 22 bp, Homo sapiens
aatggtttaacttctgcctgtg

SEQ ID NO: 243225 - DNA, 16 bp, Homo sapiens
aatggtttactgctgt

SEQ ID NO: 243226 - DNA, 17 bp, Homo sapiens
aatggtttactgctgtc

SEQ ID NO: 243227 - DNA, 20 bp, Homo sapiens
aatggtttactgctgtcatt

SEQ ID NO: 243228 - DNA, 16 bp, Homo sapiens
aatggttttcttgtgt

SEQ ID NO: 243229 - DNA, 19 bp, Homo sapiens
aatgtaaaaaagaaaaaca

SEQ ID NO: 243230 - DNA, 13 bp, Homo sapiens
aatgtaaaaatga

SEQ ID NO: 243231 - DNA, 23 bp, Homo sapiens
aatgtaaaacacatacaaaagaa

SEQ ID NO: 243232 - DNA, 17 bp, Homo sapiens
aatgtaaaattcatagc

SEQ ID NO: 243233 - DNA, 13 bp, Homo sapiens
aatgtaaatttgt

SEQ ID NO: 243234 - DNA, 15 bp, Homo sapiens
aatgtaaatttgtac

SEQ ID NO: 243235 - DNA, 17 bp, Homo sapiens
aatgtaaatttgtacta

SEQ ID NO: 243236 - DNA, 14 bp, Homo sapiens
aatgtaacttaatt

SEQ ID NO: 243237 - DNA, 18 bp, Homo sapiens
aatgtaacttaattataa

SEQ ID NO: 243238 - DNA, 17 bp, Homo sapiens
aatgtaagtaaatgtct

SEQ ID NO: 243239 - DNA, 19 bp, Homo sapiens
aatgtaagtaaatgtctgt

SEQ ID NO: 243240 - DNA, 19 bp, Homo sapiens
aatgtaatcaatgtttctt

SEQ ID NO: 243241 - DNA, 13 bp, Homo sapiens
aatgtaatcattt

SEQ ID NO: 243242 - DNA, 14 bp, Homo sapiens
aatgtaattgaata

SEQ ID NO: 243243 - DNA, 12 bp, Homo sapiens
aatgtacaaaga

SEQ ID NO: 243244 - DNA, 13 bp, Homo sapiens
aatgtacacagtt

SEQ ID NO: 243245 - DNA, 17 bp, Homo sapiens
aatgtacatctggcctt

SEQ ID NO: 243246 - DNA, 20 bp, Homo sapiens
aatgtagcatctgagaaggc

SEQ ID NO: 243247 - DNA, 13 bp, Homo sapiens
aatgtatcaggaa

SEQ ID NO: 243248 - DNA, 14 bp, Homo sapiens
aatgtatcaggaaa

SEQ ID NO: 243249 - DNA, 21 bp, Homo sapiens
aatgtatctagtggtctgatt

SEQ ID NO: 243250 - DNA, 11 bp, Homo sapiens
aatgtatctta

SEQ ID NO: 243251 - DNA, 17 bp, Homo sapiens
aatgtatcttattcaca

SEQ ID NO: 243252 - DNA, 16 bp, Homo sapiens
aatgtatcttatttat

SEQ ID NO: 243253 - DNA, 20 bp, Homo sapiens
aatgtatcttatttatatat

SEQ ID NO: 243254 - DNA, 22 bp, Homo sapiens
aatgtatcttatttatatatga

SEQ ID NO: 243255 - DNA, 19 bp, Homo sapiens
aatgtatgtgaaagtgtaa

SEQ ID NO: 243256 - DNA, 20 bp, Homo sapiens
aatgtatgtgaaagtgtaaa

SEQ ID NO: 243257 - DNA, 13 bp, Homo sapiens
aatgtattcaaat

SEQ ID NO: 243258 - DNA, 16 bp, Homo sapiens
aatgtattctatctct

SEQ ID NO: 243259 - DNA, 19 bp, Homo sapiens
aatgtcacaaattgatcaa

SEQ ID NO: 243260 - DNA, 18 bp, Homo sapiens
aatgtcacaacctctctg

SEQ ID NO: 243261 - DNA, 12 bp, Homo sapiens
aatgtcattatt

SEQ ID NO: 243262 - DNA, 15 bp, Homo sapiens
aatgtcattatttga

SEQ ID NO: 243263 - DNA, 20 bp, Homo sapiens
aatgtcattatttgataaca

SEQ ID NO: 243264 - DNA, 13 bp, Homo sapiens
aatgtcatttgct

SEQ ID NO: 243265 - DNA, 16 bp, Homo sapiens
aatgtcatttgctaat

SEQ ID NO: 243266 - DNA, 16 bp, Homo sapiens
aatgtccccattctat

SEQ ID NO: 243267 - DNA, 21 bp, Homo sapiens
aatgtcctccagaagcctctg

SEQ ID NO: 243268 - DNA, 23 bp, Homo sapiens
aatgtcctccagaagcctctggc

SEQ ID NO: 243269 - DNA, 18 bp, Homo sapiens
aatgtctaggataatttt

SEQ ID NO: 243270 - DNA, 19 bp, Homo sapiens
aatgtctgtataaataatg

SEQ ID NO: 243271 - DNA, 17 bp, Homo sapiens
aatgtcttttcaaaagg

SEQ ID NO: 243272 - DNA, 17 bp, Homo sapiens
aatgtgaaggcccaaga

SEQ ID NO: 243273 - DNA, 13 bp, Homo sapiens
aatgtgagacagc

SEQ ID NO: 243274 - DNA, 18 bp, Homo sapiens
aatgtgagctataatgtt

SEQ ID NO: 243275 - DNA, 16 bp, Homo sapiens
aatgtgagtcccagag

SEQ ID NO: 243276 - DNA, 14 bp, Homo sapiens
aatgtgatcaactg

SEQ ID NO: 243277 - DNA, 20 bp, Homo sapiens
aatgtgatcaactgttcagg

SEQ ID NO: 243278 - DNA, 18 bp, Homo sapiens
aatgtgatcatctttgct

SEQ ID NO: 243279 - DNA, 14 bp, Homo sapiens
aatgtgattctaat

SEQ ID NO: 243280 - DNA, 19 bp, Homo sapiens
aatgtgattctaatgtctt

SEQ ID NO: 243281 - DNA, 23 bp, Homo sapiens
aatgtgcaagagtatactttgta

SEQ ID NO: 243282 - DNA, 14 bp, Homo sapiens
aatgtgcaataact

SEQ ID NO: 243283 - DNA, 19 bp, Homo sapiens
aatgtgcaggtttgttaca

SEQ ID NO: 243284 - DNA, 20 bp, Homo sapiens
aatgtgcaggtttgttacat

SEQ ID NO: 243285 - DNA, 22 bp, Homo sapiens
aatgtgcaggtttgttacatag

SEQ ID NO: 243286 - DNA, 18 bp, Homo sapiens
aatgtgccatttttttca

SEQ ID NO: 243287 - DNA, 13 bp, Homo sapiens
aatgtgcccccag

SEQ ID NO: 243288 - DNA, 15 bp, Homo sapiens
aatgtgcccctggcc

SEQ ID NO: 243289 - DNA, 19 bp, Homo sapiens
aatgtgccctcttaagtgt

SEQ ID NO: 243290 - DNA, 21 bp, Homo sapiens
aatgtgcccttttggccgggc

SEQ ID NO: 243291 - DNA, 11 bp, Homo sapiens
aatgtgctgca

SEQ ID NO: 243292 - DNA, 14 bp, Homo sapiens
aatgtgctgcaaag

SEQ ID NO: 243293 - DNA, 14 bp, Homo sapiens
aatgtgctgttgat

SEQ ID NO: 243294 - DNA, 20 bp, Homo sapiens
aatgtgcttttccatctaaa

SEQ ID NO: 243295 - DNA, 17 bp, Homo sapiens
aatgtggcagctgtctc

SEQ ID NO: 243296 - DNA, 17 bp, Homo sapiens
aatgtggccgaggactt

SEQ ID NO: 243297 - DNA, 15 bp, Homo sapiens
aatgtgtatgtctgg

SEQ ID NO: 243298 - DNA, 17 bp, Homo sapiens
aatgtgtctgcaacatg

SEQ ID NO: 243299 - DNA, 18 bp, Homo sapiens
aatgtgtctgcaacatgg

SEQ ID NO: 243300 - DNA, 19 bp, Homo sapiens
aatgtgtctgcaacatgga

SEQ ID NO: 243301 - DNA, 20 bp, Homo sapiens
aatgtgtctgcaacatggat

SEQ ID NO: 243302 - DNA, 16 bp, Homo sapiens
aatgtgtgcttggaaa

SEQ ID NO: 243303 - DNA, 17 bp, Homo sapiens
aatgtgtggtgctaact

SEQ ID NO: 243304 - DNA, 13 bp, Homo sapiens
aatgttaataaag

SEQ ID NO: 243305 - DNA, 15 bp, Homo sapiens
aatgttaataaaggt

SEQ ID NO: 243306 - DNA, 16 bp, Homo sapiens
aatgttaatgatatgt

SEQ ID NO: 243307 - DNA, 17 bp, Homo sapiens
acaatgtggaattacat

SEQ ID NO: 243308 - DNA, 20 bp, Homo sapiens
acaatgtggaattacataac

SEQ ID NO: 243309 - DNA, 23 bp, Homo sapiens
acaatgtgtgggataatgtcatt

SEQ ID NO: 243310 - DNA, 20 bp, Homo sapiens
acaatgttgcactgaaaacc

SEQ ID NO: 243311 - DNA, 23 bp, Homo sapiens
acaatgttggcctgtcagagctt

SEQ ID NO: 243312 - DNA, 20 bp, Homo sapiens
acaatgtttcagaagcccca

SEQ ID NO: 243313 - DNA, 18 bp, Homo sapiens
acaattactaaattgtat

SEQ ID NO: 243314 - DNA, 20 bp, Homo sapiens
acaattagagatatttttat

SEQ ID NO: 243315 - DNA, 14 bp, Homo sapiens
acaattcagtttta

SEQ ID NO: 243316 - DNA, 13 bp, Homo sapiens
acaattctgtccc

SEQ ID NO: 243317 - DNA, 22 bp, Homo sapiens
acaattgaaatttttaaatcat

SEQ ID NO: 243318 - DNA, 13 bp, Homo sapiens
acaattgattttc

SEQ ID NO: 243319 - DNA, 20 bp, Homo sapiens
acaatttcaaaatgcatgtg

SEQ ID NO: 243320 - DNA, 16 bp, Homo sapiens
acaatttcctttatat

SEQ ID NO: 243321 - DNA, 17 bp, Homo sapiens
acaatttgcataatact

SEQ ID NO: 243322 - DNA, 20 bp, Homo sapiens
acaatttgcataatactaat

SEQ ID NO: 243323 - DNA, 21 bp, Homo sapiens
acaatttgccttaggaagtga

SEQ ID NO: 243324 - DNA, 20 bp, Homo sapiens
acaatttggtcttagcttta

SEQ ID NO: 243325 - DNA, 22 bp, Homo sapiens
acaatttggtcttagctttaca

SEQ ID NO: 243326 - DNA, 16 bp, Homo sapiens
acaattttcatcccac

SEQ ID NO: 243327 - DNA, 21 bp, Homo sapiens
acaattttctatttaaaaaat

SEQ ID NO: 243328 - DNA, 15 bp, Homo sapiens
acaattttgtacaaa

SEQ ID NO: 243329 - DNA, 16 bp, Homo sapiens
acacaaaacaacagca

SEQ ID NO: 243330 - DNA, 23 bp, Homo sapiens
acacaaatattgcttggactacc

SEQ ID NO: 243331 - DNA, 16 bp, Homo sapiens
acacaaatgcagacac

SEQ ID NO: 243332 - DNA, 18 bp, Homo sapiens
acacaaatgcagacacac

SEQ ID NO: 243333 - DNA, 14 bp, Homo sapiens
acacaaatgtgtac

SEQ ID NO: 243334 - DNA, 13 bp, Homo sapiens
acacaacaaaaat

SEQ ID NO: 243335 - DNA, 15 bp, Homo sapiens
acacaacaaaaattt

SEQ ID NO: 243336 - DNA, 13 bp, Homo sapiens
acacaacatcaag

SEQ ID NO: 243337 - DNA, 20 bp, Homo sapiens
acacaagagggactgtattt

SEQ ID NO: 243338 - DNA, 21 bp, Homo sapiens
acacaagagggactgtatttc

SEQ ID NO: 243339 - DNA, 17 bp, Homo sapiens
acacaatcctataaatg

SEQ ID NO: 243340 - DNA, 12 bp, Homo sapiens
acacacaaaaca

SEQ ID NO: 243341 - DNA, 19 bp, Homo sapiens
acacacaaaagattatgta

SEQ ID NO: 243342 - DNA, 20 bp, Homo sapiens
acacacaaatattgcttgga

SEQ ID NO: 243343 - DNA, 22 bp, Homo sapiens
acacacaaatattgcttggact

SEQ ID NO: 243344 - DNA, 17 bp, Homo sapiens
acacacaaatgcagaca

SEQ ID NO: 243345 - DNA, 20 bp, Homo sapiens
acacacaaatgcagacacac

SEQ ID NO: 243346 - DNA, 14 bp, Homo sapiens
acacacaacaaaaa

SEQ ID NO: 243347 - DNA, 13 bp, Homo sapiens
acacacacaaaac

SEQ ID NO: 243348 - DNA, 14 bp, Homo sapiens
acacacacaaaaca

SEQ ID NO: 243349 - DNA, 14 bp, Homo sapiens
acacacacacacag

SEQ ID NO: 243350 - DNA, 16 bp, Homo sapiens
acacacacacacagcc

SEQ ID NO: 243351 - DNA, 15 bp, Homo sapiens
acacacacacacagg

SEQ ID NO: 243352 - DNA, 20 bp, Homo sapiens
acagccaagcccaccctggg

SEQ ID NO: 243353 - DNA, 18 bp, Homo sapiens
acagccacctccaccccc

SEQ ID NO: 243354 - DNA, 10 bp, Homo sapiens
acagccagaa

SEQ ID NO: 243355 - DNA, 13 bp, Homo sapiens
acagccagagctg

SEQ ID NO: 243356 - DNA, 19 bp, Homo sapiens
acagccagagctgggtggg

SEQ ID NO: 243357 - DNA, 15 bp, Homo sapiens
acagccagcccagct

SEQ ID NO: 243358 - DNA, 16 bp, Homo sapiens
acagccagcccagctc

SEQ ID NO: 243359 - DNA, 20 bp, Homo sapiens
acagccagtaaggcagctct

SEQ ID NO: 243360 - DNA, 15 bp, Homo sapiens
acagccatgattctt

SEQ ID NO: 243361 - DNA, 14 bp, Homo sapiens
acagcccaaccagg

SEQ ID NO: 243362 - DNA, 16 bp, Homo sapiens
acagcccagccacgga

SEQ ID NO: 243363 - DNA, 20 bp, Homo sapiens
acagccgtcagccaaatgta

SEQ ID NO: 243364 - DNA, 22 bp, Homo sapiens
acagcctaatgaaggccatcat

SEQ ID NO: 243365 - DNA, 22 bp, Homo sapiens
acagcctaggaccagttttgta

SEQ ID NO: 243366 - DNA, 12 bp, Homo sapiens
acagcctagggt

SEQ ID NO: 243367 - DNA, 15 bp, Homo sapiens
acagcctcacccctg

SEQ ID NO: 243368 - DNA, 18 bp, Homo sapiens
acagcctcacttgaatgt

SEQ ID NO: 243369 - DNA, 12 bp, Homo sapiens
acagcctccagg

SEQ ID NO: 243370 - DNA, 18 bp, Homo sapiens
acagcctctacagccgtc

SEQ ID NO: 243371 - DNA, 13 bp, Homo sapiens
acagcctctccct

SEQ ID NO: 243372 - DNA, 12 bp, Homo sapiens
acagcctgcaca

SEQ ID NO: 243373 - DNA, 15 bp, Homo sapiens
acagcctgcacacac

SEQ ID NO: 243374 - DNA, 23 bp, Homo sapiens
acagcctgcacacacctgcctgc

SEQ ID NO: 243375 - DNA, 13 bp, Homo sapiens
acagcctggcctc

SEQ ID NO: 243376 - DNA, 20 bp, Homo sapiens
acagcctgggtgacggtcct

SEQ ID NO: 243377 - DNA, 12 bp, Homo sapiens
acagcctgtctt

SEQ ID NO: 243378 - DNA, 20 bp, Homo sapiens
acagccttcactggagaccg

SEQ ID NO: 243379 - DNA, 18 bp, Homo sapiens
acagccttgggcctttca

SEQ ID NO: 243380 - DNA, 14 bp, Homo sapiens
acagcctttctgta

SEQ ID NO: 243381 - DNA, 16 bp, Homo sapiens
acagcgacagaaaacc

SEQ ID NO: 243382 - DNA, 15 bp, Homo sapiens
acagcggcccggccc

SEQ ID NO: 243383 - DNA, 16 bp, Homo sapiens
aatgttacattattat

SEQ ID NO: 243384 - DNA, 15 bp, Homo sapiens
aatgttacattgttt

SEQ ID NO: 243385 - DNA, 20 bp, Homo sapiens
aatgttactgatcatgcatt

SEQ ID NO: 243386 - DNA, 14 bp, Homo sapiens
aatgttagtggcat

SEQ ID NO: 243387 - DNA, 17 bp, Homo sapiens
aatgttatatcatcaat

SEQ ID NO: 243388 - DNA, 15 bp, Homo sapiens
aatgttatcctcttg

SEQ ID NO: 243389 - DNA, 22 bp, Homo sapiens
aatgttatttgttattttcagt

SEQ ID NO: 243390 - DNA, 20 bp, Homo sapiens
aatgttattttttaattatt

SEQ ID NO: 243391 - DNA, 21 bp, Homo sapiens
aatgttattttttaattatta

SEQ ID NO: 243392 - DNA, 17 bp, Homo sapiens
aatgttcattgtaatgt

SEQ ID NO: 243393 - DNA, 15 bp, Homo sapiens
aatgttccctgcacc

SEQ ID NO: 243394 - DNA, 18 bp, Homo sapiens
aatgttccctgcaccctg

SEQ ID NO: 243395 - DNA, 20 bp, Homo sapiens
aatgttgacctttgaggtct

SEQ ID NO: 243396 - DNA, 13 bp, Homo sapiens
aatgttgcactga

SEQ ID NO: 243397 - DNA, 18 bp, Homo sapiens
aatgttgcactgaaaacc

SEQ ID NO: 243398 - DNA, 20 bp, Homo sapiens
aatgttggaactctgtgcag

SEQ ID NO: 243399 - DNA, 21 bp, Homo sapiens
aatgttggcctgtcagagctt

SEQ ID NO: 243400 - DNA, 15 bp, Homo sapiens
aatgttggtgcaatt

SEQ ID NO: 243401 - DNA, 23 bp, Homo sapiens
aatgttggttacatgaatgaatg

SEQ ID NO: 243402 - DNA, 18 bp, Homo sapiens
aatgttgtcctgtgtcat

SEQ ID NO: 243403 - DNA, 16 bp, Homo sapiens
aatgttgtggtttgtt

SEQ ID NO: 243404 - DNA, 17 bp, Homo sapiens
aatgttgtggtttgttg

SEQ ID NO: 243405 - DNA, 21 bp, Homo sapiens
aatgttgttcattattggagg

SEQ ID NO: 243406 - DNA, 14 bp, Homo sapiens
aatgtttaatgctg

SEQ ID NO: 243407 - DNA, 20 bp, Homo sapiens
aatgtttattcctgataata

SEQ ID NO: 243408 - DNA, 13 bp, Homo sapiens
aatgtttccaggc

SEQ ID NO: 243409 - DNA, 23 bp, Homo sapiens
aatgtttccaggcatgaccctgg

SEQ ID NO: 243410 - DNA, 23 bp, Homo sapiens
aatgtttcttctaggttctaaaa

SEQ ID NO: 243411 - DNA, 12 bp, Homo sapiens
aatgtttgttga

SEQ ID NO: 243412 - DNA, 14 bp, Homo sapiens
aatgttttgtacaa

SEQ ID NO: 243413 - DNA, 17 bp, Homo sapiens
aatgttttgtacaatta

SEQ ID NO: 243414 - DNA, 16 bp, Homo sapiens
aatgtttttaaatata

SEQ ID NO: 243415 - DNA, 17 bp, Homo sapiens
aatgtttttaaatatat

SEQ ID NO: 243416 - DNA, 20 bp, Homo sapiens
aatgttttttgaagttctgg

SEQ ID NO: 243417 - DNA, 14 bp, Homo sapiens
aattaaaacaatgt

SEQ ID NO: 243418 - DNA, 20 bp, Homo sapiens
aattaaaacaatgtcaaggt

SEQ ID NO: 243419 - DNA, 14 bp, Homo sapiens
aattaaaacgaaaa

SEQ ID NO: 243420 - DNA, 21 bp, Homo sapiens
aattaaaacgaaaataaagta

SEQ ID NO: 243421 - DNA, 19 bp, Homo sapiens
aattaaacaatttatttta

SEQ ID NO: 243422 - DNA, 12 bp, Homo sapiens
aattaaagcaaa

SEQ ID NO: 243423 - DNA, 18 bp, Homo sapiens
aattaaaggtcctgccct

SEQ ID NO: 243424 - DNA, 17 bp, Homo sapiens
aattaaataaaataacc

SEQ ID NO: 243425 - DNA, 13 bp, Homo sapiens
aattaaataattt

SEQ ID NO: 243426 - DNA, 22 bp, Homo sapiens
aattaaataattttacatgtct

SEQ ID NO: 243427 - DNA, 16 bp, Homo sapiens
aattaaatatatgtat

SEQ ID NO: 243428 - DNA, 12 bp, Homo sapiens
aattaaatctgt

SEQ ID NO: 243429 - DNA, 15 bp, Homo sapiens
aattaaatgaaatac

SEQ ID NO: 243430 - DNA, 14 bp, Homo sapiens
aattaaattaggaa

SEQ ID NO: 243431 - DNA, 14 bp, Homo sapiens
aattaaattttgag

SEQ ID NO: 243432 - DNA, 16 bp, Homo sapiens
aattaacatataatat

SEQ ID NO: 243433 - DNA, 17 bp, Homo sapiens
aattaacatataatata

SEQ ID NO: 243434 - DNA, 20 bp, Homo sapiens
aattaacatataatatatgt

SEQ ID NO: 243435 - DNA, 14 bp, Homo sapiens
aattaacattatat

SEQ ID NO: 243436 - DNA, 23 bp, Homo sapiens
aattaactccgtttccaaataca

SEQ ID NO: 243437 - DNA, 18 bp, Homo sapiens
aattaacttctattttca

SEQ ID NO: 243438 - DNA, 12 bp, Homo sapiens
aattaatacata

SEQ ID NO: 243439 - DNA, 13 bp, Homo sapiens
aattaatagcttt

SEQ ID NO: 243440 - DNA, 14 bp, Homo sapiens
aattacaagtttca

SEQ ID NO: 243441 - DNA, 23 bp, Homo sapiens
aattacacacgtgtgatgtatgt

SEQ ID NO: 243442 - DNA, 20 bp, Homo sapiens
aattacaggaagtactggag

SEQ ID NO: 243443 - DNA, 18 bp, Homo sapiens
aattacataacaggcatt

SEQ ID NO: 243444 - DNA, 14 bp, Homo sapiens
aattacataatttt

SEQ ID NO: 243445 - DNA, 16 bp, Homo sapiens
aattactacaaaattt

SEQ ID NO: 243446 - DNA, 17 bp, Homo sapiens
aattactacaaaatttg

SEQ ID NO: 243447 - DNA, 12 bp, Homo sapiens
aattagaaaaaa

SEQ ID NO: 243448 - DNA, 16 bp, Homo sapiens
aattagaaaaaaacaa

SEQ ID NO: 243449 - DNA, 22 bp, Homo sapiens
aattaggaagcttgatttgctt

SEQ ID NO: 243450 - DNA, 19 bp, Homo sapiens
aattagggctctaatttcc

SEQ ID NO: 243451 - DNA, 20 bp, Homo sapiens
aattagggctctaatttcct

SEQ ID NO: 243452 - DNA, 17 bp, Homo sapiens
aattaggggttgctaag

SEQ ID NO: 243453 - DNA, 20 bp, Homo sapiens
aattagtcctcacagcctag

SEQ ID NO: 243454 - DNA, 18 bp, Homo sapiens
aattagtgagatttgtat

SEQ ID NO: 243455 - DNA, 15 bp, Homo sapiens
aattataaggactgc

SEQ ID NO: 243456 - DNA, 20 bp, Homo sapiens
aattatacagacctaatatc

SEQ ID NO: 243457 - DNA, 21 bp, Homo sapiens
aattatacagacctaatatca

SEQ ID NO: 243458 - DNA, 23 bp, Homo sapiens
aattatacagacctaatatcatt

SEQ ID NO: 243459 - DNA, 18 bp, Homo sapiens
aattatatgatatgcatg

SEQ ID NO: 243460 - DNA, 21 bp, Homo sapiens
aattatcacaatgtactatat

SEQ ID NO: 243461 - DNA, 15 bp, Homo sapiens
aattatcggaagcag

SEQ ID NO: 243462 - DNA, 20 bp, Homo sapiens
aattatcgggaacagtgttt

SEQ ID NO: 243463 - DNA, 13 bp, Homo sapiens
aattatctatttg

SEQ ID NO: 243464 - DNA, 16 bp, Homo sapiens
aattatctatttgtat

SEQ ID NO: 243465 - DNA, 12 bp, Homo sapiens
aattatctttaa

SEQ ID NO: 243466 - DNA, 13 bp, Homo sapiens
aattatctttaaa

SEQ ID NO: 243467 - DNA, 20 bp, Homo sapiens
aattatgaagccctaagtaa

SEQ ID NO: 243468 - DNA, 12 bp, Homo sapiens
aattatgacagt

SEQ ID NO: 243469 - DNA, 22 bp, Homo sapiens
aattatgcagcttgcacaccca

SEQ ID NO: 243470 - DNA, 17 bp, Homo sapiens
aattatgctaacaaact

SEQ ID NO: 243471 - DNA, 20 bp, Homo sapiens
aattatgggaacaagtgtac

SEQ ID NO: 243472 - DNA, 15 bp, Homo sapiens
aatagttagccctca

SEQ ID NO: 243473 - DNA, 13 bp, Homo sapiens
aatagttctattt

SEQ ID NO: 243474 - DNA, 15 bp, Homo sapiens
aatagttctatttct

SEQ ID NO: 243475 - DNA, 20 bp, Homo sapiens
aatagttctatttctatctg

SEQ ID NO: 243476 - DNA, 23 bp, Homo sapiens
aatagttgctgtccccttccagg

SEQ ID NO: 243477 - DNA, 13 bp, Homo sapiens
aaaaaaaaagttc

SEQ ID NO: 243478 - DNA, 13 bp, Homo sapiens
aaaaaaaatatga

SEQ ID NO: 243479 - DNA, 13 bp, Homo sapiens
aaaaaaagaaaag

SEQ ID NO: 243480 - DNA, 12 bp, Homo sapiens
aaaaaaataaca

SEQ ID NO: 243481 - DNA, 13 bp, Homo sapiens
aaaaaaatatatt

SEQ ID NO: 243482 - DNA, 11 bp, Homo sapiens
aaaaaaatcaa

SEQ ID NO: 243483 - DNA, 20 bp, Homo sapiens
aaaaaagaaaacattccaga

SEQ ID NO: 243484 - DNA, 12 bp, Homo sapiens
aaaaaagaaacc

SEQ ID NO: 243485 - DNA, 18 bp, Homo sapiens
aaaaaagaataatgaccc

SEQ ID NO: 243486 - DNA, 15 bp, Homo sapiens
aaaaaagagaattag

SEQ ID NO: 243487 - DNA, 12 bp, Homo sapiens
aaaaaagtgagc

SEQ ID NO: 243488 - DNA, 12 bp, Homo sapiens
aaaaaataagta

SEQ ID NO: 243489 - DNA, 12 bp, Homo sapiens
aaaaaatcagct

SEQ ID NO: 243490 - DNA, 17 bp, Homo sapiens
aaaaaatgaatagtaca

SEQ ID NO: 243491 - DNA, 11 bp, Homo sapiens
aaaaaatgtcc

SEQ ID NO: 243492 - DNA, 14 bp, Homo sapiens
aaaaaatgttcatt

SEQ ID NO: 243493 - DNA, 12 bp, Homo sapiens
aaaaaatttaaa

SEQ ID NO: 243494 - DNA, 15 bp, Homo sapiens
aaaaacaaaatgtta

SEQ ID NO: 243495 - DNA, 14 bp, Homo sapiens
aaaaacatggcctt

SEQ ID NO: 243496 - DNA, 15 bp, Homo sapiens
aaaaacatgtcatgt

SEQ ID NO: 243497 - DNA, 14 bp, Homo sapiens
aaaaacatttgtac

SEQ ID NO: 243498 - DNA, 17 bp, Homo sapiens
aaaaacatttgtacatt

SEQ ID NO: 243499 - DNA, 13 bp, Homo sapiens
aaaaacctgtggg

SEQ ID NO: 243500 - DNA, 10 bp, Homo sapiens
aaaaacttcc

SEQ ID NO: 243501 - DNA, 15 bp, Homo sapiens
aaaaactttccatga

SEQ ID NO: 243502 - DNA, 17 bp, Homo sapiens
aaaaactttccatgaca

SEQ ID NO: 243503 - DNA, 16 bp, Homo sapiens
aaaaactttgttatat

SEQ ID NO: 243504 - DNA, 23 bp, Homo sapiens
aaaaacttttataaattaaatat

SEQ ID NO: 243505 - DNA, 16 bp, Homo sapiens
aaaaacttttttggaa

SEQ ID NO: 243506 - DNA, 22 bp, Homo sapiens
aaaaagaagaggttcatttttc

SEQ ID NO: 243507 - DNA, 19 bp, Homo sapiens
aaaaagagaattagattat

SEQ ID NO: 243508 - DNA, 20 bp, Homo sapiens
aaaaagagtcttaattttct

SEQ ID NO: 243509 - DNA, 11 bp, Homo sapiens
aaaaagatccc

SEQ ID NO: 243510 - DNA, 21 bp, Homo sapiens
aaaaagatggatttgacacac

SEQ ID NO: 243511 - DNA, 22 bp, Homo sapiens
aaaaagatggatttgacacact

SEQ ID NO: 243512 - DNA, 11 bp, Homo sapiens
aaaaagcacaa

SEQ ID NO: 243513 - DNA, 23 bp, Homo sapiens
aaaaagcaggaaagatcccaagt

SEQ ID NO: 243514 - DNA, 17 bp, Homo sapiens
aaaaagcctaagaaaaa

SEQ ID NO: 243515 - DNA, 19 bp, Homo sapiens
aaaaagctcaatgcattgt

SEQ ID NO: 243516 - DNA, 19 bp, Homo sapiens
aaaaaggaaaaaattaata

SEQ ID NO: 243517 - DNA, 14 bp, Homo sapiens
aaaaaggcctttgg

SEQ ID NO: 243518 - DNA, 16 bp, Homo sapiens
aaaaaggttaacagta

SEQ ID NO: 243519 - DNA, 18 bp, Homo sapiens
aaaaagtacagaacatat

SEQ ID NO: 243520 - DNA, 18 bp, Homo sapiens
aaaaagtatacttttgtt

SEQ ID NO: 243521 - DNA, 15 bp, Homo sapiens
aaaaagtcaaacttt

SEQ ID NO: 243522 - DNA, 14 bp, Homo sapiens
aaaaagtctgcatt

SEQ ID NO: 243523 - DNA, 14 bp, Homo sapiens
aaaaagtgacacag

SEQ ID NO: 243524 - DNA, 19 bp, Homo sapiens
aaaaagtgacacagcagct

SEQ ID NO: 243525 - DNA, 20 bp, Homo sapiens
aaaaagtgggttttttagtt

SEQ ID NO: 243526 - DNA, 12 bp, Homo sapiens
aaaaagtgttta

SEQ ID NO: 243527 - DNA, 15 bp, Homo sapiens
aaaaagttgcacatt

SEQ ID NO: 243528 - DNA, 13 bp, Homo sapiens
aaaaataaaagtt

SEQ ID NO: 243529 - DNA, 16 bp, Homo sapiens
aaaaataaaatgcatt

SEQ ID NO: 243530 - DNA, 21 bp, Homo sapiens
aaaaataaatttggttctaat

SEQ ID NO: 243531 - DNA, 19 bp, Homo sapiens
aaaaataaccccaaaatga

SEQ ID NO: 243532 - DNA, 16 bp, Homo sapiens
aaaaataatataaatg

SEQ ID NO: 243533 - DNA, 20 bp, Homo sapiens
aaaaataatataaatgaatg

SEQ ID NO: 243534 - DNA, 22 bp, Homo sapiens
aaaaatagtaagcctccctcct

SEQ ID NO: 243535 - DNA, 13 bp, Homo sapiens
aaaaatattccat

SEQ ID NO: 243536 - DNA, 15 bp, Homo sapiens
aaaaatattctccat

SEQ ID NO: 243537 - DNA, 23 bp, Homo sapiens
aaaaatccctcttcctccaaagc

SEQ ID NO: 243538 - DNA, 13 bp, Homo sapiens
aaaaatctagttt

SEQ ID NO: 243539 - DNA, 14 bp, Homo sapiens
aaaaatctagtttt

SEQ ID NO: 243540 - DNA, 16 bp, Homo sapiens
aaaaatgatctattgc

SEQ ID NO: 243541 - DNA, 17 bp, Homo sapiens
aaaaatgatctattgca

SEQ ID NO: 243542 - DNA, 22 bp, Homo sapiens
aaaaatgggagacagcctctta

SEQ ID NO: 243543 - DNA, 18 bp, Homo sapiens
aaaaatgtcctgcctttt

SEQ ID NO: 243544 - DNA, 12 bp, Homo sapiens
aaaaatgttcat

SEQ ID NO: 243545 - DNA, 16 bp, Homo sapiens
aaaaattatagactcc

SEQ ID NO: 243546 - DNA, 18 bp, Homo sapiens
aaaaattatctatttgta

SEQ ID NO: 243547 - DNA, 11 bp, Homo sapiens
aaaaattatta

SEQ ID NO: 243548 - DNA, 14 bp, Homo sapiens
aaaaatttaagcat

SEQ ID NO: 243549 - DNA, 16 bp, Homo sapiens
aaaaatttaagcattg

SEQ ID NO: 243550 - DNA, 22 bp, Homo sapiens
aaaaatttaagcattgtttgct

SEQ ID NO: 243551 - DNA, 20 bp, Homo sapiens
aaaaatttgaaccaaaacat

SEQ ID NO: 243552 - DNA, 16 bp, Homo sapiens
aaaaatttgtttaaag

SEQ ID NO: 243553 - DNA, 22 bp, Homo sapiens
aaaaattttataaaattaagca

SEQ ID NO: 243554 - DNA, 23 bp, Homo sapiens
aaaacaaaatccttgccttcaaa

SEQ ID NO: 243555 - DNA, 18 bp, Homo sapiens
aaaacaaagctgatttcc

SEQ ID NO: 243556 - DNA, 11 bp, Homo sapiens
aaaacaagaaa

SEQ ID NO: 243557 - DNA, 18 bp, Homo sapiens
aaaacaagaaaccaagtg

SEQ ID NO: 243558 - DNA, 14 bp, Homo sapiens
aaaacaatatttat

SEQ ID NO: 243559 - DNA, 22 bp, Homo sapiens
aaaacaccgcttctgccttttc

SEQ ID NO: 243560 - DNA, 14 bp, Homo sapiens
aaaacacttatcct

SEQ ID NO: 243561 - DNA, 16 bp, Homo sapiens
aaaacagaaaaaaaac

SEQ ID NO: 243562 - DNA, 17 bp, Homo sapiens
aaaacagatttgttcat

SEQ ID NO: 243563 - DNA, 17 bp, Homo sapiens
aaaacagccactgaata

SEQ ID NO: 243564 - DNA, 23 bp, Homo sapiens
aaaacagctgtctctaacttatt

SEQ ID NO: 243565 - DNA, 17 bp, Homo sapiens
aaaacatacccagtgtt

SEQ ID NO: 243566 - DNA, 14 bp, Homo sapiens
aaaacatgtcatgt

SEQ ID NO: 243567 - DNA, 20 bp, Homo sapiens
aaaacattccgtttacattt

SEQ ID NO: 243568 - DNA, 12 bp, Homo sapiens
aaaacatttgta

SEQ ID NO: 243569 - DNA, 15 bp, Homo sapiens
aaaacattttaaaat

SEQ ID NO: 243570 - DNA, 21 bp, Homo sapiens
aaaacattttaaaatcaactt

SEQ ID NO: 243571 - DNA, 21 bp, Homo sapiens
aaaacattttttaatagaata

SEQ ID NO: 243572 - DNA, 19 bp, Homo sapiens
aaaaccaagccgtggcttc

SEQ ID NO: 243573 - DNA, 23 bp, Homo sapiens
aaaaccaatgattcataacaatg

SEQ ID NO: 243574 - DNA, 19 bp, Homo sapiens
aaaaccactatgcaaagaa

SEQ ID NO: 243575 - DNA, 13 bp, Homo sapiens
aaaaccagaatta

SEQ ID NO: 243576 - DNA, 12 bp, Homo sapiens
aaaaccagagag

SEQ ID NO: 243577 - DNA, 13 bp, Homo sapiens
aaaacctgacaaa

SEQ ID NO: 243578 - DNA, 14 bp, Homo sapiens
aaaacctgtcaatg

SEQ ID NO: 243579 - DNA, 16 bp, Homo sapiens
aaaacctttattcttt

SEQ ID NO: 243580 - DNA, 14 bp, Homo sapiens
aaaacgaaaataaa

SEQ ID NO: 243581 - DNA, 20 bp, Homo sapiens
aaaacgaaaataaagtagct

SEQ ID NO: 243582 - DNA, 20 bp, Homo sapiens
aaaacgggttactaagatga

SEQ ID NO: 243583 - DNA, 17 bp, Homo sapiens
aaaacgttttattgtgt

SEQ ID NO: 243584 - DNA, 20 bp, Homo sapiens
aaaactaagctctttgagaa

SEQ ID NO: 243585 - DNA, 13 bp, Homo sapiens
aaaactaagttct

SEQ ID NO: 243586 - DNA, 14 bp, Homo sapiens
aaaactagataact

SEQ ID NO: 243587 - DNA, 19 bp, Homo sapiens
aaaactatatgtatggttt

SEQ ID NO: 243588 - DNA, 17 bp, Homo sapiens
aaaactatggttcccaa

SEQ ID NO: 243589 - DNA, 20 bp, Homo sapiens
aaaactatttaaaattggca

SEQ ID NO: 243590 - DNA, 16 bp, Homo sapiens
aaaactcaccatttca

SEQ ID NO: 243591 - DNA, 18 bp, Homo sapiens
aaaactgaaaatctaata

SEQ ID NO: 243592 - DNA, 19 bp, Homo sapiens
aaaactgaaaatctaatat

SEQ ID NO: 243593 - DNA, 13 bp, Homo sapiens
aaaactggctttt

SEQ ID NO: 243594 - DNA, 11 bp, Homo sapiens
aaaactgtgac

SEQ ID NO: 243595 - DNA, 19 bp, Homo sapiens
aaaactgtgacattccaca

SEQ ID NO: 243596 - DNA, 21 bp, Homo sapiens
aaaacttaaccgcatcagaag

SEQ ID NO: 243597 - DNA, 20 bp, Homo sapiens
aaaacttatgctagtttatt

SEQ ID NO: 243598 - DNA, 14 bp, Homo sapiens
aaaacttcaaagct

SEQ ID NO: 243599 - DNA, 22 bp, Homo sapiens
aaaacttcattctaaaccaaaa

SEQ ID NO: 243600 - DNA, 9 bp, Homo sapiens
aaaacttcc

SEQ ID NO: 243601 - DNA, 23 bp, Homo sapiens
aaaacttccattctttcttcctc

SEQ ID NO: 243602 - DNA, 18 bp, Homo sapiens
aaaacttgagcccactcc

SEQ ID NO: 243603 - DNA, 16 bp, Homo sapiens
aaaactttatgtactg

SEQ ID NO: 243604 - DNA, 17 bp, Homo sapiens
aaaactttatgtactgc

SEQ ID NO: 243605 - DNA, 16 bp, Homo sapiens
aaaactttattttata

SEQ ID NO: 243606 - DNA, 17 bp, Homo sapiens
aaaactttattttatat

SEQ ID NO: 243607 - DNA, 18 bp, Homo sapiens
aaaactttattttatata

SEQ ID NO: 243608 - DNA, 12 bp, Homo sapiens
aaaactttccat

SEQ ID NO: 243609 - DNA, 18 bp, Homo sapiens
aaaactttccatgacagt

SEQ ID NO: 243610 - DNA, 14 bp, Homo sapiens
aaaactttcctcgc

SEQ ID NO: 243611 - DNA, 16 bp, Homo sapiens
aaaactttcctcgcct

SEQ ID NO: 243612 - DNA, 17 bp, Homo sapiens
aaaacttttataaatta

SEQ ID NO: 243613 - DNA, 22 bp, Homo sapiens
aaaacttttataaattaaatat

SEQ ID NO: 243614 - DNA, 19 bp, Homo sapiens
aaaagaaatgctaatgtaa

SEQ ID NO: 243615 - DNA, 12 bp, Homo sapiens
aaaagaaattct

SEQ ID NO: 243616 - DNA, 23 bp, Homo sapiens
aaaagaagtttgggctaacattt

SEQ ID NO: 243617 - DNA, 13 bp, Homo sapiens
aaaagacaaacac

SEQ ID NO: 243618 - DNA, 21 bp, Homo sapiens
aaaagacagtggatcatgaaa

SEQ ID NO: 243619 - DNA, 18 bp, Homo sapiens
aaaagagaaaaaccaatg

SEQ ID NO: 243620 - DNA, 12 bp, Homo sapiens
aaaagagaaggc

SEQ ID NO: 243621 - DNA, 19 bp, Homo sapiens
aaaagagagaaaacttatt

SEQ ID NO: 243622 - DNA, 14 bp, Homo sapiens
aaaagaggaaatta

SEQ ID NO: 243623 - DNA, 18 bp, Homo sapiens
aaaagaggaaattaaata

SEQ ID NO: 243624 - DNA, 18 bp, Homo sapiens
aaaagatacatttgtatg

SEQ ID NO: 243625 - DNA, 14 bp, Homo sapiens
aaaagatgtatcct

SEQ ID NO: 243626 - DNA, 15 bp, Homo sapiens
aaaagattatgtatt

SEQ ID NO: 243627 - DNA, 12 bp, Homo sapiens
aaaagcaacttt

SEQ ID NO: 243628 - DNA, 14 bp, Homo sapiens
aaaagcagctacca

SEQ ID NO: 243629 - DNA, 10 bp, Homo sapiens
aaaagcccac

SEQ ID NO: 243630 - DNA, 17 bp, Homo sapiens
aaaagcctaagaaaaag

SEQ ID NO: 243631 - DNA, 11 bp, Homo sapiens
aaaaggaaaac

SEQ ID NO: 243632 - DNA, 14 bp, Homo sapiens
aaaaggaagactag

SEQ ID NO: 243633 - DNA, 13 bp, Homo sapiens
aaaaggaagtaga

SEQ ID NO: 243634 - DNA, 15 bp, Homo sapiens
aaaaggaatgcaaga

SEQ ID NO: 243635 - DNA, 17 bp, Homo sapiens
aaaaggaatgcaagaga

SEQ ID NO: 243636 - DNA, 18 bp, Homo sapiens
aaaaggagcgggcagggc

SEQ ID NO: 243637 - DNA, 15 bp, Homo sapiens
aaaaggataggaaaa

SEQ ID NO: 243638 - DNA, 16 bp, Homo sapiens
aaaaggataggaaaag

SEQ ID NO: 243639 - DNA, 12 bp, Homo sapiens
aaaaggcctttg

SEQ ID NO: 243640 - DNA, 14 bp, Homo sapiens
aaaaggcctttggg

SEQ ID NO: 243641 - DNA, 20 bp, Homo sapiens
aaaaggtgattaaatattta

SEQ ID NO: 243642 - DNA, 18 bp, Homo sapiens
aaaaggttaacagtaaaa

SEQ ID NO: 243643 - DNA, 16 bp, Homo sapiens
aaaaggttaagccata

SEQ ID NO: 243644 - DNA, 15 bp, Homo sapiens
aaaagtaattaattg

SEQ ID NO: 243645 - DNA, 19 bp, Homo sapiens
aaaagtacatagtgaattt

SEQ ID NO: 243646 - DNA, 19 bp, Homo sapiens
aaaagtctatttttttaac

SEQ ID NO: 243647 - DNA, 19 bp, Homo sapiens
aaaagtctcaatgttccat

SEQ ID NO: 243648 - DNA, 14 bp, Homo sapiens
aaaagtctgcatta

SEQ ID NO: 243649 - DNA, 20 bp, Homo sapiens
aaaagtcttaacaacagctt

SEQ ID NO: 243650 - DNA, 14 bp, Homo sapiens
aaaagtgactctca

SEQ ID NO: 243651 - DNA, 17 bp, Homo sapiens
aaaagtgactctcagcg

SEQ ID NO: 243652 - DNA, 15 bp, Homo sapiens
aaaagtgatgtgatt

SEQ ID NO: 243653 - DNA, 16 bp, Homo sapiens
aaaagtgcagtagtgt

SEQ ID NO: 243654 - DNA, 21 bp, Homo sapiens
aaaagtgctacttgagagtgg

SEQ ID NO: 243655 - DNA, 23 bp, Homo sapiens
aaaagtgggttttttagttgaat

SEQ ID NO: 243656 - DNA, 12 bp, Homo sapiens
aaaagtgttccc

SEQ ID NO: 243657 - DNA, 21 bp, Homo sapiens
aaaagtgtttatttttcatat

SEQ ID NO: 243658 - DNA, 22 bp, Homo sapiens
aaaagttaaaaaaaataataaa

SEQ ID NO: 243659 - DNA, 16 bp, Homo sapiens
aaaagttcgaaagaaa

SEQ ID NO: 243660 - DNA, 22 bp, Homo sapiens
aaaagttgataggagacttgta

SEQ ID NO: 243661 - DNA, 13 bp, Homo sapiens
aaaagtttacaac

SEQ ID NO: 243662 - DNA, 17 bp, Homo sapiens
aaaagtttacaacataa

SEQ ID NO: 243663 - DNA, 22 bp, Homo sapiens
aaaagtttacaagtgtatatca

SEQ ID NO: 243664 - DNA, 12 bp, Homo sapiens
aaaagtttcaat

SEQ ID NO: 243665 - DNA, 19 bp, Homo sapiens
aaaagtttcacgtcttggt

SEQ ID NO: 243666 - DNA, 17 bp, Homo sapiens
aaaagttttatgtactt

SEQ ID NO: 243667 - DNA, 18 bp, Homo sapiens
aaaagttttatgtacttt

SEQ ID NO: 243668 - DNA, 16 bp, Homo sapiens
aaaataaaaaagatcc

SEQ ID NO: 243669 - DNA, 22 bp, Homo sapiens
aaaataaaaagtgacacagcag

SEQ ID NO: 243670 - DNA, 14 bp, Homo sapiens
aaaataaaactaag

SEQ ID NO: 243671 - DNA, 16 bp, Homo sapiens
aaaataaaatgcattt

SEQ ID NO: 243672 - DNA, 17 bp, Homo sapiens
aaaataaaatgcattta

SEQ ID NO: 243673 - DNA, 16 bp, Homo sapiens
aaaataaaccaacaat

SEQ ID NO: 243674 - DNA, 20 bp, Homo sapiens
aaaataaagaatagcaatta

SEQ ID NO: 243675 - DNA, 13 bp, Homo sapiens
aaaataaatatac

SEQ ID NO: 243676 - DNA, 16 bp, Homo sapiens
aaaataaatatactaa

SEQ ID NO: 243677 - DNA, 14 bp, Homo sapiens
aaaataaatgtttt

SEQ ID NO: 243678 - DNA, 12 bp, Homo sapiens
aaaataagtaaa

SEQ ID NO: 243679 - DNA, 13 bp, Homo sapiens
aaaataagtaaca

SEQ ID NO: 243680 - DNA, 12 bp, Homo sapiens
aaaataagtgaa

SEQ ID NO: 243681 - DNA, 11 bp, Homo sapiens
aaaataataaa

SEQ ID NO: 243682 - DNA, 13 bp, Homo sapiens
aaaataataataa

SEQ ID NO: 243683 - DNA, 14 bp, Homo sapiens
aaaataatgattta

SEQ ID NO: 243684 - DNA, 12 bp, Homo sapiens
aaaataatttta

SEQ ID NO: 243685 - DNA, 18 bp, Homo sapiens
aaaatactattggacaga

SEQ ID NO: 243686 - DNA, 19 bp, Homo sapiens
aaaatacttctttttcatt

SEQ ID NO: 243687 - DNA, 21 bp, Homo sapiens
aaaatagagcttttaaaaatg

SEQ ID NO: 243688 - DNA, 14 bp, Homo sapiens
aaaatagagtgcag

SEQ ID NO: 243689 - DNA, 15 bp, Homo sapiens
aaaatagctataaat

SEQ ID NO: 243690 - DNA, 16 bp, Homo sapiens
aaaatagctataaata

SEQ ID NO: 243691 - DNA, 12 bp, Homo sapiens
aaaatagcttgt

SEQ ID NO: 243692 - DNA, 19 bp, Homo sapiens
aaaatagcttgtatagtgt

SEQ ID NO: 243693 - DNA, 21 bp, Homo sapiens
aaaatagggtggacagaagct

SEQ ID NO: 243694 - DNA, 18 bp, Homo sapiens
aaaatagtaaatgctttg

SEQ ID NO: 243695 - DNA, 14 bp, Homo sapiens
aaaatagttctatt

SEQ ID NO: 243696 - DNA, 15 bp, Homo sapiens
aaaatagttctattt

SEQ ID NO: 243697 - DNA, 18 bp, Homo sapiens
aaaatagttctatttcta

SEQ ID NO: 243698 - DNA, 23 bp, Homo sapiens
aaaatagttctatttctatctgc

SEQ ID NO: 243699 - DNA, 10 bp, Homo sapiens
aaaatataaa

SEQ ID NO: 243700 - DNA, 18 bp, Homo sapiens
aaaatataaattaagact

SEQ ID NO: 243701 - DNA, 15 bp, Homo sapiens
aaaatatatttaatg

SEQ ID NO: 243702 - DNA, 13 bp, Homo sapiens
aaaatatcccttt

SEQ ID NO: 243703 - DNA, 18 bp, Homo sapiens
aaaatatgatatatatgt

SEQ ID NO: 243704 - DNA, 21 bp, Homo sapiens
aaaatatggaacttctaatat

SEQ ID NO: 243705 - DNA, 21 bp, Homo sapiens
aaaatatgtgagcatgaaact

SEQ ID NO: 243706 - DNA, 17 bp, Homo sapiens
aaaatattatctttgta

SEQ ID NO: 243707 - DNA, 14 bp, Homo sapiens
aaaatattatgtgt

SEQ ID NO: 243708 - DNA, 15 bp, Homo sapiens
aaaatattatgtgtt

SEQ ID NO: 243709 - DNA, 21 bp, Homo sapiens
aaaatattatgtgtttccata

SEQ ID NO: 243710 - DNA, 15 bp, Homo sapiens
aaaatattcctgcat

SEQ ID NO: 243711 - DNA, 13 bp, Homo sapiens
aaaatatttattt

SEQ ID NO: 243712 - DNA, 19 bp, Homo sapiens
aaaatatttttttctagct

SEQ ID NO: 243713 - DNA, 22 bp, Homo sapiens
aaaatccaagctgctcatttca

SEQ ID NO: 243714 - DNA, 21 bp, Homo sapiens
aaaatccctcttcctccaaag

SEQ ID NO: 243715 - DNA, 21 bp, Homo sapiens
aaaatccttccaaagaattct

SEQ ID NO: 243716 - DNA, 18 bp, Homo sapiens
aaaatccttgccttcaaa

SEQ ID NO: 243717 - DNA, 16 bp, Homo sapiens
aaaatctaaaacaaaa

SEQ ID NO: 243718 - DNA, 23 bp, Homo sapiens
aaaatctagatcaattaattctt

SEQ ID NO: 243719 - DNA, 19 bp, Homo sapiens
aaaatctagttttttttgt

SEQ ID NO: 243720 - DNA, 18 bp, Homo sapiens
aaaatctgaactctcaaa

SEQ ID NO: 243721 - DNA, 22 bp, Homo sapiens
aaaatctgaactctcaaaagtc

SEQ ID NO: 243722 - DNA, 12 bp, Homo sapiens
aaaatctgtcca

SEQ ID NO: 243723 - DNA, 19 bp, Homo sapiens
aaaatcttgtgctagaata

SEQ ID NO: 243724 - DNA, 22 bp, Homo sapiens
aaaatctttccatctcattaca

SEQ ID NO: 243725 - DNA, 13 bp, Homo sapiens
aaaatgaagggat

SEQ ID NO: 243726 - DNA, 15 bp, Homo sapiens
aaaatgacttttatt

SEQ ID NO: 243727 - DNA, 19 bp, Homo sapiens
aaaatgagaatctgtgcag

SEQ ID NO: 243728 - DNA, 20 bp, Homo sapiens
aaaatgagaatctgtgcagt

SEQ ID NO: 243729 - DNA, 17 bp, Homo sapiens
aaaatgagcctgtaatc

SEQ ID NO: 243730 - DNA, 16 bp, Homo sapiens
aaaatgaggacatgtt

SEQ ID NO: 243731 - DNA, 18 bp, Homo sapiens
aaaatgaggttcaactgt

SEQ ID NO: 243732 - DNA, 19 bp, Homo sapiens
aaaatgatgtatgatttgt

SEQ ID NO: 243733 - DNA, 14 bp, Homo sapiens
aaaatgattttatc

SEQ ID NO: 243734 - DNA, 14 bp, Homo sapiens
aaaatgcacatagc

SEQ ID NO: 243735 - DNA, 13 bp, Homo sapiens
aaaatgcatgtga

SEQ ID NO: 243736 - DNA, 19 bp, Homo sapiens
aaaatgcattgaaagaatt

SEQ ID NO: 243737 - DNA, 20 bp, Homo sapiens
aaaatgcattgaaagaatta

SEQ ID NO: 243738 - DNA, 18 bp, Homo sapiens
aaaatgccacattttgct

SEQ ID NO: 243739 - DNA, 16 bp, Homo sapiens
aaaatgccacttaaca

SEQ ID NO: 243740 - DNA, 19 bp, Homo sapiens
aaaatgccacttaacagga

SEQ ID NO: 243741 - DNA, 15 bp, Homo sapiens
aaaatgcccatttgc

SEQ ID NO: 243742 - DNA, 14 bp, Homo sapiens
aaaatggaaagaat

SEQ ID NO: 243743 - DNA, 21 bp, Homo sapiens
aaaatggacgtgttatgactc

SEQ ID NO: 243744 - DNA, 17 bp, Homo sapiens
aaaatggatgacaaaga

SEQ ID NO: 243745 - DNA, 20 bp, Homo sapiens
aaaatggtgttttcatgtaa

SEQ ID NO: 243746 - DNA, 20 bp, Homo sapiens
aaaatgtaaatattctatat

SEQ ID NO: 243747 - DNA, 19 bp, Homo sapiens
aaaatgtagaagaaagcaa

SEQ ID NO: 243748 - DNA, 17 bp, Homo sapiens
aaaatgtattcaagcaa

SEQ ID NO: 243749 - DNA, 16 bp, Homo sapiens
aaaatgtcctgccttt

SEQ ID NO: 243750 - DNA, 18 bp, Homo sapiens
aaaatgtcctgcctttta

SEQ ID NO: 243751 - DNA, 12 bp, Homo sapiens
aaaatgtctgta

SEQ ID NO: 243752 - DNA, 12 bp, Homo sapiens
aaaatgtgattt

SEQ ID NO: 243753 - DNA, 13 bp, Homo sapiens
aaaatgtgatttt

SEQ ID NO: 243754 - DNA, 21 bp, Homo sapiens
aaaatgtgggattatgggtca

SEQ ID NO: 243755 - DNA, 22 bp, Homo sapiens
aaaatgtgggattatgggtcac

SEQ ID NO: 243756 - DNA, 21 bp, Homo sapiens
aaaatgtgtctgcaacatgga

SEQ ID NO: 243757 - DNA, 22 bp, Homo sapiens
aaaatgtgtctgcaacatggat

SEQ ID NO: 243758 - DNA, 15 bp, Homo sapiens
aaaatgtgtgcttgg

SEQ ID NO: 243759 - DNA, 12 bp, Homo sapiens
aaaatgttaata

SEQ ID NO: 243760 - DNA, 21 bp, Homo sapiens
aaaatgtttgccctgttcaaa

SEQ ID NO: 243761 - DNA, 18 bp, Homo sapiens
aaaattagaaaaaaacaa

SEQ ID NO: 243762 - DNA, 22 bp, Homo sapiens
aaaattagtgagatttgtattt

SEQ ID NO: 243763 - DNA, 12 bp, Homo sapiens
aaaattatcagt

SEQ ID NO: 243764 - DNA, 22 bp, Homo sapiens
aaaattatctttaaaacttact

SEQ ID NO: 243765 - DNA, 14 bp, Homo sapiens
aaaattcaaaaagt

SEQ ID NO: 243766 - DNA, 13 bp, Homo sapiens
aaaattcatataa

SEQ ID NO: 243767 - DNA, 14 bp, Homo sapiens
aaaattcatataaa

SEQ ID NO: 243768 - DNA, 13 bp, Homo sapiens
aaaattctagtct

SEQ ID NO: 243769 - DNA, 20 bp, Homo sapiens
aaaattctagtctctgattt

SEQ ID NO: 243770 - DNA, 15 bp, Homo sapiens
aaaattctcaagtga

SEQ ID NO: 243771 - DNA, 20 bp, Homo sapiens
aaaattctgtaggttctgtg

SEQ ID NO: 243772 - DNA, 14 bp, Homo sapiens
aaaattgatgtgtt

SEQ ID NO: 243773 - DNA, 15 bp, Homo sapiens
aaaattgcattttta

SEQ ID NO: 243774 - DNA, 22 bp, Homo sapiens
aaaattgcatttttacctttca

SEQ ID NO: 243775 - DNA, 15 bp, Homo sapiens
aaaattgtaaaattg

SEQ ID NO: 243776 - DNA, 17 bp, Homo sapiens
aaaattgtcaaatgtca

SEQ ID NO: 243777 - DNA, 20 bp, Homo sapiens
aaaatttaaaaaactcctgt

SEQ ID NO: 243778 - DNA, 14 bp, Homo sapiens
aaaatttaagcatt

SEQ ID NO: 243779 - DNA, 23 bp, Homo sapiens
aaaatttaagcattgtttgctta

SEQ ID NO: 243780 - DNA, 20 bp, Homo sapiens
aaaatttgaaccaaaacatt

SEQ ID NO: 243781 - DNA, 23 bp, Homo sapiens
aaaatttgaaccaaaacattccg

SEQ ID NO: 243782 - DNA, 13 bp, Homo sapiens
aaaatttgagact

SEQ ID NO: 243783 - DNA, 16 bp, Homo sapiens
aaaatttgttttgacg

SEQ ID NO: 243784 - DNA, 22 bp, Homo sapiens
aaaatttgttttgacggatgat

SEQ ID NO: 243785 - DNA, 12 bp, Homo sapiens
aaaattttactt

SEQ ID NO: 243786 - DNA, 13 bp, Homo sapiens
aaaattttacttc

SEQ ID NO: 243787 - DNA, 14 bp, Homo sapiens
aaaattttatagct

SEQ ID NO: 243788 - DNA, 17 bp, Homo sapiens
aaacaaaaactttccat

SEQ ID NO: 243789 - DNA, 23 bp, Homo sapiens
aaacaaaaactttccatgacagt

SEQ ID NO: 243790 - DNA, 20 bp, Homo sapiens
aaacaaaaattcacaagctg

SEQ ID NO: 243791 - DNA, 16 bp, Homo sapiens
aaacaaaaccaagcct

SEQ ID NO: 243792 - DNA, 22 bp, Homo sapiens
aaacaaaatccttgccttcaaa

SEQ ID NO: 243793 - DNA, 15 bp, Homo sapiens
aaacaaaatctaaaa

SEQ ID NO: 243794 - DNA, 17 bp, Homo sapiens
aaacaaagctgatttcc

SEQ ID NO: 243795 - DNA, 15 bp, Homo sapiens
aaacaaataatcaca

SEQ ID NO: 243796 - DNA, 17 bp, Homo sapiens
aaacaaataatcacatt

SEQ ID NO: 243797 - DNA, 14 bp, Homo sapiens
aaacaacaaaaaat

SEQ ID NO: 243798 - DNA, 22 bp, Homo sapiens
aaacaacgtgtatagtgcctaa

SEQ ID NO: 243799 - DNA, 19 bp, Homo sapiens
aaacaacttcaatatccaa

SEQ ID NO: 243800 - DNA, 17 bp, Homo sapiens
aaacaactttctcttgt

SEQ ID NO: 243801 - DNA, 18 bp, Homo sapiens
aaacaactttctcttgta

SEQ ID NO: 243802 - DNA, 16 bp, Homo sapiens
aaacaagaaagaaacg

SEQ ID NO: 243803 - DNA, 16 bp, Homo sapiens
aaacaagaaagtttcc

SEQ ID NO: 243804 - DNA, 18 bp, Homo sapiens
aaacaagaaagtttcccc

SEQ ID NO: 243805 - DNA, 16 bp, Homo sapiens
aaacaagactgcctcc

SEQ ID NO: 243806 - DNA, 19 bp, Homo sapiens
aaacaagttggctagaaga

SEQ ID NO: 243807 - DNA, 21 bp, Homo sapiens
aaacaagttggctagaagaaa

SEQ ID NO: 243808 - DNA, 17 bp, Homo sapiens
aaacaagttgtgccttt

SEQ ID NO: 243809 - DNA, 18 bp, Homo sapiens
aaacaagtttagaaagct

SEQ ID NO: 243810 - DNA, 14 bp, Homo sapiens
aaacaataaacgaa

SEQ ID NO: 243811 - DNA, 22 bp, Homo sapiens
aaacaataggcttttaaaagca

SEQ ID NO: 243812 - DNA, 15 bp, Homo sapiens
aaacaatcacactca

SEQ ID NO: 243813 - DNA, 15 bp, Homo sapiens
aaacaatcccaatct

SEQ ID NO: 243814 - DNA, 17 bp, Homo sapiens
aaacaatcccaatcttt

SEQ ID NO: 243815 - DNA, 22 bp, Homo sapiens
aaacaatcccaatctttctata

SEQ ID NO: 243816 - DNA, 14 bp, Homo sapiens
aaacaatctgtaat

SEQ ID NO: 243817 - DNA, 12 bp, Homo sapiens
aaacaatttatt

SEQ ID NO: 243818 - DNA, 16 bp, Homo sapiens
aaacaatttattttat

SEQ ID NO: 243819 - DNA, 14 bp, Homo sapiens
aaacaatttgcata

SEQ ID NO: 243820 - DNA, 19 bp, Homo sapiens
aaacacacaggccatttca

SEQ ID NO: 243821 - DNA, 12 bp, Homo sapiens
aaacacacagta

SEQ ID NO: 243822 - DNA, 18 bp, Homo sapiens
aaacacacgctcctctgc

SEQ ID NO: 243823 - DNA, 22 bp, Homo sapiens
aaacacacttttgcacatatat

SEQ ID NO: 243824 - DNA, 17 bp, Homo sapiens
aaacacagggttttgta

SEQ ID NO: 243825 - DNA, 18 bp, Homo sapiens
aaacacagggttttgtat

SEQ ID NO: 243826 - DNA, 15 bp, Homo sapiens
aaacacatacaaaag

SEQ ID NO: 243827 - DNA, 14 bp, Homo sapiens
aaacacatagattc

SEQ ID NO: 243828 - DNA, 18 bp, Homo sapiens
aaacacatagattcacct

SEQ ID NO: 243829 - DNA, 14 bp, Homo sapiens
aaacacattgaatg

SEQ ID NO: 243830 - DNA, 20 bp, Homo sapiens
aaacaccaccaaatgacaag

SEQ ID NO: 243831 - DNA, 19 bp, Homo sapiens
aaacacctaagtgactacc

SEQ ID NO: 243832 - DNA, 11 bp, Homo sapiens
aaacacctcct

SEQ ID NO: 243833 - DNA, 12 bp, Homo sapiens
aaacacctgaca

SEQ ID NO: 243834 - DNA, 20 bp, Homo sapiens
aaacacctgagctggtggct

SEQ ID NO: 243835 - DNA, 20 bp, Homo sapiens
aaacactacctcttttgaga

SEQ ID NO: 243836 - DNA, 16 bp, Homo sapiens
aaacactcagctgttc

SEQ ID NO: 243837 - DNA, 19 bp, Homo sapiens
aaacactcgtgtgcatgag

SEQ ID NO: 243838 - DNA, 20 bp, Homo sapiens
aaacactcgtgtgcatgaga

SEQ ID NO: 243839 - DNA, 12 bp, Homo sapiens
aaacactgtaat

SEQ ID NO: 243840 - DNA, 15 bp, Homo sapiens
aaacactgtaatctt

SEQ ID NO: 243841 - DNA, 22 bp, Homo sapiens
aaacactgtattgtaagtggaa

SEQ ID NO: 243842 - DNA, 17 bp, Homo sapiens
aaacacttatcctcctg

SEQ ID NO: 243843 - DNA, 12 bp, Homo sapiens
aaacacttgtaa

SEQ ID NO: 243844 - DNA, 13 bp, Homo sapiens
aaacactttcaaa

SEQ ID NO: 243845 - DNA, 14 bp, Homo sapiens
aaacactttttctg

SEQ ID NO: 243846 - DNA, 13 bp, Homo sapiens
aaacagaaaagag

SEQ ID NO: 243847 - DNA, 14 bp, Homo sapiens
aaacagaaaagaga

SEQ ID NO: 243848 - DNA, 18 bp, Homo sapiens
aaacagaaaagagaagaa

SEQ ID NO: 243849 - DNA, 14 bp, Homo sapiens
aaacagaaacgaga

SEQ ID NO: 243850 - DNA, 15 bp, Homo sapiens
aaacagaacactgta

SEQ ID NO: 243851 - DNA, 15 bp, Homo sapiens
aaacagaacatttct

SEQ ID NO: 243852 - DNA, 18 bp, Homo sapiens
aaacagaacatttctcat

SEQ ID NO: 243853 - DNA, 14 bp, Homo sapiens
aaacagaactcgat

SEQ ID NO: 243854 - DNA, 22 bp, Homo sapiens
aaacagacctaatgctccttgt

SEQ ID NO: 243855 - DNA, 13 bp, Homo sapiens
aaacagactattt

SEQ ID NO: 243856 - DNA, 17 bp, Homo sapiens
aaacagaggatgctgaa

SEQ ID NO: 243857 - DNA, 17 bp, Homo sapiens
aaacagatttgttcatt

SEQ ID NO: 243858 - DNA, 16 bp, Homo sapiens
aaacagcaaaagttct

SEQ ID NO: 243859 - DNA, 11 bp, Homo sapiens
aaacagcctgg

SEQ ID NO: 243860 - DNA, 18 bp, Homo sapiens
aaacagcttcatgccttt

SEQ ID NO: 243861 - DNA, 14 bp, Homo sapiens
aaacaggaaaaaaa

SEQ ID NO: 243862 - DNA, 16 bp, Homo sapiens
aaacaggagacaggaa

SEQ ID NO: 243863 - DNA, 20 bp, Homo sapiens
aaacagggacactacaaaca

SEQ ID NO: 243864 - DNA, 18 bp, Homo sapiens
aaacaggtgctaacactg

SEQ ID NO: 243865 - DNA, 21 bp, Homo sapiens
aaacagtaaaggccatgtgaa

SEQ ID NO: 243866 - DNA, 17 bp, Homo sapiens
aaacagtcgatcaaggg

SEQ ID NO: 243867 - DNA, 15 bp, Homo sapiens
aaacagtgaatctta

SEQ ID NO: 243868 - DNA, 20 bp, Homo sapiens
aaacagtgggagccctgacc

SEQ ID NO: 243869 - DNA, 15 bp, Homo sapiens
aaacagtgtttatga

SEQ ID NO: 243870 - DNA, 15 bp, Homo sapiens
aaacagttcttggac

SEQ ID NO: 243871 - DNA, 18 bp, Homo sapiens
aaacataaaaatcactca

SEQ ID NO: 243872 - DNA, 23 bp, Homo sapiens
aaacataatagaatttcctaatg

SEQ ID NO: 243873 - DNA, 20 bp, Homo sapiens
aaacataatatcttgaagaa

SEQ ID NO: 243874 - DNA, 23 bp, Homo sapiens
aaacatatttgtgaaaagagtat

SEQ ID NO: 243875 - DNA, 14 bp, Homo sapiens
aaacatcaaataaa

SEQ ID NO: 243876 - DNA, 22 bp, Homo sapiens
aaacatcacacacacagacaga

SEQ ID NO: 243877 - DNA, 17 bp, Homo sapiens
aaacatcagacctgtct

SEQ ID NO: 243878 - DNA, 21 bp, Homo sapiens
aaacatcattggataaatttg

SEQ ID NO: 243879 - DNA, 16 bp, Homo sapiens
aaacatggcctttgct

SEQ ID NO: 243880 - DNA, 22 bp, Homo sapiens
aaacatggggttggctgggccc

SEQ ID NO: 243881 - DNA, 13 bp, Homo sapiens
aaacatgtcatgt

SEQ ID NO: 243882 - DNA, 14 bp, Homo sapiens
aaacatgtgtttta

SEQ ID NO: 243883 - DNA, 12 bp, Homo sapiens
aaacattaaaca

SEQ ID NO: 243884 - DNA, 14 bp, Homo sapiens
aaacattaaacact

SEQ ID NO: 243885 - DNA, 22 bp, Homo sapiens
aaacattagaagaaaacatata

SEQ ID NO: 243886 - DNA, 13 bp, Homo sapiens
aaacattccagat

SEQ ID NO: 243887 - DNA, 20 bp, Homo sapiens
aaacattcctccagcctccc

SEQ ID NO: 243888 - DNA, 16 bp, Homo sapiens
aaacattgatgaatga

SEQ ID NO: 243889 - DNA, 19 bp, Homo sapiens
aaacattgcatgtatttaa

SEQ ID NO: 243890 - DNA, 20 bp, Homo sapiens
aaacatttctttttccttct

SEQ ID NO: 243891 - DNA, 17 bp, Homo sapiens
aaacatttgacacataa

SEQ ID NO: 243892 - DNA, 19 bp, Homo sapiens
aaacatttgacacataaaa

SEQ ID NO: 243893 - DNA, 14 bp, Homo sapiens
aaacatttgtacat

SEQ ID NO: 243894 - DNA, 21 bp, Homo sapiens
aaacattttaaaatcaacttt

SEQ ID NO: 243895 - DNA, 18 bp, Homo sapiens
aaacattttttgtttctt

SEQ ID NO: 243896 - DNA, 14 bp, Homo sapiens
aaaccaagcagctt

SEQ ID NO: 243897 - DNA, 14 bp, Homo sapiens
aaaccaagccgtgg

SEQ ID NO: 243898 - DNA, 16 bp, Homo sapiens
aaaccaagccgtggct

SEQ ID NO: 243899 - DNA, 14 bp, Homo sapiens
aaaccaagccttgg

SEQ ID NO: 243900 - DNA, 16 bp, Homo sapiens
aaaccaagtgggctgg

SEQ ID NO: 243901 - DNA, 16 bp, Homo sapiens
aaaccacagccctgtc

SEQ ID NO: 243902 - DNA, 18 bp, Homo sapiens
aaaccacagccctgtcag

SEQ ID NO: 243903 - DNA, 20 bp, Homo sapiens
aaaccactatgcaaagaact

SEQ ID NO: 243904 - DNA, 21 bp, Homo sapiens
aaaccaggagcattttgtgtc

SEQ ID NO: 243905 - DNA, 21 bp, Homo sapiens
aaaccataaaataaataatct

SEQ ID NO: 243906 - DNA, 23 bp, Homo sapiens
aaaccatccatctgtggaaatga

SEQ ID NO: 243907 - DNA, 14 bp, Homo sapiens
aaaccatctggcct

SEQ ID NO: 243908 - DNA, 18 bp, Homo sapiens
aaaccatctggcctggcc

SEQ ID NO: 243909 - DNA, 21 bp, Homo sapiens
aaaccatgactgtgaccacct

SEQ ID NO: 243910 - DNA, 13 bp, Homo sapiens
aaaccatgcacta

SEQ ID NO: 243911 - DNA, 15 bp, Homo sapiens
aaaccattgcttcac

SEQ ID NO: 243912 - DNA, 17 bp, Homo sapiens
aaacccacaagctgcct

SEQ ID NO: 243913 - DNA, 23 bp, Homo sapiens
aaacccaccttgttggagcctgc

SEQ ID NO: 243914 - DNA, 18 bp, Homo sapiens
aaacccacgcgtgttctg

SEQ ID NO: 243915 - DNA, 18 bp, Homo sapiens
aaacccagcgttcttcag

SEQ ID NO: 243916 - DNA, 20 bp, Homo sapiens
aaaccccacctttattcctt

SEQ ID NO: 243917 - DNA, 11 bp, Homo sapiens
aaaccccagcc

SEQ ID NO: 243918 - DNA, 12 bp, Homo sapiens
aaaccccagccc

SEQ ID NO: 243919 - DNA, 15 bp, Homo sapiens
aaacccccaggagga

SEQ ID NO: 243920 - DNA, 18 bp, Homo sapiens
aaacccccaggaggagag

SEQ ID NO: 243921 - DNA, 21 bp, Homo sapiens
aaacccgttttatgatttact

SEQ ID NO: 243922 - DNA, 13 bp, Homo sapiens
aaaccctgctaaa

SEQ ID NO: 243923 - DNA, 22 bp, Homo sapiens
aaaccctgctaaatgacttatt

SEQ ID NO: 243924 - DNA, 13 bp, Homo sapiens
aaaccctgcttct

SEQ ID NO: 243925 - DNA, 17 bp, Homo sapiens
aaaccggcaacctgtaa

SEQ ID NO: 243926 - DNA, 20 bp, Homo sapiens
aaacctaaggcaacatttcc

SEQ ID NO: 243927 - DNA, 16 bp, Homo sapiens
aaacctaggatggata

SEQ ID NO: 243928 - DNA, 15 bp, Homo sapiens
aaacctgcatattgt

SEQ ID NO: 243929 - DNA, 16 bp, Homo sapiens
aaacctgcatattgtg

SEQ ID NO: 243930 - DNA, 14 bp, Homo sapiens
aaacctgccctgcc

SEQ ID NO: 243931 - DNA, 11 bp, Homo sapiens
aaacctggagg

SEQ ID NO: 243932 - DNA, 11 bp, Homo sapiens
aaacctgtggg

SEQ ID NO: 243933 - DNA, 16 bp, Homo sapiens
aaaccttattgtacct

SEQ ID NO: 243934 - DNA, 12 bp, Homo sapiens
aaaccttcctct

SEQ ID NO: 243935 - DNA, 19 bp, Homo sapiens
aaaccttgctgctatgctg

SEQ ID NO: 243936 - DNA, 23 bp, Homo sapiens
aaaccttgtgactcagtgtattt

SEQ ID NO: 243937 - DNA, 14 bp, Homo sapiens
aaaccttgtttgtt

SEQ ID NO: 243938 - DNA, 22 bp, Homo sapiens
aaacctttcagctggcagagtt

SEQ ID NO: 243939 - DNA, 20 bp, Homo sapiens
aaacgcatggagtgtgtatt

SEQ ID NO: 243940 - DNA, 15 bp, Homo sapiens
aaacggttaaaactg

SEQ ID NO: 243941 - DNA, 23 bp, Homo sapiens
aaacgtacttaactgtgtgaaga

SEQ ID NO: 243942 - DNA, 14 bp, Homo sapiens
aaacgtgccctctg

SEQ ID NO: 243943 - DNA, 21 bp, Homo sapiens
aaacgtttcagtaataaaaca

SEQ ID NO: 243944 - DNA, 15 bp, Homo sapiens
aaactaaaagacatt

SEQ ID NO: 243945 - DNA, 18 bp, Homo sapiens
aaactaaaagacatttgt

SEQ ID NO: 243946 - DNA, 13 bp, Homo sapiens
aaactaaaataga

SEQ ID NO: 243947 - DNA, 12 bp, Homo sapiens
aaactaatgtga

SEQ ID NO: 243948 - DNA, 20 bp, Homo sapiens
aaactacctaacattattta

SEQ ID NO: 243949 - DNA, 20 bp, Homo sapiens
aaactactgattgaatgtta

SEQ ID NO: 243950 - DNA, 15 bp, Homo sapiens
aaactactgtacatt

SEQ ID NO: 243951 - DNA, 14 bp, Homo sapiens
aaactactttctta

SEQ ID NO: 243952 - DNA, 23 bp, Homo sapiens
aaactagacttgaggaaaccagg

SEQ ID NO: 243953 - DNA, 15 bp, Homo sapiens
aaactagataactta

SEQ ID NO: 243954 - DNA, 21 bp, Homo sapiens
aaactagataacttaaataat

SEQ ID NO: 243955 - DNA, 18 bp, Homo sapiens
aaactagggttttggcct

SEQ ID NO: 243956 - DNA, 11 bp, Homo sapiens
aaactatcagt

SEQ ID NO: 243957 - DNA, 17 bp, Homo sapiens
aaactatccaattaaaa

SEQ ID NO: 243958 - DNA, 20 bp, Homo sapiens
aaactatccaattaaaatta

SEQ ID NO: 243959 - DNA, 16 bp, Homo sapiens
aaactatggttcccaa

SEQ ID NO: 243960 - DNA, 17 bp, Homo sapiens
aaactatttaaaattgg

SEQ ID NO: 243961 - DNA, 13 bp, Homo sapiens
aaactcacaaatg

SEQ ID NO: 243962 - DNA, 15 bp, Homo sapiens
aaactcacaaatgat

SEQ ID NO: 243963 - DNA, 16 bp, Homo sapiens
aaactcagttaaaatg

SEQ ID NO: 243964 - DNA, 17 bp, Homo sapiens
aaactcagttaaaatgt

SEQ ID NO: 243965 - DNA, 12 bp, Homo sapiens
aaactcattttt

SEQ ID NO: 243966 - DNA, 23 bp, Homo sapiens
aaactcccatttacgtgtctgaa

SEQ ID NO: 243967 - DNA, 15 bp, Homo sapiens
aaactcctactgctt

SEQ ID NO: 243968 - DNA, 23 bp, Homo sapiens
aaactcctactgcttcctctgaa

SEQ ID NO: 243969 - DNA, 17 bp, Homo sapiens
aaactcttcaaggccaa

SEQ ID NO: 243970 - DNA, 12 bp, Homo sapiens
aaactgaaaatc

SEQ ID NO: 243971 - DNA, 18 bp, Homo sapiens
aaactgaaaatctaatat

SEQ ID NO: 243972 - DNA, 23 bp, Homo sapiens
aaactgagactcagacaggaaag

SEQ ID NO: 243973 - DNA, 13 bp, Homo sapiens
aaactgaggccca

SEQ ID NO: 243974 - DNA, 14 bp, Homo sapiens
aaactgagtcctgt

SEQ ID NO: 243975 - DNA, 21 bp, Homo sapiens
aaactgcaatagagactgtag

SEQ ID NO: 243976 - DNA, 22 bp, Homo sapiens
aaactgcaatagagactgtaga

SEQ ID NO: 243977 - DNA, 18 bp, Homo sapiens
aaactgcgtaggagagaa

SEQ ID NO: 243978 - DNA, 16 bp, Homo sapiens
aaactgctaattacac

SEQ ID NO: 243979 - DNA, 19 bp, Homo sapiens
aaactgctctaagcacacg

SEQ ID NO: 243980 - DNA, 20 bp, Homo sapiens
aaactggaacggtgaaggtg

SEQ ID NO: 243981 - DNA, 18 bp, Homo sapiens
aaactgtaaatacaaaat

SEQ ID NO: 243982 - DNA, 15 bp, Homo sapiens
aaactgtcctctttc

SEQ ID NO: 243983 - DNA, 20 bp, Homo sapiens
aaactgtcctctttcagaaa

SEQ ID NO: 243984 - DNA, 14 bp, Homo sapiens
aaactgtgagataa

SEQ ID NO: 243985 - DNA, 18 bp, Homo sapiens
aaactgtgagataaatat

SEQ ID NO: 243986 - DNA, 19 bp, Homo sapiens
aaactgtgagataaatatc

SEQ ID NO: 243987 - DNA, 21 bp, Homo sapiens
aaactgtgagataaatatcat

SEQ ID NO: 243988 - DNA, 15 bp, Homo sapiens
aaactgttttcatgt

SEQ ID NO: 243989 - DNA, 20 bp, Homo sapiens
aaacttaaaagtattcatac

SEQ ID NO: 243990 - DNA, 21 bp, Homo sapiens
aaacttaaaagtattcataca

SEQ ID NO: 243991 - DNA, 20 bp, Homo sapiens
aaacttaaccgcatcagaag

SEQ ID NO: 243992 - DNA, 18 bp, Homo sapiens
aaacttagaataaaattg

SEQ ID NO: 243993 - DNA, 15 bp, Homo sapiens
aaacttataaatcat

SEQ ID NO: 243994 - DNA, 20 bp, Homo sapiens
aaacttataaatcatattga

SEQ ID NO: 243995 - DNA, 13 bp, Homo sapiens
aaacttatgctag

SEQ ID NO: 243996 - DNA, 18 bp, Homo sapiens
aaacttatgctagtttat

SEQ ID NO: 243997 - DNA, 17 bp, Homo sapiens
aaacttcaaagctgaat

SEQ ID NO: 243998 - DNA, 22 bp, Homo sapiens
aaacttgatgtgttatctctta

SEQ ID NO: 243999 - DNA, 20 bp, Homo sapiens
aaacttgcaatgaaaagaaa

SEQ ID NO: 244000 - DNA, 19 bp, Homo sapiens
aaactttagggtaaaaatt

SEQ ID NO: 244001 - DNA, 16 bp, Homo sapiens
aaactttatgtactgc

SEQ ID NO: 244002 - DNA, 14 bp, Homo sapiens
aaactttattttat

SEQ ID NO: 244003 - DNA, 19 bp, Homo sapiens
aaactttattttatataat

SEQ ID NO: 244004 - DNA, 13 bp, Homo sapiens
aaactttcacttt

SEQ ID NO: 244005 - DNA, 16 bp, Homo sapiens
aaactttccatgacag

SEQ ID NO: 244006 - DNA, 13 bp, Homo sapiens
aaacttttataaa

SEQ ID NO: 244007 - DNA, 17 bp, Homo sapiens
acatctttttcctccct

SEQ ID NO: 244008 - DNA, 20 bp, Homo sapiens
acatgaaaaacacggcagct

SEQ ID NO: 244009 - DNA, 14 bp, Homo sapiens
acatgaaaacattg

SEQ ID NO: 244010 - DNA, 13 bp, Homo sapiens
acatgaagaagct

SEQ ID NO: 244011 - DNA, 20 bp, Homo sapiens
acatgaagaatgcattcaaa

SEQ ID NO: 244012 - DNA, 13 bp, Homo sapiens
acatgaatttaat

SEQ ID NO: 244013 - DNA, 16 bp, Homo sapiens
acatgacatttgtcct

SEQ ID NO: 244014 - DNA, 21 bp, Homo sapiens
acatgacatttgtcctgcaga

SEQ ID NO: 244015 - DNA, 13 bp, Homo sapiens
acatgactgggcc

SEQ ID NO: 244016 - DNA, 22 bp, Homo sapiens
acatgagctatttccattccag

SEQ ID NO: 244017 - DNA, 15 bp, Homo sapiens
acatgagtaaagcag

SEQ ID NO: 244018 - DNA, 14 bp, Homo sapiens
acatgagtgctgat

SEQ ID NO: 244019 - DNA, 13 bp, Homo sapiens
acatgagttcaaa

SEQ ID NO: 244020 - DNA, 18 bp, Homo sapiens
acatgagttcaaatactt

SEQ ID NO: 244021 - DNA, 15 bp, Homo sapiens
acatgatcttcttta

SEQ ID NO: 244022 - DNA, 14 bp, Homo sapiens
acatgattccttcc

SEQ ID NO: 244023 - DNA, 15 bp, Homo sapiens
acatgattccttcct

SEQ ID NO: 244024 - DNA, 19 bp, Homo sapiens
acatgatttagggaagcag

SEQ ID NO: 244025 - DNA, 22 bp, Homo sapiens
acatgatttagggaagcaggga

SEQ ID NO: 244026 - DNA, 20 bp, Homo sapiens
acatgcaaggcactgtacta

SEQ ID NO: 244027 - DNA, 21 bp, Homo sapiens
acatgcaatttattaaaatga

SEQ ID NO: 244028 - DNA, 12 bp, Homo sapiens
acatgcacagtt

SEQ ID NO: 244029 - DNA, 12 bp, Homo sapiens
agaaaaaaacag

SEQ ID NO: 244030 - DNA, 13 bp, Homo sapiens
agaaaaaaacagc

SEQ ID NO: 244031 - DNA, 18 bp, Homo sapiens
agaaaaaaatagttttac

SEQ ID NO: 244032 - DNA, 12 bp, Homo sapiens
agaaaaacatgt

SEQ ID NO: 244033 - DNA, 15 bp, Homo sapiens
agaaaaagagagagc

SEQ ID NO: 244034 - DNA, 15 bp, Homo sapiens
agaaaaagcacagct

SEQ ID NO: 244035 - DNA, 14 bp, Homo sapiens
agaaaaaggagctt

SEQ ID NO: 244036 - DNA, 17 bp, Homo sapiens
agaaaacacacaaaaga

SEQ ID NO: 244037 - DNA, 12 bp, Homo sapiens
agaaaacagaaa

SEQ ID NO: 244038 - DNA, 19 bp, Homo sapiens
agaaaacagaaaaaaaaca

SEQ ID NO: 244039 - DNA, 14 bp, Homo sapiens
agaaaacattccag

SEQ ID NO: 244040 - DNA, 16 bp, Homo sapiens
agaaaactgaaaatct

SEQ ID NO: 244041 - DNA, 20 bp, Homo sapiens
agaaaacttgcacttgtttt

SEQ ID NO: 244042 - DNA, 15 bp, Homo sapiens
agaaaagacacttca

SEQ ID NO: 244043 - DNA, 13 bp, Homo sapiens
agaaaagaccctg

SEQ ID NO: 244044 - DNA, 14 bp, Homo sapiens
agaaaagaccctga

SEQ ID NO: 244045 - DNA, 13 bp, Homo sapiens
agaaaagagaaga

SEQ ID NO: 244046 - DNA, 18 bp, Homo sapiens
agaaaagagaagaaagaa

SEQ ID NO: 244047 - DNA, 23 bp, Homo sapiens
agaaaagccagatgacagggagc

SEQ ID NO: 244048 - DNA, 19 bp, Homo sapiens
agaaaagctgccatttccc

SEQ ID NO: 244049 - DNA, 14 bp, Homo sapiens
agaaaagcttccta

SEQ ID NO: 244050 - DNA, 18 bp, Homo sapiens
agaaaaggaatgcaagag

SEQ ID NO: 244051 - DNA, 14 bp, Homo sapiens
agaaaataaaacta

SEQ ID NO: 244052 - DNA, 21 bp, Homo sapiens
agaaaataaaactaagctctt

SEQ ID NO: 244053 - DNA, 11 bp, Homo sapiens
agaaaataacc

SEQ ID NO: 244054 - DNA, 15 bp, Homo sapiens
agaaaatacaataaa

SEQ ID NO: 244055 - DNA, 16 bp, Homo sapiens
agaaaatacaataaac

SEQ ID NO: 244056 - DNA, 17 bp, Homo sapiens
agaaaatacaataaact

SEQ ID NO: 244057 - DNA, 15 bp, Homo sapiens
agaaaatagggtgga

SEQ ID NO: 244058 - DNA, 14 bp, Homo sapiens
agaaaatatgatat

SEQ ID NO: 244059 - DNA, 17 bp, Homo sapiens
agaaaatgaaaggtagt

SEQ ID NO: 244060 - DNA, 16 bp, Homo sapiens
agaaaatgaagcccta

SEQ ID NO: 244061 - DNA, 15 bp, Homo sapiens
agaaaatggacactg

SEQ ID NO: 244062 - DNA, 22 bp, Homo sapiens
agaaaatggacgtgttatgact

SEQ ID NO: 244063 - DNA, 22 bp, Homo sapiens
agaaaatggatgacaaagaaaa

SEQ ID NO: 244064 - DNA, 13 bp, Homo sapiens
agaaaatgtgtct

SEQ ID NO: 244065 - DNA, 14 bp, Homo sapiens
agaaaatgtgtctg

SEQ ID NO: 244066 - DNA, 24 bp, Homo sapiens
agaaaatgtgtctgcaacatggat

SEQ ID NO: 244067 - DNA, 14 bp, Homo sapiens
agaaaattctcaag

SEQ ID NO: 244068 - DNA, 18 bp, Homo sapiens
agaaaattctcaagtgat

SEQ ID NO: 244069 - DNA, 12 bp, Homo sapiens
agaaacaaaccc

SEQ ID NO: 244070 - DNA, 14 bp, Homo sapiens
agaaacaacagaaa

SEQ ID NO: 244071 - DNA, 13 bp, Homo sapiens
agaaacaatttct

SEQ ID NO: 244072 - DNA, 14 bp, Homo sapiens
agaaacaatttctg

SEQ ID NO: 244073 - DNA, 15 bp, Homo sapiens
agaaacaatttctgt

SEQ ID NO: 244074 - DNA, 19 bp, Homo sapiens
agaaacacacttttgcaca

SEQ ID NO: 244075 - DNA, 11 bp, Homo sapiens
agaaacagctt

SEQ ID NO: 244076 - DNA, 15 bp, Homo sapiens
agaaacagctttcaa

SEQ ID NO: 244077 - DNA, 17 bp, Homo sapiens
agaaacagctttcaagt

SEQ ID NO: 244078 - DNA, 18 bp, Homo sapiens
agaaacagtgggagccct

SEQ ID NO: 244079 - DNA, 17 bp, Homo sapiens
agaaaccaagtgggctg

SEQ ID NO: 244080 - DNA, 19 bp, Homo sapiens
agaaaccatgcaaagcaac

SEQ ID NO: 244081 - DNA, 13 bp, Homo sapiens
agaaacccccagg

SEQ ID NO: 244082 - DNA, 16 bp, Homo sapiens
agaaaccttattgtac

SEQ ID NO: 244083 - DNA, 18 bp, Homo sapiens
agaaaccttattgtacct

SEQ ID NO: 244084 - DNA, 20 bp, Homo sapiens
agaaaccttattgtacctct

SEQ ID NO: 244085 - DNA, 21 bp, Homo sapiens
agaaacctttatccctgctta

SEQ ID NO: 244086 - DNA, 17 bp, Homo sapiens
agaaacgagatttgcca

SEQ ID NO: 244087 - DNA, 15 bp, Homo sapiens
agaaacgtccatctc

SEQ ID NO: 244088 - DNA, 22 bp, Homo sapiens
agaaactcacccccaaggggca

SEQ ID NO: 244089 - DNA, 15 bp, Homo sapiens
agaaactgaaagtgt

SEQ ID NO: 244090 - DNA, 16 bp, Homo sapiens
agaaactgaaagtgtt

SEQ ID NO: 244091 - DNA, 16 bp, Homo sapiens
agaaactgagtcctgt

SEQ ID NO: 244092 - DNA, 20 bp, Homo sapiens
agaaactgagtcctgttctt

SEQ ID NO: 244093 - DNA, 13 bp, Homo sapiens
agaaacttgtgaa

SEQ ID NO: 244094 - DNA, 23 bp, Homo sapiens
agaaacttgtgaagtggaaatgt

SEQ ID NO: 244095 - DNA, 16 bp, Homo sapiens
agaaagaaaatgaaga

SEQ ID NO: 244096 - DNA, 16 bp, Homo sapiens
agaaagcaaaaaataa

SEQ ID NO: 244097 - DNA, 15 bp, Homo sapiens
agaaagcagaggctg

SEQ ID NO: 244098 - DNA, 16 bp, Homo sapiens
agaaagcagaggctgg

SEQ ID NO: 244099 - DNA, 23 bp, Homo sapiens
agaaagcagaggctggcctcaga

SEQ ID NO: 244100 - DNA, 19 bp, Homo sapiens
agaaagccatattccagca

SEQ ID NO: 244101 - DNA, 19 bp, Homo sapiens
agaaagcccctcacctcag

SEQ ID NO: 244102 - DNA, 20 bp, Homo sapiens
agaaagcccctcacctcagg

SEQ ID NO: 244103 - DNA, 16 bp, Homo sapiens
agaaagcctcctgccc

SEQ ID NO: 244104 - DNA, 19 bp, Homo sapiens
agaaagcctgttcccctca

SEQ ID NO: 244105 - DNA, 20 bp, Homo sapiens
agaaagcctgttcccctcac

SEQ ID NO: 244106 - DNA, 21 bp, Homo sapiens
agaaagctctgcatgtgtgtt

SEQ ID NO: 244107 - DNA, 16 bp, Homo sapiens
agaaagctggtaaact

SEQ ID NO: 244108 - DNA, 20 bp, Homo sapiens
agaaagctggtaaactattt

SEQ ID NO: 244109 - DNA, 14 bp, Homo sapiens
agaaagctgtgaaa

SEQ ID NO: 244110 - DNA, 16 bp, Homo sapiens
agaaagctgtgaaatt

SEQ ID NO: 244111 - DNA, 16 bp, Homo sapiens
agaaaggatatttaag

SEQ ID NO: 244112 - DNA, 18 bp, Homo sapiens
agaaagggcagcccctcc

SEQ ID NO: 244113 - DNA, 13 bp, Homo sapiens
agaaagggcagct

SEQ ID NO: 244114 - DNA, 23 bp, Homo sapiens
agaaagggcagcttcagtctctg

SEQ ID NO: 244115 - DNA, 23 bp, Homo sapiens
agaaagggtctgataaacacaga

SEQ ID NO: 244116 - DNA, 19 bp, Homo sapiens
agaaagggttctgtaaaat

SEQ ID NO: 244117 - DNA, 14 bp, Homo sapiens
agaaagtcagacct

SEQ ID NO: 244118 - DNA, 15 bp, Homo sapiens
agaaagtcatccttt

SEQ ID NO: 244119 - DNA, 15 bp, Homo sapiens
agaaagtctatgctt

SEQ ID NO: 244120 - DNA, 20 bp, Homo sapiens
agaaagtgaataaaaattaa

SEQ ID NO: 244121 - DNA, 21 bp, Homo sapiens
agaaagtgaataaaaattaag

SEQ ID NO: 244122 - DNA, 19 bp, Homo sapiens
agaaagtgagtctgaattg

SEQ ID NO: 244123 - DNA, 23 bp, Homo sapiens
agaaagtgtgagcaaactaactt

SEQ ID NO: 244124 - DNA, 20 bp, Homo sapiens
agaaagtttccccaccagtg

SEQ ID NO: 244125 - DNA, 12 bp, Homo sapiens
agaaataaaaat

SEQ ID NO: 244126 - DNA, 21 bp, Homo sapiens
agaaataagtggttatttctc

SEQ ID NO: 244127 - DNA, 22 bp, Homo sapiens
agaaataagtggttatttctca

SEQ ID NO: 244128 - DNA, 14 bp, Homo sapiens
agaaataatatgca

SEQ ID NO: 244129 - DNA, 15 bp, Homo sapiens
agaaataatatgcat

SEQ ID NO: 244130 - DNA, 16 bp, Homo sapiens
agaaataatatgcatt

SEQ ID NO: 244131 - DNA, 15 bp, Homo sapiens
agaaatacagtgctt

SEQ ID NO: 244132 - DNA, 14 bp, Homo sapiens
agaaatagacagtc

SEQ ID NO: 244133 - DNA, 14 bp, Homo sapiens
agaaatataattga

SEQ ID NO: 244134 - DNA, 18 bp, Homo sapiens
agaaatatgattgatttg

SEQ ID NO: 244135 - DNA, 13 bp, Homo sapiens
agaaatatgattt

SEQ ID NO: 244136 - DNA, 16 bp, Homo sapiens
agaaatatgattttat

SEQ ID NO: 244137 - DNA, 18 bp, Homo sapiens
agaaatattataaatcca

SEQ ID NO: 244138 - DNA, 20 bp, Homo sapiens
aagcctccatttagttcttt

SEQ ID NO: 244139 - DNA, 14 bp, Homo sapiens
aagcctcctgcccc

SEQ ID NO: 244140 - DNA, 14 bp, Homo sapiens
aagcctcctgctga

SEQ ID NO: 244141 - DNA, 18 bp, Homo sapiens
aagcctctgccctgcctc

SEQ ID NO: 244142 - DNA, 12 bp, Homo sapiens
aagcctctggct

SEQ ID NO: 244143 - DNA, 14 bp, Homo sapiens
aagcctctggctag

SEQ ID NO: 244144 - DNA, 23 bp, Homo sapiens
aagcctctggctagaggccagcc

SEQ ID NO: 244145 - DNA, 12 bp, Homo sapiens
aagcctgcagct

SEQ ID NO: 244146 - DNA, 14 bp, Homo sapiens
aagcctgcaggagt

SEQ ID NO: 244147 - DNA, 17 bp, Homo sapiens
aagcctgctgatttcta

SEQ ID NO: 244148 - DNA, 11 bp, Homo sapiens
aagcctggagc

SEQ ID NO: 244149 - DNA, 12 bp, Homo sapiens
aagcctggagcc

SEQ ID NO: 244150 - DNA, 15 bp, Homo sapiens
aagcctggagcccct

SEQ ID NO: 244151 - DNA, 18 bp, Homo sapiens
aagcctggagcccctgtg

SEQ ID NO: 244152 - DNA, 22 bp, Homo sapiens
aagcctggatgccaaggagccc

SEQ ID NO: 244153 - DNA, 13 bp, Homo sapiens
aagcctgtctctt

SEQ ID NO: 244154 - DNA, 15 bp, Homo sapiens
aagcctgtctctttc

SEQ ID NO: 244155 - DNA, 12 bp, Homo sapiens
aagcctgtgaat

SEQ ID NO: 244156 - DNA, 14 bp, Homo sapiens
aagccttaaaatgc

SEQ ID NO: 244157 - DNA, 21 bp, Homo sapiens
aagccttaagccataggccca

SEQ ID NO: 244158 - DNA, 16 bp, Homo sapiens
aagccttatcaagtgt

SEQ ID NO: 244159 - DNA, 21 bp, Homo sapiens
aagccttgcccagcaaggacc

SEQ ID NO: 244160 - DNA, 14 bp, Homo sapiens
aagcctttaaattg

SEQ ID NO: 244161 - DNA, 15 bp, Homo sapiens
agagctccttgatga

SEQ ID NO: 244162 - DNA, 20 bp, Homo sapiens
agagctctggagccacctgt

SEQ ID NO: 244163 - DNA, 22 bp, Homo sapiens
agagctctggagccacctgtcc

SEQ ID NO: 244164 - DNA, 20 bp, Homo sapiens
agagctctttgtctcaccag

SEQ ID NO: 244165 - DNA, 21 bp, Homo sapiens
agagctctttgtctcaccagc

SEQ ID NO: 244166 - DNA, 21 bp, Homo sapiens
agagctgagtactcaggccac

SEQ ID NO: 244167 - DNA, 14 bp, Homo sapiens
agagctgatccaga

SEQ ID NO: 244168 - DNA, 17 bp, Homo sapiens
agagctgatccagagca

SEQ ID NO: 244169 - DNA, 21 bp, Homo sapiens
agagctgatccagagcacaga

SEQ ID NO: 244170 - DNA, 18 bp, Homo sapiens
agagctgcctaagaggca

SEQ ID NO: 244171 - DNA, 14 bp, Homo sapiens
agagctgcctctcg

SEQ ID NO: 244172 - DNA, 20 bp, Homo sapiens
agagctggaaggcagggcag

SEQ ID NO: 244173 - DNA, 23 bp, Homo sapiens
agagctggaaggcagggcagagg

SEQ ID NO: 244174 - DNA, 20 bp, Homo sapiens
agagctggcaaactgtgaat

SEQ ID NO: 244175 - DNA, 13 bp, Homo sapiens
agagctggtgccc

SEQ ID NO: 244176 - DNA, 12 bp, Homo sapiens
aatactgtattg

SEQ ID NO: 244177 - DNA, 23 bp, Homo sapiens
aatactgtattgttacagctgaa

SEQ ID NO: 244178 - DNA, 14 bp, Homo sapiens
aatacttcttttta

SEQ ID NO: 244179 - DNA, 19 bp, Homo sapiens
aatacttgaatatggaaca

SEQ ID NO: 244180 - DNA, 17 bp, Homo sapiens
aatacttttttctagtt

SEQ ID NO: 244181 - DNA, 20 bp, Homo sapiens
aatagaaaactgaaaatcta

SEQ ID NO: 244182 - DNA, 16 bp, Homo sapiens
aatagaaataagtggt

SEQ ID NO: 244183 - DNA, 20 bp, Homo sapiens
aatagaatataattatcgga

SEQ ID NO: 244184 - DNA, 15 bp, Homo sapiens
aatagaatttcctaa

SEQ ID NO: 244185 - DNA, 16 bp, Homo sapiens
aatagaatttcctaat

SEQ ID NO: 244186 - DNA, 17 bp, Homo sapiens
aatagaatttcctaatg

SEQ ID NO: 244187 - DNA, 16 bp, Homo sapiens
aatagacttatatgca

SEQ ID NO: 244188 - DNA, 15 bp, Homo sapiens
aatagagtatatgca

SEQ ID NO: 244189 - DNA, 16 bp, Homo sapiens
aatagagtatatgcac

SEQ ID NO: 244190 - DNA, 23 bp, Homo sapiens
aatagataacagagaatcttgat

SEQ ID NO: 244191 - DNA, 16 bp, Homo sapiens
aatagatacttttgat

SEQ ID NO: 244192 - DNA, 19 bp, Homo sapiens
aatagatcacggcatgttt

SEQ ID NO: 244193 - DNA, 16 bp, Homo sapiens
aatagatgctgactgt

SEQ ID NO: 244194 - DNA, 16 bp, Homo sapiens
aatagatgtgatcact

SEQ ID NO: 244195 - DNA, 15 bp, Homo sapiens
aatagcatctgctct

SEQ ID NO: 244196 - DNA, 12 bp, Homo sapiens
aatagcatgtca

SEQ ID NO: 244197 - DNA, 13 bp, Homo sapiens
aatagcatgttgt

SEQ ID NO: 244198 - DNA, 15 bp, Homo sapiens
aatagcatgttgtag

SEQ ID NO: 244199 - DNA, 18 bp, Homo sapiens
aatagcatgttgtagata

SEQ ID NO: 244200 - DNA, 12 bp, Homo sapiens
aatagccagaga

SEQ ID NO: 244201 - DNA, 17 bp, Homo sapiens
aatagccctccccctca

SEQ ID NO: 244202 - DNA, 18 bp, Homo sapiens
aatagctataaatagtga

SEQ ID NO: 244203 - DNA, 22 bp, Homo sapiens
aatagctgaacctgttcaaaat

SEQ ID NO: 244204 - DNA, 14 bp, Homo sapiens
aataggaagaacag

SEQ ID NO: 244205 - DNA, 21 bp, Homo sapiens
aataggaagaacagtacattt

SEQ ID NO: 244206 - DNA, 13 bp, Homo sapiens
aataggagaaaat

SEQ ID NO: 244207 - DNA, 21 bp, Homo sapiens
aatagtaagcctccctcctcg

SEQ ID NO: 244208 - DNA, 18 bp, Homo sapiens
aatagtaggctaaaaaca

SEQ ID NO: 244209 - DNA, 21 bp, Homo sapiens
aatagtatatctaatggctgt

SEQ ID NO: 244210 - DNA, 14 bp, Homo sapiens
aatagtattaacta

SEQ ID NO: 244211 - DNA, 22 bp, Homo sapiens
aatagtgcctcagcgctgccca

SEQ ID NO: 244212 - DNA, 20 bp, Homo sapiens
aatagtgcttaaaaatcatt

SEQ ID NO: 244213 - DNA, 16 bp, Homo sapiens
aatagtggccagacca

SEQ ID NO: 244214 - DNA, 18 bp, Homo sapiens
aatagtgggatcaaagct

SEQ ID NO: 244215 - DNA, 17 bp, Homo sapiens
aatagtgtgttctgatt

SEQ ID NO: 244216 - DNA, 15 bp, Homo sapiens
aatagtgttgatcag

SEQ ID NO: 244217 - DNA, 23 bp, Homo sapiens
aatagtgttgatcagatcttaca

SEQ ID NO: 244218 - DNA, 16 bp, Homo sapiens
aatagttctatttcta

SEQ ID NO: 244219 - DNA, 23 bp, Homo sapiens
aatagttctatttctatctgcaa

SEQ ID NO: 244220 - DNA, 19 bp, Homo sapiens
aatagtttacatgtagtag

SEQ ID NO: 244221 - DNA, 16 bp, Homo sapiens
aatagtttaggagaaa

SEQ ID NO: 244222 - DNA, 20 bp, Homo sapiens
aatagtttcaaatgagttta

SEQ ID NO: 244223 - DNA, 21 bp, Homo sapiens
aatagtttctgattcactatt

SEQ ID NO: 244224 - DNA, 14 bp, Homo sapiens
aatataaacaatgt

SEQ ID NO: 244225 - DNA, 13 bp, Homo sapiens
aatataaactgtg

SEQ ID NO: 244226 - DNA, 14 bp, Homo sapiens
aatataaactgtga

SEQ ID NO: 244227 - DNA, 23 bp, Homo sapiens
aatataaataaataaaaatattc

SEQ ID NO: 244228 - DNA, 19 bp, Homo sapiens
aatataaatgaatgaaata

SEQ ID NO: 244229 - DNA, 11 bp, Homo sapiens
aatataaatgt

SEQ ID NO: 244230 - DNA, 15 bp, Homo sapiens
aatataaatgtttaa

SEQ ID NO: 244231 - DNA, 15 bp, Homo sapiens
aatataaattaagac

SEQ ID NO: 244232 - DNA, 18 bp, Homo sapiens
aatataaattaagacttt

SEQ ID NO: 244233 - DNA, 21 bp, Homo sapiens
aatataacttaaaaatgtaaa

SEQ ID NO: 244234 - DNA, 13 bp, Homo sapiens
aatataagatttt

SEQ ID NO: 244235 - DNA, 14 bp, Homo sapiens
aatataagcttaaa

SEQ ID NO: 244236 - DNA, 20 bp, Homo sapiens
aatataagcttaaaataagt

SEQ ID NO: 244237 - DNA, 19 bp, Homo sapiens
aatataaggaaagcaataa

SEQ ID NO: 244238 - DNA, 21 bp, Homo sapiens
aatataaggaaagcaataaat

SEQ ID NO: 244239 - DNA, 14 bp, Homo sapiens
aatataattatcgg

SEQ ID NO: 244240 - DNA, 13 bp, Homo sapiens
aatatacaacttt

SEQ ID NO: 244241 - DNA, 22 bp, Homo sapiens
aatatacatagtctttgtttac

SEQ ID NO: 244242 - DNA, 16 bp, Homo sapiens
aatatactaaccattt

SEQ ID NO: 244243 - DNA, 13 bp, Homo sapiens
aatatactaataa

SEQ ID NO: 244244 - DNA, 18 bp, Homo sapiens
aatatactaataaaaagg

SEQ ID NO: 244245 - DNA, 20 bp, Homo sapiens
aatatactaataaaaaggtt

SEQ ID NO: 244246 - DNA, 20 bp, Homo sapiens
aatatactcagggattcctt

SEQ ID NO: 244247 - DNA, 21 bp, Homo sapiens
aatatactcagggattccttc

SEQ ID NO: 244248 - DNA, 13 bp, Homo sapiens
aatatactgtctt

SEQ ID NO: 244249 - DNA, 15 bp, Homo sapiens
aatatactgtcttgt

SEQ ID NO: 244250 - DNA, 19 bp, Homo sapiens
aatatactgtcttgtctca

SEQ ID NO: 244251 - DNA, 20 bp, Homo sapiens
aatatagaatttttaatgtt

SEQ ID NO: 244252 - DNA, 23 bp, Homo sapiens
aatatagggtttgtttgctgctt

SEQ ID NO: 244253 - DNA, 12 bp, Homo sapiens
aatatagttaat

SEQ ID NO: 244254 - DNA, 22 bp, Homo sapiens
aatatagttaattgtggcttta

SEQ ID NO: 244255 - DNA, 13 bp, Homo sapiens
aatatagttgaac

SEQ ID NO: 244256 - DNA, 22 bp, Homo sapiens
aatatagttgtctttctttgct

SEQ ID NO: 244257 - DNA, 21 bp, Homo sapiens
aatatataaaaagaaaagata

SEQ ID NO: 244258 - DNA, 20 bp, Homo sapiens
aatatataatggtttactgc

SEQ ID NO: 244259 - DNA, 14 bp, Homo sapiens
aatatatataatac

SEQ ID NO: 244260 - DNA, 19 bp, Homo sapiens
aatatatatgtatataaaa

SEQ ID NO: 244261 - DNA, 14 bp, Homo sapiens
aatatatatttatc

SEQ ID NO: 244262 - DNA, 15 bp, Homo sapiens
aatatatatttatca

SEQ ID NO: 244263 - DNA, 17 bp, Homo sapiens
aatatatgatatataaa

SEQ ID NO: 244264 - DNA, 21 bp, Homo sapiens
aatatatgtttggctgaaatt

SEQ ID NO: 244265 - DNA, 15 bp, Homo sapiens
aatatatgttttgag

SEQ ID NO: 244266 - DNA, 18 bp, Homo sapiens
aatatattaaaaatataa

SEQ ID NO: 244267 - DNA, 13 bp, Homo sapiens
aatatattgaaca

SEQ ID NO: 244268 - DNA, 14 bp, Homo sapiens
aatatattgccagt

SEQ ID NO: 244269 - DNA, 20 bp, Homo sapiens
aatatattgccagtatataa

SEQ ID NO: 244270 - DNA, 22 bp, Homo sapiens
aatatattgccagtatataagc

SEQ ID NO: 244271 - DNA, 21 bp, Homo sapiens
aatatattgctgctggtaatt

SEQ ID NO: 244272 - DNA, 17 bp, Homo sapiens
aatatattgtatatttg

SEQ ID NO: 244273 - DNA, 19 bp, Homo sapiens
aatatatttaagataatta

SEQ ID NO: 244274 - DNA, 17 bp, Homo sapiens
aatatatttaggccagg

SEQ ID NO: 244275 - DNA, 13 bp, Homo sapiens
aatatatttttcc

SEQ ID NO: 244276 - DNA, 15 bp, Homo sapiens
aatatcagactagtg

SEQ ID NO: 244277 - DNA, 23 bp, Homo sapiens
aatatcaggagcttttttacaca

SEQ ID NO: 244278 - DNA, 15 bp, Homo sapiens
aatatcattatagca

SEQ ID NO: 244279 - DNA, 19 bp, Homo sapiens
aatatcatttcataaaaat

SEQ ID NO: 244280 - DNA, 16 bp, Homo sapiens
aatatccaaagactgt

SEQ ID NO: 244281 - DNA, 20 bp, Homo sapiens
aatatccaaagactgtactg

SEQ ID NO: 244282 - DNA, 23 bp, Homo sapiens
aatatccctttttcacatattaa

SEQ ID NO: 244283 - DNA, 22 bp, Homo sapiens
aatatcctatactggttatagt

SEQ ID NO: 244284 - DNA, 13 bp, Homo sapiens
aatatcttaggtt

SEQ ID NO: 244285 - DNA, 17 bp, Homo sapiens
aatatcttgaagaatat

SEQ ID NO: 244286 - DNA, 18 bp, Homo sapiens
aatatcttgctggattaa

SEQ ID NO: 244287 - DNA, 19 bp, Homo sapiens
aatatctttaaatgatgta

SEQ ID NO: 244288 - DNA, 17 bp, Homo sapiens
aatatcttttcttctcc

SEQ ID NO: 244289 - DNA, 14 bp, Homo sapiens
aatatgaaatgata

SEQ ID NO: 244290 - DNA, 17 bp, Homo sapiens
aatatgacggaagaaca

SEQ ID NO: 244291 - DNA, 23 bp, Homo sapiens
aatccattttctaaactgttttc

SEQ ID NO: 244292 - DNA, 20 bp, Homo sapiens
aatcccaatctttctatata

SEQ ID NO: 244293 - DNA, 22 bp, Homo sapiens
aatcccaatctttctatataaa

SEQ ID NO: 244294 - DNA, 17 bp, Homo sapiens
aatcccacttatcaaat

SEQ ID NO: 244295 - DNA, 19 bp, Homo sapiens
aatcccacttatcaaatca

SEQ ID NO: 244296 - DNA, 12 bp, Homo sapiens
aatcccagctcc

SEQ ID NO: 244297 - DNA, 13 bp, Homo sapiens
aatcccagctccg

SEQ ID NO: 244298 - DNA, 14 bp, Homo sapiens
aatcccagctccgc

SEQ ID NO: 244299 - DNA, 21 bp, Homo sapiens
aatcccctccctgtcaaagct

SEQ ID NO: 244300 - DNA, 16 bp, Homo sapiens
aatccccttctcccct

SEQ ID NO: 244301 - DNA, 20 bp, Homo sapiens
aatccccttctcccctgcac

SEQ ID NO: 244302 - DNA, 17 bp, Homo sapiens
aatccctgttcattgta

SEQ ID NO: 244303 - DNA, 17 bp, Homo sapiens
aatcctaagttaccttt

SEQ ID NO: 244304 - DNA, 16 bp, Homo sapiens
aatcctagacttgaaa

SEQ ID NO: 244305 - DNA, 20 bp, Homo sapiens
aatcctagacttgaaagttt

SEQ ID NO: 244306 - DNA, 18 bp, Homo sapiens
aatcctatgtcatttcta

SEQ ID NO: 244307 - DNA, 15 bp, Homo sapiens
aatcctcctgagtga

SEQ ID NO: 244308 - DNA, 14 bp, Homo sapiens
aatcctgcctctcc

SEQ ID NO: 244309 - DNA, 15 bp, Homo sapiens
aatcctggctctgat

SEQ ID NO: 244310 - DNA, 18 bp, Homo sapiens
aatcctgggcatccccag

SEQ ID NO: 244311 - DNA, 21 bp, Homo sapiens
aatcctgggcatccccagccc

SEQ ID NO: 244312 - DNA, 12 bp, Homo sapiens
aatcctgtcaat

SEQ ID NO: 244313 - DNA, 18 bp, Homo sapiens
aatcctgtcctcagcttc

SEQ ID NO: 244314 - DNA, 20 bp, Homo sapiens
aatccttccaaaaattatta

SEQ ID NO: 244315 - DNA, 13 bp, Homo sapiens
aatcctttactgt

SEQ ID NO: 244316 - DNA, 12 bp, Homo sapiens
aatcctttgtac

SEQ ID NO: 244317 - DNA, 16 bp, Homo sapiens
aatcgacctcactgtc

SEQ ID NO: 244318 - DNA, 13 bp, Homo sapiens
agagtgccccacc

SEQ ID NO: 244319 - DNA, 16 bp, Homo sapiens
agagtgccccacctgc

SEQ ID NO: 244320 - DNA, 18 bp, Homo sapiens
agagtgccccacctgcca

SEQ ID NO: 244321 - DNA, 13 bp, Homo sapiens
agagtggcccctc

SEQ ID NO: 244322 - DNA, 12 bp, Homo sapiens
agagtggcctgg

SEQ ID NO: 244323 - DNA, 17 bp, Homo sapiens
agagtggcctggccagg

SEQ ID NO: 244324 - DNA, 22 bp, Homo sapiens
agagtggcctggccaggagctc

SEQ ID NO: 244325 - DNA, 12 bp, Homo sapiens
agagtggctcct

SEQ ID NO: 244326 - DNA, 15 bp, Homo sapiens
agagtgggggagaat

SEQ ID NO: 244327 - DNA, 20 bp, Homo sapiens
agagtgggggagagcaggct

SEQ ID NO: 244328 - DNA, 18 bp, Homo sapiens
agagtggtctatttctcc

SEQ ID NO: 244329 - DNA, 18 bp, Homo sapiens
agagtggtctttctggag

SEQ ID NO: 244330 - DNA, 18 bp, Homo sapiens
agagtggtttcattgcct

SEQ ID NO: 244331 - DNA, 16 bp, Homo sapiens
agagtgtacatcatgt

SEQ ID NO: 244332 - DNA, 14 bp, Homo sapiens
agagtgtctctgat

SEQ ID NO: 244333 - DNA, 17 bp, Homo sapiens
agagtgtgctcgggagt

SEQ ID NO: 244334 - DNA, 21 bp, Homo sapiens
agagtgtggaaaaaaaaagaa

SEQ ID NO: 244335 - DNA, 23 bp, Homo sapiens
agagttaaatagagtatatgcac

SEQ ID NO: 244336 - DNA, 22 bp, Homo sapiens
agagttcagtaagaccggaagc

SEQ ID NO: 244337 - DNA, 15 bp, Homo sapiens
agagttctttgctgc

SEQ ID NO: 244338 - DNA, 22 bp, Homo sapiens
agagttctttgctgcccctgtc

SEQ ID NO: 244339 - DNA, 15 bp, Homo sapiens
agagtttaacacaag

SEQ ID NO: 244340 - DNA, 19 bp, Homo sapiens
agagtttatttttttgatg

SEQ ID NO: 244341 - DNA, 22 bp, Homo sapiens
agagtttatttttttgatggct

SEQ ID NO: 244342 - DNA, 23 bp, Homo sapiens
agagtttatttttttgatggcta

SEQ ID NO: 244343 - DNA, 19 bp, Homo sapiens
agagtttgatcatagaatt

SEQ ID NO: 244344 - DNA, 16 bp, Homo sapiens
agagttttatcaactt

SEQ ID NO: 244345 - DNA, 12 bp, Homo sapiens
agataaaaagat

SEQ ID NO: 244346 - DNA, 21 bp, Homo sapiens
agataaccagctgtaacacag

SEQ ID NO: 244347 - DNA, 19 bp, Homo sapiens
agataacgcaggagagaga

SEQ ID NO: 244348 - DNA, 19 bp, Homo sapiens
agataacttaaataattta

SEQ ID NO: 244349 - DNA, 17 bp, Homo sapiens
agataagcaagagagat

SEQ ID NO: 244350 - DNA, 20 bp, Homo sapiens
agataagcaagagagatgtt

SEQ ID NO: 244351 - DNA, 14 bp, Homo sapiens
agataatcagcctc

SEQ ID NO: 244352 - DNA, 16 bp, Homo sapiens
agataatcagcctctt

SEQ ID NO: 244353 - DNA, 23 bp, Homo sapiens
agataatgaaatagttattttaa

SEQ ID NO: 244354 - DNA, 15 bp, Homo sapiens
agataattaaatgaa

SEQ ID NO: 244355 - DNA, 21 bp, Homo sapiens
agataatttaaccctgcctct

SEQ ID NO: 244356 - DNA, 14 bp, Homo sapiens
agataatttgcata

SEQ ID NO: 244357 - DNA, 15 bp, Homo sapiens
agatacaagtttcag

SEQ ID NO: 244358 - DNA, 20 bp, Homo sapiens
agatacaagtttcagacagg

SEQ ID NO: 244359 - DNA, 17 bp, Homo sapiens
agatacaatcagctgct

SEQ ID NO: 244360 - DNA, 18 bp, Homo sapiens
agatacaatcagctgctt

SEQ ID NO: 244361 - DNA, 14 bp, Homo sapiens
agatacactcctgc

SEQ ID NO: 244362 - DNA, 23 bp, Homo sapiens
agatacagatccgcatgtgtctg

SEQ ID NO: 244363 - DNA, 18 bp, Homo sapiens
agatacatttgtatgttg

SEQ ID NO: 244364 - DNA, 19 bp, Homo sapiens
agataccaggttgaaagac

SEQ ID NO: 244365 - DNA, 15 bp, Homo sapiens
agataccattttgaa

SEQ ID NO: 244366 - DNA, 18 bp, Homo sapiens
agataccattttgaaata

SEQ ID NO: 244367 - DNA, 15 bp, Homo sapiens
agatacccagagaga

SEQ ID NO: 244368 - DNA, 19 bp, Homo sapiens
agataccttgaaaggaaga

SEQ ID NO: 244369 - DNA, 14 bp, Homo sapiens
agatacgactttat

SEQ ID NO: 244370 - DNA, 20 bp, Homo sapiens
agatacgactttattttctg

SEQ ID NO: 244371 - DNA, 14 bp, Homo sapiens
agatactgaaacat

SEQ ID NO: 244372 - DNA, 16 bp, Homo sapiens
agatactgctgatgct

SEQ ID NO: 244373 - DNA, 20 bp, Homo sapiens
agatacttgatgcacttatt

SEQ ID NO: 244374 - DNA, 15 bp, Homo sapiens
agatagaaataaata

SEQ ID NO: 244375 - DNA, 22 bp, Homo sapiens
agatagaaataaatagctatat

SEQ ID NO: 244376 - DNA, 20 bp, Homo sapiens
agatagctattaagatactt

SEQ ID NO: 244377 - DNA, 13 bp, Homo sapiens
agataggctctgc

SEQ ID NO: 244378 - DNA, 14 bp, Homo sapiens
agataggctctgca

SEQ ID NO: 244379 - DNA, 21 bp, Homo sapiens
agataggctctgcacagatgg

SEQ ID NO: 244380 - DNA, 19 bp, Homo sapiens
agataggtttgagttcaaa

SEQ ID NO: 244381 - DNA, 22 bp, Homo sapiens
agataggtttgagttcaaattt

SEQ ID NO: 244382 - DNA, 17 bp, Homo sapiens
agatagtagcatacatt

SEQ ID NO: 244383 - DNA, 15 bp, Homo sapiens
agatataaatggctg

SEQ ID NO: 244384 - DNA, 17 bp, Homo sapiens
agatataaatggctggt

SEQ ID NO: 244385 - DNA, 13 bp, Homo sapiens
agatatatatcat

SEQ ID NO: 244386 - DNA, 14 bp, Homo sapiens
agatatatgccttc

SEQ ID NO: 244387 - DNA, 14 bp, Homo sapiens
agatatctatgact

SEQ ID NO: 244388 - DNA, 21 bp, Homo sapiens
agatattcattaataggaaag

SEQ ID NO: 244389 - DNA, 12 bp, Homo sapiens
agatattcttta

SEQ ID NO: 244390 - DNA, 18 bp, Homo sapiens
agatattgttataaataa

SEQ ID NO: 244391 - DNA, 17 bp, Homo sapiens
agatattgttttctgta

SEQ ID NO: 244392 - DNA, 23 bp, Homo sapiens
agatatttacatgaattgcattt

SEQ ID NO: 244393 - DNA, 20 bp, Homo sapiens
agatatttatatttttattt

SEQ ID NO: 244394 - DNA, 18 bp, Homo sapiens
agatatttgatgtagttt

SEQ ID NO: 244395 - DNA, 14 bp, Homo sapiens
agatattttgcacg

SEQ ID NO: 244396 - DNA, 17 bp, Homo sapiens
agatcaaaataaaaagt

SEQ ID NO: 244397 - DNA, 16 bp, Homo sapiens
agatcaaggcaaaaat

SEQ ID NO: 244398 - DNA, 21 bp, Homo sapiens
agatcaccagcccggcctgct

SEQ ID NO: 244399 - DNA, 15 bp, Homo sapiens
agatcactactgcag

SEQ ID NO: 244400 - DNA, 15 bp, Homo sapiens
agatcagaacatgaa

SEQ ID NO: 244401 - DNA, 24 bp, Homo sapiens
agatcagcattcaaaatagttcta

SEQ ID NO: 244402 - DNA, 17 bp, Homo sapiens
agatcatttagttgggt

SEQ ID NO: 244403 - DNA, 23 bp, Homo sapiens
agatccccggggctggggcccag

SEQ ID NO: 244404 - DNA, 20 bp, Homo sapiens
agatccgagcgacggctcct

SEQ ID NO: 244405 - DNA, 16 bp, Homo sapiens
agatccgcatgtgtct

SEQ ID NO: 244406 - DNA, 21 bp, Homo sapiens
agatccgcatgtgtctgtatt

SEQ ID NO: 244407 - DNA, 17 bp, Homo sapiens
agatccgccctgggctc

SEQ ID NO: 244408 - DNA, 21 bp, Homo sapiens
agatcctgcaccccagcattc

SEQ ID NO: 244409 - DNA, 17 bp, Homo sapiens
agatccttcacaggcag

SEQ ID NO: 244410 - DNA, 14 bp, Homo sapiens
agatcctttcaaaa

SEQ ID NO: 244411 - DNA, 16 bp, Homo sapiens
agatcgcatcattgca

SEQ ID NO: 244412 - DNA, 14 bp, Homo sapiens
agatcgcttgagcc

SEQ ID NO: 244413 - DNA, 17 bp, Homo sapiens
agatcgcttgagcccag

SEQ ID NO: 244414 - DNA, 18 bp, Homo sapiens
agatcgcttgagcccagg

SEQ ID NO: 244415 - DNA, 18 bp, Homo sapiens
agatcggggccagaggca

SEQ ID NO: 244416 - DNA, 19 bp, Homo sapiens
agatcggggccagaggcag

SEQ ID NO: 244417 - DNA, 17 bp, Homo sapiens
agatcgttagtatctaa

SEQ ID NO: 244418 - DNA, 20 bp, Homo sapiens
agatctaagcctttccataa

SEQ ID NO: 244419 - DNA, 13 bp, Homo sapiens
agatctagccagg

SEQ ID NO: 244420 - DNA, 15 bp, Homo sapiens
agatctagccaggcc

SEQ ID NO: 244421 - DNA, 17 bp, Homo sapiens
agattcccggctggact

SEQ ID NO: 244422 - DNA, 20 bp, Homo sapiens
agattcccggctggactttt

SEQ ID NO: 244423 - DNA, 21 bp, Homo sapiens
agattcctacttaaacaaaaa

SEQ ID NO: 244424 - DNA, 15 bp, Homo sapiens
agattcctctgtatt

SEQ ID NO: 244425 - DNA, 14 bp, Homo sapiens
agattcctgggcct

SEQ ID NO: 244426 - DNA, 15 bp, Homo sapiens
agattcctgggcctg

SEQ ID NO: 244427 - DNA, 16 bp, Homo sapiens
agattcctgggcctgt

SEQ ID NO: 244428 - DNA, 17 bp, Homo sapiens
agattctaaaacattct

SEQ ID NO: 244429 - DNA, 15 bp, Homo sapiens
agattctagcacatc

SEQ ID NO: 244430 - DNA, 17 bp, Homo sapiens
agattctagcacatcat

SEQ ID NO: 244431 - DNA, 17 bp, Homo sapiens
agattctattaaaagcc

SEQ ID NO: 244432 - DNA, 17 bp, Homo sapiens
agattctccaaatgatt

SEQ ID NO: 244433 - DNA, 15 bp, Homo sapiens
agattctcctgtgct

SEQ ID NO: 244434 - DNA, 21 bp, Homo sapiens
agattctgggaaaggtgctca

SEQ ID NO: 244435 - DNA, 22 bp, Homo sapiens
agattctgggaaaggtgctcaa

SEQ ID NO: 244436 - DNA, 20 bp, Homo sapiens
agattgcaaggaaggaaaca

SEQ ID NO: 244437 - DNA, 21 bp, Homo sapiens
agattgcaaggaaggaaacaa

SEQ ID NO: 244438 - DNA, 15 bp, Homo sapiens
agattgcttctgtag

SEQ ID NO: 244439 - DNA, 18 bp, Homo sapiens
agattggaaaaaattaga

SEQ ID NO: 244440 - DNA, 20 bp, Homo sapiens
agattggacatggtctcctc

SEQ ID NO: 244441 - DNA, 14 bp, Homo sapiens
agattgggggccct

SEQ ID NO: 244442 - DNA, 23 bp, Homo sapiens
agattgggggccctggggtcccc

SEQ ID NO: 244443 - DNA, 13 bp, Homo sapiens
agattgtgtaaat

SEQ ID NO: 244444 - DNA, 20 bp, Homo sapiens
agattgtgtaaattcctgtt

SEQ ID NO: 244445 - DNA, 13 bp, Homo sapiens
agattgtgtaaca

SEQ ID NO: 244446 - DNA, 15 bp, Homo sapiens
agattgtgtaacaat

SEQ ID NO: 244447 - DNA, 21 bp, Homo sapiens
agattgtgtaacaattttaat

SEQ ID NO: 244448 - DNA, 23 bp, Homo sapiens
agattgttttatcatgacatgtt

SEQ ID NO: 244449 - DNA, 19 bp, Homo sapiens
agatttaagcacaaacttt

SEQ ID NO: 244450 - DNA, 16 bp, Homo sapiens
agatttaccctttata

SEQ ID NO: 244451 - DNA, 17 bp, Homo sapiens
agatttatataaatgta

SEQ ID NO: 244452 - DNA, 13 bp, Homo sapiens
agatttctagaaa

SEQ ID NO: 244453 - DNA, 12 bp, Homo sapiens
agatttggaata

SEQ ID NO: 244454 - DNA, 15 bp, Homo sapiens
agatttgtatttata

SEQ ID NO: 244455 - DNA, 20 bp, Homo sapiens
agatttgtatttatattaga

SEQ ID NO: 244456 - DNA, 12 bp, Homo sapiens
agatttgttcat

SEQ ID NO: 244457 - DNA, 13 bp, Homo sapiens
agatttgttttgt

SEQ ID NO: 244458 - DNA, 17 bp, Homo sapiens
agattttacaaaagatg

SEQ ID NO: 244459 - DNA, 18 bp, Homo sapiens
agattttacaaaagatgt

SEQ ID NO: 244460 - DNA, 19 bp, Homo sapiens
aatgatctaggtttaactc

SEQ ID NO: 244461 - DNA, 22 bp, Homo sapiens
aatgatctaggtttaactcaga

SEQ ID NO: 244462 - DNA, 23 bp, Homo sapiens
aatgatctaggtttaactcagat

SEQ ID NO: 244463 - DNA, 18 bp, Homo sapiens
aatgatgatgataatgat

SEQ ID NO: 244464 - DNA, 19 bp, Homo sapiens
aatgatgccatgaggaaca

SEQ ID NO: 244465 - DNA, 21 bp, Homo sapiens
aatgatgtacaggcagatgaa

SEQ ID NO: 244466 - DNA, 12 bp, Homo sapiens
aatgattaatta

SEQ ID NO: 244467 - DNA, 19 bp, Homo sapiens
aatgattcacttttattgt

SEQ ID NO: 244468 - DNA, 13 bp, Homo sapiens
aatgattcataac

SEQ ID NO: 244469 - DNA, 16 bp, Homo sapiens
aatgattcataacaat

SEQ ID NO: 244470 - DNA, 11 bp, Homo sapiens
aatgattccaa

SEQ ID NO: 244471 - DNA, 13 bp, Homo sapiens
aatgattccaaat

SEQ ID NO: 244472 - DNA, 13 bp, Homo sapiens
aatgattgtaaaa

SEQ ID NO: 244473 - DNA, 12 bp, Homo sapiens
aatgattgttta

SEQ ID NO: 244474 - DNA, 20 bp, Homo sapiens
aatgatttaagcattttact

SEQ ID NO: 244475 - DNA, 15 bp, Homo sapiens
aatgattttcatcaa

SEQ ID NO: 244476 - DNA, 22 bp, Homo sapiens
aatgcaatgtcttaaataaaac

SEQ ID NO: 244477 - DNA, 17 bp, Homo sapiens
aatgcacaagctcagaa

SEQ ID NO: 244478 - DNA, 12 bp, Homo sapiens
aatgcagacaca

SEQ ID NO: 244479 - DNA, 17 bp, Homo sapiens
aatgcagattcctgggc

SEQ ID NO: 244480 - DNA, 18 bp, Homo sapiens
aatgcagattcctgggcc

SEQ ID NO: 244481 - DNA, 19 bp, Homo sapiens
aatgcagtataaaatgtaa

SEQ ID NO: 244482 - DNA, 17 bp, Homo sapiens
aatgcagtgaattgtga

SEQ ID NO: 244483 - DNA, 16 bp, Homo sapiens
aatgcagttttaagaa

SEQ ID NO: 244484 - DNA, 18 bp, Homo sapiens
aatgcatatcctgagcca

SEQ ID NO: 244485 - DNA, 19 bp, Homo sapiens
aatgcatgcagccactgtg

SEQ ID NO: 244486 - DNA, 15 bp, Homo sapiens
aatgcatgctttgga

SEQ ID NO: 244487 - DNA, 20 bp, Homo sapiens
aatgcatgctttggaaattt

SEQ ID NO: 244488 - DNA, 17 bp, Homo sapiens
aatgcattattttgaat

SEQ ID NO: 244489 - DNA, 15 bp, Homo sapiens
aatgcattcaaaata

SEQ ID NO: 244490 - DNA, 22 bp, Homo sapiens
aatgcatttttatcatgtaaca

SEQ ID NO: 244491 - DNA, 16 bp, Homo sapiens
aatgccacttaacagg

SEQ ID NO: 244492 - DNA, 12 bp, Homo sapiens
aatgccagccca

SEQ ID NO: 244493 - DNA, 14 bp, Homo sapiens
aatgccctgccatt

SEQ ID NO: 244494 - DNA, 16 bp, Homo sapiens
aatgcccttaaatcat

SEQ ID NO: 244495 - DNA, 11 bp, Homo sapiens
aatgcctctgc

SEQ ID NO: 244496 - DNA, 19 bp, Homo sapiens
aatgcgctcttcaccagga

SEQ ID NO: 244497 - DNA, 19 bp, Homo sapiens
aatgctacctctgatcaaa

SEQ ID NO: 244498 - DNA, 20 bp, Homo sapiens
aatgctacctctgatcaaag

SEQ ID NO: 244499 - DNA, 22 bp, Homo sapiens
aatgctagcacaatattcctat

SEQ ID NO: 244500 - DNA, 16 bp, Homo sapiens
aatgctcaatgtgctg

SEQ ID NO: 244501 - DNA, 11 bp, Homo sapiens
aatgctccccc

SEQ ID NO: 244502 - DNA, 21 bp, Homo sapiens
aatgctcgtatctccttgatt

SEQ ID NO: 244503 - DNA, 20 bp, Homo sapiens
aatgctctggggtcttttta

SEQ ID NO: 244504 - DNA, 21 bp, Homo sapiens
aatgctggttttcctaaatgc

SEQ ID NO: 244505 - DNA, 22 bp, Homo sapiens
aatgctgtgcaaacagtgtaag

SEQ ID NO: 244506 - DNA, 16 bp, Homo sapiens
aatgctgttgtaaaca

SEQ ID NO: 244507 - DNA, 16 bp, Homo sapiens
aatgcttaatttctaa

SEQ ID NO: 244508 - DNA, 23 bp, Homo sapiens
aatgcttccccacgggaacatta

SEQ ID NO: 244509 - DNA, 18 bp, Homo sapiens
aatgcttgccaagaaatc

SEQ ID NO: 244510 - DNA, 12 bp, Homo sapiens
aatgcttttcta

SEQ ID NO: 244511 - DNA, 14 bp, Homo sapiens
aatgcttttctagc

SEQ ID NO: 244512 - DNA, 14 bp, Homo sapiens
aatgctttttgaat

SEQ ID NO: 244513 - DNA, 23 bp, Homo sapiens
aatggaaaactgcctgttccttg

SEQ ID NO: 244514 - DNA, 14 bp, Homo sapiens
aatggaactgaccc

SEQ ID NO: 244515 - DNA, 19 bp, Homo sapiens
aatggaatcagcttttaat

SEQ ID NO: 244516 - DNA, 15 bp, Homo sapiens
aatggaattattttg

SEQ ID NO: 244517 - DNA, 21 bp, Homo sapiens
aatggacttatttcttcaaat

SEQ ID NO: 244518 - DNA, 19 bp, Homo sapiens
aatggacttgcttcttgtg

SEQ ID NO: 244519 - DNA, 23 bp, Homo sapiens
aatggagtagacccctggctggt

SEQ ID NO: 244520 - DNA, 20 bp, Homo sapiens
aatggatccccagtgaaaac

SEQ ID NO: 244521 - DNA, 17 bp, Homo sapiens
aatggatgtaatatagg

SEQ ID NO: 244522 - DNA, 17 bp, Homo sapiens
aatggcacctgtatacc

SEQ ID NO: 244523 - DNA, 19 bp, Homo sapiens
aatggcagctagactggag

SEQ ID NO: 244524 - DNA, 21 bp, Homo sapiens
aatggccctagaactgtgcct

SEQ ID NO: 244525 - DNA, 13 bp, Homo sapiens
aatggcctcttaa

SEQ ID NO: 244526 - DNA, 16 bp, Homo sapiens
aatggcctcttaaaaa

SEQ ID NO: 244527 - DNA, 19 bp, Homo sapiens
aatggcgcagtgcctctgg

SEQ ID NO: 244528 - DNA, 21 bp, Homo sapiens
aatggctcgtgggctctggct

SEQ ID NO: 244529 - DNA, 22 bp, Homo sapiens
aatggctgggtttgggcagtgg

SEQ ID NO: 244530 - DNA, 20 bp, Homo sapiens
aatgggactgatgtcatctt

SEQ ID NO: 244531 - DNA, 22 bp, Homo sapiens
aatgggactggagtcagatgag

SEQ ID NO: 244532 - DNA, 16 bp, Homo sapiens
aatggggacctggggt

SEQ ID NO: 244533 - DNA, 16 bp, Homo sapiens
aatgggtagcaacagg

SEQ ID NO: 244534 - DNA, 22 bp, Homo sapiens
aatggtgaactgtcattacaga

SEQ ID NO: 244535 - DNA, 18 bp, Homo sapiens
aatggtgagaattaaaat

SEQ ID NO: 244536 - DNA, 14 bp, Homo sapiens
aatggtgagggctg

SEQ ID NO: 244537 - DNA, 13 bp, Homo sapiens
aatggtgcagaaa

SEQ ID NO: 244538 - DNA, 16 bp, Homo sapiens
aatggtgggctccaga

SEQ ID NO: 244539 - DNA, 17 bp, Homo sapiens
aatggtgggctccagag

SEQ ID NO: 244540 - DNA, 15 bp, Homo sapiens
aatggtgtgtttccc

SEQ ID NO: 244541 - DNA, 19 bp, Homo sapiens
aatggtgttgtatgccttt

SEQ ID NO: 244542 - DNA, 17 bp, Homo sapiens
aatggtgtttttttaat

SEQ ID NO: 244543 - DNA, 15 bp, Homo sapiens
aatggttgccttaaa

SEQ ID NO: 244544 - DNA, 18 bp, Homo sapiens
aatggttgccttaaagaa

SEQ ID NO: 244545 - DNA, 17 bp, Homo sapiens
aatggtttaacttctgc

SEQ ID NO: 244546 - DNA, 15 bp, Homo sapiens
aatggtttactgctg

SEQ ID NO: 244547 - DNA, 22 bp, Homo sapiens
aatggttttcttgtgtgtttat

SEQ ID NO: 244548 - DNA, 17 bp, Homo sapiens
aatgtaaaaatgaagga

SEQ ID NO: 244549 - DNA, 15 bp, Homo sapiens
aatgtaaaacacata

SEQ ID NO: 244550 - DNA, 21 bp, Homo sapiens
aatgtaaaacacatacaaaag

SEQ ID NO: 244551 - DNA, 12 bp, Homo sapiens
agcattgttcca

SEQ ID NO: 244552 - DNA, 21 bp, Homo sapiens
agcattgtttgcttattgttc

SEQ ID NO: 244553 - DNA, 22 bp, Homo sapiens
agcattgtttgcttattgttcc

SEQ ID NO: 244554 - DNA, 23 bp, Homo sapiens
agcattgtttgcttattgttcca

SEQ ID NO: 244555 - DNA, 16 bp, Homo sapiens
agcatttgactttctg

SEQ ID NO: 244556 - DNA, 17 bp, Homo sapiens
agcatttgactttctgt

SEQ ID NO: 244557 - DNA, 14 bp, Homo sapiens
agcatttggaagga

SEQ ID NO: 244558 - DNA, 23 bp, Homo sapiens
agcattttactgtctgtaagaga

SEQ ID NO: 244559 - DNA, 23 bp, Homo sapiens
agcattttagcaatttatacaat

SEQ ID NO: 244560 - DNA, 19 bp, Homo sapiens
agcattttctttctgtttt

SEQ ID NO: 244561 - DNA, 14 bp, Homo sapiens
agcatttttaaggg

SEQ ID NO: 244562 - DNA, 17 bp, Homo sapiens
agccaaaaacaataaac

SEQ ID NO: 244563 - DNA, 18 bp, Homo sapiens
agccaaacattcttattt

SEQ ID NO: 244564 - DNA, 13 bp, Homo sapiens
agccaaacccttg

SEQ ID NO: 244565 - DNA, 16 bp, Homo sapiens
agccaaagagctcttt

SEQ ID NO: 244566 - DNA, 20 bp, Homo sapiens
agccaaatgacttcatttct

SEQ ID NO: 244567 - DNA, 23 bp, Homo sapiens
agccaaatgtggcatttgtgatc

SEQ ID NO: 244568 - DNA, 18 bp, Homo sapiens
agccaacctcggcttgtg

SEQ ID NO: 244569 - DNA, 20 bp, Homo sapiens
agccaactcactcttatgaa

SEQ ID NO: 244570 - DNA, 15 bp, Homo sapiens
agccaacttgtaaat

SEQ ID NO: 244571 - DNA, 17 bp, Homo sapiens
agccaagaagtgaggcc

SEQ ID NO: 244572 - DNA, 19 bp, Homo sapiens
agccaagacaaggaggtag

SEQ ID NO: 244573 - DNA, 17 bp, Homo sapiens
agccaagacagtggcag

SEQ ID NO: 244574 - DNA, 19 bp, Homo sapiens
agccaagatcacgccactg

SEQ ID NO: 244575 - DNA, 22 bp, Homo sapiens
agccaaggcctatgccacctgc

SEQ ID NO: 244576 - DNA, 15 bp, Homo sapiens
agccaagggcctctt

SEQ ID NO: 244577 - DNA, 19 bp, Homo sapiens
agccaaggtgctaaaagga

SEQ ID NO: 244578 - DNA, 20 bp, Homo sapiens
agccaaggtgctaaaaggaa

SEQ ID NO: 244579 - DNA, 21 bp, Homo sapiens
agccaaggtgctaaaaggaat

SEQ ID NO: 244580 - DNA, 17 bp, Homo sapiens
agccaagtcctccctct

SEQ ID NO: 244581 - DNA, 15 bp, Homo sapiens
agccaagtgccttcc

SEQ ID NO: 244582 - DNA, 16 bp, Homo sapiens
agccaagttcaaagaa

SEQ ID NO: 244583 - DNA, 14 bp, Homo sapiens
agccaataaataat

SEQ ID NO: 244584 - DNA, 17 bp, Homo sapiens
agccaataaataatatt

SEQ ID NO: 244585 - DNA, 16 bp, Homo sapiens
agccaatactgagtgc

SEQ ID NO: 244586 - DNA, 19 bp, Homo sapiens
agccaatgaacagctcctc

SEQ ID NO: 244587 - DNA, 18 bp, Homo sapiens
agccaatggtgagggctg

SEQ ID NO: 244588 - DNA, 18 bp, Homo sapiens
agccacaaggctggccag

SEQ ID NO: 244589 - DNA, 17 bp, Homo sapiens
agccacacaaacgttta

SEQ ID NO: 244590 - DNA, 13 bp, Homo sapiens
agccacaggcaga

SEQ ID NO: 244591 - DNA, 14 bp, Homo sapiens
agccacaggcagac

SEQ ID NO: 244592 - DNA, 20 bp, Homo sapiens
agccacagtggggcccatgg

SEQ ID NO: 244593 - DNA, 21 bp, Homo sapiens
agccacatgggaaacttccaa

SEQ ID NO: 244594 - DNA, 15 bp, Homo sapiens
agccaccacacctgg

SEQ ID NO: 244595 - DNA, 14 bp, Homo sapiens
agccaccaccactg

SEQ ID NO: 244596 - DNA, 16 bp, Homo sapiens
agccaccaccactgtc

SEQ ID NO: 244597 - DNA, 13 bp, Homo sapiens
agccaccacctgg

SEQ ID NO: 244598 - DNA, 15 bp, Homo sapiens
agccacccagccagg

SEQ ID NO: 244599 - DNA, 18 bp, Homo sapiens
agccacccggatctccag

SEQ ID NO: 244600 - DNA, 19 bp, Homo sapiens
agccacccggatctccagg

SEQ ID NO: 244601 - DNA, 21 bp, Homo sapiens
agccacccggatctccaggcc

SEQ ID NO: 244602 - DNA, 23 bp, Homo sapiens
agccacccggatctccaggccca

SEQ ID NO: 244603 - DNA, 14 bp, Homo sapiens
agccaccgctgcca

SEQ ID NO: 244604 - DNA, 21 bp, Homo sapiens
agccaccgctgccagcacaga

SEQ ID NO: 244605 - DNA, 17 bp, Homo sapiens
agccacctccaccccca

SEQ ID NO: 244606 - DNA, 21 bp, Homo sapiens
agccacctccacccccaagaa

SEQ ID NO: 244607 - DNA, 14 bp, Homo sapiens
agccacctgtccca

SEQ ID NO: 244608 - DNA, 18 bp, Homo sapiens
agccacctgtcccacctc

SEQ ID NO: 244609 - DNA, 14 bp, Homo sapiens
agccaccttcctga

SEQ ID NO: 244610 - DNA, 21 bp, Homo sapiens
agccaccttcctgactgggaa

SEQ ID NO: 244611 - DNA, 14 bp, Homo sapiens
agccacgaggtggt

SEQ ID NO: 244612 - DNA, 22 bp, Homo sapiens
agccacggaccgcatcctccag

SEQ ID NO: 244613 - DNA, 14 bp, Homo sapiens
aatttaaattgtta

SEQ ID NO: 244614 - DNA, 20 bp, Homo sapiens
aatttaactactaagaataa

SEQ ID NO: 244615 - DNA, 21 bp, Homo sapiens
aatttaagcattgtttgctta

SEQ ID NO: 244616 - DNA, 17 bp, Homo sapiens
aatttaagtcgggaaat

SEQ ID NO: 244617 - DNA, 15 bp, Homo sapiens
aatttaatatactgc

SEQ ID NO: 244618 - DNA, 15 bp, Homo sapiens
aatttacatactctg

SEQ ID NO: 244619 - DNA, 19 bp, Homo sapiens
aatttacatactctgctta

SEQ ID NO: 244620 - DNA, 13 bp, Homo sapiens
aatttacttttta

SEQ ID NO: 244621 - DNA, 17 bp, Homo sapiens
aatttagaaatataatt

SEQ ID NO: 244622 - DNA, 17 bp, Homo sapiens
aatttaggaatgctcaa

SEQ ID NO: 244623 - DNA, 15 bp, Homo sapiens
aatttagtcattatt

SEQ ID NO: 244624 - DNA, 16 bp, Homo sapiens
aatttatagtttatac

SEQ ID NO: 244625 - DNA, 17 bp, Homo sapiens
aatttatagtttataca

SEQ ID NO: 244626 - DNA, 16 bp, Homo sapiens
aatttatgagtttttg

SEQ ID NO: 244627 - DNA, 19 bp, Homo sapiens
aatttattagttaatatat

SEQ ID NO: 244628 - DNA, 22 bp, Homo sapiens
aatttattattaaatcagtttt

SEQ ID NO: 244629 - DNA, 12 bp, Homo sapiens
aatttattcaat

SEQ ID NO: 244630 - DNA, 13 bp, Homo sapiens
aatttattttgta

SEQ ID NO: 244631 - DNA, 16 bp, Homo sapiens
aatttcaaaaatataa

SEQ ID NO: 244632 - DNA, 17 bp, Homo sapiens
aatttcaaaaatataac

SEQ ID NO: 244633 - DNA, 18 bp, Homo sapiens
aatttcaaaatgcatgtg

SEQ ID NO: 244634 - DNA, 19 bp, Homo sapiens
aatttcaaaatgcatgtga

SEQ ID NO: 244635 - DNA, 21 bp, Homo sapiens
aatttcacagataatttactt

SEQ ID NO: 244636 - DNA, 21 bp, Homo sapiens
aatttcagctagttaataatt

SEQ ID NO: 244637 - DNA, 13 bp, Homo sapiens
aatttcataaatt

SEQ ID NO: 244638 - DNA, 19 bp, Homo sapiens
aatttcataaattggctcc

SEQ ID NO: 244639 - DNA, 15 bp, Homo sapiens
aatttccagtacctt

SEQ ID NO: 244640 - DNA, 19 bp, Homo sapiens
aatttcccaattaggaagt

SEQ ID NO: 244641 - DNA, 22 bp, Homo sapiens
aatttcccacaccccagcgcct

SEQ ID NO: 244642 - DNA, 15 bp, Homo sapiens
aatttcctatctgta

SEQ ID NO: 244643 - DNA, 13 bp, Homo sapiens
aatttcctctatt

SEQ ID NO: 244644 - DNA, 16 bp, Homo sapiens
aatttcctttatattt

SEQ ID NO: 244645 - DNA, 13 bp, Homo sapiens
aatttctaaagat

SEQ ID NO: 244646 - DNA, 23 bp, Homo sapiens
aatttctaaagataatattactg

SEQ ID NO: 244647 - DNA, 21 bp, Homo sapiens
aatttctagacagtattgcca

SEQ ID NO: 244648 - DNA, 20 bp, Homo sapiens
aatttctagatatgagaaat

SEQ ID NO: 244649 - DNA, 16 bp, Homo sapiens
aatttctctcaatttg

SEQ ID NO: 244650 - DNA, 20 bp, Homo sapiens
aatttctgggatatttaact

SEQ ID NO: 244651 - DNA, 13 bp, Homo sapiens
aatttctgtccag

SEQ ID NO: 244652 - DNA, 21 bp, Homo sapiens
aatttcttcactgttgaaaat

SEQ ID NO: 244653 - DNA, 21 bp, Homo sapiens
aatttcttgctctatctctca

SEQ ID NO: 244654 - DNA, 19 bp, Homo sapiens
aatttctttgtcattcaag

SEQ ID NO: 244655 - DNA, 15 bp, Homo sapiens
aatttgaaaggaaaa

SEQ ID NO: 244656 - DNA, 23 bp, Homo sapiens
aatttgaagaattaatgacaaca

SEQ ID NO: 244657 - DNA, 16 bp, Homo sapiens
aatttgatgaaagctg

SEQ ID NO: 244658 - DNA, 18 bp, Homo sapiens
aatttgatggtgaatatt

SEQ ID NO: 244659 - DNA, 16 bp, Homo sapiens
aatttgcatattctat

SEQ ID NO: 244660 - DNA, 17 bp, Homo sapiens
aatttgcatattctatt

SEQ ID NO: 244661 - DNA, 12 bp, Homo sapiens
aatttgctgctg

SEQ ID NO: 244662 - DNA, 16 bp, Homo sapiens
aatttggattgctaat

SEQ ID NO: 244663 - DNA, 19 bp, Homo sapiens
aatttgggcctcttgtaca

SEQ ID NO: 244664 - DNA, 16 bp, Homo sapiens
aatttggttctaatag

SEQ ID NO: 244665 - DNA, 15 bp, Homo sapiens
aatttggtttttact

SEQ ID NO: 244666 - DNA, 22 bp, Homo sapiens
aatttggtttttactcaaccaa

SEQ ID NO: 244667 - DNA, 15 bp, Homo sapiens
aatttgtaacctcag

SEQ ID NO: 244668 - DNA, 19 bp, Homo sapiens
aatttgtactatttaactg

SEQ ID NO: 244669 - DNA, 15 bp, Homo sapiens
aatttgtataaaatg

SEQ ID NO: 244670 - DNA, 14 bp, Homo sapiens
aatttgtatctgaa

SEQ ID NO: 244671 - DNA, 12 bp, Homo sapiens
aatttgtatgtt

SEQ ID NO: 244672 - DNA, 17 bp, Homo sapiens
aatttgtatgtttccat

SEQ ID NO: 244673 - DNA, 17 bp, Homo sapiens
aatttgtgtaatattac

SEQ ID NO: 244674 - DNA, 14 bp, Homo sapiens
aatttgttaatata

SEQ ID NO: 244675 - DNA, 16 bp, Homo sapiens
aatttgttaatatata

SEQ ID NO: 244676 - DNA, 19 bp, Homo sapiens
aatttgttatacttcaaaa

SEQ ID NO: 244677 - DNA, 22 bp, Homo sapiens
aatttgtttacttgtaaattga

SEQ ID NO: 244678 - DNA, 17 bp, Homo sapiens
aatttgttttgttttaa

SEQ ID NO: 244679 - DNA, 21 bp, Homo sapiens
aattttaaaaaagatggattt

SEQ ID NO: 244680 - DNA, 15 bp, Homo sapiens
aattttaaaaagcag

SEQ ID NO: 244681 - DNA, 18 bp, Homo sapiens
agcccgtgtggccccttc

SEQ ID NO: 244682 - DNA, 18 bp, Homo sapiens
agccctagtgggagccca

SEQ ID NO: 244683 - DNA, 23 bp, Homo sapiens
agccctcagtcagttcccggagc

SEQ ID NO: 244684 - DNA, 13 bp, Homo sapiens
agccctccagagc

SEQ ID NO: 244685 - DNA, 14 bp, Homo sapiens
agccctccagagca

SEQ ID NO: 244686 - DNA, 14 bp, Homo sapiens
agccctccccctca

SEQ ID NO: 244687 - DNA, 22 bp, Homo sapiens
agccctccctcttcccagcaca

SEQ ID NO: 244688 - DNA, 15 bp, Homo sapiens
agccctccctgcccc

SEQ ID NO: 244689 - DNA, 16 bp, Homo sapiens
agccctccctgcccct

SEQ ID NO: 244690 - DNA, 22 bp, Homo sapiens
agccctccctgcccctcccttc

SEQ ID NO: 244691 - DNA, 14 bp, Homo sapiens
agccctcctgagca

SEQ ID NO: 244692 - DNA, 21 bp, Homo sapiens
agccctcctggaatggagctg

SEQ ID NO: 244693 - DNA, 20 bp, Homo sapiens
agccctccttcttgccctga

SEQ ID NO: 244694 - DNA, 22 bp, Homo sapiens
agccctccttcttgccctgagc

SEQ ID NO: 244695 - DNA, 17 bp, Homo sapiens
agccctccttgccaccc

SEQ ID NO: 244696 - DNA, 18 bp, Homo sapiens
agccctcgaaccaaggca

SEQ ID NO: 244697 - DNA, 16 bp, Homo sapiens
agccctcggcctccga

SEQ ID NO: 244698 - DNA, 17 bp, Homo sapiens
agccctcggcctccgag

SEQ ID NO: 244699 - DNA, 16 bp, Homo sapiens
agccctctcactgtgt

SEQ ID NO: 244700 - DNA, 19 bp, Homo sapiens
agccctctcactgtgtccc

SEQ ID NO: 244701 - DNA, 16 bp, Homo sapiens
agccctctccaccctc

SEQ ID NO: 244702 - DNA, 16 bp, Homo sapiens
agccctcttcaggggt

SEQ ID NO: 244703 - DNA, 16 bp, Homo sapiens
agccctctttctctct

SEQ ID NO: 244704 - DNA, 18 bp, Homo sapiens
agccctctttctctctgt

SEQ ID NO: 244705 - DNA, 20 bp, Homo sapiens
agccctctttctctctgtgt

SEQ ID NO: 244706 - DNA, 21 bp, Homo sapiens
agccctctttctctctgtgtg

SEQ ID NO: 244707 - DNA, 12 bp, Homo sapiens
agccctgacctt

SEQ ID NO: 244708 - DNA, 21 bp, Homo sapiens
agccctgaggtgaaagggagc

SEQ ID NO: 244709 - DNA, 14 bp, Homo sapiens
agccctgccctcac

SEQ ID NO: 244710 - DNA, 15 bp, Homo sapiens
agccctgccctcact

SEQ ID NO: 244711 - DNA, 17 bp, Homo sapiens
agccctgccctcactcc

SEQ ID NO: 244712 - DNA, 18 bp, Homo sapiens
agccctgccctcactcca

SEQ ID NO: 244713 - DNA, 14 bp, Homo sapiens
agccctgccctgca

SEQ ID NO: 244714 - DNA, 18 bp, Homo sapiens
agccctgctgctgcctgc

SEQ ID NO: 244715 - DNA, 19 bp, Homo sapiens
agccctgctgctgcctgcc

SEQ ID NO: 244716 - DNA, 19 bp, Homo sapiens
agccctgctgcttcctaac

SEQ ID NO: 244717 - DNA, 20 bp, Homo sapiens
agccctgctgcttcctaact

SEQ ID NO: 244718 - DNA, 22 bp, Homo sapiens
agccctgctgcttcctaactta

SEQ ID NO: 244719 - DNA, 17 bp, Homo sapiens
agccctgctttgggctg

SEQ ID NO: 244720 - DNA, 21 bp, Homo sapiens
agccctgctttgggctgccct

SEQ ID NO: 244721 - DNA, 14 bp, Homo sapiens
agccctggccagag

SEQ ID NO: 244722 - DNA, 18 bp, Homo sapiens
agccctggcccagagctg

SEQ ID NO: 244723 - DNA, 14 bp, Homo sapiens
agccctggctgggt

SEQ ID NO: 244724 - DNA, 16 bp, Homo sapiens
agccctggctgggttc

SEQ ID NO: 244725 - DNA, 12 bp, Homo sapiens
agccctggggct

SEQ ID NO: 244726 - DNA, 13 bp, Homo sapiens
agccctggggctg

SEQ ID NO: 244727 - DNA, 18 bp, Homo sapiens
agccctggggctgggccc

SEQ ID NO: 244728 - DNA, 22 bp, Homo sapiens
agccctggggtttccacacagg

SEQ ID NO: 244729 - DNA, 19 bp, Homo sapiens
agccctggttctccatccc

SEQ ID NO: 244730 - DNA, 22 bp, Homo sapiens
agccctggttctccatccccat

SEQ ID NO: 244731 - DNA, 11 bp, Homo sapiens
agccctgtcct

SEQ ID NO: 244732 - DNA, 13 bp, Homo sapiens
agccctgtcctgg

SEQ ID NO: 244733 - DNA, 21 bp, Homo sapiens
agccctgtcgagacacttgcc

SEQ ID NO: 244734 - DNA, 12 bp, Homo sapiens
agccctgtggaa

SEQ ID NO: 244735 - DNA, 16 bp, Homo sapiens
agcccttagccttgct

SEQ ID NO: 244736 - DNA, 23 bp, Homo sapiens
agcccttagccttgctgtagaga

SEQ ID NO: 244737 - DNA, 17 bp, Homo sapiens
agcccttcactgccatg

SEQ ID NO: 244738 - DNA, 18 bp, Homo sapiens
agcccttcactgccatga

SEQ ID NO: 244739 - DNA, 22 bp, Homo sapiens
agcccttccatgtcgcctctgc

SEQ ID NO: 244740 - DNA, 15 bp, Homo sapiens
agcccttcccaggcc

SEQ ID NO: 244741 - DNA, 19 bp, Homo sapiens
agcccttcccaggccagcg

SEQ ID NO: 244742 - DNA, 15 bp, Homo sapiens
agcccttccctgctt

SEQ ID NO: 244743 - DNA, 13 bp, Homo sapiens
agcccttgcacag

SEQ ID NO: 244744 - DNA, 15 bp, Homo sapiens
agcccttgcacaggc

SEQ ID NO: 244745 - DNA, 17 bp, Homo sapiens
agcccttgcacaggcca

SEQ ID NO: 244746 - DNA, 22 bp, Homo sapiens
agcccttgcacaggccacttgc

SEQ ID NO: 244747 - DNA, 22 bp, Homo sapiens
agcccttgcccccatccctcgg

SEQ ID NO: 244748 - DNA, 12 bp, Homo sapiens
agcccttgggca

SEQ ID NO: 244749 - DNA, 21 bp, Homo sapiens
agccctttacttgacctccta

SEQ ID NO: 244750 - DNA, 14 bp, Homo sapiens
agccctttccaggg

SEQ ID NO: 244751 - DNA, 21 bp, Homo sapiens
agccctttccccactcagctg

SEQ ID NO: 244752 - DNA, 12 bp, Homo sapiens
agccctttctgt

SEQ ID NO: 244753 - DNA, 17 bp, Homo sapiens
agccctttctgtgtgca

SEQ ID NO: 244754 - DNA, 15 bp, Homo sapiens
agccctttgcctgta

SEQ ID NO: 244755 - DNA, 22 bp, Homo sapiens
agccctttgcctgtagagccag

SEQ ID NO: 244756 - DNA, 23 bp, Homo sapiens
agccgagctcgtgtatcctgggg

SEQ ID NO: 244757 - DNA, 15 bp, Homo sapiens
agccgagctctcctg

SEQ ID NO: 244758 - DNA, 14 bp, Homo sapiens
agccgccaggaccg

SEQ ID NO: 244759 - DNA, 17 bp, Homo sapiens
agccgccattgccacca

SEQ ID NO: 244760 - DNA, 18 bp, Homo sapiens
acaatactttgtgtcttt

SEQ ID NO: 244761 - DNA, 22 bp, Homo sapiens
acaatactttgtgtcttttgtt

SEQ ID NO: 244762 - DNA, 14 bp, Homo sapiens
acaatagacagaaa

SEQ ID NO: 244763 - DNA, 17 bp, Homo sapiens
acaatagacagaaacag

SEQ ID NO: 244764 - DNA, 19 bp, Homo sapiens
acaatagctttaccctcag

SEQ ID NO: 244765 - DNA, 17 bp, Homo sapiens
acaatatatgatatata

SEQ ID NO: 244766 - DNA, 21 bp, Homo sapiens
acaatatgaatacagggcatg

SEQ ID NO: 244767 - DNA, 14 bp, Homo sapiens
acaatatgctttac

SEQ ID NO: 244768 - DNA, 19 bp, Homo sapiens
acaatatgtgttttttaat

SEQ ID NO: 244769 - DNA, 16 bp, Homo sapiens
acaatatttattgtat

SEQ ID NO: 244770 - DNA, 14 bp, Homo sapiens
acaatcaaaggaaa

SEQ ID NO: 244771 - DNA, 21 bp, Homo sapiens
acaatcacaaaagctgtgtct

SEQ ID NO: 244772 - DNA, 12 bp, Homo sapiens
acaatcacactc

SEQ ID NO: 244773 - DNA, 14 bp, Homo sapiens
acaatcactattct

SEQ ID NO: 244774 - DNA, 20 bp, Homo sapiens
acaatcactattcttaagca

SEQ ID NO: 244775 - DNA, 23 bp, Homo sapiens
acaatcactattcttaagcactt

SEQ ID NO: 244776 - DNA, 12 bp, Homo sapiens
acaatcagctgc

SEQ ID NO: 244777 - DNA, 22 bp, Homo sapiens
acaatccaaatgcattcatgtt

SEQ ID NO: 244778 - DNA, 17 bp, Homo sapiens
acaatcccaatctttct

SEQ ID NO: 244779 - DNA, 18 bp, Homo sapiens
acaatcccaatctttcta

SEQ ID NO: 244780 - DNA, 19 bp, Homo sapiens
acaatcctataaatgtgat

SEQ ID NO: 244781 - DNA, 16 bp, Homo sapiens
acaatcctccccacca

SEQ ID NO: 244782 - DNA, 20 bp, Homo sapiens
acaatctaaaaaatatctta

SEQ ID NO: 244783 - DNA, 19 bp, Homo sapiens
acaatctcacacagctggg

SEQ ID NO: 244784 - DNA, 18 bp, Homo sapiens
acaatgaagataaaaaga

SEQ ID NO: 244785 - DNA, 17 bp, Homo sapiens
acaatgatgatgataat

SEQ ID NO: 244786 - DNA, 19 bp, Homo sapiens
acaatgatgattaaacacc

SEQ ID NO: 244787 - DNA, 12 bp, Homo sapiens
acaatgcaaaac

SEQ ID NO: 244788 - DNA, 16 bp, Homo sapiens
acaatgcatgctttgg

SEQ ID NO: 244789 - DNA, 21 bp, Homo sapiens
acaatggctgggagggggccc

SEQ ID NO: 244790 - DNA, 23 bp, Homo sapiens
acaatggctgggagggggccctt

SEQ ID NO: 244791 - DNA, 21 bp, Homo sapiens
acaatggttttcttgtgtgtt

SEQ ID NO: 244792 - DNA, 14 bp, Homo sapiens
acaatgtactatat

SEQ ID NO: 244793 - DNA, 20 bp, Homo sapiens
acaatgtgatatgtgtaata

SEQ ID NO: 244794 - DNA, 14 bp, Homo sapiens
acaatgtgcactga

SEQ ID NO: 244795 - DNA, 15 bp, Homo sapiens
acaatgtgcactgaa

SEQ ID NO: 244796 - DNA, 18 bp, Homo sapiens
acaatgtggaattacata

SEQ ID NO: 244797 - DNA, 14 bp, Homo sapiens
acaattactaaatt

SEQ ID NO: 244798 - DNA, 17 bp, Homo sapiens
acaattactaaattgta

SEQ ID NO: 244799 - DNA, 13 bp, Homo sapiens
acaattaggtctg

SEQ ID NO: 244800 - DNA, 20 bp, Homo sapiens
acaattaggtctgcattttc

SEQ ID NO: 244801 - DNA, 22 bp, Homo sapiens
acaattaggtctgcattttctc

SEQ ID NO: 244802 - DNA, 19 bp, Homo sapiens
acaattatttttgctctgc

SEQ ID NO: 244803 - DNA, 15 bp, Homo sapiens
acaattcagttttag

SEQ ID NO: 244804 - DNA, 19 bp, Homo sapiens
acaattcccgggcccttca

SEQ ID NO: 244805 - DNA, 15 bp, Homo sapiens
acaattccctgctgt

SEQ ID NO: 244806 - DNA, 19 bp, Homo sapiens
acaattcctagataaaaag

SEQ ID NO: 244807 - DNA, 22 bp, Homo sapiens
acaattcctagataaaaagatg

SEQ ID NO: 244808 - DNA, 11 bp, Homo sapiens
acaattctgtc

SEQ ID NO: 244809 - DNA, 14 bp, Homo sapiens
acaattctgtccct

SEQ ID NO: 244810 - DNA, 12 bp, Homo sapiens
acaattctttgt

SEQ ID NO: 244811 - DNA, 21 bp, Homo sapiens
acagaactcgatgcactgacc

SEQ ID NO: 244812 - DNA, 16 bp, Homo sapiens
acagaagacacgtgtt

SEQ ID NO: 244813 - DNA, 18 bp, Homo sapiens
acagaagcaggctggagg

SEQ ID NO: 244814 - DNA, 19 bp, Homo sapiens
acagaagcaggctggaggt

SEQ ID NO: 244815 - DNA, 13 bp, Homo sapiens
acagaagcttcag

SEQ ID NO: 244816 - DNA, 19 bp, Homo sapiens
acagaaggtaataggaaga

SEQ ID NO: 244817 - DNA, 22 bp, Homo sapiens
acagaatactgttaaaggaaaa

SEQ ID NO: 244818 - DNA, 14 bp, Homo sapiens
acagacaaagcgtg

SEQ ID NO: 244819 - DNA, 21 bp, Homo sapiens
acagacaaggtagccctggcc

SEQ ID NO: 244820 - DNA, 22 bp, Homo sapiens
acagacaaggtagccctggcca

SEQ ID NO: 244821 - DNA, 12 bp, Homo sapiens
acagacacacac

SEQ ID NO: 244822 - DNA, 16 bp, Homo sapiens
acagacacacacacgc

SEQ ID NO: 244823 - DNA, 18 bp, Homo sapiens
acagacacacacacgcac

SEQ ID NO: 244824 - DNA, 22 bp, Homo sapiens
acagacacacacacgcacgcac

SEQ ID NO: 244825 - DNA, 18 bp, Homo sapiens
acagacactaagttatag

SEQ ID NO: 244826 - DNA, 14 bp, Homo sapiens
acagacactacatt

SEQ ID NO: 244827 - DNA, 15 bp, Homo sapiens
acagacatctctgca

SEQ ID NO: 244828 - DNA, 15 bp, Homo sapiens
acagacctaatatca

SEQ ID NO: 244829 - DNA, 16 bp, Homo sapiens
acagacctaatatcat

SEQ ID NO: 244830 - DNA, 13 bp, Homo sapiens
acagacctcggct

SEQ ID NO: 244831 - DNA, 15 bp, Homo sapiens
acagacgtccctcca

SEQ ID NO: 244832 - DNA, 19 bp, Homo sapiens
acagactctgtgagattct

SEQ ID NO: 244833 - DNA, 16 bp, Homo sapiens
acagactgttccctcc

SEQ ID NO: 244834 - DNA, 23 bp, Homo sapiens
acagactgttccctccaaggtcc

SEQ ID NO: 244835 - DNA, 23 bp, Homo sapiens
acagacttctggaaggctggctg

SEQ ID NO: 244836 - DNA, 16 bp, Homo sapiens
acagacttgagaactt

SEQ ID NO: 244837 - DNA, 18 bp, Homo sapiens
acagacttgagaacttga

SEQ ID NO: 244838 - DNA, 16 bp, Homo sapiens
acagagaaggcagcag

SEQ ID NO: 244839 - DNA, 18 bp, Homo sapiens
acagagacgcaggaatgg

SEQ ID NO: 244840 - DNA, 23 bp, Homo sapiens
acagagagacagacttgagaact

SEQ ID NO: 244841 - DNA, 21 bp, Homo sapiens
acagagagggggccacctccc

SEQ ID NO: 244842 - DNA, 15 bp, Homo sapiens
acagagcagctcccc

SEQ ID NO: 244843 - DNA, 17 bp, Homo sapiens
acagagcagctccccag

SEQ ID NO: 244844 - DNA, 24 bp, Homo sapiens
acagagcagctccccaggagctca

SEQ ID NO: 244845 - DNA, 23 bp, Homo sapiens
acagagcaggtctgcaggccacc

SEQ ID NO: 244846 - DNA, 21 bp, Homo sapiens
acagagcctcgggacatcaaa

SEQ ID NO: 244847 - DNA, 20 bp, Homo sapiens
acagagcgtccttccccctg

SEQ ID NO: 244848 - DNA, 20 bp, Homo sapiens
acagagctgacaaaattttg

SEQ ID NO: 244849 - DNA, 17 bp, Homo sapiens
acagaggatgctgaagt

SEQ ID NO: 244850 - DNA, 17 bp, Homo sapiens
acagaggcagtggcagc

SEQ ID NO: 244851 - DNA, 22 bp, Homo sapiens
acagagggaaaggctgaacata

SEQ ID NO: 244852 - DNA, 13 bp, Homo sapiens
acagagtatatat

SEQ ID NO: 244853 - DNA, 15 bp, Homo sapiens
acagagtatatatgt

SEQ ID NO: 244854 - DNA, 18 bp, Homo sapiens
acagagtatatatgtaca

SEQ ID NO: 244855 - DNA, 20 bp, Homo sapiens
acagagtatatatgtacagt

SEQ ID NO: 244856 - DNA, 19 bp, Homo sapiens
acagagtccaatttaagga

SEQ ID NO: 244857 - DNA, 18 bp, Homo sapiens
acagagtcgatgctcaat

SEQ ID NO: 244858 - DNA, 19 bp, Homo sapiens
acagagtctcgctctgtcg

SEQ ID NO: 244859 - DNA, 17 bp, Homo sapiens
acagagtctgacaggaa

SEQ ID NO: 244860 - DNA, 19 bp, Homo sapiens
acagagtctgacaggaaga

SEQ ID NO: 244861 - DNA, 13 bp, Homo sapiens
acagagtctgggt

SEQ ID NO: 244862 - DNA, 19 bp, Homo sapiens
acagagtggcccctcacct

SEQ ID NO: 244863 - DNA, 16 bp, Homo sapiens
acagagtgtggtccct

SEQ ID NO: 244864 - DNA, 15 bp, Homo sapiens
acagataagcaagag

SEQ ID NO: 244865 - DNA, 19 bp, Homo sapiens
acagataagcaagagagat

SEQ ID NO: 244866 - DNA, 14 bp, Homo sapiens
acagataatcagtg

SEQ ID NO: 244867 - DNA, 16 bp, Homo sapiens
acagatacacatacac

SEQ ID NO: 244868 - DNA, 22 bp, Homo sapiens
acagatactgaaacatttgaca

SEQ ID NO: 244869 - DNA, 17 bp, Homo sapiens
acagatataaatggctg

SEQ ID NO: 244870 - DNA, 14 bp, Homo sapiens
acagatattccaga

SEQ ID NO: 244871 - DNA, 15 bp, Homo sapiens
acagatccgcatgtg

SEQ ID NO: 244872 - DNA, 17 bp, Homo sapiens
acagatccgcatgtgtc

SEQ ID NO: 244873 - DNA, 20 bp, Homo sapiens
acagatccgcatgtgtctgt

SEQ ID NO: 244874 - DNA, 21 bp, Homo sapiens
acagatccgcatgtgtctgta

SEQ ID NO: 244875 - DNA, 17 bp, Homo sapiens
acagatctccaaagctt

SEQ ID NO: 244876 - DNA, 18 bp, Homo sapiens
acagatgccccagagctg

SEQ ID NO: 244877 - DNA, 21 bp, Homo sapiens
acagatggctgtgaaaattac

SEQ ID NO: 244878 - DNA, 23 bp, Homo sapiens
acagatgggtattaaacttgtca

SEQ ID NO: 244879 - DNA, 13 bp, Homo sapiens
acagatgtgccca

SEQ ID NO: 244880 - DNA, 17 bp, Homo sapiens
acagatgtgcccagagt

SEQ ID NO: 244881 - DNA, 22 bp, Homo sapiens
acagatgttccatcctgtacaa

SEQ ID NO: 244882 - DNA, 19 bp, Homo sapiens
acagatgtttgttttcaaa

SEQ ID NO: 244883 - DNA, 19 bp, Homo sapiens
acagattgctacacacaca

SEQ ID NO: 244884 - DNA, 15 bp, Homo sapiens
acagatttgttcatt

SEQ ID NO: 244885 - DNA, 17 bp, Homo sapiens
acagatttgttcattcc

SEQ ID NO: 244886 - DNA, 14 bp, Homo sapiens
acagcaaaagttct

SEQ ID NO: 244887 - DNA, 15 bp, Homo sapiens
acagcaacaacaaca

SEQ ID NO: 244888 - DNA, 17 bp, Homo sapiens
acagcaagccggccccc

SEQ ID NO: 244889 - DNA, 15 bp, Homo sapiens
acagcaattttgtat

SEQ ID NO: 244890 - DNA, 15 bp, Homo sapiens
acagcacatgctggc

SEQ ID NO: 244891 - DNA, 17 bp, Homo sapiens
acagcacatgctggcca

SEQ ID NO: 244892 - DNA, 18 bp, Homo sapiens
acagcacatgctggccag

SEQ ID NO: 244893 - DNA, 21 bp, Homo sapiens
acagcacatgctggccagcct

SEQ ID NO: 244894 - DNA, 20 bp, Homo sapiens
acagcacctcctctctgctg

SEQ ID NO: 244895 - DNA, 12 bp, Homo sapiens
acagcactactc

SEQ ID NO: 244896 - DNA, 14 bp, Homo sapiens
acagcactactctg

SEQ ID NO: 244897 - DNA, 15 bp, Homo sapiens
acagcactactctgt

SEQ ID NO: 244898 - DNA, 21 bp, Homo sapiens
acagcactacttacttagaga

SEQ ID NO: 244899 - DNA, 19 bp, Homo sapiens
acagcactggctctctcca

SEQ ID NO: 244900 - DNA, 20 bp, Homo sapiens
acagcactggctctctccag

SEQ ID NO: 244901 - DNA, 22 bp, Homo sapiens
acagcactggctctctccagga

SEQ ID NO: 244902 - DNA, 13 bp, Homo sapiens
acagcagcagctc

SEQ ID NO: 244903 - DNA, 17 bp, Homo sapiens
acagcagcccctgcaca

SEQ ID NO: 244904 - DNA, 17 bp, Homo sapiens
acagcagcctctgaagt

SEQ ID NO: 244905 - DNA, 16 bp, Homo sapiens
agcctggtgctgctgc

SEQ ID NO: 244906 - DNA, 18 bp, Homo sapiens
agcctggttccctctttc

SEQ ID NO: 244907 - DNA, 20 bp, Homo sapiens
agcctggttccctctttcct

SEQ ID NO: 244908 - DNA, 21 bp, Homo sapiens
agcctggttccctctttcctg

SEQ ID NO: 244909 - DNA, 22 bp, Homo sapiens
agcctgtcagccaacattgcct

SEQ ID NO: 244910 - DNA, 21 bp, Homo sapiens
agcctgtccccgccttccctc

SEQ ID NO: 244911 - DNA, 22 bp, Homo sapiens
agcctgtccccgccttccctca

SEQ ID NO: 244912 - DNA, 11 bp, Homo sapiens
agcctgtcctc

SEQ ID NO: 244913 - DNA, 14 bp, Homo sapiens
agcctgtctctccc

SEQ ID NO: 244914 - DNA, 16 bp, Homo sapiens
agcctgtctctttcca

SEQ ID NO: 244915 - DNA, 20 bp, Homo sapiens
agcctgtctctttccacttt

SEQ ID NO: 244916 - DNA, 21 bp, Homo sapiens
agcctgtcttcagatcctgct

SEQ ID NO: 244917 - DNA, 22 bp, Homo sapiens
agcctgtcttcagatcctgctg

SEQ ID NO: 244918 - DNA, 14 bp, Homo sapiens
agcctgtgagggag

SEQ ID NO: 244919 - DNA, 11 bp, Homo sapiens
agcctgtggca

SEQ ID NO: 244920 - DNA, 13 bp, Homo sapiens
agcctgtgggaga

SEQ ID NO: 244921 - DNA, 20 bp, Homo sapiens
agcctgttcccctcactgga

SEQ ID NO: 244922 - DNA, 22 bp, Homo sapiens
agcctgttcccctcactggatg

SEQ ID NO: 244923 - DNA, 15 bp, Homo sapiens
agcctgttgctgaag

SEQ ID NO: 244924 - DNA, 18 bp, Homo sapiens
agcctgtttgggaggctg

SEQ ID NO: 244925 - DNA, 17 bp, Homo sapiens
agccttaagtcttactg

SEQ ID NO: 244926 - DNA, 17 bp, Homo sapiens
agccttaatggatgctc

SEQ ID NO: 244927 - DNA, 23 bp, Homo sapiens
agccttaatggatgctcattcat

SEQ ID NO: 244928 - DNA, 15 bp, Homo sapiens
agccttacatttgtg

SEQ ID NO: 244929 - DNA, 14 bp, Homo sapiens
agccttaccacgca

SEQ ID NO: 244930 - DNA, 15 bp, Homo sapiens
agccttagcatcccc

SEQ ID NO: 244931 - DNA, 20 bp, Homo sapiens
agccttagcatcccctgtga

SEQ ID NO: 244932 - DNA, 15 bp, Homo sapiens
agccttagctgccag

SEQ ID NO: 244933 - DNA, 23 bp, Homo sapiens
agccttagtgtcacctttcttct

SEQ ID NO: 244934 - DNA, 14 bp, Homo sapiens
agccttatcaagtg

SEQ ID NO: 244935 - DNA, 19 bp, Homo sapiens
agccttatcaagtgtcttc

SEQ ID NO: 244936 - DNA, 13 bp, Homo sapiens
agccttcactgga

SEQ ID NO: 244937 - DNA, 17 bp, Homo sapiens
agccttcccctccctgt

SEQ ID NO: 244938 - DNA, 18 bp, Homo sapiens
agccttccgagtagctgg

SEQ ID NO: 244939 - DNA, 14 bp, Homo sapiens
agccttcctctgca

SEQ ID NO: 244940 - DNA, 16 bp, Homo sapiens
ataaggcctcatcctc

SEQ ID NO: 244941 - DNA, 15 bp, Homo sapiens
ataaggcctgccctc

SEQ ID NO: 244942 - DNA, 22 bp, Homo sapiens
ataaggtaccaagatcacaaat

SEQ ID NO: 244943 - DNA, 17 bp, Homo sapiens
ataagtaattcaagaaa

SEQ ID NO: 244944 - DNA, 16 bp, Homo sapiens
ataagtcctaaagtga

SEQ ID NO: 244945 - DNA, 14 bp, Homo sapiens
ataagtgaaaatct

SEQ ID NO: 244946 - DNA, 13 bp, Homo sapiens
ataagtggaaaaa

SEQ ID NO: 244947 - DNA, 15 bp, Homo sapiens
ataagtggaaaaaag

SEQ ID NO: 244948 - DNA, 18 bp, Homo sapiens
ataagtggaaaaaagaga

SEQ ID NO: 244949 - DNA, 14 bp, Homo sapiens
ataagttaaagaga

SEQ ID NO: 244950 - DNA, 17 bp, Homo sapiens
ataagttaaaggcagtc

SEQ ID NO: 244951 - DNA, 17 bp, Homo sapiens
ataagttaatattggaa

SEQ ID NO: 244952 - DNA, 23 bp, Homo sapiens
ataagtttattgtaaaagtgaca

SEQ ID NO: 244953 - DNA, 21 bp, Homo sapiens
ataagtttctgggacctcagt

SEQ ID NO: 244954 - DNA, 21 bp, Homo sapiens
ataataaagaactccttattt

SEQ ID NO: 244955 - DNA, 22 bp, Homo sapiens
ataataaagtattccaccttaa

SEQ ID NO: 244956 - DNA, 16 bp, Homo sapiens
ataataaatatatatt

SEQ ID NO: 244957 - DNA, 15 bp, Homo sapiens
ataataaatgtacat

SEQ ID NO: 244958 - DNA, 17 bp, Homo sapiens
ataataactagatctcc

SEQ ID NO: 244959 - DNA, 13 bp, Homo sapiens
ataataagctaaa

SEQ ID NO: 244960 - DNA, 17 bp, Homo sapiens
ataataatgttctctgg

SEQ ID NO: 244961 - DNA, 15 bp, Homo sapiens
ataatacatctttat

SEQ ID NO: 244962 - DNA, 20 bp, Homo sapiens
ataatactaatttattgccg

SEQ ID NO: 244963 - DNA, 16 bp, Homo sapiens
ataatagttaatgaag

SEQ ID NO: 244964 - DNA, 13 bp, Homo sapiens
ataatataaatga

SEQ ID NO: 244965 - DNA, 22 bp, Homo sapiens
ataatatatgttttaaatatag

SEQ ID NO: 244966 - DNA, 17 bp, Homo sapiens
ataatatcctgaataac

SEQ ID NO: 244967 - DNA, 17 bp, Homo sapiens
ataatatcttgaagaat

SEQ ID NO: 244968 - DNA, 14 bp, Homo sapiens
ataatatgtttgag

SEQ ID NO: 244969 - DNA, 20 bp, Homo sapiens
ataatcaattattacattta

SEQ ID NO: 244970 - DNA, 16 bp, Homo sapiens
ataatcagcctcttaa

SEQ ID NO: 244971 - DNA, 15 bp, Homo sapiens
ataatcccagcactt

SEQ ID NO: 244972 - DNA, 17 bp, Homo sapiens
ataatcccagcactttg

SEQ ID NO: 244973 - DNA, 23 bp, Homo sapiens
ataatctagtttacagaaaaatc

SEQ ID NO: 244974 - DNA, 18 bp, Homo sapiens
ataatctggactcctctg

SEQ ID NO: 244975 - DNA, 21 bp, Homo sapiens
ataatgaaatagttattttaa

SEQ ID NO: 244976 - DNA, 18 bp, Homo sapiens
ataatgaagaatggccat

SEQ ID NO: 244977 - DNA, 12 bp, Homo sapiens
ataatgaataat

SEQ ID NO: 244978 - DNA, 15 bp, Homo sapiens
ataatgaatgaaaca

SEQ ID NO: 244979 - DNA, 17 bp, Homo sapiens
ataatgacgtattgtga

SEQ ID NO: 244980 - DNA, 23 bp, Homo sapiens
ataatgagtaatgcagacattta

SEQ ID NO: 244981 - DNA, 15 bp, Homo sapiens
ataatgatagtgttt

SEQ ID NO: 244982 - DNA, 21 bp, Homo sapiens
ataatgcactggggtaccaca

SEQ ID NO: 244983 - DNA, 15 bp, Homo sapiens
ataatgcttaatttc

SEQ ID NO: 244984 - DNA, 15 bp, Homo sapiens
ataatgcttttacta

SEQ ID NO: 244985 - DNA, 16 bp, Homo sapiens
ataatggcctcttaaa

SEQ ID NO: 244986 - DNA, 17 bp, Homo sapiens
ataatggcctcttaaaa

SEQ ID NO: 244987 - DNA, 14 bp, Homo sapiens
ataatggtttactg

SEQ ID NO: 244988 - DNA, 19 bp, Homo sapiens
ataatggtttactgctgtc

SEQ ID NO: 244989 - DNA, 15 bp, Homo sapiens
ataatgtagtgcagt

SEQ ID NO: 244990 - DNA, 15 bp, Homo sapiens
ataatgtcctttccc

SEQ ID NO: 244991 - DNA, 19 bp, Homo sapiens
ataatgtgggaagaaacaa

SEQ ID NO: 244992 - DNA, 21 bp, Homo sapiens
ataatgtgggaagaaacaaac

SEQ ID NO: 244993 - DNA, 15 bp, Homo sapiens
ataatgttagtagca

SEQ ID NO: 244994 - DNA, 13 bp, Homo sapiens
ataatgttcctta

SEQ ID NO: 244995 - DNA, 15 bp, Homo sapiens
ataatgttccttagt

SEQ ID NO: 244996 - DNA, 18 bp, Homo sapiens
ataatgttgtggtttgtt

SEQ ID NO: 244997 - DNA, 13 bp, Homo sapiens
ataatgtttgcta

SEQ ID NO: 244998 - DNA, 12 bp, Homo sapiens
ataattaaaaca

SEQ ID NO: 244999 - DNA, 13 bp, Homo sapiens
ataattaaaacaa

SEQ ID NO: 245000 - DNA, 21 bp, Homo sapiens
ataattaaaacaaaatccttg

SEQ ID NO: 245001 - DNA, 16 bp, Homo sapiens
ataattataatatact

SEQ ID NO: 245002 - DNA, 16 bp, Homo sapiens
ataattatcggaagca

SEQ ID NO: 245003 - DNA, 19 bp, Homo sapiens
ataattatcggaagcagtg

SEQ ID NO: 245004 - DNA, 13 bp, Homo sapiens
ataattatgggaa

SEQ ID NO: 245005 - DNA, 22 bp, Homo sapiens
ataattatgttattgaaaaaaa

SEQ ID NO: 245006 - DNA, 18 bp, Homo sapiens
ataattatttatttaata

SEQ ID NO: 245007 - DNA, 17 bp, Homo sapiens
ataattccctatctttt

SEQ ID NO: 245008 - DNA, 14 bp, Homo sapiens
ataattctattgaa

SEQ ID NO: 245009 - DNA, 12 bp, Homo sapiens
ataattctgtaa

SEQ ID NO: 245010 - DNA, 13 bp, Homo sapiens
ataattctgtaaa

SEQ ID NO: 245011 - DNA, 20 bp, Homo sapiens
ataattgactggtggaagga

SEQ ID NO: 245012 - DNA, 16 bp, Homo sapiens
ataattgcaagggaag

SEQ ID NO: 245013 - DNA, 17 bp, Homo sapiens
ataattgcaagggaaga

SEQ ID NO: 245014 - DNA, 12 bp, Homo sapiens
ataattgtgtac

SEQ ID NO: 245015 - DNA, 17 bp, Homo sapiens
ataattgtgtacaaagt

SEQ ID NO: 245016 - DNA, 13 bp, Homo sapiens
ataatttaaccct

SEQ ID NO: 245017 - DNA, 23 bp, Homo sapiens
ataatttaagccaataaataata

SEQ ID NO: 245018 - DNA, 15 bp, Homo sapiens
ataatttctacccat

SEQ ID NO: 245019 - DNA, 11 bp, Homo sapiens
ataatttgcat

SEQ ID NO: 245020 - DNA, 21 bp, Homo sapiens
ataattttaagaaatcaaaga

SEQ ID NO: 245021 - DNA, 14 bp, Homo sapiens
ataattttacatgt

SEQ ID NO: 245022 - DNA, 15 bp, Homo sapiens
ataattttacatgtc

SEQ ID NO: 245023 - DNA, 17 bp, Homo sapiens
ataattttattgctgga

SEQ ID NO: 245024 - DNA, 20 bp, Homo sapiens
ataattttggtccaaattct

SEQ ID NO: 245025 - DNA, 23 bp, Homo sapiens
ataatttttatatttaattatta

SEQ ID NO: 245026 - DNA, 16 bp, Homo sapiens
ataattttttattcaa

SEQ ID NO: 245027 - DNA, 20 bp, Homo sapiens
ataatttttttcaatattta

SEQ ID NO: 245028 - DNA, 22 bp, Homo sapiens
ataatttttttcaatatttatt

SEQ ID NO: 245029 - DNA, 15 bp, Homo sapiens
atacaaaaatatatt

SEQ ID NO: 245030 - DNA, 21 bp, Homo sapiens
atacaaaaatatattaaaaat

SEQ ID NO: 245031 - DNA, 12 bp, Homo sapiens
atacaaacaggt

SEQ ID NO: 245032 - DNA, 17 bp, Homo sapiens
atacaacaatcccagca

SEQ ID NO: 245033 - DNA, 16 bp, Homo sapiens
atacaacttaaataat

SEQ ID NO: 245034 - DNA, 17 bp, Homo sapiens
atacaactttggaattt

SEQ ID NO: 245035 - DNA, 20 bp, Homo sapiens
atacaaggagggcctctggt

SEQ ID NO: 245036 - DNA, 15 bp, Homo sapiens
atacaatcagctgct

SEQ ID NO: 245037 - DNA, 13 bp, Homo sapiens
atacaattaaagg

SEQ ID NO: 245038 - DNA, 16 bp, Homo sapiens
atacaattaaaggtcc

SEQ ID NO: 245039 - DNA, 22 bp, Homo sapiens
atacaattaaaggtcctgccct

SEQ ID NO: 245040 - DNA, 23 bp, Homo sapiens
atacaattcagttttagtttcaa

SEQ ID NO: 245041 - DNA, 15 bp, Homo sapiens
atacaattctacatt

SEQ ID NO: 245042 - DNA, 19 bp, Homo sapiens
atacacccagttctgaata

SEQ ID NO: 245043 - DNA, 17 bp, Homo sapiens
atacactaatagtaaga

SEQ ID NO: 245044 - DNA, 13 bp, Homo sapiens
atacactcctgct

SEQ ID NO: 245045 - DNA, 13 bp, Homo sapiens
atacacttacact

SEQ ID NO: 245046 - DNA, 14 bp, Homo sapiens
atacagacactaag

SEQ ID NO: 245047 - DNA, 13 bp, Homo sapiens
atacagacctaat

SEQ ID NO: 245048 - DNA, 20 bp, Homo sapiens
atacagacctaatatcattt

SEQ ID NO: 245049 - DNA, 15 bp, Homo sapiens
atacagatgaaaatt

SEQ ID NO: 245050 - DNA, 16 bp, Homo sapiens
atacagatgaaaattt

SEQ ID NO: 245051 - DNA, 20 bp, Homo sapiens
atacagatgaaaatttgaga

SEQ ID NO: 245052 - DNA, 18 bp, Homo sapiens
atacagccttacaataca

SEQ ID NO: 245053 - DNA, 19 bp, Homo sapiens
atacagtaagctgctctat

SEQ ID NO: 245054 - DNA, 16 bp, Homo sapiens
atacagtacagtggtt

SEQ ID NO: 245055 - DNA, 18 bp, Homo sapiens
atacagtccctaaagaaa

SEQ ID NO: 245056 - DNA, 20 bp, Homo sapiens
atacagtccctaaagaaaaa

SEQ ID NO: 245057 - DNA, 14 bp, Homo sapiens
atacagtgctttat

SEQ ID NO: 245058 - DNA, 22 bp, Homo sapiens
atacagttaggcaccagaagaa

SEQ ID NO: 245059 - DNA, 19 bp, Homo sapiens
atacagttcaataaactta

SEQ ID NO: 245060 - DNA, 15 bp, Homo sapiens
atacagtttttgtaa

SEQ ID NO: 245061 - DNA, 16 bp, Homo sapiens
atacataagttaatat

SEQ ID NO: 245062 - DNA, 20 bp, Homo sapiens
atacataagttaatattgga

SEQ ID NO: 245063 - DNA, 14 bp, Homo sapiens
atacatatacacaa

SEQ ID NO: 245064 - DNA, 13 bp, Homo sapiens
atacatgaatcat

SEQ ID NO: 245065 - DNA, 16 bp, Homo sapiens
atacatgatgatttca

SEQ ID NO: 245066 - DNA, 24 bp, Homo sapiens
atacatgggtagcttctgacctca

SEQ ID NO: 245067 - DNA, 16 bp, Homo sapiens
atacatggtagcaggg

SEQ ID NO: 245068 - DNA, 14 bp, Homo sapiens
atacatggttgtga

SEQ ID NO: 245069 - DNA, 16 bp, Homo sapiens
atacatggtttaaagt

SEQ ID NO: 245070 - DNA, 15 bp, Homo sapiens
atacatgtgtggatg

SEQ ID NO: 245071 - DNA, 20 bp, Homo sapiens
atataatggtttactgctgt

SEQ ID NO: 245072 - DNA, 14 bp, Homo sapiens
atataattatcgga

SEQ ID NO: 245073 - DNA, 12 bp, Homo sapiens
atataattctgt

SEQ ID NO: 245074 - DNA, 19 bp, Homo sapiens
atataattttcacttctgt

SEQ ID NO: 245075 - DNA, 14 bp, Homo sapiens
atatacaaataaac

SEQ ID NO: 245076 - DNA, 22 bp, Homo sapiens
atatacaactttggaatttgaa

SEQ ID NO: 245077 - DNA, 13 bp, Homo sapiens
atatacagatgaa

SEQ ID NO: 245078 - DNA, 16 bp, Homo sapiens
atatacagatgaaaat

SEQ ID NO: 245079 - DNA, 13 bp, Homo sapiens
atatacatataca

SEQ ID NO: 245080 - DNA, 17 bp, Homo sapiens
atatacatctagcacag

SEQ ID NO: 245081 - DNA, 18 bp, Homo sapiens
atatacattcaaacttaa

SEQ ID NO: 245082 - DNA, 12 bp, Homo sapiens
atatacatttca

SEQ ID NO: 245083 - DNA, 19 bp, Homo sapiens
atatacctggcttttactt

SEQ ID NO: 245084 - DNA, 16 bp, Homo sapiens
atatactaaccatttc

SEQ ID NO: 245085 - DNA, 12 bp, Homo sapiens
atatactaataa

SEQ ID NO: 245086 - DNA, 16 bp, Homo sapiens
atatactaataaaaag

SEQ ID NO: 245087 - DNA, 14 bp, Homo sapiens
atatactgcatatc

SEQ ID NO: 245088 - DNA, 18 bp, Homo sapiens
atatactgggttcttgtt

SEQ ID NO: 245089 - DNA, 17 bp, Homo sapiens
atatagacctatgataa

SEQ ID NO: 245090 - DNA, 14 bp, Homo sapiens
atatagagatgttt

SEQ ID NO: 245091 - DNA, 15 bp, Homo sapiens
atatagagatgtttt

SEQ ID NO: 245092 - DNA, 19 bp, Homo sapiens
atatagccctttccccact

SEQ ID NO: 245093 - DNA, 23 bp, Homo sapiens
atatagctctacacaacatgtat

SEQ ID NO: 245094 - DNA, 19 bp, Homo sapiens
atataggattatagatact

SEQ ID NO: 245095 - DNA, 14 bp, Homo sapiens
atatagggtttgtt

SEQ ID NO: 245096 - DNA, 22 bp, Homo sapiens
atataggttgtgcaaattaaca

SEQ ID NO: 245097 - DNA, 17 bp, Homo sapiens
atatagtacctttgctc

SEQ ID NO: 245098 - DNA, 23 bp, Homo sapiens
atatagttgaacaagatttccct

SEQ ID NO: 245099 - DNA, 22 bp, Homo sapiens
atatagttgtctttctttgctg

SEQ ID NO: 245100 - DNA, 14 bp, Homo sapiens
atatataaaataaa

SEQ ID NO: 245101 - DNA, 15 bp, Homo sapiens
atatataaaataaat

SEQ ID NO: 245102 - DNA, 17 bp, Homo sapiens
atatataaaataaatat

SEQ ID NO: 245103 - DNA, 15 bp, Homo sapiens
atatataaatatcta

SEQ ID NO: 245104 - DNA, 17 bp, Homo sapiens
atatataataaatggga

SEQ ID NO: 245105 - DNA, 20 bp, Homo sapiens
atatataataaatgggaaat

SEQ ID NO: 245106 - DNA, 13 bp, Homo sapiens
atatatacatgta

SEQ ID NO: 245107 - DNA, 16 bp, Homo sapiens
atatatatgccatgat

SEQ ID NO: 245108 - DNA, 20 bp, Homo sapiens
atatatatgtgtgtgtatgt

SEQ ID NO: 245109 - DNA, 14 bp, Homo sapiens
atatatattgcata

SEQ ID NO: 245110 - DNA, 16 bp, Homo sapiens
atatatctttatactt

SEQ ID NO: 245111 - DNA, 19 bp, Homo sapiens
atatatgaaaactaagttc

SEQ ID NO: 245112 - DNA, 22 bp, Homo sapiens
atatatgaaaggcttctgggac

SEQ ID NO: 245113 - DNA, 17 bp, Homo sapiens
atatatgaagtaagttc

SEQ ID NO: 245114 - DNA, 18 bp, Homo sapiens
atatatgaataattatgt

SEQ ID NO: 245115 - DNA, 15 bp, Homo sapiens
atatatgtatgtaaa

SEQ ID NO: 245116 - DNA, 16 bp, Homo sapiens
atatatgtatgtaaaa

SEQ ID NO: 245117 - DNA, 12 bp, Homo sapiens
atatatgtattt

SEQ ID NO: 245118 - DNA, 16 bp, Homo sapiens
atatatgtgtgtttaa

SEQ ID NO: 245119 - DNA, 23 bp, Homo sapiens
atatatgtgtgtttaaataaagt

SEQ ID NO: 245120 - DNA, 10 bp, Homo sapiens
atatatgttt

SEQ ID NO: 245121 - DNA, 11 bp, Homo sapiens
atatatgtttt

SEQ ID NO: 245122 - DNA, 13 bp, Homo sapiens
atatatgttttaa

SEQ ID NO: 245123 - DNA, 14 bp, Homo sapiens
atatatgttttgag

SEQ ID NO: 245124 - DNA, 20 bp, Homo sapiens
atatattctggctgataaaa

SEQ ID NO: 245125 - DNA, 14 bp, Homo sapiens
atatattcttataa

SEQ ID NO: 245126 - DNA, 12 bp, Homo sapiens
atatattgcata

SEQ ID NO: 245127 - DNA, 23 bp, Homo sapiens
atatattgccagtatataagctg

SEQ ID NO: 245128 - DNA, 10 bp, Homo sapiens
atatatttat

SEQ ID NO: 245129 - DNA, 12 bp, Homo sapiens
atatatttataa

SEQ ID NO: 245130 - DNA, 13 bp, Homo sapiens
atatatttataac

SEQ ID NO: 245131 - DNA, 14 bp, Homo sapiens
atatatttataact

SEQ ID NO: 245132 - DNA, 16 bp, Homo sapiens
atatatttataactca

SEQ ID NO: 245133 - DNA, 14 bp, Homo sapiens
atatatttctttgt

SEQ ID NO: 245134 - DNA, 14 bp, Homo sapiens
atatatttgaaaga

SEQ ID NO: 245135 - DNA, 16 bp, Homo sapiens
atatattttattttca

SEQ ID NO: 245136 - DNA, 13 bp, Homo sapiens
atatattttgaaa

SEQ ID NO: 245137 - DNA, 18 bp, Homo sapiens
atatattttgaaaggaga

SEQ ID NO: 245138 - DNA, 16 bp, Homo sapiens
atatcaacaacaagtt

SEQ ID NO: 245139 - DNA, 18 bp, Homo sapiens
atatcaacaacaagttgt

SEQ ID NO: 245140 - DNA, 21 bp, Homo sapiens
atatcaacagatagttgtgtt

SEQ ID NO: 245141 - DNA, 21 bp, Homo sapiens
atatcaagaagtcagagaaaa

SEQ ID NO: 245142 - DNA, 14 bp, Homo sapiens
atatcaaggatgtt

SEQ ID NO: 245143 - DNA, 18 bp, Homo sapiens
atatcaagtcccgaggca

SEQ ID NO: 245144 - DNA, 17 bp, Homo sapiens
atatcagaaaagggaag

SEQ ID NO: 245145 - DNA, 15 bp, Homo sapiens
atatcagacctctga

SEQ ID NO: 245146 - DNA, 19 bp, Homo sapiens
atatcagcagacactccag

SEQ ID NO: 245147 - DNA, 12 bp, Homo sapiens
atatcagcctga

SEQ ID NO: 245148 - DNA, 16 bp, Homo sapiens
atatcataatgtaatg

SEQ ID NO: 245149 - DNA, 22 bp, Homo sapiens
atatcatatgtatctaaatgaa

SEQ ID NO: 245150 - DNA, 16 bp, Homo sapiens
atatcatgaagccttg

SEQ ID NO: 245151 - DNA, 17 bp, Homo sapiens
atatcattatagcatgt

SEQ ID NO: 245152 - DNA, 14 bp, Homo sapiens
atatcattcagcaa

SEQ ID NO: 245153 - DNA, 20 bp, Homo sapiens
atatcattctttgtatctta

SEQ ID NO: 245154 - DNA, 21 bp, Homo sapiens
atatcattctttgtatcttaa

SEQ ID NO: 245155 - DNA, 21 bp, Homo sapiens
atatcatttattttttacatt

SEQ ID NO: 245156 - DNA, 18 bp, Homo sapiens
atatcatttcataaaaat

SEQ ID NO: 245157 - DNA, 13 bp, Homo sapiens
atatcattttatt

SEQ ID NO: 245158 - DNA, 17 bp, Homo sapiens
atatcattttattcaca

SEQ ID NO: 245159 - DNA, 15 bp, Homo sapiens
atatccaaagactgt

SEQ ID NO: 245160 - DNA, 16 bp, Homo sapiens
atatccaaagactgta

SEQ ID NO: 245161 - DNA, 20 bp, Homo sapiens
atatccacctacctattcat

SEQ ID NO: 245162 - DNA, 12 bp, Homo sapiens
atatccatgtac

SEQ ID NO: 245163 - DNA, 17 bp, Homo sapiens
atatccatgtactgtag

SEQ ID NO: 245164 - DNA, 18 bp, Homo sapiens
atatccatgtactgtagt

SEQ ID NO: 245165 - DNA, 20 bp, Homo sapiens
atatccctatgtcccagccc

SEQ ID NO: 245166 - DNA, 14 bp, Homo sapiens
atatcctatactgg

SEQ ID NO: 245167 - DNA, 16 bp, Homo sapiens
atatcctatactggtt

SEQ ID NO: 245168 - DNA, 15 bp, Homo sapiens
atatcctccgccctt

SEQ ID NO: 245169 - DNA, 15 bp, Homo sapiens
atatcctgagccatc

SEQ ID NO: 245170 - DNA, 15 bp, Homo sapiens
atatcctttctaaca

SEQ ID NO: 245171 - DNA, 16 bp, Homo sapiens
atatcctttctaacaa

SEQ ID NO: 245172 - DNA, 23 bp, Homo sapiens
atatctatttatctgtctgagcc

SEQ ID NO: 245173 - DNA, 15 bp, Homo sapiens
atatctctagtccct

SEQ ID NO: 245174 - DNA, 13 bp, Homo sapiens
atatctgctgtat

SEQ ID NO: 245175 - DNA, 16 bp, Homo sapiens
atatctgctgtatgtc

SEQ ID NO: 245176 - DNA, 17 bp, Homo sapiens
atatctgggattctact

SEQ ID NO: 245177 - DNA, 21 bp, Homo sapiens
atatctgtaaatttaactgca

SEQ ID NO: 245178 - DNA, 17 bp, Homo sapiens
atatctgtttgcttcta

SEQ ID NO: 245179 - DNA, 16 bp, Homo sapiens
atatcttaaagaaaca

SEQ ID NO: 245180 - DNA, 12 bp, Homo sapiens
atatcttgaaga

SEQ ID NO: 245181 - DNA, 13 bp, Homo sapiens
atatcttgaagaa

SEQ ID NO: 245182 - DNA, 15 bp, Homo sapiens
atatcttgaagaata

SEQ ID NO: 245183 - DNA, 17 bp, Homo sapiens
atatctttaaataaatg

SEQ ID NO: 245184 - DNA, 19 bp, Homo sapiens
atatctttaaataaatgtg

SEQ ID NO: 245185 - DNA, 20 bp, Homo sapiens
atatctttaataagtaatct

SEQ ID NO: 245186 - DNA, 15 bp, Homo sapiens
atatctttatactta

SEQ ID NO: 245187 - DNA, 20 bp, Homo sapiens
atatctttatacttaaacag

SEQ ID NO: 245188 - DNA, 20 bp, Homo sapiens
atatgaacagggcccaggcc

SEQ ID NO: 245189 - DNA, 22 bp, Homo sapiens
atatgaacagggcccaggcctg

SEQ ID NO: 245190 - DNA, 17 bp, Homo sapiens
atatgaacttaacatgc

SEQ ID NO: 245191 - DNA, 22 bp, Homo sapiens
atatgaatacagggcatgcatt

SEQ ID NO: 245192 - DNA, 22 bp, Homo sapiens
atatgacaatttcaaaatgcat

SEQ ID NO: 245193 - DNA, 19 bp, Homo sapiens
atatgacttcttgttcatg

SEQ ID NO: 245194 - DNA, 13 bp, Homo sapiens
atatgagagggat

SEQ ID NO: 245195 - DNA, 14 bp, Homo sapiens
atatgagattggaa

SEQ ID NO: 245196 - DNA, 22 bp, Homo sapiens
atatgagattggaaaaaattag

SEQ ID NO: 245197 - DNA, 18 bp, Homo sapiens
atatgaggggactgcatg

SEQ ID NO: 245198 - DNA, 19 bp, Homo sapiens
atatgaggggactgcatgc

SEQ ID NO: 245199 - DNA, 16 bp, Homo sapiens
atatgagtatctttaa

SEQ ID NO: 245200 - DNA, 17 bp, Homo sapiens
atatgagttactgaagg

SEQ ID NO: 245201 - DNA, 20 bp, Homo sapiens
atatgatgtttaaaagcata

SEQ ID NO: 245202 - DNA, 19 bp, Homo sapiens
atatgattctcctctccca

SEQ ID NO: 245203 - DNA, 16 bp, Homo sapiens
taacctttaagtctta

SEQ ID NO: 245204 - DNA, 17 bp, Homo sapiens
taacctttttgtaaata

SEQ ID NO: 245205 - DNA, 17 bp, Homo sapiens
taacgcaggagagagag

SEQ ID NO: 245206 - DNA, 19 bp, Homo sapiens
taactaatctattgggttc

SEQ ID NO: 245207 - DNA, 22 bp, Homo sapiens
taactaatctattgggttcatt

SEQ ID NO: 245208 - DNA, 17 bp, Homo sapiens
taactaccctacacctc

SEQ ID NO: 245209 - DNA, 14 bp, Homo sapiens
taactactaagaat

SEQ ID NO: 245210 - DNA, 17 bp, Homo sapiens
taactactgcaaaaagt

SEQ ID NO: 245211 - DNA, 14 bp, Homo sapiens
taactactgtgttc

SEQ ID NO: 245212 - DNA, 17 bp, Homo sapiens
taactagaatttattca

SEQ ID NO: 245213 - DNA, 18 bp, Homo sapiens
taactagaatttattcaa

SEQ ID NO: 245214 - DNA, 13 bp, Homo sapiens
taactagatctcc

SEQ ID NO: 245215 - DNA, 17 bp, Homo sapiens
taactagatctcctgta

SEQ ID NO: 245216 - DNA, 19 bp, Homo sapiens
taactagatggtgctgaga

SEQ ID NO: 245217 - DNA, 17 bp, Homo sapiens
taactcagacattccaa

SEQ ID NO: 245218 - DNA, 13 bp, Homo sapiens
taactcagatcac

SEQ ID NO: 245219 - DNA, 14 bp, Homo sapiens
taactcagatcact

SEQ ID NO: 245220 - DNA, 20 bp, Homo sapiens
taactcagatcactactgca

SEQ ID NO: 245221 - DNA, 14 bp, Homo sapiens
taactcatcataaa

SEQ ID NO: 245222 - DNA, 21 bp, Homo sapiens
taactcatggcaggcatctgt

SEQ ID NO: 245223 - DNA, 14 bp, Homo sapiens
taactccttcttgt

SEQ ID NO: 245224 - DNA, 16 bp, Homo sapiens
taactctgcatagaca

SEQ ID NO: 245225 - DNA, 14 bp, Homo sapiens
taactcttgctcac

SEQ ID NO: 245226 - DNA, 22 bp, Homo sapiens
taactcttgctcactccctaaa

SEQ ID NO: 245227 - DNA, 14 bp, Homo sapiens
taactcttgtctat

SEQ ID NO: 245228 - DNA, 22 bp, Homo sapiens
taactgactattcttgatgtaa

SEQ ID NO: 245229 - DNA, 15 bp, Homo sapiens
taactgacttagttc

SEQ ID NO: 245230 - DNA, 18 bp, Homo sapiens
taactgacttagttcttc

SEQ ID NO: 245231 - DNA, 13 bp, Homo sapiens
taactgagagaag

SEQ ID NO: 245232 - DNA, 17 bp, Homo sapiens
taactgcatatagataa

SEQ ID NO: 245233 - DNA, 18 bp, Homo sapiens
taactgccagccttggag

SEQ ID NO: 245234 - DNA, 21 bp, Homo sapiens
taactgcccaaagcagcactt

SEQ ID NO: 245235 - DNA, 19 bp, Homo sapiens
taactgcccttttaaatgg

SEQ ID NO: 245236 - DNA, 21 bp, Homo sapiens
taactgcccttttaaatggca

SEQ ID NO: 245237 - DNA, 22 bp, Homo sapiens
taactgcccttttaaatggcat

SEQ ID NO: 245238 - DNA, 17 bp, Homo sapiens
taactgtgaagtttaca

SEQ ID NO: 245239 - DNA, 18 bp, Homo sapiens
taactgtgaagtttacat

SEQ ID NO: 245240 - DNA, 13 bp, Homo sapiens
taactgtgtatgt

SEQ ID NO: 245241 - DNA, 14 bp, Homo sapiens
taactgtgtatgta

SEQ ID NO: 245242 - DNA, 19 bp, Homo sapiens
taactgtgtatgtacatat

SEQ ID NO: 245243 - DNA, 20 bp, Homo sapiens
taactgtgtatgtacatata

SEQ ID NO: 245244 - DNA, 17 bp, Homo sapiens
taactgtgtgaagaaat

SEQ ID NO: 245245 - DNA, 19 bp, Homo sapiens
taactgttagtattaacta

SEQ ID NO: 245246 - DNA, 17 bp, Homo sapiens
taacttaaaaatgtaaa

SEQ ID NO: 245247 - DNA, 20 bp, Homo sapiens
taacttaaaaatgtaaatat

SEQ ID NO: 245248 - DNA, 21 bp, Homo sapiens
taacttaaaaatgtaaatatt

SEQ ID NO: 245249 - DNA, 23 bp, Homo sapiens
taacttaaaaatgtaaatattct

SEQ ID NO: 245250 - DNA, 17 bp, Homo sapiens
taacttagtattttacc

SEQ ID NO: 245251 - DNA, 21 bp, Homo sapiens
taacttattgcctgggcagtg

SEQ ID NO: 245252 - DNA, 14 bp, Homo sapiens
taacttcagagaag

SEQ ID NO: 245253 - DNA, 15 bp, Homo sapiens
taacttcagagaagt

SEQ ID NO: 245254 - DNA, 13 bp, Homo sapiens
taacttcataaaa

SEQ ID NO: 245255 - DNA, 17 bp, Homo sapiens
taacttccaatttacat

SEQ ID NO: 245256 - DNA, 21 bp, Homo sapiens
taacttgagttttatttattt

SEQ ID NO: 245257 - DNA, 23 bp, Homo sapiens
taacttgatggcttaaaaatact

SEQ ID NO: 245258 - DNA, 13 bp, Homo sapiens
taacttgctgtga

SEQ ID NO: 245259 - DNA, 16 bp, Homo sapiens
taacttgctgtgaaat

SEQ ID NO: 245260 - DNA, 23 bp, Homo sapiens
taacttggagagggacgaagaaa

SEQ ID NO: 245261 - DNA, 14 bp, Homo sapiens
taacttggggaggc

SEQ ID NO: 245262 - DNA, 21 bp, Homo sapiens
taactttatcacattatttgc

SEQ ID NO: 245263 - DNA, 23 bp, Homo sapiens
taactttcagaagagatgggctt

SEQ ID NO: 245264 - DNA, 18 bp, Homo sapiens
taactttgcatgttcttg

SEQ ID NO: 245265 - DNA, 24 bp, Homo sapiens
taactttgcccttcactgttgctt

SEQ ID NO: 245266 - DNA, 20 bp, Homo sapiens
taacttttgtaaatacacat

SEQ ID NO: 245267 - DNA, 22 bp, Homo sapiens
taagaaaaaaataattttatga

SEQ ID NO: 245268 - DNA, 12 bp, Homo sapiens
taagaaaaacat

SEQ ID NO: 245269 - DNA, 13 bp, Homo sapiens
taagaaaaacatg

SEQ ID NO: 245270 - DNA, 17 bp, Homo sapiens
taagaaacaatttaaat

SEQ ID NO: 245271 - DNA, 16 bp, Homo sapiens
taagaaacagagcagt

SEQ ID NO: 245272 - DNA, 16 bp, Homo sapiens
taagaaagctatatat

SEQ ID NO: 245273 - DNA, 15 bp, Homo sapiens
taagaaagtgaagca

SEQ ID NO: 245274 - DNA, 22 bp, Homo sapiens
taagaaagtgaagcaaatcaga

SEQ ID NO: 245275 - DNA, 19 bp, Homo sapiens
taagaaatcaaagagagaa

SEQ ID NO: 245276 - DNA, 18 bp, Homo sapiens
taagaaatggctttccac

SEQ ID NO: 245277 - DNA, 22 bp, Homo sapiens
taagaactttgcacacttcaaa

SEQ ID NO: 245278 - DNA, 14 bp, Homo sapiens
taagaagacatgaa

SEQ ID NO: 245279 - DNA, 15 bp, Homo sapiens
taagaagacatgaac

SEQ ID NO: 245280 - DNA, 12 bp, Homo sapiens
taagaagagact

SEQ ID NO: 245281 - DNA, 21 bp, Homo sapiens
taagaataaataaagaagaaa

SEQ ID NO: 245282 - DNA, 23 bp, Homo sapiens
taagaataatgacgtattgtgaa

SEQ ID NO: 245283 - DNA, 17 bp, Homo sapiens
taagaatagttctaaaa

SEQ ID NO: 245284 - DNA, 22 bp, Homo sapiens
taagaatgcagattcctgggcc

SEQ ID NO: 245285 - DNA, 23 bp, Homo sapiens
taagaatgcagattcctgggcct

SEQ ID NO: 245286 - DNA, 23 bp, Homo sapiens
taagaatgctggttttcctaaat

SEQ ID NO: 245287 - DNA, 19 bp, Homo sapiens
taagaattcccagatagtc

SEQ ID NO: 245288 - DNA, 21 bp, Homo sapiens
taagaattgtttttgaattta

SEQ ID NO: 245289 - DNA, 17 bp, Homo sapiens
taagaatttattattaa

SEQ ID NO: 245290 - DNA, 15 bp, Homo sapiens
taagacaaatgggac

SEQ ID NO: 245291 - DNA, 20 bp, Homo sapiens
taagacaaatgggactgatg

SEQ ID NO: 245292 - DNA, 21 bp, Homo sapiens
taagacaaatgggactgatgt

SEQ ID NO: 245293 - DNA, 15 bp, Homo sapiens
taagacaacaggcat

SEQ ID NO: 245294 - DNA, 13 bp, Homo sapiens
taagacacacagc

SEQ ID NO: 245295 - DNA, 17 bp, Homo sapiens
taagacacacagccttt

SEQ ID NO: 245296 - DNA, 20 bp, Homo sapiens
taagacacacagcctttctg

SEQ ID NO: 245297 - DNA, 22 bp, Homo sapiens
taagacacacagcctttctgta

SEQ ID NO: 245298 - DNA, 23 bp, Homo sapiens
taagacacacagcctttctgtat

SEQ ID NO: 245299 - DNA, 16 bp, Homo sapiens
taagacatatctctaa

SEQ ID NO: 245300 - DNA, 16 bp, Homo sapiens
taagaccggaagctcc

SEQ ID NO: 245301 - DNA, 16 bp, Homo sapiens
taagaccgtgtcccaa

SEQ ID NO: 245302 - DNA, 19 bp, Homo sapiens
taagaccgtgtcccaagga

SEQ ID NO: 245303 - DNA, 22 bp, Homo sapiens
taagaccgtgtcccaaggagct

SEQ ID NO: 245304 - DNA, 17 bp, Homo sapiens
taagactaaatctgtaa

SEQ ID NO: 245305 - DNA, 18 bp, Homo sapiens
taagactaaatctgtaag

SEQ ID NO: 245306 - DNA, 18 bp, Homo sapiens
taagacttgtttctttct

SEQ ID NO: 245307 - DNA, 13 bp, Homo sapiens
taagagaaagaaa

SEQ ID NO: 245308 - DNA, 15 bp, Homo sapiens
taagagaaatgagct

SEQ ID NO: 245309 - DNA, 16 bp, Homo sapiens
taagagagagagcctt

SEQ ID NO: 245310 - DNA, 15 bp, Homo sapiens
taagagcaccttcct

SEQ ID NO: 245311 - DNA, 20 bp, Homo sapiens
taagagcaccttcctcactt

SEQ ID NO: 245312 - DNA, 17 bp, Homo sapiens
taagagcagagtctccc

SEQ ID NO: 245313 - DNA, 14 bp, Homo sapiens
taagagctggtgtc

SEQ ID NO: 245314 - DNA, 20 bp, Homo sapiens
taagataattaaatgaaata

SEQ ID NO: 245315 - DNA, 23 bp, Homo sapiens
taagatacaagtttcagacaggg

SEQ ID NO: 245316 - DNA, 16 bp, Homo sapiens
taagatacactcctgc

SEQ ID NO: 245317 - DNA, 19 bp, Homo sapiens
taagatacactcctgctgt

SEQ ID NO: 245318 - DNA, 21 bp, Homo sapiens
taagatacactcctgctgtgc

SEQ ID NO: 245319 - DNA, 22 bp, Homo sapiens
taagatacttagattagaccta

SEQ ID NO: 245320 - DNA, 18 bp, Homo sapiens
taagatattctttacaaa

SEQ ID NO: 245321 - DNA, 23 bp, Homo sapiens
taagatattctttacaaactgaa

SEQ ID NO: 245322 - DNA, 18 bp, Homo sapiens
taagatcgttctctgcct

SEQ ID NO: 245323 - DNA, 12 bp, Homo sapiens
taagatgaaatt

SEQ ID NO: 245324 - DNA, 18 bp, Homo sapiens
taagatgaggaaataatg

SEQ ID NO: 245325 - DNA, 20 bp, Homo sapiens
taagatgccagcatatactg

SEQ ID NO: 245326 - DNA, 17 bp, Homo sapiens
taagatggattctcaga

SEQ ID NO: 245327 - DNA, 22 bp, Homo sapiens
taagatggattctcagatattt

SEQ ID NO: 245328 - DNA, 14 bp, Homo sapiens
taagattaaattat

SEQ ID NO: 245329 - DNA, 22 bp, Homo sapiens
taagattaaattatatctgagg

SEQ ID NO: 245330 - DNA, 21 bp, Homo sapiens
taagattccattttggaaaat

SEQ ID NO: 245331 - DNA, 13 bp, Homo sapiens
taagattcttggt

SEQ ID NO: 245332 - DNA, 16 bp, Homo sapiens
taataaatgaccagtt

SEQ ID NO: 245333 - DNA, 14 bp, Homo sapiens
taataaatgggaaa

SEQ ID NO: 245334 - DNA, 17 bp, Homo sapiens
taataaatgtacattaa

SEQ ID NO: 245335 - DNA, 11 bp, Homo sapiens
taataaattaa

SEQ ID NO: 245336 - DNA, 17 bp, Homo sapiens
taataaattgaaattgt

SEQ ID NO: 245337 - DNA, 15 bp, Homo sapiens
taataactagatctc

SEQ ID NO: 245338 - DNA, 19 bp, Homo sapiens
taataactagatctcctgt

SEQ ID NO: 245339 - DNA, 20 bp, Homo sapiens
taataactagatctcctgta

SEQ ID NO: 245340 - DNA, 21 bp, Homo sapiens
taataactagatctcctgtaa

SEQ ID NO: 245341 - DNA, 21 bp, Homo sapiens
taataactgtgaagtttacat

SEQ ID NO: 245342 - DNA, 18 bp, Homo sapiens
taataatttttgctgaat

SEQ ID NO: 245343 - DNA, 19 bp, Homo sapiens
taataatttttgctgaatt

SEQ ID NO: 245344 - DNA, 13 bp, Homo sapiens
taatacagatgta

SEQ ID NO: 245345 - DNA, 23 bp, Homo sapiens
taatacagcagtgtcatcagaag

SEQ ID NO: 245346 - DNA, 19 bp, Homo sapiens
taatacattccatcacagc

SEQ ID NO: 245347 - DNA, 23 bp, Homo sapiens
taatacattccatcacagccagc

SEQ ID NO: 245348 - DNA, 16 bp, Homo sapiens
taatacctttaaatat

SEQ ID NO: 245349 - DNA, 22 bp, Homo sapiens
taatacctttaaatatcattct

SEQ ID NO: 245350 - DNA, 14 bp, Homo sapiens
taatactaatttat

SEQ ID NO: 245351 - DNA, 21 bp, Homo sapiens
taatactgaatttctttgatt

SEQ ID NO: 245352 - DNA, 19 bp, Homo sapiens
taatactggttatcctgtg

SEQ ID NO: 245353 - DNA, 14 bp, Homo sapiens
taatacttaaaaat

SEQ ID NO: 245354 - DNA, 20 bp, Homo sapiens
taatacttaaaaatatgtga

SEQ ID NO: 245355 - DNA, 18 bp, Homo sapiens
taatagaaaactgaaaat

SEQ ID NO: 245356 - DNA, 14 bp, Homo sapiens
taatagaaatgcat

SEQ ID NO: 245357 - DNA, 21 bp, Homo sapiens
taatagaatataattatcgga

SEQ ID NO: 245358 - DNA, 21 bp, Homo sapiens
taatagaatatactgtcttgt

SEQ ID NO: 245359 - DNA, 19 bp, Homo sapiens
taatagaatttcctaatga

SEQ ID NO: 245360 - DNA, 20 bp, Homo sapiens
taatagagtacttaatatac

SEQ ID NO: 245361 - DNA, 14 bp, Homo sapiens
taatagcctcacct

SEQ ID NO: 245362 - DNA, 19 bp, Homo sapiens
taatagcgggttactttca

SEQ ID NO: 245363 - DNA, 15 bp, Homo sapiens
taatagctgaacctg

SEQ ID NO: 245364 - DNA, 20 bp, Homo sapiens
taataggaaagatttaatgt

SEQ ID NO: 245365 - DNA, 17 bp, Homo sapiens
taataggaagaacagta

SEQ ID NO: 245366 - DNA, 15 bp, Homo sapiens
taatagttagccctc

SEQ ID NO: 245367 - DNA, 19 bp, Homo sapiens
taatagttagccctcagtc

SEQ ID NO: 245368 - DNA, 19 bp, Homo sapiens
taatagtttacatgtagta

SEQ ID NO: 245369 - DNA, 23 bp, Homo sapiens
taatataacaatatatgatatat

SEQ ID NO: 245370 - DNA, 16 bp, Homo sapiens
taatatactatattta

SEQ ID NO: 245371 - DNA, 14 bp, Homo sapiens
taatatagggtttg

SEQ ID NO: 245372 - DNA, 17 bp, Homo sapiens
taatatatcccagaaat

SEQ ID NO: 245373 - DNA, 22 bp, Homo sapiens
taatatatttttatatttagtt

SEQ ID NO: 245374 - DNA, 15 bp, Homo sapiens
taatatcatttcata

SEQ ID NO: 245375 - DNA, 16 bp, Homo sapiens
taatatctgactgaaa

SEQ ID NO: 245376 - DNA, 12 bp, Homo sapiens
taatatcttgaa

SEQ ID NO: 245377 - DNA, 14 bp, Homo sapiens
taatatcttgaaga

SEQ ID NO: 245378 - DNA, 22 bp, Homo sapiens
taatatcttgaagaatattgtt

SEQ ID NO: 245379 - DNA, 16 bp, Homo sapiens
taatatctttaaatga

SEQ ID NO: 245380 - DNA, 15 bp, Homo sapiens
taatatgggcattgt

SEQ ID NO: 245381 - DNA, 19 bp, Homo sapiens
taatatgggcattgtagtt

SEQ ID NO: 245382 - DNA, 17 bp, Homo sapiens
taatatgtttgaggtta

SEQ ID NO: 245383 - DNA, 18 bp, Homo sapiens
taatattaaaaatatgga

SEQ ID NO: 245384 - DNA, 22 bp, Homo sapiens
taatattaaaaatatggaactt

SEQ ID NO: 245385 - DNA, 19 bp, Homo sapiens
taatattaatttatatttg

SEQ ID NO: 245386 - DNA, 21 bp, Homo sapiens
taatattactgtctttattct

SEQ ID NO: 245387 - DNA, 14 bp, Homo sapiens
taatattatattgt

SEQ ID NO: 245388 - DNA, 14 bp, Homo sapiens
taatattctctgat

SEQ ID NO: 245389 - DNA, 14 bp, Homo sapiens
taatattgagaaag

SEQ ID NO: 245390 - DNA, 21 bp, Homo sapiens
taatattgatatgcttataca

SEQ ID NO: 245391 - DNA, 14 bp, Homo sapiens
taatatttatgttt

SEQ ID NO: 245392 - DNA, 15 bp, Homo sapiens
taatatttatgttta

SEQ ID NO: 245393 - DNA, 19 bp, Homo sapiens
taatatttatgtttaagtg

SEQ ID NO: 245394 - DNA, 15 bp, Homo sapiens
taatatttattgaat

SEQ ID NO: 245395 - DNA, 18 bp, Homo sapiens
taatatttcttcaagtga

SEQ ID NO: 245396 - DNA, 22 bp, Homo sapiens
taatatttcttcaagtgagtgg

SEQ ID NO: 245397 - DNA, 17 bp, Homo sapiens
taatcaatacccttggc

SEQ ID NO: 245398 - DNA, 19 bp, Homo sapiens
taatcaatgaatattgaag

SEQ ID NO: 245399 - DNA, 16 bp, Homo sapiens
taatcacaactcagca

SEQ ID NO: 245400 - DNA, 20 bp, Homo sapiens
taatcagaaatttttatcag

SEQ ID NO: 245401 - DNA, 11 bp, Homo sapiens
taatcagcctc

SEQ ID NO: 245402 - DNA, 14 bp, Homo sapiens
taatcagcctctta

SEQ ID NO: 245403 - DNA, 18 bp, Homo sapiens
taatcagtgtagccccaa

SEQ ID NO: 245404 - DNA, 17 bp, Homo sapiens
taatcagtgtgtctaaa

SEQ ID NO: 245405 - DNA, 23 bp, Homo sapiens
taatcagtgtgtctaaatttgaa

SEQ ID NO: 245406 - DNA, 13 bp, Homo sapiens
taatcatcttctc

SEQ ID NO: 245407 - DNA, 19 bp, Homo sapiens
taatcatgtgggtgagcca

SEQ ID NO: 245408 - DNA, 21 bp, Homo sapiens
taatcatgtgggtgagccagt

SEQ ID NO: 245409 - DNA, 19 bp, Homo sapiens
taatcatttccagcaaaat

SEQ ID NO: 245410 - DNA, 12 bp, Homo sapiens
taatcatttctt

SEQ ID NO: 245411 - DNA, 19 bp, Homo sapiens
taatcatttcttgggccct

SEQ ID NO: 245412 - DNA, 22 bp, Homo sapiens
taatcatttcttgggccctcct

SEQ ID NO: 245413 - DNA, 18 bp, Homo sapiens
taatccacgctcatcttg

SEQ ID NO: 245414 - DNA, 20 bp, Homo sapiens
taatcccagctacttgggaa

SEQ ID NO: 245415 - DNA, 14 bp, Homo sapiens
taatccccttctcc

SEQ ID NO: 245416 - DNA, 19 bp, Homo sapiens
taatcccggtttcagaagc

SEQ ID NO: 245417 - DNA, 21 bp, Homo sapiens
taatccttctaactaaactaa

SEQ ID NO: 245418 - DNA, 19 bp, Homo sapiens
taatctagagctatgcaca

SEQ ID NO: 245419 - DNA, 22 bp, Homo sapiens
taatctagagctatgcacacca

SEQ ID NO: 245420 - DNA, 15 bp, Homo sapiens
taatctagtttacag

SEQ ID NO: 245421 - DNA, 21 bp, Homo sapiens
taatctctaaatcaagtattt

SEQ ID NO: 245422 - DNA, 20 bp, Homo sapiens
taatctgacaaagtcatgaa

SEQ ID NO: 245423 - DNA, 15 bp, Homo sapiens
taatctggactcctc

SEQ ID NO: 245424 - DNA, 17 bp, Homo sapiens
taatctgggaagggaag

SEQ ID NO: 245425 - DNA, 21 bp, Homo sapiens
taatctggtgttcttgctaac

SEQ ID NO: 245426 - DNA, 16 bp, Homo sapiens
taatctgtagggctgg

SEQ ID NO: 245427 - DNA, 15 bp, Homo sapiens
taatctgttgtttga

SEQ ID NO: 245428 - DNA, 16 bp, Homo sapiens
taatctgttgtttgaa

SEQ ID NO: 245429 - DNA, 20 bp, Homo sapiens
taatcttaggggagagcttt

SEQ ID NO: 245430 - DNA, 16 bp, Homo sapiens
taatcttcagttttat

SEQ ID NO: 245431 - DNA, 20 bp, Homo sapiens
taatctttattttattattc

SEQ ID NO: 245432 - DNA, 21 bp, Homo sapiens
taatctttctttacctgagac

SEQ ID NO: 245433 - DNA, 19 bp, Homo sapiens
taatctttttctccaccca

SEQ ID NO: 245434 - DNA, 17 bp, Homo sapiens
taatgaaaatgataaaa

SEQ ID NO: 245435 - DNA, 13 bp, Homo sapiens
taatgaaaatgtc

SEQ ID NO: 245436 - DNA, 14 bp, Homo sapiens
taatgaaaatgtca

SEQ ID NO: 245437 - DNA, 15 bp, Homo sapiens
taatgaaaatgtcag

SEQ ID NO: 245438 - DNA, 15 bp, Homo sapiens
taatgaactgtgaca

SEQ ID NO: 245439 - DNA, 15 bp, Homo sapiens
taatgaaggtgtgct

SEQ ID NO: 245440 - DNA, 11 bp, Homo sapiens
taatgaataat

SEQ ID NO: 245441 - DNA, 16 bp, Homo sapiens
taatgaattttatgtg

SEQ ID NO: 245442 - DNA, 15 bp, Homo sapiens
taatgacagagagtt

SEQ ID NO: 245443 - DNA, 17 bp, Homo sapiens
taatgacgtattgtgaa

SEQ ID NO: 245444 - DNA, 18 bp, Homo sapiens
taatgacgtattgtgaaa

SEQ ID NO: 245445 - DNA, 19 bp, Homo sapiens
taatgacgtattgtgaaat

SEQ ID NO: 245446 - DNA, 21 bp, Homo sapiens
taatgacgtattgtgaaattt

SEQ ID NO: 245447 - DNA, 15 bp, Homo sapiens
taatgacttaagcac

SEQ ID NO: 245448 - DNA, 18 bp, Homo sapiens
taatgagatatatcttta

SEQ ID NO: 245449 - DNA, 18 bp, Homo sapiens
taatgagttttacattac

SEQ ID NO: 245450 - DNA, 19 bp, Homo sapiens
taatgataagtaaatgcta

SEQ ID NO: 245451 - DNA, 22 bp, Homo sapiens
taatgatactgtctaagaataa

SEQ ID NO: 245452 - DNA, 11 bp, Homo sapiens
taatgatgttt

SEQ ID NO: 245453 - DNA, 17 bp, Homo sapiens
taatgatttttgtgtat

SEQ ID NO: 245454 - DNA, 18 bp, Homo sapiens
taatgcagacatttacat

SEQ ID NO: 245455 - DNA, 19 bp, Homo sapiens
taatgcatgtggtatgagt

SEQ ID NO: 245456 - DNA, 14 bp, Homo sapiens
taatgcctttttgg

SEQ ID NO: 245457 - DNA, 20 bp, Homo sapiens
taatgcttatgtgttgcata

SEQ ID NO: 245458 - DNA, 15 bp, Homo sapiens
taatggaattatgta

SEQ ID NO: 245459 - DNA, 14 bp, Homo sapiens
taatggaggccaag

SEQ ID NO: 245460 - DNA, 16 bp, Homo sapiens
taatggaggccaagcc

SEQ ID NO: 245461 - DNA, 13 bp, Homo sapiens
taatggtttactg

SEQ ID NO: 245462 - DNA, 18 bp, Homo sapiens
agccttcctctgcagctg

SEQ ID NO: 245463 - DNA, 21 bp, Homo sapiens
agccttcctctgcagctgacc

SEQ ID NO: 245464 - DNA, 22 bp, Homo sapiens
agccttcctctgcagctgacct

SEQ ID NO: 245465 - DNA, 12 bp, Homo sapiens
agccttgcccag

SEQ ID NO: 245466 - DNA, 21 bp, Homo sapiens
agccttgcgcaaaacccagaa

SEQ ID NO: 245467 - DNA, 18 bp, Homo sapiens
agccttgctgtagagact

SEQ ID NO: 245468 - DNA, 19 bp, Homo sapiens
agccttgctgtagagactt

SEQ ID NO: 245469 - DNA, 22 bp, Homo sapiens
agccttgctgtagagacttccg

SEQ ID NO: 245470 - DNA, 17 bp, Homo sapiens
agccttggcctgacctg

SEQ ID NO: 245471 - DNA, 22 bp, Homo sapiens
agccttggcctgacctggcaca

SEQ ID NO: 245472 - DNA, 16 bp, Homo sapiens
agccttgtaattctaa

SEQ ID NO: 245473 - DNA, 13 bp, Homo sapiens
agccttgtgccct

SEQ ID NO: 245474 - DNA, 13 bp, Homo sapiens
agcctttaaattg

SEQ ID NO: 245475 - DNA, 23 bp, Homo sapiens
agcctttaccctcctctatttct

SEQ ID NO: 245476 - DNA, 11 bp, Homo sapiens
agcctttgaat

SEQ ID NO: 245477 - DNA, 16 bp, Homo sapiens
agcctttgcctccccg

SEQ ID NO: 245478 - DNA, 17 bp, Homo sapiens
agcctttggtgaataac

SEQ ID NO: 245479 - DNA, 19 bp, Homo sapiens
agccttttattaacatata

SEQ ID NO: 245480 - DNA, 23 bp, Homo sapiens
agcgacagaaaacctcaagggct

SEQ ID NO: 245481 - DNA, 12 bp, Homo sapiens
agcgagaccctt

SEQ ID NO: 245482 - DNA, 22 bp, Homo sapiens
agcgagacccttgcattagaaa

SEQ ID NO: 245483 - DNA, 23 bp, Homo sapiens
agcgaggcgaggctgcctctggg

SEQ ID NO: 245484 - DNA, 21 bp, Homo sapiens
agcgatgatgtccccttccct

SEQ ID NO: 245485 - DNA, 19 bp, Homo sapiens
agcgattattatctaaagt

SEQ ID NO: 245486 - DNA, 14 bp, Homo sapiens
agcgccacccgccc

SEQ ID NO: 245487 - DNA, 15 bp, Homo sapiens
agcgccccgccccca

SEQ ID NO: 245488 - DNA, 15 bp, Homo sapiens
agcgcccctccctag

SEQ ID NO: 245489 - DNA, 16 bp, Homo sapiens
agcgcccctccctagt

SEQ ID NO: 245490 - DNA, 12 bp, Homo sapiens
agcgcctcccgc

SEQ ID NO: 245491 - DNA, 16 bp, Homo sapiens
agcgcctcctggacac

SEQ ID NO: 245492 - DNA, 22 bp, Homo sapiens
agcgcgcgtgatagaagaaaag

SEQ ID NO: 245493 - DNA, 14 bp, Homo sapiens
agcgcgggagagag

SEQ ID NO: 245494 - DNA, 15 bp, Homo sapiens
agcgctatccacaga

SEQ ID NO: 245495 - DNA, 15 bp, Homo sapiens
agcgctcctctgcct

SEQ ID NO: 245496 - DNA, 13 bp, Homo sapiens
agcgctgcccaca

SEQ ID NO: 245497 - DNA, 14 bp, Homo sapiens
agcggaggaggaag

SEQ ID NO: 245498 - DNA, 18 bp, Homo sapiens
agcggcccggcccacgca

SEQ ID NO: 245499 - DNA, 22 bp, Homo sapiens
agcggcccggcccacgcagagc

SEQ ID NO: 245500 - DNA, 15 bp, Homo sapiens
agcgggacaaagcct

SEQ ID NO: 245501 - DNA, 11 bp, Homo sapiens
agcgggcagcc

SEQ ID NO: 245502 - DNA, 12 bp, Homo sapiens
agcgggcagccc

SEQ ID NO: 245503 - DNA, 14 bp, Homo sapiens
agcgggcagccccg

SEQ ID NO: 245504 - DNA, 20 bp, Homo sapiens
agcggggccttgtctcttcc

SEQ ID NO: 245505 - DNA, 13 bp, Homo sapiens
agcggggggaggg

SEQ ID NO: 245506 - DNA, 14 bp, Homo sapiens
agcggggggagggt

SEQ ID NO: 245507 - DNA, 17 bp, Homo sapiens
agcgggtaaaaagagaa

SEQ ID NO: 245508 - DNA, 18 bp, Homo sapiens
agcgggtctagtggaaag

SEQ ID NO: 245509 - DNA, 17 bp, Homo sapiens
agcggtggaaggagcct

SEQ ID NO: 245510 - DNA, 19 bp, Homo sapiens
agcggtttggggagcagag

SEQ ID NO: 245511 - DNA, 22 bp, Homo sapiens
agcggtttggggagcagagaca

SEQ ID NO: 245512 - DNA, 16 bp, Homo sapiens
agcgtcccagtctctg

SEQ ID NO: 245513 - DNA, 16 bp, Homo sapiens
agcgtccttccccctg

SEQ ID NO: 245514 - DNA, 14 bp, Homo sapiens
agcgtctcccttgg

SEQ ID NO: 245515 - DNA, 22 bp, Homo sapiens
agcgtctgagcggccgcctgtc

SEQ ID NO: 245516 - DNA, 22 bp, Homo sapiens
agcgtggcgcagtggccctgag

SEQ ID NO: 245517 - DNA, 24 bp, Homo sapiens
agcgtggcgcagtggccctgagca

SEQ ID NO: 245518 - DNA, 18 bp, Homo sapiens
agcgttaacacagtaaaa

SEQ ID NO: 245519 - DNA, 15 bp, Homo sapiens
agcgttcctggcctt

SEQ ID NO: 245520 - DNA, 21 bp, Homo sapiens
agcgtttgaggggctggcctt

SEQ ID NO: 245521 - DNA, 14 bp, Homo sapiens
agctaaaaatatat

SEQ ID NO: 245522 - DNA, 19 bp, Homo sapiens
agctaaaaatatatataac

SEQ ID NO: 245523 - DNA, 15 bp, Homo sapiens
agctaaaatgatttt

SEQ ID NO: 245524 - DNA, 15 bp, Homo sapiens
agctaaagaggctga

SEQ ID NO: 245525 - DNA, 23 bp, Homo sapiens
agctaaagaggtggggtgaagct

SEQ ID NO: 245526 - DNA, 13 bp, Homo sapiens
agctaaatccttt

SEQ ID NO: 245527 - DNA, 17 bp, Homo sapiens
agctaacactggcccct

SEQ ID NO: 245528 - DNA, 12 bp, Homo sapiens
agctaacagaca

SEQ ID NO: 245529 - DNA, 20 bp, Homo sapiens
agctaacatggaagtactat

SEQ ID NO: 245530 - DNA, 17 bp, Homo sapiens
agctaacattttaaata

SEQ ID NO: 245531 - DNA, 20 bp, Homo sapiens
agctaacattttaaataaaa

SEQ ID NO: 245532 - DNA, 20 bp, Homo sapiens
agctaagcagaataatggaa

SEQ ID NO: 245533 - DNA, 18 bp, Homo sapiens
agctaagctcaaatgtat

SEQ ID NO: 245534 - DNA, 15 bp, Homo sapiens
agctaataaaatatc

SEQ ID NO: 245535 - DNA, 16 bp, Homo sapiens
agctaataaaatatca

SEQ ID NO: 245536 - DNA, 21 bp, Homo sapiens
agctaataaaatatcattcag

SEQ ID NO: 245537 - DNA, 23 bp, Homo sapiens
agctaatctgtagggctggacct

SEQ ID NO: 245538 - DNA, 18 bp, Homo sapiens
agctacaggggaggctga

SEQ ID NO: 245539 - DNA, 18 bp, Homo sapiens
agctacattcctcagctg

SEQ ID NO: 245540 - DNA, 21 bp, Homo sapiens
agctacattcctcagctgcca

SEQ ID NO: 245541 - DNA, 16 bp, Homo sapiens
agctaccccttctttg

SEQ ID NO: 245542 - DNA, 16 bp, Homo sapiens
agctacctcaaacttc

SEQ ID NO: 245543 - DNA, 18 bp, Homo sapiens
agctacggttccctgcct

SEQ ID NO: 245544 - DNA, 21 bp, Homo sapiens
agctactaacctggagacagt

SEQ ID NO: 245545 - DNA, 14 bp, Homo sapiens
agctactctcttgc

SEQ ID NO: 245546 - DNA, 17 bp, Homo sapiens
agctactctgtccaggc

SEQ ID NO: 245547 - DNA, 18 bp, Homo sapiens
agctactctgtccaggcc

SEQ ID NO: 245548 - DNA, 20 bp, Homo sapiens
agctactctgtccaggccac

SEQ ID NO: 245549 - DNA, 23 bp, Homo sapiens
agctactctgtccaggccactgt

SEQ ID NO: 245550 - DNA, 20 bp, Homo sapiens
agctactgatttcctttgga

SEQ ID NO: 245551 - DNA, 16 bp, Homo sapiens
agctactgatttttgt

SEQ ID NO: 245552 - DNA, 18 bp, Homo sapiens
agctacttgggagcctga

SEQ ID NO: 245553 - DNA, 16 bp, Homo sapiens
agctacttgggaggct

SEQ ID NO: 245554 - DNA, 16 bp, Homo sapiens
agctagaaagtggcag

SEQ ID NO: 245555 - DNA, 17 bp, Homo sapiens
agctagagaggggcctc

SEQ ID NO: 245556 - DNA, 22 bp, Homo sapiens
agctagagaggggcctctggct

SEQ ID NO: 245557 - DNA, 14 bp, Homo sapiens
agctagagcttcaa

SEQ ID NO: 245558 - DNA, 23 bp, Homo sapiens
agctagcccagtccctggagctg

SEQ ID NO: 245559 - DNA, 15 bp, Homo sapiens
agctagctatttcta

SEQ ID NO: 245560 - DNA, 22 bp, Homo sapiens
agctagctatttctatgtatgt

SEQ ID NO: 245561 - DNA, 18 bp, Homo sapiens
acagcagcctgcttccca

SEQ ID NO: 245562 - DNA, 18 bp, Homo sapiens
acagcagcttcaccagag

SEQ ID NO: 245563 - DNA, 21 bp, Homo sapiens
acagcaggatgtgcctgtggc

SEQ ID NO: 245564 - DNA, 11 bp, Homo sapiens
acagcaggtgt

SEQ ID NO: 245565 - DNA, 21 bp, Homo sapiens
acagcagtcccagtattctca

SEQ ID NO: 245566 - DNA, 22 bp, Homo sapiens
acagcagtcccagtattctcag

SEQ ID NO: 245567 - DNA, 17 bp, Homo sapiens
acagcatcaaaatacaa

SEQ ID NO: 245568 - DNA, 14 bp, Homo sapiens
acagcatgtctact

SEQ ID NO: 245569 - DNA, 19 bp, Homo sapiens
acagcattcttgtcacaat

SEQ ID NO: 245570 - DNA, 18 bp, Homo sapiens
acagcatttcagctgtga

SEQ ID NO: 245571 - DNA, 12 bp, Homo sapiens
acagccaagccc

SEQ ID NO: 245572 - DNA, 18 bp, Homo sapiens
acagccaccacctggatg

SEQ ID NO: 245573 - DNA, 13 bp, Homo sapiens
acagccacctcca

SEQ ID NO: 245574 - DNA, 12 bp, Homo sapiens
acagccagccca

SEQ ID NO: 245575 - DNA, 13 bp, Homo sapiens
acagccagcccag

SEQ ID NO: 245576 - DNA, 14 bp, Homo sapiens
acagccagcccagc

SEQ ID NO: 245577 - DNA, 22 bp, Homo sapiens
acagccatgtccaagttcttca

SEQ ID NO: 245578 - DNA, 22 bp, Homo sapiens
acagccattcatctgggctggc

SEQ ID NO: 245579 - DNA, 16 bp, Homo sapiens
acagcccaaccaggag

SEQ ID NO: 245580 - DNA, 20 bp, Homo sapiens
acagcccgcatgcagcagct

SEQ ID NO: 245581 - DNA, 15 bp, Homo sapiens
acagccctcggcctc

SEQ ID NO: 245582 - DNA, 13 bp, Homo sapiens
acagccctgggag

SEQ ID NO: 245583 - DNA, 13 bp, Homo sapiens
acagccctgtcag

SEQ ID NO: 245584 - DNA, 18 bp, Homo sapiens
acagccggatcttggaga

SEQ ID NO: 245585 - DNA, 18 bp, Homo sapiens
acagccggggcctgccta

SEQ ID NO: 245586 - DNA, 22 bp, Homo sapiens
acagccgtcccgcgttcaagac

SEQ ID NO: 245587 - DNA, 23 bp, Homo sapiens
acagccgtcccgcgttcaagact

SEQ ID NO: 245588 - DNA, 18 bp, Homo sapiens
acagcctaatgaaggcca

SEQ ID NO: 245589 - DNA, 12 bp, Homo sapiens
acagcctcaccc

SEQ ID NO: 245590 - DNA, 19 bp, Homo sapiens
acagcctcacccctgcagg

SEQ ID NO: 245591 - DNA, 15 bp, Homo sapiens
acagcctccagggcc

SEQ ID NO: 245592 - DNA, 14 bp, Homo sapiens
acagtctctttaat

SEQ ID NO: 245593 - DNA, 16 bp, Homo sapiens
acagtgaacagcttca

SEQ ID NO: 245594 - DNA, 22 bp, Homo sapiens
acagtgaacataactgtaacat

SEQ ID NO: 245595 - DNA, 14 bp, Homo sapiens
acagtgaggagggt

SEQ ID NO: 245596 - DNA, 22 bp, Homo sapiens
acagtgatctccatatgttaca

SEQ ID NO: 245597 - DNA, 13 bp, Homo sapiens
acagtgcagacag

SEQ ID NO: 245598 - DNA, 14 bp, Homo sapiens
acagtgcagacagg

SEQ ID NO: 245599 - DNA, 12 bp, Homo sapiens
acagtggatgcc

SEQ ID NO: 245600 - DNA, 21 bp, Homo sapiens
acagtgggccggccccaggct

SEQ ID NO: 245601 - DNA, 22 bp, Homo sapiens
acagtgggccggccccaggctc

SEQ ID NO: 245602 - DNA, 16 bp, Homo sapiens
acagtggggcccatgg

SEQ ID NO: 245603 - DNA, 22 bp, Homo sapiens
acagtggggcccatggccccag

SEQ ID NO: 245604 - DNA, 10 bp, Homo sapiens
acagtggggg

SEQ ID NO: 245605 - DNA, 16 bp, Homo sapiens
acagtgggtggcacct

SEQ ID NO: 245606 - DNA, 18 bp, Homo sapiens
acagtgtggatgtaaatt

SEQ ID NO: 245607 - DNA, 21 bp, Homo sapiens
acagtgtggcttaaacatttt

SEQ ID NO: 245608 - DNA, 16 bp, Homo sapiens
acagtgtttcccataa

SEQ ID NO: 245609 - DNA, 22 bp, Homo sapiens
acagtgtttcccataattttct

SEQ ID NO: 245610 - DNA, 18 bp, Homo sapiens
acagttaaacttgcaatg

SEQ ID NO: 245611 - DNA, 21 bp, Homo sapiens
acagttaaatgagaacatgaa

SEQ ID NO: 245612 - DNA, 16 bp, Homo sapiens
acagttaactctccca

SEQ ID NO: 245613 - DNA, 16 bp, Homo sapiens
acagttactcttcagt

SEQ ID NO: 245614 - DNA, 22 bp, Homo sapiens
acagttagggttgagttacttc

SEQ ID NO: 245615 - DNA, 17 bp, Homo sapiens
acagttcacaccctgca

SEQ ID NO: 245616 - DNA, 15 bp, Homo sapiens
acagttcttcgggaa

SEQ ID NO: 245617 - DNA, 21 bp, Homo sapiens
acagttcttcgggaagagagg

SEQ ID NO: 245618 - DNA, 15 bp, Homo sapiens
acagttgactggctt

SEQ ID NO: 245619 - DNA, 18 bp, Homo sapiens
acagttgagagagaatct

SEQ ID NO: 245620 - DNA, 22 bp, Homo sapiens
acagttgagtttcttctaaaga

SEQ ID NO: 245621 - DNA, 22 bp, Homo sapiens
acagttggcagagaaggcctct

SEQ ID NO: 245622 - DNA, 21 bp, Homo sapiens
acagttgtaccactgctaata

SEQ ID NO: 245623 - DNA, 23 bp, Homo sapiens
acagttgtaccactgctaataaa

SEQ ID NO: 245624 - DNA, 17 bp, Homo sapiens
acagttgtctagagata

SEQ ID NO: 245625 - DNA, 22 bp, Homo sapiens
acagttgtctattctgagcctt

SEQ ID NO: 245626 - DNA, 23 bp, Homo sapiens
acagttgtctattctgagccttg

SEQ ID NO: 245627 - DNA, 21 bp, Homo sapiens
acagtttatgcagtgctgctt

SEQ ID NO: 245628 - DNA, 20 bp, Homo sapiens
acagtttgatgctgagtcat

SEQ ID NO: 245629 - DNA, 18 bp, Homo sapiens
acagtttgctatttgctt

SEQ ID NO: 245630 - DNA, 14 bp, Homo sapiens
acagtttgctctag

SEQ ID NO: 245631 - DNA, 12 bp, Homo sapiens
acagttttccat

SEQ ID NO: 245632 - DNA, 17 bp, Homo sapiens
acagttttccatgaaaa

SEQ ID NO: 245633 - DNA, 18 bp, Homo sapiens
acagttttccatgaaaac

SEQ ID NO: 245634 - DNA, 19 bp, Homo sapiens
acagttttccatgaaaacg

SEQ ID NO: 245635 - DNA, 23 bp, Homo sapiens
acagttttccatgaaaacgtttt

SEQ ID NO: 245636 - DNA, 12 bp, Homo sapiens
acataaaaagtt

SEQ ID NO: 245637 - DNA, 18 bp, Homo sapiens
acataaaagagtggaact

SEQ ID NO: 245638 - DNA, 14 bp, Homo sapiens
acataaaatctgtg

SEQ ID NO: 245639 - DNA, 17 bp, Homo sapiens
acataaaatctgtgaat

SEQ ID NO: 245640 - DNA, 15 bp, Homo sapiens
acataaactgacttt

SEQ ID NO: 245641 - DNA, 18 bp, Homo sapiens
acataaagaaacactttc

SEQ ID NO: 245642 - DNA, 18 bp, Homo sapiens
acataaatctgtctgatt

SEQ ID NO: 245643 - DNA, 13 bp, Homo sapiens
acataacaggcat

SEQ ID NO: 245644 - DNA, 16 bp, Homo sapiens
acataacagggtaaat

SEQ ID NO: 245645 - DNA, 22 bp, Homo sapiens
acataacagggtaaattattca

SEQ ID NO: 245646 - DNA, 16 bp, Homo sapiens
acataaccactgcttc

SEQ ID NO: 245647 - DNA, 18 bp, Homo sapiens
acataactgacttagttc

SEQ ID NO: 245648 - DNA, 14 bp, Homo sapiens
acataactgtaaca

SEQ ID NO: 245649 - DNA, 19 bp, Homo sapiens
acataagaccgtgtcccaa

SEQ ID NO: 245650 - DNA, 21 bp, Homo sapiens
acataagtaattcaagaaaac

SEQ ID NO: 245651 - DNA, 17 bp, Homo sapiens
acataataagtttcata

SEQ ID NO: 245652 - DNA, 15 bp, Homo sapiens
acataatacattcca

SEQ ID NO: 245653 - DNA, 15 bp, Homo sapiens
acataatagaatttc

SEQ ID NO: 245654 - DNA, 15 bp, Homo sapiens
acataatatcttgaa

SEQ ID NO: 245655 - DNA, 21 bp, Homo sapiens
acataatatcttgaagaatat

SEQ ID NO: 245656 - DNA, 22 bp, Homo sapiens
acataatatcttgaagaatatt

SEQ ID NO: 245657 - DNA, 21 bp, Homo sapiens
acataatgttagtagcactga

SEQ ID NO: 245658 - DNA, 21 bp, Homo sapiens
acataattttttttttttaac

SEQ ID NO: 245659 - DNA, 15 bp, Homo sapiens
acataccagcttaga

SEQ ID NO: 245660 - DNA, 20 bp, Homo sapiens
acatacctctctctatatat

SEQ ID NO: 245661 - DNA, 14 bp, Homo sapiens
acatactagaaagc

SEQ ID NO: 245662 - DNA, 24 bp, Homo sapiens
acatactccttccatcaaatagaa

SEQ ID NO: 245663 - DNA, 19 bp, Homo sapiens
acatactgcatgtaagcca

SEQ ID NO: 245664 - DNA, 19 bp, Homo sapiens
acatagattcacctgtaaa

SEQ ID NO: 245665 - DNA, 12 bp, Homo sapiens
acatagcccctg

SEQ ID NO: 245666 - DNA, 13 bp, Homo sapiens
acatagcccctgc

SEQ ID NO: 245667 - DNA, 13 bp, Homo sapiens
acatagtgaattt

SEQ ID NO: 245668 - DNA, 15 bp, Homo sapiens
acatagtgaatttta

SEQ ID NO: 245669 - DNA, 16 bp, Homo sapiens
acatagtgaattttaa

SEQ ID NO: 245670 - DNA, 16 bp, Homo sapiens
acatagtgatggttcc

SEQ ID NO: 245671 - DNA, 21 bp, Homo sapiens
acatagttgaaaaaagaagtt

SEQ ID NO: 245672 - DNA, 12 bp, Homo sapiens
acatagtttctt

SEQ ID NO: 245673 - DNA, 17 bp, Homo sapiens
acatagttttaaactca

SEQ ID NO: 245674 - DNA, 19 bp, Homo sapiens
acatataaattaatacata

SEQ ID NO: 245675 - DNA, 16 bp, Homo sapiens
acatataatatatgtt

SEQ ID NO: 245676 - DNA, 15 bp, Homo sapiens
acatatacacaaaga

SEQ ID NO: 245677 - DNA, 16 bp, Homo sapiens
acatatacagcaggat

SEQ ID NO: 245678 - DNA, 22 bp, Homo sapiens
acatatagccctttccccactc

SEQ ID NO: 245679 - DNA, 16 bp, Homo sapiens
acatatattttttaca

SEQ ID NO: 245680 - DNA, 15 bp, Homo sapiens
acatatgaaaataca

SEQ ID NO: 245681 - DNA, 23 bp, Homo sapiens
acatatgtagatattgttttctg

SEQ ID NO: 245682 - DNA, 14 bp, Homo sapiens
acatatgtcttact

SEQ ID NO: 245683 - DNA, 18 bp, Homo sapiens
acatattcaaatcagcaa

SEQ ID NO: 245684 - DNA, 23 bp, Homo sapiens
acatattcttgctttcacaaata

SEQ ID NO: 245685 - DNA, 22 bp, Homo sapiens
acatatttgtagctagaatatc

SEQ ID NO: 245686 - DNA, 18 bp, Homo sapiens
acatattttcctttagat

SEQ ID NO: 245687 - DNA, 14 bp, Homo sapiens
acatcaaataaact

SEQ ID NO: 245688 - DNA, 14 bp, Homo sapiens
acatcaaataaatt

SEQ ID NO: 245689 - DNA, 17 bp, Homo sapiens
acatcaaataaatttct

SEQ ID NO: 245690 - DNA, 19 bp, Homo sapiens
acatcaaataaatttctgg

SEQ ID NO: 245691 - DNA, 16 bp, Homo sapiens
acatcaacatcttggt

SEQ ID NO: 245692 - DNA, 18 bp, Homo sapiens
acatcaacatcttggtca

SEQ ID NO: 245693 - DNA, 12 bp, Homo sapiens
acatcaagatac

SEQ ID NO: 245694 - DNA, 15 bp, Homo sapiens
acatcaatgttcatt

SEQ ID NO: 245695 - DNA, 13 bp, Homo sapiens
acatcacacacac

SEQ ID NO: 245696 - DNA, 19 bp, Homo sapiens
acatcagacctgtcttcca

SEQ ID NO: 245697 - DNA, 21 bp, Homo sapiens
acatcagcttgaccagtataa

SEQ ID NO: 245698 - DNA, 15 bp, Homo sapiens
acatcagtaatgtat

SEQ ID NO: 245699 - DNA, 23 bp, Homo sapiens
acatcagtggcatggctccagtc

SEQ ID NO: 245700 - DNA, 16 bp, Homo sapiens
acatcatgttatttta

SEQ ID NO: 245701 - DNA, 19 bp, Homo sapiens
acatcattggataaatttg

SEQ ID NO: 245702 - DNA, 12 bp, Homo sapiens
acatcatttctt

SEQ ID NO: 245703 - DNA, 16 bp, Homo sapiens
agctgacaaaattttg

SEQ ID NO: 245704 - DNA, 19 bp, Homo sapiens
agctgacaaaattttgctc

SEQ ID NO: 245705 - DNA, 15 bp, Homo sapiens
agctgacctctgttg

SEQ ID NO: 245706 - DNA, 20 bp, Homo sapiens
agctgacgaggctgggccaa

SEQ ID NO: 245707 - DNA, 16 bp, Homo sapiens
agctgactcattcttt

SEQ ID NO: 245708 - DNA, 11 bp, Homo sapiens
agctgactgtg

SEQ ID NO: 245709 - DNA, 13 bp, Homo sapiens
agctgactgtggc

SEQ ID NO: 245710 - DNA, 15 bp, Homo sapiens
agctgagatgtggac

SEQ ID NO: 245711 - DNA, 12 bp, Homo sapiens
agctgagctgga

SEQ ID NO: 245712 - DNA, 23 bp, Homo sapiens
agctgagcttcggttctccagaa

SEQ ID NO: 245713 - DNA, 15 bp, Homo sapiens
agctgagcttgagct

SEQ ID NO: 245714 - DNA, 20 bp, Homo sapiens
agctgaggacacaccccaca

SEQ ID NO: 245715 - DNA, 23 bp, Homo sapiens
agctgaggccattccctgtagga

SEQ ID NO: 245716 - DNA, 14 bp, Homo sapiens
agctgaggccccag

SEQ ID NO: 245717 - DNA, 22 bp, Homo sapiens
agctgaggccccagggctgtgg

SEQ ID NO: 245718 - DNA, 23 bp, Homo sapiens
agctgaggccccagggctgtggg

SEQ ID NO: 245719 - DNA, 18 bp, Homo sapiens
agctgaggtctcttgagg

SEQ ID NO: 245720 - DNA, 23 bp, Homo sapiens
agctgaggtctcttgagggagct

SEQ ID NO: 245721 - DNA, 18 bp, Homo sapiens
agctgagtcggctgggca

SEQ ID NO: 245722 - DNA, 14 bp, Homo sapiens
acattgtcaataaa

SEQ ID NO: 245723 - DNA, 14 bp, Homo sapiens
acattgttgttttt

SEQ ID NO: 245724 - DNA, 20 bp, Homo sapiens
acattgttgtttttttaata

SEQ ID NO: 245725 - DNA, 12 bp, Homo sapiens
acatttacagtc

SEQ ID NO: 245726 - DNA, 21 bp, Homo sapiens
acatttacagtccttcaaaat

SEQ ID NO: 245727 - DNA, 14 bp, Homo sapiens
acatttaggagaag

SEQ ID NO: 245728 - DNA, 16 bp, Homo sapiens
acatttaggagaagtt

SEQ ID NO: 245729 - DNA, 20 bp, Homo sapiens
acatttataatgtttgctat

SEQ ID NO: 245730 - DNA, 18 bp, Homo sapiens
acatttatcttctgtttt

SEQ ID NO: 245731 - DNA, 20 bp, Homo sapiens
acatttatcttctgtttttc

SEQ ID NO: 245732 - DNA, 22 bp, Homo sapiens
acatttatcttctgtttttctc

SEQ ID NO: 245733 - DNA, 19 bp, Homo sapiens
acatttcaagatccaaatg

SEQ ID NO: 245734 - DNA, 20 bp, Homo sapiens
acatttcataaggcctgccc

SEQ ID NO: 245735 - DNA, 22 bp, Homo sapiens
acatttcataaggcctgccctc

SEQ ID NO: 245736 - DNA, 13 bp, Homo sapiens
acatttctcatgt

SEQ ID NO: 245737 - DNA, 20 bp, Homo sapiens
acatttctcttcagtgtgtt

SEQ ID NO: 245738 - DNA, 20 bp, Homo sapiens
acatttctggccatttaact

SEQ ID NO: 245739 - DNA, 24 bp, Homo sapiens
acatttctggccatttaactagca

SEQ ID NO: 245740 - DNA, 19 bp, Homo sapiens
acatttgagtcccttccag

SEQ ID NO: 245741 - DNA, 19 bp, Homo sapiens
acatttgctgaatatgcaa

SEQ ID NO: 245742 - DNA, 20 bp, Homo sapiens
acatttggaaaccatgcact

SEQ ID NO: 245743 - DNA, 22 bp, Homo sapiens
acatttgggagactgagcttga

SEQ ID NO: 245744 - DNA, 18 bp, Homo sapiens
acatttgggtaaatcatg

SEQ ID NO: 245745 - DNA, 22 bp, Homo sapiens
acatttggtggtactttattct

SEQ ID NO: 245746 - DNA, 13 bp, Homo sapiens
acatttgtacatt

SEQ ID NO: 245747 - DNA, 17 bp, Homo sapiens
acatttgtagttggagt

SEQ ID NO: 245748 - DNA, 16 bp, Homo sapiens
acatttgtcctgcaga

SEQ ID NO: 245749 - DNA, 15 bp, Homo sapiens
acatttgtgcataaa

SEQ ID NO: 245750 - DNA, 22 bp, Homo sapiens
acatttgtgcataaatttccac

SEQ ID NO: 245751 - DNA, 15 bp, Homo sapiens
acattttaaaatcaa

SEQ ID NO: 245752 - DNA, 20 bp, Homo sapiens
acattttaaataaaagaaaa

SEQ ID NO: 245753 - DNA, 16 bp, Homo sapiens
acattttagacagtaa

SEQ ID NO: 245754 - DNA, 13 bp, Homo sapiens
acattttgcttgc

SEQ ID NO: 245755 - DNA, 19 bp, Homo sapiens
acattttgttatagaatac

SEQ ID NO: 245756 - DNA, 12 bp, Homo sapiens
acatttttacaa

SEQ ID NO: 245757 - DNA, 21 bp, Homo sapiens
acattttttgtttcttggtgt

SEQ ID NO: 245758 - DNA, 11 bp, Homo sapiens
accaaaaatat

SEQ ID NO: 245759 - DNA, 17 bp, Homo sapiens
accaaaacataagacga

SEQ ID NO: 245760 - DNA, 17 bp, Homo sapiens
accaaaatatagttaat

SEQ ID NO: 245761 - DNA, 12 bp, Homo sapiens
accaaaatgaca

SEQ ID NO: 245762 - DNA, 16 bp, Homo sapiens
accaaacggaactctt

SEQ ID NO: 245763 - DNA, 21 bp, Homo sapiens
accaaagctgacgaggctggg

SEQ ID NO: 245764 - DNA, 18 bp, Homo sapiens
accaaataaaaatattgt

SEQ ID NO: 245765 - DNA, 14 bp, Homo sapiens
accaaatctgtcta

SEQ ID NO: 245766 - DNA, 20 bp, Homo sapiens
accaaatgcctctgccttga

SEQ ID NO: 245767 - DNA, 14 bp, Homo sapiens
accaaattgctgag

SEQ ID NO: 245768 - DNA, 17 bp, Homo sapiens
accaaattgctgagatg

SEQ ID NO: 245769 - DNA, 22 bp, Homo sapiens
accaaattttgaggtcttttac

SEQ ID NO: 245770 - DNA, 21 bp, Homo sapiens
accaacaattaggtctgcatt

SEQ ID NO: 245771 - DNA, 21 bp, Homo sapiens
accaacaccatcacagcttgt

SEQ ID NO: 245772 - DNA, 15 bp, Homo sapiens
accaacataaaacaa

SEQ ID NO: 245773 - DNA, 16 bp, Homo sapiens
accaacataaaacaaa

SEQ ID NO: 245774 - DNA, 15 bp, Homo sapiens
accaaccctcagagc

SEQ ID NO: 245775 - DNA, 15 bp, Homo sapiens
accaactctgcactc

SEQ ID NO: 245776 - DNA, 14 bp, Homo sapiens
accaactgagccaa

SEQ ID NO: 245777 - DNA, 22 bp, Homo sapiens
accaacttggttctgcttcaat

SEQ ID NO: 245778 - DNA, 19 bp, Homo sapiens
accaactttctgtaaactc

SEQ ID NO: 245779 - DNA, 22 bp, Homo sapiens
accaacttttctattaaaagtg

SEQ ID NO: 245780 - DNA, 20 bp, Homo sapiens
accaagaaaccactgggcat

SEQ ID NO: 245781 - DNA, 14 bp, Homo sapiens
accaagaaagcagg

SEQ ID NO: 245782 - DNA, 12 bp, Homo sapiens
accaagaactgc

SEQ ID NO: 245783 - DNA, 14 bp, Homo sapiens
accaagaactgcat

SEQ ID NO: 245784 - DNA, 15 bp, Homo sapiens
accaagaactgcatg

SEQ ID NO: 245785 - DNA, 19 bp, Homo sapiens
accaagagtatgagaaata

SEQ ID NO: 245786 - DNA, 14 bp, Homo sapiens
accaagagtattcc

SEQ ID NO: 245787 - DNA, 21 bp, Homo sapiens
accaagatcacaaatagtgtt

SEQ ID NO: 245788 - DNA, 16 bp, Homo sapiens
accaagatgccatctg

SEQ ID NO: 245789 - DNA, 22 bp, Homo sapiens
accaagatgccatctgtgtcct

SEQ ID NO: 245790 - DNA, 12 bp, Homo sapiens
accaagcagctt

SEQ ID NO: 245791 - DNA, 14 bp, Homo sapiens
accaagccgtggct

SEQ ID NO: 245792 - DNA, 18 bp, Homo sapiens
accaagccgtggcttccc

SEQ ID NO: 245793 - DNA, 13 bp, Homo sapiens
accaagccttggc

SEQ ID NO: 245794 - DNA, 21 bp, Homo sapiens
accaagctgctctccttcact

SEQ ID NO: 245795 - DNA, 18 bp, Homo sapiens
accaagcttaaggagagg

SEQ ID NO: 245796 - DNA, 18 bp, Homo sapiens
accaagcttagaagccac

SEQ ID NO: 245797 - DNA, 19 bp, Homo sapiens
accaagcttgtttccctgc

SEQ ID NO: 245798 - DNA, 23 bp, Homo sapiens
accaagcttgtttccctgctggc

SEQ ID NO: 245799 - DNA, 13 bp, Homo sapiens
accaaggacccct

SEQ ID NO: 245800 - DNA, 15 bp, Homo sapiens
accaaggcagcctcc

SEQ ID NO: 245801 - DNA, 17 bp, Homo sapiens
accaaggcagcctccag

SEQ ID NO: 245802 - DNA, 18 bp, Homo sapiens
accaaggcagcctccaga

SEQ ID NO: 245803 - DNA, 17 bp, Homo sapiens
accaagggtatctgctg

SEQ ID NO: 245804 - DNA, 15 bp, Homo sapiens
accaagtcctggcta

SEQ ID NO: 245805 - DNA, 23 bp, Homo sapiens
accaagtcctggctacatcccag

SEQ ID NO: 245806 - DNA, 20 bp, Homo sapiens
accaagtgccttgagctgcc

SEQ ID NO: 245807 - DNA, 16 bp, Homo sapiens
accaagtggaccttga

SEQ ID NO: 245808 - DNA, 20 bp, Homo sapiens
accaagttcattacctccct

SEQ ID NO: 245809 - DNA, 18 bp, Homo sapiens
accaataacttcagagaa

SEQ ID NO: 245810 - DNA, 18 bp, Homo sapiens
accaatattaccatctta

SEQ ID NO: 245811 - DNA, 18 bp, Homo sapiens
accaatcccgtgaaagaa

SEQ ID NO: 245812 - DNA, 20 bp, Homo sapiens
accaatcctatgtcatttct

SEQ ID NO: 245813 - DNA, 22 bp, Homo sapiens
accaatgattcataacaatgta

SEQ ID NO: 245814 - DNA, 12 bp, Homo sapiens
accaatgcatgc

SEQ ID NO: 245815 - DNA, 22 bp, Homo sapiens
accaatgcattaccttctgttc

SEQ ID NO: 245816 - DNA, 18 bp, Homo sapiens
accaatgctgttgtaaac

SEQ ID NO: 245817 - DNA, 22 bp, Homo sapiens
accaatggtgatcctctatttt

SEQ ID NO: 245818 - DNA, 14 bp, Homo sapiens
accaattgccctgc

SEQ ID NO: 245819 - DNA, 15 bp, Homo sapiens
accaattgccctgcc

SEQ ID NO: 245820 - DNA, 15 bp, Homo sapiens
accaattgtttcttg

SEQ ID NO: 245821 - DNA, 13 bp, Homo sapiens
accacacacaccc

SEQ ID NO: 245822 - DNA, 20 bp, Homo sapiens
accacacacacccttcccca

SEQ ID NO: 245823 - DNA, 11 bp, Homo sapiens
accacactgaa

SEQ ID NO: 245824 - DNA, 13 bp, Homo sapiens
accacactgacca

SEQ ID NO: 245825 - DNA, 14 bp, Homo sapiens
accacactgaccac

SEQ ID NO: 245826 - DNA, 18 bp, Homo sapiens
accacactgaccacactg

SEQ ID NO: 245827 - DNA, 14 bp, Homo sapiens
accacactgttgag

SEQ ID NO: 245828 - DNA, 17 bp, Homo sapiens
accacactgttgagttg

SEQ ID NO: 245829 - DNA, 16 bp, Homo sapiens
accacacttcctgtcc

SEQ ID NO: 245830 - DNA, 17 bp, Homo sapiens
accacacttcctgtcca

SEQ ID NO: 245831 - DNA, 22 bp, Homo sapiens
accacacttcctgtccagagag

SEQ ID NO: 245832 - DNA, 22 bp, Homo sapiens
accacagaagcttgtattatca

SEQ ID NO: 245833 - DNA, 20 bp, Homo sapiens
accacagacgccacctggcg

SEQ ID NO: 245834 - DNA, 19 bp, Homo sapiens
accacagcaggtgtcatat

SEQ ID NO: 245835 - DNA, 13 bp, Homo sapiens
accacagccctgt

SEQ ID NO: 245836 - DNA, 15 bp, Homo sapiens
accacagccctgtca

SEQ ID NO: 245837 - DNA, 12 bp, Homo sapiens
accacagctgct

SEQ ID NO: 245838 - DNA, 14 bp, Homo sapiens
accacaggaagccg

SEQ ID NO: 245839 - DNA, 19 bp, Homo sapiens
accacaggatctgaacttt

SEQ ID NO: 245840 - DNA, 17 bp, Homo sapiens
accacagggttcaaaat

SEQ ID NO: 245841 - DNA, 22 bp, Homo sapiens
accacagggttcaaaatgtctg

SEQ ID NO: 245842 - DNA, 16 bp, Homo sapiens
accacagtgggtggca

SEQ ID NO: 245843 - DNA, 19 bp, Homo sapiens
accacagtgggtggcacct

SEQ ID NO: 245844 - DNA, 22 bp, Homo sapiens
accacatcctccgtccagccgc

SEQ ID NO: 245845 - DNA, 14 bp, Homo sapiens
accacatcttgtct

SEQ ID NO: 245846 - DNA, 20 bp, Homo sapiens
accacatggtccatttcatg

SEQ ID NO: 245847 - DNA, 14 bp, Homo sapiens
accaccacacccct

SEQ ID NO: 245848 - DNA, 16 bp, Homo sapiens
aggaaatctcacccca

SEQ ID NO: 245849 - DNA, 19 bp, Homo sapiens
aggaaatctcctcttttgt

SEQ ID NO: 245850 - DNA, 22 bp, Homo sapiens
aggaaatcttgtccagagacaa

SEQ ID NO: 245851 - DNA, 14 bp, Homo sapiens
aggaaatgttattg

SEQ ID NO: 245852 - DNA, 18 bp, Homo sapiens
accagtgtactgctttca

SEQ ID NO: 245853 - DNA, 21 bp, Homo sapiens
accagtgttaagtgacataga

SEQ ID NO: 245854 - DNA, 19 bp, Homo sapiens
accagtgttagtgggaaga

SEQ ID NO: 245855 - DNA, 22 bp, Homo sapiens
accagtgttagtgggaagagct

SEQ ID NO: 245856 - DNA, 17 bp, Homo sapiens
accagttatgtgaatga

SEQ ID NO: 245857 - DNA, 21 bp, Homo sapiens
accagttgcacttggcctctg

SEQ ID NO: 245858 - DNA, 15 bp, Homo sapiens
accagttgggagcac

SEQ ID NO: 245859 - DNA, 19 bp, Homo sapiens
accagttgggagcactgga

SEQ ID NO: 245860 - DNA, 11 bp, Homo sapiens
accagtttacc

SEQ ID NO: 245861 - DNA, 14 bp, Homo sapiens
accagttttgctgc

SEQ ID NO: 245862 - DNA, 23 bp, Homo sapiens
accataacccaggaatgaagata

SEQ ID NO: 245863 - DNA, 14 bp, Homo sapiens
accatagaactgtc

SEQ ID NO: 245864 - DNA, 12 bp, Homo sapiens
accatcaataaa

SEQ ID NO: 245865 - DNA, 18 bp, Homo sapiens
accatcacaatacagata

SEQ ID NO: 245866 - DNA, 16 bp, Homo sapiens
accatcacagcttgtt

SEQ ID NO: 245867 - DNA, 23 bp, Homo sapiens
accatcagtgcacaaatcattcc

SEQ ID NO: 245868 - DNA, 20 bp, Homo sapiens
accatcagttactggtttca

SEQ ID NO: 245869 - DNA, 23 bp, Homo sapiens
accatcagttactggtttcagtt

SEQ ID NO: 245870 - DNA, 14 bp, Homo sapiens
accatcccactgat

SEQ ID NO: 245871 - DNA, 18 bp, Homo sapiens
accatcccctcctagcac

SEQ ID NO: 245872 - DNA, 14 bp, Homo sapiens
accatcctggcccc

SEQ ID NO: 245873 - DNA, 17 bp, Homo sapiens
accatcctggcccctcc

SEQ ID NO: 245874 - DNA, 16 bp, Homo sapiens
accatcggtcagcagg

SEQ ID NO: 245875 - DNA, 13 bp, Homo sapiens
accatctcaggcc

SEQ ID NO: 245876 - DNA, 16 bp, Homo sapiens
accatctcaggccacc

SEQ ID NO: 245877 - DNA, 21 bp, Homo sapiens
accatctcaggccacctgccc

SEQ ID NO: 245878 - DNA, 15 bp, Homo sapiens
accatctggcctggc

SEQ ID NO: 245879 - DNA, 14 bp, Homo sapiens
accatcttaatctt

SEQ ID NO: 245880 - DNA, 23 bp, Homo sapiens
accatcttaatctttattttatt

SEQ ID NO: 245881 - DNA, 15 bp, Homo sapiens
accatgaaacaaagc

SEQ ID NO: 245882 - DNA, 14 bp, Homo sapiens
accatgaagtgaaa

SEQ ID NO: 245883 - DNA, 18 bp, Homo sapiens
accatgagaagagggcct

SEQ ID NO: 245884 - DNA, 17 bp, Homo sapiens
accatgcacagagtcct

SEQ ID NO: 245885 - DNA, 23 bp, Homo sapiens
accatgctgctttttggcacagt

SEQ ID NO: 245886 - DNA, 21 bp, Homo sapiens
accatgctggcggcgcagagg

SEQ ID NO: 245887 - DNA, 21 bp, Homo sapiens
accatggctaaggcaccagcc

SEQ ID NO: 245888 - DNA, 14 bp, Homo sapiens
accatgtaaaacaa

SEQ ID NO: 245889 - DNA, 15 bp, Homo sapiens
accatgtaaaacaaa

SEQ ID NO: 245890 - DNA, 21 bp, Homo sapiens
accatgtaaaacaaaaaacaa

SEQ ID NO: 245891 - DNA, 11 bp, Homo sapiens
accatgtacat

SEQ ID NO: 245892 - DNA, 17 bp, Homo sapiens
accatgtgcatcaggaa

SEQ ID NO: 245893 - DNA, 12 bp, Homo sapiens
accatgtgccat

SEQ ID NO: 245894 - DNA, 21 bp, Homo sapiens
accatgtgccatctgtacata

SEQ ID NO: 245895 - DNA, 13 bp, Homo sapiens
accattaaaactg

SEQ ID NO: 245896 - DNA, 20 bp, Homo sapiens
accattaaaactgctttttt

SEQ ID NO: 245897 - DNA, 14 bp, Homo sapiens
accattataaaatc

SEQ ID NO: 245898 - DNA, 12 bp, Homo sapiens
accattccccat

SEQ ID NO: 245899 - DNA, 21 bp, Homo sapiens
accattcctttaaattctcca

SEQ ID NO: 245900 - DNA, 22 bp, Homo sapiens
accattgacctcagctgcacat

SEQ ID NO: 245901 - DNA, 13 bp, Homo sapiens
accattgcttcac

SEQ ID NO: 245902 - DNA, 15 bp, Homo sapiens
accattgcttcacta

SEQ ID NO: 245903 - DNA, 14 bp, Homo sapiens
accatttaatcatt

SEQ ID NO: 245904 - DNA, 19 bp, Homo sapiens
accatttagtcctcacctt

SEQ ID NO: 245905 - DNA, 16 bp, Homo sapiens
accatttcccctgtgg

SEQ ID NO: 245906 - DNA, 22 bp, Homo sapiens
accatttcccctgtggtttgtt

SEQ ID NO: 245907 - DNA, 17 bp, Homo sapiens
accatttcttatggaaa

SEQ ID NO: 245908 - DNA, 19 bp, Homo sapiens
accatttgtaataaagtat

SEQ ID NO: 245909 - DNA, 22 bp, Homo sapiens
accattttaacctagatgttta

SEQ ID NO: 245910 - DNA, 16 bp, Homo sapiens
acccaaaccccttccc

SEQ ID NO: 245911 - DNA, 19 bp, Homo sapiens
acccaactgacttctgcta

SEQ ID NO: 245912 - DNA, 15 bp, Homo sapiens
acccaagtccacccc

SEQ ID NO: 245913 - DNA, 11 bp, Homo sapiens
acccaataaag

SEQ ID NO: 245914 - DNA, 13 bp, Homo sapiens
acccaatttccaa

SEQ ID NO: 245915 - DNA, 21 bp, Homo sapiens
acccaattttaaaaaataaca

SEQ ID NO: 245916 - DNA, 22 bp, Homo sapiens
acccaattttaaaaaataacat

SEQ ID NO: 245917 - DNA, 13 bp, Homo sapiens
acccacaagtgcc

SEQ ID NO: 245918 - DNA, 21 bp, Homo sapiens
acccacaccccgtctgcccct

SEQ ID NO: 245919 - DNA, 14 bp, Homo sapiens
acccacagagcaag

SEQ ID NO: 245920 - DNA, 22 bp, Homo sapiens
acccacagggcctgacttttac

SEQ ID NO: 245921 - DNA, 17 bp, Homo sapiens
acccaccaaactgcaca

SEQ ID NO: 245922 - DNA, 20 bp, Homo sapiens
acccaccaaatgcctctgcc

SEQ ID NO: 245923 - DNA, 14 bp, Homo sapiens
acccaccagggctc

SEQ ID NO: 245924 - DNA, 14 bp, Homo sapiens
acccaccagtcagg

SEQ ID NO: 245925 - DNA, 11 bp, Homo sapiens
acccaccagtg

SEQ ID NO: 245926 - DNA, 16 bp, Homo sapiens
acccacccagcaccca

SEQ ID NO: 245927 - DNA, 14 bp, Homo sapiens
acccacccatcttc

SEQ ID NO: 245928 - DNA, 21 bp, Homo sapiens
acccacccatcttcctgctgc

SEQ ID NO: 245929 - DNA, 12 bp, Homo sapiens
acccaccccaac

SEQ ID NO: 245930 - DNA, 15 bp, Homo sapiens
acccaccccaactct

SEQ ID NO: 245931 - DNA, 16 bp, Homo sapiens
acccacccctcctggg

SEQ ID NO: 245932 - DNA, 23 bp, Homo sapiens
acccacccctcctgggcccaggc

SEQ ID NO: 245933 - DNA, 14 bp, Homo sapiens
acccacccctgccc

SEQ ID NO: 245934 - DNA, 16 bp, Homo sapiens
acccacccctgcccag

SEQ ID NO: 245935 - DNA, 13 bp, Homo sapiens
acccaccctctgg

SEQ ID NO: 245936 - DNA, 15 bp, Homo sapiens
acccacccttctccc

SEQ ID NO: 245937 - DNA, 22 bp, Homo sapiens
acccaccgatggagcccccaga

SEQ ID NO: 245938 - DNA, 13 bp, Homo sapiens
acccacctcagcc

SEQ ID NO: 245939 - DNA, 14 bp, Homo sapiens
acccacctccaccc

SEQ ID NO: 245940 - DNA, 15 bp, Homo sapiens
acccacctccaccca

SEQ ID NO: 245941 - DNA, 19 bp, Homo sapiens
acccacctccacccagccc

SEQ ID NO: 245942 - DNA, 16 bp, Homo sapiens
acccacctgagctttg

SEQ ID NO: 245943 - DNA, 20 bp, Homo sapiens
acccaccttgttggagcctg

SEQ ID NO: 245944 - DNA, 18 bp, Homo sapiens
acccacgaacgctcttag

SEQ ID NO: 245945 - DNA, 17 bp, Homo sapiens
acccactaagtaacctc

SEQ ID NO: 245946 - DNA, 19 bp, Homo sapiens
acccactagccctctttct

SEQ ID NO: 245947 - DNA, 15 bp, Homo sapiens
acccactcaccaggg

SEQ ID NO: 245948 - DNA, 19 bp, Homo sapiens
acccactgtccgcctctgc

SEQ ID NO: 245949 - DNA, 21 bp, Homo sapiens
acccactgtggggcaagcctg

SEQ ID NO: 245950 - DNA, 23 bp, Homo sapiens
acccagaagatgtattcagagcc

SEQ ID NO: 245951 - DNA, 18 bp, Homo sapiens
acccagagaatatataca

SEQ ID NO: 245952 - DNA, 23 bp, Homo sapiens
acccagaggaggcagaataagaa

SEQ ID NO: 245953 - DNA, 13 bp, Homo sapiens
acccagcaggggc

SEQ ID NO: 245954 - DNA, 20 bp, Homo sapiens
acccagcaggggcagaagga

SEQ ID NO: 245955 - DNA, 16 bp, Homo sapiens
acccagccaccttcct

SEQ ID NO: 245956 - DNA, 17 bp, Homo sapiens
acccagccaccttcctg

SEQ ID NO: 245957 - DNA, 22 bp, Homo sapiens
acccagccccagcgagtctgga

SEQ ID NO: 245958 - DNA, 21 bp, Homo sapiens
acccagccgccatcagcccaa

SEQ ID NO: 245959 - DNA, 18 bp, Homo sapiens
acccagcgttcttcagga

SEQ ID NO: 245960 - DNA, 14 bp, Homo sapiens
acccagctactctg

SEQ ID NO: 245961 - DNA, 13 bp, Homo sapiens
acccagctccagg

SEQ ID NO: 245962 - DNA, 21 bp, Homo sapiens
acccagctccttttgtcccca

SEQ ID NO: 245963 - DNA, 21 bp, Homo sapiens
acccaggaagggaaagcgggc

SEQ ID NO: 245964 - DNA, 12 bp, Homo sapiens
acccaggccctc

SEQ ID NO: 245965 - DNA, 16 bp, Homo sapiens
acccaggccctccatg

SEQ ID NO: 245966 - DNA, 11 bp, Homo sapiens
acccaggctgc

SEQ ID NO: 245967 - DNA, 13 bp, Homo sapiens
acccaggctgcac

SEQ ID NO: 245968 - DNA, 19 bp, Homo sapiens
acccaggctgcactgcagt

SEQ ID NO: 245969 - DNA, 21 bp, Homo sapiens
acccagggcagtgtggtggga

SEQ ID NO: 245970 - DNA, 18 bp, Homo sapiens
acccagggcccggcacag

SEQ ID NO: 245971 - DNA, 20 bp, Homo sapiens
acccagggctccctcctgga

SEQ ID NO: 245972 - DNA, 22 bp, Homo sapiens
acccagtcccagaaccacactg

SEQ ID NO: 245973 - DNA, 17 bp, Homo sapiens
acccagtccccgtgccc

SEQ ID NO: 245974 - DNA, 21 bp, Homo sapiens
acccagtccccgtgccccgcc

SEQ ID NO: 245975 - DNA, 21 bp, Homo sapiens
acccagtgctgccatgccact

SEQ ID NO: 245976 - DNA, 15 bp, Homo sapiens
acccagtggaaccaa

SEQ ID NO: 245977 - DNA, 18 bp, Homo sapiens
acccatagatcttctgaa

SEQ ID NO: 245978 - DNA, 22 bp, Homo sapiens
acccatagatcttctgaaatga

SEQ ID NO: 245979 - DNA, 15 bp, Homo sapiens
acccatcttccccgg

SEQ ID NO: 245980 - DNA, 23 bp, Homo sapiens
acccatgactgccccttgcttct

SEQ ID NO: 245981 - DNA, 15 bp, Homo sapiens
acccatgagcctgcc

SEQ ID NO: 245982 - DNA, 18 bp, Homo sapiens
acccctgtggagcccgca

SEQ ID NO: 245983 - DNA, 16 bp, Homo sapiens
accccttagcctccct

SEQ ID NO: 245984 - DNA, 18 bp, Homo sapiens
accccttcagccgagccc

SEQ ID NO: 245985 - DNA, 10 bp, Homo sapiens
accccttccc

SEQ ID NO: 245986 - DNA, 11 bp, Homo sapiens
accccttcccc

SEQ ID NO: 245987 - DNA, 14 bp, Homo sapiens
accccttccccact

SEQ ID NO: 245988 - DNA, 22 bp, Homo sapiens
accccttccccactgcctgccc

SEQ ID NO: 245989 - DNA, 23 bp, Homo sapiens
accccttccccactgcctgccca

SEQ ID NO: 245990 - DNA, 18 bp, Homo sapiens
accccttccccatttcct

SEQ ID NO: 245991 - DNA, 20 bp, Homo sapiens
accccttccccatttcctct

SEQ ID NO: 245992 - DNA, 20 bp, Homo sapiens
accccttcctgtctggccca

SEQ ID NO: 245993 - DNA, 23 bp, Homo sapiens
accccttccttttttctttcttt

SEQ ID NO: 245994 - DNA, 19 bp, Homo sapiens
accccttctttgcagggct

SEQ ID NO: 245995 - DNA, 16 bp, Homo sapiens
accccttgctcccttc

SEQ ID NO: 245996 - DNA, 12 bp, Homo sapiens
acccctttgctg

SEQ ID NO: 245997 - DNA, 13 bp, Homo sapiens
aggaggctggcag

SEQ ID NO: 245998 - DNA, 23 bp, Homo sapiens
aggaggctttaagctccagcttt

SEQ ID NO: 245999 - DNA, 15 bp, Homo sapiens
aggagggagggggct

SEQ ID NO: 246000 - DNA, 18 bp, Homo sapiens
aggagggcctcagagaca

SEQ ID NO: 246001 - DNA, 20 bp, Homo sapiens
aggagggcctcagagacagc

SEQ ID NO: 246002 - DNA, 15 bp, Homo sapiens
aggagggcctctggt

SEQ ID NO: 246003 - DNA, 14 bp, Homo sapiens
aggagggcgcccat

SEQ ID NO: 246004 - DNA, 14 bp, Homo sapiens
aggaggggaagctg

SEQ ID NO: 246005 - DNA, 22 bp, Homo sapiens
aggaggggacttgtaggaatct

SEQ ID NO: 246006 - DNA, 18 bp, Homo sapiens
aggagggggaggacggag

SEQ ID NO: 246007 - DNA, 13 bp, Homo sapiens
aggaggggtctgc

SEQ ID NO: 246008 - DNA, 21 bp, Homo sapiens
aggagggtggaggaaggtgct

SEQ ID NO: 246009 - DNA, 18 bp, Homo sapiens
aggaggtcccaggaagtc

SEQ ID NO: 246010 - DNA, 20 bp, Homo sapiens
aggaggtgtgatagagcctt

SEQ ID NO: 246011 - DNA, 20 bp, Homo sapiens
aggaggttgagaatgcagtg

SEQ ID NO: 246012 - DNA, 20 bp, Homo sapiens
aggagtaaagataaaaggat

SEQ ID NO: 246013 - DNA, 12 bp, Homo sapiens
aggagtactttc

SEQ ID NO: 246014 - DNA, 14 bp, Homo sapiens
aggagtcctttctt

SEQ ID NO: 246015 - DNA, 21 bp, Homo sapiens
aggagtctctgccacccactc

SEQ ID NO: 246016 - DNA, 22 bp, Homo sapiens
aggagtctctgccacccactca

SEQ ID NO: 246017 - DNA, 13 bp, Homo sapiens
aggagtctgtgct

SEQ ID NO: 246018 - DNA, 14 bp, Homo sapiens
aggagtctgtgctc

SEQ ID NO: 246019 - DNA, 16 bp, Homo sapiens
aggagtctgtgctctt

SEQ ID NO: 246020 - DNA, 17 bp, Homo sapiens
aggagtctgtgctcttt

SEQ ID NO: 246021 - DNA, 14 bp, Homo sapiens
aggagtgcatggcc

SEQ ID NO: 246022 - DNA, 18 bp, Homo sapiens
aggagtgcatggccacag

SEQ ID NO: 246023 - DNA, 19 bp, Homo sapiens
aggagtgcatggccacagc

SEQ ID NO: 246024 - DNA, 21 bp, Homo sapiens
aggagtgccgtgtgttgcatg

SEQ ID NO: 246025 - DNA, 17 bp, Homo sapiens
aggagtgcgctagagca

SEQ ID NO: 246026 - DNA, 17 bp, Homo sapiens
aggagtgtgctcaggcc

SEQ ID NO: 246027 - DNA, 16 bp, Homo sapiens
aggagtgtggccacgt

SEQ ID NO: 246028 - DNA, 14 bp, Homo sapiens
aggagttcaatgat

SEQ ID NO: 246029 - DNA, 16 bp, Homo sapiens
aggagttcaatgatct

SEQ ID NO: 246030 - DNA, 19 bp, Homo sapiens
aggagttcctaaccagcct

SEQ ID NO: 246031 - DNA, 18 bp, Homo sapiens
aggagttgtttctgaccc

SEQ ID NO: 246032 - DNA, 20 bp, Homo sapiens
aggagttgtttctgacccac

SEQ ID NO: 246033 - DNA, 14 bp, Homo sapiens
aggatacatgtgcc

SEQ ID NO: 246034 - DNA, 14 bp, Homo sapiens
aggatagcattttt

SEQ ID NO: 246035 - DNA, 13 bp, Homo sapiens
aggatagcctttg

SEQ ID NO: 246036 - DNA, 14 bp, Homo sapiens
aggatagcctttgt

SEQ ID NO: 246037 - DNA, 17 bp, Homo sapiens
aggatatttaagaaaat

SEQ ID NO: 246038 - DNA, 19 bp, Homo sapiens
aggatatttaagaaaatac

SEQ ID NO: 246039 - DNA, 19 bp, Homo sapiens
aggatcacttaagcccagg

SEQ ID NO: 246040 - DNA, 12 bp, Homo sapiens
aggatcacttga

SEQ ID NO: 246041 - DNA, 19 bp, Homo sapiens
aggatcacttgagcccaga

SEQ ID NO: 246042 - DNA, 15 bp, Homo sapiens
aggatccgtgctgtc

SEQ ID NO: 246043 - DNA, 16 bp, Homo sapiens
aggatcctgcaggaac

SEQ ID NO: 246044 - DNA, 15 bp, Homo sapiens
aggatctctcaggag

SEQ ID NO: 246045 - DNA, 20 bp, Homo sapiens
aggatctctcaggagcacag

SEQ ID NO: 246046 - DNA, 13 bp, Homo sapiens
aggatgaaagaca

SEQ ID NO: 246047 - DNA, 19 bp, Homo sapiens
aggatgaagaacacagcat

SEQ ID NO: 246048 - DNA, 21 bp, Homo sapiens
aggatgacccggggcagctgg

SEQ ID NO: 246049 - DNA, 15 bp, Homo sapiens
aggatgagctggaag

SEQ ID NO: 246050 - DNA, 14 bp, Homo sapiens
aggatgatgtaatt

SEQ ID NO: 246051 - DNA, 15 bp, Homo sapiens
aggatgattgtacag

SEQ ID NO: 246052 - DNA, 21 bp, Homo sapiens
aggatgcacagtttgctattt

SEQ ID NO: 246053 - DNA, 12 bp, Homo sapiens
aggatgctgaag

SEQ ID NO: 246054 - DNA, 13 bp, Homo sapiens
aggatgctgtgcc

SEQ ID NO: 246055 - DNA, 15 bp, Homo sapiens
aggatgctgtgcctc

SEQ ID NO: 246056 - DNA, 17 bp, Homo sapiens
aggatggagccagctct

SEQ ID NO: 246057 - DNA, 12 bp, Homo sapiens
aggatggagggg

SEQ ID NO: 246058 - DNA, 14 bp, Homo sapiens
aggatggcgtgtcc

SEQ ID NO: 246059 - DNA, 18 bp, Homo sapiens
aggatggcgtgtcccctg

SEQ ID NO: 246060 - DNA, 16 bp, Homo sapiens
aggatgtggatggagg

SEQ ID NO: 246061 - DNA, 21 bp, Homo sapiens
aggattaagttcgaggtggct

SEQ ID NO: 246062 - DNA, 18 bp, Homo sapiens
aggattaatctctaaaat

SEQ ID NO: 246063 - DNA, 15 bp, Homo sapiens
aggattatatgtatt

SEQ ID NO: 246064 - DNA, 18 bp, Homo sapiens
aggattcaaccctggctt

SEQ ID NO: 246065 - DNA, 15 bp, Homo sapiens
aggattcctccccca

SEQ ID NO: 246066 - DNA, 17 bp, Homo sapiens
aggattctaaacagatg

SEQ ID NO: 246067 - DNA, 20 bp, Homo sapiens
aggattgtctggggccgagg

SEQ ID NO: 246068 - DNA, 18 bp, Homo sapiens
aggatttaaaaactggaa

SEQ ID NO: 246069 - DNA, 12 bp, Homo sapiens
aggatttaacag

SEQ ID NO: 246070 - DNA, 16 bp, Homo sapiens
aggatttaacagtcat

SEQ ID NO: 246071 - DNA, 14 bp, Homo sapiens
aggatttacttttt

SEQ ID NO: 246072 - DNA, 15 bp, Homo sapiens
aggatttgaaaacac

SEQ ID NO: 246073 - DNA, 18 bp, Homo sapiens
aggatttggtttttctct

SEQ ID NO: 246074 - DNA, 19 bp, Homo sapiens
aggatttggtttttctctt

SEQ ID NO: 246075 - DNA, 20 bp, Homo sapiens
aggatttggtttttctcttt

SEQ ID NO: 246076 - DNA, 14 bp, Homo sapiens
aggattttgtattg

SEQ ID NO: 246077 - DNA, 17 bp, Homo sapiens
aggattttgtgtttttt

SEQ ID NO: 246078 - DNA, 16 bp, Homo sapiens
aggatttttttctgag

SEQ ID NO: 246079 - DNA, 21 bp, Homo sapiens
aggcaaacaatcccaatcttt

SEQ ID NO: 246080 - DNA, 11 bp, Homo sapiens
aggcaaatgtc

SEQ ID NO: 246081 - DNA, 12 bp, Homo sapiens
aggcaaatgtcc

SEQ ID NO: 246082 - DNA, 20 bp, Homo sapiens
aggcaacagtgttctgagcc

SEQ ID NO: 246083 - DNA, 21 bp, Homo sapiens
aggcaacagtgttctgagccc

SEQ ID NO: 246084 - DNA, 20 bp, Homo sapiens
aggcaacattacaaacaaag

SEQ ID NO: 246085 - DNA, 17 bp, Homo sapiens
aggcaactattaataat

SEQ ID NO: 246086 - DNA, 18 bp, Homo sapiens
aggcaactgaacaaaaaa

SEQ ID NO: 246087 - DNA, 22 bp, Homo sapiens
aggcaacttcagtcctgggaga

SEQ ID NO: 246088 - DNA, 15 bp, Homo sapiens
aggcaagaagtggga

SEQ ID NO: 246089 - DNA, 20 bp, Homo sapiens
aggcaagagaaatgaggaag

SEQ ID NO: 246090 - DNA, 20 bp, Homo sapiens
aggcaagatccccgccaccc

SEQ ID NO: 246091 - DNA, 13 bp, Homo sapiens
aggcaagcccctc

SEQ ID NO: 246092 - DNA, 14 bp, Homo sapiens
aggcaagcccctca

SEQ ID NO: 246093 - DNA, 19 bp, Homo sapiens
aggcaagctggcaggaggg

SEQ ID NO: 246094 - DNA, 14 bp, Homo sapiens
aggcaaggatgaaa

SEQ ID NO: 246095 - DNA, 15 bp, Homo sapiens
aggcaaggctgccgg

SEQ ID NO: 246096 - DNA, 19 bp, Homo sapiens
aggcaaggctgccggctgc

SEQ ID NO: 246097 - DNA, 16 bp, Homo sapiens
aggcaaggctgtcaat

SEQ ID NO: 246098 - DNA, 18 bp, Homo sapiens
aggcaaggggtgcctggg

SEQ ID NO: 246099 - DNA, 18 bp, Homo sapiens
aggcaagtttctagctag

SEQ ID NO: 246100 - DNA, 17 bp, Homo sapiens
aggcaataaaaatcata

SEQ ID NO: 246101 - DNA, 19 bp, Homo sapiens
aggcacactgagcaagttt

SEQ ID NO: 246102 - DNA, 19 bp, Homo sapiens
aggcacactgctaaattta

SEQ ID NO: 246103 - DNA, 13 bp, Homo sapiens
aggcaccagctct

SEQ ID NO: 246104 - DNA, 16 bp, Homo sapiens
aggcaccagctctgtg

SEQ ID NO: 246105 - DNA, 17 bp, Homo sapiens
aggcaccagctctgtgg

SEQ ID NO: 246106 - DNA, 19 bp, Homo sapiens
aggcaccatagaagaacag

SEQ ID NO: 246107 - DNA, 17 bp, Homo sapiens
aggcaccattcaggaac

SEQ ID NO: 246108 - DNA, 22 bp, Homo sapiens
aggcacccctccgtgtggagca

SEQ ID NO: 246109 - DNA, 23 bp, Homo sapiens
aggcacccgccctttccttgcct

SEQ ID NO: 246110 - DNA, 18 bp, Homo sapiens
aggcaccgagaatgttgt

SEQ ID NO: 246111 - DNA, 15 bp, Homo sapiens
aggcacctggcctgc

SEQ ID NO: 246112 - DNA, 21 bp, Homo sapiens
aggcacctggcctgctgggaa

SEQ ID NO: 246113 - DNA, 20 bp, Homo sapiens
aggccccagagactcagagg

SEQ ID NO: 246114 - DNA, 13 bp, Homo sapiens
aggccccagccaa

SEQ ID NO: 246115 - DNA, 13 bp, Homo sapiens
aggccccagcctc

SEQ ID NO: 246116 - DNA, 14 bp, Homo sapiens
aggccccagcctcc

SEQ ID NO: 246117 - DNA, 19 bp, Homo sapiens
aggccccagcctccaggcc

SEQ ID NO: 246118 - DNA, 19 bp, Homo sapiens
aggcccccaaacatagccc

SEQ ID NO: 246119 - DNA, 19 bp, Homo sapiens
aggcccccggaggcgccca

SEQ ID NO: 246120 - DNA, 22 bp, Homo sapiens
aggcccccggaggcgcccacct

SEQ ID NO: 246121 - DNA, 13 bp, Homo sapiens
aggcccctgagga

SEQ ID NO: 246122 - DNA, 17 bp, Homo sapiens
aggcccctgaggactgg

SEQ ID NO: 246123 - DNA, 15 bp, Homo sapiens
aggcccctggcccag

SEQ ID NO: 246124 - DNA, 20 bp, Homo sapiens
aggcccctggcccagcggcc

SEQ ID NO: 246125 - DNA, 15 bp, Homo sapiens
aggccctagaccctc

SEQ ID NO: 246126 - DNA, 12 bp, Homo sapiens
aggccctaggcg

SEQ ID NO: 246127 - DNA, 18 bp, Homo sapiens
aggccctccatgggctag

SEQ ID NO: 246128 - DNA, 15 bp, Homo sapiens
aggccctccctgtct

SEQ ID NO: 246129 - DNA, 23 bp, Homo sapiens
aggccctcctgctggctgaggct

SEQ ID NO: 246130 - DNA, 12 bp, Homo sapiens
aggccctgcagt

SEQ ID NO: 246131 - DNA, 14 bp, Homo sapiens
aggccctgtctgta

SEQ ID NO: 246132 - DNA, 13 bp, Homo sapiens
aggcccttcctct

SEQ ID NO: 246133 - DNA, 14 bp, Homo sapiens
aggcccttgtcctg

SEQ ID NO: 246134 - DNA, 22 bp, Homo sapiens
aggcccttgtcctgccagctgc

SEQ ID NO: 246135 - DNA, 15 bp, Homo sapiens
aggcccttttctggc

SEQ ID NO: 246136 - DNA, 22 bp, Homo sapiens
aggcccttttctggctcctgtg

SEQ ID NO: 246137 - DNA, 16 bp, Homo sapiens
aggccgaggagagagg

SEQ ID NO: 246138 - DNA, 14 bp, Homo sapiens
aggccgccccagcc

SEQ ID NO: 246139 - DNA, 14 bp, Homo sapiens
aggccgctagaggc

SEQ ID NO: 246140 - DNA, 17 bp, Homo sapiens
accgcatatgcatgcca

SEQ ID NO: 246141 - DNA, 15 bp, Homo sapiens
accgcatcctccagg

SEQ ID NO: 246142 - DNA, 20 bp, Homo sapiens
accgcatctgctcatctgat

SEQ ID NO: 246143 - DNA, 17 bp, Homo sapiens
accgccagatggggcct

SEQ ID NO: 246144 - DNA, 20 bp, Homo sapiens
accgccagatggggcctctg

SEQ ID NO: 246145 - DNA, 20 bp, Homo sapiens
accgcccaacccccacctcc

SEQ ID NO: 246146 - DNA, 18 bp, Homo sapiens
accgccctgggctggact

SEQ ID NO: 246147 - DNA, 16 bp, Homo sapiens
accgcctgcttcacac

SEQ ID NO: 246148 - DNA, 22 bp, Homo sapiens
accgcctgcttcacacccctca

SEQ ID NO: 246149 - DNA, 15 bp, Homo sapiens
accgctccccagccc

SEQ ID NO: 246150 - DNA, 17 bp, Homo sapiens
accgctccccagcccag

SEQ ID NO: 246151 - DNA, 20 bp, Homo sapiens
accgctccccagcccagggt

SEQ ID NO: 246152 - DNA, 16 bp, Homo sapiens
accgctgccagcacag

SEQ ID NO: 246153 - DNA, 19 bp, Homo sapiens
accgctgccagcacagagc

SEQ ID NO: 246154 - DNA, 20 bp, Homo sapiens
accgcttcacccctgcactt

SEQ ID NO: 246155 - DNA, 15 bp, Homo sapiens
accgcttctgccttt

SEQ ID NO: 246156 - DNA, 17 bp, Homo sapiens
accgcttctgccttttc

SEQ ID NO: 246157 - DNA, 17 bp, Homo sapiens
accggaagctcctggta

SEQ ID NO: 246158 - DNA, 16 bp, Homo sapiens
accggaattgagaggt

SEQ ID NO: 246159 - DNA, 16 bp, Homo sapiens
accggcccgccacctt

SEQ ID NO: 246160 - DNA, 22 bp, Homo sapiens
accggccgcatgtctgcatggc

SEQ ID NO: 246161 - DNA, 14 bp, Homo sapiens
accggctgcttttc

SEQ ID NO: 246162 - DNA, 19 bp, Homo sapiens
accgggagcctgcgtggcc

SEQ ID NO: 246163 - DNA, 22 bp, Homo sapiens
accgggagcctgcgtggcctgg

SEQ ID NO: 246164 - DNA, 21 bp, Homo sapiens
accgggctgggagctctgcag

SEQ ID NO: 246165 - DNA, 21 bp, Homo sapiens
accggggcactggctgctctg

SEQ ID NO: 246166 - DNA, 14 bp, Homo sapiens
accgggtgggcctg

SEQ ID NO: 246167 - DNA, 15 bp, Homo sapiens
accgggtgggcctgg

SEQ ID NO: 246168 - DNA, 17 bp, Homo sapiens
accgggtgggcctggcc

SEQ ID NO: 246169 - DNA, 18 bp, Homo sapiens
accgggtgggcctggcct

SEQ ID NO: 246170 - DNA, 16 bp, Homo sapiens
accgtaattttattat

SEQ ID NO: 246171 - DNA, 14 bp, Homo sapiens
accgtactctcaca

SEQ ID NO: 246172 - DNA, 13 bp, Homo sapiens
accgtagcctccg

SEQ ID NO: 246173 - DNA, 20 bp, Homo sapiens
accgtgagcaggaaggcctg

SEQ ID NO: 246174 - DNA, 22 bp, Homo sapiens
accgtgagcaggaaggcctggg

SEQ ID NO: 246175 - DNA, 22 bp, Homo sapiens
accgtgagcgccccgcccccac

SEQ ID NO: 246176 - DNA, 13 bp, Homo sapiens
accgtgccattgt

SEQ ID NO: 246177 - DNA, 20 bp, Homo sapiens
accgtgcccggctaattttt

SEQ ID NO: 246178 - DNA, 18 bp, Homo sapiens
accgtggtgtgaggcccc

SEQ ID NO: 246179 - DNA, 21 bp, Homo sapiens
accgtggtgtgaggcccccgg

SEQ ID NO: 246180 - DNA, 20 bp, Homo sapiens
accgtgtcccaaggagctga

SEQ ID NO: 246181 - DNA, 14 bp, Homo sapiens
accgttcacttccc

SEQ ID NO: 246182 - DNA, 13 bp, Homo sapiens
accgtttggtgtc

SEQ ID NO: 246183 - DNA, 18 bp, Homo sapiens
accgttttcatcctggcc

SEQ ID NO: 246184 - DNA, 18 bp, Homo sapiens
accgtttttatattactt

SEQ ID NO: 246185 - DNA, 17 bp, Homo sapiens
acctaaaaaaagagaat

SEQ ID NO: 246186 - DNA, 19 bp, Homo sapiens
acctaaaaccagttttgct

SEQ ID NO: 246187 - DNA, 19 bp, Homo sapiens
acctaaaattaagaagtac

SEQ ID NO: 246188 - DNA, 20 bp, Homo sapiens
acctaaatccattttctaaa

SEQ ID NO: 246189 - DNA, 11 bp, Homo sapiens
acctaacattc

SEQ ID NO: 246190 - DNA, 19 bp, Homo sapiens
acctaagggctaaggcctc

SEQ ID NO: 246191 - DNA, 14 bp, Homo sapiens
acctaagtgactac

SEQ ID NO: 246192 - DNA, 23 bp, Homo sapiens
acctacattccctctcctgccca

SEQ ID NO: 246193 - DNA, 15 bp, Homo sapiens
acctaccacagtgtc

SEQ ID NO: 246194 - DNA, 16 bp, Homo sapiens
acctaccacagtgtct

SEQ ID NO: 246195 - DNA, 17 bp, Homo sapiens
acctaccacagtgtctg

SEQ ID NO: 246196 - DNA, 18 bp, Homo sapiens
acctaccctcaaagtagg

SEQ ID NO: 246197 - DNA, 17 bp, Homo sapiens
acctaccttcaaagctg

SEQ ID NO: 246198 - DNA, 16 bp, Homo sapiens
acctacgaccccagag

SEQ ID NO: 246199 - DNA, 17 bp, Homo sapiens
acctactatgtgctggg

SEQ ID NO: 246200 - DNA, 11 bp, Homo sapiens
acctactgagt

SEQ ID NO: 246201 - DNA, 22 bp, Homo sapiens
acctagaaacctttatccctgc

SEQ ID NO: 246202 - DNA, 21 bp, Homo sapiens
acctagaccttgcctcccctc

SEQ ID NO: 246203 - DNA, 23 bp, Homo sapiens
acctagaccttgcctcccctcct

SEQ ID NO: 246204 - DNA, 19 bp, Homo sapiens
acctagcatcttacaaaaa

SEQ ID NO: 246205 - DNA, 17 bp, Homo sapiens
acctagccaacatggtg

SEQ ID NO: 246206 - DNA, 17 bp, Homo sapiens
acctagggaggacctta

SEQ ID NO: 246207 - DNA, 16 bp, Homo sapiens
acctataaagtaaagc

SEQ ID NO: 246208 - DNA, 22 bp, Homo sapiens
acctatataataaagctactga

SEQ ID NO: 246209 - DNA, 22 bp, Homo sapiens
acctatgcttctagaaagcccc

SEQ ID NO: 246210 - DNA, 23 bp, Homo sapiens
acctatgtcctaaggacacacta

SEQ ID NO: 246211 - DNA, 12 bp, Homo sapiens
acctatgtttgc

SEQ ID NO: 246212 - DNA, 13 bp, Homo sapiens
acctattgccagg

SEQ ID NO: 246213 - DNA, 23 bp, Homo sapiens
acctattgccaggaatgtttcag

SEQ ID NO: 246214 - DNA, 16 bp, Homo sapiens
acctcaaaatgtctaa

SEQ ID NO: 246215 - DNA, 16 bp, Homo sapiens
acctcaacctgtaaat

SEQ ID NO: 246216 - DNA, 18 bp, Homo sapiens
acctcaacctgtaaatta

SEQ ID NO: 246217 - DNA, 19 bp, Homo sapiens
acctcaacctgtaaattat

SEQ ID NO: 246218 - DNA, 21 bp, Homo sapiens
acctcaacctgtaaattattt

SEQ ID NO: 246219 - DNA, 16 bp, Homo sapiens
acctcaacctgtgatg

SEQ ID NO: 246220 - DNA, 12 bp, Homo sapiens
acctcaagggct

SEQ ID NO: 246221 - DNA, 14 bp, Homo sapiens
acctcacaactcct

SEQ ID NO: 246222 - DNA, 20 bp, Homo sapiens
acctcaccccgttacagctc

SEQ ID NO: 246223 - DNA, 15 bp, Homo sapiens
acctcacgctctgga

SEQ ID NO: 246224 - DNA, 14 bp, Homo sapiens
acctcactgccctc

SEQ ID NO: 246225 - DNA, 18 bp, Homo sapiens
acctcactggtgcattta

SEQ ID NO: 246226 - DNA, 16 bp, Homo sapiens
acctcagagccccgca

SEQ ID NO: 246227 - DNA, 17 bp, Homo sapiens
acctcagagtccaggcc

SEQ ID NO: 246228 - DNA, 15 bp, Homo sapiens
acctcagcaacctgt

SEQ ID NO: 246229 - DNA, 23 bp, Homo sapiens
acctcagcatttactttgtttct

SEQ ID NO: 246230 - DNA, 11 bp, Homo sapiens
acctcagcctc

SEQ ID NO: 246231 - DNA, 14 bp, Homo sapiens
acctcagctctggg

SEQ ID NO: 246232 - DNA, 12 bp, Homo sapiens
acctcagctgca

SEQ ID NO: 246233 - DNA, 18 bp, Homo sapiens
acctcagctgcacattcc

SEQ ID NO: 246234 - DNA, 14 bp, Homo sapiens
acctcaggacccca

SEQ ID NO: 246235 - DNA, 15 bp, Homo sapiens
acctcaggaccccag

SEQ ID NO: 246236 - DNA, 12 bp, Homo sapiens
acctcaggcagg

SEQ ID NO: 246237 - DNA, 15 bp, Homo sapiens
acctcaggttccaaa

SEQ ID NO: 246238 - DNA, 16 bp, Homo sapiens
acctcagtgtcattta

SEQ ID NO: 246239 - DNA, 19 bp, Homo sapiens
acctcagttcccttggcct

SEQ ID NO: 246240 - DNA, 21 bp, Homo sapiens
acctcagttcccttggcctca

SEQ ID NO: 246241 - DNA, 23 bp, Homo sapiens
acctcagttcccttggcctcaga

SEQ ID NO: 246242 - DNA, 21 bp, Homo sapiens
acctcagtttctgttgtttct

SEQ ID NO: 246243 - DNA, 15 bp, Homo sapiens
caaatagcataagtt

SEQ ID NO: 246244 - DNA, 20 bp, Homo sapiens
caaatagggcaaagaatcaa

SEQ ID NO: 246245 - DNA, 23 bp, Homo sapiens
caaatagtaggctaaaaacattt

SEQ ID NO: 246246 - DNA, 15 bp, Homo sapiens
caaatagtgaaaagt

SEQ ID NO: 246247 - DNA, 20 bp, Homo sapiens
caaatagtttataaatgtga

SEQ ID NO: 246248 - DNA, 15 bp, Homo sapiens
caaatataagatttt

SEQ ID NO: 246249 - DNA, 18 bp, Homo sapiens
caaatataagattttctg

SEQ ID NO: 246250 - DNA, 14 bp, Homo sapiens
caaatatagttgaa

SEQ ID NO: 246251 - DNA, 13 bp, Homo sapiens
caaatatctcaga

SEQ ID NO: 246252 - DNA, 14 bp, Homo sapiens
caaatatctcagag

SEQ ID NO: 246253 - DNA, 15 bp, Homo sapiens
caaatatctcagagg

SEQ ID NO: 246254 - DNA, 14 bp, Homo sapiens
caaatatgtcctgg

SEQ ID NO: 246255 - DNA, 15 bp, Homo sapiens
caaatatgtcctggg

SEQ ID NO: 246256 - DNA, 16 bp, Homo sapiens
caaatattcattttga

SEQ ID NO: 246257 - DNA, 18 bp, Homo sapiens
caaatattgcttggacta

SEQ ID NO: 246258 - DNA, 21 bp, Homo sapiens
caaatatttatgacctcaaca

SEQ ID NO: 246259 - DNA, 17 bp, Homo sapiens
caaatattttagaagct

SEQ ID NO: 246260 - DNA, 22 bp, Homo sapiens
caaatcaaagcaagggctccag

SEQ ID NO: 246261 - DNA, 18 bp, Homo sapiens
caaatcactgtatttatc

SEQ ID NO: 246262 - DNA, 15 bp, Homo sapiens
caaatcagacacaat

SEQ ID NO: 246263 - DNA, 13 bp, Homo sapiens
caaatcagtctca

SEQ ID NO: 246264 - DNA, 17 bp, Homo sapiens
caaatcagtctcacaat

SEQ ID NO: 246265 - DNA, 19 bp, Homo sapiens
caaatcccctccctgtgac

SEQ ID NO: 246266 - DNA, 20 bp, Homo sapiens
caaatccttccaaaaattat

SEQ ID NO: 246267 - DNA, 23 bp, Homo sapiens
caaatctaatctcttattctaat

SEQ ID NO: 246268 - DNA, 16 bp, Homo sapiens
caaatctactgagcca

SEQ ID NO: 246269 - DNA, 17 bp, Homo sapiens
caaatctactgagccac

SEQ ID NO: 246270 - DNA, 13 bp, Homo sapiens
caaatctattcag

SEQ ID NO: 246271 - DNA, 19 bp, Homo sapiens
caaatctgtatatgttgta

SEQ ID NO: 246272 - DNA, 12 bp, Homo sapiens
caaatctgtcta

SEQ ID NO: 246273 - DNA, 12 bp, Homo sapiens
caaatcttcctc

SEQ ID NO: 246274 - DNA, 14 bp, Homo sapiens
caaatcttcctctg

SEQ ID NO: 246275 - DNA, 13 bp, Homo sapiens
caaatctttaaga

SEQ ID NO: 246276 - DNA, 20 bp, Homo sapiens
caaatgaccgcacgttctct

SEQ ID NO: 246277 - DNA, 16 bp, Homo sapiens
caaatgacttcatttc

SEQ ID NO: 246278 - DNA, 22 bp, Homo sapiens
caaatgagatgtatgcccaaag

SEQ ID NO: 246279 - DNA, 21 bp, Homo sapiens
caaatgattttcatcaattta

SEQ ID NO: 246280 - DNA, 15 bp, Homo sapiens
caaatgcagacacac

SEQ ID NO: 246281 - DNA, 16 bp, Homo sapiens
caaatgcagacacaca

SEQ ID NO: 246282 - DNA, 19 bp, Homo sapiens
caaatgcagacacacaaca

SEQ ID NO: 246283 - DNA, 20 bp, Homo sapiens
caaatgcagggaggggaggc

SEQ ID NO: 246284 - DNA, 14 bp, Homo sapiens
caaatgcctctgcc

SEQ ID NO: 246285 - DNA, 20 bp, Homo sapiens
attttttccctcctgacaaa

SEQ ID NO: 246286 - DNA, 16 bp, Homo sapiens
atttttttaaatttgc

SEQ ID NO: 246287 - DNA, 19 bp, Homo sapiens
atttttttaactgaaaatg

SEQ ID NO: 246288 - DNA, 23 bp, Homo sapiens
atttttttatataagttaaagag

SEQ ID NO: 246289 - DNA, 15 bp, Homo sapiens
atttttttattcttc

SEQ ID NO: 246290 - DNA, 21 bp, Homo sapiens
atttttttcactggagttaca

SEQ ID NO: 246291 - DNA, 22 bp, Homo sapiens
atttttttctagctataacaac

SEQ ID NO: 246292 - DNA, 13 bp, Homo sapiens
atttttttgtatt

SEQ ID NO: 246293 - DNA, 14 bp, Homo sapiens
atttttttgtattt

SEQ ID NO: 246294 - DNA, 15 bp, Homo sapiens
attttttttaactgc

SEQ ID NO: 246295 - DNA, 21 bp, Homo sapiens
attttttttggttgtttgctg

SEQ ID NO: 246296 - DNA, 22 bp, Homo sapiens
attttttttggttgtttgctgt

SEQ ID NO: 246297 - DNA, 16 bp, Homo sapiens
caaaaaaacactagtt

SEQ ID NO: 246298 - DNA, 23 bp, Homo sapiens
caaaaaaatatatttaatgataa

SEQ ID NO: 246299 - DNA, 22 bp, Homo sapiens
caaaaaacaatatttattgtat

SEQ ID NO: 246300 - DNA, 15 bp, Homo sapiens
caaaaaagggacagc

SEQ ID NO: 246301 - DNA, 20 bp, Homo sapiens
caaaaaatgtgagctataat

SEQ ID NO: 246302 - DNA, 17 bp, Homo sapiens
caaaaacaataaacgaa

SEQ ID NO: 246303 - DNA, 14 bp, Homo sapiens
caaaaaccagcagg

SEQ ID NO: 246304 - DNA, 19 bp, Homo sapiens
caaaaactagtaaagacat

SEQ ID NO: 246305 - DNA, 14 bp, Homo sapiens
caaaaactttccat

SEQ ID NO: 246306 - DNA, 18 bp, Homo sapiens
caaaaactttccatgaca

SEQ ID NO: 246307 - DNA, 24 bp, Homo sapiens
caaaaactttccatgacagtagca

SEQ ID NO: 246308 - DNA, 22 bp, Homo sapiens
caaaaagaatctgcatttagca

SEQ ID NO: 246309 - DNA, 23 bp, Homo sapiens
caaaaagctttaaaaaataaagc

SEQ ID NO: 246310 - DNA, 11 bp, Homo sapiens
caaaaagtgtt

SEQ ID NO: 246311 - DNA, 15 bp, Homo sapiens
caaaaagtttccata

SEQ ID NO: 246312 - DNA, 11 bp, Homo sapiens
caaaaatataa

SEQ ID NO: 246313 - DNA, 15 bp, Homo sapiens
caaaaatatattaaa

SEQ ID NO: 246314 - DNA, 20 bp, Homo sapiens
caaaaatatattaaaaatat

SEQ ID NO: 246315 - DNA, 17 bp, Homo sapiens
caaaaatgaactgaagt

SEQ ID NO: 246316 - DNA, 18 bp, Homo sapiens
caaaaatgccacttaaca

SEQ ID NO: 246317 - DNA, 13 bp, Homo sapiens
caaaaattaaaat

SEQ ID NO: 246318 - DNA, 15 bp, Homo sapiens
caaaaattagccggg

SEQ ID NO: 246319 - DNA, 11 bp, Homo sapiens
caaaaattatc

SEQ ID NO: 246320 - DNA, 22 bp, Homo sapiens
caaaaattgcgagcctttaccc

SEQ ID NO: 246321 - DNA, 10 bp, Homo sapiens
caaaacaaca

SEQ ID NO: 246322 - DNA, 12 bp, Homo sapiens
caaaacaacagc

SEQ ID NO: 246323 - DNA, 13 bp, Homo sapiens
caaaacaacagca

SEQ ID NO: 246324 - DNA, 16 bp, Homo sapiens
caaaacaacagcaaca

SEQ ID NO: 246325 - DNA, 21 bp, Homo sapiens
caaaacaacagcaacaacaac

SEQ ID NO: 246326 - DNA, 14 bp, Homo sapiens
caaaacaagaaaga

SEQ ID NO: 246327 - DNA, 17 bp, Homo sapiens
caaaacaagaaagaaac

SEQ ID NO: 246328 - DNA, 12 bp, Homo sapiens
caaaacagaacg

SEQ ID NO: 246329 - DNA, 22 bp, Homo sapiens
caaaacatgctacctgatccca

SEQ ID NO: 246330 - DNA, 16 bp, Homo sapiens
caaaaccaagccttgg

SEQ ID NO: 246331 - DNA, 17 bp, Homo sapiens
caaaaccattgcttcac

SEQ ID NO: 246332 - DNA, 22 bp, Homo sapiens
caaaaccggcaacctgtaactg

SEQ ID NO: 246333 - DNA, 14 bp, Homo sapiens
caaaacctaacttg

SEQ ID NO: 246334 - DNA, 21 bp, Homo sapiens
caaaacctgatgttaaaattc

SEQ ID NO: 246335 - DNA, 19 bp, Homo sapiens
caaaacctgtgccaggctg

SEQ ID NO: 246336 - DNA, 19 bp, Homo sapiens
caaaactatcggttcaagt

SEQ ID NO: 246337 - DNA, 17 bp, Homo sapiens
caaaactgcctgaaagc

SEQ ID NO: 246338 - DNA, 19 bp, Homo sapiens
caaaactgcctgaaagcaa

SEQ ID NO: 246339 - DNA, 12 bp, Homo sapiens
caaaactttcag

SEQ ID NO: 246340 - DNA, 14 bp, Homo sapiens
caaaagataaaact

SEQ ID NO: 246341 - DNA, 18 bp, Homo sapiens
caaaagcacaaaccctgg

SEQ ID NO: 246342 - DNA, 19 bp, Homo sapiens
caaaagcaggcttgtgctt

SEQ ID NO: 246343 - DNA, 18 bp, Homo sapiens
caaaagccataacttgaa

SEQ ID NO: 246344 - DNA, 11 bp, Homo sapiens
caaaagcctct

SEQ ID NO: 246345 - DNA, 11 bp, Homo sapiens
caaaagcctgg

SEQ ID NO: 246346 - DNA, 14 bp, Homo sapiens
caaaagcctgggtg

SEQ ID NO: 246347 - DNA, 20 bp, Homo sapiens
caaaagccttacggtcatga

SEQ ID NO: 246348 - DNA, 14 bp, Homo sapiens
caaaagctatatgt

SEQ ID NO: 246349 - DNA, 15 bp, Homo sapiens
caaaagctgtgtctc

SEQ ID NO: 246350 - DNA, 22 bp, Homo sapiens
caaaaggagaactgtgctctcc

SEQ ID NO: 246351 - DNA, 12 bp, Homo sapiens
caaaaggcagct

SEQ ID NO: 246352 - DNA, 13 bp, Homo sapiens
caaaaggcagctc

SEQ ID NO: 246353 - DNA, 22 bp, Homo sapiens
caaaaggcagctcacccctggg

SEQ ID NO: 246354 - DNA, 16 bp, Homo sapiens
caaaagggagaacatg

SEQ ID NO: 246355 - DNA, 23 bp, Homo sapiens
caaaagggagaacatggccaata

SEQ ID NO: 246356 - DNA, 16 bp, Homo sapiens
caaaaggttaagccat

SEQ ID NO: 246357 - DNA, 19 bp, Homo sapiens
caaaagtccttagaatgag

SEQ ID NO: 246358 - DNA, 22 bp, Homo sapiens
caaaagtccttagaatgaggga

SEQ ID NO: 246359 - DNA, 21 bp, Homo sapiens
caaaagtctcaatgttccatt

SEQ ID NO: 246360 - DNA, 20 bp, Homo sapiens
caaaagtgagatgggaaggg

SEQ ID NO: 246361 - DNA, 20 bp, Homo sapiens
caaaagtggattttcctgaa

SEQ ID NO: 246362 - DNA, 21 bp, Homo sapiens
caaaataaaaagtgacacagc

SEQ ID NO: 246363 - DNA, 19 bp, Homo sapiens
caaaataaagaatagcaat

SEQ ID NO: 246364 - DNA, 18 bp, Homo sapiens
caaaataattttaagaaa

SEQ ID NO: 246365 - DNA, 18 bp, Homo sapiens
caaaatacagcactttga

SEQ ID NO: 246366 - DNA, 22 bp, Homo sapiens
caaaatacatgatgatttcaga

SEQ ID NO: 246367 - DNA, 13 bp, Homo sapiens
caaaatagaagct

SEQ ID NO: 246368 - DNA, 13 bp, Homo sapiens
caaaatagttcta

SEQ ID NO: 246369 - DNA, 14 bp, Homo sapiens
caaaatagttctat

SEQ ID NO: 246370 - DNA, 15 bp, Homo sapiens
caaaatagttctatt

SEQ ID NO: 246371 - DNA, 15 bp, Homo sapiens
caaaatatatgtttg

SEQ ID NO: 246372 - DNA, 14 bp, Homo sapiens
caaaatatttattt

SEQ ID NO: 246373 - DNA, 22 bp, Homo sapiens
caaaatatttctaagcttattt

SEQ ID NO: 246374 - DNA, 17 bp, Homo sapiens
caaaatcagtgatggga

SEQ ID NO: 246375 - DNA, 12 bp, Homo sapiens
caaaatcattcc

SEQ ID NO: 246376 - DNA, 20 bp, Homo sapiens
caaaatctaaaacaaaatct

SEQ ID NO: 246377 - DNA, 21 bp, Homo sapiens
caaaatctgtagagcagggca

SEQ ID NO: 246378 - DNA, 22 bp, Homo sapiens
caaaatgaaacgcaaccaccac

SEQ ID NO: 246379 - DNA, 15 bp, Homo sapiens
caaaatgaatgcatt

SEQ ID NO: 246380 - DNA, 15 bp, Homo sapiens
caaaatgacaatgat

SEQ ID NO: 246381 - DNA, 15 bp, Homo sapiens
caaaatgcatgtgat

SEQ ID NO: 246382 - DNA, 22 bp, Homo sapiens
caaaatgtctgtagctcctcaa

SEQ ID NO: 246383 - DNA, 17 bp, Homo sapiens
caaaatgtctgttttag

SEQ ID NO: 246384 - DNA, 11 bp, Homo sapiens
caaaatgtgcc

SEQ ID NO: 246385 - DNA, 16 bp, Homo sapiens
caaaatgttaacaact

SEQ ID NO: 246386 - DNA, 17 bp, Homo sapiens
caaaatgttaacaactt

SEQ ID NO: 246387 - DNA, 23 bp, Homo sapiens
caaaattacctaccccagttcat

SEQ ID NO: 246388 - DNA, 21 bp, Homo sapiens
caaaattataggagacttgta

SEQ ID NO: 246389 - DNA, 22 bp, Homo sapiens
caaaattataggagacttgtag

SEQ ID NO: 246390 - DNA, 22 bp, Homo sapiens
caaaattgatgtgtttatttat

SEQ ID NO: 246391 - DNA, 15 bp, Homo sapiens
caaaatttccagtac

SEQ ID NO: 246392 - DNA, 18 bp, Homo sapiens
caaaatttccagtacctt

SEQ ID NO: 246393 - DNA, 20 bp, Homo sapiens
caaaatttccagtacctttg

SEQ ID NO: 246394 - DNA, 21 bp, Homo sapiens
caaaatttgatggtgaatatt

SEQ ID NO: 246395 - DNA, 20 bp, Homo sapiens
caaacaaaggatttgaaaac

SEQ ID NO: 246396 - DNA, 22 bp, Homo sapiens
caaacaaaggatttgaaaacac

SEQ ID NO: 246397 - DNA, 15 bp, Homo sapiens
caaacaaatatgcaa

SEQ ID NO: 246398 - DNA, 19 bp, Homo sapiens
caaacaatcccaatctttc

SEQ ID NO: 246399 - DNA, 17 bp, Homo sapiens
caaacaccattattcca

SEQ ID NO: 246400 - DNA, 19 bp, Homo sapiens
caaacagaacactgtaata

SEQ ID NO: 246401 - DNA, 16 bp, Homo sapiens
caaacagtaaaggcca

SEQ ID NO: 246402 - DNA, 14 bp, Homo sapiens
caaacagtaggttg

SEQ ID NO: 246403 - DNA, 19 bp, Homo sapiens
caaacagtaggttggcagt

SEQ ID NO: 246404 - DNA, 13 bp, Homo sapiens
caaacagtgaatt

SEQ ID NO: 246405 - DNA, 20 bp, Homo sapiens
caaacatagcccctgccccg

SEQ ID NO: 246406 - DNA, 14 bp, Homo sapiens
caaacatgaaaaca

SEQ ID NO: 246407 - DNA, 15 bp, Homo sapiens
caaacatgaaaacat

SEQ ID NO: 246408 - DNA, 21 bp, Homo sapiens
caaacatgtgcaactcttgta

SEQ ID NO: 246409 - DNA, 14 bp, Homo sapiens
caaacattcttatt

SEQ ID NO: 246410 - DNA, 18 bp, Homo sapiens
caaacatttctttttcct

SEQ ID NO: 246411 - DNA, 13 bp, Homo sapiens
caaaccaggactc

SEQ ID NO: 246412 - DNA, 17 bp, Homo sapiens
caaaccaggactctgcc

SEQ ID NO: 246413 - DNA, 22 bp, Homo sapiens
caaaccaggagcattttgtgtc

SEQ ID NO: 246414 - DNA, 14 bp, Homo sapiens
caaaccccagcccc

SEQ ID NO: 246415 - DNA, 14 bp, Homo sapiens
caaaccccttccca

SEQ ID NO: 246416 - DNA, 11 bp, Homo sapiens
caaaccctgct

SEQ ID NO: 246417 - DNA, 24 bp, Homo sapiens
caaaccctgcttctgctgccctga

SEQ ID NO: 246418 - DNA, 13 bp, Homo sapiens
caaaccctgggga

SEQ ID NO: 246419 - DNA, 13 bp, Homo sapiens
caaaccctgttta

SEQ ID NO: 246420 - DNA, 16 bp, Homo sapiens
caaacctgccccatcc

SEQ ID NO: 246421 - DNA, 20 bp, Homo sapiens
caaacctttattttagaatt

SEQ ID NO: 246422 - DNA, 20 bp, Homo sapiens
caaacctttttatattttat

SEQ ID NO: 246423 - DNA, 23 bp, Homo sapiens
caaacctttttatattttatact

SEQ ID NO: 246424 - DNA, 14 bp, Homo sapiens
caaactactttctt

SEQ ID NO: 246425 - DNA, 17 bp, Homo sapiens
caaactcccaggacctg

SEQ ID NO: 246426 - DNA, 12 bp, Homo sapiens
caaactcctgcc

SEQ ID NO: 246427 - DNA, 13 bp, Homo sapiens
caaactcctgcct

SEQ ID NO: 246428 - DNA, 18 bp, Homo sapiens
caaactcctgcctgtgtt

SEQ ID NO: 246429 - DNA, 15 bp, Homo sapiens
caaactcgtctgatg

SEQ ID NO: 246430 - DNA, 16 bp, Homo sapiens
caaactcgtctgatgt

SEQ ID NO: 246431 - DNA, 16 bp, Homo sapiens
caaactctactaattt

SEQ ID NO: 246432 - DNA, 19 bp, Homo sapiens
caaactgatggaccgggtg

SEQ ID NO: 246433 - DNA, 19 bp, Homo sapiens
caaactgcaatagagactg

SEQ ID NO: 246434 - DNA, 22 bp, Homo sapiens
caaactgcacacacagctcctc

SEQ ID NO: 246435 - DNA, 22 bp, Homo sapiens
caaactgcctgttaagtctgag

SEQ ID NO: 246436 - DNA, 17 bp, Homo sapiens
caaactggggcctccct

SEQ ID NO: 246437 - DNA, 23 bp, Homo sapiens
caaactgtgggtattgttaatat

SEQ ID NO: 246438 - DNA, 15 bp, Homo sapiens
caaactgtgtaactg

SEQ ID NO: 246439 - DNA, 18 bp, Homo sapiens
caaactgtgtaactgccc

SEQ ID NO: 246440 - DNA, 15 bp, Homo sapiens
caaacttgggccgct

SEQ ID NO: 246441 - DNA, 14 bp, Homo sapiens
caaacttgttttct

SEQ ID NO: 246442 - DNA, 19 bp, Homo sapiens
caaacttttcccctgtcct

SEQ ID NO: 246443 - DNA, 15 bp, Homo sapiens
caaagaaaatgagaa

SEQ ID NO: 246444 - DNA, 16 bp, Homo sapiens
caaagaaaattctcaa

SEQ ID NO: 246445 - DNA, 19 bp, Homo sapiens
caaagaaagaaagtttaga

SEQ ID NO: 246446 - DNA, 15 bp, Homo sapiens
caaagaacccccctc

SEQ ID NO: 246447 - DNA, 19 bp, Homo sapiens
caaagaacttgatttgcat

SEQ ID NO: 246448 - DNA, 11 bp, Homo sapiens
caaagaagagt

SEQ ID NO: 246449 - DNA, 16 bp, Homo sapiens
caaagaaggaaaagag

SEQ ID NO: 246450 - DNA, 13 bp, Homo sapiens
caaagaagtggtt

SEQ ID NO: 246451 - DNA, 16 bp, Homo sapiens
caaagaatcaacagtg

SEQ ID NO: 246452 - DNA, 22 bp, Homo sapiens
caaagaatcacctaattaattt

SEQ ID NO: 246453 - DNA, 22 bp, Homo sapiens
caaagaatttcaatttgttcag

SEQ ID NO: 246454 - DNA, 15 bp, Homo sapiens
caaagacacacagga

SEQ ID NO: 246455 - DNA, 16 bp, Homo sapiens
caaagacacacaggag

SEQ ID NO: 246456 - DNA, 21 bp, Homo sapiens
caaagacagggaatagtggga

SEQ ID NO: 246457 - DNA, 15 bp, Homo sapiens
caaagaccaatgtga

SEQ ID NO: 246458 - DNA, 22 bp, Homo sapiens
caaagagaaggcctggtcagca

SEQ ID NO: 246459 - DNA, 15 bp, Homo sapiens
caaagagaataaaga

SEQ ID NO: 246460 - DNA, 20 bp, Homo sapiens
caaagaggtgctgctttgct

SEQ ID NO: 246461 - DNA, 20 bp, Homo sapiens
caaagataacgcaggagaga

SEQ ID NO: 246462 - DNA, 22 bp, Homo sapiens
caaagataacgcaggagagaga

SEQ ID NO: 246463 - DNA, 21 bp, Homo sapiens
caaagataagacttgtttctt

SEQ ID NO: 246464 - DNA, 16 bp, Homo sapiens
caaagatattatttat

SEQ ID NO: 246465 - DNA, 14 bp, Homo sapiens
caaagatcaaaata

SEQ ID NO: 246466 - DNA, 22 bp, Homo sapiens
caaagatctgaattaaataaat

SEQ ID NO: 246467 - DNA, 23 bp, Homo sapiens
caaagatctgaattaaataaata

SEQ ID NO: 246468 - DNA, 23 bp, Homo sapiens
caaagatgcagccgccttccttg

SEQ ID NO: 246469 - DNA, 17 bp, Homo sapiens
caaagatgtactgagag

SEQ ID NO: 246470 - DNA, 21 bp, Homo sapiens
caaagatgtactgagaggagg

SEQ ID NO: 246471 - DNA, 16 bp, Homo sapiens
caaagcaaccacctgt

SEQ ID NO: 246472 - DNA, 11 bp, Homo sapiens
caaagcaaggg

SEQ ID NO: 246473 - DNA, 14 bp, Homo sapiens
caaagcaagggctc

SEQ ID NO: 246474 - DNA, 17 bp, Homo sapiens
caaagcaagggctccag

SEQ ID NO: 246475 - DNA, 22 bp, Homo sapiens
caaagcacagtgttaaatgaaa

SEQ ID NO: 246476 - DNA, 22 bp, Homo sapiens
caaagcaccttgaatggaaggt

SEQ ID NO: 246477 - DNA, 22 bp, Homo sapiens
caaagcacgaaatgttattttt

SEQ ID NO: 246478 - DNA, 15 bp, Homo sapiens
caaagcagtgcatgc

SEQ ID NO: 246479 - DNA, 14 bp, Homo sapiens
caaagcatcaaata

SEQ ID NO: 246480 - DNA, 20 bp, Homo sapiens
caaagcatcaaataatacat

SEQ ID NO: 246481 - DNA, 14 bp, Homo sapiens
caaagcatgctcag

SEQ ID NO: 246482 - DNA, 20 bp, Homo sapiens
caaagcatgctcagtattga

SEQ ID NO: 246483 - DNA, 18 bp, Homo sapiens
caaagccacaaggctggc

SEQ ID NO: 246484 - DNA, 16 bp, Homo sapiens
caaagcccagcccggc

SEQ ID NO: 246485 - DNA, 17 bp, Homo sapiens
caaagcccagcccggct

SEQ ID NO: 246486 - DNA, 22 bp, Homo sapiens
caaagcccctacaactccagcc

SEQ ID NO: 246487 - DNA, 11 bp, Homo sapiens
caaagccttat

SEQ ID NO: 246488 - DNA, 14 bp, Homo sapiens
caaagcctttaaat

SEQ ID NO: 246489 - DNA, 15 bp, Homo sapiens
caaagcctttaaatt

SEQ ID NO: 246490 - DNA, 20 bp, Homo sapiens
caaagctaggaaaggcagaa

SEQ ID NO: 246491 - DNA, 21 bp, Homo sapiens
caaagctaggaaaggcagaaa

SEQ ID NO: 246492 - DNA, 22 bp, Homo sapiens
caaagctagggtggcccttgca

SEQ ID NO: 246493 - DNA, 20 bp, Homo sapiens
caaagctgaagaaaatgaag

SEQ ID NO: 246494 - DNA, 14 bp, Homo sapiens
caaagctgaatatt

SEQ ID NO: 246495 - DNA, 15 bp, Homo sapiens
caaagctgaatattt

SEQ ID NO: 246496 - DNA, 21 bp, Homo sapiens
caaagctgagttacttgtctg

SEQ ID NO: 246497 - DNA, 14 bp, Homo sapiens
caaagcttgaagat

SEQ ID NO: 246498 - DNA, 18 bp, Homo sapiens
caaagctttcctgcccca

SEQ ID NO: 246499 - DNA, 22 bp, Homo sapiens
caaagctttcctgccccaggcc

SEQ ID NO: 246500 - DNA, 22 bp, Homo sapiens
caaaggaaaatagtaatgtttt

SEQ ID NO: 246501 - DNA, 22 bp, Homo sapiens
caaaggaagacttggcccagga

SEQ ID NO: 246502 - DNA, 18 bp, Homo sapiens
caaaggactgacctgccc

SEQ ID NO: 246503 - DNA, 19 bp, Homo sapiens
caaaggagacaaagcagga

SEQ ID NO: 246504 - DNA, 13 bp, Homo sapiens
caaaggagggcct

SEQ ID NO: 246505 - DNA, 14 bp, Homo sapiens
caaaggagggcctc

SEQ ID NO: 246506 - DNA, 20 bp, Homo sapiens
caaaggagggcctcagagac

SEQ ID NO: 246507 - DNA, 21 bp, Homo sapiens
caaaggagggcctcagagaca

SEQ ID NO: 246508 - DNA, 22 bp, Homo sapiens
caaaggagggcctcagagacag

SEQ ID NO: 246509 - DNA, 17 bp, Homo sapiens
caaaggagtgcatggcc

SEQ ID NO: 246510 - DNA, 19 bp, Homo sapiens
caaaggagtgcatggccac

SEQ ID NO: 246511 - DNA, 15 bp, Homo sapiens
caaaggatttgaaaa

SEQ ID NO: 246512 - DNA, 18 bp, Homo sapiens
caaaggcagaaaggagat

SEQ ID NO: 246513 - DNA, 11 bp, Homo sapiens
caaaggcccag

SEQ ID NO: 246514 - DNA, 13 bp, Homo sapiens
caaaggcccagaa

SEQ ID NO: 246515 - DNA, 11 bp, Homo sapiens
caaaggggctg

SEQ ID NO: 246516 - DNA, 20 bp, Homo sapiens
caaaggggctgctggggcat

SEQ ID NO: 246517 - DNA, 11 bp, Homo sapiens
caaagggtgtg

SEQ ID NO: 246518 - DNA, 20 bp, Homo sapiens
caaagtaccaactgagccaa

SEQ ID NO: 246519 - DNA, 18 bp, Homo sapiens
caaagtactaaaactaga

SEQ ID NO: 246520 - DNA, 13 bp, Homo sapiens
caaagtagagaag

SEQ ID NO: 246521 - DNA, 22 bp, Homo sapiens
caaagtagagaagtatccaatt

SEQ ID NO: 246522 - DNA, 23 bp, Homo sapiens
caaagtaggtatacaaaagacta

SEQ ID NO: 246523 - DNA, 18 bp, Homo sapiens
caaagtataaatttgtgt

SEQ ID NO: 246524 - DNA, 19 bp, Homo sapiens
caaagtataaatttgtgta

SEQ ID NO: 246525 - DNA, 23 bp, Homo sapiens
caaagtattaatgtacagagtgg

SEQ ID NO: 246526 - DNA, 20 bp, Homo sapiens
caaagtctaaagtttacagt

SEQ ID NO: 246527 - DNA, 19 bp, Homo sapiens
caaagtcttgatagcaagc

SEQ ID NO: 246528 - DNA, 15 bp, Homo sapiens
caaagtgcagccctt

SEQ ID NO: 246529 - DNA, 19 bp, Homo sapiens
caaagtgcagcccttcctc

SEQ ID NO: 246530 - DNA, 17 bp, Homo sapiens
caaagtggggagggaca

SEQ ID NO: 246531 - DNA, 20 bp, Homo sapiens
caaagtggggagggacaagg

SEQ ID NO: 246532 - DNA, 19 bp, Homo sapiens
caaagtgtacaattttcat

SEQ ID NO: 246533 - DNA, 20 bp, Homo sapiens
caaagtgtacaattttcatc

SEQ ID NO: 246534 - DNA, 16 bp, Homo sapiens
caaagttaacctacct

SEQ ID NO: 246535 - DNA, 14 bp, Homo sapiens
caaagttccagttt

SEQ ID NO: 246536 - DNA, 21 bp, Homo sapiens
caaagttccctacttcctgtg

SEQ ID NO: 246537 - DNA, 22 bp, Homo sapiens
caaagttccctacttcctgtga

SEQ ID NO: 246538 - DNA, 22 bp, Homo sapiens
caaagtttcctaatcagaaatt

SEQ ID NO: 246539 - DNA, 13 bp, Homo sapiens
caaagttttcaga

SEQ ID NO: 246540 - DNA, 20 bp, Homo sapiens
caaagttttcagattgtaaa

SEQ ID NO: 246541 - DNA, 16 bp, Homo sapiens
caaagtttttacagtg

SEQ ID NO: 246542 - DNA, 15 bp, Homo sapiens
caaataaaaatattg

SEQ ID NO: 246543 - DNA, 16 bp, Homo sapiens
caaataaaaatattgt

SEQ ID NO: 246544 - DNA, 19 bp, Homo sapiens
caaataaagttaaaagtaa

SEQ ID NO: 246545 - DNA, 19 bp, Homo sapiens
caaataaatttataacaat

SEQ ID NO: 246546 - DNA, 14 bp, Homo sapiens
caaataagtaatat

SEQ ID NO: 246547 - DNA, 15 bp, Homo sapiens
caaatacattccagt

SEQ ID NO: 246548 - DNA, 19 bp, Homo sapiens
caaatacctccattaaatg

SEQ ID NO: 246549 - DNA, 22 bp, Homo sapiens
caaatacctccattaaatggtc

SEQ ID NO: 246550 - DNA, 12 bp, Homo sapiens
caaatagaaaac

SEQ ID NO: 246551 - DNA, 14 bp, Homo sapiens
caaatagaaaacag

SEQ ID NO: 246552 - DNA, 19 bp, Homo sapiens
atttgatgtctagataaca

SEQ ID NO: 246553 - DNA, 21 bp, Homo sapiens
atttgatgtctagataacatt

SEQ ID NO: 246554 - DNA, 16 bp, Homo sapiens
atttgatttcgatgta

SEQ ID NO: 246555 - DNA, 13 bp, Homo sapiens
atttgcaaatgca

SEQ ID NO: 246556 - DNA, 12 bp, Homo sapiens
atttgcaacatt

SEQ ID NO: 246557 - DNA, 14 bp, Homo sapiens
atttgcagctgctg

SEQ ID NO: 246558 - DNA, 19 bp, Homo sapiens
atttgcataatactaattt

SEQ ID NO: 246559 - DNA, 19 bp, Homo sapiens
atttgcatattctattgta

SEQ ID NO: 246560 - DNA, 16 bp, Homo sapiens
atttgcatttttgtat

SEQ ID NO: 246561 - DNA, 22 bp, Homo sapiens
atttgccaaaaactaaaattca

SEQ ID NO: 246562 - DNA, 14 bp, Homo sapiens
atttgccagcacag

SEQ ID NO: 246563 - DNA, 22 bp, Homo sapiens
atttgccccaacttaagtttag

SEQ ID NO: 246564 - DNA, 15 bp, Homo sapiens
atttgcccttcagga

SEQ ID NO: 246565 - DNA, 20 bp, Homo sapiens
atttgccgatttcctaagct

SEQ ID NO: 246566 - DNA, 17 bp, Homo sapiens
atttgcctaattcctgg

SEQ ID NO: 246567 - DNA, 14 bp, Homo sapiens
atttgcctttaaaa

SEQ ID NO: 246568 - DNA, 13 bp, Homo sapiens
atttgctgaataa

SEQ ID NO: 246569 - DNA, 20 bp, Homo sapiens
atttgctgaataacaacaat

SEQ ID NO: 246570 - DNA, 15 bp, Homo sapiens
atttgctgcatttca

SEQ ID NO: 246571 - DNA, 21 bp, Homo sapiens
atttgctggagtgctggctcc

SEQ ID NO: 246572 - DNA, 23 bp, Homo sapiens
atttgctgggctttttttttctc

SEQ ID NO: 246573 - DNA, 15 bp, Homo sapiens
atttgcttatttata

SEQ ID NO: 246574 - DNA, 16 bp, Homo sapiens
atttgctttagagaca

SEQ ID NO: 246575 - DNA, 19 bp, Homo sapiens
atttgctttagagacaggg

SEQ ID NO: 246576 - DNA, 19 bp, Homo sapiens
atttgctttgggattttct

SEQ ID NO: 246577 - DNA, 20 bp, Homo sapiens
atttggaagagaggcacctg

SEQ ID NO: 246578 - DNA, 13 bp, Homo sapiens
atttggaaggaaa

SEQ ID NO: 246579 - DNA, 20 bp, Homo sapiens
atttggagaaaacagccact

SEQ ID NO: 246580 - DNA, 20 bp, Homo sapiens
atttggagacacaactattt

SEQ ID NO: 246581 - DNA, 14 bp, Homo sapiens
atttggagtggagg

SEQ ID NO: 246582 - DNA, 16 bp, Homo sapiens
atttggagtggaggca

SEQ ID NO: 246583 - DNA, 20 bp, Homo sapiens
atttggagttaggtcctcac

SEQ ID NO: 246584 - DNA, 17 bp, Homo sapiens
atttggatatctgttag

SEQ ID NO: 246585 - DNA, 16 bp, Homo sapiens
atttgggtaaatcatg

SEQ ID NO: 246586 - DNA, 16 bp, Homo sapiens
atttggtcttagcttt

SEQ ID NO: 246587 - DNA, 19 bp, Homo sapiens
atttggtcttagctttaca

SEQ ID NO: 246588 - DNA, 21 bp, Homo sapiens
atttggtgcacttttctgtgt

SEQ ID NO: 246589 - DNA, 20 bp, Homo sapiens
atttggtggcctaatttaca

SEQ ID NO: 246590 - DNA, 16 bp, Homo sapiens
atttggtttttctctt

SEQ ID NO: 246591 - DNA, 15 bp, Homo sapiens
atttgtaaatattaa

SEQ ID NO: 246592 - DNA, 17 bp, Homo sapiens
atttgtaacctcagctc

SEQ ID NO: 246593 - DNA, 19 bp, Homo sapiens
atttgtaacctcagctctg

SEQ ID NO: 246594 - DNA, 17 bp, Homo sapiens
atttgtaactttgcatg

SEQ ID NO: 246595 - DNA, 14 bp, Homo sapiens
atttgtaagtttat

SEQ ID NO: 246596 - DNA, 14 bp, Homo sapiens
atttgtaataaagt

SEQ ID NO: 246597 - DNA, 22 bp, Homo sapiens
atttgtaatgtatcttatttat

SEQ ID NO: 246598 - DNA, 20 bp, Homo sapiens
atttgtaatttttttctagt

SEQ ID NO: 246599 - DNA, 15 bp, Homo sapiens
atttgtacagttcag

SEQ ID NO: 246600 - DNA, 13 bp, Homo sapiens
atttgtaccttat

SEQ ID NO: 246601 - DNA, 19 bp, Homo sapiens
atttgtaccttattgatct

SEQ ID NO: 246602 - DNA, 14 bp, Homo sapiens
atttgtactttgtt

SEQ ID NO: 246603 - DNA, 18 bp, Homo sapiens
atttgtagctagaatatc

SEQ ID NO: 246604 - DNA, 15 bp, Homo sapiens
atttgtatatataca

SEQ ID NO: 246605 - DNA, 16 bp, Homo sapiens
atttgtatatatacat

SEQ ID NO: 246606 - DNA, 20 bp, Homo sapiens
atttgtatctctgaagcatg

SEQ ID NO: 246607 - DNA, 14 bp, Homo sapiens
atttgtatctgaag

SEQ ID NO: 246608 - DNA, 18 bp, Homo sapiens
atttgtatgttgtgaaga

SEQ ID NO: 246609 - DNA, 13 bp, Homo sapiens
atttgtatttata

SEQ ID NO: 246610 - DNA, 16 bp, Homo sapiens
atttgtatttatatta

SEQ ID NO: 246611 - DNA, 17 bp, Homo sapiens
atttgtcaatgacagtt

SEQ ID NO: 246612 - DNA, 22 bp, Homo sapiens
atttgtcacagaaatcagagga

SEQ ID NO: 246613 - DNA, 17 bp, Homo sapiens
atttgtcctgcagagct

SEQ ID NO: 246614 - DNA, 19 bp, Homo sapiens
atttgtcggggaagatgaa

SEQ ID NO: 246615 - DNA, 13 bp, Homo sapiens
atttgtctcattt

SEQ ID NO: 246616 - DNA, 15 bp, Homo sapiens
atttgtctcattttg

SEQ ID NO: 246617 - DNA, 18 bp, Homo sapiens
atttgtctcattttgtat

SEQ ID NO: 246618 - DNA, 21 bp, Homo sapiens
atttgtctcattttgtatgta

SEQ ID NO: 246619 - DNA, 16 bp, Homo sapiens
atttgtcttagagaga

SEQ ID NO: 246620 - DNA, 15 bp, Homo sapiens
atttgtctttcagga

SEQ ID NO: 246621 - DNA, 15 bp, Homo sapiens
atttgtgagattcct

SEQ ID NO: 246622 - DNA, 18 bp, Homo sapiens
atttgtgagccaaagaga

SEQ ID NO: 246623 - DNA, 21 bp, Homo sapiens
atttgtgagccaaagagaaaa

SEQ ID NO: 246624 - DNA, 12 bp, Homo sapiens
atttgtgtgtgt

SEQ ID NO: 246625 - DNA, 15 bp, Homo sapiens
atttgtgtgtgtgca

SEQ ID NO: 246626 - DNA, 13 bp, Homo sapiens
atttgtgtttttc

SEQ ID NO: 246627 - DNA, 19 bp, Homo sapiens
atttgtgtttttctttttc

SEQ ID NO: 246628 - DNA, 20 bp, Homo sapiens
atttgttatgataaaaggaa

SEQ ID NO: 246629 - DNA, 18 bp, Homo sapiens
atttgttatttgtacagt

SEQ ID NO: 246630 - DNA, 19 bp, Homo sapiens
atttgttatttgtacagtt

SEQ ID NO: 246631 - DNA, 20 bp, Homo sapiens
atttgttgaaattatgtatg

SEQ ID NO: 246632 - DNA, 17 bp, Homo sapiens
atttgttgtcatgtgta

SEQ ID NO: 246633 - DNA, 19 bp, Homo sapiens
atttgtttaaagaataaag

SEQ ID NO: 246634 - DNA, 23 bp, Homo sapiens
atttgtttatttttatatagctt

SEQ ID NO: 246635 - DNA, 20 bp, Homo sapiens
atttgttttgttttaaaata

SEQ ID NO: 246636 - DNA, 18 bp, Homo sapiens
attttaaaaagtcttcac

SEQ ID NO: 246637 - DNA, 17 bp, Homo sapiens
attttaaaaattggaaa

SEQ ID NO: 246638 - DNA, 14 bp, Homo sapiens
attttaaaagcata

SEQ ID NO: 246639 - DNA, 17 bp, Homo sapiens
attttaaaatcaacttt

SEQ ID NO: 246640 - DNA, 16 bp, Homo sapiens
attttaaataaaagaa

SEQ ID NO: 246641 - DNA, 18 bp, Homo sapiens
attttaaattacacagtt

SEQ ID NO: 246642 - DNA, 17 bp, Homo sapiens
attttaaattataagga

SEQ ID NO: 246643 - DNA, 18 bp, Homo sapiens
attttaaattataaggac

SEQ ID NO: 246644 - DNA, 21 bp, Homo sapiens
attttaaattataaggactgc

SEQ ID NO: 246645 - DNA, 16 bp, Homo sapiens
attttaacaaaagcaa

SEQ ID NO: 246646 - DNA, 14 bp, Homo sapiens
attttaacaataac

SEQ ID NO: 246647 - DNA, 19 bp, Homo sapiens
attttaactttatcacatt

SEQ ID NO: 246648 - DNA, 21 bp, Homo sapiens
attttaagcactcttaaagca

SEQ ID NO: 246649 - DNA, 12 bp, Homo sapiens
attttaagtgct

SEQ ID NO: 246650 - DNA, 19 bp, Homo sapiens
attttaatacctttaaata

SEQ ID NO: 246651 - DNA, 14 bp, Homo sapiens
attttaatcaaatt

SEQ ID NO: 246652 - DNA, 12 bp, Homo sapiens
attttaatggct

SEQ ID NO: 246653 - DNA, 19 bp, Homo sapiens
attttaatgtaaaattcat

SEQ ID NO: 246654 - DNA, 20 bp, Homo sapiens
attttaatgtaaaattcata

SEQ ID NO: 246655 - DNA, 18 bp, Homo sapiens
attttaatttatgagttt

SEQ ID NO: 246656 - DNA, 11 bp, Homo sapiens
attttacaaaa

SEQ ID NO: 246657 - DNA, 20 bp, Homo sapiens
attttacaataggtgcttat

SEQ ID NO: 246658 - DNA, 23 bp, Homo sapiens
attttacacagcaattttgtatc

SEQ ID NO: 246659 - DNA, 23 bp, Homo sapiens
attttactgtctgtaagagaatt

SEQ ID NO: 246660 - DNA, 13 bp, Homo sapiens
attttacttccat

SEQ ID NO: 246661 - DNA, 13 bp, Homo sapiens
attttactttgta

SEQ ID NO: 246662 - DNA, 18 bp, Homo sapiens
attttactttgtgcaata

SEQ ID NO: 246663 - DNA, 16 bp, Homo sapiens
attttagacaaccata

SEQ ID NO: 246664 - DNA, 21 bp, Homo sapiens
attttagacaaccatagaact

SEQ ID NO: 246665 - DNA, 15 bp, Homo sapiens
attttagatgtttaa

SEQ ID NO: 246666 - DNA, 21 bp, Homo sapiens
attttagcagttctgcaaata

SEQ ID NO: 246667 - DNA, 19 bp, Homo sapiens
attttaggagacagtctca

SEQ ID NO: 246668 - DNA, 20 bp, Homo sapiens
attttaggtcccagaatgga

SEQ ID NO: 246669 - DNA, 22 bp, Homo sapiens
attttagtatatttatataatt

SEQ ID NO: 246670 - DNA, 11 bp, Homo sapiens
attttatactg

SEQ ID NO: 246671 - DNA, 23 bp, Homo sapiens
attttatactgcactttagtgta

SEQ ID NO: 246672 - DNA, 14 bp, Homo sapiens
attttatataataa

SEQ ID NO: 246673 - DNA, 22 bp, Homo sapiens
attttatccctttctcttctga

SEQ ID NO: 246674 - DNA, 23 bp, Homo sapiens
attttatccctttctcttctgac

SEQ ID NO: 246675 - DNA, 15 bp, Homo sapiens
attttatgtctatat

SEQ ID NO: 246676 - DNA, 14 bp, Homo sapiens
attttattattcag

SEQ ID NO: 246677 - DNA, 21 bp, Homo sapiens
attttattcacatatgtctta

SEQ ID NO: 246678 - DNA, 13 bp, Homo sapiens
attttattgaata

SEQ ID NO: 246679 - DNA, 16 bp, Homo sapiens
attttattgaatataa

SEQ ID NO: 246680 - DNA, 17 bp, Homo sapiens
attttatttaaactatt

SEQ ID NO: 246681 - DNA, 20 bp, Homo sapiens
attttatttattagctgtaa

SEQ ID NO: 246682 - DNA, 22 bp, Homo sapiens
attttatttattagctgtaaat

SEQ ID NO: 246683 - DNA, 15 bp, Homo sapiens
attttattttagcag

SEQ ID NO: 246684 - DNA, 14 bp, Homo sapiens
attttattttctaa

SEQ ID NO: 246685 - DNA, 13 bp, Homo sapiens
attttcaaaatct

SEQ ID NO: 246686 - DNA, 20 bp, Homo sapiens
agcccgtgaagcagtgcctc

SEQ ID NO: 246687 - DNA, 20 bp, Homo sapiens
agcccgtgcagtacaggcaa

SEQ ID NO: 246688 - DNA, 16 bp, Homo sapiens
agcccgtgtggcccct

SEQ ID NO: 246689 - DNA, 17 bp, Homo sapiens
agcccgtgtggcccctt

SEQ ID NO: 246690 - DNA, 14 bp, Homo sapiens
agccctaaataaat

SEQ ID NO: 246691 - DNA, 18 bp, Homo sapiens
agccctaacatagtgtct

SEQ ID NO: 246692 - DNA, 22 bp, Homo sapiens
agccctagaggcgagccaggca

SEQ ID NO: 246693 - DNA, 15 bp, Homo sapiens
agccctaggctaccc

SEQ ID NO: 246694 - DNA, 21 bp, Homo sapiens
agccctagtgggagcccagca

SEQ ID NO: 246695 - DNA, 22 bp, Homo sapiens
agccctagtgggagcccagcac

SEQ ID NO: 246696 - DNA, 23 bp, Homo sapiens
agccctcatcttgaagggcccag

SEQ ID NO: 246697 - DNA, 15 bp, Homo sapiens
agccctccaaaagca

SEQ ID NO: 246698 - DNA, 17 bp, Homo sapiens
agccctccaaaagcact

SEQ ID NO: 246699 - DNA, 16 bp, Homo sapiens
agccctccccctcaac

SEQ ID NO: 246700 - DNA, 17 bp, Homo sapiens
agccctccctcttccca

SEQ ID NO: 246701 - DNA, 13 bp, Homo sapiens
agccctccctgcc

SEQ ID NO: 246702 - DNA, 17 bp, Homo sapiens
agccctccctgcccctc

SEQ ID NO: 246703 - DNA, 19 bp, Homo sapiens
agccctccctgcccctccc

SEQ ID NO: 246704 - DNA, 23 bp, Homo sapiens
agccctccctgcccctcccttca

SEQ ID NO: 246705 - DNA, 15 bp, Homo sapiens
agccctcctgagcac

SEQ ID NO: 246706 - DNA, 15 bp, Homo sapiens
agccctccttgccac

SEQ ID NO: 246707 - DNA, 16 bp, Homo sapiens
agccctccttgccacc

SEQ ID NO: 246708 - DNA, 19 bp, Homo sapiens
agccctcgaaccaaggcag

SEQ ID NO: 246709 - DNA, 24 bp, Homo sapiens
agccctcgaaccaaggcagcctcc

SEQ ID NO: 246710 - DNA, 20 bp, Homo sapiens
agccctcggcctccgaggct

SEQ ID NO: 246711 - DNA, 18 bp, Homo sapiens
agccctctcactgtgtcc

SEQ ID NO: 246712 - DNA, 20 bp, Homo sapiens
agccctcttcaggggtcacc

SEQ ID NO: 246713 - DNA, 21 bp, Homo sapiens
agccctcttcaggggtcacct

SEQ ID NO: 246714 - DNA, 15 bp, Homo sapiens
agccctctttctctc

SEQ ID NO: 246715 - DNA, 19 bp, Homo sapiens
agccctctttctctctgtg

SEQ ID NO: 246716 - DNA, 24 bp, Homo sapiens
agccctctttctctctgtgtggca

SEQ ID NO: 246717 - DNA, 19 bp, Homo sapiens
agccctgaccttggctgac

SEQ ID NO: 246718 - DNA, 23 bp, Homo sapiens
agccctgaccttggctgactggg

SEQ ID NO: 246719 - DNA, 22 bp, Homo sapiens
agccctgaggtgaaagggagct

SEQ ID NO: 246720 - DNA, 23 bp, Homo sapiens
agccctgagtttcaagtatcctt

SEQ ID NO: 246721 - DNA, 15 bp, Homo sapiens
agccctgcaaatttt

SEQ ID NO: 246722 - DNA, 11 bp, Homo sapiens
agccctgccct

SEQ ID NO: 246723 - DNA, 16 bp, Homo sapiens
agccctgccctcactc

SEQ ID NO: 246724 - DNA, 20 bp, Homo sapiens
agccctgccctcactccact

SEQ ID NO: 246725 - DNA, 22 bp, Homo sapiens
agccctgccctcactccactcc

SEQ ID NO: 246726 - DNA, 22 bp, Homo sapiens
agccctgctttgggctgccctg

SEQ ID NO: 246727 - DNA, 17 bp, Homo sapiens
agccctggacacccctg

SEQ ID NO: 246728 - DNA, 20 bp, Homo sapiens
agccctggacacccctgctc

SEQ ID NO: 246729 - DNA, 24 bp, Homo sapiens
agccctggctgggttcaggtccca

SEQ ID NO: 246730 - DNA, 20 bp, Homo sapiens
agccctggttctccatcccc

SEQ ID NO: 246731 - DNA, 16 bp, Homo sapiens
agccctgtcagtgcag

SEQ ID NO: 246732 - DNA, 17 bp, Homo sapiens
agccctgtcagtgcagc

SEQ ID NO: 246733 - DNA, 14 bp, Homo sapiens
agccctgtcctggt

SEQ ID NO: 246734 - DNA, 17 bp, Homo sapiens
agccctgtcgagacact

SEQ ID NO: 246735 - DNA, 23 bp, Homo sapiens
agcccttccatgtcgcctctgca

SEQ ID NO: 246736 - DNA, 13 bp, Homo sapiens
agcccttcccagg

SEQ ID NO: 246737 - DNA, 13 bp, Homo sapiens
agcccttccctgc

SEQ ID NO: 246738 - DNA, 17 bp, Homo sapiens
agcccttccctgctttg

SEQ ID NO: 246739 - DNA, 17 bp, Homo sapiens
agcccttccctggcccc

SEQ ID NO: 246740 - DNA, 15 bp, Homo sapiens
agcccttcctcctga

SEQ ID NO: 246741 - DNA, 21 bp, Homo sapiens
agcccttctccatggccctgc

SEQ ID NO: 246742 - DNA, 15 bp, Homo sapiens
agcccttctgccttt

SEQ ID NO: 246743 - DNA, 17 bp, Homo sapiens
agccctttccccactca

SEQ ID NO: 246744 - DNA, 16 bp, Homo sapiens
agccctttctgtgtgc

SEQ ID NO: 246745 - DNA, 18 bp, Homo sapiens
agccctttctgtgtgcac

SEQ ID NO: 246746 - DNA, 17 bp, Homo sapiens
agccctttgcctgtaga

SEQ ID NO: 246747 - DNA, 15 bp, Homo sapiens
agccctttggagaac

SEQ ID NO: 246748 - DNA, 23 bp, Homo sapiens
agccctttggagaacgccagtct

SEQ ID NO: 246749 - DNA, 21 bp, Homo sapiens
agccgagatcggggtggcaga

SEQ ID NO: 246750 - DNA, 21 bp, Homo sapiens
agccgagccgggcctggggct

SEQ ID NO: 246751 - DNA, 13 bp, Homo sapiens
agccgagctctcc

SEQ ID NO: 246752 - DNA, 18 bp, Homo sapiens
agccgagctctcctgggc

SEQ ID NO: 246753 - DNA, 18 bp, Homo sapiens
agccgccattgccaccag

SEQ ID NO: 246754 - DNA, 20 bp, Homo sapiens
agccgccattgccaccagga

SEQ ID NO: 246755 - DNA, 22 bp, Homo sapiens
agccgccggaagtggctccgtg

SEQ ID NO: 246756 - DNA, 23 bp, Homo sapiens
agccgcctctggttccactcagc

SEQ ID NO: 246757 - DNA, 15 bp, Homo sapiens
agccgccttccttga

SEQ ID NO: 246758 - DNA, 16 bp, Homo sapiens
agccgcgctctgcccc

SEQ ID NO: 246759 - DNA, 17 bp, Homo sapiens
agccgcgctctgcccct

SEQ ID NO: 246760 - DNA, 18 bp, Homo sapiens
agccgctgccaggggctg

SEQ ID NO: 246761 - DNA, 15 bp, Homo sapiens
agccggcacagggtc

SEQ ID NO: 246762 - DNA, 11 bp, Homo sapiens
agccgggccgc

SEQ ID NO: 246763 - DNA, 18 bp, Homo sapiens
agccggggcctgcctagc

SEQ ID NO: 246764 - DNA, 23 bp, Homo sapiens
agccgggtgtggcacgcacctgt

SEQ ID NO: 246765 - DNA, 13 bp, Homo sapiens
agccggtgcccac

SEQ ID NO: 246766 - DNA, 18 bp, Homo sapiens
agccgtccaacttaaaaa

SEQ ID NO: 246767 - DNA, 16 bp, Homo sapiens
agccgtccatggcacc

SEQ ID NO: 246768 - DNA, 17 bp, Homo sapiens
agccgtccatggcacca

SEQ ID NO: 246769 - DNA, 18 bp, Homo sapiens
agccgtccatggcaccag

SEQ ID NO: 246770 - DNA, 18 bp, Homo sapiens
agccgtgatgctcaggct

SEQ ID NO: 246771 - DNA, 21 bp, Homo sapiens
agccgtggcttcccgctcagc

SEQ ID NO: 246772 - DNA, 14 bp, Homo sapiens
agccgttcctggga

SEQ ID NO: 246773 - DNA, 21 bp, Homo sapiens
agccgtttgaatatattttat

SEQ ID NO: 246774 - DNA, 23 bp, Homo sapiens
agccgtttgaatatattttatct

SEQ ID NO: 246775 - DNA, 13 bp, Homo sapiens
agcctaaaattaa

SEQ ID NO: 246776 - DNA, 16 bp, Homo sapiens
agcctaaaattaaata

SEQ ID NO: 246777 - DNA, 23 bp, Homo sapiens
agcctaaaattaaataaatcttt

SEQ ID NO: 246778 - DNA, 18 bp, Homo sapiens
agcctaagaaaaaggaaa

SEQ ID NO: 246779 - DNA, 14 bp, Homo sapiens
agcctactgtctcc

SEQ ID NO: 246780 - DNA, 15 bp, Homo sapiens
agcctactgtctcct

SEQ ID NO: 246781 - DNA, 23 bp, Homo sapiens
agcctaggggtcagggaccaagg

SEQ ID NO: 246782 - DNA, 18 bp, Homo sapiens
agcctatatttcctcttc

SEQ ID NO: 246783 - DNA, 20 bp, Homo sapiens
agcctatatttcctcttctg

SEQ ID NO: 246784 - DNA, 16 bp, Homo sapiens
agcctcacttgaatgt

SEQ ID NO: 246785 - DNA, 22 bp, Homo sapiens
agcctcacttgaatgtgtcact

SEQ ID NO: 246786 - DNA, 17 bp, Homo sapiens
agcctcagggcttcctt

SEQ ID NO: 246787 - DNA, 19 bp, Homo sapiens
agcctccaagcctgcctcc

SEQ ID NO: 246788 - DNA, 21 bp, Homo sapiens
agcctccaagctccatctcca

SEQ ID NO: 246789 - DNA, 20 bp, Homo sapiens
agcctccactgcctctggaa

SEQ ID NO: 246790 - DNA, 12 bp, Homo sapiens
agcctccagagc

SEQ ID NO: 246791 - DNA, 17 bp, Homo sapiens
agcctccagagccagcc

SEQ ID NO: 246792 - DNA, 18 bp, Homo sapiens
agcctccagagccagcct

SEQ ID NO: 246793 - DNA, 20 bp, Homo sapiens
agcctccagagccagcctgg

SEQ ID NO: 246794 - DNA, 24 bp, Homo sapiens
agcctccagagccagcctgggact

SEQ ID NO: 246795 - DNA, 20 bp, Homo sapiens
agcctccaggcccccaactc

SEQ ID NO: 246796 - DNA, 21 bp, Homo sapiens
agcctccaggcccccaactcc

SEQ ID NO: 246797 - DNA, 12 bp, Homo sapiens
agcctccagggc

SEQ ID NO: 246798 - DNA, 17 bp, Homo sapiens
agcctccagggcccccc

SEQ ID NO: 246799 - DNA, 21 bp, Homo sapiens
agcctccatttagttctttgt

SEQ ID NO: 246800 - DNA, 17 bp, Homo sapiens
agcctcccccaggctgc

SEQ ID NO: 246801 - DNA, 21 bp, Homo sapiens
agcctcccccaggctgcgcct

SEQ ID NO: 246802 - DNA, 13 bp, Homo sapiens
agcctcccctccc

SEQ ID NO: 246803 - DNA, 20 bp, Homo sapiens
agcctcccctcccctgggga

SEQ ID NO: 246804 - DNA, 24 bp, Homo sapiens
agcctccctcctcgtcccctgcct

SEQ ID NO: 246805 - DNA, 12 bp, Homo sapiens
agcctccctgtc

SEQ ID NO: 246806 - DNA, 13 bp, Homo sapiens
agcctccctgtca

SEQ ID NO: 246807 - DNA, 17 bp, Homo sapiens
agcctccgccattccaa

SEQ ID NO: 246808 - DNA, 19 bp, Homo sapiens
agcctccgtttatgggcct

SEQ ID NO: 246809 - DNA, 22 bp, Homo sapiens
agcctccgtttatgggccttgc

SEQ ID NO: 246810 - DNA, 16 bp, Homo sapiens
agcctcctcctgacca

SEQ ID NO: 246811 - DNA, 13 bp, Homo sapiens
agcctcctctctc

SEQ ID NO: 246812 - DNA, 12 bp, Homo sapiens
agcctcctgacc

SEQ ID NO: 246813 - DNA, 19 bp, Homo sapiens
agcctcctgagtagctgga

SEQ ID NO: 246814 - DNA, 19 bp, Homo sapiens
agcctcctgccccctgcca

SEQ ID NO: 246815 - DNA, 13 bp, Homo sapiens
agcctcctgctga

SEQ ID NO: 246816 - DNA, 15 bp, Homo sapiens
agcctcgaactcctg

SEQ ID NO: 246817 - DNA, 14 bp, Homo sapiens
agcctctcccaccc

SEQ ID NO: 246818 - DNA, 18 bp, Homo sapiens
attttcaacgcagccctg

SEQ ID NO: 246819 - DNA, 15 bp, Homo sapiens
attttcaagcaaata

SEQ ID NO: 246820 - DNA, 15 bp, Homo sapiens
attttcaagctttca

SEQ ID NO: 246821 - DNA, 19 bp, Homo sapiens
attttcaagtaattgtgaa

SEQ ID NO: 246822 - DNA, 22 bp, Homo sapiens
attttcacattcccatctgtca

SEQ ID NO: 246823 - DNA, 21 bp, Homo sapiens
attttcacctgtttttaagct

SEQ ID NO: 246824 - DNA, 17 bp, Homo sapiens
attttcagaaaatatta

SEQ ID NO: 246825 - DNA, 19 bp, Homo sapiens
attttcagcatcaaacatg

SEQ ID NO: 246826 - DNA, 23 bp, Homo sapiens
attttcagcatgaaaatgtgtgt

SEQ ID NO: 246827 - DNA, 17 bp, Homo sapiens
attttcagtaccaaaga

SEQ ID NO: 246828 - DNA, 21 bp, Homo sapiens
attttcagtaccaaagaaaca

SEQ ID NO: 246829 - DNA, 14 bp, Homo sapiens
attttcatcaagta

SEQ ID NO: 246830 - DNA, 20 bp, Homo sapiens
attttcatgacttttccatg

SEQ ID NO: 246831 - DNA, 18 bp, Homo sapiens
attttcattggatgcagt

SEQ ID NO: 246832 - DNA, 19 bp, Homo sapiens
attttccattaatttcaac

SEQ ID NO: 246833 - DNA, 14 bp, Homo sapiens
attttccccccact

SEQ ID NO: 246834 - DNA, 14 bp, Homo sapiens
attttcctccccag

SEQ ID NO: 246835 - DNA, 14 bp, Homo sapiens
attttcctttagat

SEQ ID NO: 246836 - DNA, 14 bp, Homo sapiens
attttctaaactgt

SEQ ID NO: 246837 - DNA, 18 bp, Homo sapiens
attttctaagcaatttct

SEQ ID NO: 246838 - DNA, 22 bp, Homo sapiens
attttctaagcaatttcttgct

SEQ ID NO: 246839 - DNA, 18 bp, Homo sapiens
attttctagactttctgt

SEQ ID NO: 246840 - DNA, 19 bp, Homo sapiens
attttctagactttctgtt

SEQ ID NO: 246841 - DNA, 17 bp, Homo sapiens
attttctatatttgtaa

SEQ ID NO: 246842 - DNA, 16 bp, Homo sapiens
attttctattgttact

SEQ ID NO: 246843 - DNA, 15 bp, Homo sapiens
attttctatttaaaa

SEQ ID NO: 246844 - DNA, 19 bp, Homo sapiens
attttctcaaaagcattta

SEQ ID NO: 246845 - DNA, 20 bp, Homo sapiens
attttctcaaaagcatttat

SEQ ID NO: 246846 - DNA, 23 bp, Homo sapiens
attttctcaaaagcatttatcat

SEQ ID NO: 246847 - DNA, 18 bp, Homo sapiens
attttctctgtgtttgtt

SEQ ID NO: 246848 - DNA, 17 bp, Homo sapiens
attttctggtagataga

SEQ ID NO: 246849 - DNA, 20 bp, Homo sapiens
attttctggtagatagaaat

SEQ ID NO: 246850 - DNA, 13 bp, Homo sapiens
attttctgtcact

SEQ ID NO: 246851 - DNA, 19 bp, Homo sapiens
attttctgtgttgttcata

SEQ ID NO: 246852 - DNA, 16 bp, Homo sapiens
attttcttcccatttg

SEQ ID NO: 246853 - DNA, 22 bp, Homo sapiens
attttcttcccatttgtaatgt

SEQ ID NO: 246854 - DNA, 16 bp, Homo sapiens
attttctttctatgta

SEQ ID NO: 246855 - DNA, 22 bp, Homo sapiens
attttctttctatgtagaactg

SEQ ID NO: 246856 - DNA, 18 bp, Homo sapiens
attttcttttatatctgt

SEQ ID NO: 246857 - DNA, 20 bp, Homo sapiens
attttcttttatatctgtaa

SEQ ID NO: 246858 - DNA, 21 bp, Homo sapiens
attttcttttatatctgtaaa

SEQ ID NO: 246859 - DNA, 22 bp, Homo sapiens
attttcttttatatctgtaaat

SEQ ID NO: 246860 - DNA, 18 bp, Homo sapiens
attttgaaaacacttatt

SEQ ID NO: 246861 - DNA, 12 bp, Homo sapiens
attttgaaatat

SEQ ID NO: 246862 - DNA, 20 bp, Homo sapiens
attttgaataaataaatgta

SEQ ID NO: 246863 - DNA, 15 bp, Homo sapiens
attttgaataccatt

SEQ ID NO: 246864 - DNA, 14 bp, Homo sapiens
attttgaatgtgat

SEQ ID NO: 246865 - DNA, 15 bp, Homo sapiens
attttgaatgtgatc

SEQ ID NO: 246866 - DNA, 20 bp, Homo sapiens
attttgagggtgtaaccagt

SEQ ID NO: 246867 - DNA, 18 bp, Homo sapiens
attttgagtggcaaaata

SEQ ID NO: 246868 - DNA, 13 bp, Homo sapiens
attttgataataa

SEQ ID NO: 246869 - DNA, 14 bp, Homo sapiens
attttgatgcacaa

SEQ ID NO: 246870 - DNA, 18 bp, Homo sapiens
attttgcaaaatttccag

SEQ ID NO: 246871 - DNA, 14 bp, Homo sapiens
attttgcagcagtg

SEQ ID NO: 246872 - DNA, 16 bp, Homo sapiens
attttgcagcagtgag

SEQ ID NO: 246873 - DNA, 15 bp, Homo sapiens
attttgcagtgtgca

SEQ ID NO: 246874 - DNA, 16 bp, Homo sapiens
attttgcgatgtgttt

SEQ ID NO: 246875 - DNA, 15 bp, Homo sapiens
attttggaaaagaaa

SEQ ID NO: 246876 - DNA, 19 bp, Homo sapiens
attttggaaaatgattagg

SEQ ID NO: 246877 - DNA, 19 bp, Homo sapiens
attttggaattggtgtata

SEQ ID NO: 246878 - DNA, 20 bp, Homo sapiens
attttggaattggtgtatat

SEQ ID NO: 246879 - DNA, 16 bp, Homo sapiens
attttggacgtgtgag

SEQ ID NO: 246880 - DNA, 22 bp, Homo sapiens
attttggataaatcatttcagt

SEQ ID NO: 246881 - DNA, 21 bp, Homo sapiens
atttaaaaatgccaaaactta

SEQ ID NO: 246882 - DNA, 16 bp, Homo sapiens
atttaaaagacaaaca

SEQ ID NO: 246883 - DNA, 14 bp, Homo sapiens
atttaaaatgatta

SEQ ID NO: 246884 - DNA, 19 bp, Homo sapiens
atttaaacaataaatgtgc

SEQ ID NO: 246885 - DNA, 20 bp, Homo sapiens
atttaaactaaccttttatc

SEQ ID NO: 246886 - DNA, 13 bp, Homo sapiens
atttaaagaaagt

SEQ ID NO: 246887 - DNA, 13 bp, Homo sapiens
atttaaataaagt

SEQ ID NO: 246888 - DNA, 19 bp, Homo sapiens
atttaaatagaacttgatt

SEQ ID NO: 246889 - DNA, 13 bp, Homo sapiens
atttaaatataat

SEQ ID NO: 246890 - DNA, 15 bp, Homo sapiens
atttaaatataattc

SEQ ID NO: 246891 - DNA, 21 bp, Homo sapiens
atttaaatcattttaacttct

SEQ ID NO: 246892 - DNA, 23 bp, Homo sapiens
atttaaatctgattaatccattt

SEQ ID NO: 246893 - DNA, 17 bp, Homo sapiens
atttaaatgctttgttt

SEQ ID NO: 246894 - DNA, 14 bp, Homo sapiens
atttaaattgttat

SEQ ID NO: 246895 - DNA, 16 bp, Homo sapiens
atttaaattttcacct

SEQ ID NO: 246896 - DNA, 16 bp, Homo sapiens
atttaacagtcattta

SEQ ID NO: 246897 - DNA, 18 bp, Homo sapiens
atttaacagtcatttaaa

SEQ ID NO: 246898 - DNA, 12 bp, Homo sapiens
atttaactgcat

SEQ ID NO: 246899 - DNA, 14 bp, Homo sapiens
atttaactgcatat

SEQ ID NO: 246900 - DNA, 15 bp, Homo sapiens
atttaactgcatata

SEQ ID NO: 246901 - DNA, 21 bp, Homo sapiens
atttaacttgagggtaataaa

SEQ ID NO: 246902 - DNA, 22 bp, Homo sapiens
atttaacttgagggtaataaac

SEQ ID NO: 246903 - DNA, 22 bp, Homo sapiens
atttaagaaaaacaaaatgtta

SEQ ID NO: 246904 - DNA, 20 bp, Homo sapiens
atttaagaaaatacaataaa

SEQ ID NO: 246905 - DNA, 13 bp, Homo sapiens
atttaagagtcct

SEQ ID NO: 246906 - DNA, 15 bp, Homo sapiens
atttaagagtcctga

SEQ ID NO: 246907 - DNA, 15 bp, Homo sapiens
atttaagataattat

SEQ ID NO: 246908 - DNA, 18 bp, Homo sapiens
atttaagcacaaacttta

SEQ ID NO: 246909 - DNA, 17 bp, Homo sapiens
atttaagcatgagtggc

SEQ ID NO: 246910 - DNA, 14 bp, Homo sapiens
atttaagcattgtt

SEQ ID NO: 246911 - DNA, 17 bp, Homo sapiens
atttaagccaataaata

SEQ ID NO: 246912 - DNA, 10 bp, Homo sapiens
atttaagccc

SEQ ID NO: 246913 - DNA, 15 bp, Homo sapiens
atttaagccccctct

SEQ ID NO: 246914 - DNA, 23 bp, Homo sapiens
atttaagtcgggaaattctgctg

SEQ ID NO: 246915 - DNA, 18 bp, Homo sapiens
atttaataactttgctgg

SEQ ID NO: 246916 - DNA, 15 bp, Homo sapiens
atttaatatgcatct

SEQ ID NO: 246917 - DNA, 18 bp, Homo sapiens
atttaatatgcatctttg

SEQ ID NO: 246918 - DNA, 23 bp, Homo sapiens
atttaatatgcatctttgagaat

SEQ ID NO: 246919 - DNA, 18 bp, Homo sapiens
atttaatcagtgtgacag

SEQ ID NO: 246920 - DNA, 16 bp, Homo sapiens
atttaatgatgtgtca

SEQ ID NO: 246921 - DNA, 17 bp, Homo sapiens
atttaatgttacagcat

SEQ ID NO: 246922 - DNA, 12 bp, Homo sapiens
atttaattatta

SEQ ID NO: 246923 - DNA, 12 bp, Homo sapiens
atttaatttcat

SEQ ID NO: 246924 - DNA, 14 bp, Homo sapiens
atttaatttttaaa

SEQ ID NO: 246925 - DNA, 20 bp, Homo sapiens
atttaatttttaaaagactt

SEQ ID NO: 246926 - DNA, 18 bp, Homo sapiens
atttacagtccttcaaaa

SEQ ID NO: 246927 - DNA, 15 bp, Homo sapiens
atttacagtgcctgt

SEQ ID NO: 246928 - DNA, 17 bp, Homo sapiens
atttacagttactgcct

SEQ ID NO: 246929 - DNA, 16 bp, Homo sapiens
atttacatcatttctt

SEQ ID NO: 246930 - DNA, 21 bp, Homo sapiens
atttacatgaattgcatttta

SEQ ID NO: 246931 - DNA, 20 bp, Homo sapiens
atttaccttttctgttgtac

SEQ ID NO: 246932 - DNA, 15 bp, Homo sapiens
atttacgtaaaaaga

SEQ ID NO: 246933 - DNA, 16 bp, Homo sapiens
atttacgtatatttca

SEQ ID NO: 246934 - DNA, 22 bp, Homo sapiens
atttacgtatatttcattgaat

SEQ ID NO: 246935 - DNA, 13 bp, Homo sapiens
atttactcattat

SEQ ID NO: 246936 - DNA, 12 bp, Homo sapiens
atttactgtact

SEQ ID NO: 246937 - DNA, 14 bp, Homo sapiens
atttacttcttata

SEQ ID NO: 246938 - DNA, 16 bp, Homo sapiens
atttacttcttataca

SEQ ID NO: 246939 - DNA, 18 bp, Homo sapiens
atttactttttaaacagt

SEQ ID NO: 246940 - DNA, 13 bp, Homo sapiens
atttagaaaaaag

SEQ ID NO: 246941 - DNA, 18 bp, Homo sapiens
atttagaaaaaagtttac

SEQ ID NO: 246942 - DNA, 22 bp, Homo sapiens
atttagaaaatagagcttttaa

SEQ ID NO: 246943 - DNA, 22 bp, Homo sapiens
atttagaaagaagcccaatatt

SEQ ID NO: 246944 - DNA, 14 bp, Homo sapiens
atttagaactgtat

SEQ ID NO: 246945 - DNA, 18 bp, Homo sapiens
atttagaatttgaaagga

SEQ ID NO: 246946 - DNA, 14 bp, Homo sapiens
atttagcacatttt

SEQ ID NO: 246947 - DNA, 16 bp, Homo sapiens
atttaggaatgctcaa

SEQ ID NO: 246948 - DNA, 22 bp, Homo sapiens
atttaggaatgctcaatgtgct

SEQ ID NO: 246949 - DNA, 23 bp, Homo sapiens
atttagggaagcagggacacccc

SEQ ID NO: 246950 - DNA, 22 bp, Homo sapiens
atttagggagaaatgttgttca

SEQ ID NO: 246951 - DNA, 15 bp, Homo sapiens
atttagtcctcacct

SEQ ID NO: 246952 - DNA, 16 bp, Homo sapiens
atttagttctttgtta

SEQ ID NO: 246953 - DNA, 17 bp, Homo sapiens
atttataaactaatttt

SEQ ID NO: 246954 - DNA, 20 bp, Homo sapiens
atttataaactaattttgta

SEQ ID NO: 246955 - DNA, 19 bp, Homo sapiens
atttataaactagatctcc

SEQ ID NO: 246956 - DNA, 14 bp, Homo sapiens
atttataaatatat

SEQ ID NO: 246957 - DNA, 22 bp, Homo sapiens
atttataaatgagcaaatggaa

SEQ ID NO: 246958 - DNA, 14 bp, Homo sapiens
atttataaatgtgt

SEQ ID NO: 246959 - DNA, 18 bp, Homo sapiens
atttataacaattgattt

SEQ ID NO: 246960 - DNA, 15 bp, Homo sapiens
atttataacattgta

SEQ ID NO: 246961 - DNA, 13 bp, Homo sapiens
atttataactcat

SEQ ID NO: 246962 - DNA, 16 bp, Homo sapiens
atttataactcatcat

SEQ ID NO: 246963 - DNA, 23 bp, Homo sapiens
atttataactcatcataaaataa

SEQ ID NO: 246964 - DNA, 13 bp, Homo sapiens
atttatagggctt

SEQ ID NO: 246965 - DNA, 16 bp, Homo sapiens
atttatagtttataca

SEQ ID NO: 246966 - DNA, 18 bp, Homo sapiens
atttatagtttatacagt

SEQ ID NO: 246967 - DNA, 20 bp, Homo sapiens
atttatagtttatacagttt

SEQ ID NO: 246968 - DNA, 14 bp, Homo sapiens
atttatagtttgta

SEQ ID NO: 246969 - DNA, 15 bp, Homo sapiens
agcaggcctgttgct

SEQ ID NO: 246970 - DNA, 18 bp, Homo sapiens
agcaggcctgttgctttt

SEQ ID NO: 246971 - DNA, 21 bp, Homo sapiens
agcaggcggtggggagagatg

SEQ ID NO: 246972 - DNA, 18 bp, Homo sapiens
agcaggctgcagcaggca

SEQ ID NO: 246973 - DNA, 20 bp, Homo sapiens
agcaggctgcagcaggcaga

SEQ ID NO: 246974 - DNA, 21 bp, Homo sapiens
agcaggctgcagcaggcagag

SEQ ID NO: 246975 - DNA, 13 bp, Homo sapiens
agcaggctggcag

SEQ ID NO: 246976 - DNA, 19 bp, Homo sapiens
agcagggaaagctccacgg

SEQ ID NO: 246977 - DNA, 21 bp, Homo sapiens
agcagggattaacctctgcac

SEQ ID NO: 246978 - DNA, 22 bp, Homo sapiens
agcagggattaacctctgcact

SEQ ID NO: 246979 - DNA, 13 bp, Homo sapiens
agcagggccctca

SEQ ID NO: 246980 - DNA, 18 bp, Homo sapiens
agcagggccctcagagga

SEQ ID NO: 246981 - DNA, 16 bp, Homo sapiens
agcagggctgggctct

SEQ ID NO: 246982 - DNA, 15 bp, Homo sapiens
agcaggggcagaagg

SEQ ID NO: 246983 - DNA, 23 bp, Homo sapiens
agcaggggggttgggttccagac

SEQ ID NO: 246984 - DNA, 17 bp, Homo sapiens
agcaggggtgggaggct

SEQ ID NO: 246985 - DNA, 18 bp, Homo sapiens
agcagggtagtctggttt

SEQ ID NO: 246986 - DNA, 21 bp, Homo sapiens
agcagggtagtctggtttcta

SEQ ID NO: 246987 - DNA, 16 bp, Homo sapiens
agcagggtcttgctgt

SEQ ID NO: 246988 - DNA, 20 bp, Homo sapiens
agcaggtctgcaggccacca

SEQ ID NO: 246989 - DNA, 14 bp, Homo sapiens
agcaggtggggagg

SEQ ID NO: 246990 - DNA, 22 bp, Homo sapiens
agcaggtgtggtggctcatggc

SEQ ID NO: 246991 - DNA, 21 bp, Homo sapiens
agcagtatcacaggccagatg

SEQ ID NO: 246992 - DNA, 14 bp, Homo sapiens
agcagtatgaatga

SEQ ID NO: 246993 - DNA, 12 bp, Homo sapiens
agcagtcacagg

SEQ ID NO: 246994 - DNA, 17 bp, Homo sapiens
agcagtctacttctgtg

SEQ ID NO: 246995 - DNA, 13 bp, Homo sapiens
agcagtcttgctc

SEQ ID NO: 246996 - DNA, 18 bp, Homo sapiens
agcagtgcatgctgtccc

SEQ ID NO: 246997 - DNA, 22 bp, Homo sapiens
agcagtgcctcgaggcaccggc

SEQ ID NO: 246998 - DNA, 11 bp, Homo sapiens
agcagtgctgg

SEQ ID NO: 246999 - DNA, 19 bp, Homo sapiens
agcagtgctgggcccagcc

SEQ ID NO: 247000 - DNA, 19 bp, Homo sapiens
agcagtgtcatcagaagat

SEQ ID NO: 247001 - DNA, 21 bp, Homo sapiens
agcagtgtcgccgtccctctg

SEQ ID NO: 247002 - DNA, 20 bp, Homo sapiens
agcagtgtcttccataatgt

SEQ ID NO: 247003 - DNA, 17 bp, Homo sapiens
agcagtgtgtctcctgc

SEQ ID NO: 247004 - DNA, 22 bp, Homo sapiens
agcagtgtgtctcctgcatgca

SEQ ID NO: 247005 - DNA, 22 bp, Homo sapiens
agcagttgacatccaaatctag

SEQ ID NO: 247006 - DNA, 13 bp, Homo sapiens
agcagttgtgtca

SEQ ID NO: 247007 - DNA, 14 bp, Homo sapiens
agcagtttcactgc

SEQ ID NO: 247008 - DNA, 20 bp, Homo sapiens
agcagttttcttttaatttt

SEQ ID NO: 247009 - DNA, 23 bp, Homo sapiens
agcataagtttctgggacctcag

SEQ ID NO: 247010 - DNA, 17 bp, Homo sapiens
agcatacaaaaatatat

SEQ ID NO: 247011 - DNA, 18 bp, Homo sapiens
agcatacaaaaatatatt

SEQ ID NO: 247012 - DNA, 15 bp, Homo sapiens
agcatataaatgttt

SEQ ID NO: 247013 - DNA, 18 bp, Homo sapiens
agcatataaatgtttata

SEQ ID NO: 247014 - DNA, 20 bp, Homo sapiens
agcatatattcatacctgtt

SEQ ID NO: 247015 - DNA, 17 bp, Homo sapiens
agcatcaaacatgaaaa

SEQ ID NO: 247016 - DNA, 13 bp, Homo sapiens
agcatcaccacca

SEQ ID NO: 247017 - DNA, 15 bp, Homo sapiens
agcatcaccaccaca

SEQ ID NO: 247018 - DNA, 21 bp, Homo sapiens
agcatcaccaccacacccctg

SEQ ID NO: 247019 - DNA, 16 bp, Homo sapiens
agcatcagagagtgta

SEQ ID NO: 247020 - DNA, 22 bp, Homo sapiens
agcatccatgcggccggcctgg

SEQ ID NO: 247021 - DNA, 24 bp, Homo sapiens
agcatccatgtgtggactcaagtc

SEQ ID NO: 247022 - DNA, 16 bp, Homo sapiens
agcatcccccaaagtt

SEQ ID NO: 247023 - DNA, 20 bp, Homo sapiens
agcatcccccaaagttcaca

SEQ ID NO: 247024 - DNA, 20 bp, Homo sapiens
agcatccggcatgagggctg

SEQ ID NO: 247025 - DNA, 21 bp, Homo sapiens
agcatcctgattattgaatgt

SEQ ID NO: 247026 - DNA, 19 bp, Homo sapiens
agcatcgtgacccttcagg

SEQ ID NO: 247027 - DNA, 23 bp, Homo sapiens
agcatcgtgacccttcagggcca

SEQ ID NO: 247028 - DNA, 13 bp, Homo sapiens
agcatctgctaat

SEQ ID NO: 247029 - DNA, 20 bp, Homo sapiens
agcatctgtcccactgggac

SEQ ID NO: 247030 - DNA, 18 bp, Homo sapiens
agcatcttcacttctaaa

SEQ ID NO: 247031 - DNA, 23 bp, Homo sapiens
agcatcttcacttctaaatgcat

SEQ ID NO: 247032 - DNA, 13 bp, Homo sapiens
agcatgaaaaagc

SEQ ID NO: 247033 - DNA, 14 bp, Homo sapiens
agcatgaaaggtaa

SEQ ID NO: 247034 - DNA, 17 bp, Homo sapiens
agcatgacaagccccag

SEQ ID NO: 247035 - DNA, 19 bp, Homo sapiens
agcatgacaagccccaggc

SEQ ID NO: 247036 - DNA, 20 bp, Homo sapiens
agcatgacaagccccaggca

SEQ ID NO: 247037 - DNA, 21 bp, Homo sapiens
agcatgaccttttggcctttg

SEQ ID NO: 247038 - DNA, 18 bp, Homo sapiens
agcatgcacaaagtgtat

SEQ ID NO: 247039 - DNA, 21 bp, Homo sapiens
agcatgcacaaagtgtattca

SEQ ID NO: 247040 - DNA, 16 bp, Homo sapiens
agcatgccccttggct

SEQ ID NO: 247041 - DNA, 19 bp, Homo sapiens
agcatgccccttggctgga

SEQ ID NO: 247042 - DNA, 16 bp, Homo sapiens
agcatgctcagtattg

SEQ ID NO: 247043 - DNA, 16 bp, Homo sapiens
agcatgctttgctgct

SEQ ID NO: 247044 - DNA, 17 bp, Homo sapiens
agcatgctttgctgcta

SEQ ID NO: 247045 - DNA, 18 bp, Homo sapiens
agcatgctttgctgctat

SEQ ID NO: 247046 - DNA, 16 bp, Homo sapiens
agcatgtaatattaaa

SEQ ID NO: 247047 - DNA, 17 bp, Homo sapiens
agcatgtaatattaaat

SEQ ID NO: 247048 - DNA, 14 bp, Homo sapiens
agcatgtctactgc

SEQ ID NO: 247049 - DNA, 15 bp, Homo sapiens
agcatgtctctgctt

SEQ ID NO: 247050 - DNA, 18 bp, Homo sapiens
agcatgtctctgcttcca

SEQ ID NO: 247051 - DNA, 19 bp, Homo sapiens
agcatgtgtatttccagtg

SEQ ID NO: 247052 - DNA, 13 bp, Homo sapiens
agcatgtgtcaga

SEQ ID NO: 247053 - DNA, 14 bp, Homo sapiens
agcatgtgtgtgtc

SEQ ID NO: 247054 - DNA, 18 bp, Homo sapiens
agcatgttgaatgtatct

SEQ ID NO: 247055 - DNA, 16 bp, Homo sapiens
agcatgttgagccagg

SEQ ID NO: 247056 - DNA, 19 bp, Homo sapiens
agcatgttgagccaggcct

SEQ ID NO: 247057 - DNA, 23 bp, Homo sapiens
agcatgttgtagatacaatcagc

SEQ ID NO: 247058 - DNA, 17 bp, Homo sapiens
agcatgttgttttttca

SEQ ID NO: 247059 - DNA, 19 bp, Homo sapiens
agcatgttgttttttcata

SEQ ID NO: 247060 - DNA, 17 bp, Homo sapiens
agcatgtttcatgtttt

SEQ ID NO: 247061 - DNA, 18 bp, Homo sapiens
agcatgtttcatgttttg

SEQ ID NO: 247062 - DNA, 17 bp, Homo sapiens
agcattaaaaataaaag

SEQ ID NO: 247063 - DNA, 17 bp, Homo sapiens
agcattaacttctctgg

SEQ ID NO: 247064 - DNA, 21 bp, Homo sapiens
agcattaggcttttaagaaac

SEQ ID NO: 247065 - DNA, 15 bp, Homo sapiens
agcattattcttcag

SEQ ID NO: 247066 - DNA, 18 bp, Homo sapiens
agcattccttagcagctc

SEQ ID NO: 247067 - DNA, 18 bp, Homo sapiens
agcattctcactcctacc

SEQ ID NO: 247068 - DNA, 17 bp, Homo sapiens
agcattctgagctgggc

SEQ ID NO: 247069 - DNA, 18 bp, Homo sapiens
agcattctgagctgggct

SEQ ID NO: 247070 - DNA, 15 bp, Homo sapiens
agcattctgcctgcc

SEQ ID NO: 247071 - DNA, 16 bp, Homo sapiens
agcattctgcctgcct

SEQ ID NO: 247072 - DNA, 21 bp, Homo sapiens
agcattctgcctgcctgggaa

SEQ ID NO: 247073 - DNA, 13 bp, Homo sapiens
agcattctggggt

SEQ ID NO: 247074 - DNA, 16 bp, Homo sapiens
agcattcttgtcacaa

SEQ ID NO: 247075 - DNA, 22 bp, Homo sapiens
agcattcttgtcacaataaatg

SEQ ID NO: 247076 - DNA, 17 bp, Homo sapiens
agcattgaaataataat

SEQ ID NO: 247077 - DNA, 19 bp, Homo sapiens
agcattgaaataataatat

SEQ ID NO: 247078 - DNA, 15 bp, Homo sapiens
agcattgaaattata

SEQ ID NO: 247079 - DNA, 15 bp, Homo sapiens
agcatttatcattct

SEQ ID NO: 247080 - DNA, 17 bp, Homo sapiens
agcatttccaacaccac

SEQ ID NO: 247081 - DNA, 21 bp, Homo sapiens
agcatttccaacaccacagac

SEQ ID NO: 247082 - DNA, 21 bp, Homo sapiens
agcatttgactttctgtctgt

SEQ ID NO: 247083 - DNA, 13 bp, Homo sapiens
agcatttggaagg

SEQ ID NO: 247084 - DNA, 17 bp, Homo sapiens
agcatttggaaggaaag

SEQ ID NO: 247085 - DNA, 17 bp, Homo sapiens
agcattttactgtctgt

SEQ ID NO: 247086 - DNA, 13 bp, Homo sapiens
agcattttcagca

SEQ ID NO: 247087 - DNA, 18 bp, Homo sapiens
agcattttctttctgttt

SEQ ID NO: 247088 - DNA, 14 bp, Homo sapiens
agcattttgtgtct

SEQ ID NO: 247089 - DNA, 19 bp, Homo sapiens
atgtctgcatggcagaagc

SEQ ID NO: 247090 - DNA, 16 bp, Homo sapiens
atgtctgtggccttgt

SEQ ID NO: 247091 - DNA, 21 bp, Homo sapiens
atgtctgttttagttggaatg

SEQ ID NO: 247092 - DNA, 17 bp, Homo sapiens
atgtcttactactttaa

SEQ ID NO: 247093 - DNA, 15 bp, Homo sapiens
atgtcttataagaaa

SEQ ID NO: 247094 - DNA, 23 bp, Homo sapiens
atgtcttataagaaaacatgtaa

SEQ ID NO: 247095 - DNA, 20 bp, Homo sapiens
atgtcttcatttcattgtat

SEQ ID NO: 247096 - DNA, 20 bp, Homo sapiens
atgtcttcgtacagttcttc

SEQ ID NO: 247097 - DNA, 14 bp, Homo sapiens
atgtcttgagatgt

SEQ ID NO: 247098 - DNA, 14 bp, Homo sapiens
atagcatcccatct

SEQ ID NO: 247099 - DNA, 14 bp, Homo sapiens
atagcatctgctct

SEQ ID NO: 247100 - DNA, 15 bp, Homo sapiens
atagcattaactaat

SEQ ID NO: 247101 - DNA, 21 bp, Homo sapiens
atagcattaactaatctattg

SEQ ID NO: 247102 - DNA, 12 bp, Homo sapiens
atagcctttgta

SEQ ID NO: 247103 - DNA, 14 bp, Homo sapiens
atagcctttgtagg

SEQ ID NO: 247104 - DNA, 23 bp, Homo sapiens
atagcggggccttgtctcttcct

SEQ ID NO: 247105 - DNA, 13 bp, Homo sapiens
atagctaaatggc

SEQ ID NO: 247106 - DNA, 15 bp, Homo sapiens
atagctacaggaagc

SEQ ID NO: 247107 - DNA, 14 bp, Homo sapiens
atagctactatatg

SEQ ID NO: 247108 - DNA, 21 bp, Homo sapiens
atagctagctatttctatgta

SEQ ID NO: 247109 - DNA, 22 bp, Homo sapiens
atagctagctatttctatgtat

SEQ ID NO: 247110 - DNA, 17 bp, Homo sapiens
atagctatatccatgta

SEQ ID NO: 247111 - DNA, 19 bp, Homo sapiens
atagctatatccatgtact

SEQ ID NO: 247112 - DNA, 18 bp, Homo sapiens
atagctatttagagatat

SEQ ID NO: 247113 - DNA, 20 bp, Homo sapiens
atagctccccgcttctgcct

SEQ ID NO: 247114 - DNA, 20 bp, Homo sapiens
atagctccttggagcaggca

SEQ ID NO: 247115 - DNA, 17 bp, Homo sapiens
atagctgagctggaaag

SEQ ID NO: 247116 - DNA, 24 bp, Homo sapiens
atagctgggaacccgactgtgaaa

SEQ ID NO: 247117 - DNA, 23 bp, Homo sapiens
atagctggtcttatttgtaaagc

SEQ ID NO: 247118 - DNA, 15 bp, Homo sapiens
atagctgtatatttg

SEQ ID NO: 247119 - DNA, 20 bp, Homo sapiens
atagctgtatatttgaaact

SEQ ID NO: 247120 - DNA, 10 bp, Homo sapiens
atagctttat

SEQ ID NO: 247121 - DNA, 21 bp, Homo sapiens
atagctttattttttaagtat

SEQ ID NO: 247122 - DNA, 15 bp, Homo sapiens
ataggaaaactgaat

SEQ ID NO: 247123 - DNA, 12 bp, Homo sapiens
ataggaaaagat

SEQ ID NO: 247124 - DNA, 18 bp, Homo sapiens
ataggaaaagtacattta

SEQ ID NO: 247125 - DNA, 18 bp, Homo sapiens
ataggacatactgcatgt

SEQ ID NO: 247126 - DNA, 19 bp, Homo sapiens
ataggacatactgcatgta

SEQ ID NO: 247127 - DNA, 15 bp, Homo sapiens
ataggagacttgtag

SEQ ID NO: 247128 - DNA, 15 bp, Homo sapiens
ataggagaggagggt

SEQ ID NO: 247129 - DNA, 16 bp, Homo sapiens
ataggagcttccagat

SEQ ID NO: 247130 - DNA, 18 bp, Homo sapiens
ataggagcttccagatgg

SEQ ID NO: 247131 - DNA, 13 bp, Homo sapiens
ataggaggacaga

SEQ ID NO: 247132 - DNA, 18 bp, Homo sapiens
ataggccatctgtaaata

SEQ ID NO: 247133 - DNA, 23 bp, Homo sapiens
ataggcccaaggtcccctccaca

SEQ ID NO: 247134 - DNA, 22 bp, Homo sapiens
ataggctctgcacagatggatt

SEQ ID NO: 247135 - DNA, 16 bp, Homo sapiens
atagggtctcttcagg

SEQ ID NO: 247136 - DNA, 21 bp, Homo sapiens
atagggtctcttcaggttctt

SEQ ID NO: 247137 - DNA, 14 bp, Homo sapiens
atagggtggacaga

SEQ ID NO: 247138 - DNA, 14 bp, Homo sapiens
ataggtaatcaatg

SEQ ID NO: 247139 - DNA, 20 bp, Homo sapiens
ataggtaggagacctcttct

SEQ ID NO: 247140 - DNA, 22 bp, Homo sapiens
ataggtgcttattctcaaagca

SEQ ID NO: 247141 - DNA, 20 bp, Homo sapiens
atagtaaaaagattctctgc

SEQ ID NO: 247142 - DNA, 18 bp, Homo sapiens
atagtaagcctccctcct

SEQ ID NO: 247143 - DNA, 20 bp, Homo sapiens
atagtaagcctccctcctcg

SEQ ID NO: 247144 - DNA, 17 bp, Homo sapiens
atagtaggctaaaaaca

SEQ ID NO: 247145 - DNA, 20 bp, Homo sapiens
atagtaggctaaaaacattt

SEQ ID NO: 247146 - DNA, 21 bp, Homo sapiens
atagtaggctaaaaacatttt

SEQ ID NO: 247147 - DNA, 18 bp, Homo sapiens
atagtagtaaaattagaa

SEQ ID NO: 247148 - DNA, 21 bp, Homo sapiens
atagtagtaaaattagaaaaa

SEQ ID NO: 247149 - DNA, 22 bp, Homo sapiens
atagtatgcagctaaaaaataa

SEQ ID NO: 247150 - DNA, 21 bp, Homo sapiens
atagtatggaagtatttgaga

SEQ ID NO: 247151 - DNA, 20 bp, Homo sapiens
atagtatttgagagttctaa

SEQ ID NO: 247152 - DNA, 21 bp, Homo sapiens
atagtcaatcaaacagggaca

SEQ ID NO: 247153 - DNA, 21 bp, Homo sapiens
atagtcagctgtaccaagccc

SEQ ID NO: 247154 - DNA, 13 bp, Homo sapiens
atagtcgggcata

SEQ ID NO: 247155 - DNA, 23 bp, Homo sapiens
atagtctctacctatagaaatgt

SEQ ID NO: 247156 - DNA, 20 bp, Homo sapiens
atagtgcaactatgaatgta

SEQ ID NO: 247157 - DNA, 21 bp, Homo sapiens
atagtgcctcagcgctgccca

SEQ ID NO: 247158 - DNA, 23 bp, Homo sapiens
atagtgcctcagcgctgcccaca

SEQ ID NO: 247159 - DNA, 12 bp, Homo sapiens
atagtgcctttt

SEQ ID NO: 247160 - DNA, 17 bp, Homo sapiens
atagtgcttcttgtaat

SEQ ID NO: 247161 - DNA, 13 bp, Homo sapiens
atagtggccagac

SEQ ID NO: 247162 - DNA, 21 bp, Homo sapiens
atagtggtgttttaaagagaa

SEQ ID NO: 247163 - DNA, 18 bp, Homo sapiens
atagtggttcttggaaaa

SEQ ID NO: 247164 - DNA, 13 bp, Homo sapiens
atagtgtaaaata

SEQ ID NO: 247165 - DNA, 14 bp, Homo sapiens
atagtgtaaaataa

SEQ ID NO: 247166 - DNA, 22 bp, Homo sapiens
atagtgtataccacctgtacat

SEQ ID NO: 247167 - DNA, 12 bp, Homo sapiens
atagtgtgttct

SEQ ID NO: 247168 - DNA, 13 bp, Homo sapiens
atagtgtgttctg

SEQ ID NO: 247169 - DNA, 19 bp, Homo sapiens
atagtgttgatcagatctt

SEQ ID NO: 247170 - DNA, 21 bp, Homo sapiens
atagttaatgaaggtgtgcta

SEQ ID NO: 247171 - DNA, 15 bp, Homo sapiens
atagttcaggatttg

SEQ ID NO: 247172 - DNA, 13 bp, Homo sapiens
atagttctatttc

SEQ ID NO: 247173 - DNA, 16 bp, Homo sapiens
atagttctatttctat

SEQ ID NO: 247174 - DNA, 12 bp, Homo sapiens
atagttctgtta

SEQ ID NO: 247175 - DNA, 20 bp, Homo sapiens
atagttctgttaaatatttt

SEQ ID NO: 247176 - DNA, 16 bp, Homo sapiens
atagttgaacaagatt

SEQ ID NO: 247177 - DNA, 15 bp, Homo sapiens
atagttgtctttctt

SEQ ID NO: 247178 - DNA, 16 bp, Homo sapiens
atagtttaggagaaac

SEQ ID NO: 247179 - DNA, 21 bp, Homo sapiens
atagtttcagatatatatcat

SEQ ID NO: 247180 - DNA, 15 bp, Homo sapiens
atagtttgtacatgc

SEQ ID NO: 247181 - DNA, 20 bp, Homo sapiens
atagttttaaactcattttt

SEQ ID NO: 247182 - DNA, 18 bp, Homo sapiens
atataaaaagaaaagata

SEQ ID NO: 247183 - DNA, 20 bp, Homo sapiens
atataaaaagaaaagataaa

SEQ ID NO: 247184 - DNA, 12 bp, Homo sapiens
atataaaaataa

SEQ ID NO: 247185 - DNA, 13 bp, Homo sapiens
atataaaaataat

SEQ ID NO: 247186 - DNA, 22 bp, Homo sapiens
atataaaataaatatactaata

SEQ ID NO: 247187 - DNA, 17 bp, Homo sapiens
atataaaatgtattcaa

SEQ ID NO: 247188 - DNA, 15 bp, Homo sapiens
atataaactgtgaga

SEQ ID NO: 247189 - DNA, 16 bp, Homo sapiens
atataaactgtgagat

SEQ ID NO: 247190 - DNA, 17 bp, Homo sapiens
atataaagtactactgt

SEQ ID NO: 247191 - DNA, 18 bp, Homo sapiens
atataaagtactactgta

SEQ ID NO: 247192 - DNA, 12 bp, Homo sapiens
atataaagtttt

SEQ ID NO: 247193 - DNA, 15 bp, Homo sapiens
atataaatgaatgaa

SEQ ID NO: 247194 - DNA, 17 bp, Homo sapiens
atataaatgtactacat

SEQ ID NO: 247195 - DNA, 14 bp, Homo sapiens
atataaatgtttat

SEQ ID NO: 247196 - DNA, 16 bp, Homo sapiens
atataaatgtttatat

SEQ ID NO: 247197 - DNA, 12 bp, Homo sapiens
atataaattaag

SEQ ID NO: 247198 - DNA, 17 bp, Homo sapiens
atataaattattacttt

SEQ ID NO: 247199 - DNA, 18 bp, Homo sapiens
atataacaatatatgata

SEQ ID NO: 247200 - DNA, 23 bp, Homo sapiens
atataaggaaagcaataaatgaa

SEQ ID NO: 247201 - DNA, 14 bp, Homo sapiens
atataagttaaaga

SEQ ID NO: 247202 - DNA, 18 bp, Homo sapiens
atataataaagctactga

SEQ ID NO: 247203 - DNA, 21 bp, Homo sapiens
atataataaagctactgattt

SEQ ID NO: 247204 - DNA, 17 bp, Homo sapiens
atataataaagtattcc

SEQ ID NO: 247205 - DNA, 14 bp, Homo sapiens
atataataaatggg

SEQ ID NO: 247206 - DNA, 17 bp, Homo sapiens
atataataatgtccttt

SEQ ID NO: 247207 - DNA, 23 bp, Homo sapiens
atataatatgtcttcataatata

SEQ ID NO: 247208 - DNA, 18 bp, Homo sapiens
atataatgagtttcatta

SEQ ID NO: 247209 - DNA, 18 bp, Homo sapiens
atataatggtttactgct

SEQ ID NO: 247210 - DNA, 19 bp, Homo sapiens
atataatggtttactgctg

SEQ ID NO: 247211 - DNA, 21 bp, Homo sapiens
atataatgttgttatttaaag

SEQ ID NO: 247212 - DNA, 14 bp, Homo sapiens
atataattatgtta

SEQ ID NO: 247213 - DNA, 19 bp, Homo sapiens
atataattatgttattgaa

SEQ ID NO: 247214 - DNA, 23 bp, Homo sapiens
atataatttttttatgttttgtt

SEQ ID NO: 247215 - DNA, 16 bp, Homo sapiens
atatacacaaagatat

SEQ ID NO: 247216 - DNA, 20 bp, Homo sapiens
atatacacaaagatattatt

SEQ ID NO: 247217 - DNA, 21 bp, Homo sapiens
atatacacggattattatttg

SEQ ID NO: 247218 - DNA, 15 bp, Homo sapiens
atatacagatgaaaa

SEQ ID NO: 247219 - DNA, 11 bp, Homo sapiens
atatgttgtaa

SEQ ID NO: 247220 - DNA, 17 bp, Homo sapiens
atatgttttaaatatag

SEQ ID NO: 247221 - DNA, 13 bp, Homo sapiens
atatgttttgaga

SEQ ID NO: 247222 - DNA, 16 bp, Homo sapiens
atatgttttgagaaaa

SEQ ID NO: 247223 - DNA, 17 bp, Homo sapiens
atatgttttgagaaaaa

SEQ ID NO: 247224 - DNA, 23 bp, Homo sapiens
atattaaaaatataaacaatgtt

SEQ ID NO: 247225 - DNA, 20 bp, Homo sapiens
atattaaagcgcaaatgaat

SEQ ID NO: 247226 - DNA, 15 bp, Homo sapiens
atattaaataaatgt

SEQ ID NO: 247227 - DNA, 12 bp, Homo sapiens
atattaaataca

SEQ ID NO: 247228 - DNA, 16 bp, Homo sapiens
atattaagaaacaatt

SEQ ID NO: 247229 - DNA, 17 bp, Homo sapiens
atattaataaaacttta

SEQ ID NO: 247230 - DNA, 20 bp, Homo sapiens
atattaatttatcagattgc

SEQ ID NO: 247231 - DNA, 15 bp, Homo sapiens
atattacattgcatt

SEQ ID NO: 247232 - DNA, 19 bp, Homo sapiens
atattacattgcattcaaa

SEQ ID NO: 247233 - DNA, 15 bp, Homo sapiens
atattaccagcaaga

SEQ ID NO: 247234 - DNA, 20 bp, Homo sapiens
atattaccatcttaatcttt

SEQ ID NO: 247235 - DNA, 23 bp, Homo sapiens
atattaccatcttaatctttatt

SEQ ID NO: 247236 - DNA, 14 bp, Homo sapiens
atattactgtcttt

SEQ ID NO: 247237 - DNA, 19 bp, Homo sapiens
atattactgtctttattct

SEQ ID NO: 247238 - DNA, 21 bp, Homo sapiens
atattactgtctttattctta

SEQ ID NO: 247239 - DNA, 15 bp, Homo sapiens
atattactgttgcat

SEQ ID NO: 247240 - DNA, 20 bp, Homo sapiens
atattactgttgcatttact

SEQ ID NO: 247241 - DNA, 21 bp, Homo sapiens
atattactgttgcatttactt

SEQ ID NO: 247242 - DNA, 19 bp, Homo sapiens
atattacttttgtaaatat

SEQ ID NO: 247243 - DNA, 16 bp, Homo sapiens
atattagagtgccctt

SEQ ID NO: 247244 - DNA, 17 bp, Homo sapiens
atattagagtgccctta

SEQ ID NO: 247245 - DNA, 14 bp, Homo sapiens
atattataaatcca

SEQ ID NO: 247246 - DNA, 21 bp, Homo sapiens
atattataagttgacctttat

SEQ ID NO: 247247 - DNA, 22 bp, Homo sapiens
atattataataatgttctctgg

SEQ ID NO: 247248 - DNA, 20 bp, Homo sapiens
atattatactaagaaaagat

SEQ ID NO: 247249 - DNA, 14 bp, Homo sapiens
atattatgatttta

SEQ ID NO: 247250 - DNA, 20 bp, Homo sapiens
atattatgattttatttaaa

SEQ ID NO: 247251 - DNA, 22 bp, Homo sapiens
atattatgtggcttttatttca

SEQ ID NO: 247252 - DNA, 13 bp, Homo sapiens
atattatgtgttt

SEQ ID NO: 247253 - DNA, 15 bp, Homo sapiens
atattcaaacacaca

SEQ ID NO: 247254 - DNA, 18 bp, Homo sapiens
atattcaaacacacagta

SEQ ID NO: 247255 - DNA, 23 bp, Homo sapiens
atattcaaatcagcaagcttgta

SEQ ID NO: 247256 - DNA, 15 bp, Homo sapiens
atattcaataaagct

SEQ ID NO: 247257 - DNA, 14 bp, Homo sapiens
atattcagagatgt

SEQ ID NO: 247258 - DNA, 16 bp, Homo sapiens
atattcaggagttgga

SEQ ID NO: 247259 - DNA, 19 bp, Homo sapiens
atattcaggagttggaatg

SEQ ID NO: 247260 - DNA, 23 bp, Homo sapiens
atattcatacctgttgtacactt

SEQ ID NO: 247261 - DNA, 20 bp, Homo sapiens
atattcatcaaataaacctt

SEQ ID NO: 247262 - DNA, 17 bp, Homo sapiens
atattcattctttataa

SEQ ID NO: 247263 - DNA, 16 bp, Homo sapiens
atattccatgaatgta

SEQ ID NO: 247264 - DNA, 14 bp, Homo sapiens
atattcccatggta

SEQ ID NO: 247265 - DNA, 18 bp, Homo sapiens
atattcccctatctctag

SEQ ID NO: 247266 - DNA, 18 bp, Homo sapiens
atattcctgaatgaaata

SEQ ID NO: 247267 - DNA, 13 bp, Homo sapiens
atattctaagcca

SEQ ID NO: 247268 - DNA, 17 bp, Homo sapiens
atattctggctgataaa

SEQ ID NO: 247269 - DNA, 19 bp, Homo sapiens
atattcttgctttcacaaa

SEQ ID NO: 247270 - DNA, 22 bp, Homo sapiens
atattctttacaaactgaagat

SEQ ID NO: 247271 - DNA, 16 bp, Homo sapiens
atattctttatatact

SEQ ID NO: 247272 - DNA, 15 bp, Homo sapiens
atattgaccatgtga

SEQ ID NO: 247273 - DNA, 16 bp, Homo sapiens
atattgaccatgtgat

SEQ ID NO: 247274 - DNA, 19 bp, Homo sapiens
atattgaccatgtgattat

SEQ ID NO: 247275 - DNA, 15 bp, Homo sapiens
atattgagacaaaaa

SEQ ID NO: 247276 - DNA, 14 bp, Homo sapiens
atattgatgaaaag

SEQ ID NO: 247277 - DNA, 15 bp, Homo sapiens
atattgcttggacta

SEQ ID NO: 247278 - DNA, 13 bp, Homo sapiens
atattggtattca

SEQ ID NO: 247279 - DNA, 14 bp, Homo sapiens
atattggtgtgaat

SEQ ID NO: 247280 - DNA, 12 bp, Homo sapiens
atattgtatgta

SEQ ID NO: 247281 - DNA, 22 bp, Homo sapiens
atattgtatttaacccattatt

SEQ ID NO: 247282 - DNA, 19 bp, Homo sapiens
atattgtcacaacactgaa

SEQ ID NO: 247283 - DNA, 21 bp, Homo sapiens
atattgtgccaatatgtattg

SEQ ID NO: 247284 - DNA, 17 bp, Homo sapiens
atattgtttttatatat

SEQ ID NO: 247285 - DNA, 21 bp, Homo sapiens
atatttaaaaaaaaaatcagt

SEQ ID NO: 247286 - DNA, 22 bp, Homo sapiens
atatttaaaagacaaacacctt

SEQ ID NO: 247287 - DNA, 15 bp, Homo sapiens
atatttaacttctag

SEQ ID NO: 247288 - DNA, 18 bp, Homo sapiens
atatttaagaaaatacaa

SEQ ID NO: 247289 - DNA, 22 bp, Homo sapiens
atatttaataggataaattaat

SEQ ID NO: 247290 - DNA, 12 bp, Homo sapiens
atatttaatgat

SEQ ID NO: 247291 - DNA, 22 bp, Homo sapiens
atatttagttatagtttcagat

SEQ ID NO: 247292 - DNA, 14 bp, Homo sapiens
atatttatataatt

SEQ ID NO: 247293 - DNA, 20 bp, Homo sapiens
atatttatataattatgtta

SEQ ID NO: 247294 - DNA, 22 bp, Homo sapiens
atatttatataattatgttatt

SEQ ID NO: 247295 - DNA, 21 bp, Homo sapiens
atatttatgacctcaacaaag

SEQ ID NO: 247296 - DNA, 20 bp, Homo sapiens
atatttatgtagatgtgcat

SEQ ID NO: 247297 - DNA, 22 bp, Homo sapiens
atatttattgaattattttgtt

SEQ ID NO: 247298 - DNA, 14 bp, Homo sapiens
atatttatttctag

SEQ ID NO: 247299 - DNA, 18 bp, Homo sapiens
atatttatttctagcaaa

SEQ ID NO: 247300 - DNA, 22 bp, Homo sapiens
atatttattttcagtatactgt

SEQ ID NO: 247301 - DNA, 12 bp, Homo sapiens
atatttcactta

SEQ ID NO: 247302 - DNA, 21 bp, Homo sapiens
atatttccatatggattttct

SEQ ID NO: 247303 - DNA, 18 bp, Homo sapiens
atatttctaagcttattt

SEQ ID NO: 247304 - DNA, 21 bp, Homo sapiens
atatttctaagcttatttcta

SEQ ID NO: 247305 - DNA, 15 bp, Homo sapiens
atatttctatgtaaa

SEQ ID NO: 247306 - DNA, 13 bp, Homo sapiens
atatttcttgctt

SEQ ID NO: 247307 - DNA, 14 bp, Homo sapiens
atatttcttgcttt

SEQ ID NO: 247308 - DNA, 15 bp, Homo sapiens
atatttcttgctttc

SEQ ID NO: 247309 - DNA, 19 bp, Homo sapiens
atatttgacattcttcact

SEQ ID NO: 247310 - DNA, 13 bp, Homo sapiens
atatttgatgtag

SEQ ID NO: 247311 - DNA, 21 bp, Homo sapiens
atatttgctggagtgctggct

SEQ ID NO: 247312 - DNA, 15 bp, Homo sapiens
atatttgcttattta

SEQ ID NO: 247313 - DNA, 16 bp, Homo sapiens
atatttgcttatttat

SEQ ID NO: 247314 - DNA, 17 bp, Homo sapiens
atatttgcttctaatgt

SEQ ID NO: 247315 - DNA, 15 bp, Homo sapiens
atatttggattgtca

SEQ ID NO: 247316 - DNA, 14 bp, Homo sapiens
atatttgtaacttt

SEQ ID NO: 247317 - DNA, 18 bp, Homo sapiens
atatttgtaactttgcat

SEQ ID NO: 247318 - DNA, 21 bp, Homo sapiens
atatttgtaactttgcatgtt

SEQ ID NO: 247319 - DNA, 18 bp, Homo sapiens
atatttgtagctagaata

SEQ ID NO: 247320 - DNA, 18 bp, Homo sapiens
atatttgtctcattttgt

SEQ ID NO: 247321 - DNA, 20 bp, Homo sapiens
atatttgttatgataaaagg

SEQ ID NO: 247322 - DNA, 16 bp, Homo sapiens
atattttatactgcac

SEQ ID NO: 247323 - DNA, 15 bp, Homo sapiens
atattttatttttat

SEQ ID NO: 247324 - DNA, 19 bp, Homo sapiens
atattttcaaagtacataa

SEQ ID NO: 247325 - DNA, 23 bp, Homo sapiens
atattttcatgacttttccatgt

SEQ ID NO: 247326 - DNA, 19 bp, Homo sapiens
atatttttaataaaagttg

SEQ ID NO: 247327 - DNA, 22 bp, Homo sapiens
atatttttacaaataattatca

SEQ ID NO: 247328 - DNA, 22 bp, Homo sapiens
agaggatgaatgtatgtgcact

SEQ ID NO: 247329 - DNA, 16 bp, Homo sapiens
agaggatgatgtaatt

SEQ ID NO: 247330 - DNA, 16 bp, Homo sapiens
agaggattgcttccct

SEQ ID NO: 247331 - DNA, 18 bp, Homo sapiens
agaggatttttttctgag

SEQ ID NO: 247332 - DNA, 22 bp, Homo sapiens
agaggcaacagtgttctgagcc

SEQ ID NO: 247333 - DNA, 14 bp, Homo sapiens
agaggcagagtgcc

SEQ ID NO: 247334 - DNA, 12 bp, Homo sapiens
agaggcagggcc

SEQ ID NO: 247335 - DNA, 15 bp, Homo sapiens
agaggcagggccctg

SEQ ID NO: 247336 - DNA, 16 bp, Homo sapiens
agaggcagggccctgg

SEQ ID NO: 247337 - DNA, 14 bp, Homo sapiens
agaggcagtggcag

SEQ ID NO: 247338 - DNA, 16 bp, Homo sapiens
agaggcagtggcagca

SEQ ID NO: 247339 - DNA, 17 bp, Homo sapiens
agaggcagtggcagcaa

SEQ ID NO: 247340 - DNA, 15 bp, Homo sapiens
agaggcatgacagct

SEQ ID NO: 247341 - DNA, 23 bp, Homo sapiens
agaggcatttgtcttagagagag

SEQ ID NO: 247342 - DNA, 18 bp, Homo sapiens
agaggccagccccaccca

SEQ ID NO: 247343 - DNA, 21 bp, Homo sapiens
agaggccagccccacccagga

SEQ ID NO: 247344 - DNA, 19 bp, Homo sapiens
agaggccatgattcgccca

SEQ ID NO: 247345 - DNA, 21 bp, Homo sapiens
agaggcctcccccagccagga

SEQ ID NO: 247346 - DNA, 22 bp, Homo sapiens
agaggcctcccccagccaggac

SEQ ID NO: 247347 - DNA, 22 bp, Homo sapiens
agaggcctccctggctgcctct

SEQ ID NO: 247348 - DNA, 13 bp, Homo sapiens
agaggcctgagga

SEQ ID NO: 247349 - DNA, 12 bp, Homo sapiens
agaggccttggg

SEQ ID NO: 247350 - DNA, 18 bp, Homo sapiens
agaggccttgggggtctg

SEQ ID NO: 247351 - DNA, 14 bp, Homo sapiens
agaggcgagccagg

SEQ ID NO: 247352 - DNA, 21 bp, Homo sapiens
agaggcgtcctggtgaggaca

SEQ ID NO: 247353 - DNA, 22 bp, Homo sapiens
agaggcgttagtgggcaggtgg

SEQ ID NO: 247354 - DNA, 16 bp, Homo sapiens
agaggctaagatgaga

SEQ ID NO: 247355 - DNA, 12 bp, Homo sapiens
agaggctagccc

SEQ ID NO: 247356 - DNA, 16 bp, Homo sapiens
agaggctagccccagg

SEQ ID NO: 247357 - DNA, 17 bp, Homo sapiens
agaggctagccccaggg

SEQ ID NO: 247358 - DNA, 14 bp, Homo sapiens
agaggctcctggag

SEQ ID NO: 247359 - DNA, 17 bp, Homo sapiens
agaggctcctggagcca

SEQ ID NO: 247360 - DNA, 20 bp, Homo sapiens
agaggctcctggagccagcc

SEQ ID NO: 247361 - DNA, 15 bp, Homo sapiens
agaggctgagcagga

SEQ ID NO: 247362 - DNA, 18 bp, Homo sapiens
agagggaaatacaaggag

SEQ ID NO: 247363 - DNA, 12 bp, Homo sapiens
agagggaatgtg

SEQ ID NO: 247364 - DNA, 15 bp, Homo sapiens
agagggaatgtgaaa

SEQ ID NO: 247365 - DNA, 19 bp, Homo sapiens
agagggaatgttccctgca

SEQ ID NO: 247366 - DNA, 12 bp, Homo sapiens
agagggacagat

SEQ ID NO: 247367 - DNA, 18 bp, Homo sapiens
agagggaccagctggggg

SEQ ID NO: 247368 - DNA, 23 bp, Homo sapiens
agagggagccggtttgggagaga

SEQ ID NO: 247369 - DNA, 18 bp, Homo sapiens
agagggagtacaaagaca

SEQ ID NO: 247370 - DNA, 20 bp, Homo sapiens
agagggcaggggctgcatcc

SEQ ID NO: 247371 - DNA, 20 bp, Homo sapiens
agagggcagtacctgggaaa

SEQ ID NO: 247372 - DNA, 16 bp, Homo sapiens
agagggcccagctgta

SEQ ID NO: 247373 - DNA, 15 bp, Homo sapiens
agagggcctgtggga

SEQ ID NO: 247374 - DNA, 16 bp, Homo sapiens
agagggcctgtgggag

SEQ ID NO: 247375 - DNA, 22 bp, Homo sapiens
agaggggacttggataggagct

SEQ ID NO: 247376 - DNA, 14 bp, Homo sapiens
agaggggagaggaa

SEQ ID NO: 247377 - DNA, 15 bp, Homo sapiens
agaggggaggggcct

SEQ ID NO: 247378 - DNA, 15 bp, Homo sapiens
agagggggctctcca

SEQ ID NO: 247379 - DNA, 21 bp, Homo sapiens
agaggggtgagacagtggggg

SEQ ID NO: 247380 - DNA, 23 bp, Homo sapiens
agaggggtgcacccactcaccag

SEQ ID NO: 247381 - DNA, 18 bp, Homo sapiens
agaggtacccaaggtcac

SEQ ID NO: 247382 - DNA, 17 bp, Homo sapiens
agaggtgagggaggcct

SEQ ID NO: 247383 - DNA, 18 bp, Homo sapiens
agaggtgagggaggcctg

SEQ ID NO: 247384 - DNA, 14 bp, Homo sapiens
agaggtgctgcttt

SEQ ID NO: 247385 - DNA, 18 bp, Homo sapiens
agaggtgctgctttgctt

SEQ ID NO: 247386 - DNA, 23 bp, Homo sapiens
agaggtgggaggcccctggtggc

SEQ ID NO: 247387 - DNA, 19 bp, Homo sapiens
agaggtgggcagctgggcc

SEQ ID NO: 247388 - DNA, 18 bp, Homo sapiens
agaggtggggaagagagc

SEQ ID NO: 247389 - DNA, 19 bp, Homo sapiens
agaggtggggaagagagcc

SEQ ID NO: 247390 - DNA, 18 bp, Homo sapiens
agaggtgggggatgctga

SEQ ID NO: 247391 - DNA, 22 bp, Homo sapiens
agaggtgggggatgctgaggag

SEQ ID NO: 247392 - DNA, 17 bp, Homo sapiens
agaggtggggtgaagct

SEQ ID NO: 247393 - DNA, 18 bp, Homo sapiens
agaggtggggtgaagctg

SEQ ID NO: 247394 - DNA, 13 bp, Homo sapiens
agaggtgtgtgcc

SEQ ID NO: 247395 - DNA, 20 bp, Homo sapiens
agaggttaaggtgggtccag

SEQ ID NO: 247396 - DNA, 22 bp, Homo sapiens
agaggttaaggtgggtccagga

SEQ ID NO: 247397 - DNA, 17 bp, Homo sapiens
agaggttatctgcctgg

SEQ ID NO: 247398 - DNA, 20 bp, Homo sapiens
agaggttatctgcctggcct

SEQ ID NO: 247399 - DNA, 21 bp, Homo sapiens
agaggttatctgcctggcctg

SEQ ID NO: 247400 - DNA, 17 bp, Homo sapiens
agaggttctcagcaagt

SEQ ID NO: 247401 - DNA, 13 bp, Homo sapiens
agaggttgtgaaa

SEQ ID NO: 247402 - DNA, 19 bp, Homo sapiens
agaggttgtggtgagccga

SEQ ID NO: 247403 - DNA, 18 bp, Homo sapiens
agagtaaatattgtcaca

SEQ ID NO: 247404 - DNA, 16 bp, Homo sapiens
agagtacccccctgag

SEQ ID NO: 247405 - DNA, 17 bp, Homo sapiens
agagtacccccctgaga

SEQ ID NO: 247406 - DNA, 16 bp, Homo sapiens
agagtacttaatatac

SEQ ID NO: 247407 - DNA, 21 bp, Homo sapiens
agagtagatggtgaaatttat

SEQ ID NO: 247408 - DNA, 22 bp, Homo sapiens
agagtagatggtgaaatttatt

SEQ ID NO: 247409 - DNA, 18 bp, Homo sapiens
atgatatttcttgctttc

SEQ ID NO: 247410 - DNA, 12 bp, Homo sapiens
atgatattttat

SEQ ID NO: 247411 - DNA, 20 bp, Homo sapiens
atgatcaaaacctgtgccag

SEQ ID NO: 247412 - DNA, 22 bp, Homo sapiens
atgatcagaactgggaaaacag

SEQ ID NO: 247413 - DNA, 21 bp, Homo sapiens
atgatccatgagtttgccctg

SEQ ID NO: 247414 - DNA, 20 bp, Homo sapiens
atgatccctgtgttgtctct

SEQ ID NO: 247415 - DNA, 19 bp, Homo sapiens
atgatctaggtttaactca

SEQ ID NO: 247416 - DNA, 22 bp, Homo sapiens
atgatctaggtttaactcagat

SEQ ID NO: 247417 - DNA, 12 bp, Homo sapiens
atgatctattgc

SEQ ID NO: 247418 - DNA, 14 bp, Homo sapiens
atgatctgtcaaag

SEQ ID NO: 247419 - DNA, 15 bp, Homo sapiens
atgatcttctttata

SEQ ID NO: 247420 - DNA, 18 bp, Homo sapiens
atgatcttctttataatt

SEQ ID NO: 247421 - DNA, 20 bp, Homo sapiens
atgatgagccttcgtgcccc

SEQ ID NO: 247422 - DNA, 16 bp, Homo sapiens
atgatgattaaacacc

SEQ ID NO: 247423 - DNA, 23 bp, Homo sapiens
atgatgattaaacacctgacaca

SEQ ID NO: 247424 - DNA, 15 bp, Homo sapiens
atgatgattcaatca

SEQ ID NO: 247425 - DNA, 21 bp, Homo sapiens
atgatgcatggagtgtttgac

SEQ ID NO: 247426 - DNA, 15 bp, Homo sapiens
atgatgctgtgacaa

SEQ ID NO: 247427 - DNA, 14 bp, Homo sapiens
atgatgcttactac

SEQ ID NO: 247428 - DNA, 17 bp, Homo sapiens
atgatggatgagaaaaa

SEQ ID NO: 247429 - DNA, 19 bp, Homo sapiens
atgatgtccagaagaatat

SEQ ID NO: 247430 - DNA, 19 bp, Homo sapiens
atgatgtctcttgtagaag

SEQ ID NO: 247431 - DNA, 14 bp, Homo sapiens
atgatgtgttgtga

SEQ ID NO: 247432 - DNA, 19 bp, Homo sapiens
atgattaaacacctgacac

SEQ ID NO: 247433 - DNA, 20 bp, Homo sapiens
atgattaaacacctgacaca

SEQ ID NO: 247434 - DNA, 16 bp, Homo sapiens
atgattaattcacctt

SEQ ID NO: 247435 - DNA, 21 bp, Homo sapiens
atgattagacaatgtggaatt

SEQ ID NO: 247436 - DNA, 21 bp, Homo sapiens
atgattcaacaggttttcctg

SEQ ID NO: 247437 - DNA, 17 bp, Homo sapiens
atgattcacttttattg

SEQ ID NO: 247438 - DNA, 18 bp, Homo sapiens
atgattcacttttattgt

SEQ ID NO: 247439 - DNA, 14 bp, Homo sapiens
atgattcataacaa

SEQ ID NO: 247440 - DNA, 13 bp, Homo sapiens
atgattccaaata

SEQ ID NO: 247441 - DNA, 22 bp, Homo sapiens
atgattccttgatggagatatt

SEQ ID NO: 247442 - DNA, 13 bp, Homo sapiens
atgattctcctct

SEQ ID NO: 247443 - DNA, 16 bp, Homo sapiens
atgattctcctctccc

SEQ ID NO: 247444 - DNA, 14 bp, Homo sapiens
atgattgaaaagaa

SEQ ID NO: 247445 - DNA, 13 bp, Homo sapiens
atgattggattat

SEQ ID NO: 247446 - DNA, 16 bp, Homo sapiens
atgattggattattca

SEQ ID NO: 247447 - DNA, 21 bp, Homo sapiens
atgattggattattcatttaa

SEQ ID NO: 247448 - DNA, 14 bp, Homo sapiens
atgattgtaaaata

SEQ ID NO: 247449 - DNA, 15 bp, Homo sapiens
atgattgtaacatat

SEQ ID NO: 247450 - DNA, 20 bp, Homo sapiens
atgatttaaatagaacttga

SEQ ID NO: 247451 - DNA, 12 bp, Homo sapiens
atgatttaacat

SEQ ID NO: 247452 - DNA, 15 bp, Homo sapiens
atgatttatagtttg

SEQ ID NO: 247453 - DNA, 14 bp, Homo sapiens
atgatttcatttca

SEQ ID NO: 247454 - DNA, 18 bp, Homo sapiens
atgattttgatgcacaac

SEQ ID NO: 247455 - DNA, 21 bp, Homo sapiens
atgatttttaagtacaaaaaa

SEQ ID NO: 247456 - DNA, 22 bp, Homo sapiens
atgatttttagatgagattgtt

SEQ ID NO: 247457 - DNA, 14 bp, Homo sapiens
atgatttttgtgta

SEQ ID NO: 247458 - DNA, 16 bp, Homo sapiens
atgccgtctcatattt

SEQ ID NO: 247459 - DNA, 22 bp, Homo sapiens
atgccgtctcatatttttacaa

SEQ ID NO: 247460 - DNA, 19 bp, Homo sapiens
atgcctatttactggaaac

SEQ ID NO: 247461 - DNA, 16 bp, Homo sapiens
atgcctcacgagattt

SEQ ID NO: 247462 - DNA, 18 bp, Homo sapiens
atgcctcatgccacacct

SEQ ID NO: 247463 - DNA, 22 bp, Homo sapiens
atgcctccctgaccctgcagag

SEQ ID NO: 247464 - DNA, 15 bp, Homo sapiens
atgcctcctctgtcc

SEQ ID NO: 247465 - DNA, 21 bp, Homo sapiens
atgcctgacacaggggacact

SEQ ID NO: 247466 - DNA, 12 bp, Homo sapiens
atgcctgagggt

SEQ ID NO: 247467 - DNA, 15 bp, Homo sapiens
atgcctgagggtgga

SEQ ID NO: 247468 - DNA, 12 bp, Homo sapiens
atgcctgcctga

SEQ ID NO: 247469 - DNA, 12 bp, Homo sapiens
atgcctgtaatc

SEQ ID NO: 247470 - DNA, 20 bp, Homo sapiens
atgcctgtcagtttcatgga

SEQ ID NO: 247471 - DNA, 16 bp, Homo sapiens
atgcctgtccagcctg

SEQ ID NO: 247472 - DNA, 17 bp, Homo sapiens
atgcctgtccagcctgg

SEQ ID NO: 247473 - DNA, 19 bp, Homo sapiens
atgcctgtggtgaagtgtg

SEQ ID NO: 247474 - DNA, 22 bp, Homo sapiens
atgcctgtggtgaagtgtggct

SEQ ID NO: 247475 - DNA, 14 bp, Homo sapiens
atgccttcttattg

SEQ ID NO: 247476 - DNA, 20 bp, Homo sapiens
atgccttcttattgctttta

SEQ ID NO: 247477 - DNA, 20 bp, Homo sapiens
atgcctttaaatctgtgatg

SEQ ID NO: 247478 - DNA, 21 bp, Homo sapiens
atgcctttaaatctgtgatga

SEQ ID NO: 247479 - DNA, 14 bp, Homo sapiens
atgcctttgctgtt

SEQ ID NO: 247480 - DNA, 15 bp, Homo sapiens
atgcctttgtaagtt

SEQ ID NO: 247481 - DNA, 16 bp, Homo sapiens
atgcctttgtaagtta

SEQ ID NO: 247482 - DNA, 17 bp, Homo sapiens
atgcgcaaaactgcctg

SEQ ID NO: 247483 - DNA, 19 bp, Homo sapiens
atgcgctcttcaccaggaa

SEQ ID NO: 247484 - DNA, 20 bp, Homo sapiens
atgcgctcttcaccaggaag

SEQ ID NO: 247485 - DNA, 21 bp, Homo sapiens
atgcgctcttcaccaggaaga

SEQ ID NO: 247486 - DNA, 15 bp, Homo sapiens
atgcggccggcctgg

SEQ ID NO: 247487 - DNA, 16 bp, Homo sapiens
atgcggccggcctggg

SEQ ID NO: 247488 - DNA, 17 bp, Homo sapiens
atgcgggcattttgaat

SEQ ID NO: 247489 - DNA, 19 bp, Homo sapiens
atgcgggctgggcagctgt

SEQ ID NO: 247490 - DNA, 15 bp, Homo sapiens
atgcgtccactttcc

SEQ ID NO: 247491 - DNA, 19 bp, Homo sapiens
atgctaacaaactgaaaaa

SEQ ID NO: 247492 - DNA, 20 bp, Homo sapiens
atgctaagggcaggcccaaa

SEQ ID NO: 247493 - DNA, 14 bp, Homo sapiens
atgctaataaactg

SEQ ID NO: 247494 - DNA, 18 bp, Homo sapiens
atgctacaaaatgtgtgc

SEQ ID NO: 247495 - DNA, 20 bp, Homo sapiens
atgctacctctgatcaaagc

SEQ ID NO: 247496 - DNA, 16 bp, Homo sapiens
atgctactcagtatat

SEQ ID NO: 247497 - DNA, 21 bp, Homo sapiens
atgctactgtcagtgtcctca

SEQ ID NO: 247498 - DNA, 16 bp, Homo sapiens
atgctaggcctgtagt

SEQ ID NO: 247499 - DNA, 18 bp, Homo sapiens
atgctatctcgctagcca

SEQ ID NO: 247500 - DNA, 19 bp, Homo sapiens
atgctatctcgctagccat

SEQ ID NO: 247501 - DNA, 19 bp, Homo sapiens
atgctcaaagatgtaatgt

SEQ ID NO: 247502 - DNA, 17 bp, Homo sapiens
atgctcaacccccctcc

SEQ ID NO: 247503 - DNA, 22 bp, Homo sapiens
atgctcaacccccctcccagac

SEQ ID NO: 247504 - DNA, 15 bp, Homo sapiens
atgctcaatgtgctg

SEQ ID NO: 247505 - DNA, 18 bp, Homo sapiens
atgctcacctctagcctt

SEQ ID NO: 247506 - DNA, 20 bp, Homo sapiens
atgctccagccaacccctgt

SEQ ID NO: 247507 - DNA, 22 bp, Homo sapiens
atgctcccccatcctccccttc

SEQ ID NO: 247508 - DNA, 19 bp, Homo sapiens
atgctccctcccctgccct

SEQ ID NO: 247509 - DNA, 15 bp, Homo sapiens
atgctccttgttcct

SEQ ID NO: 247510 - DNA, 12 bp, Homo sapiens
atgctctaacaa

SEQ ID NO: 247511 - DNA, 16 bp, Homo sapiens
atgctctacttctttt

SEQ ID NO: 247512 - DNA, 20 bp, Homo sapiens
atgctctctatagaggagga

SEQ ID NO: 247513 - DNA, 13 bp, Homo sapiens
atgctctgcccca

SEQ ID NO: 247514 - DNA, 13 bp, Homo sapiens
atgctctgtgcca

SEQ ID NO: 247515 - DNA, 18 bp, Homo sapiens
atgctgaaataaactagg

SEQ ID NO: 247516 - DNA, 18 bp, Homo sapiens
atgctgaatatctgttca

SEQ ID NO: 247517 - DNA, 16 bp, Homo sapiens
atgctgaattgaacat

SEQ ID NO: 247518 - DNA, 19 bp, Homo sapiens
atgctgactgtactcctcc

SEQ ID NO: 247519 - DNA, 19 bp, Homo sapiens
atgctgcctaggctgacct

SEQ ID NO: 247520 - DNA, 11 bp, Homo sapiens
atgctgcctgc

SEQ ID NO: 247521 - DNA, 12 bp, Homo sapiens
atgctgcctgcc

SEQ ID NO: 247522 - DNA, 13 bp, Homo sapiens
atgctgcctgcct

SEQ ID NO: 247523 - DNA, 21 bp, Homo sapiens
atgctgcctgcctccggccct

SEQ ID NO: 247524 - DNA, 14 bp, Homo sapiens
atgctgcctgcctg

SEQ ID NO: 247525 - DNA, 19 bp, Homo sapiens
atgctgcgcccttccccag

SEQ ID NO: 247526 - DNA, 13 bp, Homo sapiens
atgctgctactta

SEQ ID NO: 247527 - DNA, 12 bp, Homo sapiens
atgctgctgtga

SEQ ID NO: 247528 - DNA, 19 bp, Homo sapiens
atgctgctgtgaatttttt

SEQ ID NO: 247529 - DNA, 19 bp, Homo sapiens
atgctgctttttggcacag

SEQ ID NO: 247530 - DNA, 20 bp, Homo sapiens
atgctgctttttggcacagt

SEQ ID NO: 247531 - DNA, 12 bp, Homo sapiens
atgctggagagg

SEQ ID NO: 247532 - DNA, 11 bp, Homo sapiens
atgctggagcg

SEQ ID NO: 247533 - DNA, 23 bp, Homo sapiens
atgctggccagcctggggcctgg

SEQ ID NO: 247534 - DNA, 12 bp, Homo sapiens
atgctggcccca

SEQ ID NO: 247535 - DNA, 17 bp, Homo sapiens
atgctggggtacacagt

SEQ ID NO: 247536 - DNA, 22 bp, Homo sapiens
atgctgtaactttctgaaataa

SEQ ID NO: 247537 - DNA, 14 bp, Homo sapiens
atgctgtatatgtt

SEQ ID NO: 247538 - DNA, 11 bp, Homo sapiens
atgctgtgaca

SEQ ID NO: 247539 - DNA, 21 bp, Homo sapiens
atgctgtgacaataagtttga

SEQ ID NO: 247540 - DNA, 13 bp, Homo sapiens
atgcttaatttct

SEQ ID NO: 247541 - DNA, 14 bp, Homo sapiens
atgcttaatttcta

SEQ ID NO: 247542 - DNA, 15 bp, Homo sapiens
atgcttaatttctaa

SEQ ID NO: 247543 - DNA, 13 bp, Homo sapiens
atgcttactattt

SEQ ID NO: 247544 - DNA, 15 bp, Homo sapiens
atgcttactcttgct

SEQ ID NO: 247545 - DNA, 15 bp, Homo sapiens
atgcttagagcatgt

SEQ ID NO: 247546 - DNA, 19 bp, Homo sapiens
atgcttatcatctaaagat

SEQ ID NO: 247547 - DNA, 16 bp, Homo sapiens
atgcttcaagtgttgc

SEQ ID NO: 247548 - DNA, 14 bp, Homo sapiens
atgcttcagttgta

SEQ ID NO: 247549 - DNA, 15 bp, Homo sapiens
atgcttcatgaaaat

SEQ ID NO: 247550 - DNA, 22 bp, Homo sapiens
atgcttcatgaaaatcctacca

SEQ ID NO: 247551 - DNA, 15 bp, Homo sapiens
atgcttcctgacaat

SEQ ID NO: 247552 - DNA, 20 bp, Homo sapiens
atgcttcctgacaatcaact

SEQ ID NO: 247553 - DNA, 10 bp, Homo sapiens
agatcccaaa

SEQ ID NO: 247554 - DNA, 20 bp, Homo sapiens
agatcccaagtcaaacagtg

SEQ ID NO: 247555 - DNA, 22 bp, Homo sapiens
agatcccagaaggacctcctga

SEQ ID NO: 247556 - DNA, 21 bp, Homo sapiens
agatcccatccatcagctccc

SEQ ID NO: 247557 - DNA, 13 bp, Homo sapiens
agatccccgccac

SEQ ID NO: 247558 - DNA, 19 bp, Homo sapiens
agatccctcggtcagcacc

SEQ ID NO: 247559 - DNA, 20 bp, Homo sapiens
agatccctcggtcagcaccg

SEQ ID NO: 247560 - DNA, 15 bp, Homo sapiens
agatccgcatgtgtc

SEQ ID NO: 247561 - DNA, 23 bp, Homo sapiens
agatccgcatgtgtctgtattca

SEQ ID NO: 247562 - DNA, 15 bp, Homo sapiens
agatcctacccctga

SEQ ID NO: 247563 - DNA, 13 bp, Homo sapiens
agatcctgcaccc

SEQ ID NO: 247564 - DNA, 12 bp, Homo sapiens
agatcctgctgc

SEQ ID NO: 247565 - DNA, 13 bp, Homo sapiens
agatcctgctgcc

SEQ ID NO: 247566 - DNA, 12 bp, Homo sapiens
agatccttcaca

SEQ ID NO: 247567 - DNA, 16 bp, Homo sapiens
agatccttcacaggca

SEQ ID NO: 247568 - DNA, 23 bp, Homo sapiens
agatccttcacaggcagtgcatg

SEQ ID NO: 247569 - DNA, 17 bp, Homo sapiens
agatcctttcaaaagaa

SEQ ID NO: 247570 - DNA, 19 bp, Homo sapiens
agatcgcttgagcccagga

SEQ ID NO: 247571 - DNA, 15 bp, Homo sapiens
agatcggggccagag

SEQ ID NO: 247572 - DNA, 17 bp, Homo sapiens
agatcggggccagaggc

SEQ ID NO: 247573 - DNA, 16 bp, Homo sapiens
agatcgttagtatcta

SEQ ID NO: 247574 - DNA, 16 bp, Homo sapiens
agatcgttctgccact

SEQ ID NO: 247575 - DNA, 14 bp, Homo sapiens
agatctataaagcg

SEQ ID NO: 247576 - DNA, 13 bp, Homo sapiens
agatctcctgtaa

SEQ ID NO: 247577 - DNA, 12 bp, Homo sapiens
agatctgagccc

SEQ ID NO: 247578 - DNA, 13 bp, Homo sapiens
agatctgagccct

SEQ ID NO: 247579 - DNA, 20 bp, Homo sapiens
agatctgatggtgagctggg

SEQ ID NO: 247580 - DNA, 12 bp, Homo sapiens
agatctgcctgg

SEQ ID NO: 247581 - DNA, 13 bp, Homo sapiens
agatctgcctggg

SEQ ID NO: 247582 - DNA, 17 bp, Homo sapiens
agatctgcctgggcctg

SEQ ID NO: 247583 - DNA, 24 bp, Homo sapiens
agatctgcctgggcctgtgcagca

SEQ ID NO: 247584 - DNA, 12 bp, Homo sapiens
agatctgtgccc

SEQ ID NO: 247585 - DNA, 13 bp, Homo sapiens
agatctgtgcccc

SEQ ID NO: 247586 - DNA, 19 bp, Homo sapiens
agatctgtgccccatgcct

SEQ ID NO: 247587 - DNA, 14 bp, Homo sapiens
agatcttaaatttt

SEQ ID NO: 247588 - DNA, 17 bp, Homo sapiens
agatcttctgaaatgaa

SEQ ID NO: 247589 - DNA, 17 bp, Homo sapiens
agatcttgagagctgct

SEQ ID NO: 247590 - DNA, 16 bp, Homo sapiens
agattcctacttaaac

SEQ ID NO: 247591 - DNA, 18 bp, Homo sapiens
agattcctacttaaacaa

SEQ ID NO: 247592 - DNA, 20 bp, Homo sapiens
agattcctacttaaacaaaa

SEQ ID NO: 247593 - DNA, 17 bp, Homo sapiens
agattcctgggcctgtc

SEQ ID NO: 247594 - DNA, 16 bp, Homo sapiens
agattctccaaatgat

SEQ ID NO: 247595 - DNA, 15 bp, Homo sapiens
agattctgggaaagg

SEQ ID NO: 247596 - DNA, 19 bp, Homo sapiens
agattctgggaaaggtgct

SEQ ID NO: 247597 - DNA, 18 bp, Homo sapiens
agattctttaaactactg

SEQ ID NO: 247598 - DNA, 22 bp, Homo sapiens
agattctttaaactactgaact

SEQ ID NO: 247599 - DNA, 19 bp, Homo sapiens
agattgctgaattaaggat

SEQ ID NO: 247600 - DNA, 15 bp, Homo sapiens
agattgctgcttctg

SEQ ID NO: 247601 - DNA, 17 bp, Homo sapiens
agattgcttctgtagta

SEQ ID NO: 247602 - DNA, 23 bp, Homo sapiens
agattggacataactgacttagt

SEQ ID NO: 247603 - DNA, 23 bp, Homo sapiens
agattggcatggctttatttgtt

SEQ ID NO: 247604 - DNA, 18 bp, Homo sapiens
agattggctttgccttta

SEQ ID NO: 247605 - DNA, 18 bp, Homo sapiens
agattgggggccctgggg

SEQ ID NO: 247606 - DNA, 21 bp, Homo sapiens
agattgtccagtgcaaccaca

SEQ ID NO: 247607 - DNA, 18 bp, Homo sapiens
agattgtgaatatttcca

SEQ ID NO: 247608 - DNA, 12 bp, Homo sapiens
agattgtgtctg

SEQ ID NO: 247609 - DNA, 20 bp, Homo sapiens
agattgtgtctggtcgtttg

SEQ ID NO: 247610 - DNA, 22 bp, Homo sapiens
agattgttttatcatgacatgt

SEQ ID NO: 247611 - DNA, 20 bp, Homo sapiens
agatttaagcacaaacttta

SEQ ID NO: 247612 - DNA, 20 bp, Homo sapiens
agatttaccctttatagaac

SEQ ID NO: 247613 - DNA, 22 bp, Homo sapiens
agatttaccttttctgttgtac

SEQ ID NO: 247614 - DNA, 22 bp, Homo sapiens
agatttctagaaaagcttccta

SEQ ID NO: 247615 - DNA, 17 bp, Homo sapiens
agatttgaactcttcaa

SEQ ID NO: 247616 - DNA, 12 bp, Homo sapiens
agatttgtattt

SEQ ID NO: 247617 - DNA, 15 bp, Homo sapiens
agattttaatcaaat

SEQ ID NO: 247618 - DNA, 16 bp, Homo sapiens
agattttaatcaaatt

SEQ ID NO: 247619 - DNA, 17 bp, Homo sapiens
agattttaattttgaat

SEQ ID NO: 247620 - DNA, 19 bp, Homo sapiens
agattttacaaaagatgta

SEQ ID NO: 247621 - DNA, 15 bp, Homo sapiens
agattttaggtgttg

SEQ ID NO: 247622 - DNA, 12 bp, Homo sapiens
agattttcagaa

SEQ ID NO: 247623 - DNA, 20 bp, Homo sapiens
agattttctattatggaaat

SEQ ID NO: 247624 - DNA, 13 bp, Homo sapiens
agatttttagatt

SEQ ID NO: 247625 - DNA, 21 bp, Homo sapiens
agcaaaaactagtaaagacat

SEQ ID NO: 247626 - DNA, 16 bp, Homo sapiens
agcaaaaatgccaggc

SEQ ID NO: 247627 - DNA, 20 bp, Homo sapiens
agcaaaaccattgcttcact

SEQ ID NO: 247628 - DNA, 12 bp, Homo sapiens
agcaaaactgca

SEQ ID NO: 247629 - DNA, 13 bp, Homo sapiens
agcaaaaggatga

SEQ ID NO: 247630 - DNA, 14 bp, Homo sapiens
agcaaaaggcagct

SEQ ID NO: 247631 - DNA, 22 bp, Homo sapiens
agcaaaaggcagctcacccctg

SEQ ID NO: 247632 - DNA, 24 bp, Homo sapiens
agcaaaatatgccccttcttgggc

SEQ ID NO: 247633 - DNA, 14 bp, Homo sapiens
agcaaacctgcccc

SEQ ID NO: 247634 - DNA, 19 bp, Homo sapiens
agcaaactgaagcccacag

SEQ ID NO: 247635 - DNA, 13 bp, Homo sapiens
agcaaagatcaaa

SEQ ID NO: 247636 - DNA, 14 bp, Homo sapiens
agcaaagcttggtg

SEQ ID NO: 247637 - DNA, 22 bp, Homo sapiens
agcaaagcttggtgtcttggca

SEQ ID NO: 247638 - DNA, 18 bp, Homo sapiens
agcaaaggagacaaagca

SEQ ID NO: 247639 - DNA, 21 bp, Homo sapiens
agcaaaggagacaaagcagga

SEQ ID NO: 247640 - DNA, 23 bp, Homo sapiens
agcaaaggagacaaagcaggagt

SEQ ID NO: 247641 - DNA, 20 bp, Homo sapiens
agcaaagtctaaagtttaca

SEQ ID NO: 247642 - DNA, 22 bp, Homo sapiens
agcaaagtctaaagtttacagt

SEQ ID NO: 247643 - DNA, 15 bp, Homo sapiens
agcaaagttttcaga

SEQ ID NO: 247644 - DNA, 16 bp, Homo sapiens
agcaaatcagacacaa

SEQ ID NO: 247645 - DNA, 22 bp, Homo sapiens
agcaaatcagacacaattagag

SEQ ID NO: 247646 - DNA, 21 bp, Homo sapiens
agcaaatgagatgtatgccca

SEQ ID NO: 247647 - DNA, 21 bp, Homo sapiens
agcaaatttctagatatgaga

SEQ ID NO: 247648 - DNA, 19 bp, Homo sapiens
agcaacaaaggatttgaaa

SEQ ID NO: 247649 - DNA, 14 bp, Homo sapiens
agcaacaacttact

SEQ ID NO: 247650 - DNA, 12 bp, Homo sapiens
agcaacatgaat

SEQ ID NO: 247651 - DNA, 22 bp, Homo sapiens
agcaacccctgtacccagctcc

SEQ ID NO: 247652 - DNA, 16 bp, Homo sapiens
agcaaccctacagtat

SEQ ID NO: 247653 - DNA, 22 bp, Homo sapiens
agcaacctatttgactgcttca

SEQ ID NO: 247654 - DNA, 13 bp, Homo sapiens
agcaacctcccaa

SEQ ID NO: 247655 - DNA, 16 bp, Homo sapiens
agcaaccttaaagcaa

SEQ ID NO: 247656 - DNA, 19 bp, Homo sapiens
agcaaccttaaagcaataa

SEQ ID NO: 247657 - DNA, 15 bp, Homo sapiens
agcaactgtgcagca

SEQ ID NO: 247658 - DNA, 17 bp, Homo sapiens
agcaactgtgcagcacc

SEQ ID NO: 247659 - DNA, 20 bp, Homo sapiens
agcaactgttagctgggaag

SEQ ID NO: 247660 - DNA, 15 bp, Homo sapiens
agcaacttgtctttt

SEQ ID NO: 247661 - DNA, 19 bp, Homo sapiens
agcaactttccaacttttc

SEQ ID NO: 247662 - DNA, 18 bp, Homo sapiens
agcaactttgatggaaga

SEQ ID NO: 247663 - DNA, 15 bp, Homo sapiens
agcaagaagattcta

SEQ ID NO: 247664 - DNA, 21 bp, Homo sapiens
agcaagaataaaaaagaaatc

SEQ ID NO: 247665 - DNA, 16 bp, Homo sapiens
agcaagacgtcctgga

SEQ ID NO: 247666 - DNA, 14 bp, Homo sapiens
agcaaggacattgc

SEQ ID NO: 247667 - DNA, 16 bp, Homo sapiens
agcaaggacattgccc

SEQ ID NO: 247668 - DNA, 23 bp, Homo sapiens
agcaaggacattgccccaagata

SEQ ID NO: 247669 - DNA, 22 bp, Homo sapiens
agcaaggcaagaagtgggattc

SEQ ID NO: 247670 - DNA, 17 bp, Homo sapiens
agcaaggcacaggctcc

SEQ ID NO: 247671 - DNA, 11 bp, Homo sapiens
agcaaggcctt

SEQ ID NO: 247672 - DNA, 13 bp, Homo sapiens
agcaaggctgggt

SEQ ID NO: 247673 - DNA, 18 bp, Homo sapiens
agcaagggctccagcatc

SEQ ID NO: 247674 - DNA, 16 bp, Homo sapiens
agcaaggggctctgcc

SEQ ID NO: 247675 - DNA, 14 bp, Homo sapiens
agcaagtatattta

SEQ ID NO: 247676 - DNA, 20 bp, Homo sapiens
agcaagtcccagacaaggag

SEQ ID NO: 247677 - DNA, 16 bp, Homo sapiens
agcaagtgctgagtct

SEQ ID NO: 247678 - DNA, 19 bp, Homo sapiens
agcaagtgtgcactccagc

SEQ ID NO: 247679 - DNA, 15 bp, Homo sapiens
agcaataaatgaatg

SEQ ID NO: 247680 - DNA, 16 bp, Homo sapiens
agcaatatattaccag

SEQ ID NO: 247681 - DNA, 23 bp, Homo sapiens
agcaatatattaccagcaagaat

SEQ ID NO: 247682 - DNA, 12 bp, Homo sapiens
agcaatatttat

SEQ ID NO: 247683 - DNA, 13 bp, Homo sapiens
agcaatatttata

SEQ ID NO: 247684 - DNA, 17 bp, Homo sapiens
agcaatcctcctgagtg

SEQ ID NO: 247685 - DNA, 13 bp, Homo sapiens
agcaatcttgctg

SEQ ID NO: 247686 - DNA, 14 bp, Homo sapiens
agcaatcttgctgt

SEQ ID NO: 247687 - DNA, 20 bp, Homo sapiens
agcaatgggactggagtcag

SEQ ID NO: 247688 - DNA, 21 bp, Homo sapiens
agcaatgggactggagtcaga

SEQ ID NO: 247689 - DNA, 17 bp, Homo sapiens
agcaattatttaaagaa

SEQ ID NO: 247690 - DNA, 22 bp, Homo sapiens
agcaattctcctgcctcagcct

SEQ ID NO: 247691 - DNA, 14 bp, Homo sapiens
agcaattgccctgt

SEQ ID NO: 247692 - DNA, 15 bp, Homo sapiens
agcaattgccctgta

SEQ ID NO: 247693 - DNA, 18 bp, Homo sapiens
agcaattgctgcatctta

SEQ ID NO: 247694 - DNA, 20 bp, Homo sapiens
agcaattgctgcatcttagt

SEQ ID NO: 247695 - DNA, 20 bp, Homo sapiens
atggcgtaatgggcctgccc

SEQ ID NO: 247696 - DNA, 19 bp, Homo sapiens
atggcgtgtcccctgcctg

SEQ ID NO: 247697 - DNA, 17 bp, Homo sapiens
atggctaaggcaccagc

SEQ ID NO: 247698 - DNA, 23 bp, Homo sapiens
atggctagtactgtattggctct

SEQ ID NO: 247699 - DNA, 13 bp, Homo sapiens
atggctataaata

SEQ ID NO: 247700 - DNA, 21 bp, Homo sapiens
atggctataaatatataaaaa

SEQ ID NO: 247701 - DNA, 12 bp, Homo sapiens
atggctcaggca

SEQ ID NO: 247702 - DNA, 16 bp, Homo sapiens
atggctcaggcaagcc

SEQ ID NO: 247703 - DNA, 23 bp, Homo sapiens
atggctccagtctgctgccctcc

SEQ ID NO: 247704 - DNA, 14 bp, Homo sapiens
atggctcctgtctg

SEQ ID NO: 247705 - DNA, 18 bp, Homo sapiens
atggctcctgtctggctc

SEQ ID NO: 247706 - DNA, 19 bp, Homo sapiens
atggctgggagggggccct

SEQ ID NO: 247707 - DNA, 16 bp, Homo sapiens
atggctgtatttttag

SEQ ID NO: 247708 - DNA, 15 bp, Homo sapiens
atggctgtgcctctg

SEQ ID NO: 247709 - DNA, 19 bp, Homo sapiens
atggctgttatctgtcttt

SEQ ID NO: 247710 - DNA, 20 bp, Homo sapiens
atggctgttatctgtcttta

SEQ ID NO: 247711 - DNA, 16 bp, Homo sapiens
atggcttaaaaatact

SEQ ID NO: 247712 - DNA, 14 bp, Homo sapiens
atggcttattgtgt

SEQ ID NO: 247713 - DNA, 13 bp, Homo sapiens
atggcttcctgag

SEQ ID NO: 247714 - DNA, 17 bp, Homo sapiens
atggcttctatgatcag

SEQ ID NO: 247715 - DNA, 13 bp, Homo sapiens
atggcttgacatg

SEQ ID NO: 247716 - DNA, 19 bp, Homo sapiens
atggcttgtagggtgaggc

SEQ ID NO: 247717 - DNA, 20 bp, Homo sapiens
atggctttatttgttttttt

SEQ ID NO: 247718 - DNA, 16 bp, Homo sapiens
atgggaacaagtgtac

SEQ ID NO: 247719 - DNA, 17 bp, Homo sapiens
atgggaacaagtgtaca

SEQ ID NO: 247720 - DNA, 14 bp, Homo sapiens
agggagttcatctg

SEQ ID NO: 247721 - DNA, 18 bp, Homo sapiens
agggatcagccctgccct

SEQ ID NO: 247722 - DNA, 16 bp, Homo sapiens
agggatctggggaagg

SEQ ID NO: 247723 - DNA, 18 bp, Homo sapiens
agggatgcaggtgggccg

SEQ ID NO: 247724 - DNA, 15 bp, Homo sapiens
agggatggaaaagga

SEQ ID NO: 247725 - DNA, 17 bp, Homo sapiens
agggatgggatttcatg

SEQ ID NO: 247726 - DNA, 15 bp, Homo sapiens
agggatggggagcag

SEQ ID NO: 247727 - DNA, 17 bp, Homo sapiens
agggattaacctctgca

SEQ ID NO: 247728 - DNA, 19 bp, Homo sapiens
agggattaacctctgcact

SEQ ID NO: 247729 - DNA, 15 bp, Homo sapiens
agggattcaggctgc

SEQ ID NO: 247730 - DNA, 13 bp, Homo sapiens
agggattctggga

SEQ ID NO: 247731 - DNA, 23 bp, Homo sapiens
agggattctgggcttggggtgtg

SEQ ID NO: 247732 - DNA, 19 bp, Homo sapiens
agggcacctcttgtgctga

SEQ ID NO: 247733 - DNA, 19 bp, Homo sapiens
agggcactctctgccagct

SEQ ID NO: 247734 - DNA, 20 bp, Homo sapiens
agggcactctctgccagctc

SEQ ID NO: 247735 - DNA, 14 bp, Homo sapiens
agggcactggtggc

SEQ ID NO: 247736 - DNA, 20 bp, Homo sapiens
agggcagagccatgggcctg

SEQ ID NO: 247737 - DNA, 13 bp, Homo sapiens
agggcagcccctc

SEQ ID NO: 247738 - DNA, 17 bp, Homo sapiens
agggcagcccctcccca

SEQ ID NO: 247739 - DNA, 18 bp, Homo sapiens
agggcagcctgtgggaga

SEQ ID NO: 247740 - DNA, 16 bp, Homo sapiens
agggcaggaaggagag

SEQ ID NO: 247741 - DNA, 15 bp, Homo sapiens
agggcaggcagagct

SEQ ID NO: 247742 - DNA, 16 bp, Homo sapiens
agggcaggcagagctc

SEQ ID NO: 247743 - DNA, 17 bp, Homo sapiens
agggcaggcagagctca

SEQ ID NO: 247744 - DNA, 20 bp, Homo sapiens
agggcaggcccaaattatca

SEQ ID NO: 247745 - DNA, 15 bp, Homo sapiens
agggcagggctctga

SEQ ID NO: 247746 - DNA, 16 bp, Homo sapiens
agggcagggctctgat

SEQ ID NO: 247747 - DNA, 22 bp, Homo sapiens
agggcaggggctgcatcctcag

SEQ ID NO: 247748 - DNA, 18 bp, Homo sapiens
agggcagggtgggcagcc

SEQ ID NO: 247749 - DNA, 23 bp, Homo sapiens
agggcagggtgggcagcctatgg

SEQ ID NO: 247750 - DNA, 18 bp, Homo sapiens
agggcagggttctagaag

SEQ ID NO: 247751 - DNA, 17 bp, Homo sapiens
agggcagtacctgggaa

SEQ ID NO: 247752 - DNA, 23 bp, Homo sapiens
agggcagtggcacgatctcagct

SEQ ID NO: 247753 - DNA, 22 bp, Homo sapiens
agggcagtgtggtgggaggggt

SEQ ID NO: 247754 - DNA, 23 bp, Homo sapiens
agggcatcagctttccctggctc

SEQ ID NO: 247755 - DNA, 22 bp, Homo sapiens
agggcatgtgatattttcacat

SEQ ID NO: 247756 - DNA, 17 bp, Homo sapiens
agggccagaaggagggc

SEQ ID NO: 247757 - DNA, 22 bp, Homo sapiens
agggccagaaggagggcagagc

SEQ ID NO: 247758 - DNA, 16 bp, Homo sapiens
agggccagagcctggt

SEQ ID NO: 247759 - DNA, 13 bp, Homo sapiens
agggccagggttg

SEQ ID NO: 247760 - DNA, 19 bp, Homo sapiens
agggccagtcctgcctggc

SEQ ID NO: 247761 - DNA, 23 bp, Homo sapiens
agggccatacttttgagaggggt

SEQ ID NO: 247762 - DNA, 23 bp, Homo sapiens
agggcccacttgtatcctctggt

SEQ ID NO: 247763 - DNA, 13 bp, Homo sapiens
agggcccagaggg

SEQ ID NO: 247764 - DNA, 17 bp, Homo sapiens
agggcccagctgtagcc

SEQ ID NO: 247765 - DNA, 23 bp, Homo sapiens
agggcccagctgtagccatggct

SEQ ID NO: 247766 - DNA, 12 bp, Homo sapiens
agggcccaggag

SEQ ID NO: 247767 - DNA, 17 bp, Homo sapiens
agggcccaggcctggag

SEQ ID NO: 247768 - DNA, 13 bp, Homo sapiens
agggcccatctgc

SEQ ID NO: 247769 - DNA, 21 bp, Homo sapiens
agggccccccaaatcccaggg

SEQ ID NO: 247770 - DNA, 18 bp, Homo sapiens
agggcccctctgcccagc

SEQ ID NO: 247771 - DNA, 12 bp, Homo sapiens
agggcccctgcg

SEQ ID NO: 247772 - DNA, 19 bp, Homo sapiens
agggcccctgcgtgggggc

SEQ ID NO: 247773 - DNA, 16 bp, Homo sapiens
agggcctactgccacc

SEQ ID NO: 247774 - DNA, 17 bp, Homo sapiens
agggcctcacctttccc

SEQ ID NO: 247775 - DNA, 13 bp, Homo sapiens
agggcctcagaga

SEQ ID NO: 247776 - DNA, 15 bp, Homo sapiens
agggcctcagagaca

SEQ ID NO: 247777 - DNA, 15 bp, Homo sapiens
agggcctccagccct

SEQ ID NO: 247778 - DNA, 20 bp, Homo sapiens
agggcctctggtgttcctgg

SEQ ID NO: 247779 - DNA, 11 bp, Homo sapiens
agggcctggcc

SEQ ID NO: 247780 - DNA, 12 bp, Homo sapiens
agggcctggcct

SEQ ID NO: 247781 - DNA, 13 bp, Homo sapiens
agggcctggcctg

SEQ ID NO: 247782 - DNA, 20 bp, Homo sapiens
agggcgaggcgggggagcct

SEQ ID NO: 247783 - DNA, 21 bp, Homo sapiens
agggcgaggcgggggagcctg

SEQ ID NO: 247784 - DNA, 21 bp, Homo sapiens
agggcgcccattcgtctgtcc

SEQ ID NO: 247785 - DNA, 20 bp, Homo sapiens
agggcgctccggcagaggca

SEQ ID NO: 247786 - DNA, 23 bp, Homo sapiens
agggcgctccggcagaggcaggg

SEQ ID NO: 247787 - DNA, 15 bp, Homo sapiens
agggcgctgagggca

SEQ ID NO: 247788 - DNA, 18 bp, Homo sapiens
agggcgctgagggcaggg

SEQ ID NO: 247789 - DNA, 17 bp, Homo sapiens
agggcggccagggacag

SEQ ID NO: 247790 - DNA, 20 bp, Homo sapiens
agggcggcccctctgttctg

SEQ ID NO: 247791 - DNA, 23 bp, Homo sapiens
agggcggctaggccggccagctc

SEQ ID NO: 247792 - DNA, 14 bp, Homo sapiens
agggcgggccagga

SEQ ID NO: 247793 - DNA, 19 bp, Homo sapiens
agggctaccctcccccagg

SEQ ID NO: 247794 - DNA, 16 bp, Homo sapiens
agggctagcatccctg

SEQ ID NO: 247795 - DNA, 22 bp, Homo sapiens
agggctagtgacttgtgtccca

SEQ ID NO: 247796 - DNA, 14 bp, Homo sapiens
agggctatggcaag

SEQ ID NO: 247797 - DNA, 20 bp, Homo sapiens
agggctccacgggggcctag

SEQ ID NO: 247798 - DNA, 13 bp, Homo sapiens
agggctccagcat

SEQ ID NO: 247799 - DNA, 17 bp, Homo sapiens
agggctccagggccagg

SEQ ID NO: 247800 - DNA, 19 bp, Homo sapiens
agggctcccggagagggag

SEQ ID NO: 247801 - DNA, 18 bp, Homo sapiens
agggctccctcctggagc

SEQ ID NO: 247802 - DNA, 20 bp, Homo sapiens
agggctccctcctggagcat

SEQ ID NO: 247803 - DNA, 22 bp, Homo sapiens
agggctccctcctggagcatcc

SEQ ID NO: 247804 - DNA, 19 bp, Homo sapiens
aaagctggacaagaagctg

SEQ ID NO: 247805 - DNA, 16 bp, Homo sapiens
aaagctgtgtctctgt

SEQ ID NO: 247806 - DNA, 19 bp, Homo sapiens
aaagctgtgtctttaggga

SEQ ID NO: 247807 - DNA, 19 bp, Homo sapiens
aaagcttaaattgcttttg

SEQ ID NO: 247808 - DNA, 14 bp, Homo sapiens
aaagctttcctgcc

SEQ ID NO: 247809 - DNA, 15 bp, Homo sapiens
aaagctttcctggag

SEQ ID NO: 247810 - DNA, 20 bp, Homo sapiens
actctagcctgggccagaga

SEQ ID NO: 247811 - DNA, 16 bp, Homo sapiens
actctagtgacttcct

SEQ ID NO: 247812 - DNA, 18 bp, Homo sapiens
actctatagactctagga

SEQ ID NO: 247813 - DNA, 22 bp, Homo sapiens
actctattttttactacataat

SEQ ID NO: 247814 - DNA, 16 bp, Homo sapiens
actctcaaaagtctat

SEQ ID NO: 247815 - DNA, 14 bp, Homo sapiens
actctcacatgtgg

SEQ ID NO: 247816 - DNA, 16 bp, Homo sapiens
actctcacatgtggca

SEQ ID NO: 247817 - DNA, 19 bp, Homo sapiens
actctcagagactcccagg

SEQ ID NO: 247818 - DNA, 22 bp, Homo sapiens
actctcagtgcttcttactatt

SEQ ID NO: 247819 - DNA, 20 bp, Homo sapiens
actctccaggattgtccaca

SEQ ID NO: 247820 - DNA, 23 bp, Homo sapiens
actctcccagaggctcctggagc

SEQ ID NO: 247821 - DNA, 15 bp, Homo sapiens
actctccccacacta

SEQ ID NO: 247822 - DNA, 11 bp, Homo sapiens
actctccccag

SEQ ID NO: 247823 - DNA, 18 bp, Homo sapiens
actctccccagtgcctgc

SEQ ID NO: 247824 - DNA, 15 bp, Homo sapiens
actctcctcatctct

SEQ ID NO: 247825 - DNA, 19 bp, Homo sapiens
actctcctcggccccctcc

SEQ ID NO: 247826 - DNA, 22 bp, Homo sapiens
actctcctcggccccctccatc

SEQ ID NO: 247827 - DNA, 19 bp, Homo sapiens
actctcctctttttttaaa

SEQ ID NO: 247828 - DNA, 18 bp, Homo sapiens
actctcctgctcctcagg

SEQ ID NO: 247829 - DNA, 14 bp, Homo sapiens
actctcctgggccc

SEQ ID NO: 247830 - DNA, 15 bp, Homo sapiens
actctcctgggcccc

SEQ ID NO: 247831 - DNA, 18 bp, Homo sapiens
actctccttcgtgtctct

SEQ ID NO: 247832 - DNA, 22 bp, Homo sapiens
actctccttcgtgtctctccca

SEQ ID NO: 247833 - DNA, 14 bp, Homo sapiens
actctcggggccct

SEQ ID NO: 247834 - DNA, 17 bp, Homo sapiens
actctcggggcccttgg

SEQ ID NO: 247835 - DNA, 20 bp, Homo sapiens
actctctagttccctcagtg

SEQ ID NO: 247836 - DNA, 12 bp, Homo sapiens
actctctgctct

SEQ ID NO: 247837 - DNA, 19 bp, Homo sapiens
actctctgctctagccagg

SEQ ID NO: 247838 - DNA, 18 bp, Homo sapiens
actctctgggactctcct

SEQ ID NO: 247839 - DNA, 21 bp, Homo sapiens
actctctgggactctcctcct

SEQ ID NO: 247840 - DNA, 16 bp, Homo sapiens
actctctgtcttctct

SEQ ID NO: 247841 - DNA, 15 bp, Homo sapiens
actctctttcttcca

SEQ ID NO: 247842 - DNA, 22 bp, Homo sapiens
actctgaaaagcaattgccctg

SEQ ID NO: 247843 - DNA, 21 bp, Homo sapiens
actctgaagtcccttcctgtc

SEQ ID NO: 247844 - DNA, 14 bp, Homo sapiens
actctgacataaac

SEQ ID NO: 247845 - DNA, 21 bp, Homo sapiens
actctgagtttaccatttgta

SEQ ID NO: 247846 - DNA, 15 bp, Homo sapiens
actctgcactactcc

SEQ ID NO: 247847 - DNA, 19 bp, Homo sapiens
actctgcactatagccatt

SEQ ID NO: 247848 - DNA, 13 bp, Homo sapiens
actctgcactcca

SEQ ID NO: 247849 - DNA, 18 bp, Homo sapiens
actctgcactccatggcc

SEQ ID NO: 247850 - DNA, 20 bp, Homo sapiens
actctgcactccatggccac

SEQ ID NO: 247851 - DNA, 16 bp, Homo sapiens
actctgcattctagta

SEQ ID NO: 247852 - DNA, 11 bp, Homo sapiens
actctgccagg

SEQ ID NO: 247853 - DNA, 14 bp, Homo sapiens
actctgccccaatc

SEQ ID NO: 247854 - DNA, 21 bp, Homo sapiens
actctgccccttctgtttcca

SEQ ID NO: 247855 - DNA, 16 bp, Homo sapiens
actctgcctcctcttc

SEQ ID NO: 247856 - DNA, 19 bp, Homo sapiens
actctgcctctaaggccaa

SEQ ID NO: 247857 - DNA, 16 bp, Homo sapiens
actctgccttccaggc

SEQ ID NO: 247858 - DNA, 19 bp, Homo sapiens
actctgcggatagcatttg

SEQ ID NO: 247859 - DNA, 17 bp, Homo sapiens
actctgctaatcatgtg

SEQ ID NO: 247860 - DNA, 9 bp, Homo sapiens
actctgctg

SEQ ID NO: 247861 - DNA, 12 bp, Homo sapiens
actctgctgctc

SEQ ID NO: 247862 - DNA, 16 bp, Homo sapiens
actctgcttggctgtc

SEQ ID NO: 247863 - DNA, 23 bp, Homo sapiens
actctgcttggctgtcccctcca

SEQ ID NO: 247864 - DNA, 14 bp, Homo sapiens
actctgctttgact

SEQ ID NO: 247865 - DNA, 23 bp, Homo sapiens
actctgctttgactgagcagact

SEQ ID NO: 247866 - DNA, 13 bp, Homo sapiens
actctgctttgca

SEQ ID NO: 247867 - DNA, 18 bp, Homo sapiens
actctggaccccaggcca

SEQ ID NO: 247868 - DNA, 19 bp, Homo sapiens
actctgggtttcatatcca

SEQ ID NO: 247869 - DNA, 15 bp, Homo sapiens
actctggttctttgt

SEQ ID NO: 247870 - DNA, 23 bp, Homo sapiens
actctgtccaggccactgtggcc

SEQ ID NO: 247871 - DNA, 13 bp, Homo sapiens
actctgtctcaaa

SEQ ID NO: 247872 - DNA, 21 bp, Homo sapiens
actctgtgtaatctctgatta

SEQ ID NO: 247873 - DNA, 12 bp, Homo sapiens
actctgttgcct

SEQ ID NO: 247874 - DNA, 14 bp, Homo sapiens
actctgttgcctcc

SEQ ID NO: 247875 - DNA, 18 bp, Homo sapiens
actctgttgcctcctctc

SEQ ID NO: 247876 - DNA, 13 bp, Homo sapiens
actcttaaagcaa

SEQ ID NO: 247877 - DNA, 20 bp, Homo sapiens
actcttaaagcaaaaaatga

SEQ ID NO: 247878 - DNA, 16 bp, Homo sapiens
actcttaaatatacaa

SEQ ID NO: 247879 - DNA, 17 bp, Homo sapiens
actcttaggaagagaaa

SEQ ID NO: 247880 - DNA, 19 bp, Homo sapiens
actcttaggaagagaaacc

SEQ ID NO: 247881 - DNA, 20 bp, Homo sapiens
actcttaggaagagaaacca

SEQ ID NO: 247882 - DNA, 15 bp, Homo sapiens
actcttatgaaatgg

SEQ ID NO: 247883 - DNA, 16 bp, Homo sapiens
actcttcaaggccaag

SEQ ID NO: 247884 - DNA, 12 bp, Homo sapiens
actcttcactgt

SEQ ID NO: 247885 - DNA, 13 bp, Homo sapiens
actcttcactgtt

SEQ ID NO: 247886 - DNA, 19 bp, Homo sapiens
actcttcagcctcattcac

SEQ ID NO: 247887 - DNA, 22 bp, Homo sapiens
actcttcagcctcattcactgt

SEQ ID NO: 247888 - DNA, 17 bp, Homo sapiens
actcttccctctcgctc

SEQ ID NO: 247889 - DNA, 15 bp, Homo sapiens
actcttcctcatcct

SEQ ID NO: 247890 - DNA, 20 bp, Homo sapiens
actcttcctcatcctgcttc

SEQ ID NO: 247891 - DNA, 13 bp, Homo sapiens
actcttgctcact

SEQ ID NO: 247892 - DNA, 17 bp, Homo sapiens
actcttgctcactccct

SEQ ID NO: 247893 - DNA, 18 bp, Homo sapiens
actcttgctcactcccta

SEQ ID NO: 247894 - DNA, 14 bp, Homo sapiens
actcttgctctttc

SEQ ID NO: 247895 - DNA, 17 bp, Homo sapiens
actcttggtcacctcaa

SEQ ID NO: 247896 - DNA, 20 bp, Homo sapiens
actcttggtcagcttttgtt

SEQ ID NO: 247897 - DNA, 20 bp, Homo sapiens
actcttgtattgctccattt

SEQ ID NO: 247898 - DNA, 11 bp, Homo sapiens
agtctgtcctt

SEQ ID NO: 247899 - DNA, 16 bp, Homo sapiens
agtctgtctactgtgg

SEQ ID NO: 247900 - DNA, 19 bp, Homo sapiens
agtctgtctactgtggtga

SEQ ID NO: 247901 - DNA, 15 bp, Homo sapiens
agtctgtctgcactg

SEQ ID NO: 247902 - DNA, 18 bp, Homo sapiens
agtctgtgaataaagcca

SEQ ID NO: 247903 - DNA, 14 bp, Homo sapiens
agtctgtgcctgga

SEQ ID NO: 247904 - DNA, 22 bp, Homo sapiens
agtctgtgcctggagctcctgg

SEQ ID NO: 247905 - DNA, 23 bp, Homo sapiens
agtctgtgcctggagctcctggg

SEQ ID NO: 247906 - DNA, 11 bp, Homo sapiens
agtctgtgtga

SEQ ID NO: 247907 - DNA, 12 bp, Homo sapiens
agtctgtgtgaa

SEQ ID NO: 247908 - DNA, 18 bp, Homo sapiens
agtctgtgtgatgaactt

SEQ ID NO: 247909 - DNA, 21 bp, Homo sapiens
agtctgtgtgatgaactttct

SEQ ID NO: 247910 - DNA, 22 bp, Homo sapiens
agtctgtgtgatgaactttctc

SEQ ID NO: 247911 - DNA, 21 bp, Homo sapiens
agtctgtgtgctgtggttcct

SEQ ID NO: 247912 - DNA, 21 bp, Homo sapiens
agtcttaacaacagcttcttg

SEQ ID NO: 247913 - DNA, 17 bp, Homo sapiens
agtcttaattttctaaa

SEQ ID NO: 247914 - DNA, 19 bp, Homo sapiens
agtcttcacttgcactggg

SEQ ID NO: 247915 - DNA, 14 bp, Homo sapiens
agtcttccatcagc

SEQ ID NO: 247916 - DNA, 17 bp, Homo sapiens
agtcttccatcagcagt

SEQ ID NO: 247917 - DNA, 19 bp, Homo sapiens
agtcttccatcagcagtga

SEQ ID NO: 247918 - DNA, 18 bp, Homo sapiens
agtcttccctagggctgg

SEQ ID NO: 247919 - DNA, 12 bp, Homo sapiens
agtcttctcata

SEQ ID NO: 247920 - DNA, 21 bp, Homo sapiens
agtcttctcatagcattaact

SEQ ID NO: 247921 - DNA, 13 bp, Homo sapiens
agtcttctccctg

SEQ ID NO: 247922 - DNA, 14 bp, Homo sapiens
agtcttgagtgggc

SEQ ID NO: 247923 - DNA, 15 bp, Homo sapiens
agtcttgagtgggcc

SEQ ID NO: 247924 - DNA, 17 bp, Homo sapiens
agtcttgagtgggcccc

SEQ ID NO: 247925 - DNA, 20 bp, Homo sapiens
agtcttgctgtggtctcttt

SEQ ID NO: 247926 - DNA, 22 bp, Homo sapiens
agtcttgtgactagtgctgaag

SEQ ID NO: 247927 - DNA, 15 bp, Homo sapiens
agtctttgccttctc

SEQ ID NO: 247928 - DNA, 16 bp, Homo sapiens
agtctttgccttctct

SEQ ID NO: 247929 - DNA, 20 bp, Homo sapiens
agtctttgggggattcaaat

SEQ ID NO: 247930 - DNA, 22 bp, Homo sapiens
agtctttgtaagtaaactgccc

SEQ ID NO: 247931 - DNA, 12 bp, Homo sapiens
agtcttttctgt

SEQ ID NO: 247932 - DNA, 22 bp, Homo sapiens
agtgaaaaatatgttgagtgtt

SEQ ID NO: 247933 - DNA, 17 bp, Homo sapiens
agtgaaaccatgactgt

SEQ ID NO: 247934 - DNA, 23 bp, Homo sapiens
agtgaacagattgctacacacac

SEQ ID NO: 247935 - DNA, 15 bp, Homo sapiens
agtgaacagcttcac

SEQ ID NO: 247936 - DNA, 21 bp, Homo sapiens
agtgaaccatcattataaacg

SEQ ID NO: 247937 - DNA, 18 bp, Homo sapiens
agtgaagaagccatcaat

SEQ ID NO: 247938 - DNA, 20 bp, Homo sapiens
agtgaagcccaggaggacct

SEQ ID NO: 247939 - DNA, 22 bp, Homo sapiens
agtgaatacatggtagcagggt

SEQ ID NO: 247940 - DNA, 16 bp, Homo sapiens
agtgtataccacctgt

SEQ ID NO: 247941 - DNA, 18 bp, Homo sapiens
agtgtataccacctgtac

SEQ ID NO: 247942 - DNA, 14 bp, Homo sapiens
agtgtatatcagaa

SEQ ID NO: 247943 - DNA, 15 bp, Homo sapiens
agtgtattttaaatt

SEQ ID NO: 247944 - DNA, 23 bp, Homo sapiens
agtgtattttaaattctcagtca

SEQ ID NO: 247945 - DNA, 17 bp, Homo sapiens
agtgtcactgagctgtg

SEQ ID NO: 247946 - DNA, 17 bp, Homo sapiens
agtgtcacttgactctt

SEQ ID NO: 247947 - DNA, 16 bp, Homo sapiens
agtgtcacttttttcc

SEQ ID NO: 247948 - DNA, 23 bp, Homo sapiens
agtgtcacttttttcctgtcaat

SEQ ID NO: 247949 - DNA, 17 bp, Homo sapiens
agtgtcaggctctgaat

SEQ ID NO: 247950 - DNA, 21 bp, Homo sapiens
agtgtccattatctgctgttc

SEQ ID NO: 247951 - DNA, 17 bp, Homo sapiens
agtgtcctcatctataa

SEQ ID NO: 247952 - DNA, 18 bp, Homo sapiens
agtgtcctgtgctttctg

SEQ ID NO: 247953 - DNA, 19 bp, Homo sapiens
agtgtctaagttttgtcat

SEQ ID NO: 247954 - DNA, 15 bp, Homo sapiens
agtgtctgtaaggac

SEQ ID NO: 247955 - DNA, 22 bp, Homo sapiens
agtgtctgtatcggagacagtg

SEQ ID NO: 247956 - DNA, 19 bp, Homo sapiens
agtgtctgtgccatggatt

SEQ ID NO: 247957 - DNA, 15 bp, Homo sapiens
agtgtcttccataat

SEQ ID NO: 247958 - DNA, 20 bp, Homo sapiens
agtgtgacgggggttggggt

SEQ ID NO: 247959 - DNA, 21 bp, Homo sapiens
agtgtgacgggggttggggtg

SEQ ID NO: 247960 - DNA, 14 bp, Homo sapiens
agtgtgagggcagc

SEQ ID NO: 247961 - DNA, 16 bp, Homo sapiens
agtgtgagtaagagct

SEQ ID NO: 247962 - DNA, 17 bp, Homo sapiens
agtgtgagtaagagctg

SEQ ID NO: 247963 - DNA, 18 bp, Homo sapiens
agtgtgagtaagagctgg

SEQ ID NO: 247964 - DNA, 19 bp, Homo sapiens
agtgtgagtggcagccatg

SEQ ID NO: 247965 - DNA, 18 bp, Homo sapiens
agtgtgcaagcaaagaac

SEQ ID NO: 247966 - DNA, 16 bp, Homo sapiens
agtgtgcacgagtggg

SEQ ID NO: 247967 - DNA, 22 bp, Homo sapiens
agtgtgcacgagtgggaaggac

SEQ ID NO: 247968 - DNA, 12 bp, Homo sapiens
agtgtgctttat

SEQ ID NO: 247969 - DNA, 18 bp, Homo sapiens
agtgtgctttatgctgaa

SEQ ID NO: 247970 - DNA, 21 bp, Homo sapiens
agtgtgctttatgctgaaaca

SEQ ID NO: 247971 - DNA, 13 bp, Homo sapiens
agtgtggagaggg

SEQ ID NO: 247972 - DNA, 21 bp, Homo sapiens
agtgtggatgtaaattttata

SEQ ID NO: 247973 - DNA, 16 bp, Homo sapiens
agtgtggctggtgtcc

SEQ ID NO: 247974 - DNA, 17 bp, Homo sapiens
agtgtggctggtgtccc

SEQ ID NO: 247975 - DNA, 22 bp, Homo sapiens
agtgtggctggtgtccccttcc

SEQ ID NO: 247976 - DNA, 16 bp, Homo sapiens
agtgtggggcgggggt

SEQ ID NO: 247977 - DNA, 16 bp, Homo sapiens
agtgtgtattgttccc

SEQ ID NO: 247978 - DNA, 18 bp, Homo sapiens
agtgtgtccaagtgtgtg

SEQ ID NO: 247979 - DNA, 19 bp, Homo sapiens
agtgtgtctcctgcatgca

SEQ ID NO: 247980 - DNA, 11 bp, Homo sapiens
agtgtgtgtct

SEQ ID NO: 247981 - DNA, 12 bp, Homo sapiens
agtgtgtgtctt

SEQ ID NO: 247982 - DNA, 18 bp, Homo sapiens
agtgtgtgtgcaatgttc

SEQ ID NO: 247983 - DNA, 12 bp, Homo sapiens
agtgtgttctga

SEQ ID NO: 247984 - DNA, 21 bp, Homo sapiens
agtgtgttctgattagaaatg

SEQ ID NO: 247985 - DNA, 12 bp, Homo sapiens
agtgtgttgact

SEQ ID NO: 247986 - DNA, 17 bp, Homo sapiens
agtgtgtttgtgagtat

SEQ ID NO: 247987 - DNA, 22 bp, Homo sapiens
agtgtgtttgtgagtatgtgtg

SEQ ID NO: 247988 - DNA, 21 bp, Homo sapiens
agtgttaaaaaatttttgaaa

SEQ ID NO: 247989 - DNA, 19 bp, Homo sapiens
agtgttagtgggaagagct

SEQ ID NO: 247990 - DNA, 15 bp, Homo sapiens
agtgttataaaatct

SEQ ID NO: 247991 - DNA, 23 bp, Homo sapiens
agtgttataaaatctgtattgct

SEQ ID NO: 247992 - DNA, 15 bp, Homo sapiens
agtgttcgcttggct

SEQ ID NO: 247993 - DNA, 12 bp, Homo sapiens
agtgttctgagc

SEQ ID NO: 247994 - DNA, 23 bp, Homo sapiens
agtgttctgtgggcttggccttg

SEQ ID NO: 247995 - DNA, 15 bp, Homo sapiens
agtgttcttctcaag

SEQ ID NO: 247996 - DNA, 15 bp, Homo sapiens
agtgttgcctcctcc

SEQ ID NO: 247997 - DNA, 22 bp, Homo sapiens
agtgttggtctttctaatgtag

SEQ ID NO: 247998 - DNA, 21 bp, Homo sapiens
agtgttgtttgtaaataagag

SEQ ID NO: 247999 - DNA, 22 bp, Homo sapiens
agtgttgtttgtaaataagaga

SEQ ID NO: 248000 - DNA, 17 bp, Homo sapiens
agtgtttatttttcata

SEQ ID NO: 248001 - DNA, 14 bp, Homo sapiens
agtgtttcatgggt

SEQ ID NO: 248002 - DNA, 16 bp, Homo sapiens
agtgtttcccataatt

SEQ ID NO: 248003 - DNA, 19 bp, Homo sapiens
agtgtttcgtaagacaaaa

SEQ ID NO: 248004 - DNA, 14 bp, Homo sapiens
agtgtttctgcaga

SEQ ID NO: 248005 - DNA, 15 bp, Homo sapiens
agtgtttctgcagag

SEQ ID NO: 248006 - DNA, 16 bp, Homo sapiens
agtgtttctgcagagg

SEQ ID NO: 248007 - DNA, 20 bp, Homo sapiens
agtgtttctgcagaggcagc

SEQ ID NO: 248008 - DNA, 11 bp, Homo sapiens
agtgtttctgt

SEQ ID NO: 248009 - DNA, 13 bp, Homo sapiens
agtgtttctgttc

SEQ ID NO: 248010 - DNA, 14 bp, Homo sapiens
agtgttttactctt

SEQ ID NO: 248011 - DNA, 22 bp, Homo sapiens
agtgttttctcagaacagctga

SEQ ID NO: 248012 - DNA, 15 bp, Homo sapiens
agtgtttttctttaa

SEQ ID NO: 248013 - DNA, 22 bp, Homo sapiens
agtgtttttctttaatcaaaag

SEQ ID NO: 248014 - DNA, 13 bp, Homo sapiens
agttaaaaaaaat

SEQ ID NO: 248015 - DNA, 18 bp, Homo sapiens
agttaaaaaaaataataa

SEQ ID NO: 248016 - DNA, 23 bp, Homo sapiens
agttaaagagcagcctggctaac

SEQ ID NO: 248017 - DNA, 19 bp, Homo sapiens
agttaaaggcagtccagag

SEQ ID NO: 248018 - DNA, 20 bp, Homo sapiens
agttaaaggcagtccagagc

SEQ ID NO: 248019 - DNA, 23 bp, Homo sapiens
agttaaatagagtatatgcactt

SEQ ID NO: 248020 - DNA, 14 bp, Homo sapiens
agttaacaaggaat

SEQ ID NO: 248021 - DNA, 17 bp, Homo sapiens
agttaacaaggaatgcc

SEQ ID NO: 248022 - DNA, 20 bp, Homo sapiens
agttaacaaggaatgcctgt

SEQ ID NO: 248023 - DNA, 17 bp, Homo sapiens
agttaacatctgaagtg

SEQ ID NO: 248024 - DNA, 14 bp, Homo sapiens
agttaactttcaga

SEQ ID NO: 248025 - DNA, 14 bp, Homo sapiens
agttaagaaaaaaa

SEQ ID NO: 248026 - DNA, 18 bp, Homo sapiens
agttaagacaacaggcat

SEQ ID NO: 248027 - DNA, 16 bp, Homo sapiens
agttaagattcttggt

SEQ ID NO: 248028 - DNA, 21 bp, Homo sapiens
agttaagcagcctttctgtgg

SEQ ID NO: 248029 - DNA, 19 bp, Homo sapiens
agttaagtgtcatttcttt

SEQ ID NO: 248030 - DNA, 21 bp, Homo sapiens
agttaatattggaagtgaaat

SEQ ID NO: 248031 - DNA, 15 bp, Homo sapiens
agttaatcttgcttt

SEQ ID NO: 248032 - DNA, 21 bp, Homo sapiens
agttaatgaaggtgtgctaca

SEQ ID NO: 248033 - DNA, 21 bp, Homo sapiens
agttaattatgtgcatattaa

SEQ ID NO: 248034 - DNA, 13 bp, Homo sapiens
agttacccaccct

SEQ ID NO: 248035 - DNA, 14 bp, Homo sapiens
agttacccacccta

SEQ ID NO: 248036 - DNA, 16 bp, Homo sapiens
agttactatcctggct

SEQ ID NO: 248037 - DNA, 17 bp, Homo sapiens
agttactatcctggctt

SEQ ID NO: 248038 - DNA, 21 bp, Homo sapiens
agttactgccacggtcctttg

SEQ ID NO: 248039 - DNA, 14 bp, Homo sapiens
agttacttcctatc

SEQ ID NO: 248040 - DNA, 16 bp, Homo sapiens
agttacttgaatttca

SEQ ID NO: 248041 - DNA, 14 bp, Homo sapiens
agttagagatgcct

SEQ ID NO: 248042 - DNA, 18 bp, Homo sapiens
agttagcaggaaatagtg

SEQ ID NO: 248043 - DNA, 12 bp, Homo sapiens
agttaggaaata

SEQ ID NO: 248044 - DNA, 16 bp, Homo sapiens
agttaggccacgctcc

SEQ ID NO: 248045 - DNA, 14 bp, Homo sapiens
agttagtagcatgt

SEQ ID NO: 248046 - DNA, 15 bp, Homo sapiens
agttagtagcatgtt

SEQ ID NO: 248047 - DNA, 15 bp, Homo sapiens
agttatagtttcaga

SEQ ID NO: 248048 - DNA, 12 bp, Homo sapiens
agttatgaatca

SEQ ID NO: 248049 - DNA, 17 bp, Homo sapiens
agttattaatttcttca

SEQ ID NO: 248050 - DNA, 21 bp, Homo sapiens
agttattatgtagctgaaaca

SEQ ID NO: 248051 - DNA, 19 bp, Homo sapiens
agttattgaatcttaattt

SEQ ID NO: 248052 - DNA, 12 bp, Homo sapiens
agttattgtaca

SEQ ID NO: 248053 - DNA, 13 bp, Homo sapiens
agttattgtacag

SEQ ID NO: 248054 - DNA, 13 bp, Homo sapiens
agttattttagga

SEQ ID NO: 248055 - DNA, 14 bp, Homo sapiens
agttcaaattttgc

SEQ ID NO: 248056 - DNA, 10 bp, Homo sapiens
agttcaatga

SEQ ID NO: 248057 - DNA, 15 bp, Homo sapiens
agttcaatgatctag

SEQ ID NO: 248058 - DNA, 15 bp, Homo sapiens
agttcaattgtgtct

SEQ ID NO: 248059 - DNA, 14 bp, Homo sapiens
agttcacaccctgc

SEQ ID NO: 248060 - DNA, 16 bp, Homo sapiens
agttcacaccctgcaa

SEQ ID NO: 248061 - DNA, 18 bp, Homo sapiens
agttcacaccctgcaagg

SEQ ID NO: 248062 - DNA, 21 bp, Homo sapiens
agttcactataaatggtgttt

SEQ ID NO: 248063 - DNA, 15 bp, Homo sapiens
agttcaggaattttt

SEQ ID NO: 248064 - DNA, 17 bp, Homo sapiens
agttcaggaatttttgt

SEQ ID NO: 248065 - DNA, 18 bp, Homo sapiens
agttcagggaggggctga

SEQ ID NO: 248066 - DNA, 20 bp, Homo sapiens
agttcagtaagaccggaagc

SEQ ID NO: 248067 - DNA, 20 bp, Homo sapiens
agttcagttcctctttgcat

SEQ ID NO: 248068 - DNA, 22 bp, Homo sapiens
agttcatatgtaccatgtacat

SEQ ID NO: 248069 - DNA, 16 bp, Homo sapiens
agttcatccaatcctc

SEQ ID NO: 248070 - DNA, 16 bp, Homo sapiens
agttcatctctgctga

SEQ ID NO: 248071 - DNA, 11 bp, Homo sapiens
agtttctgttg

SEQ ID NO: 248072 - DNA, 14 bp, Homo sapiens
agtttcttctaaag

SEQ ID NO: 248073 - DNA, 19 bp, Homo sapiens
agtttgagacaagccctgg

SEQ ID NO: 248074 - DNA, 17 bp, Homo sapiens
agtttgcaatcttatgt

SEQ ID NO: 248075 - DNA, 21 bp, Homo sapiens
agtttgcaatcttatgttgat

SEQ ID NO: 248076 - DNA, 15 bp, Homo sapiens
agtttgctgggttta

SEQ ID NO: 248077 - DNA, 21 bp, Homo sapiens
agtttgctgtatacaaacagg

SEQ ID NO: 248078 - DNA, 18 bp, Homo sapiens
agtttggctgtaatttaa

SEQ ID NO: 248079 - DNA, 17 bp, Homo sapiens
agtttgtagtaaatatt

SEQ ID NO: 248080 - DNA, 22 bp, Homo sapiens
agtttgtatgccaagtgagaag

SEQ ID NO: 248081 - DNA, 12 bp, Homo sapiens
agtttgtattaa

SEQ ID NO: 248082 - DNA, 14 bp, Homo sapiens
agtttgtcccattt

SEQ ID NO: 248083 - DNA, 16 bp, Homo sapiens
agtttgtcctgtagag

SEQ ID NO: 248084 - DNA, 13 bp, Homo sapiens
agtttgtccttta

SEQ ID NO: 248085 - DNA, 22 bp, Homo sapiens
agtttgtgaagtgattgacatt

SEQ ID NO: 248086 - DNA, 16 bp, Homo sapiens
agtttgtgcaagacac

SEQ ID NO: 248087 - DNA, 17 bp, Homo sapiens
agtttgtgcaagacacc

SEQ ID NO: 248088 - DNA, 16 bp, Homo sapiens
agtttgttaattgatt

SEQ ID NO: 248089 - DNA, 23 bp, Homo sapiens
agttttaaactcatttttgccat

SEQ ID NO: 248090 - DNA, 14 bp, Homo sapiens
agttttaaagaagt

SEQ ID NO: 248091 - DNA, 15 bp, Homo sapiens
agttttaaagaagtc

SEQ ID NO: 248092 - DNA, 16 bp, Homo sapiens
agttttaatccagaat

SEQ ID NO: 248093 - DNA, 22 bp, Homo sapiens
agttttacattacaaatttctg

SEQ ID NO: 248094 - DNA, 22 bp, Homo sapiens
agttttactcttgttgcccagg

SEQ ID NO: 248095 - DNA, 20 bp, Homo sapiens
agttttagggtacagtttgg

SEQ ID NO: 248096 - DNA, 15 bp, Homo sapiens
agttttagtttcaaa

SEQ ID NO: 248097 - DNA, 21 bp, Homo sapiens
agttttagtttcaaaatgtta

SEQ ID NO: 248098 - DNA, 14 bp, Homo sapiens
agttttataaaact

SEQ ID NO: 248099 - DNA, 18 bp, Homo sapiens
agttttcagaacctcttc

SEQ ID NO: 248100 - DNA, 15 bp, Homo sapiens
agttttccagtattg

SEQ ID NO: 248101 - DNA, 13 bp, Homo sapiens
agttttccatgaa

SEQ ID NO: 248102 - DNA, 16 bp, Homo sapiens
agttttcttttactat

SEQ ID NO: 248103 - DNA, 14 bp, Homo sapiens
agttttgaaagaaa

SEQ ID NO: 248104 - DNA, 15 bp, Homo sapiens
agttttgaaagaaaa

SEQ ID NO: 248105 - DNA, 15 bp, Homo sapiens
agttttgatgaaatt

SEQ ID NO: 248106 - DNA, 23 bp, Homo sapiens
agttttgccccatgataaaataa

SEQ ID NO: 248107 - DNA, 14 bp, Homo sapiens
agttttggttttta

SEQ ID NO: 248108 - DNA, 15 bp, Homo sapiens
agttttgtataaata

SEQ ID NO: 248109 - DNA, 17 bp, Homo sapiens
agttttgtataaataat

SEQ ID NO: 248110 - DNA, 16 bp, Homo sapiens
agttttgtgtacagta

SEQ ID NO: 248111 - DNA, 16 bp, Homo sapiens
agttttgtgtgtatat

SEQ ID NO: 248112 - DNA, 16 bp, Homo sapiens
agtttttacagtgtat

SEQ ID NO: 248113 - DNA, 18 bp, Homo sapiens
agtttttattccttgtga

SEQ ID NO: 248114 - DNA, 14 bp, Homo sapiens
agtttttctctcaa

SEQ ID NO: 248115 - DNA, 18 bp, Homo sapiens
agttttttctcttgggct

SEQ ID NO: 248116 - DNA, 17 bp, Homo sapiens
agttttttgccactgca

SEQ ID NO: 248117 - DNA, 20 bp, Homo sapiens
agttttttgccactgcaaac

SEQ ID NO: 248118 - DNA, 16 bp, Homo sapiens
ataaaaaacatttgta

SEQ ID NO: 248119 - DNA, 20 bp, Homo sapiens
ataaaaaacatttgtacatt

SEQ ID NO: 248120 - DNA, 11 bp, Homo sapiens
ataaaaaagaa

SEQ ID NO: 248121 - DNA, 13 bp, Homo sapiens
ataaaaaagaaaa

SEQ ID NO: 248122 - DNA, 23 bp, Homo sapiens
ataaaaaagaaaacattccagat

SEQ ID NO: 248123 - DNA, 18 bp, Homo sapiens
ataaaaaagtgtcctata

SEQ ID NO: 248124 - DNA, 13 bp, Homo sapiens
ataaaaaataagt

SEQ ID NO: 248125 - DNA, 18 bp, Homo sapiens
ataaaaaatttattatgt

SEQ ID NO: 248126 - DNA, 13 bp, Homo sapiens
ataaaaataaatt

SEQ ID NO: 248127 - DNA, 14 bp, Homo sapiens
ataaaaatattgtg

SEQ ID NO: 248128 - DNA, 14 bp, Homo sapiens
ataaaaatggaatt

SEQ ID NO: 248129 - DNA, 15 bp, Homo sapiens
ataaaaattctgaat

SEQ ID NO: 248130 - DNA, 18 bp, Homo sapiens
ataaaacaaaacaaacaa

SEQ ID NO: 248131 - DNA, 16 bp, Homo sapiens
ataaaacaagaatact

SEQ ID NO: 248132 - DNA, 15 bp, Homo sapiens
ataaaacagaatatt

SEQ ID NO: 248133 - DNA, 16 bp, Homo sapiens
ataaaacatctttcca

SEQ ID NO: 248134 - DNA, 12 bp, Homo sapiens
ataaaacattcc

SEQ ID NO: 248135 - DNA, 15 bp, Homo sapiens
ataaaacctttcaaa

SEQ ID NO: 248136 - DNA, 20 bp, Homo sapiens
ataaaacctttcaaatttca

SEQ ID NO: 248137 - DNA, 22 bp, Homo sapiens
ataaaactagggggtgtatatt

SEQ ID NO: 248138 - DNA, 14 bp, Homo sapiens
ataaaactatttaa

SEQ ID NO: 248139 - DNA, 17 bp, Homo sapiens
ataaaagggcaaatctg

SEQ ID NO: 248140 - DNA, 20 bp, Homo sapiens
ataaaaggtgacccttctgt

SEQ ID NO: 248141 - DNA, 13 bp, Homo sapiens
ataaaagtgatca

SEQ ID NO: 248142 - DNA, 22 bp, Homo sapiens
ataaaagtgatcaataaaatgt

SEQ ID NO: 248143 - DNA, 16 bp, Homo sapiens
ataaaagtgcacacct

SEQ ID NO: 248144 - DNA, 22 bp, Homo sapiens
ataaaatactctagcctgggcc

SEQ ID NO: 248145 - DNA, 17 bp, Homo sapiens
ataaaatatcattcagc

SEQ ID NO: 248146 - DNA, 20 bp, Homo sapiens
ataaaatctttccatctcat

SEQ ID NO: 248147 - DNA, 12 bp, Homo sapiens
ataaaatgaggg

SEQ ID NO: 248148 - DNA, 13 bp, Homo sapiens
ataaaatgtgatt

SEQ ID NO: 248149 - DNA, 20 bp, Homo sapiens
ataaaatgtgatttttctga

SEQ ID NO: 248150 - DNA, 16 bp, Homo sapiens
ataaaattcatttcta

SEQ ID NO: 248151 - DNA, 23 bp, Homo sapiens
ataaaattgtaaaattgtataga

SEQ ID NO: 248152 - DNA, 23 bp, Homo sapiens
ataaacacatagattcacctgta

SEQ ID NO: 248153 - DNA, 16 bp, Homo sapiens
ataaacacattgaatg

SEQ ID NO: 248154 - DNA, 13 bp, Homo sapiens
ataaacagataat

SEQ ID NO: 248155 - DNA, 22 bp, Homo sapiens
ataaacagtggaatataaggaa

SEQ ID NO: 248156 - DNA, 15 bp, Homo sapiens
ataaacatatgcaaa

SEQ ID NO: 248157 - DNA, 18 bp, Homo sapiens
ataaacatatgcaaacag

SEQ ID NO: 248158 - DNA, 13 bp, Homo sapiens
ataaacattaaac

SEQ ID NO: 248159 - DNA, 15 bp, Homo sapiens
ataaacattaaacac

SEQ ID NO: 248160 - DNA, 18 bp, Homo sapiens
ataaacattaaacactgt

SEQ ID NO: 248161 - DNA, 19 bp, Homo sapiens
ataaacccatctgtaatat

SEQ ID NO: 248162 - DNA, 15 bp, Homo sapiens
ataaaccttaaatga

SEQ ID NO: 248163 - DNA, 14 bp, Homo sapiens
ataaacgaaacaca

SEQ ID NO: 248164 - DNA, 20 bp, Homo sapiens
ataaacgtgatgatcagctg

SEQ ID NO: 248165 - DNA, 23 bp, Homo sapiens
ataaactagggttttggcctgcc

SEQ ID NO: 248166 - DNA, 15 bp, Homo sapiens
ataaactctaaacat

SEQ ID NO: 248167 - DNA, 13 bp, Homo sapiens
ataaactgacttt

SEQ ID NO: 248168 - DNA, 20 bp, Homo sapiens
ataaactgactttatcctca

SEQ ID NO: 248169 - DNA, 11 bp, Homo sapiens
ataaactgtga

SEQ ID NO: 248170 - DNA, 14 bp, Homo sapiens
ataaactgtgagat

SEQ ID NO: 248171 - DNA, 16 bp, Homo sapiens
ataaactgtgagataa

SEQ ID NO: 248172 - DNA, 17 bp, Homo sapiens
ataaactgtgagataaa

SEQ ID NO: 248173 - DNA, 22 bp, Homo sapiens
ataaactgtgagataaatatca

SEQ ID NO: 248174 - DNA, 16 bp, Homo sapiens
ataaactttcagaact

SEQ ID NO: 248175 - DNA, 13 bp, Homo sapiens
ataaagaaaaaaa

SEQ ID NO: 248176 - DNA, 21 bp, Homo sapiens
ataaagaactccttattttgt

SEQ ID NO: 248177 - DNA, 23 bp, Homo sapiens
ataaagaactccttattttgtat

SEQ ID NO: 248178 - DNA, 17 bp, Homo sapiens
ataaagaagaaaataac

SEQ ID NO: 248179 - DNA, 12 bp, Homo sapiens
ataaagacacct

SEQ ID NO: 248180 - DNA, 11 bp, Homo sapiens
ataaagacagg

SEQ ID NO: 248181 - DNA, 15 bp, Homo sapiens
ataaagatggctatt

SEQ ID NO: 248182 - DNA, 18 bp, Homo sapiens
ataaagatttttgttaag

SEQ ID NO: 248183 - DNA, 14 bp, Homo sapiens
ataaagcataagta

SEQ ID NO: 248184 - DNA, 20 bp, Homo sapiens
ataaagcctgttttgtcttt

SEQ ID NO: 248185 - DNA, 21 bp, Homo sapiens
ataaagcgatatacagatgaa

SEQ ID NO: 248186 - DNA, 20 bp, Homo sapiens
ataaagctggacaagaagct

SEQ ID NO: 248187 - DNA, 23 bp, Homo sapiens
ataaagctggacaagaagctgct

SEQ ID NO: 248188 - DNA, 14 bp, Homo sapiens
ataaaggtcatatt

SEQ ID NO: 248189 - DNA, 23 bp, Homo sapiens
ataaaggtcatattggaaacata

SEQ ID NO: 248190 - DNA, 14 bp, Homo sapiens
ataaagtaaagcta

SEQ ID NO: 248191 - DNA, 17 bp, Homo sapiens
ataaagtaaagctaaaa

SEQ ID NO: 248192 - DNA, 22 bp, Homo sapiens
ataaagtaaatgctacctctga

SEQ ID NO: 248193 - DNA, 18 bp, Homo sapiens
ataaagtactactgtaga

SEQ ID NO: 248194 - DNA, 20 bp, Homo sapiens
ataaagtattccaccttaaa

SEQ ID NO: 248195 - DNA, 15 bp, Homo sapiens
ataaagtcctcttcc

SEQ ID NO: 248196 - DNA, 14 bp, Homo sapiens
ataaagtgcaattg

SEQ ID NO: 248197 - DNA, 17 bp, Homo sapiens
ataaagttacttgaatt

SEQ ID NO: 248198 - DNA, 13 bp, Homo sapiens
ataaagttattaa

SEQ ID NO: 248199 - DNA, 15 bp, Homo sapiens
ataaataaaaatgga

SEQ ID NO: 248200 - DNA, 14 bp, Homo sapiens
ataaataaagaaga

SEQ ID NO: 248201 - DNA, 15 bp, Homo sapiens
ataaataaagaagaa

SEQ ID NO: 248202 - DNA, 18 bp, Homo sapiens
ataagttaaagagacaaa

SEQ ID NO: 248203 - DNA, 15 bp, Homo sapiens
ataagttaaaggcag

SEQ ID NO: 248204 - DNA, 20 bp, Homo sapiens
ataagttaaaggcagtccag

SEQ ID NO: 248205 - DNA, 15 bp, Homo sapiens
ataagttgaccttta

SEQ ID NO: 248206 - DNA, 13 bp, Homo sapiens
ataataaatggga

SEQ ID NO: 248207 - DNA, 16 bp, Homo sapiens
ataataaattaacatt

SEQ ID NO: 248208 - DNA, 18 bp, Homo sapiens
ataataaattaacattat

SEQ ID NO: 248209 - DNA, 12 bp, Homo sapiens
ataataaattga

SEQ ID NO: 248210 - DNA, 15 bp, Homo sapiens
ataataaattgcatg

SEQ ID NO: 248211 - DNA, 21 bp, Homo sapiens
ataataactagatctcctgta

SEQ ID NO: 248212 - DNA, 21 bp, Homo sapiens
ataatacactaattcctttct

SEQ ID NO: 248213 - DNA, 22 bp, Homo sapiens
ataatacactaattcctttcta

SEQ ID NO: 248214 - DNA, 14 bp, Homo sapiens
ataatactaattta

SEQ ID NO: 248215 - DNA, 15 bp, Homo sapiens
ataatactaatttat

SEQ ID NO: 248216 - DNA, 22 bp, Homo sapiens
ataatacttaaaaatatgtgag

SEQ ID NO: 248217 - DNA, 15 bp, Homo sapiens
ataatagaatttcct

SEQ ID NO: 248218 - DNA, 22 bp, Homo sapiens
ataatagacttatatgcaggct

SEQ ID NO: 248219 - DNA, 13 bp, Homo sapiens
ataatagtactat

SEQ ID NO: 248220 - DNA, 16 bp, Homo sapiens
ataatagtcaatttct

SEQ ID NO: 248221 - DNA, 18 bp, Homo sapiens
ataatagttcaggatttg

SEQ ID NO: 248222 - DNA, 16 bp, Homo sapiens
ataatataacaacact

SEQ ID NO: 248223 - DNA, 21 bp, Homo sapiens
ataatatgctgccaaattttg

SEQ ID NO: 248224 - DNA, 13 bp, Homo sapiens
ataatattactgt

SEQ ID NO: 248225 - DNA, 14 bp, Homo sapiens
ataatattactgtt

SEQ ID NO: 248226 - DNA, 14 bp, Homo sapiens
ataatatttaggca

SEQ ID NO: 248227 - DNA, 20 bp, Homo sapiens
ataatatttaggcatgagct

SEQ ID NO: 248228 - DNA, 21 bp, Homo sapiens
ataatcaattattacatttat

SEQ ID NO: 248229 - DNA, 14 bp, Homo sapiens
ataatcagcctctt

SEQ ID NO: 248230 - DNA, 15 bp, Homo sapiens
ataatcagcctctta

SEQ ID NO: 248231 - DNA, 17 bp, Homo sapiens
ataatcagcctcttaaa

SEQ ID NO: 248232 - DNA, 20 bp, Homo sapiens
ataatcagtgtgtctaaatt

SEQ ID NO: 248233 - DNA, 14 bp, Homo sapiens
ataatctagtttac

SEQ ID NO: 248234 - DNA, 16 bp, Homo sapiens
ataatctcatccccaa

SEQ ID NO: 248235 - DNA, 13 bp, Homo sapiens
ataatgaagaatg

SEQ ID NO: 248236 - DNA, 22 bp, Homo sapiens
ataatgacgtattgtgaaattt

SEQ ID NO: 248237 - DNA, 18 bp, Homo sapiens
ataatgagttttacatta

SEQ ID NO: 248238 - DNA, 11 bp, Homo sapiens
ataatgattta

SEQ ID NO: 248239 - DNA, 17 bp, Homo sapiens
ataatgcttaatttcta

SEQ ID NO: 248240 - DNA, 18 bp, Homo sapiens
ataatgcttaatttctaa

SEQ ID NO: 248241 - DNA, 23 bp, Homo sapiens
ataatggcctcttaaaaattatc

SEQ ID NO: 248242 - DNA, 20 bp, Homo sapiens
ataatgggaaaggttgaatt

SEQ ID NO: 248243 - DNA, 17 bp, Homo sapiens
ataatggtttactgctg

SEQ ID NO: 248244 - DNA, 21 bp, Homo sapiens
ataatgtcctttccctggagt

SEQ ID NO: 248245 - DNA, 11 bp, Homo sapiens
ataatgttctt

SEQ ID NO: 248246 - DNA, 19 bp, Homo sapiens
ataatgttctttaatgttg

SEQ ID NO: 248247 - DNA, 22 bp, Homo sapiens
ataatgtttaatattgagaaag

SEQ ID NO: 248248 - DNA, 22 bp, Homo sapiens
ataatgtttccctcaagaacaa

SEQ ID NO: 248249 - DNA, 16 bp, Homo sapiens
ataattaaatgaaata

SEQ ID NO: 248250 - DNA, 18 bp, Homo sapiens
ataattaaattttaatgt

SEQ ID NO: 248251 - DNA, 20 bp, Homo sapiens
ataattaaattttgagttct

SEQ ID NO: 248252 - DNA, 20 bp, Homo sapiens
ataattatcggaagcagtgc

SEQ ID NO: 248253 - DNA, 18 bp, Homo sapiens
ataattatgacagttata

SEQ ID NO: 248254 - DNA, 20 bp, Homo sapiens
ataattatgacagttatact

SEQ ID NO: 248255 - DNA, 20 bp, Homo sapiens
ataattatgttattgaaaaa

SEQ ID NO: 248256 - DNA, 13 bp, Homo sapiens
ataattatgttta

SEQ ID NO: 248257 - DNA, 16 bp, Homo sapiens
ataattatttatttaa

SEQ ID NO: 248258 - DNA, 23 bp, Homo sapiens
ataattcagggtggtaaagtatg

SEQ ID NO: 248259 - DNA, 18 bp, Homo sapiens
ataattctatactgttga

SEQ ID NO: 248260 - DNA, 15 bp, Homo sapiens
ataattgatcaaatt

SEQ ID NO: 248261 - DNA, 15 bp, Homo sapiens
ataattgtggagagg

SEQ ID NO: 248262 - DNA, 16 bp, Homo sapiens
ataattgtggagagga

SEQ ID NO: 248263 - DNA, 21 bp, Homo sapiens
ataattgtggagaggagagaa

SEQ ID NO: 248264 - DNA, 13 bp, Homo sapiens
ataattgtgtaca

SEQ ID NO: 248265 - DNA, 14 bp, Homo sapiens
ataattgtgtacaa

SEQ ID NO: 248266 - DNA, 15 bp, Homo sapiens
ataattgtgtacaaa

SEQ ID NO: 248267 - DNA, 21 bp, Homo sapiens
ataatttaagccaataaataa

SEQ ID NO: 248268 - DNA, 11 bp, Homo sapiens
ataatttccca

SEQ ID NO: 248269 - DNA, 18 bp, Homo sapiens
ataatttcccaattagga

SEQ ID NO: 248270 - DNA, 21 bp, Homo sapiens
ataatttcccaattaggaagt

SEQ ID NO: 248271 - DNA, 22 bp, Homo sapiens
ataatttcccaattaggaagtg

SEQ ID NO: 248272 - DNA, 21 bp, Homo sapiens
ataatttgcatattctattgt

SEQ ID NO: 248273 - DNA, 13 bp, Homo sapiens
ataattttatgaa

SEQ ID NO: 248274 - DNA, 13 bp, Homo sapiens
ataattttcttca

SEQ ID NO: 248275 - DNA, 17 bp, Homo sapiens
ataattttcttcatgca

SEQ ID NO: 248276 - DNA, 20 bp, Homo sapiens
ataatttttaaaagaggaaa

SEQ ID NO: 248277 - DNA, 19 bp, Homo sapiens
ataatttttatatttaatt

SEQ ID NO: 248278 - DNA, 19 bp, Homo sapiens
ataatttttgctgaattcc

SEQ ID NO: 248279 - DNA, 17 bp, Homo sapiens
ataattttttagttaaa

SEQ ID NO: 248280 - DNA, 19 bp, Homo sapiens
ataattttttagttaaaat

SEQ ID NO: 248281 - DNA, 20 bp, Homo sapiens
ataattttttagttaaaatc

SEQ ID NO: 248282 - DNA, 17 bp, Homo sapiens
ataattttttattcaag

SEQ ID NO: 248283 - DNA, 13 bp, Homo sapiens
atacaaaagaatt

SEQ ID NO: 248284 - DNA, 11 bp, Homo sapiens
atacaaacagg

SEQ ID NO: 248285 - DNA, 20 bp, Homo sapiens
atacaactttggaatttgaa

SEQ ID NO: 248286 - DNA, 21 bp, Homo sapiens
atacaataaactattggaaag

SEQ ID NO: 248287 - DNA, 15 bp, Homo sapiens
atacaatatcatcca

SEQ ID NO: 248288 - DNA, 14 bp, Homo sapiens
atacaattaaaggt

SEQ ID NO: 248289 - DNA, 18 bp, Homo sapiens
atacacaaagatattatt

SEQ ID NO: 248290 - DNA, 13 bp, Homo sapiens
atacacacaaaaa

SEQ ID NO: 248291 - DNA, 21 bp, Homo sapiens
atacacacatagtttcttttt

SEQ ID NO: 248292 - DNA, 22 bp, Homo sapiens
atacacacatagtttctttttt

SEQ ID NO: 248293 - DNA, 14 bp, Homo sapiens
atacaccgggcctg

SEQ ID NO: 248294 - DNA, 22 bp, Homo sapiens
atacactatttgtgagcaaagg

SEQ ID NO: 248295 - DNA, 14 bp, Homo sapiens
atacactcctgctg

SEQ ID NO: 248296 - DNA, 17 bp, Homo sapiens
atacactgacttggtgc

SEQ ID NO: 248297 - DNA, 23 bp, Homo sapiens
atacactgtatctaaaaaataac

SEQ ID NO: 248298 - DNA, 16 bp, Homo sapiens
atacacttgtaaataa

SEQ ID NO: 248299 - DNA, 14 bp, Homo sapiens
atacagaaaatgct

SEQ ID NO: 248300 - DNA, 12 bp, Homo sapiens
atacagacacta

SEQ ID NO: 248301 - DNA, 23 bp, Homo sapiens
atacagacactaagttatagtat

SEQ ID NO: 248302 - DNA, 18 bp, Homo sapiens
atacagacctaatatcat

SEQ ID NO: 248303 - DNA, 15 bp, Homo sapiens
atacagataacatta

SEQ ID NO: 248304 - DNA, 16 bp, Homo sapiens
atacagatccgcatgt

SEQ ID NO: 248305 - DNA, 17 bp, Homo sapiens
atacagatccgcatgtg

SEQ ID NO: 248306 - DNA, 18 bp, Homo sapiens
atacagatccgcatgtgt

SEQ ID NO: 248307 - DNA, 20 bp, Homo sapiens
atacagatccgcatgtgtct

SEQ ID NO: 248308 - DNA, 22 bp, Homo sapiens
atacagcactacttacttagag

SEQ ID NO: 248309 - DNA, 20 bp, Homo sapiens
atacagccctcccccagcag

SEQ ID NO: 248310 - DNA, 22 bp, Homo sapiens
atacagcctctacagccgtccc

SEQ ID NO: 248311 - DNA, 18 bp, Homo sapiens
atacagtattatagatat

SEQ ID NO: 248312 - DNA, 14 bp, Homo sapiens
atacagtattctgt

SEQ ID NO: 248313 - DNA, 15 bp, Homo sapiens
atacagtcaggacac

SEQ ID NO: 248314 - DNA, 21 bp, Homo sapiens
atacagtcattatttaaagca

SEQ ID NO: 248315 - DNA, 20 bp, Homo sapiens
atacagttgttggcctccgg

SEQ ID NO: 248316 - DNA, 16 bp, Homo sapiens
atacagttttaaagaa

SEQ ID NO: 248317 - DNA, 23 bp, Homo sapiens
atacagttttaaagaatcattat

SEQ ID NO: 248318 - DNA, 12 bp, Homo sapiens
atacataacagg

SEQ ID NO: 248319 - DNA, 17 bp, Homo sapiens
atacatacctctctcta

SEQ ID NO: 248320 - DNA, 14 bp, Homo sapiens
atacatcagttatt

SEQ ID NO: 248321 - DNA, 23 bp, Homo sapiens
atacatctaagtcagtttcacat

SEQ ID NO: 248322 - DNA, 14 bp, Homo sapiens
atacatctttatca

SEQ ID NO: 248323 - DNA, 22 bp, Homo sapiens
atacatctttatcattaaacat

SEQ ID NO: 248324 - DNA, 12 bp, Homo sapiens
atacatgtatag

SEQ ID NO: 248325 - DNA, 19 bp, Homo sapiens
atacatgttattgttttca

SEQ ID NO: 248326 - DNA, 14 bp, Homo sapiens
atacattaaaagaa

SEQ ID NO: 248327 - DNA, 16 bp, Homo sapiens
atacattccatcacag

SEQ ID NO: 248328 - DNA, 14 bp, Homo sapiens
acttaacattgcat

SEQ ID NO: 248329 - DNA, 23 bp, Homo sapiens
acttaactattcaggagagtaga

SEQ ID NO: 248330 - DNA, 15 bp, Homo sapiens
acttaagacaaatgg

SEQ ID NO: 248331 - DNA, 17 bp, Homo sapiens
acttaagacaaatggga

SEQ ID NO: 248332 - DNA, 23 bp, Homo sapiens
atacattccatcacagccagccc

SEQ ID NO: 248333 - DNA, 10 bp, Homo sapiens
atacattcct

SEQ ID NO: 248334 - DNA, 11 bp, Homo sapiens
atacattcctg

SEQ ID NO: 248335 - DNA, 14 bp, Homo sapiens
atacattcctgaga

SEQ ID NO: 248336 - DNA, 17 bp, Homo sapiens
atacattgtataggcca

SEQ ID NO: 248337 - DNA, 21 bp, Homo sapiens
atacattgtataggccatctg

SEQ ID NO: 248338 - DNA, 16 bp, Homo sapiens
atacatttatcttctg

SEQ ID NO: 248339 - DNA, 18 bp, Homo sapiens
atacatttatcttctgtt

SEQ ID NO: 248340 - DNA, 19 bp, Homo sapiens
atacatttatcttctgttt

SEQ ID NO: 248341 - DNA, 12 bp, Homo sapiens
atacatttgtat

SEQ ID NO: 248342 - DNA, 16 bp, Homo sapiens
atacattttatatctg

SEQ ID NO: 248343 - DNA, 22 bp, Homo sapiens
atacattttgttatagaatact

SEQ ID NO: 248344 - DNA, 12 bp, Homo sapiens
atacatttttaa

SEQ ID NO: 248345 - DNA, 16 bp, Homo sapiens
ataccaaagcagttgg

SEQ ID NO: 248346 - DNA, 15 bp, Homo sapiens
ataccacctgtacat

SEQ ID NO: 248347 - DNA, 11 bp, Homo sapiens
ataccatcagc

SEQ ID NO: 248348 - DNA, 17 bp, Homo sapiens
ataccattaaaactgct

SEQ ID NO: 248349 - DNA, 16 bp, Homo sapiens
ataccattttgaaata

SEQ ID NO: 248350 - DNA, 18 bp, Homo sapiens
atacccagagagaaaaag

SEQ ID NO: 248351 - DNA, 18 bp, Homo sapiens
atacccatagcttccatg

SEQ ID NO: 248352 - DNA, 22 bp, Homo sapiens
atacccccgtcggaatggtaac

SEQ ID NO: 248353 - DNA, 17 bp, Homo sapiens
ataccccctgccccaga

SEQ ID NO: 248354 - DNA, 20 bp, Homo sapiens
ataccccctgccccagagaa

SEQ ID NO: 248355 - DNA, 16 bp, Homo sapiens
ataccctaggtctcca

SEQ ID NO: 248356 - DNA, 18 bp, Homo sapiens
ataccctaggtctccacc

SEQ ID NO: 248357 - DNA, 19 bp, Homo sapiens
ataccctaggtctccaccc

SEQ ID NO: 248358 - DNA, 18 bp, Homo sapiens
ataccgtttggtgtctga

SEQ ID NO: 248359 - DNA, 23 bp, Homo sapiens
ataccgtttggtgtctgatgtgt

SEQ ID NO: 248360 - DNA, 17 bp, Homo sapiens
atacctccattaaatgg

SEQ ID NO: 248361 - DNA, 18 bp, Homo sapiens
atacctctctctatatat

SEQ ID NO: 248362 - DNA, 20 bp, Homo sapiens
atacctctctctatatatac

SEQ ID NO: 248363 - DNA, 16 bp, Homo sapiens
atacctctttgaaaga

SEQ ID NO: 248364 - DNA, 19 bp, Homo sapiens
atacctggcttttacttta

SEQ ID NO: 248365 - DNA, 23 bp, Homo sapiens
atacctggcttttactttattaa

SEQ ID NO: 248366 - DNA, 13 bp, Homo sapiens
atacctttaaata

SEQ ID NO: 248367 - DNA, 14 bp, Homo sapiens
atacctttaaatat

SEQ ID NO: 248368 - DNA, 16 bp, Homo sapiens
atacctttaaatatca

SEQ ID NO: 248369 - DNA, 12 bp, Homo sapiens
atactaataaaa

SEQ ID NO: 248370 - DNA, 15 bp, Homo sapiens
atactaataaaaagg

SEQ ID NO: 248371 - DNA, 13 bp, Homo sapiens
atactaatttatt

SEQ ID NO: 248372 - DNA, 22 bp, Homo sapiens
atactaggttaacatttgtaat

SEQ ID NO: 248373 - DNA, 15 bp, Homo sapiens
atactataaatatat

SEQ ID NO: 248374 - DNA, 22 bp, Homo sapiens
atactattggacagacacagag

SEQ ID NO: 248375 - DNA, 17 bp, Homo sapiens
atactcacctcctccca

SEQ ID NO: 248376 - DNA, 22 bp, Homo sapiens
atactcacctcctcccagactt

SEQ ID NO: 248377 - DNA, 22 bp, Homo sapiens
atactccctttttgagtaattt

SEQ ID NO: 248378 - DNA, 20 bp, Homo sapiens
atactctcaccatttggatc

SEQ ID NO: 248379 - DNA, 21 bp, Homo sapiens
atactctgtgtaatctctgat

SEQ ID NO: 248380 - DNA, 22 bp, Homo sapiens
atactctgtgtaatctctgatt

SEQ ID NO: 248381 - DNA, 12 bp, Homo sapiens
atactctgttgc

SEQ ID NO: 248382 - DNA, 15 bp, Homo sapiens
atactctgttgcctc

SEQ ID NO: 248383 - DNA, 17 bp, Homo sapiens
atactctgttgcctcct

SEQ ID NO: 248384 - DNA, 18 bp, Homo sapiens
atactctgttgcctcctc

SEQ ID NO: 248385 - DNA, 19 bp, Homo sapiens
atactctgttgcctcctct

SEQ ID NO: 248386 - DNA, 20 bp, Homo sapiens
atactctgttgcctcctctc

SEQ ID NO: 248387 - DNA, 21 bp, Homo sapiens
atactctgttgcctcctctct

SEQ ID NO: 248388 - DNA, 14 bp, Homo sapiens
atactcttggtcac

SEQ ID NO: 248389 - DNA, 19 bp, Homo sapiens
atactcttggtcacctcaa

SEQ ID NO: 248390 - DNA, 14 bp, Homo sapiens
atactgaaacattt

SEQ ID NO: 248391 - DNA, 13 bp, Homo sapiens
atactgaatttct

SEQ ID NO: 248392 - DNA, 18 bp, Homo sapiens
atactgaatttctttgat

SEQ ID NO: 248393 - DNA, 16 bp, Homo sapiens
atactgagtgcctgca

SEQ ID NO: 248394 - DNA, 13 bp, Homo sapiens
atactgatgagac

SEQ ID NO: 248395 - DNA, 18 bp, Homo sapiens
atactgatgagacaacac

SEQ ID NO: 248396 - DNA, 21 bp, Homo sapiens
atactgatgagacaacacaca

SEQ ID NO: 248397 - DNA, 21 bp, Homo sapiens
atactgctgatgctgaaataa

SEQ ID NO: 248398 - DNA, 14 bp, Homo sapiens
atactgcttttgca

SEQ ID NO: 248399 - DNA, 14 bp, Homo sapiens
atactggaagtttt

SEQ ID NO: 248400 - DNA, 16 bp, Homo sapiens
atactggaagttttgc

SEQ ID NO: 248401 - DNA, 20 bp, Homo sapiens
atactggaagttttgcattt

SEQ ID NO: 248402 - DNA, 23 bp, Homo sapiens
atactgggttcttgttttatata

SEQ ID NO: 248403 - DNA, 14 bp, Homo sapiens
atactgtctaagaa

SEQ ID NO: 248404 - DNA, 20 bp, Homo sapiens
atactgtgtgggatacttag

SEQ ID NO: 248405 - DNA, 18 bp, Homo sapiens
atactgtttgtaatatac

SEQ ID NO: 248406 - DNA, 16 bp, Homo sapiens
atacttaaaaatatgt

SEQ ID NO: 248407 - DNA, 15 bp, Homo sapiens
atacttaatatgtgg

SEQ ID NO: 248408 - DNA, 20 bp, Homo sapiens
atacttagtggtatgtctct

SEQ ID NO: 248409 - DNA, 14 bp, Homo sapiens
atacttatctatat

SEQ ID NO: 248410 - DNA, 17 bp, Homo sapiens
atacttcaaaagccata

SEQ ID NO: 248411 - DNA, 16 bp, Homo sapiens
atacttctttttcatt

SEQ ID NO: 248412 - DNA, 20 bp, Homo sapiens
atacttgctccttgaataag

SEQ ID NO: 248413 - DNA, 13 bp, Homo sapiens
atactttatttct

SEQ ID NO: 248414 - DNA, 14 bp, Homo sapiens
atactttatttctg

SEQ ID NO: 248415 - DNA, 15 bp, Homo sapiens
atactttatttctga

SEQ ID NO: 248416 - DNA, 15 bp, Homo sapiens
atactttgtgtcttt

SEQ ID NO: 248417 - DNA, 22 bp, Homo sapiens
atacttttttttttgaggcaga

SEQ ID NO: 248418 - DNA, 14 bp, Homo sapiens
atagaaaaagcaca

SEQ ID NO: 248419 - DNA, 15 bp, Homo sapiens
atagaaaaagcacag

SEQ ID NO: 248420 - DNA, 21 bp, Homo sapiens
atagaaaacaggaaaaaaact

SEQ ID NO: 248421 - DNA, 17 bp, Homo sapiens
atagaaaactgaaaatc

SEQ ID NO: 248422 - DNA, 16 bp, Homo sapiens
atagaaatgtattttg

SEQ ID NO: 248423 - DNA, 22 bp, Homo sapiens
atagaaatgtattttgaaaaca

SEQ ID NO: 248424 - DNA, 15 bp, Homo sapiens
atagaactctgggct

SEQ ID NO: 248425 - DNA, 23 bp, Homo sapiens
atagaactgtcccacaaaatatt

SEQ ID NO: 248426 - DNA, 14 bp, Homo sapiens
atagaagatgtttg

SEQ ID NO: 248427 - DNA, 13 bp, Homo sapiens
atagaagctgtag

SEQ ID NO: 248428 - DNA, 21 bp, Homo sapiens
atagaagcttcttgctcctgt

SEQ ID NO: 248429 - DNA, 14 bp, Homo sapiens
atagaagtttagat

SEQ ID NO: 248430 - DNA, 22 bp, Homo sapiens
atagaatacttttttctagttt

SEQ ID NO: 248431 - DNA, 12 bp, Homo sapiens
atagaatattta

SEQ ID NO: 248432 - DNA, 13 bp, Homo sapiens
atagaatatttat

SEQ ID NO: 248433 - DNA, 22 bp, Homo sapiens
atagaatatttattacctctga

SEQ ID NO: 248434 - DNA, 17 bp, Homo sapiens
atagaatgaactgtcta

SEQ ID NO: 248435 - DNA, 16 bp, Homo sapiens
atagaatgttactttg

SEQ ID NO: 248436 - DNA, 19 bp, Homo sapiens
atagaatttttaatgtttt

SEQ ID NO: 248437 - DNA, 11 bp, Homo sapiens
atagacacagt

SEQ ID NO: 248438 - DNA, 13 bp, Homo sapiens
atagacttcgaaa

SEQ ID NO: 248439 - DNA, 23 bp, Homo sapiens
atagacttcgaaaacagatgaga

SEQ ID NO: 248440 - DNA, 17 bp, Homo sapiens
atagagagggggctctc

SEQ ID NO: 248441 - DNA, 14 bp, Homo sapiens
atagagatatttaa

SEQ ID NO: 248442 - DNA, 16 bp, Homo sapiens
atagagatatttaaaa

SEQ ID NO: 248443 - DNA, 18 bp, Homo sapiens
atagagatatttaaaaga

SEQ ID NO: 248444 - DNA, 17 bp, Homo sapiens
atagagatgagctttct

SEQ ID NO: 248445 - DNA, 16 bp, Homo sapiens
atagagatgtttttaa

SEQ ID NO: 248446 - DNA, 18 bp, Homo sapiens
atagaggatgatgtaatt

SEQ ID NO: 248447 - DNA, 21 bp, Homo sapiens
atagaggatgatgtaattaaa

SEQ ID NO: 248448 - DNA, 16 bp, Homo sapiens
atagaggtaccagcaa

SEQ ID NO: 248449 - DNA, 19 bp, Homo sapiens
atagagtacttaatatact

SEQ ID NO: 248450 - DNA, 18 bp, Homo sapiens
atagataccattttgaaa

SEQ ID NO: 248451 - DNA, 19 bp, Homo sapiens
atagatcaaagtcaaaaat

SEQ ID NO: 248452 - DNA, 17 bp, Homo sapiens
atagatcacggcatgtt

SEQ ID NO: 248453 - DNA, 15 bp, Homo sapiens
atagatcagtatttc

SEQ ID NO: 248454 - DNA, 14 bp, Homo sapiens
atagatcttctgaa

SEQ ID NO: 248455 - DNA, 18 bp, Homo sapiens
atagatgaactttttaac

SEQ ID NO: 248456 - DNA, 15 bp, Homo sapiens
atagattagattata

SEQ ID NO: 248457 - DNA, 13 bp, Homo sapiens
atagattcacctg

SEQ ID NO: 248458 - DNA, 15 bp, Homo sapiens
atagattcacctgta

SEQ ID NO: 248459 - DNA, 20 bp, Homo sapiens
atagatttaccctttataga

SEQ ID NO: 248460 - DNA, 16 bp, Homo sapiens
atagcaaacttggaat

SEQ ID NO: 248461 - DNA, 15 bp, Homo sapiens
atagcaacatgcttc

SEQ ID NO: 248462 - DNA, 22 bp, Homo sapiens
atagcaacctatttgactgctt

SEQ ID NO: 248463 - DNA, 16 bp, Homo sapiens
cctctggtttggggcg

SEQ ID NO: 248464 - DNA, 21 bp, Homo sapiens
cctctggtttggggcgaggca

SEQ ID NO: 248465 - DNA, 23 bp, Homo sapiens
cctctggtttggggcgaggcaga

SEQ ID NO: 248466 - DNA, 22 bp, Homo sapiens
cctctgtagctccctcctccca

SEQ ID NO: 248467 - DNA, 15 bp, Homo sapiens
cctctgtcagtttgt

SEQ ID NO: 248468 - DNA, 22 bp, Homo sapiens
cctctgtcatcactccctggat

SEQ ID NO: 248469 - DNA, 12 bp, Homo sapiens
cctctgtccaca

SEQ ID NO: 248470 - DNA, 16 bp, Homo sapiens
cctctgtccacatgtg

SEQ ID NO: 248471 - DNA, 22 bp, Homo sapiens
cctctgtccccgagccgagctc

SEQ ID NO: 248472 - DNA, 12 bp, Homo sapiens
cctctgtgccta

SEQ ID NO: 248473 - DNA, 18 bp, Homo sapiens
cctctgtgcctaataaag

SEQ ID NO: 248474 - DNA, 14 bp, Homo sapiens
cctctgtgctccct

SEQ ID NO: 248475 - DNA, 20 bp, Homo sapiens
cctctgttacatcctgctac

SEQ ID NO: 248476 - DNA, 19 bp, Homo sapiens
cctctgttctggtggcccc

SEQ ID NO: 248477 - DNA, 21 bp, Homo sapiens
cctctgttctggtggccccag

SEQ ID NO: 248478 - DNA, 21 bp, Homo sapiens
cctctgttggaaattgggtgt

SEQ ID NO: 248479 - DNA, 18 bp, Homo sapiens
cctctgttgtcctcccct

SEQ ID NO: 248480 - DNA, 23 bp, Homo sapiens
cctctgttgtcctccccttgggc

SEQ ID NO: 248481 - DNA, 17 bp, Homo sapiens
cctcttaaagctgcctg

SEQ ID NO: 248482 - DNA, 19 bp, Homo sapiens
cctcttaaagctgcctgta

SEQ ID NO: 248483 - DNA, 20 bp, Homo sapiens
cctcttaaagctgcctgtag

SEQ ID NO: 248484 - DNA, 22 bp, Homo sapiens
cctcttaaagctgcctgtagtt

SEQ ID NO: 248485 - DNA, 23 bp, Homo sapiens
cctcttaaagctgcctgtagtta

SEQ ID NO: 248486 - DNA, 17 bp, Homo sapiens
cctcttaagacactagt

SEQ ID NO: 248487 - DNA, 17 bp, Homo sapiens
cctcttaccgtagcctc

SEQ ID NO: 248488 - DNA, 18 bp, Homo sapiens
cctcttagcttttctgca

SEQ ID NO: 248489 - DNA, 22 bp, Homo sapiens
cctcttaggtcccgggaggaac

SEQ ID NO: 248490 - DNA, 19 bp, Homo sapiens
cctcttagtgattgtgtct

SEQ ID NO: 248491 - DNA, 17 bp, Homo sapiens
cctcttcaccccggcag

SEQ ID NO: 248492 - DNA, 19 bp, Homo sapiens
cctcttcaggggtcacctc

SEQ ID NO: 248493 - DNA, 20 bp, Homo sapiens
cctcttcccccttcccctgc

SEQ ID NO: 248494 - DNA, 20 bp, Homo sapiens
cctcttccctgtcttcccca

SEQ ID NO: 248495 - DNA, 22 bp, Homo sapiens
cctcttcccttagcctctccca

SEQ ID NO: 248496 - DNA, 17 bp, Homo sapiens
cctcttccttctctact

SEQ ID NO: 248497 - DNA, 16 bp, Homo sapiens
cctcttctcaagtgcc

SEQ ID NO: 248498 - DNA, 15 bp, Homo sapiens
cctcttctcagctcc

SEQ ID NO: 248499 - DNA, 22 bp, Homo sapiens
cctcttctcagctccactctga

SEQ ID NO: 248500 - DNA, 17 bp, Homo sapiens
cctcttctctgggccca

SEQ ID NO: 248501 - DNA, 19 bp, Homo sapiens
cctcttgagcagtggctgg

SEQ ID NO: 248502 - DNA, 24 bp, Homo sapiens
cctcttgagcagtggctggtccag

SEQ ID NO: 248503 - DNA, 14 bp, Homo sapiens
cctcttgccactgc

SEQ ID NO: 248504 - DNA, 22 bp, Homo sapiens
cctcttgccactgcctcttcct

SEQ ID NO: 248505 - DNA, 12 bp, Homo sapiens
cctcttgccccc

SEQ ID NO: 248506 - DNA, 18 bp, Homo sapiens
cctcttgcctctctcagg

SEQ ID NO: 248507 - DNA, 22 bp, Homo sapiens
cctcttgctcagagctaggccc

SEQ ID NO: 248508 - DNA, 12 bp, Homo sapiens
cctcttgctggt

SEQ ID NO: 248509 - DNA, 22 bp, Homo sapiens
cctctttactcccttcctggcc

SEQ ID NO: 248510 - DNA, 16 bp, Homo sapiens
cctctttcagaaaaca

SEQ ID NO: 248511 - DNA, 22 bp, Homo sapiens
cctctttctctctgtgtggcaa

SEQ ID NO: 248512 - DNA, 15 bp, Homo sapiens
cctctttgagtgaag

SEQ ID NO: 248513 - DNA, 15 bp, Homo sapiens
cctctttgcatggaa

SEQ ID NO: 248514 - DNA, 19 bp, Homo sapiens
cctctttgttttgttttaa

SEQ ID NO: 248515 - DNA, 18 bp, Homo sapiens
cctcttttccctctctag

SEQ ID NO: 248516 - DNA, 14 bp, Homo sapiens
cctcttttgagact

SEQ ID NO: 248517 - DNA, 14 bp, Homo sapiens
cctcttttggcctt

SEQ ID NO: 248518 - DNA, 20 bp, Homo sapiens
cctgaaaaatgactgtccca

SEQ ID NO: 248519 - DNA, 19 bp, Homo sapiens
cctgaaaacgaaggggccc

SEQ ID NO: 248520 - DNA, 16 bp, Homo sapiens
cctgaaacagccatgt

SEQ ID NO: 248521 - DNA, 18 bp, Homo sapiens
cctgaaacagccatgtcc

SEQ ID NO: 248522 - DNA, 19 bp, Homo sapiens
cctgaaagaggctgaggcc

SEQ ID NO: 248523 - DNA, 22 bp, Homo sapiens
cctgaaagaggctgaggcctgg

SEQ ID NO: 248524 - DNA, 14 bp, Homo sapiens
cctgaaataaaact

SEQ ID NO: 248525 - DNA, 21 bp, Homo sapiens
cctgaaatgtttccaggcatg

SEQ ID NO: 248526 - DNA, 13 bp, Homo sapiens
cctgaacaagaaa

SEQ ID NO: 248527 - DNA, 16 bp, Homo sapiens
cctgaacaagaaagag

SEQ ID NO: 248528 - DNA, 17 bp, Homo sapiens
cctgaagagcgctcctc

SEQ ID NO: 248529 - DNA, 20 bp, Homo sapiens
cctgaagagcgctcctctgc

SEQ ID NO: 248530 - DNA, 21 bp, Homo sapiens
cctgaagagcgctcctctgcc

SEQ ID NO: 248531 - DNA, 15 bp, Homo sapiens
cctgaagcctctgcc

SEQ ID NO: 248532 - DNA, 18 bp, Homo sapiens
cctgaagggtgacatccc

SEQ ID NO: 248533 - DNA, 16 bp, Homo sapiens
cctgaatattaatccc

SEQ ID NO: 248534 - DNA, 13 bp, Homo sapiens
cctgaatgaaata

SEQ ID NO: 248535 - DNA, 15 bp, Homo sapiens
cctgaatgcttctga

SEQ ID NO: 248536 - DNA, 22 bp, Homo sapiens
cctgaatggttccatgcctgag

SEQ ID NO: 248537 - DNA, 23 bp, Homo sapiens
cctgaatggttccatgcctgagg

SEQ ID NO: 248538 - DNA, 14 bp, Homo sapiens
cctgaattctattt

SEQ ID NO: 248539 - DNA, 21 bp, Homo sapiens
cctgaattctatttgctgggc

SEQ ID NO: 248540 - DNA, 18 bp, Homo sapiens
cctgacaatggcagctag

SEQ ID NO: 248541 - DNA, 16 bp, Homo sapiens
cctgacagaaggactc

SEQ ID NO: 248542 - DNA, 20 bp, Homo sapiens
cctgacagatgtcagccgag

SEQ ID NO: 248543 - DNA, 18 bp, Homo sapiens
cctgacagtcttgtgctt

SEQ ID NO: 248544 - DNA, 22 bp, Homo sapiens
cctgacatgtgacatctacctc

SEQ ID NO: 248545 - DNA, 20 bp, Homo sapiens
cctgaccacgctttctagct

SEQ ID NO: 248546 - DNA, 15 bp, Homo sapiens
cctgacccagtcccc

SEQ ID NO: 248547 - DNA, 21 bp, Homo sapiens
cctgaccctgtgatgcctgac

SEQ ID NO: 248548 - DNA, 18 bp, Homo sapiens
cctgacctcaagcaacca

SEQ ID NO: 248549 - DNA, 21 bp, Homo sapiens
cctgacctcatgatccaccca

SEQ ID NO: 248550 - DNA, 16 bp, Homo sapiens
cctgacctccctctaa

SEQ ID NO: 248551 - DNA, 13 bp, Homo sapiens
cctgacctggcac

SEQ ID NO: 248552 - DNA, 19 bp, Homo sapiens
cctgaccttagcgttctgg

SEQ ID NO: 248553 - DNA, 13 bp, Homo sapiens
cctgacgccctgc

SEQ ID NO: 248554 - DNA, 14 bp, Homo sapiens
cctgacgccctgcg

SEQ ID NO: 248555 - DNA, 22 bp, Homo sapiens
cctgacgccctgcgttggagcc

SEQ ID NO: 248556 - DNA, 20 bp, Homo sapiens
cctgactaatttttgtattt

SEQ ID NO: 248557 - DNA, 10 bp, Homo sapiens
cctgactcaa

SEQ ID NO: 248558 - DNA, 16 bp, Homo sapiens
cctgactcaggcatca

SEQ ID NO: 248559 - DNA, 18 bp, Homo sapiens
cctgactcgtctgactgt

SEQ ID NO: 248560 - DNA, 23 bp, Homo sapiens
cctgacttagcccgtcaccctta

SEQ ID NO: 248561 - DNA, 18 bp, Homo sapiens
cctgacttcccagctggc

SEQ ID NO: 248562 - DNA, 19 bp, Homo sapiens
cctgacttttacagctttt

SEQ ID NO: 248563 - DNA, 22 bp, Homo sapiens
cctgacttttacagcttttctc

SEQ ID NO: 248564 - DNA, 17 bp, Homo sapiens
cctgagaaagcccacct

SEQ ID NO: 248565 - DNA, 14 bp, Homo sapiens
cctgagaaggcgag

SEQ ID NO: 248566 - DNA, 20 bp, Homo sapiens
cctgagacgggcatcgcagg

SEQ ID NO: 248567 - DNA, 22 bp, Homo sapiens
cctgagacgggcatcgcaggag

SEQ ID NO: 248568 - DNA, 13 bp, Homo sapiens
cctgagactccag

SEQ ID NO: 248569 - DNA, 15 bp, Homo sapiens
cctgagagcagaatg

SEQ ID NO: 248570 - DNA, 19 bp, Homo sapiens
cctgagagcatgtggggga

SEQ ID NO: 248571 - DNA, 14 bp, Homo sapiens
cctgagattctggg

SEQ ID NO: 248572 - DNA, 16 bp, Homo sapiens
cctgagattctgggaa

SEQ ID NO: 248573 - DNA, 18 bp, Homo sapiens
cctgagattctgggaaag

SEQ ID NO: 248574 - DNA, 19 bp, Homo sapiens
cctgagcacccgctgacat

SEQ ID NO: 248575 - DNA, 22 bp, Homo sapiens
cctgagcagtctacttctgtgt

SEQ ID NO: 248576 - DNA, 23 bp, Homo sapiens
cctgagccacagtggggcccatg

SEQ ID NO: 248577 - DNA, 16 bp, Homo sapiens
cctgagcccaggagct

SEQ ID NO: 248578 - DNA, 18 bp, Homo sapiens
cctgagcccccacccggg

SEQ ID NO: 248579 - DNA, 17 bp, Homo sapiens
cctgagcctgccccagc

SEQ ID NO: 248580 - DNA, 13 bp, Homo sapiens
cctgagcctgtct

SEQ ID NO: 248581 - DNA, 15 bp, Homo sapiens
cctgagcctgtgggt

SEQ ID NO: 248582 - DNA, 17 bp, Homo sapiens
cctgagctgccatccag

SEQ ID NO: 248583 - DNA, 12 bp, Homo sapiens
cctgagctgggg

SEQ ID NO: 248584 - DNA, 16 bp, Homo sapiens
cctgagcttggccaga

SEQ ID NO: 248585 - DNA, 22 bp, Homo sapiens
cctgagctttccggggaggagc

SEQ ID NO: 248586 - DNA, 22 bp, Homo sapiens
cctgagctttggacgcacacag

SEQ ID NO: 248587 - DNA, 21 bp, Homo sapiens
cctgaggaaggaggggaagct

SEQ ID NO: 248588 - DNA, 23 bp, Homo sapiens
cctgaggaaggaggggaagctgc

SEQ ID NO: 248589 - DNA, 20 bp, Homo sapiens
cctgaggcagaacctggtgg

SEQ ID NO: 248590 - DNA, 21 bp, Homo sapiens
cctgaggcagaacctggtggc

SEQ ID NO: 248591 - DNA, 14 bp, Homo sapiens
cctgaggctggggc

SEQ ID NO: 248592 - DNA, 22 bp, Homo sapiens
cctgagggaagcccacccgccc

SEQ ID NO: 248593 - DNA, 22 bp, Homo sapiens
cctgagggcccctctgcccagc

SEQ ID NO: 248594 - DNA, 20 bp, Homo sapiens
cctgaggggcatctgcccct

SEQ ID NO: 248595 - DNA, 16 bp, Homo sapiens
caatttcctttatatt

SEQ ID NO: 248596 - DNA, 20 bp, Homo sapiens
caatttcctttatatttagt

SEQ ID NO: 248597 - DNA, 22 bp, Homo sapiens
caatttctcccgaatcctgagg

SEQ ID NO: 248598 - DNA, 17 bp, Homo sapiens
caatttcttctgtagct

SEQ ID NO: 248599 - DNA, 17 bp, Homo sapiens
caatttgggtcccagct

SEQ ID NO: 248600 - DNA, 23 bp, Homo sapiens
caatttgggtcccagctaaagag

SEQ ID NO: 248601 - DNA, 16 bp, Homo sapiens
caatttgtataaaatg

SEQ ID NO: 248602 - DNA, 15 bp, Homo sapiens
caattttaaaaaata

SEQ ID NO: 248603 - DNA, 18 bp, Homo sapiens
caattttaaaaaataaca

SEQ ID NO: 248604 - DNA, 19 bp, Homo sapiens
caattttaaaaaataacat

SEQ ID NO: 248605 - DNA, 13 bp, Homo sapiens
caattttgtatcc

SEQ ID NO: 248606 - DNA, 22 bp, Homo sapiens
caatttttacacaaacctgaaa

SEQ ID NO: 248607 - DNA, 21 bp, Homo sapiens
cacaaaaagaaagctgtgaaa

SEQ ID NO: 248608 - DNA, 22 bp, Homo sapiens
cacaaaaagaaagctgtgaaat

SEQ ID NO: 248609 - DNA, 22 bp, Homo sapiens
cacaaaacaacagcaacaacaa

SEQ ID NO: 248610 - DNA, 23 bp, Homo sapiens
cacaaaacaacagcaacaacaac

SEQ ID NO: 248611 - DNA, 15 bp, Homo sapiens
cacaaaatctgtcca

SEQ ID NO: 248612 - DNA, 14 bp, Homo sapiens
cacaaacacctcct

SEQ ID NO: 248613 - DNA, 17 bp, Homo sapiens
cacaaaccctggggact

SEQ ID NO: 248614 - DNA, 21 bp, Homo sapiens
cacaaagagttctggaaaaga

SEQ ID NO: 248615 - DNA, 22 bp, Homo sapiens
cacaaagataacgcaggagaga

SEQ ID NO: 248616 - DNA, 18 bp, Homo sapiens
cacaaagcggggggaggg

SEQ ID NO: 248617 - DNA, 17 bp, Homo sapiens
cacaaatgtcctcagag

SEQ ID NO: 248618 - DNA, 21 bp, Homo sapiens
cacaaatgtgtcccagtgaac

SEQ ID NO: 248619 - DNA, 11 bp, Homo sapiens
cacaacaaaaa

SEQ ID NO: 248620 - DNA, 17 bp, Homo sapiens
cacaacaaaaatttgaa

SEQ ID NO: 248621 - DNA, 18 bp, Homo sapiens
cacaacctcctcctccag

SEQ ID NO: 248622 - DNA, 23 bp, Homo sapiens
cacaacctctctgatcttgtgct

SEQ ID NO: 248623 - DNA, 19 bp, Homo sapiens
cacaaccttctgtggctca

SEQ ID NO: 248624 - DNA, 13 bp, Homo sapiens
cacaactaacaat

SEQ ID NO: 248625 - DNA, 19 bp, Homo sapiens
cacaactatttttccaaaa

SEQ ID NO: 248626 - DNA, 14 bp, Homo sapiens
cacaactctccaaa

SEQ ID NO: 248627 - DNA, 13 bp, Homo sapiens
cacaacttaaaaa

SEQ ID NO: 248628 - DNA, 12 bp, Homo sapiens
cacaagaaattt

SEQ ID NO: 248629 - DNA, 12 bp, Homo sapiens
cacaagaagtgg

SEQ ID NO: 248630 - DNA, 17 bp, Homo sapiens
cacaagaagtgggagtg

SEQ ID NO: 248631 - DNA, 22 bp, Homo sapiens
cacaagaagtgggagtgggaga

SEQ ID NO: 248632 - DNA, 22 bp, Homo sapiens
cacaagacccctgctcctgact

SEQ ID NO: 248633 - DNA, 15 bp, Homo sapiens
cacaagagacttaaa

SEQ ID NO: 248634 - DNA, 22 bp, Homo sapiens
cacaagagggactgtatttctg

SEQ ID NO: 248635 - DNA, 12 bp, Homo sapiens
cacaagctgcct

SEQ ID NO: 248636 - DNA, 17 bp, Homo sapiens
cacaagctgcctctgac

SEQ ID NO: 248637 - DNA, 18 bp, Homo sapiens
cacaaggaataaatgaga

SEQ ID NO: 248638 - DNA, 16 bp, Homo sapiens
cacaaggctgaaaagt

SEQ ID NO: 248639 - DNA, 12 bp, Homo sapiens
cacaaggctggc

SEQ ID NO: 248640 - DNA, 15 bp, Homo sapiens
cacaaggtcaggagt

SEQ ID NO: 248641 - DNA, 15 bp, Homo sapiens
cacaaggtccactcc

SEQ ID NO: 248642 - DNA, 15 bp, Homo sapiens
cacaaggtgggcagg

SEQ ID NO: 248643 - DNA, 21 bp, Homo sapiens
cacaagtagatgcctgaactt

SEQ ID NO: 248644 - DNA, 17 bp, Homo sapiens
cacaagtagattgatct

SEQ ID NO: 248645 - DNA, 20 bp, Homo sapiens
cacaagtcctgtgaatttct

SEQ ID NO: 248646 - DNA, 17 bp, Homo sapiens
cacaagttaagattctt

SEQ ID NO: 248647 - DNA, 20 bp, Homo sapiens
cacaagttaagattcttggt

SEQ ID NO: 248648 - DNA, 17 bp, Homo sapiens
cacaatagggttcaaat

SEQ ID NO: 248649 - DNA, 12 bp, Homo sapiens
cacaatatgaat

SEQ ID NO: 248650 - DNA, 20 bp, Homo sapiens
cacaatcctaacacattatc

SEQ ID NO: 248651 - DNA, 22 bp, Homo sapiens
cacaatcctaacacattatcgg

SEQ ID NO: 248652 - DNA, 17 bp, Homo sapiens
cacaatctcacacagct

SEQ ID NO: 248653 - DNA, 22 bp, Homo sapiens
cacaatggctgggagggggccc

SEQ ID NO: 248654 - DNA, 14 bp, Homo sapiens
cacaatgtactata

SEQ ID NO: 248655 - DNA, 22 bp, Homo sapiens
cacaatgtgatatgtgtaatat

SEQ ID NO: 248656 - DNA, 13 bp, Homo sapiens
cacaattagagaa

SEQ ID NO: 248657 - DNA, 13 bp, Homo sapiens
cacaattctgtcc

SEQ ID NO: 248658 - DNA, 15 bp, Homo sapiens
cacaattctgtccct

SEQ ID NO: 248659 - DNA, 23 bp, Homo sapiens
cacaattctgtccctgtccctgc

SEQ ID NO: 248660 - DNA, 20 bp, Homo sapiens
cacacaaaaaggagcgggca

SEQ ID NO: 248661 - DNA, 23 bp, Homo sapiens
cacacaaaaaggagcgggcaggg

SEQ ID NO: 248662 - DNA, 14 bp, Homo sapiens
cacacaaaacaaca

SEQ ID NO: 248663 - DNA, 17 bp, Homo sapiens
cacacaaaacaacagca

SEQ ID NO: 248664 - DNA, 16 bp, Homo sapiens
cacacaaacacctcct

SEQ ID NO: 248665 - DNA, 20 bp, Homo sapiens
cacacaaacacctcctagca

SEQ ID NO: 248666 - DNA, 11 bp, Homo sapiens
cacacaaatgc

SEQ ID NO: 248667 - DNA, 23 bp, Homo sapiens
cacacaaatgcagacacacaaca

SEQ ID NO: 248668 - DNA, 16 bp, Homo sapiens
cacacaacaccaggac

SEQ ID NO: 248669 - DNA, 17 bp, Homo sapiens
cacacaacaccaggact

SEQ ID NO: 248670 - DNA, 10 bp, Homo sapiens
cacacacaaa

SEQ ID NO: 248671 - DNA, 12 bp, Homo sapiens
cacacacaaaac

SEQ ID NO: 248672 - DNA, 14 bp, Homo sapiens
cacacacaaaacaa

SEQ ID NO: 248673 - DNA, 14 bp, Homo sapiens
cacacacaaatgca

SEQ ID NO: 248674 - DNA, 16 bp, Homo sapiens
cacacacacacacaca

SEQ ID NO: 248675 - DNA, 14 bp, Homo sapiens
cacacacacacagc

SEQ ID NO: 248676 - DNA, 15 bp, Homo sapiens
cacacacacacagcc

SEQ ID NO: 248677 - DNA, 13 bp, Homo sapiens
cacacacacacgc

SEQ ID NO: 248678 - DNA, 13 bp, Homo sapiens
cacacacacagcc

SEQ ID NO: 248679 - DNA, 14 bp, Homo sapiens
cacacacacagcca

SEQ ID NO: 248680 - DNA, 14 bp, Homo sapiens
cacacacacagctg

SEQ ID NO: 248681 - DNA, 12 bp, Homo sapiens
cacacacacagg

SEQ ID NO: 248682 - DNA, 13 bp, Homo sapiens
cacacacacagga

SEQ ID NO: 248683 - DNA, 13 bp, Homo sapiens
cacacacacccac

SEQ ID NO: 248684 - DNA, 13 bp, Homo sapiens
cacacacagccat

SEQ ID NO: 248685 - DNA, 13 bp, Homo sapiens
cacacacagctcc

SEQ ID NO: 248686 - DNA, 22 bp, Homo sapiens
cacacacagctgggcaaagcca

SEQ ID NO: 248687 - DNA, 12 bp, Homo sapiens
cacacacagctt

SEQ ID NO: 248688 - DNA, 12 bp, Homo sapiens
cacacacaggag

SEQ ID NO: 248689 - DNA, 15 bp, Homo sapiens
cacacaccacagaag

SEQ ID NO: 248690 - DNA, 15 bp, Homo sapiens
cacacacctgcctgc

SEQ ID NO: 248691 - DNA, 15 bp, Homo sapiens
cacacacgcacgcac

SEQ ID NO: 248692 - DNA, 16 bp, Homo sapiens
cacacacgcacgcaca

SEQ ID NO: 248693 - DNA, 16 bp, Homo sapiens
cacacacgcagacaca

SEQ ID NO: 248694 - DNA, 19 bp, Homo sapiens
cacacacgcagacacacac

SEQ ID NO: 248695 - DNA, 20 bp, Homo sapiens
cacacacgcagacacacaca

SEQ ID NO: 248696 - DNA, 21 bp, Homo sapiens
cacacactcgcccgcccactg

SEQ ID NO: 248697 - DNA, 14 bp, Homo sapiens
cacacagagtggtc

SEQ ID NO: 248698 - DNA, 15 bp, Homo sapiens
cacacagagtggtct

SEQ ID NO: 248699 - DNA, 10 bp, Homo sapiens
cacacagcca

SEQ ID NO: 248700 - DNA, 15 bp, Homo sapiens
cacacagccattcat

SEQ ID NO: 248701 - DNA, 19 bp, Homo sapiens
cacacagccattcatctgg

SEQ ID NO: 248702 - DNA, 21 bp, Homo sapiens
cacacagcctggcctcccctg

SEQ ID NO: 248703 - DNA, 13 bp, Homo sapiens
cacacagcctttc

SEQ ID NO: 248704 - DNA, 15 bp, Homo sapiens
cacacagctgcagag

SEQ ID NO: 248705 - DNA, 17 bp, Homo sapiens
cacacaggagtcctttc

SEQ ID NO: 248706 - DNA, 18 bp, Homo sapiens
cacacaggagtcctttct

SEQ ID NO: 248707 - DNA, 19 bp, Homo sapiens
cacacaggagtcctttctt

SEQ ID NO: 248708 - DNA, 17 bp, Homo sapiens
cacacaggcccatgccc

SEQ ID NO: 248709 - DNA, 16 bp, Homo sapiens
cacacaggcctggccc

SEQ ID NO: 248710 - DNA, 17 bp, Homo sapiens
cacacaggcctggccca

SEQ ID NO: 248711 - DNA, 20 bp, Homo sapiens
cacacaggcctggcccagcc

SEQ ID NO: 248712 - DNA, 23 bp, Homo sapiens
cacacaggcctggcccagccagc

SEQ ID NO: 248713 - DNA, 22 bp, Homo sapiens
cacacaggggaggtgatagcat

SEQ ID NO: 248714 - DNA, 23 bp, Homo sapiens
cacacagtgggccggccccaggc

SEQ ID NO: 248715 - DNA, 12 bp, Homo sapiens
cacacatacaca

SEQ ID NO: 248716 - DNA, 17 bp, Homo sapiens
cacacatagtttctttt

SEQ ID NO: 248717 - DNA, 12 bp, Homo sapiens
cacacatttaaa

SEQ ID NO: 248718 - DNA, 21 bp, Homo sapiens
cacaccaccgccctcctcgct

SEQ ID NO: 248719 - DNA, 22 bp, Homo sapiens
cacaccacgtccttattggaat

SEQ ID NO: 248720 - DNA, 14 bp, Homo sapiens
cacaccactgccct

SEQ ID NO: 248721 - DNA, 15 bp, Homo sapiens
cacaccactgccctg

SEQ ID NO: 248722 - DNA, 16 bp, Homo sapiens
cacaccactgccctgc

SEQ ID NO: 248723 - DNA, 19 bp, Homo sapiens
cacaccagaagtgccatgc

SEQ ID NO: 248724 - DNA, 23 bp, Homo sapiens
cacaccaggccgtcctcccgggc

SEQ ID NO: 248725 - DNA, 20 bp, Homo sapiens
cacaccaggctgtgggcctc

SEQ ID NO: 248726 - DNA, 15 bp, Homo sapiens
cacacccaggaaggg

SEQ ID NO: 248727 - DNA, 16 bp, Homo sapiens
cacaccccgtctgccc

SEQ ID NO: 248728 - DNA, 17 bp, Homo sapiens
cacaccccgtctgcccc

SEQ ID NO: 248729 - DNA, 20 bp, Homo sapiens
cacaccccgtctgccccttg

SEQ ID NO: 248730 - DNA, 15 bp, Homo sapiens
cctgagggtggagac

SEQ ID NO: 248731 - DNA, 20 bp, Homo sapiens
cctgagggtttccaccttgg

SEQ ID NO: 248732 - DNA, 16 bp, Homo sapiens
cctgaggttaagggga

SEQ ID NO: 248733 - DNA, 22 bp, Homo sapiens
cctgagtaccttctacaggccc

SEQ ID NO: 248734 - DNA, 19 bp, Homo sapiens
cctgagtagctggattaca

SEQ ID NO: 248735 - DNA, 16 bp, Homo sapiens
cctgagtcagggccca

SEQ ID NO: 248736 - DNA, 17 bp, Homo sapiens
cctgagtcagggcccag

SEQ ID NO: 248737 - DNA, 21 bp, Homo sapiens
cctgagtcagggcccagaggc

SEQ ID NO: 248738 - DNA, 17 bp, Homo sapiens
cctgagtccccacctgc

SEQ ID NO: 248739 - DNA, 14 bp, Homo sapiens
cctgagtctcctgt

SEQ ID NO: 248740 - DNA, 16 bp, Homo sapiens
cctgagtctcctgtgc

SEQ ID NO: 248741 - DNA, 12 bp, Homo sapiens
cctgagtggtga

SEQ ID NO: 248742 - DNA, 23 bp, Homo sapiens
cctgagttgcaccattctttctt

SEQ ID NO: 248743 - DNA, 23 bp, Homo sapiens
cctgagttggcgttgtgggcagg

SEQ ID NO: 248744 - DNA, 22 bp, Homo sapiens
cctgataaacattaaacactgt

SEQ ID NO: 248745 - DNA, 22 bp, Homo sapiens
cctgatagctacccacagagca

SEQ ID NO: 248746 - DNA, 20 bp, Homo sapiens
cctgatagtcacctgctggt

SEQ ID NO: 248747 - DNA, 20 bp, Homo sapiens
cctgatcattacatggctgt

SEQ ID NO: 248748 - DNA, 15 bp, Homo sapiens
cctgatgccccttcc

SEQ ID NO: 248749 - DNA, 16 bp, Homo sapiens
cctgatgccccttccc

SEQ ID NO: 248750 - DNA, 17 bp, Homo sapiens
cctgatgcgtctaccca

SEQ ID NO: 248751 - DNA, 20 bp, Homo sapiens
cctgatgcgtctacccagac

SEQ ID NO: 248752 - DNA, 22 bp, Homo sapiens
cctgatgcgtctacccagactc

SEQ ID NO: 248753 - DNA, 23 bp, Homo sapiens
cctgatgcgtctacccagactca

SEQ ID NO: 248754 - DNA, 13 bp, Homo sapiens
cctgatgctccct

SEQ ID NO: 248755 - DNA, 16 bp, Homo sapiens
cctgatgctgccccgt

SEQ ID NO: 248756 - DNA, 18 bp, Homo sapiens
cctgatggagaggagaac

SEQ ID NO: 248757 - DNA, 12 bp, Homo sapiens
cctgatggccaa

SEQ ID NO: 248758 - DNA, 21 bp, Homo sapiens
cctgatggccaagggggtgga

SEQ ID NO: 248759 - DNA, 21 bp, Homo sapiens
cctgatggtacaggaaagctc

SEQ ID NO: 248760 - DNA, 18 bp, Homo sapiens
cctgatggtcagctccct

SEQ ID NO: 248761 - DNA, 22 bp, Homo sapiens
cctgatggtcagctcccttctc

SEQ ID NO: 248762 - DNA, 17 bp, Homo sapiens
cctgatgttaaaattcc

SEQ ID NO: 248763 - DNA, 18 bp, Homo sapiens
cctgattattgaatgtta

SEQ ID NO: 248764 - DNA, 14 bp, Homo sapiens
cctgattggggcct

SEQ ID NO: 248765 - DNA, 20 bp, Homo sapiens
cctgattgtgtatattcata

SEQ ID NO: 248766 - DNA, 14 bp, Homo sapiens
cctgcaaaatttta

SEQ ID NO: 248767 - DNA, 16 bp, Homo sapiens
cctgcaaactcactgc

SEQ ID NO: 248768 - DNA, 22 bp, Homo sapiens
cctgcaaactcactgctcaaga

SEQ ID NO: 248769 - DNA, 18 bp, Homo sapiens
cctgcaactcaaggactt

SEQ ID NO: 248770 - DNA, 15 bp, Homo sapiens
cctgcaagagtgggc

SEQ ID NO: 248771 - DNA, 15 bp, Homo sapiens
cctgcaagccccagg

SEQ ID NO: 248772 - DNA, 13 bp, Homo sapiens
cctgcaaggccca

SEQ ID NO: 248773 - DNA, 14 bp, Homo sapiens
cctgcaaggcccac

SEQ ID NO: 248774 - DNA, 15 bp, Homo sapiens
cctgcaaggcccaca

SEQ ID NO: 248775 - DNA, 18 bp, Homo sapiens
cctgcaatctccagggct

SEQ ID NO: 248776 - DNA, 20 bp, Homo sapiens
cctgcaatctccagggctgc

SEQ ID NO: 248777 - DNA, 19 bp, Homo sapiens
cctgcaatttcatatgctg

SEQ ID NO: 248778 - DNA, 14 bp, Homo sapiens
cctgcacacacctg

SEQ ID NO: 248779 - DNA, 22 bp, Homo sapiens
cctgcaccagcccttccctgct

SEQ ID NO: 248780 - DNA, 14 bp, Homo sapiens
cctgcaccaggaga

SEQ ID NO: 248781 - DNA, 15 bp, Homo sapiens
cctgcacccacccct

SEQ ID NO: 248782 - DNA, 19 bp, Homo sapiens
cctgcacccacccctgccc

SEQ ID NO: 248783 - DNA, 21 bp, Homo sapiens
cctgcacccacccctgcccag

SEQ ID NO: 248784 - DNA, 21 bp, Homo sapiens
cctgcaccccagcattccagc

SEQ ID NO: 248785 - DNA, 22 bp, Homo sapiens
cctgcaccccagcattccagct

SEQ ID NO: 248786 - DNA, 12 bp, Homo sapiens
cctgcaccctct

SEQ ID NO: 248787 - DNA, 13 bp, Homo sapiens
cctgcaccctgga

SEQ ID NO: 248788 - DNA, 15 bp, Homo sapiens
cctgcaccctggaaa

SEQ ID NO: 248789 - DNA, 12 bp, Homo sapiens
cctgcactgtaa

SEQ ID NO: 248790 - DNA, 14 bp, Homo sapiens
cctgcagagctggg

SEQ ID NO: 248791 - DNA, 12 bp, Homo sapiens
cctgcagaggcc

SEQ ID NO: 248792 - DNA, 18 bp, Homo sapiens
cctgcagcctcctcctga

SEQ ID NO: 248793 - DNA, 19 bp, Homo sapiens
cctgcagcctcctcctgac

SEQ ID NO: 248794 - DNA, 12 bp, Homo sapiens
cctgcagcctgg

SEQ ID NO: 248795 - DNA, 16 bp, Homo sapiens
cctgcagcctggaggc

SEQ ID NO: 248796 - DNA, 16 bp, Homo sapiens
cctgcaggaacgagca

SEQ ID NO: 248797 - DNA, 17 bp, Homo sapiens
cctgcaggaacgagcac

SEQ ID NO: 248798 - DNA, 22 bp, Homo sapiens
cctgcaggaacgagcactggcc

SEQ ID NO: 248799 - DNA, 21 bp, Homo sapiens
cctgcaggaggcctgggaggg

SEQ ID NO: 248800 - DNA, 23 bp, Homo sapiens
cctgcaggaggcctgggagggca

SEQ ID NO: 248801 - DNA, 12 bp, Homo sapiens
cctgcaggcccc

SEQ ID NO: 248802 - DNA, 20 bp, Homo sapiens
cctgcaggccccagccaagt

SEQ ID NO: 248803 - DNA, 20 bp, Homo sapiens
cctgcaggctggctgttggc

SEQ ID NO: 248804 - DNA, 16 bp, Homo sapiens
cctgcagggtaggggg

SEQ ID NO: 248805 - DNA, 19 bp, Homo sapiens
cctgcagggtggtgctggg

SEQ ID NO: 248806 - DNA, 20 bp, Homo sapiens
cctgcagggtggtgctggga

SEQ ID NO: 248807 - DNA, 23 bp, Homo sapiens
cctgcagggtggtgctgggactg

SEQ ID NO: 248808 - DNA, 21 bp, Homo sapiens
cctgcagtgttcgcttggctc

SEQ ID NO: 248809 - DNA, 15 bp, Homo sapiens
cctgcagttcctgag

SEQ ID NO: 248810 - DNA, 21 bp, Homo sapiens
cctgcatatctctagtccctg

SEQ ID NO: 248811 - DNA, 13 bp, Homo sapiens
cctgcatattgtg

SEQ ID NO: 248812 - DNA, 18 bp, Homo sapiens
cctgcatcagcctctggc

SEQ ID NO: 248813 - DNA, 16 bp, Homo sapiens
cctgcatccctccacc

SEQ ID NO: 248814 - DNA, 18 bp, Homo sapiens
cctgcatcccttggcccc
